United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 5

SEQ ID NO: 156539 - RNA, 22 nt, Human
cagggcuugaaucaaggaaguc

SEQ ID NO: 156540 - RNA, 22 nt, Human
cagcucugcugggaggaugcag

SEQ ID NO: 156541 - RNA, 22 nt, Human
caggaagucugaauucugagag

SEQ ID NO: 156542 - RNA, 22 nt, Human
caggacacaaaagguggagaag

SEQ ID NO: 156543 - RNA, 22 nt, Human
cagcuauuguucuguauaauga

SEQ ID NO: 156544 - RNA, 22 nt, Human
caggcagggagcuggaaaggau

SEQ ID NO: 156545 - RNA, 22 nt, Human
caggcaggagaaaaggcgcggg

SEQ ID NO: 156546 - RNA, 22 nt, Human
caggcacagcuaagacuggcca

SEQ ID NO: 156547 - RNA, 22 nt, Human
cagcuugcccugauguggaaga

SEQ ID NO: 156548 - RNA, 22 nt, Human
cagcccaggcucagauguuggg

SEQ ID NO: 156549 - RNA, 22 nt, Human
cagcuuaccucccacagcucuc

SEQ ID NO: 156550 - RNA, 22 nt, Human
cagccagaucgccuuccgccuc

SEQ ID NO: 156551 - RNA, 22 nt, Human
cagcccuguugcgcuuccggcg

SEQ ID NO: 156552 - RNA, 22 nt, Human
caggaagagaacugcucagccu

SEQ ID NO: 156553 - RNA, 22 nt, Human
cagcacugcccuaccccuccac

SEQ ID NO: 156554 - RNA, 22 nt, Human
cagcagccuccccggccgaccu

SEQ ID NO: 156555 - RNA, 22 nt, Human
cagcuguauuucucugguuaga

SEQ ID NO: 156556 - RNA, 22 nt, Human
cagauuuagcacugauaggacu

SEQ ID NO: 156557 - RNA, 22 nt, Human
cagaaaacauuguguguauaag

SEQ ID NO: 156558 - RNA, 22 nt, Human
cagaccagaaggaagccgacaa

SEQ ID NO: 156559 - RNA, 22 nt, Human
cagacagaaggcuccuugaggu

SEQ ID NO: 156560 - RNA, 22 nt, Human
cagacugagaaagugccacagg

SEQ ID NO: 156561 - RNA, 22 nt, Human
cagauacaacagcaggaaugaa

SEQ ID NO: 156562 - RNA, 22 nt, Human
cacuuuuucccccuggugucau

SEQ ID NO: 156563 - RNA, 22 nt, Human
cagaaaaaaaugcagacuagca

SEQ ID NO: 156564 - RNA, 19 nt, Human
cagcaaacacuguaaaugg

SEQ ID NO: 156565 - RNA, 22 nt, Human
cacaauuuccauugagcagcag

SEQ ID NO: 156566 - RNA, 22 nt, Human
cagagcugucauuugccaguga

SEQ ID NO: 156567 - RNA, 22 nt, Human
cacucaaacugaaauccuuuuu

SEQ ID NO: 156568 - RNA, 22 nt, Human
caguaaccaguaguuuuggaaa

SEQ ID NO: 156569 - RNA, 22 nt, Human
caggcagagagggcagugugga

SEQ ID NO: 156570 - RNA, 22 nt, Human
caggcagggcugccuucugcuu

SEQ ID NO: 156571 - RNA, 22 nt, Human
caguuuuggaagaaacaaggaa

SEQ ID NO: 156572 - RNA, 22 nt, Human
cagggcuuuuuccuccucuuug

SEQ ID NO: 156573 - RNA, 22 nt, Human
cagggcagaguuaagaugcugg

SEQ ID NO: 156574 - RNA, 20 nt, Human
caggccuucaggauggcugg

SEQ ID NO: 156575 - RNA, 22 nt, Human
caggccgccacugcagcagcug

SEQ ID NO: 156576 - RNA, 22 nt, Human
cauccagcuccugggggccacc

SEQ ID NO: 156577 - RNA, 22 nt, Human
cagguuguugacugcauauagg

SEQ ID NO: 156578 - RNA, 23 nt, Human
cauauucagaaacaccuaguggu

SEQ ID NO: 156579 - RNA, 22 nt, Human
caguacugucuuccugauggca

SEQ ID NO: 156580 - RNA, 22 nt, Human
cauaauuggugcuuauuaaaug

SEQ ID NO: 156581 - RNA, 22 nt, Human
cauggcaggugcagauucugug

SEQ ID NO: 156582 - RNA, 22 nt, Human
cauagacauugauagguuauau

SEQ ID NO: 156583 - RNA, 19 nt, Human
cauggcgguaaagaggcug

SEQ ID NO: 156584 - RNA, 22 nt, Human
caugcuaacacguugcucaccg

SEQ ID NO: 156585 - RNA, 22 nt, Human
cagugcuggaggggugcuugca

SEQ ID NO: 156586 - RNA, 22 nt, Human
caucuuuguuuuggauauaauc

SEQ ID NO: 156587 - RNA, 22 nt, Human
cagucaaauuugaaaacuuuga

SEQ ID NO: 156588 - RNA, 22 nt, Human
cagucucuggugaguugacagu

SEQ ID NO: 156589 - RNA, 22 nt, Human
auuucauaaaaacuuuaccuga

SEQ ID NO: 156590 - RNA, 22 nt, Human
auuucauccauuaagaguacuc

SEQ ID NO: 156591 - RNA, 19 nt, Human
auuuccuggcauauaucac

SEQ ID NO: 156592 - RNA, 22 nt, Human
auuguuuugugaaacauaguga

SEQ ID NO: 156593 - RNA, 17 nt, Human
auuguuuuuaauuugca

SEQ ID NO: 156594 - RNA, 22 nt, Human
auuucagaaugaaaggaaaaau

SEQ ID NO: 156595 - RNA, 22 nt, Human
auuucacucuuaauugcuuccu

SEQ ID NO: 156596 - RNA, 22 nt, Human
auuuggaaacaugcugaccaug

SEQ ID NO: 156597 - RNA, 22 nt, Human
auuuccugugaacuuuucugau

SEQ ID NO: 156598 - RNA, 22 nt, Human
auuuggaaggcguuucucugua

SEQ ID NO: 156599 - RNA, 22 nt, Human
auuuauuugaagagccauugca

SEQ ID NO: 156600 - RNA, 22 nt, Human
auuucaacagaguuugaaggca

SEQ ID NO: 156601 - RNA, 22 nt, Human
auuuauuuucccucaaguaccu

SEQ ID NO: 156602 - RNA, 22 nt, Human
auuagaagagcuuuuuacucuu

SEQ ID NO: 156603 - RNA, 22 nt, Human
auuaauaucaauauauuauaug

SEQ ID NO: 156604 - RNA, 22 nt, Human
auuagguaguauaaucuuuguu

SEQ ID NO: 156605 - RNA, 21 nt, Human
auuauagugacuaaauugaua

SEQ ID NO: 156606 - RNA, 22 nt, Human
auuguuacuggguuaauuugga

SEQ ID NO: 156607 - RNA, 22 nt, Human
auugaaauuugcuuccucacug

SEQ ID NO: 156608 - RNA, 22 nt, Human
auuuaaaaacugguacaacagg

SEQ ID NO: 156609 - RNA, 22 nt, Human
auuuaaagaguaauacaaucca

SEQ ID NO: 156610 - RNA, 22 nt, Human
auuuauccuugggguagagcca

SEQ ID NO: 156611 - RNA, 22 nt, Human
auuuauauauuuuguucuggua

SEQ ID NO: 156612 - RNA, 22 nt, Human
auuuuugguuauaaaauaguuu

SEQ ID NO: 156613 - RNA, 18 nt, Human
auuuguggggguuauaga

SEQ ID NO: 156614 - RNA, 22 nt, Human
auuucagaguagaucguuauuu

SEQ ID NO: 156615 - RNA, 22 nt, Human
auuuuaccauuaguuuguaaua

SEQ ID NO: 156616 - RNA, 22 nt, Human
auuugaaaaucuaugaugugca

SEQ ID NO: 156617 - RNA, 22 nt, Human
auuuccacaaauuaagauugca

SEQ ID NO: 156618 - RNA, 22 nt, Human
auuuaagacuguggugcaguuu

SEQ ID NO: 156619 - RNA, 23 nt, Human
auuugcugaucguagaugacuag

SEQ ID NO: 156620 - RNA, 22 nt, Human
auuuccagcagcauauuugucu

SEQ ID NO: 156621 - RNA, 22 nt, Human
auuuuuaucuaaaauccacuuu

SEQ ID NO: 156622 - RNA, 22 nt, Human
auuugcaucagugagcgaugug

SEQ ID NO: 156623 - RNA, 22 nt, Human
auuugcauguuuauuucuuaga

SEQ ID NO: 156624 - RNA, 22 nt, Human
auuugaaguauaaguaauugcu

SEQ ID NO: 156625 - RNA, 22 nt, Human
caaagaaccuucgagacagggc

SEQ ID NO: 156626 - RNA, 22 nt, Human
caaagccuggggagaguaagga

SEQ ID NO: 156627 - RNA, 22 nt, Human
caaaaauacuugccuguaucug

SEQ ID NO: 156628 - RNA, 22 nt, Human
caaaaaauccauagaaagaggu

SEQ ID NO: 156629 - RNA, 22 nt, Human
caaaacccaagugcuauugcaa

SEQ ID NO: 156630 - RNA, 20 nt, Human
caacacugcccauuguuugc

SEQ ID NO: 156631 - RNA, 22 nt, Human
caaccaguagcugaguucaaaa

SEQ ID NO: 156632 - RNA, 22 nt, Human
auuuuuuuaggcugucagccgc

SEQ ID NO: 156633 - RNA, 22 nt, Human
caacaagcgcucagagcaaagc

SEQ ID NO: 156634 - RNA, 22 nt, Human
auuuuucucucaugugcaacua

SEQ ID NO: 156635 - RNA, 22 nt, Human
auuuuucuuucacauuuucuua

SEQ ID NO: 156636 - RNA, 23 nt, Human
auuuuuccacacacagacucagu

SEQ ID NO: 156637 - RNA, 22 nt, Human
auuuuuauuugccuaugauaua

SEQ ID NO: 156638 - RNA, 22 nt, Human
caacauuucaaggucuuuagga

SEQ ID NO: 156639 - RNA, 22 nt, Human
caacacaucaguucagucuuga

SEQ ID NO: 156640 - RNA, 22 nt, Human
caaaguauuuagcugacucgcu

SEQ ID NO: 156641 - RNA, 22 nt, Human
caaauacaaauacgggcagcuu

SEQ ID NO: 156642 - RNA, 22 nt, Human
caaaucagaucagagacaggcu

SEQ ID NO: 156643 - RNA, 22 nt, Human
caaaugcaguggucgugcugga

SEQ ID NO: 156644 - RNA, 22 nt, Human
caaaugaugcauggcuagugag

SEQ ID NO: 156645 - RNA, 22 nt, Human
caaauguuugguggcauuuugu

SEQ ID NO: 156646 - RNA, 22 nt, Human
caagguugugacccaaugacca

SEQ ID NO: 156647 - RNA, 22 nt, Human
caagguuucgaguucccaacca

SEQ ID NO: 156648 - RNA, 22 nt, Human
caaaacauucagagagcucacu

SEQ ID NO: 156649 - RNA, 22 nt, Human
caagaaaaaacaugaugagugu

SEQ ID NO: 156650 - RNA, 22 nt, Human
caaggaaaugucagaaaggcaa

SEQ ID NO: 156651 - RNA, 22 nt, Human
caagaugcaagaccagucaggc

SEQ ID NO: 156652 - RNA, 22 nt, Human
caaagaagagauuuacagagcu

SEQ ID NO: 156653 - RNA, 22 nt, Human
caaagagaugcaccauauuucu

SEQ ID NO: 156654 - RNA, 22 nt, Human
cacccgacugaggacgccgccc

SEQ ID NO: 156655 - RNA, 22 nt, Human
caagugaguauguauuguguag

SEQ ID NO: 156656 - RNA, 22 nt, Human
caauaccucuuggugauugggc

SEQ ID NO: 156657 - RNA, 22 nt, Human
caauaguaaucaaugcaguuag

SEQ ID NO: 156658 - RNA, 22 nt, Human
caccagcgacugugaccagcaa

SEQ ID NO: 156659 - RNA, 22 nt, Human
cacauugguagaauuuagaaga

SEQ ID NO: 156660 - RNA, 22 nt, Human
cacauuucagcacucagggcau

SEQ ID NO: 156661 - RNA, 22 nt, Human
caaggaaaacagaugaucaaca

SEQ ID NO: 156662 - RNA, 22 nt, Human
cacauuaagcccaagcauagaa

SEQ ID NO: 156663 - RNA, 22 nt, Human
cacagaauuaagggagaaauau

SEQ ID NO: 156664 - RNA, 22 nt, Human
cacacagcuagugacaggagaa

SEQ ID NO: 156665 - RNA, 22 nt, Human
caagaaccuagcgaucagguaa

SEQ ID NO: 156666 - RNA, 20 nt, Human
cacagcugacgaguauccaa

SEQ ID NO: 156667 - RNA, 22 nt, Human
caagagcgugugcagggcaagu

SEQ ID NO: 156668 - RNA, 22 nt, Human
caagagcucccagaccugggca

SEQ ID NO: 156669 - RNA, 21 nt, Human
augcgcgguggagugagcgaa

SEQ ID NO: 156670 - RNA, 22 nt, Human
augcacuacuagaugcaaaagu

SEQ ID NO: 156671 - RNA, 22 nt, Human
augauggagaacaaagaaaauc

SEQ ID NO: 156672 - RNA, 22 nt, Human
augaucaagaauuuuguauucc

SEQ ID NO: 156673 - RNA, 22 nt, Human
augccgggguggcuccagcacc

SEQ ID NO: 156674 - RNA, 22 nt, Human
augccugcugucaggaacucuu

SEQ ID NO: 156675 - RNA, 22 nt, Human
augcucggcuuucuuucuuucu

SEQ ID NO: 156676 - RNA, 22 nt, Human
augcugacaacaaagaaggaag

SEQ ID NO: 156677 - RNA, 22 nt, Human
augcuugaaaguuauuucauuu

SEQ ID NO: 156678 - RNA, 22 nt, Human
augcugcuuguccauuuauuug

SEQ ID NO: 156679 - RNA, 18 nt, Human
augcugacacaaugugga

SEQ ID NO: 156680 - RNA, 22 nt, Human
augcaggcuaagaguaaagacg

SEQ ID NO: 156681 - RNA, 22 nt, Human
augcugcuccuuuucaggcauu

SEQ ID NO: 156682 - RNA, 22 nt, Human
augcuugcccauguuucugaag

SEQ ID NO: 156683 - RNA, 22 nt, Human
augccucuugagagccagugcu

SEQ ID NO: 156684 - RNA, 22 nt, Human
augcggcugugggggaauggga

SEQ ID NO: 156685 - RNA, 20 nt, Human
augaaugcuccccacguuuc

SEQ ID NO: 156686 - RNA, 22 nt, Human
augaugauuauucauuuucugu

SEQ ID NO: 156687 - RNA, 22 nt, Human
augauguuggaauuuuaacuua

SEQ ID NO: 156688 - RNA, 22 nt, Human
augauuaagguacgucauuucu

SEQ ID NO: 156689 - RNA, 22 nt, Human
augcagaaucucuuuccugagg

SEQ ID NO: 156690 - RNA, 22 nt, Human
augaccauccagaaguccagcu

SEQ ID NO: 156691 - RNA, 22 nt, Human
augauuauuugaaugaagagga

SEQ ID NO: 156692 - RNA, 22 nt, Human
aucuucaggggcaauggagaua

SEQ ID NO: 156693 - RNA, 22 nt, Human
aucuucucucucaucaggauca

SEQ ID NO: 156694 - RNA, 22 nt, Human
augagcuaagcagaaagcacac

SEQ ID NO: 156695 - RNA, 22 nt, Human
aucucaaagauaugcugguaaa

SEQ ID NO: 156696 - RNA, 22 nt, Human
augaaacucuagcuuucagcac

SEQ ID NO: 156697 - RNA, 22 nt, Human
aucugcuguaguuggugccagu

SEQ ID NO: 156698 - RNA, 22 nt, Human
augaaaacgugugugugugugu

SEQ ID NO: 156699 - RNA, 22 nt, Human
augaaacuggagcgccuggagg

SEQ ID NO: 156700 - RNA, 23 nt, Human
augaaaugauacuuuauucacug

SEQ ID NO: 156701 - RNA, 22 nt, Human
auguuccaugacuaugcaugaa

SEQ ID NO: 156702 - RNA, 22 nt, Human
auguuuaauuugaaauuuuauu

SEQ ID NO: 156703 - RNA, 22 nt, Human
auuacagaagauaugcucaaca

SEQ ID NO: 156704 - RNA, 22 nt, Human
auuauaauucauuaggcuuagu

SEQ ID NO: 156705 - RNA, 22 nt, Human
auguuuuauacacauguaucac

SEQ ID NO: 156706 - RNA, 22 nt, Human
auguuuuaaaaaacaggcuacc

SEQ ID NO: 156707 - RNA, 22 nt, Human
auuaaaaaaagauaaugaguua

SEQ ID NO: 156708 - RNA, 23 nt, Human
auuaugaagaagacucgccuguu

SEQ ID NO: 156709 - RNA, 22 nt, Human
auucaggacucuuccuugaaga

SEQ ID NO: 156710 - RNA, 22 nt, Human
auucauuuuuacaucaccaaua

SEQ ID NO: 156711 - RNA, 22 nt, Human
auucaucuguacuucaauaucu

SEQ ID NO: 156712 - RNA, 22 nt, Human
auuccaccccauccucccaggu

SEQ ID NO: 156713 - RNA, 23 nt, Human
auuauuucaggguuuugacuugc

SEQ ID NO: 156714 - RNA, 22 nt, Human
auuauggacuuucuuguuuggg

SEQ ID NO: 156715 - RNA, 22 nt, Human
auuauuugcuuaagcuggucuc

SEQ ID NO: 156716 - RNA, 20 nt, Human
auuauuucuucugcccaaag

SEQ ID NO: 156717 - RNA, 22 nt, Human
auuaaauagcagaagaaagaug

SEQ ID NO: 156718 - RNA, 21 nt, Human
auucaaagaagaggaaggccc

SEQ ID NO: 156719 - RNA, 22 nt, Human
auuaaacuaaauuaugaauugg

SEQ ID NO: 156720 - RNA, 22 nt, Human
auguauuuauguauguguuaua

SEQ ID NO: 156721 - RNA, 22 nt, Human
augguuuugugaaaaugcuuug

SEQ ID NO: 156722 - RNA, 22 nt, Human
augguuuuguccucuuugguuc

SEQ ID NO: 156723 - RNA, 22 nt, Human
augugaaauuugggcucuggga

SEQ ID NO: 156724 - RNA, 22 nt, Human
auguguuuugaccccugcuaaa

SEQ ID NO: 156725 - RNA, 22 nt, Human
augcuuucucuucuauuucuca

SEQ ID NO: 156726 - RNA, 22 nt, Human
auggccguggccagggucaggg

SEQ ID NO: 156727 - RNA, 22 nt, Human
auggcuucugucuuggaaauuu

SEQ ID NO: 156728 - RNA, 20 nt, Human
auggcgagucagcacaaaac

SEQ ID NO: 156729 - RNA, 22 nt, Human
augguuagauggaugagaugug

SEQ ID NO: 156730 - RNA, 22 nt, Human
auguacugacuguacuuuuaaa

SEQ ID NO: 156731 - RNA, 22 nt, Human
auguauauauacauguauugua

SEQ ID NO: 156732 - RNA, 22 nt, Human
auguaugagagauucuuuuauu

SEQ ID NO: 156733 - RNA, 22 nt, Human
auguaaauauuuauauaugcau

SEQ ID NO: 156734 - RNA, 22 nt, Human
augguugggggaugucagcagg

SEQ ID NO: 156735 - RNA, 22 nt, Human
auauuuuugcagaauuuuucgu

SEQ ID NO: 156736 - RNA, 22 nt, Human
aucaagacaaaggaaaggcuaa

SEQ ID NO: 156737 - RNA, 22 nt, Human
aucaaacuaugguccaugggca

SEQ ID NO: 156738 - RNA, 22 nt, Human
auauguuaugccauuuucaagg

SEQ ID NO: 156739 - RNA, 22 nt, Human
auauucaaugaggucauauaag

SEQ ID NO: 156740 - RNA, 22 nt, Human
auauuguagcaucacugucuug

SEQ ID NO: 156741 - RNA, 22 nt, Human
auauugcuuuauucuugaauau

SEQ ID NO: 156742 - RNA, 22 nt, Human
aucaaaauguguagucuugauc

SEQ ID NO: 156743 - RNA, 21 nt, Human
aucagaaucucuagauuugga

SEQ ID NO: 156744 - RNA, 22 nt, Human
aucacaaauggaaucaccuccc

SEQ ID NO: 156745 - RNA, 22 nt, Human
aucagaagaaauggaugugacu

SEQ ID NO: 156746 - RNA, 22 nt, Human
auauuuuacagcucucguugaa

SEQ ID NO: 156747 - RNA, 22 nt, Human
auauuuguuagcugcuuuggag

SEQ ID NO: 156748 - RNA, 22 nt, Human
auauuuguuuggcagaguucag

SEQ ID NO: 156749 - RNA, 22 nt, Human
auauuugucuguuuuaguggca

SEQ ID NO: 156750 - RNA, 22 nt, Human
aucaugcgguuaaggagugugu

SEQ ID NO: 156751 - RNA, 22 nt, Human
aucauguauaugcagcguuugu

SEQ ID NO: 156752 - RNA, 22 nt, Human
aucaaaauuuucagauacuaca

SEQ ID NO: 156753 - RNA, 22 nt, Human
aucagagcuaguacuugcaggu

SEQ ID NO: 156754 - RNA, 22 nt, Human
aucauccuagaaggaagcuagg

SEQ ID NO: 156755 - RNA, 22 nt, Human
auccacccugcaggccaacucu

SEQ ID NO: 156756 - RNA, 18 nt, Human
auccuuugaucaucuguc

SEQ ID NO: 156757 - RNA, 22 nt, Human
auccuucaaaaggaauagcagg

SEQ ID NO: 156758 - RNA, 22 nt, Human
auccugauggaaacugguauga

SEQ ID NO: 156759 - RNA, 22 nt, Human
auccucaaggaauuaaauaggg

SEQ ID NO: 156760 - RNA, 22 nt, Human
auccuagacuccuaugccccaa

SEQ ID NO: 156761 - RNA, 22 nt, Human
aucuaaaacuacgaauacuacc

SEQ ID NO: 156762 - RNA, 22 nt, Human
auccacuagagggugaacucug

SEQ ID NO: 156763 - RNA, 22 nt, Human
aucauugcuaguaaggaucuug

SEQ ID NO: 156764 - RNA, 22 nt, Human
aucauugaaaauuuaugcauuu

SEQ ID NO: 156765 - RNA, 22 nt, Human
aucccacaccccuacaacauau

SEQ ID NO: 156766 - RNA, 23 nt, Human
aucauuucuuagugagucccugc

SEQ ID NO: 156767 - RNA, 22 nt, Human
auauaggcugaaaaauagaauu

SEQ ID NO: 156768 - RNA, 22 nt, Human
auaucuaggcugaauguaaaau

SEQ ID NO: 156769 - RNA, 22 nt, Human
auauguuuuaguagaaucccaa

SEQ ID NO: 156770 - RNA, 22 nt, Human
auauuauuaaaauagauggaua

SEQ ID NO: 156771 - RNA, 22 nt, Human
auauuuguacagcuugugaguu

SEQ ID NO: 156772 - RNA, 22 nt, Human
auauuucuacaggcugauuuua

SEQ ID NO: 156773 - RNA, 22 nt, Human
auaugcacauguacauguauau

SEQ ID NO: 156774 - RNA, 21 nt, Human
auauuguugggguuuucuuuu

SEQ ID NO: 156775 - RNA, 22 nt, Human
auauaguuggguuucauucuac

SEQ ID NO: 156776 - RNA, 22 nt, Human
auauaguacauguauauauaua

SEQ ID NO: 156777 - RNA, 22 nt, Human
auagauguauucauuguuuggc

SEQ ID NO: 156778 - RNA, 22 nt, Human
auaucuuguuuuugauuucuug

SEQ ID NO: 156779 - RNA, 22 nt, Human
auacuuccugcuucccugaucu

SEQ ID NO: 156780 - RNA, 22 nt, Human
auagaaauagacaaugcaaaga

SEQ ID NO: 156781 - RNA, 22 nt, Human
auaggggagcagccagagaaga

SEQ ID NO: 156782 - RNA, 22 nt, Human
auaguaaauguuaacagcaaca

SEQ ID NO: 156783 - RNA, 22 nt, Human
auauaagucacauuaaggaggu

SEQ ID NO: 156784 - RNA, 22 nt, Human
auauaaugcaguaggugauuaa

SEQ ID NO: 156785 - RNA, 22 nt, Human
auaguuuuagauacugagaaaa

SEQ ID NO: 156786 - RNA, 22 nt, Human
auaguuaucuguggauaagguu

SEQ ID NO: 156787 - RNA, 22 nt, Human
auagaauggcaccagcaucuac

SEQ ID NO: 156788 - RNA, 22 nt, Human
auaggcggagccauaucaucca

SEQ ID NO: 156789 - RNA, 22 nt, Human
auagacuuccuguccuagacuu

SEQ ID NO: 156790 - RNA, 22 nt, Human
auacaggcaguaagauucucag

SEQ ID NO: 156791 - RNA, 22 nt, Human
auagaagugaaaagggaugacu

SEQ ID NO: 156792 - RNA, 18 nt, Human
auagacaggaaaaaugga

SEQ ID NO: 156793 - RNA, 22 nt, Human
uuuuuuuguagguguaugaaaa

SEQ ID NO: 156794 - RNA, 22 nt, Human
uuuuuugguuuggggauuauuu

SEQ ID NO: 156795 - RNA, 22 nt, Human
uuuuuugucuugaagaaauggu

SEQ ID NO: 156796 - RNA, 22 nt, Human
uuuuuuguggcuggaagaaaaa

SEQ ID NO: 156797 - RNA, 22 nt, Human
uuuuuuguuccuugguuuuugu

SEQ ID NO: 156798 - RNA, 22 nt, Human
uuuuuuuaaguuuugauuuuag

SEQ ID NO: 156799 - RNA, 18 nt, Human
uuuuuuguucuguuuugu

SEQ ID NO: 156800 - RNA, 22 nt, Human
uuuuuguggggggcggugugaa

SEQ ID NO: 156801 - RNA, 22 nt, Human
uuuuuuaaucaaguaggaaaca

SEQ ID NO: 156802 - RNA, 22 nt, Human
uuuuuuccuguuugucuuuggg

SEQ ID NO: 156803 - RNA, 22 nt, Human
uuuuuuccugguuacagauugu

SEQ ID NO: 156804 - RNA, 22 nt, Human
uuuuuucuucucuaucuuaaua

SEQ ID NO: 156805 - RNA, 22 nt, Human
uuuuuggacccaucuucuuuuu

SEQ ID NO: 156806 - RNA, 21 nt, Human
uuuuuggagggguggggagga

SEQ ID NO: 156807 - RNA, 22 nt, Human
uuuuugggaagaauucugauau

SEQ ID NO: 156808 - RNA, 21 nt, Human
uuuuucuccagaguuuccacu

SEQ ID NO: 156809 - RNA, 22 nt, Human
uuuuucugacugcuaacaaaaa

SEQ ID NO: 156810 - RNA, 22 nt, Human
uuuuucuccucucucuuucauu

SEQ ID NO: 156811 - RNA, 22 nt, Human
uuuuguuacugauuauuaaaau

SEQ ID NO: 156812 - RNA, 22 nt, Human
uuuuuaaaauuaggacggcacg

SEQ ID NO: 156813 - RNA, 22 nt, Human
uuuuuaccugguguccagcuuc

SEQ ID NO: 156814 - RNA, 22 nt, Human
uuuuuauguaaaauauuaaaag

SEQ ID NO: 156815 - RNA, 22 nt, Human
uuuuucagacuaauagggcaua

SEQ ID NO: 156816 - RNA, 22 nt, Human
uuuuggauugcuaacucagggu

SEQ ID NO: 156817 - RNA, 22 nt, Human
uuuuggagaaaugggacuuaau

SEQ ID NO: 156818 - RNA, 22 nt, Human
uuuugguaguccagaguuuagu

SEQ ID NO: 156819 - RNA, 22 nt, Human
uuuugguuugaguauuuuuuuu

SEQ ID NO: 156820 - RNA, 22 nt, Human
uuuuguggacugugagggugca

SEQ ID NO: 156821 - RNA, 22 nt, Human
uuuuguggacugauccgaggac

SEQ ID NO: 156822 - RNA, 22 nt, Human
uuuugucuguggaaagcugcua

SEQ ID NO: 156823 - RNA, 22 nt, Human
uuuuguagauagggaaacagag

SEQ ID NO: 156824 - RNA, 22 nt, Human
uuuucucaguuuuuuucaaaag

SEQ ID NO: 156825 - RNA, 22 nt, Human
uuuucggagaauguuaaugugu

SEQ ID NO: 156826 - RNA, 22 nt, Human
uuuuccaaaaguggagaggaau

SEQ ID NO: 156827 - RNA, 23 nt, Human
uuuuccaaaucgacucucuaguu

SEQ ID NO: 156828 - RNA, 22 nt, Human
uuuucauuguuaguuucuccuu

SEQ ID NO: 156829 - RNA, 22 nt, Human
uuuuccgaccuuaggaaggaac

SEQ ID NO: 156830 - RNA, 22 nt, Human
uuuugccuauuguaucaucgua

SEQ ID NO: 156831 - RNA, 22 nt, Human
uuuugcuagaaaucaccaauac

SEQ ID NO: 156832 - RNA, 22 nt, Human
uuuugcaaauuacuaaauuucu

SEQ ID NO: 156833 - RNA, 22 nt, Human
uuuucuuggaguggcuguccuu

SEQ ID NO: 156834 - RNA, 22 nt, Human
uuuugaauaauucagaaacagc

SEQ ID NO: 156835 - RNA, 22 nt, Human
uuuugauacaaguuguaaaaaa

SEQ ID NO: 156836 - RNA, 22 nt, Human
uuuugagucuggcaguuuuguu

SEQ ID NO: 156837 - RNA, 22 nt, Human
uuuucuucggugcuggguugau

SEQ ID NO: 156838 - RNA, 22 nt, Human
uuuucuugagucacuccaguga

SEQ ID NO: 156839 - RNA, 22 nt, Human
uuuucucucacuucacauauuu

SEQ ID NO: 156840 - RNA, 22 nt, Human
uuuuagaagcauuuaugagauu

SEQ ID NO: 156841 - RNA, 22 nt, Human
uuuuaggauuugaguugcugga

SEQ ID NO: 156842 - RNA, 22 nt, Human
uuuuauaauacccuugacuaau

SEQ ID NO: 156843 - RNA, 22 nt, Human
uuuucaauuuucauuugcaaga

SEQ ID NO: 156844 - RNA, 22 nt, Human
uuuucaguuccaucucugcucu

SEQ ID NO: 156845 - RNA, 22 nt, Human
uuuuauuuguauguugaaugua

SEQ ID NO: 156846 - RNA, 22 nt, Human
uuuuaucuuacauggaaucucc

SEQ ID NO: 156847 - RNA, 22 nt, Human
uuuuauguuccugaagcuaucu

SEQ ID NO: 156848 - RNA, 22 nt, Human
uuuuaaaagguugcuguuauaa

SEQ ID NO: 156849 - RNA, 22 nt, Human
uuuuaaauaaacuacacugauu

SEQ ID NO: 156850 - RNA, 22 nt, Human
uuuuaacuuuaccauuucuuca

SEQ ID NO: 156851 - RNA, 22 nt, Human
uuuuaaguauuuucuuuuuuua

SEQ ID NO: 156852 - RNA, 23 nt, Human
uuuuacaagagugcauuugucuc

SEQ ID NO: 156853 - RNA, 22 nt, Human
uuuuaauccucuugguaucuua

SEQ ID NO: 156854 - RNA, 23 nt, Human
uuuuaauaguaugacaugagcug

SEQ ID NO: 156855 - RNA, 23 nt, Human
uuuguugguuuaagaguagcaga

SEQ ID NO: 156856 - RNA, 22 nt, Human
uuuguuugcuaguauuuuguuu

SEQ ID NO: 156857 - RNA, 22 nt, Human
uuuguugucuucauaauacuuu

SEQ ID NO: 156858 - RNA, 21 nt, Human
uuuguucacacacagggcagc

SEQ ID NO: 156859 - RNA, 22 nt, Human
uuuacuauuaguauuucauuuu

SEQ ID NO: 156860 - RNA, 22 nt, Human
uuuacuguuuacagcuaaugca

SEQ ID NO: 156861 - RNA, 22 nt, Human
uuuacuuuugguaaggucauuu

SEQ ID NO: 156862 - RNA, 22 nt, Human
uucuguucugcuuucuccaucc

SEQ ID NO: 156863 - RNA, 22 nt, Human
uucuguguauggaagaaugucc

SEQ ID NO: 156864 - RNA, 22 nt, Human
uuuuguagauuggaaaaucugg

SEQ ID NO: 156865 - RNA, 22 nt, Human
uuuugucagggcaggaggaaga

SEQ ID NO: 156866 - RNA, 22 nt, Human
uuuuuaaaagaugauuuaauga

SEQ ID NO: 156867 - RNA, 21 nt, Human
uuuuguguugcgcacuuugag

SEQ ID NO: 156868 - RNA, 22 nt, Human
uuuuguuuacauuaaauuuuga

SEQ ID NO: 156869 - RNA, 18 nt, Human
uuuuguguuuauucugca

SEQ ID NO: 156870 - RNA, 22 nt, Human
uuuuucacacuccuuuccaguu

SEQ ID NO: 156871 - RNA, 22 nt, Human
uuuuucuccauuccaggugccu

SEQ ID NO: 156872 - RNA, 22 nt, Human
uuuuuagcuguuauuguggaag

SEQ ID NO: 156873 - RNA, 22 nt, Human
uuuuuagcauaugucaaaucag

SEQ ID NO: 156874 - RNA, 22 nt, Human
uuuuuagggauuaguguuugag

SEQ ID NO: 156875 - RNA, 22 nt, Human
uucuugagaacaaauuccugga

SEQ ID NO: 156876 - RNA, 22 nt, Human
uuuuuaauuuuaagcuauuugu

SEQ ID NO: 156877 - RNA, 22 nt, Human
uuuuuaagguuuguuuauauau

SEQ ID NO: 156878 - RNA, 22 nt, Human
uuuuuuuagaaagaucauaguu

SEQ ID NO: 156879 - RNA, 19 nt, Human
uugaauguuugauagucuc

SEQ ID NO: 156880 - RNA, 22 nt, Human
uugaggcugaucacuccuauaa

SEQ ID NO: 156881 - RNA, 22 nt, Human
uuuuuuuuacuccggacagcuc

SEQ ID NO: 156882 - RNA, 22 nt, Human
uugaaccaggauaaacauagaa

SEQ ID NO: 156883 - RNA, 22 nt, Human
uuuuuguuauuuagguguagag

SEQ ID NO: 156884 - RNA, 22 nt, Human
uuuuuguauaugcuucgaggau

SEQ ID NO: 156885 - RNA, 22 nt, Human
uugaaagaacaauucugugaug

SEQ ID NO: 156886 - RNA, 22 nt, Human
uugaaaauuaauagguguacaa

SEQ ID NO: 156887 - RNA, 21 nt, Human
uuccuaaaaugcuuuugugcc

SEQ ID NO: 156888 - RNA, 22 nt, Human
uuccuaagugcugguaugaggc

SEQ ID NO: 156889 - RNA, 22 nt, Human
uuuguucuucucaugcacacaa

SEQ ID NO: 156890 - RNA, 22 nt, Human
uuuguugaauggcaggauuuua

SEQ ID NO: 156891 - RNA, 22 nt, Human
uucuccaccugcuccucccacc

SEQ ID NO: 156892 - RNA, 22 nt, Human
uucucagagaaagcuccucaug

SEQ ID NO: 156893 - RNA, 22 nt, Human
uucuccccacuccucccucuga

SEQ ID NO: 156894 - RNA, 22 nt, Human
uucuccacguucuucucggccu

SEQ ID NO: 156895 - RNA, 22 nt, Human
uucuaggagucugguuccugcc

SEQ ID NO: 156896 - RNA, 22 nt, Human
uucugcuuuaaagcucauguuu

SEQ ID NO: 156897 - RNA, 22 nt, Human
uuuuggaaaaaccaguauggaa

SEQ ID NO: 156898 - RNA, 22 nt, Human
uucucugcgcuccggcccaguu

SEQ ID NO: 156899 - RNA, 22 nt, Human
uuuucaaucaaguuuauuuaua

SEQ ID NO: 156900 - RNA, 22 nt, Human
uucugaaccauugagcacugcc

SEQ ID NO: 156901 - RNA, 22 nt, Human
uucugaugccuggguugcuucu

SEQ ID NO: 156902 - RNA, 20 nt, Human
uucugcagcagguguugaag

SEQ ID NO: 156903 - RNA, 22 nt, Human
uuuaauauucucuuugaaggaa

SEQ ID NO: 156904 - RNA, 22 nt, Human
uuuaaaccuuggaagccacaua

SEQ ID NO: 156905 - RNA, 22 nt, Human
uuuaaaccuaucuaagaaauag

SEQ ID NO: 156906 - RNA, 22 nt, Human
uuuaacauaugaaagaauauuu

SEQ ID NO: 156907 - RNA, 22 nt, Human
uuguuuguaaggcucuuagaau

SEQ ID NO: 156908 - RNA, 22 nt, Human
uuguuugguugacugauuuacc

SEQ ID NO: 156909 - RNA, 22 nt, Human
uuguuucauggggacgacuggc

SEQ ID NO: 156910 - RNA, 22 nt, Human
uuguuuuaguagaaguuacaug

SEQ ID NO: 156911 - RNA, 22 nt, Human
uuuaaaacaguacguuuucuua

SEQ ID NO: 156912 - RNA, 22 nt, Human
uuuaaaacagcauuuaaaaggu

SEQ ID NO: 156913 - RNA, 22 nt, Human
uuguuuuucucuagggaaggcu

SEQ ID NO: 156914 - RNA, 22 nt, Human
uuguuuucuugaugaaauuauu

SEQ ID NO: 156915 - RNA, 22 nt, Human
uuguuuucuaguguuuugaaua

SEQ ID NO: 156916 - RNA, 22 nt, Human
uuggucaagacugauaucaaga

SEQ ID NO: 156917 - RNA, 22 nt, Human
uuggguguugguuccugggagg

SEQ ID NO: 156918 - RNA, 22 nt, Human
uugguaaccaaucaaaugugag

SEQ ID NO: 156919 - RNA, 22 nt, Human
uuggcaaagagaugcauaagga

SEQ ID NO: 156920 - RNA, 22 nt, Human
uuggcaaaaauacuguaggccu

SEQ ID NO: 156921 - RNA, 22 nt, Human
uuggcaaaagauuggguacuua

SEQ ID NO: 156922 - RNA, 22 nt, Human
uuggguagguccuucacggaua

SEQ ID NO: 156923 - RNA, 22 nt, Human
uuguacuuguucuguuuccuug

SEQ ID NO: 156924 - RNA, 22 nt, Human
uuggugaugcuaggaauguagu

SEQ ID NO: 156925 - RNA, 22 nt, Human
uugucuguacuggcugcaucga

SEQ ID NO: 156926 - RNA, 22 nt, Human
uuggaaaugcauuuguuauuau

SEQ ID NO: 156927 - RNA, 22 nt, Human
uuggaagacagccgucuuuauu

SEQ ID NO: 156928 - RNA, 22 nt, Human
uuggaaaagaaauacucauaua

SEQ ID NO: 156929 - RNA, 22 nt, Human
uugcuuugcuucuuuaugguca

SEQ ID NO: 156930 - RNA, 23 nt, Human
uugcuuuugccccaaaagaguua

SEQ ID NO: 156931 - RNA, 22 nt, Human
uuggaaguggcaaaggcuaaag

SEQ ID NO: 156932 - RNA, 22 nt, Human
uuggaagagagauggggagaga

SEQ ID NO: 156933 - RNA, 22 nt, Human
uugcuuuuuuggguuuacuggg

SEQ ID NO: 156934 - RNA, 22 nt, Human
uuggaagugucuaauacaggua

SEQ ID NO: 156935 - RNA, 22 nt, Human
uugcuuucuuuguagguuuucc

SEQ ID NO: 156936 - RNA, 22 nt, Human
uugcugccagcgcccugcaggg

SEQ ID NO: 156937 - RNA, 22 nt, Human
uugcuggaguagaaaacuuaac

SEQ ID NO: 156938 - RNA, 20 nt, Human
uugcaaagugaauagcaauu

SEQ ID NO: 156939 - RNA, 22 nt, Human
uugcaagauaguguauuuuuca

SEQ ID NO: 156940 - RNA, 22 nt, Human
uugcauauguccagccaugcau

SEQ ID NO: 156941 - RNA, 22 nt, Human
uugcaucagcaggcauaauugg

SEQ ID NO: 156942 - RNA, 20 nt, Human
uugcaugcagccggaugcug

SEQ ID NO: 156943 - RNA, 22 nt, Human
uugccuguuugagagcuguguu

SEQ ID NO: 156944 - RNA, 22 nt, Human
uuucuguuuguaacuccagcaa

SEQ ID NO: 156945 - RNA, 22 nt, Human
uuucuuaaaagcuuuuaaaguu

SEQ ID NO: 156946 - RNA, 22 nt, Human
uuucuguugugaccugacucuu

SEQ ID NO: 156947 - RNA, 22 nt, Human
uuucugggggucgugcuggcug

SEQ ID NO: 156948 - RNA, 22 nt, Human
uuucuggaaacuguaaagagga

SEQ ID NO: 156949 - RNA, 22 nt, Human
uuucuuccuucuugaucauuug

SEQ ID NO: 156950 - RNA, 22 nt, Human
uuucuuccaucuggcuuuauuu

SEQ ID NO: 156951 - RNA, 22 nt, Human
uuauuuuauaaagagaagacuu

SEQ ID NO: 156952 - RNA, 22 nt, Human
uuucucuuguauuugaaucacu

SEQ ID NO: 156953 - RNA, 17 nt, Human
uuucugcaugauuggac

SEQ ID NO: 156954 - RNA, 22 nt, Human
uuucugaugaaguagaaagacc

SEQ ID NO: 156955 - RNA, 22 nt, Human
uuugagaaugucaaucacaaga

SEQ ID NO: 156956 - RNA, 22 nt, Human
uuugagguuuagcucacuauuu

SEQ ID NO: 156957 - RNA, 22 nt, Human
uuugagugccucgaguguggga

SEQ ID NO: 156958 - RNA, 22 nt, Human
uuugacaccaggagagaaaaca

SEQ ID NO: 156959 - RNA, 22 nt, Human
uucaacaacuugguucaaaugg

SEQ ID NO: 156960 - RNA, 22 nt, Human
uucaaacaguguagaauauaug

SEQ ID NO: 156961 - RNA, 22 nt, Human
uuugaagaaacagucuuaagag

SEQ ID NO: 156962 - RNA, 22 nt, Human
uuugaaaggagcuuuauccaga

SEQ ID NO: 156963 - RNA, 22 nt, Human
uuugaagauaaauauggagaaa

SEQ ID NO: 156964 - RNA, 22 nt, Human
uuauuuuuaggaauguagaggu

SEQ ID NO: 156965 - RNA, 22 nt, Human
uuauuuuguagcucugaucuuu

SEQ ID NO: 156966 - RNA, 18 nt, Human
uuugggauccucuuuucu

SEQ ID NO: 156967 - RNA, 22 nt, Human
uucaguuuugcuuuuaaucaug

SEQ ID NO: 156968 - RNA, 22 nt, Human
uuuggguauuaguuuagcuaga

SEQ ID NO: 156969 - RNA, 22 nt, Human
uucagacugcccauguuugcca

SEQ ID NO: 156970 - RNA, 22 nt, Human
uuugcaggaaauguacugaaug

SEQ ID NO: 156971 - RNA, 22 nt, Human
uuuggcaagcagaugaagguag

SEQ ID NO: 156972 - RNA, 22 nt, Human
uuuggccauuuguaugcaugau

SEQ ID NO: 156973 - RNA, 22 nt, Human
uucagguuuuuaaguucugccu

SEQ ID NO: 156974 - RNA, 22 nt, Human
uuuguacuuucuaauguauuua

SEQ ID NO: 156975 - RNA, 22 nt, Human
uucauugcagaauuuggccuca

SEQ ID NO: 156976 - RNA, 22 nt, Human
uucauuuccauuuuauagauaa

SEQ ID NO: 156977 - RNA, 20 nt, Human
uuugucaacugcauccagca

SEQ ID NO: 156978 - RNA, 22 nt, Human
uuugucaggaauugaaaaguuu

SEQ ID NO: 156979 - RNA, 22 nt, Human
uuuguauuguuuauuucauuuu

SEQ ID NO: 156980 - RNA, 22 nt, Human
uucccuauaauauggcucuucu

SEQ ID NO: 156981 - RNA, 22 nt, Human
uuuguuaggguuucagcuagcc

SEQ ID NO: 156982 - RNA, 22 nt, Human
uuccccagaaaaguaaacaagg

SEQ ID NO: 156983 - RNA, 22 nt, Human
uuuguguuuugaggucuugcaa

SEQ ID NO: 156984 - RNA, 22 nt, Human
uuuguguuuucaggcacauggc

SEQ ID NO: 156985 - RNA, 22 nt, Human
uuccaugccuaagagccugaag

SEQ ID NO: 156986 - RNA, 22 nt, Human
uuugugauaaguggauucaagg

SEQ ID NO: 156987 - RNA, 22 nt, Human
uuugucaucuuccauauuugca

SEQ ID NO: 156988 - RNA, 22 nt, Human
uuuguggugagcagggaacguc

SEQ ID NO: 156989 - RNA, 17 nt, Human
uuugugauggcagaugc

SEQ ID NO: 156990 - RNA, 22 nt, Human
uuuguggaaaagagcccaggag

SEQ ID NO: 156991 - RNA, 22 nt, Human
uuucagacugcccauguuugcc

SEQ ID NO: 156992 - RNA, 22 nt, Human
uuucagauuauguucauggguu

SEQ ID NO: 156993 - RNA, 22 nt, Human
uuucaugauuaacuuagugaau

SEQ ID NO: 156994 - RNA, 22 nt, Human
uuauacugaaagucuuuuaaua

SEQ ID NO: 156995 - RNA, 22 nt, Human
uuauaggugauuaauuuuaacc

SEQ ID NO: 156996 - RNA, 22 nt, Human
uuaucugugcuuuacugacaga

SEQ ID NO: 156997 - RNA, 20 nt, Human
uuauccccauucuuguucuc

SEQ ID NO: 156998 - RNA, 22 nt, Human
uuaugccuguuaggcagcaucu

SEQ ID NO: 156999 - RNA, 21 nt, Human
uuucauuaguacaucaauuug

SEQ ID NO: 157000 - RNA, 22 nt, Human
uuuccagacaugguuuuucaaa

SEQ ID NO: 157001 - RNA, 21 nt, Human
uuuccagaggcagccggacuc

SEQ ID NO: 157002 - RNA, 22 nt, Human
uuaucaaaaaauaguacuuuga

SEQ ID NO: 157003 - RNA, 22 nt, Human
uuaucagggaguuguguguucu

SEQ ID NO: 157004 - RNA, 22 nt, Human
uuauauuuuauuuaauuaaaua

SEQ ID NO: 157005 - RNA, 22 nt, Human
uuauuguagcacuuuggcagug

SEQ ID NO: 157006 - RNA, 22 nt, Human
uuucguugcacucauaugguug

SEQ ID NO: 157007 - RNA, 22 nt, Human
uuucuaaaaccagaguuuauaa

SEQ ID NO: 157008 - RNA, 22 nt, Human
uuucuaaguuugaggcgaagca

SEQ ID NO: 157009 - RNA, 22 nt, Human
uuucucagcauauugccuuuga

SEQ ID NO: 157010 - RNA, 22 nt, Human
uuucccuugcgcuugcucuccg

SEQ ID NO: 157011 - RNA, 22 nt, Human
uuuccugcagacaguuuaagca

SEQ ID NO: 157012 - RNA, 22 nt, Human
uuauucuuagccucgguauuuc

SEQ ID NO: 157013 - RNA, 22 nt, Human
uuaccuaagaaacucauuucgu

SEQ ID NO: 157014 - RNA, 22 nt, Human
uuaccauaguacuaucaguuua

SEQ ID NO: 157015 - RNA, 22 nt, Human
uuaccugcagagacguggaggc

SEQ ID NO: 157016 - RNA, 22 nt, Human
uguuugaggugacucuggaaug

SEQ ID NO: 157017 - RNA, 22 nt, Human
uuguauaaagauggcuagaucc

SEQ ID NO: 157018 - RNA, 22 nt, Human
uguuugaugugcacgugugugu

SEQ ID NO: 157019 - RNA, 21 nt, Human
uguuugcuuuuggagcaacug

SEQ ID NO: 157020 - RNA, 22 nt, Human
uuuagcauggacacugagggcu

SEQ ID NO: 157021 - RNA, 22 nt, Human
uuuaggaagaucugaaggaaga

SEQ ID NO: 157022 - RNA, 22 nt, Human
uuuaggaauuugcugggcauga

SEQ ID NO: 157023 - RNA, 22 nt, Human
uuagaaauguccuacuaauaug

SEQ ID NO: 157024 - RNA, 22 nt, Human
uuuauuugugguaguguaaucu

SEQ ID NO: 157025 - RNA, 22 nt, Human
uuuauuuuccaugucucuaggu

SEQ ID NO: 157026 - RNA, 19 nt, Human
uuuauuugagacaugccuu

SEQ ID NO: 157027 - RNA, 22 nt, Human
uuuauugaccugaguaucagca

SEQ ID NO: 157028 - RNA, 22 nt, Human
uuuauaauuguuauguuaccca

SEQ ID NO: 157029 - RNA, 22 nt, Human
uuuauauauauguaggagcaca

SEQ ID NO: 157030 - RNA, 21 nt, Human
uuagcaguuguugauuuccag

SEQ ID NO: 157031 - RNA, 22 nt, Human
uuuaggugucugcucauugaag

SEQ ID NO: 157032 - RNA, 22 nt, Human
ugggcaguccagcuggaaacgg

SEQ ID NO: 157033 - RNA, 22 nt, Human
ugggccgugagacgucucuggg

SEQ ID NO: 157034 - RNA, 22 nt, Human
uggggaauguaauucuuuggcu

SEQ ID NO: 157035 - RNA, 22 nt, Human
ugggagagauaggcuucuggac

SEQ ID NO: 157036 - RNA, 22 nt, Human
uggcuuuugaaaaggugaugua

SEQ ID NO: 157037 - RNA, 22 nt, Human
ugggauauagaauuggcagagu

SEQ ID NO: 157038 - RNA, 18 nt, Human
uuccauuuuucagucuuc

SEQ ID NO: 157039 - RNA, 22 nt, Human
uuccccgagccuggggaagcug

SEQ ID NO: 157040 - RNA, 22 nt, Human
uuccccaccagagacagagcug

SEQ ID NO: 157041 - RNA, 20 nt, Human
uuccccauaaaaauguucca

SEQ ID NO: 157042 - RNA, 20 nt, Human
uucuccacaggguggaggag

SEQ ID NO: 157043 - RNA, 22 nt, Human
ugggugaagaggcuaugcuacu

SEQ ID NO: 157044 - RNA, 22 nt, Human
uucucaauggcaacuuguugcu

SEQ ID NO: 157045 - RNA, 22 nt, Human
uucucuggggacugucucuauu

SEQ ID NO: 157046 - RNA, 22 nt, Human
uucuagaagggccuaggcauaa

SEQ ID NO: 157047 - RNA, 22 nt, Human
uucuagccauagaaauuagauu

SEQ ID NO: 157048 - RNA, 22 nt, Human
uucuagauagucugauauuccu

SEQ ID NO: 157049 - RNA, 22 nt, Human
uucuagacaauugaaaacuguu

SEQ ID NO: 157050 - RNA, 22 nt, Human
ugggggagggagaguugauggg

SEQ ID NO: 157051 - RNA, 22 nt, Human
ugggggaugacuugcucuuuca

SEQ ID NO: 157052 - RNA, 22 nt, Human
uucgucauuguuguugguuuuc

SEQ ID NO: 157053 - RNA, 18 nt, Human
uucuaaauucuguuuuua

SEQ ID NO: 157054 - RNA, 22 nt, Human
uucuaauauuaugauuucuaag

SEQ ID NO: 157055 - RNA, 22 nt, Human
uucaguaugcugaaugauuuuu

SEQ ID NO: 157056 - RNA, 22 nt, Human
uucagguuuuaugguaaugcuu

SEQ ID NO: 157057 - RNA, 22 nt, Human
uucaguuugaauucuguagaac

SEQ ID NO: 157058 - RNA, 22 nt, Human
uggccugauuuugcuaagagaa

SEQ ID NO: 157059 - RNA, 22 nt, Human
uucaugcaagagugugaggucc

SEQ ID NO: 157060 - RNA, 23 nt, Human
uggccguccccugacucucuggc

SEQ ID NO: 157061 - RNA, 22 nt, Human
uggccgaugagcaugcgcugau

SEQ ID NO: 157062 - RNA, 22 nt, Human
uuccagucugggcucuucacug

SEQ ID NO: 157063 - RNA, 22 nt, Human
uuccagauguuuaaguucugcu

SEQ ID NO: 157064 - RNA, 22 nt, Human
uggcucuucucaagcauuggcu

SEQ ID NO: 157065 - RNA, 22 nt, Human
uggcggcuggacuggggggcca

SEQ ID NO: 157066 - RNA, 22 nt, Human
uggcgcgcucgcucucgcugag

SEQ ID NO: 157067 - RNA, 22 nt, Human
uggcgcgcagccugcuggugcu

SEQ ID NO: 157068 - RNA, 22 nt, Human
uucauuauuaauaauagcagcu

SEQ ID NO: 157069 - RNA, 22 nt, Human
uucauugcuacuuaaaauacca

SEQ ID NO: 157070 - RNA, 21 nt, Human
uggcaggcagcuggaagcuug

SEQ ID NO: 157071 - RNA, 22 nt, Human
uucagauuuguuuuuguuucug

SEQ ID NO: 157072 - RNA, 22 nt, Human
uucagaugcuugauuauggcaa

SEQ ID NO: 157073 - RNA, 22 nt, Human
uggcagugggaagcuggaaguc

SEQ ID NO: 157074 - RNA, 20 nt, Human
uggcaugaaauuuuccaagc

SEQ ID NO: 157075 - RNA, 22 nt, Human
uggcauuugagcuggaaggaug

SEQ ID NO: 157076 - RNA, 22 nt, Human
uucaggaucuaggaguauuuuu

SEQ ID NO: 157077 - RNA, 22 nt, Human
uucagcugcuugccugaaguca

SEQ ID NO: 157078 - RNA, 22 nt, Human
uucaggacuauccaguggucuc

SEQ ID NO: 157079 - RNA, 22 nt, Human
uggcagccucugguccuuaguu

SEQ ID NO: 157080 - RNA, 22 nt, Human
uggcacagcuugucauaaacuc

SEQ ID NO: 157081 - RNA, 22 nt, Human
uggcaaggccacaggugcaguu

SEQ ID NO: 157082 - RNA, 18 nt, Human
uggcaaugccaaaggcuu

SEQ ID NO: 157083 - RNA, 22 nt, Human
uggcaaacacaauauggguaca

SEQ ID NO: 157084 - RNA, 23 nt, Human
uggcaaacgggaauaaaggaauu

SEQ ID NO: 157085 - RNA, 22 nt, Human
uggauuagugcugaaaugaugg

SEQ ID NO: 157086 - RNA, 22 nt, Human
uucaaugcaagggaggucugaa

SEQ ID NO: 157087 - RNA, 22 nt, Human
uucaaaccuaucuaagaaauag

SEQ ID NO: 157088 - RNA, 22 nt, Human
uggaguucauauuggacauaag

SEQ ID NO: 157089 - RNA, 22 nt, Human
uucaaaaugcagaauaguuugg

SEQ ID NO: 157090 - RNA, 22 nt, Human
uuauuuuuguuuguuaagccua

SEQ ID NO: 157091 - RNA, 22 nt, Human
uuauuuuuguaacacuguauag

SEQ ID NO: 157092 - RNA, 19 nt, Human
uggaggcacuaacaaacuc

SEQ ID NO: 157093 - RNA, 22 nt, Human
uuauuuaagaucuuaauauaua

SEQ ID NO: 157094 - RNA, 22 nt, Human
uuauuuaaguauuuauugaagu

SEQ ID NO: 157095 - RNA, 22 nt, Human
uggaggaugacagagaugggcu

SEQ ID NO: 157096 - RNA, 22 nt, Human
uggaggauggaaggaaagcugg

SEQ ID NO: 157097 - RNA, 22 nt, Human
uuauuugguuuuggcuuuagcu

SEQ ID NO: 157098 - RNA, 22 nt, Human
uuauuuucgugugugugugugu

SEQ ID NO: 157099 - RNA, 22 nt, Human
uuauuugcccauguuuagcaga

SEQ ID NO: 157100 - RNA, 22 nt, Human
uuauuucuucucgaagcuuggg

SEQ ID NO: 157101 - RNA, 22 nt, Human
uuauuucauguaaaauuuaugu

SEQ ID NO: 157102 - RNA, 22 nt, Human
uuauuguuuggguauaauuuga

SEQ ID NO: 157103 - RNA, 22 nt, Human
ugcuauucuuggagcugaugga

SEQ ID NO: 157104 - RNA, 22 nt, Human
ugcuauuuuguuuucaguccau

SEQ ID NO: 157105 - RNA, 22 nt, Human
uuauguugauaggaaucugauu

SEQ ID NO: 157106 - RNA, 22 nt, Human
uucuguuuauaauuugcaguug

SEQ ID NO: 157107 - RNA, 22 nt, Human
uucugcauaggcuauauuuguu

SEQ ID NO: 157108 - RNA, 22 nt, Human
uucuguuuaaccuggaaagugu

SEQ ID NO: 157109 - RNA, 22 nt, Human
uucugauacagucccaacacaa

SEQ ID NO: 157110 - RNA, 22 nt, Human
uucugaaggcaggggcuaucuu

SEQ ID NO: 157111 - RNA, 22 nt, Human
uucugaaacauugcuauuuucc

SEQ ID NO: 157112 - RNA, 22 nt, Human
uucuuccagugaaacgugcauc

SEQ ID NO: 157113 - RNA, 22 nt, Human
uucuuagauuuuauuucuucug

SEQ ID NO: 157114 - RNA, 22 nt, Human
uugaacguguaggaagcugguu

SEQ ID NO: 157115 - RNA, 22 nt, Human
uugaacaguuuugucagguuca

SEQ ID NO: 157116 - RNA, 22 nt, Human
uguauaugucugugagcuauua

SEQ ID NO: 157117 - RNA, 22 nt, Human
uugaaaacugucaccuuuauuc

SEQ ID NO: 157118 - RNA, 22 nt, Human
uguaaacuuuugcauacugcuu

SEQ ID NO: 157119 - RNA, 22 nt, Human
uguaauuugguuagauuucuuu

SEQ ID NO: 157120 - RNA, 22 nt, Human
uucuuucgaacaagagaaguuc

SEQ ID NO: 157121 - RNA, 22 nt, Human
ugguuucagacagacucgaacu

SEQ ID NO: 157122 - RNA, 22 nt, Human
ugugaagcgugugcaggggaca

SEQ ID NO: 157123 - RNA, 23 nt, Human
ugugaauggccuucuuuagaggu

SEQ ID NO: 157124 - RNA, 22 nt, Human
ugugauaaaggcccgcagaucc

SEQ ID NO: 157125 - RNA, 22 nt, Human
ugugaugagaugaacuguagac

SEQ ID NO: 157126 - RNA, 22 nt, Human
uugccuagugguagugacuguu

SEQ ID NO: 157127 - RNA, 22 nt, Human
uugccucuaauuagcucuguga

SEQ ID NO: 157128 - RNA, 22 nt, Human
ugucuuucuuucucuugacaga

SEQ ID NO: 157129 - RNA, 22 nt, Human
ugucuuugaccuuaagaaguuu

SEQ ID NO: 157130 - RNA, 22 nt, Human
uugcacgucacccuucccaccu

SEQ ID NO: 157131 - RNA, 22 nt, Human
uugcacuccagcccgagcaaca

SEQ ID NO: 157132 - RNA, 22 nt, Human
uugaguuuacauuguauuagcc

SEQ ID NO: 157133 - RNA, 22 nt, Human
uguauuuuuucccugaaauaaa

SEQ ID NO: 157134 - RNA, 22 nt, Human
uguauuugaagaaagagcuucu

SEQ ID NO: 157135 - RNA, 22 nt, Human
uguaucuguguguauguguuua

SEQ ID NO: 157136 - RNA, 22 nt, Human
uguauauuuucuguauaaaaua

SEQ ID NO: 157137 - RNA, 22 nt, Human
uguauguguuuuauguguguuu

SEQ ID NO: 157138 - RNA, 22 nt, Human
uugauggaggaaaaguuggaau

SEQ ID NO: 157139 - RNA, 22 nt, Human
uugauuaauugaugaaccucuc

SEQ ID NO: 157140 - RNA, 21 nt, Human
ugucaucucuaaaaagauugu

SEQ ID NO: 157141 - RNA, 22 nt, Human
uugauuuccauuguccagcauu

SEQ ID NO: 157142 - RNA, 22 nt, Human
uugauuuggaauuuuuagagcu

SEQ ID NO: 157143 - RNA, 20 nt, Human
ugucccuggagagcugcaga

SEQ ID NO: 157144 - RNA, 22 nt, Human
uguuggauuuugugaaauauga

SEQ ID NO: 157145 - RNA, 22 nt, Human
uguuggaauaagugcuugaagg

SEQ ID NO: 157146 - RNA, 19 nt, Human
uguugcagcuugaucggua

SEQ ID NO: 157147 - RNA, 22 nt, Human
uguugcauguggcuguuugcca

SEQ ID NO: 157148 - RNA, 22 nt, Human
uguuggugcacugaaaggcagg

SEQ ID NO: 157149 - RNA, 22 nt, Human
uguugguuucaagcaggagccu

SEQ ID NO: 157150 - RNA, 22 nt, Human
uugguuaccuucagaaaugagu

SEQ ID NO: 157151 - RNA, 22 nt, Human
uguugauuaauuuucccaaaca

SEQ ID NO: 157152 - RNA, 22 nt, Human
uguugaagcaccucugucuuuc

SEQ ID NO: 157153 - RNA, 22 nt, Human
uuggggaauuuggggccguccg

SEQ ID NO: 157154 - RNA, 22 nt, Human
uugggauuggugggguggguuu

SEQ ID NO: 157155 - RNA, 22 nt, Human
uugggcauuucuuauguauuuu

SEQ ID NO: 157156 - RNA, 22 nt, Human
uuggccuaggcacaggcaggug

SEQ ID NO: 157157 - RNA, 22 nt, Human
uguguguauauauauguaucau

SEQ ID NO: 157158 - RNA, 22 nt, Human
uguguguauauauggaauauug

SEQ ID NO: 157159 - RNA, 22 nt, Human
uuggcuguguugaaaacgugga

SEQ ID NO: 157160 - RNA, 22 nt, Human
uuggcuuuucaguuuuaaguua

SEQ ID NO: 157161 - RNA, 22 nt, Human
ugugggcguggguuggggaggg

SEQ ID NO: 157162 - RNA, 22 nt, Human
uugcuugaacccaggaagugga

SEQ ID NO: 157163 - RNA, 22 nt, Human
uugcuuaggccaaauggcgcau

SEQ ID NO: 157164 - RNA, 22 nt, Human
uugcuugcggccuuugugccuu

SEQ ID NO: 157165 - RNA, 22 nt, Human
uugcuuuuugggguuuacuggg

SEQ ID NO: 157166 - RNA, 22 nt, Human
uuggaaauguagaaaagcagau

SEQ ID NO: 157167 - RNA, 19 nt, Human
uguguaccuaauguuugug

SEQ ID NO: 157168 - RNA, 22 nt, Human
ugugguuuguaagcaaagcaaa

SEQ ID NO: 157169 - RNA, 22 nt, Human
ugugcagaaaacacuuaagaac

SEQ ID NO: 157170 - RNA, 22 nt, Human
ugugccuuucacuaugucauuc

SEQ ID NO: 157171 - RNA, 22 nt, Human
ugugcugcagcgagagcuacga

SEQ ID NO: 157172 - RNA, 22 nt, Human
ugugcuauuuuugcauaugugu

SEQ ID NO: 157173 - RNA, 22 nt, Human
uugcucuuaccauuauguguga

SEQ ID NO: 157174 - RNA, 22 nt, Human
uugcuuaaaucgcuuaaacugg

SEQ ID NO: 157175 - RNA, 21 nt, Human
uugcuggagcaauguaaauca

SEQ ID NO: 157176 - RNA, 22 nt, Human
uguggauauauuuuaaaaggaa

SEQ ID NO: 157177 - RNA, 22 nt, Human
ugcauuuucuaccacacccacu

SEQ ID NO: 157178 - RNA, 22 nt, Human
ugcauuugcaauggguacacaa

SEQ ID NO: 157179 - RNA, 22 nt, Human
ugccaaagauagagguuugagu

SEQ ID NO: 157180 - RNA, 22 nt, Human
ugccaucuuugccccuauuuua

SEQ ID NO: 157181 - RNA, 22 nt, Human
ugugggaucauggaucagggcc

SEQ ID NO: 157182 - RNA, 22 nt, Human
uguguguauauauuuuuauaug

SEQ ID NO: 157183 - RNA, 17 nt, Human
uguguaaguugcauaga

SEQ ID NO: 157184 - RNA, 22 nt, Human
ugcccacuuugucuccaugcug

SEQ ID NO: 157185 - RNA, 22 nt, Human
ugccgggcugagcaagugcugc

SEQ ID NO: 157186 - RNA, 22 nt, Human
ugugguagagcuuaaaugaggu

SEQ ID NO: 157187 - RNA, 22 nt, Human
ugugggaucguaaauuugggac

SEQ ID NO: 157188 - RNA, 22 nt, Human
ugucuuaggcuccgccggccca

SEQ ID NO: 157189 - RNA, 22 nt, Human
ugcacugccuuucuuggcauga

SEQ ID NO: 157190 - RNA, 22 nt, Human
ugugcgcgugugcuuugugugu

SEQ ID NO: 157191 - RNA, 22 nt, Human
ugugccuucuucauuuaauuua

SEQ ID NO: 157192 - RNA, 22 nt, Human
ugugggaggauuuaggugaauc

SEQ ID NO: 157193 - RNA, 22 nt, Human
ugcauugccucuauucauuaua

SEQ ID NO: 157194 - RNA, 22 nt, Human
ugcauuccagcucccuucuggc

SEQ ID NO: 157195 - RNA, 22 nt, Human
ugcauaagguuaaauuagcaga

SEQ ID NO: 157196 - RNA, 23 nt, Human
uguuccugaugccucguccuguc

SEQ ID NO: 157197 - RNA, 22 nt, Human
ugcgcgcaccugcauauauaug

SEQ ID NO: 157198 - RNA, 22 nt, Human
ugcggaaggcagcgcagggugg

SEQ ID NO: 157199 - RNA, 22 nt, Human
uguucggaaaagggcaagcuau

SEQ ID NO: 157200 - RNA, 21 nt, Human
ugcguaugucuuguauuacuc

SEQ ID NO: 157201 - RNA, 22 nt, Human
uguugaaacagcuauugacuuu

SEQ ID NO: 157202 - RNA, 22 nt, Human
uguucugaggaggguuucaagg

SEQ ID NO: 157203 - RNA, 22 nt, Human
ugcguuuaguuucaagacacgu

SEQ ID NO: 157204 - RNA, 22 nt, Human
ugcguugaggaccgcgagggcg

SEQ ID NO: 157205 - RNA, 21 nt, Human
uguugcuugucugagacuaug

SEQ ID NO: 157206 - RNA, 22 nt, Human
uguugagaacaucucggggaca

SEQ ID NO: 157207 - RNA, 22 nt, Human
ugccuucugccaaggacggugc

SEQ ID NO: 157208 - RNA, 20 nt, Human
ugccuuccgccccgggcacc

SEQ ID NO: 157209 - RNA, 19 nt, Human
uguguuccauccaccaccc

SEQ ID NO: 157210 - RNA, 21 nt, Human
uguguuuauauguguuuauau

SEQ ID NO: 157211 - RNA, 22 nt, Human
uguguucagaagaggcugccgg

SEQ ID NO: 157212 - RNA, 22 nt, Human
uguguguguguguguguuugug

SEQ ID NO: 157213 - RNA, 22 nt, Human
ugccuuuggcuguucugugacc

SEQ ID NO: 157214 - RNA, 22 nt, Human
uguguuuuucauuuuaaguccu

SEQ ID NO: 157215 - RNA, 22 nt, Human
uguucccgaugacaggaccagg

SEQ ID NO: 157216 - RNA, 22 nt, Human
uguuacugaaugucucugcuuu

SEQ ID NO: 157217 - RNA, 22 nt, Human
ugaggaagugguuguaugguuu

SEQ ID NO: 157218 - RNA, 22 nt, Human
ugagcuuugguaccuucauuug

SEQ ID NO: 157219 - RNA, 22 nt, Human
ugagcuauuucaccauauagau

SEQ ID NO: 157220 - RNA, 23 nt, Human
uggugcagcgcaggccggguggc

SEQ ID NO: 157221 - RNA, 22 nt, Human
ugaggcaguucuuacuuguauu

SEQ ID NO: 157222 - RNA, 21 nt, Human
ugaggccugccagucucagaa

SEQ ID NO: 157223 - RNA, 22 nt, Human
ugacaucagacugugagaagag

SEQ ID NO: 157224 - RNA, 22 nt, Human
uggggggacagauggagaggac

SEQ ID NO: 157225 - RNA, 22 nt, Human
ugggguuuuagagcaggcagag

SEQ ID NO: 157226 - RNA, 23 nt, Human
ugaccauauauccaucagauaua

SEQ ID NO: 157227 - RNA, 22 nt, Human
ugaccgucagcugucuuccauu

SEQ ID NO: 157228 - RNA, 22 nt, Human
uguaaaguuuccuauugcccua

SEQ ID NO: 157229 - RNA, 22 nt, Human
ugaguuucuuacucaggagcug

SEQ ID NO: 157230 - RNA, 23 nt, Human
uguaaaacaccguuauugcaccu

SEQ ID NO: 157231 - RNA, 22 nt, Human
uguaaagaaagacgcagaguua

SEQ ID NO: 157232 - RNA, 22 nt, Human
ugguuuacucuguaaaccagga

SEQ ID NO: 157233 - RNA, 22 nt, Human
ugguugauuaauuuugccaagc

SEQ ID NO: 157234 - RNA, 22 nt, Human
ugcacgcgcccuucgauggccc

SEQ ID NO: 157235 - RNA, 22 nt, Human
ugucuguauuugaggacauugu

SEQ ID NO: 157236 - RNA, 22 nt, Human
ugucugucugccauuuauucuc

SEQ ID NO: 157237 - RNA, 22 nt, Human
ugcaagagcccaaacuauauac

SEQ ID NO: 157238 - RNA, 23 nt, Human
ugcaaaauuugcagaguucgaug

SEQ ID NO: 157239 - RNA, 22 nt, Human
uguauuuauuuuucaacuacca

SEQ ID NO: 157240 - RNA, 22 nt, Human
ugauugcucagcuagccucuuu

SEQ ID NO: 157241 - RNA, 22 nt, Human
ugauugaauaauguuaugugaa

SEQ ID NO: 157242 - RNA, 22 nt, Human
ugauucuuugaccaaaaaauug

SEQ ID NO: 157243 - RNA, 22 nt, Human
ugucagacagggcugcagucag

SEQ ID NO: 157244 - RNA, 22 nt, Human
ugcaaaaagagcgaggagcccu

SEQ ID NO: 157245 - RNA, 22 nt, Human
ugauguauaaaaagagugaaau

SEQ ID NO: 157246 - RNA, 22 nt, Human
ugauggaucuguuggcggguuu

SEQ ID NO: 157247 - RNA, 22 nt, Human
ugaaccgacaggggaagauugu

SEQ ID NO: 157248 - RNA, 22 nt, Human
ugggaaacucuaaacuugagua

SEQ ID NO: 157249 - RNA, 22 nt, Human
uggcuuuuuauuccuaugugau

SEQ ID NO: 157250 - RNA, 22 nt, Human
ugggaaaauugugauucuuucu

SEQ ID NO: 157251 - RNA, 22 nt, Human
ugggaaaauagcuauuuugaaa

SEQ ID NO: 157252 - RNA, 22 nt, Human
ugggaugagcuauauagaaagu

SEQ ID NO: 157253 - RNA, 22 nt, Human
ugggagagaaauuuaaguuuuu

SEQ ID NO: 157254 - RNA, 22 nt, Human
ugggacaugaugcauuugaaag

SEQ ID NO: 157255 - RNA, 22 nt, Human
ugggaaggggagcuggaaagga

SEQ ID NO: 157256 - RNA, 22 nt, Human
ucuuugcauggacauguguuuu

SEQ ID NO: 157257 - RNA, 22 nt, Human
ucuuuuaucuguuguguaacaa

SEQ ID NO: 157258 - RNA, 22 nt, Human
uggccucuuucuucccuuugac

SEQ ID NO: 157259 - RNA, 22 nt, Human
ugaaagcuggcucugcagagug

SEQ ID NO: 157260 - RNA, 22 nt, Human
uggcugaugucuguucuguuau

SEQ ID NO: 157261 - RNA, 22 nt, Human
uggcuguuggagcuggaagaug

SEQ ID NO: 157262 - RNA, 22 nt, Human
uggcuucagacuucugcuacgu

SEQ ID NO: 157263 - RNA, 22 nt, Human
uggcuucuggccaggcacagga

SEQ ID NO: 157264 - RNA, 22 nt, Human
uggcuuuucaccugcuccucug

SEQ ID NO: 157265 - RNA, 22 nt, Human
ugaaauugaguaccucuuuaua

SEQ ID NO: 157266 - RNA, 21 nt, Human
ugaacaccaggagaaaucggu

SEQ ID NO: 157267 - RNA, 22 nt, Human
ugaaaggaauuuaaauguuguu

SEQ ID NO: 157268 - RNA, 22 nt, Human
ugaaauuuuuuggagauaauuu

SEQ ID NO: 157269 - RNA, 22 nt, Human
ugaaaugccucuuugguucuaa

SEQ ID NO: 157270 - RNA, 22 nt, Human
ugaagcuagguucaugaggucg

SEQ ID NO: 157271 - RNA, 22 nt, Human
ugaaggaggugaauccaugcau

SEQ ID NO: 157272 - RNA, 22 nt, Human
ugggauggacuuuagagaaucg

SEQ ID NO: 157273 - RNA, 22 nt, Human
ugggauucugaaaauggauuac

SEQ ID NO: 157274 - RNA, 21 nt, Human
ugaagggugagauauaaguga

SEQ ID NO: 157275 - RNA, 22 nt, Human
uggggcauacgugaaauaauuu

SEQ ID NO: 157276 - RNA, 21 nt, Human
uggggaugcauugcagaggca

SEQ ID NO: 157277 - RNA, 22 nt, Human
ugaaucagaccuucauugggua

SEQ ID NO: 157278 - RNA, 22 nt, Human
ugaaucaaugaauugcacuuca

SEQ ID NO: 157279 - RNA, 22 nt, Human
ugaauuuguaggaauucuccau

SEQ ID NO: 157280 - RNA, 22 nt, Human
ugaauuuuaacauucugcugga

SEQ ID NO: 157281 - RNA, 22 nt, Human
ugaauucaaacuuuuuaacaag

SEQ ID NO: 157282 - RNA, 23 nt, Human
ugacagguucuaugguuuccaac

SEQ ID NO: 157283 - RNA, 22 nt, Human
ugacagaaaccaccccccaggu

SEQ ID NO: 157284 - RNA, 22 nt, Human
ugaaugaagcacuguaauucuc

SEQ ID NO: 157285 - RNA, 22 nt, Human
uggggcuccuccuggcaggagg

SEQ ID NO: 157286 - RNA, 22 nt, Human
uggggcgccuggcugaggcugc

SEQ ID NO: 157287 - RNA, 22 nt, Human
uggggcggaaggaggagaggug

SEQ ID NO: 157288 - RNA, 22 nt, Human
ucugcggccggaauucccuuca

SEQ ID NO: 157289 - RNA, 22 nt, Human
ucugcggccuagcgcccggcgc

SEQ ID NO: 157290 - RNA, 22 nt, Human
ucugcccguucaaauccuuguu

SEQ ID NO: 157291 - RNA, 22 nt, Human
ucugccuucaggagcagacucu

SEQ ID NO: 157292 - RNA, 22 nt, Human
ucuggaaauggaaguaacuaug

SEQ ID NO: 157293 - RNA, 22 nt, Human
uggaacuuccucacuuucccuc

SEQ ID NO: 157294 - RNA, 22 nt, Human
uggaagaaaacuuggaaggcau

SEQ ID NO: 157295 - RNA, 22 nt, Human
uggaaagaagacugugguugag

SEQ ID NO: 157296 - RNA, 22 nt, Human
uggaaaggaguucuguuuauuu

SEQ ID NO: 157297 - RNA, 22 nt, Human
uggaaaguuggaagucucagga

SEQ ID NO: 157298 - RNA, 22 nt, Human
ugcugccucugaauggagcagu

SEQ ID NO: 157299 - RNA, 22 nt, Human
ugcugccgccgccaccgccgcc

SEQ ID NO: 157300 - RNA, 22 nt, Human
uggagcuuuguguauuuuuaau

SEQ ID NO: 157301 - RNA, 22 nt, Human
uggagcugguucuggggaagcu

SEQ ID NO: 157302 - RNA, 22 nt, Human
uggaggauaacacaagaaguga

SEQ ID NO: 157303 - RNA, 22 nt, Human
uggagcugaaguacucucacua

SEQ ID NO: 157304 - RNA, 22 nt, Human
ucuguaaaugcaaguuuuccuc

SEQ ID NO: 157305 - RNA, 22 nt, Human
uggaagcccagaaggaagcaga

SEQ ID NO: 157306 - RNA, 22 nt, Human
uggaaggggagcuggaaagggg

SEQ ID NO: 157307 - RNA, 22 nt, Human
uggacacugguggauauggaau

SEQ ID NO: 157308 - RNA, 22 nt, Human
uggagaaauaacauuuggauuc

SEQ ID NO: 157309 - RNA, 22 nt, Human
ucuuuauuucccuaacuugcua

SEQ ID NO: 157310 - RNA, 22 nt, Human
uggccauuuacucuguaagagu

SEQ ID NO: 157311 - RNA, 22 nt, Human
uggcagccugcgugaaggagcu

SEQ ID NO: 157312 - RNA, 22 nt, Human
uggcagcucauuuggaaaugga

SEQ ID NO: 157313 - RNA, 22 nt, Human
uggaguuuauuugaauucuugg

SEQ ID NO: 157314 - RNA, 22 nt, Human
ucuuaaauaugaaaaggauuau

SEQ ID NO: 157315 - RNA, 22 nt, Human
uggauauagcugaggugucuug

SEQ ID NO: 157316 - RNA, 22 nt, Human
uggcacugaagcuggaaagccu

SEQ ID NO: 157317 - RNA, 22 nt, Human
uggcagcauuuuuuccagaaca

SEQ ID NO: 157318 - RNA, 22 nt, Human
ucuucaguaaucgacauuccac

SEQ ID NO: 157319 - RNA, 22 nt, Human
uggcacugcccugucucggugg

SEQ ID NO: 157320 - RNA, 23 nt, Human
ugccggaucuacuuuggguucuc

SEQ ID NO: 157321 - RNA, 22 nt, Human
ugccgcaggaggggcgauuucu

SEQ ID NO: 157322 - RNA, 22 nt, Human
ugccgccccggggcccccagcc

SEQ ID NO: 157323 - RNA, 22 nt, Human
uccuuccucuuucaaauuuguu

SEQ ID NO: 157324 - RNA, 20 nt, Human
uccugaaauuacgugauuca

SEQ ID NO: 157325 - RNA, 22 nt, Human
ugcccaaucaauuguagcuauu

SEQ ID NO: 157326 - RNA, 22 nt, Human
ugccaucaugucagauuuggga

SEQ ID NO: 157327 - RNA, 22 nt, Human
ugccauauuuugaggauguaca

SEQ ID NO: 157328 - RNA, 22 nt, Human
ugccagcuccgaggagcugcag

SEQ ID NO: 157329 - RNA, 22 nt, Human
ugccagucggcacuuuaucugg

SEQ ID NO: 157330 - RNA, 22 nt, Human
ugcauucugggucgcagagugg

SEQ ID NO: 157331 - RNA, 22 nt, Human
ugccaaugauuccacaauggaa

SEQ ID NO: 157332 - RNA, 22 nt, Human
ucccuuucuucuugguccaccu

SEQ ID NO: 157333 - RNA, 23 nt, Human
ucccuuuguucuugcuaggaugu

SEQ ID NO: 157334 - RNA, 22 nt, Human
ugcauguuucuguauguuaaug

SEQ ID NO: 157335 - RNA, 21 nt, Human
ugcuaagugucacaugucugc

SEQ ID NO: 157336 - RNA, 22 nt, Human
ugcggugcagcccugcccucuc

SEQ ID NO: 157337 - RNA, 22 nt, Human
ugcggugcgcccgggcgagugc

SEQ ID NO: 157338 - RNA, 22 nt, Human
ucgcccagguuggagugcagug

SEQ ID NO: 157339 - RNA, 22 nt, Human
ugcggcucaaagggaaggccuu

SEQ ID NO: 157340 - RNA, 22 nt, Human
ugccuuuuguguuuggcuaauc

SEQ ID NO: 157341 - RNA, 22 nt, Human
ucggcgaccugucauggaccaa

SEQ ID NO: 157342 - RNA, 22 nt, Human
ugcucgauuauuucauuuugca

SEQ ID NO: 157343 - RNA, 22 nt, Human
ugcuauuaagagaaagugaaca

SEQ ID NO: 157344 - RNA, 22 nt, Human
ugcuaucuagaaauacuggguu

SEQ ID NO: 157345 - RNA, 22 nt, Human
ucguguuggaacugcuuuguaa

SEQ ID NO: 157346 - RNA, 22 nt, Human
ucgugaagaaauguggacuuca

SEQ ID NO: 157347 - RNA, 22 nt, Human
ucuaaaaauuagaaauuagguc

SEQ ID NO: 157348 - RNA, 22 nt, Human
ucguuucuuuuucuucccugga

SEQ ID NO: 157349 - RNA, 22 nt, Human
ugcucuuuguagcugcuuugcu

SEQ ID NO: 157350 - RNA, 22 nt, Human
ucggccuuuucuuauacccaca

SEQ ID NO: 157351 - RNA, 23 nt, Human
ugcucgccuucaggacuugggcu

SEQ ID NO: 157352 - RNA, 17 nt, Human
ucccacuucauuuucca

SEQ ID NO: 157353 - RNA, 22 nt, Human
ucccagaaccuuuuagcuucac

SEQ ID NO: 157354 - RNA, 22 nt, Human
ugcagaauauucuggugacaau

SEQ ID NO: 157355 - RNA, 22 nt, Human
ugcagacuguuucuugacugaa

SEQ ID NO: 157356 - RNA, 18 nt, Human
ugcagcuuugugauuggc

SEQ ID NO: 157357 - RNA, 22 nt, Human
ugcagcagaauauggcugcagg

SEQ ID NO: 157358 - RNA, 22 nt, Human
ugcagccuuuguccuugggcua

SEQ ID NO: 157359 - RNA, 22 nt, Human
ugcagccucacgcauccgcauu

SEQ ID NO: 157360 - RNA, 21 nt, Human
ugcaaugcauugacagcagca

SEQ ID NO: 157361 - RNA, 22 nt, Human
ugcaaugagcuucuuugauaaa

SEQ ID NO: 157362 - RNA, 22 nt, Human
ugcaaggcacccacucugcuuu

SEQ ID NO: 157363 - RNA, 22 nt, Human
ugcaacuacccccaggauuuua

SEQ ID NO: 157364 - RNA, 22 nt, Human
ugauucacgcuucucuuuaaac

SEQ ID NO: 157365 - RNA, 22 nt, Human
ugauuuggcaucaguguauccu

SEQ ID NO: 157366 - RNA, 22 nt, Human
ugauuugauuuguuuaugccug

SEQ ID NO: 157367 - RNA, 22 nt, Human
uccagaaaucucuguugauugu

SEQ ID NO: 157368 - RNA, 22 nt, Human
uccacuuaauagguauggagcc

SEQ ID NO: 157369 - RNA, 22 nt, Human
uccacagugguggaauuguuca

SEQ ID NO: 157370 - RNA, 22 nt, Human
uccacgcucuuucuacuuuuca

SEQ ID NO: 157371 - RNA, 22 nt, Human
ugcaaaaguuuuauacacagau

SEQ ID NO: 157372 - RNA, 22 nt, Human
ugcaaauuuuuuuauuuuuccu

SEQ ID NO: 157373 - RNA, 22 nt, Human
ugauuuguuuaaauugcucguu

SEQ ID NO: 157374 - RNA, 22 nt, Human
uccagguucaguucaucaucua

SEQ ID NO: 157375 - RNA, 22 nt, Human
ugaugcuagaacuuccaagaua

SEQ ID NO: 157376 - RNA, 22 nt, Human
uccaaauagcuggaugauggug

SEQ ID NO: 157377 - RNA, 22 nt, Human
uccaacuuaauugggaagauua

SEQ ID NO: 157378 - RNA, 21 nt, Human
uccaaaggagacugagugugu

SEQ ID NO: 157379 - RNA, 22 nt, Human
ucauuauuuugauguauuuccu

SEQ ID NO: 157380 - RNA, 20 nt, Human
ucauucagaaucaguaugca

SEQ ID NO: 157381 - RNA, 22 nt, Human
ucauuguuuacugucuuuuuuc

SEQ ID NO: 157382 - RNA, 22 nt, Human
ucauuguuucugcuuuucauga

SEQ ID NO: 157383 - RNA, 20 nt, Human
ugauaggcauugacauaagg

SEQ ID NO: 157384 - RNA, 22 nt, Human
ugagugggaggugggaagggua

SEQ ID NO: 157385 - RNA, 22 nt, Human
ugaguugcagucaauauugcaa

SEQ ID NO: 157386 - RNA, 22 nt, Human
ugauagcaugcucucaguaaaa

SEQ ID NO: 157387 - RNA, 22 nt, Human
ugaguuuuggaagauguuacag

SEQ ID NO: 157388 - RNA, 23 nt, Human
ugaggucuuggaaguucuguuug

SEQ ID NO: 157389 - RNA, 22 nt, Human
ugacuuuucuccucugaaguuu

SEQ ID NO: 157390 - RNA, 22 nt, Human
ugagggagggggagccguucua

SEQ ID NO: 157391 - RNA, 22 nt, Human
uagugggauuuugaacaaaacc

SEQ ID NO: 157392 - RNA, 21 nt, Human
ucuagaccuugggcagucacu

SEQ ID NO: 157393 - RNA, 22 nt, Human
ucuucccgggcaucucugcuca

SEQ ID NO: 157394 - RNA, 22 nt, Human
ucuuccuuguaagggcuuuaga

SEQ ID NO: 157395 - RNA, 22 nt, Human
ucuugcuggagucaaggcuaca

SEQ ID NO: 157396 - RNA, 22 nt, Human
ucuuggcaguucuugugcuuuu

SEQ ID NO: 157397 - RNA, 22 nt, Human
ucuugucacagcuugacuccua

SEQ ID NO: 157398 - RNA, 22 nt, Human
ucuugugagcugagauaaagcc

SEQ ID NO: 157399 - RNA, 22 nt, Human
ucuuucucauccaaacuaguug

SEQ ID NO: 157400 - RNA, 23 nt, Human
ucuuuccuuucauacagucagcu

SEQ ID NO: 157401 - RNA, 22 nt, Human
ucuuuaaauucuuaugagugaa

SEQ ID NO: 157402 - RNA, 22 nt, Human
ucuuuguuagucagaauugauc

SEQ ID NO: 157403 - RNA, 20 nt, Human
uauuucaaugugccaaguuu

SEQ ID NO: 157404 - RNA, 22 nt, Human
uauuguuuuaagguguauuaau

SEQ ID NO: 157405 - RNA, 22 nt, Human
uauuuaaagucagcaacuuuuc

SEQ ID NO: 157406 - RNA, 18 nt, Human
uauuuacuguguguuacc

SEQ ID NO: 157407 - RNA, 22 nt, Human
ugaacuggauuugugagcuccu

SEQ ID NO: 157408 - RNA, 22 nt, Human
ugaaccgcuucauggugccugu

SEQ ID NO: 157409 - RNA, 22 nt, Human
ucaaagaucuuugcuuuugggg

SEQ ID NO: 157410 - RNA, 22 nt, Human
ucaaauaugggccagaggaaau

SEQ ID NO: 157411 - RNA, 22 nt, Human
ugaagacaguuuuacucaugag

SEQ ID NO: 157412 - RNA, 22 nt, Human
uauuuuuuuaacauuuauugua

SEQ ID NO: 157413 - RNA, 21 nt, Human
ugaagccuagagaauugggga

SEQ ID NO: 157414 - RNA, 21 nt, Human
ugaagcccugugaggugcuua

SEQ ID NO: 157415 - RNA, 22 nt, Human
ugaagccaugcuaaauguuaca

SEQ ID NO: 157416 - RNA, 21 nt, Human
ucaaccagguguugaaggcac

SEQ ID NO: 157417 - RNA, 22 nt, Human
uauuuuggaugcauugagaugc

SEQ ID NO: 157418 - RNA, 22 nt, Human
uauuuucucugccacacuucca

SEQ ID NO: 157419 - RNA, 22 nt, Human
uauuuugaggugaaagaguuug

SEQ ID NO: 157420 - RNA, 22 nt, Human
uauuuuauuuagguuuaguugu

SEQ ID NO: 157421 - RNA, 22 nt, Human
uauuuuagaagauuuggagaaa

SEQ ID NO: 157422 - RNA, 22 nt, Human
uauuuuagccaacagaaugaug

SEQ ID NO: 157423 - RNA, 22 nt, Human
ugaaaaauauuuuuagaaauaa

SEQ ID NO: 157424 - RNA, 22 nt, Human
ugaaauguggagaugguaagua

SEQ ID NO: 157425 - RNA, 22 nt, Human
uauuuguuucuaguggcagcaa

SEQ ID NO: 157426 - RNA, 22 nt, Human
ucuuuugaacauccaggauguc

SEQ ID NO: 157427 - RNA, 22 nt, Human
uauuucaucugaacuucccaac

SEQ ID NO: 157428 - RNA, 22 nt, Human
ugacguuugcgccgcgcacgac

SEQ ID NO: 157429 - RNA, 22 nt, Human
ucagcaguuaagcuucccugcc

SEQ ID NO: 157430 - RNA, 23 nt, Human
ucagccgcuggcgaguccacugg

SEQ ID NO: 157431 - RNA, 22 nt, Human
ugacgcauggccagcucugucu

SEQ ID NO: 157432 - RNA, 22 nt, Human
ugacgggacacaggugccaaca

SEQ ID NO: 157433 - RNA, 22 nt, Human
ugaccucaagcaugcggagggc

SEQ ID NO: 157434 - RNA, 22 nt, Human
ucagauaauccaauagagagga

SEQ ID NO: 157435 - RNA, 22 nt, Human
ucagcguuaguuuuucaucuaa

SEQ ID NO: 157436 - RNA, 22 nt, Human
ucagccuugguuuugguguugg

SEQ ID NO: 157437 - RNA, 22 nt, Human
ucaggcaggaucccagggaagg

SEQ ID NO: 157438 - RNA, 22 nt, Human
ucaggacacuuaauaggaacag

SEQ ID NO: 157439 - RNA, 22 nt, Human
ucagaacucuagucucagccug

SEQ ID NO: 157440 - RNA, 22 nt, Human
ugacagaggagcuggaaugauu

SEQ ID NO: 157441 - RNA, 22 nt, Human
ucacuuuacaucuguaaaagga

SEQ ID NO: 157442 - RNA, 22 nt, Human
ucacuauagugccgaggacuga

SEQ ID NO: 157443 - RNA, 22 nt, Human
ugaauuucuuuuuaaaauauua

SEQ ID NO: 157444 - RNA, 22 nt, Human
ugaauuuuggcaauuuucugug

SEQ ID NO: 157445 - RNA, 23 nt, Human
ucagaccaaccucuugcuggaac

SEQ ID NO: 157446 - RNA, 22 nt, Human
ucagagaaguaggcuaauggug

SEQ ID NO: 157447 - RNA, 22 nt, Human
ugacaucuagauaaaugggaca

SEQ ID NO: 157448 - RNA, 18 nt, Human
ucagaaugauuuggugga

SEQ ID NO: 157449 - RNA, 22 nt, Human
ucagagacaucagguuguagca

SEQ ID NO: 157450 - RNA, 21 nt, Human
ucagaccaacucuuguauccu

SEQ ID NO: 157451 - RNA, 22 nt, Human
ugacauccuacaccccuggguc

SEQ ID NO: 157452 - RNA, 22 nt, Human
ugacagugugcccggagguuag

SEQ ID NO: 157453 - RNA, 22 nt, Human
ugaauguggucaggaaauuguu

SEQ ID NO: 157454 - RNA, 22 nt, Human
ugaauuacacugggaucagggc

SEQ ID NO: 157455 - RNA, 22 nt, Human
ucaagguauuauuuuuguggug

SEQ ID NO: 157456 - RNA, 22 nt, Human
ugaaucugagccugcgcaaagu

SEQ ID NO: 157457 - RNA, 22 nt, Human
ugaagguggcuugcagcuaguc

SEQ ID NO: 157458 - RNA, 22 nt, Human
ugaauaaauaaacuuuuacuac

SEQ ID NO: 157459 - RNA, 22 nt, Human
ugaaguuuagaaaaagugccuu

SEQ ID NO: 157460 - RNA, 22 nt, Human
ugaaggccagggauuugcagcc

SEQ ID NO: 157461 - RNA, 22 nt, Human
ucaagagauauaugcugguuua

SEQ ID NO: 157462 - RNA, 22 nt, Human
ucaagaagauaaugucuagggu

SEQ ID NO: 157463 - RNA, 22 nt, Human
ugaagcuaguauuaacucagau

SEQ ID NO: 157464 - RNA, 22 nt, Human
uauucccacuccucagcaauuu

SEQ ID NO: 157465 - RNA, 22 nt, Human
guuccgcggccucgcgcugagc

SEQ ID NO: 157466 - RNA, 22 nt, Human
guucccuugccuuuaguuugau

SEQ ID NO: 157467 - RNA, 22 nt, Human
guucagauucuuucucuuucac

SEQ ID NO: 157468 - RNA, 22 nt, Human
uauuaaaagagaaaaagccacc

SEQ ID NO: 157469 - RNA, 22 nt, Human
guuauugggagagggaauggga

SEQ ID NO: 157470 - RNA, 22 nt, Human
guuauuuugucuuguucaugaa

SEQ ID NO: 157471 - RNA, 22 nt, Human
uauguacauauauguguauaua

SEQ ID NO: 157472 - RNA, 22 nt, Human
uauggcuucucagucaugaaaa

SEQ ID NO: 157473 - RNA, 22 nt, Human
uauggcucacaaauaauaaauu

SEQ ID NO: 157474 - RNA, 22 nt, Human
guuccucucacaggcuggagcu

SEQ ID NO: 157475 - RNA, 22 nt, Human
uauugucuuuuucuuccaccug

SEQ ID NO: 157476 - RNA, 22 nt, Human
uauuucaguuaagaugagguca

SEQ ID NO: 157477 - RNA, 22 nt, Human
uauuuaugcaucacuuuuuucc

SEQ ID NO: 157478 - RNA, 22 nt, Human
uauuuaggcagaaagugauauu

SEQ ID NO: 157479 - RNA, 18 nt, Human
uauuugugugugugugug

SEQ ID NO: 157480 - RNA, 22 nt, Human
uauuugauggaacucuugcuuu

SEQ ID NO: 157481 - RNA, 22 nt, Human
uauuuguauugucuuaucacuu

SEQ ID NO: 157482 - RNA, 22 nt, Human
uauuucuagggcaugaaaauaa

SEQ ID NO: 157483 - RNA, 22 nt, Human
uauuucaugagugaauaucuag

SEQ ID NO: 157484 - RNA, 22 nt, Human
guugauuuaaccucaccuuuga

SEQ ID NO: 157485 - RNA, 22 nt, Human
uauaugcacucagguguaugug

SEQ ID NO: 157486 - RNA, 22 nt, Human
uauaugcagauuuucaucaucg

SEQ ID NO: 157487 - RNA, 22 nt, Human
uaucuguauuguagaacuguug

SEQ ID NO: 157488 - RNA, 22 nt, Human
gugugguguuaagcaaauuaau

SEQ ID NO: 157489 - RNA, 22 nt, Human
uaugcagauaguuugccauuca

SEQ ID NO: 157490 - RNA, 22 nt, Human
guguguauguagguauauaugu

SEQ ID NO: 157491 - RNA, 22 nt, Human
uaugagguuaucuaugucguau

SEQ ID NO: 157492 - RNA, 22 nt, Human
uaugaccuuaggaagcaagaag

SEQ ID NO: 157493 - RNA, 22 nt, Human
uagcauccugugugaauguauu

SEQ ID NO: 157494 - RNA, 23 nt, Human
uaguuucaucuccacccugcccu

SEQ ID NO: 157495 - RNA, 22 nt, Human
uaguuucuucaacugucccagc

SEQ ID NO: 157496 - RNA, 22 nt, Human
uauaaucuugcccauaguauuu

SEQ ID NO: 157497 - RNA, 22 nt, Human
uauaagaaaagucauuaucaaa

SEQ ID NO: 157498 - RNA, 22 nt, Human
uauauauacauauagaauaugu

SEQ ID NO: 157499 - RNA, 22 nt, Human
guuguugucauuagcuguuuaa

SEQ ID NO: 157500 - RNA, 22 nt, Human
guuguugcuauguuauuguuau

SEQ ID NO: 157501 - RNA, 22 nt, Human
guuguuaagugcugguuguuag

SEQ ID NO: 157502 - RNA, 21 nt, Human
ucaaguccuggcuuugcucuu

SEQ ID NO: 157503 - RNA, 22 nt, Human
ucaagggaccaagcauucauua

SEQ ID NO: 157504 - RNA, 22 nt, Human
guugauuuaggguuuugguuuu

SEQ ID NO: 157505 - RNA, 22 nt, Human
uauuuuggcuccugagcucuga

SEQ ID NO: 157506 - RNA, 22 nt, Human
uauuuuuaccuaauuuaugaga

SEQ ID NO: 157507 - RNA, 22 nt, Human
uauuuuuacuguuugaugauuc

SEQ ID NO: 157508 - RNA, 22 nt, Human
ucaauuuauguggcuauucauu

SEQ ID NO: 157509 - RNA, 22 nt, Human
guuguuuuuguuaaaacaguga

SEQ ID NO: 157510 - RNA, 22 nt, Human
guuguuuucagcccagcauuag

SEQ ID NO: 157511 - RNA, 22 nt, Human
guuuauucuuuuauuugugaga

SEQ ID NO: 157512 - RNA, 22 nt, Human
guuugagcaaucccucuauccc

SEQ ID NO: 157513 - RNA, 22 nt, Human
guuugaacagaaggguugauca

SEQ ID NO: 157514 - RNA, 22 nt, Human
guuucuguguugauugugcccu

SEQ ID NO: 157515 - RNA, 22 nt, Human
guuuauuucuuaucaucacuau

SEQ ID NO: 157516 - RNA, 22 nt, Human
guuuggguggcuagagaaagaa

SEQ ID NO: 157517 - RNA, 22 nt, Human
ucacuuccuugcagcuguagaa

SEQ ID NO: 157518 - RNA, 22 nt, Human
ucagcucacaauguugagaaag

SEQ ID NO: 157519 - RNA, 22 nt, Human
ucagcaggugcuuuguuuacuc

SEQ ID NO: 157520 - RNA, 22 nt, Human
ucagaaacuaaauguggauuug

SEQ ID NO: 157521 - RNA, 22 nt, Human
guuugggauucuagacaaaaau

SEQ ID NO: 157522 - RNA, 22 nt, Human
guuugguucucauuguuuuucu

SEQ ID NO: 157523 - RNA, 22 nt, Human
ucagaagguacugaagacaugg

SEQ ID NO: 157524 - RNA, 22 nt, Human
guuuuauguuuuauagacacaa

SEQ ID NO: 157525 - RNA, 22 nt, Human
guuuuuaguuuaaguuuuugca

SEQ ID NO: 157526 - RNA, 22 nt, Human
guuuuucuagaaaucuccuccu

SEQ ID NO: 157527 - RNA, 22 nt, Human
ucagagagagagaggcggaaga

SEQ ID NO: 157528 - RNA, 22 nt, Human
guuuuguucaugaacauugggu

SEQ ID NO: 157529 - RNA, 22 nt, Human
guuuuuacuuccaaugcuauga

SEQ ID NO: 157530 - RNA, 22 nt, Human
guuuugaugugauuucucaugu

SEQ ID NO: 157531 - RNA, 22 nt, Human
guuuugaagagaagcaagucug

SEQ ID NO: 157532 - RNA, 22 nt, Human
uagaaugggaggggaaucaucc

SEQ ID NO: 157533 - RNA, 22 nt, Human
uagagaaauuacagcuuucuuu

SEQ ID NO: 157534 - RNA, 22 nt, Human
uccucuccaggugagccgaaau

SEQ ID NO: 157535 - RNA, 22 nt, Human
uccuagaccuacugaaucagac

SEQ ID NO: 157536 - RNA, 22 nt, Human
uagcauuuauugggcuagcaaa

SEQ ID NO: 157537 - RNA, 22 nt, Human
uagcauuucacugaucuucacu

SEQ ID NO: 157538 - RNA, 22 nt, Human
uccugaaugguguaauagguuu

SEQ ID NO: 157539 - RNA, 22 nt, Human
uccucuucucuagagccggaau

SEQ ID NO: 157540 - RNA, 22 nt, Human
uagauuguaagcuccuugaggg

SEQ ID NO: 157541 - RNA, 22 nt, Human
uccugcccuguccuugccucug

SEQ ID NO: 157542 - RNA, 22 nt, Human
uccuuuucuuugaggaaggugu

SEQ ID NO: 157543 - RNA, 22 nt, Human
uagucggcuaggagggccuucu

SEQ ID NO: 157544 - RNA, 22 nt, Human
ucuaaagcuccuuccacuaaaa

SEQ ID NO: 157545 - RNA, 22 nt, Human
ucgggggaaccggcccgggccu

SEQ ID NO: 157546 - RNA, 22 nt, Human
ucgggggucgggcggcggucca

SEQ ID NO: 157547 - RNA, 22 nt, Human
ucgggaggaggcggagcucguu

SEQ ID NO: 157548 - RNA, 21 nt, Human
ucgggcggcggcugaggcggc

SEQ ID NO: 157549 - RNA, 22 nt, Human
ucguccaauaaccugccagcgc

SEQ ID NO: 157550 - RNA, 22 nt, Human
ucgucaaaguaaugucauagca

SEQ ID NO: 157551 - RNA, 22 nt, Human
ucggccggagggggcgggcgca

SEQ ID NO: 157552 - RNA, 22 nt, Human
ucggauuggggaugggugggag

SEQ ID NO: 157553 - RNA, 22 nt, Human
uaggcauguaaaagugaguucg

SEQ ID NO: 157554 - RNA, 22 nt, Human
ucgacuccauuuuucuugguuc

SEQ ID NO: 157555 - RNA, 22 nt, Human
ucgagaccagcuagaaggaagu

SEQ ID NO: 157556 - RNA, 22 nt, Human
ucgaaacuucucauuuaucugu

SEQ ID NO: 157557 - RNA, 22 nt, Human
uaggcaaguggaccagagguuu

SEQ ID NO: 157558 - RNA, 22 nt, Human
ucgccauguacaugaagggcgg

SEQ ID NO: 157559 - RNA, 22 nt, Human
ucgcucgcuggcuccugcccgc

SEQ ID NO: 157560 - RNA, 22 nt, Human
ucgcgcgugccacgcgccgcgg

SEQ ID NO: 157561 - RNA, 22 nt, Human
uaccgaagcugcuuuugcaugu

SEQ ID NO: 157562 - RNA, 20 nt, Human
uacccgcagcugggucuggc

SEQ ID NO: 157563 - RNA, 22 nt, Human
uaccgcagagucauugugagga

SEQ ID NO: 157564 - RNA, 22 nt, Human
uccagccauaucuuguagcccu

SEQ ID NO: 157565 - RNA, 22 nt, Human
uacucauuggagaauuacgagg

SEQ ID NO: 157566 - RNA, 22 nt, Human
ucccaccugcuaagauguaucc

SEQ ID NO: 157567 - RNA, 22 nt, Human
ucccaauuuacuagaugaauga

SEQ ID NO: 157568 - RNA, 22 nt, Human
ucccaaguguuuggcgaggaga

SEQ ID NO: 157569 - RNA, 21 nt, Human
uacugugccagggcagcucug

SEQ ID NO: 157570 - RNA, 22 nt, Human
uacuggaugcaacaaagcccag

SEQ ID NO: 157571 - RNA, 22 nt, Human
uacugguguauuucuucuuauu

SEQ ID NO: 157572 - RNA, 22 nt, Human
ucccaaaacuugaagcaagccu

SEQ ID NO: 157573 - RNA, 22 nt, Human
uaccauaaagcaggcaaaugag

SEQ ID NO: 157574 - RNA, 22 nt, Human
uccagaaagccguugacuuauu

SEQ ID NO: 157575 - RNA, 22 nt, Human
uccacuuaaaacucuuuuuguc

SEQ ID NO: 157576 - RNA, 22 nt, Human
uacauuugauuuuugcuucuuu

SEQ ID NO: 157577 - RNA, 22 nt, Human
uacauuccagaaaguuucugua

SEQ ID NO: 157578 - RNA, 20 nt, Human
uccacugagcgucacggcag

SEQ ID NO: 157579 - RNA, 22 nt, Human
uccacuaucugagcuuaguugc

SEQ ID NO: 157580 - RNA, 22 nt, Human
uccacuaucagaccuguagucu

SEQ ID NO: 157581 - RNA, 22 nt, Human
uacauagaauauauaaaugucg

SEQ ID NO: 157582 - RNA, 22 nt, Human
uacauaauucauuagcuccucu

SEQ ID NO: 157583 - RNA, 22 nt, Human
uaagcacuuuauaugcuuuauc

SEQ ID NO: 157584 - RNA, 22 nt, Human
uaaggcuuuggucaccauggag

SEQ ID NO: 157585 - RNA, 22 nt, Human
uaaguaauugugguuuuugcca

SEQ ID NO: 157586 - RNA, 22 nt, Human
ucaucuuucuuuauggaaauac

SEQ ID NO: 157587 - RNA, 22 nt, Human
uaagaaacauuuuuaugacagu

SEQ ID NO: 157588 - RNA, 23 nt, Human
uaaagauaguuuaaaggugaguu

SEQ ID NO: 157589 - RNA, 22 nt, Human
uaagaauguuuguugaguaaau

SEQ ID NO: 157590 - RNA, 22 nt, Human
ucauucucucguauucgcgaau

SEQ ID NO: 157591 - RNA, 22 nt, Human
uccaaauucccaugacagaagu

SEQ ID NO: 157592 - RNA, 22 nt, Human
uacaaauuguuuugccacaaag

SEQ ID NO: 157593 - RNA, 22 nt, Human
ucauuguguaguagagguggca

SEQ ID NO: 157594 - RNA, 22 nt, Human
uacugaagaugccaucacaagc

SEQ ID NO: 157595 - RNA, 22 nt, Human
uacugaaagagugguggacucu

SEQ ID NO: 157596 - RNA, 22 nt, Human
uacugccauuauccugcugaaa

SEQ ID NO: 157597 - RNA, 22 nt, Human
gugaagcaagggucaccugugg

SEQ ID NO: 157598 - RNA, 22 nt, Human
gugaaaauaguaaccuggcuag

SEQ ID NO: 157599 - RNA, 23 nt, Human
uacagccaugucgcugauuuaac

SEQ ID NO: 157600 - RNA, 21 nt, Human
uacagcucaucaauuacugcu

SEQ ID NO: 157601 - RNA, 22 nt, Human
uacuauuuugacaugaaauuga

SEQ ID NO: 157602 - RNA, 22 nt, Human
uacaaaugaucaucucuuugaa

SEQ ID NO: 157603 - RNA, 22 nt, Human
uacaaauguuucuucuccuuuu

SEQ ID NO: 157604 - RNA, 22 nt, Human
uacaaauugccugacggcaggu

SEQ ID NO: 157605 - RNA, 22 nt, Human
uaauaguugaaggucaucacua

SEQ ID NO: 157606 - RNA, 22 nt, Human
uaauagauagggagaguugcug

SEQ ID NO: 157607 - RNA, 22 nt, Human
uaauaaaaauuuaauucacauu

SEQ ID NO: 157608 - RNA, 22 nt, Human
uaauaauuaacagugauggguc

SEQ ID NO: 157609 - RNA, 21 nt, Human
uaauaauugggggcagggugg

SEQ ID NO: 157610 - RNA, 22 nt, Human
gguguauucuccaguuuuagca

SEQ ID NO: 157611 - RNA, 22 nt, Human
gucugaaauaucuuuugucuug

SEQ ID NO: 157612 - RNA, 22 nt, Human
gucugcagcacugugcacgguc

SEQ ID NO: 157613 - RNA, 22 nt, Human
gucugccagauucugcuggauc

SEQ ID NO: 157614 - RNA, 20 nt, Human
gugcggcucuaccacucggu

SEQ ID NO: 157615 - RNA, 22 nt, Human
gugccuggaaucuuuucuucac

SEQ ID NO: 157616 - RNA, 22 nt, Human
uagauuccaaaauaguuugguu

SEQ ID NO: 157617 - RNA, 22 nt, Human
gugccgcuggagcuggaauuga

SEQ ID NO: 157618 - RNA, 22 nt, Human
gugccgaugaggccuggcauuc

SEQ ID NO: 157619 - RNA, 22 nt, Human
gugcagcugguggagucugggg

SEQ ID NO: 157620 - RNA, 22 nt, Human
uagacauuuacuuugaaaaaau

SEQ ID NO: 157621 - RNA, 22 nt, Human
gugaguugugugaguaagcaga

SEQ ID NO: 157622 - RNA, 22 nt, Human
uagaaauaaacacugcuaccuu

SEQ ID NO: 157623 - RNA, 22 nt, Human
gugaugaagguggagaaucaga

SEQ ID NO: 157624 - RNA, 22 nt, Human
gugauuucagguuuuucauacu

SEQ ID NO: 157625 - RNA, 22 nt, Human
gguugccuguggcucccuguua

SEQ ID NO: 157626 - RNA, 22 nt, Human
uaaagaagaaaaggcuucaggc

SEQ ID NO: 157627 - RNA, 22 nt, Human
gguucuggaaaagaaagcaaag

SEQ ID NO: 157628 - RNA, 22 nt, Human
gguuauuucugauuauaugaua

SEQ ID NO: 157629 - RNA, 22 nt, Human
gguuuaucuuuacaaaugaaau

SEQ ID NO: 157630 - RNA, 22 nt, Human
uaaagcacucaaaauuguagcu

SEQ ID NO: 157631 - RNA, 22 nt, Human
guaaauacuaugagauaaugaa

SEQ ID NO: 157632 - RNA, 22 nt, Human
uaaaugagcaccucuaguuuug

SEQ ID NO: 157633 - RNA, 22 nt, Human
uaaaugcucuuuaaaagugcuu

SEQ ID NO: 157634 - RNA, 22 nt, Human
gguggcuucuguuugcaagagg

SEQ ID NO: 157635 - RNA, 22 nt, Human
guuuucuccugcuauacagugc

SEQ ID NO: 157636 - RNA, 22 nt, Human
ggugggaauccaggccuucauc

SEQ ID NO: 157637 - RNA, 22 nt, Human
guuuuguagucuggagacuguc

SEQ ID NO: 157638 - RNA, 22 nt, Human
guuuugauggaguguguuaaau

SEQ ID NO: 157639 - RNA, 22 nt, Human
guuuucuuguuaauuuugaacg

SEQ ID NO: 157640 - RNA, 22 nt, Human
ggucaaauaugaguaauuuccu

SEQ ID NO: 157641 - RNA, 22 nt, Human
guuuuaucuauguaauuauaaa

SEQ ID NO: 157642 - RNA, 22 nt, Human
uaacauuuaguuuuaagauggu

SEQ ID NO: 157643 - RNA, 22 nt, Human
guaggaaaugaauaagguaccu

SEQ ID NO: 157644 - RNA, 22 nt, Human
uaaccuugaagacugagcugac

SEQ ID NO: 157645 - RNA, 22 nt, Human
uaaccuuuuuuaaaguuuccug

SEQ ID NO: 157646 - RNA, 23 nt, Human
uaaauuuuauucugauaacacag

SEQ ID NO: 157647 - RNA, 23 nt, Human
uaacacaguccuggucuuuggcc

SEQ ID NO: 157648 - RNA, 22 nt, Human
guaguuuuugagcuguaaucuu

SEQ ID NO: 157649 - RNA, 22 nt, Human
uaacucuagggacucgcccaga

SEQ ID NO: 157650 - RNA, 22 nt, Human
uaacuuuucuguucaauuuucc

SEQ ID NO: 157651 - RNA, 22 nt, Human
guaucaggugugagcauuuuaa

SEQ ID NO: 157652 - RNA, 22 nt, Human
uaacuuuuuauccuguuaaaug

SEQ ID NO: 157653 - RNA, 22 nt, Human
guaucugaaaaagaauucugac

SEQ ID NO: 157654 - RNA, 21 nt, Human
uaaggaagagcauuuuagguc

SEQ ID NO: 157655 - RNA, 22 nt, Human
guggagaaagcuggaaucugag

SEQ ID NO: 157656 - RNA, 22 nt, Human
guggagaugagauauaccccuu

SEQ ID NO: 157657 - RNA, 22 nt, Human
guggagaucuggugcccccugg

SEQ ID NO: 157658 - RNA, 22 nt, Human
guggagauauuugugauagggg

SEQ ID NO: 157659 - RNA, 22 nt, Human
gggccgcagccucuccggccug

SEQ ID NO: 157660 - RNA, 22 nt, Human
gggccggcuggggcggggcggg

SEQ ID NO: 157661 - RNA, 22 nt, Human
gggccggagaagguagcugaag

SEQ ID NO: 157662 - RNA, 22 nt, Human
guggaaauuuuaggaucaucuu

SEQ ID NO: 157663 - RNA, 22 nt, Human
guggaaauaugggcaacaaaga

SEQ ID NO: 157664 - RNA, 22 nt, Human
guggaagauauuucugguccag

SEQ ID NO: 157665 - RNA, 22 nt, Human
guggaaggaauuaacagacuag

SEQ ID NO: 157666 - RNA, 22 nt, Human
gggcaguuucaugugguucaac

SEQ ID NO: 157667 - RNA, 22 nt, Human
gugcuuuaccuuauuggucucg

SEQ ID NO: 157668 - RNA, 22 nt, Human
gggcagagggcgagcugggaga

SEQ ID NO: 157669 - RNA, 22 nt, Human
guggcuuucuaccauuaaauug

SEQ ID NO: 157670 - RNA, 22 nt, Human
guggcagagagcaagugucuga

SEQ ID NO: 157671 - RNA, 20 nt, Human
guggcagugguggcagcagu

SEQ ID NO: 157672 - RNA, 22 nt, Human
gugggauaaccugagauaacau

SEQ ID NO: 157673 - RNA, 22 nt, Human
guggguauauauaugugugcug

SEQ ID NO: 157674 - RNA, 22 nt, Human
gugguuuagccuucauuaaccu

SEQ ID NO: 157675 - RNA, 22 nt, Human
gugguuugcugguguacguuua

SEQ ID NO: 157676 - RNA, 22 nt, Human
guguaucagaggcuguguuaua

SEQ ID NO: 157677 - RNA, 22 nt, Human
gggcggcguccucagucgggug

SEQ ID NO: 157678 - RNA, 22 nt, Human
gggcggugccugucuccgaagc

SEQ ID NO: 157679 - RNA, 22 nt, Human
gggcucaaccauagcacaaaga

SEQ ID NO: 157680 - RNA, 22 nt, Human
gggcgcuguguuaggugcugua

SEQ ID NO: 157681 - RNA, 22 nt, Human
gggcgcgcggagccucgccggg

SEQ ID NO: 157682 - RNA, 22 nt, Human
guguugaaaaguagcacugcuu

SEQ ID NO: 157683 - RNA, 19 nt, Human
guguucuguuauacaguug

SEQ ID NO: 157684 - RNA, 22 nt, Human
guguuaaucauuuuugauuuug

SEQ ID NO: 157685 - RNA, 22 nt, Human
guguccuguagaaacuguucca

SEQ ID NO: 157686 - RNA, 22 nt, Human
gggcuggcaguuuucugaguuc

SEQ ID NO: 157687 - RNA, 22 nt, Human
ggguuuguuccuacuucuacuc

SEQ ID NO: 157688 - RNA, 22 nt, Human
ggguuuugugauugccucugaa

SEQ ID NO: 157689 - RNA, 22 nt, Human
guugaacagucacccugggagu

SEQ ID NO: 157690 - RNA, 22 nt, Human
ggguuuuggggaggaagugagc

SEQ ID NO: 157691 - RNA, 22 nt, Human
ggguuuuaccagauguguggug

SEQ ID NO: 157692 - RNA, 22 nt, Human
ggguuggaggcauugaaacaga

SEQ ID NO: 157693 - RNA, 22 nt, Human
ggguguuuuuggugacagggag

SEQ ID NO: 157694 - RNA, 22 nt, Human
gguagggggaggagaagaaaaa

SEQ ID NO: 157695 - RNA, 22 nt, Human
guugcaaaugggaagaugguua

SEQ ID NO: 157696 - RNA, 22 nt, Human
gguacgagcccugccuaguguc

SEQ ID NO: 157697 - RNA, 22 nt, Human
guucuacaacuucgcuugcaga

SEQ ID NO: 157698 - RNA, 22 nt, Human
guucggcuuccuaugucaugag

SEQ ID NO: 157699 - RNA, 22 nt, Human
guucuguuguugaucuuuggag

SEQ ID NO: 157700 - RNA, 22 nt, Human
guucuguucuucacagguuugu

SEQ ID NO: 157701 - RNA, 22 nt, Human
gggggaaaguggagguucguga

SEQ ID NO: 157702 - RNA, 22 nt, Human
ggggcugggaggccggcgcgca

SEQ ID NO: 157703 - RNA, 22 nt, Human
ggggcuggguuugcgcaggcuc

SEQ ID NO: 157704 - RNA, 22 nt, Human
ggggcuuccagcgcccgccggu

SEQ ID NO: 157705 - RNA, 22 nt, Human
gggguauuugguagacauuuug

SEQ ID NO: 157706 - RNA, 22 nt, Human
guuauacuuaugugcaaaaaua

SEQ ID NO: 157707 - RNA, 18 nt, Human
guucaagcauuuugcucu

SEQ ID NO: 157708 - RNA, 23 nt, Human
guuauugcuggugcuggccagcc

SEQ ID NO: 157709 - RNA, 17 nt, Human
ggggcguguauuugaug

SEQ ID NO: 157710 - RNA, 22 nt, Human
guuaauaugcaaaacggaugcg

SEQ ID NO: 157711 - RNA, 22 nt, Human
ggggcggcgugggcgcggugau

SEQ ID NO: 157712 - RNA, 22 nt, Human
guguuuugagaggaugguuuua

SEQ ID NO: 157713 - RNA, 22 nt, Human
ggggauuucccaaugcgaagca

SEQ ID NO: 157714 - RNA, 22 nt, Human
ggggaaggaaggggagggcacg

SEQ ID NO: 157715 - RNA, 22 nt, Human
guguuugagagguacaagggaa

SEQ ID NO: 157716 - RNA, 21 nt, Human
guguugugagguugguguuag

SEQ ID NO: 157717 - RNA, 22 nt, Human
ggaauacggguuuauuuagucu

SEQ ID NO: 157718 - RNA, 22 nt, Human
gccuggccaaucgccgucuagg

SEQ ID NO: 157719 - RNA, 22 nt, Human
gccuggaaugcaaugugacgaa

SEQ ID NO: 157720 - RNA, 21 nt, Human
gccugcuguucacccugccac

SEQ ID NO: 157721 - RNA, 22 nt, Human
gccugcugggcucuuccugcug

SEQ ID NO: 157722 - RNA, 22 nt, Human
ggaauaaaaggagguggcgaga

SEQ ID NO: 157723 - RNA, 20 nt, Human
ggaaguauccacaaauuccu

SEQ ID NO: 157724 - RNA, 22 nt, Human
ggaaguuugagcaucuguuucc

SEQ ID NO: 157725 - RNA, 22 nt, Human
ggaagucuacucuuccgaaaac

SEQ ID NO: 157726 - RNA, 22 nt, Human
gcgcacaaccccguggcgguga

SEQ ID NO: 157727 - RNA, 22 nt, Human
ggaccucagccaucccucggag

SEQ ID NO: 157728 - RNA, 23 nt, Human
ggaauuucagaugugaaauaaaa

SEQ ID NO: 157729 - RNA, 22 nt, Human
gccuuggacuaccacucccaca

SEQ ID NO: 157730 - RNA, 22 nt, Human
gccuuuauauuacauuuggaag

SEQ ID NO: 157731 - RNA, 22 nt, Human
ggagaucucauugauacugaua

SEQ ID NO: 157732 - RNA, 22 nt, Human
ggagcaagagugagcaagcaga

SEQ ID NO: 157733 - RNA, 22 nt, Human
gcgcagugagguuaagaaugca

SEQ ID NO: 157734 - RNA, 20 nt, Human
ggauugaacuauuucucagc

SEQ ID NO: 157735 - RNA, 22 nt, Human
ggauugaagggaaccucagaau

SEQ ID NO: 157736 - RNA, 22 nt, Human
ggauuucuucucauaacugaga

SEQ ID NO: 157737 - RNA, 22 nt, Human
ggauuugaugagacuaucuacu

SEQ ID NO: 157738 - RNA, 22 nt, Human
ggcaaagaguacaucguccugg

SEQ ID NO: 157739 - RNA, 22 nt, Human
gcggcaguccuuccaguacagg

SEQ ID NO: 157740 - RNA, 22 nt, Human
gcgggccggcaggggaggaguu

SEQ ID NO: 157741 - RNA, 22 nt, Human
ggcaaggaagaaagcagaaguu

SEQ ID NO: 157742 - RNA, 22 nt, Human
ggcaagcacugggugucuuagc

SEQ ID NO: 157743 - RNA, 22 nt, Human
gcggccucuuugcugccucagg

SEQ ID NO: 157744 - RNA, 22 nt, Human
ggaugcagcagagaccuggagu

SEQ ID NO: 157745 - RNA, 22 nt, Human
ggcaggauggagcagggcuaaa

SEQ ID NO: 157746 - RNA, 22 nt, Human
ggcagggacugggauauggaga

SEQ ID NO: 157747 - RNA, 22 nt, Human
ggcagggagagcaugcugauaa

SEQ ID NO: 157748 - RNA, 20 nt, Human
ggcagagcuaugucuguugc

SEQ ID NO: 157749 - RNA, 22 nt, Human
ggcagagcugugcgcccaccca

SEQ ID NO: 157750 - RNA, 22 nt, Human
gcggggcucuacuuggccugga

SEQ ID NO: 157751 - RNA, 22 nt, Human
gcgguuauggcagagauuacag

SEQ ID NO: 157752 - RNA, 23 nt, Human
gcugaagcccacucccugggucu

SEQ ID NO: 157753 - RNA, 22 nt, Human
gcugcaggaggugguagggucu

SEQ ID NO: 157754 - RNA, 22 nt, Human
gcugcacgguccuggcaccacg

SEQ ID NO: 157755 - RNA, 22 nt, Human
gcugcagggagcuggaaggcuc

SEQ ID NO: 157756 - RNA, 23 nt, Human
gcugcagugaauguuguuguugu

SEQ ID NO: 157757 - RNA, 22 nt, Human
ggccgccgcuuagcugagcccc

SEQ ID NO: 157758 - RNA, 22 nt, Human
ggcccgcgcugcuggcgcgcca

SEQ ID NO: 157759 - RNA, 22 nt, Human
ggccgggugggaggcagcggag

SEQ ID NO: 157760 - RNA, 22 nt, Human
ggccuggcacauaguaggcagu

SEQ ID NO: 157761 - RNA, 22 nt, Human
ggcuauuguuuuaaaaaaugag

SEQ ID NO: 157762 - RNA, 22 nt, Human
ggcgccauuuuugccuucggag

SEQ ID NO: 157763 - RNA, 22 nt, Human
ggccuugggauguggcugcagc

SEQ ID NO: 157764 - RNA, 23 nt, Human
ggccuuuuuaaccgcgagcgaca

SEQ ID NO: 157765 - RNA, 22 nt, Human
ggccuugguggcuuugcugaug

SEQ ID NO: 157766 - RNA, 22 nt, Human
gcugccuugaacuuggccuggg

SEQ ID NO: 157767 - RNA, 22 nt, Human
ggcgaggcgggccgcggggucu

SEQ ID NO: 157768 - RNA, 22 nt, Human
ggcgacuacugaaugcuugaaa

SEQ ID NO: 157769 - RNA, 22 nt, Human
ggcgauuggccgggaggaggca

SEQ ID NO: 157770 - RNA, 22 nt, Human
gcugcgccgggagccggggccg

SEQ ID NO: 157771 - RNA, 22 nt, Human
gcugguuacuucauuagguccu

SEQ ID NO: 157772 - RNA, 22 nt, Human
gcuggggaucgaaggcagagcc

SEQ ID NO: 157773 - RNA, 22 nt, Human
gcuggguaguucuuguuuggga

SEQ ID NO: 157774 - RNA, 19 nt, Human
gcugggauaggauguauuu

SEQ ID NO: 157775 - RNA, 22 nt, Human
ggcuucaaaacacaugucaaga

SEQ ID NO: 157776 - RNA, 22 nt, Human
ggcugugggguccuguggugug

SEQ ID NO: 157777 - RNA, 22 nt, Human
ggcugugguggacgcgggaaac

SEQ ID NO: 157778 - RNA, 22 nt, Human
ggcuuacgcgcuaacagugaau

SEQ ID NO: 157779 - RNA, 22 nt, Human
gcugucaggaacaugccuuggu

SEQ ID NO: 157780 - RNA, 22 nt, Human
gcuguaacuuuuucauuuucaa

SEQ ID NO: 157781 - RNA, 22 nt, Human
gcuguccugggaacaggcacua

SEQ ID NO: 157782 - RNA, 18 nt, Human
gcuguccgguagcuggug

SEQ ID NO: 157783 - RNA, 22 nt, Human
gcugcuggcuuccugcuguuuu

SEQ ID NO: 157784 - RNA, 22 nt, Human
gcuggauuuaggguucccuccu

SEQ ID NO: 157785 - RNA, 22 nt, Human
gcuggaugucugugccaggcac

SEQ ID NO: 157786 - RNA, 22 nt, Human
gcuggauaaggaucaguuucuu

SEQ ID NO: 157787 - RNA, 22 nt, Human
ggcugcaagacguuauuagcgu

SEQ ID NO: 157788 - RNA, 22 nt, Human
ggcugaggccucuggggaggga

SEQ ID NO: 157789 - RNA, 22 nt, Human
ggcugcuauuggucuggcuugg

SEQ ID NO: 157790 - RNA, 22 nt, Human
ggcugcugcccaccccugcaug

SEQ ID NO: 157791 - RNA, 22 nt, Human
ggcugcuggaguugggucucuc

SEQ ID NO: 157792 - RNA, 17 nt, Human
ggcugccaggcaacaua

SEQ ID NO: 157793 - RNA, 22 nt, Human
gcugggagucgcgucuguggcc

SEQ ID NO: 157794 - RNA, 21 nt, Human
gcuggcugucucuuacacggu

SEQ ID NO: 157795 - RNA, 22 nt, Human
ggcagucuuucccuugagcucu

SEQ ID NO: 157796 - RNA, 22 nt, Human
ggcagucaucacuuauucauca

SEQ ID NO: 157797 - RNA, 22 nt, Human
ggugguucagugguuagggcca

SEQ ID NO: 157798 - RNA, 19 nt, Human
ggugggacaggugagauau

SEQ ID NO: 157799 - RNA, 22 nt, Human
ggcaggaaguaaggaugcuaca

SEQ ID NO: 157800 - RNA, 22 nt, Human
ggcagcgcuuggcugcucgaca

SEQ ID NO: 157801 - RNA, 18 nt, Human
ggcagggcucagcugcuc

SEQ ID NO: 157802 - RNA, 22 nt, Human
ggcagcagaacuggcccuguau

SEQ ID NO: 157803 - RNA, 21 nt, Human
ggcagccuggcaggggcacug

SEQ ID NO: 157804 - RNA, 22 nt, Human
ggugcaaagauggcaguugcaa

SEQ ID NO: 157805 - RNA, 22 nt, Human
ggucgguuggagagaucaugaa

SEQ ID NO: 157806 - RNA, 22 nt, Human
ggucuagcucggugcuggcgac

SEQ ID NO: 157807 - RNA, 22 nt, Human
ggucugagcaaguuaccauggg

SEQ ID NO: 157808 - RNA, 22 nt, Human
ggugucagccacuuugucggag

SEQ ID NO: 157809 - RNA, 22 nt, Human
gguugaagcuacuuucuggaug

SEQ ID NO: 157810 - RNA, 22 nt, Human
gguugauuuuuaugaagccaug

SEQ ID NO: 157811 - RNA, 22 nt, Human
gguugccuuugcaguuggauca

SEQ ID NO: 157812 - RNA, 22 nt, Human
guaagcagcaugacgguuggau

SEQ ID NO: 157813 - RNA, 22 nt, Human
guaguauuuucugaggacuggu

SEQ ID NO: 157814 - RNA, 22 nt, Human
guagaaaauagauugucucuug

SEQ ID NO: 157815 - RNA, 22 nt, Human
ggccgcuuucuggggagugagg

SEQ ID NO: 157816 - RNA, 22 nt, Human
ggccgggcaugcgagcugagcg

SEQ ID NO: 157817 - RNA, 22 nt, Human
guaguggaauuuagaguauaau

SEQ ID NO: 157818 - RNA, 22 nt, Human
guaguuuuucuugcaagaguag

SEQ ID NO: 157819 - RNA, 22 nt, Human
ggccugcucuggcuguggucag

SEQ ID NO: 157820 - RNA, 22 nt, Human
ggccugcuaccagcugugaccu

SEQ ID NO: 157821 - RNA, 22 nt, Human
ggaaaaugcugaagcaucugaa

SEQ ID NO: 157822 - RNA, 22 nt, Human
ggaaaaucaaaccauuuacagu

SEQ ID NO: 157823 - RNA, 22 nt, Human
ggaaagaggacaucuuacuucu

SEQ ID NO: 157824 - RNA, 22 nt, Human
gggcagaaaggaaggcuggggg

SEQ ID NO: 157825 - RNA, 19 nt, Human
gggauuccuggcuuuagaa

SEQ ID NO: 157826 - RNA, 22 nt, Human
gggaguggagagugaagcuaau

SEQ ID NO: 157827 - RNA, 22 nt, Human
ggaaaagaauuguuaguuagug

SEQ ID NO: 157828 - RNA, 22 nt, Human
gcuguggacacagcucucuuca

SEQ ID NO: 157829 - RNA, 22 nt, Human
gcuguggaaaaugggucuccaa

SEQ ID NO: 157830 - RNA, 22 nt, Human
gggagcuggagcuggaagacuc

SEQ ID NO: 157831 - RNA, 22 nt, Human
gcuuuucaaguuacaauuagcu

SEQ ID NO: 157832 - RNA, 22 nt, Human
ggacagggagcaaaaacguccc

SEQ ID NO: 157833 - RNA, 22 nt, Human
gggcggggcucacggugcggca

SEQ ID NO: 157834 - RNA, 22 nt, Human
gggcggggggagcuggaaugaa

SEQ ID NO: 157835 - RNA, 22 nt, Human
gggcaugcagcaauucuguggu

SEQ ID NO: 157836 - RNA, 22 nt, Human
ggaagugagcucauuacuuuag

SEQ ID NO: 157837 - RNA, 22 nt, Human
gggcgcaagcaugugucugggu

SEQ ID NO: 157838 - RNA, 22 nt, Human
gggcgagcgucucagccgggcg

SEQ ID NO: 157839 - RNA, 22 nt, Human
gggcgcgccaggagcugcgcgg

SEQ ID NO: 157840 - RNA, 22 nt, Human
ggagaggaaguuuaaagaauug

SEQ ID NO: 157841 - RNA, 22 nt, Human
ggagaggaggugagaggaagua

SEQ ID NO: 157842 - RNA, 22 nt, Human
ggggaggguuuggaugagaguc

SEQ ID NO: 157843 - RNA, 22 nt, Human
ggggaauuaaaugagaagccuu

SEQ ID NO: 157844 - RNA, 17 nt, Human
ggacuuucugccugucc

SEQ ID NO: 157845 - RNA, 22 nt, Human
ggggaauaaacacuuugucacu

SEQ ID NO: 157846 - RNA, 22 nt, Human
gggcugaugcuuauacauacug

SEQ ID NO: 157847 - RNA, 22 nt, Human
gggcugcuccgcccgcugcgcc

SEQ ID NO: 157848 - RNA, 22 nt, Human
ggacuuucuccugcacaaagug

SEQ ID NO: 157849 - RNA, 22 nt, Human
ggggaaauauuucugaccugug

SEQ ID NO: 157850 - RNA, 22 nt, Human
ggggccgggccggcagacuggg

SEQ ID NO: 157851 - RNA, 20 nt, Human
ggagagggaaaggcuguacu

SEQ ID NO: 157852 - RNA, 22 nt, Human
ggggcggggagcaugagcuggg

SEQ ID NO: 157853 - RNA, 22 nt, Human
gggguugauaauuagagaaaug

SEQ ID NO: 157854 - RNA, 22 nt, Human
ggguauuugacaaacugacacu

SEQ ID NO: 157855 - RNA, 22 nt, Human
gggucggcacucuggcagcacc

SEQ ID NO: 157856 - RNA, 22 nt, Human
gcugcgcgcagccggcgccgag

SEQ ID NO: 157857 - RNA, 23 nt, Human
gcugccguuucccaucgugguga

SEQ ID NO: 157858 - RNA, 22 nt, Human
gccagccggugaguggaagcgg

SEQ ID NO: 157859 - RNA, 19 nt, Human
gccacguuggcuaguugcc

SEQ ID NO: 157860 - RNA, 22 nt, Human
gcugccgcugcggggcgcgggc

SEQ ID NO: 157861 - RNA, 23 nt, Human
gcauuugcaggaaacuggaaaag

SEQ ID NO: 157862 - RNA, 23 nt, Human
gcugagcaccagccauaucuuuu

SEQ ID NO: 157863 - RNA, 22 nt, Human
gcucugcuccaucuguuuccuc

SEQ ID NO: 157864 - RNA, 22 nt, Human
gcuggcggguuggggaggcgga

SEQ ID NO: 157865 - RNA, 22 nt, Human
gccauggugagccaccuggugg

SEQ ID NO: 157866 - RNA, 22 nt, Human
gcccagaagguagcgaguaguc

SEQ ID NO: 157867 - RNA, 22 nt, Human
gcuggaagggccagcuuucagg

SEQ ID NO: 157868 - RNA, 22 nt, Human
gcugcuggcggagcuggcgcug

SEQ ID NO: 157869 - RNA, 22 nt, Human
gccaggcggcccaggagauggc

SEQ ID NO: 157870 - RNA, 22 nt, Human
gcuggaaauaacuuguguagaa

SEQ ID NO: 157871 - RNA, 22 nt, Human
gccagucgucuuuauuacagcu

SEQ ID NO: 157872 - RNA, 22 nt, Human
gccauauucaugcaggugcuaa

SEQ ID NO: 157873 - RNA, 22 nt, Human
gcaguuugugauguggcaguca

SEQ ID NO: 157874 - RNA, 22 nt, Human
gcuauuuagaaaggcuuggaga

SEQ ID NO: 157875 - RNA, 22 nt, Human
gcuaagucaaaaaauucaaaau

SEQ ID NO: 157876 - RNA, 22 nt, Human
gcuacaaauaaaaugggugacu

SEQ ID NO: 157877 - RNA, 22 nt, Human
gcaguugguccagccucggcug

SEQ ID NO: 157878 - RNA, 22 nt, Human
gcgugugugauaugccucugca

SEQ ID NO: 157879 - RNA, 22 nt, Human
gcguggaugauuuugagucggu

SEQ ID NO: 157880 - RNA, 19 nt, Human
gcggcggugccggcuggga

SEQ ID NO: 157881 - RNA, 22 nt, Human
gcggcgucccagcuccgacggc

SEQ ID NO: 157882 - RNA, 22 nt, Human
gcggcuggcuguccaaacuggg

SEQ ID NO: 157883 - RNA, 22 nt, Human
gcagcguguggcuaauggcucu

SEQ ID NO: 157884 - RNA, 22 nt, Human
gcggcggcggaggcgggggcag

SEQ ID NO: 157885 - RNA, 22 nt, Human
gcagcgcugagaugauuuguug

SEQ ID NO: 157886 - RNA, 22 nt, Human
gcgguguuuuaacacucccucg

SEQ ID NO: 157887 - RNA, 22 nt, Human
gcaggaaugguacauaccuguu

SEQ ID NO: 157888 - RNA, 22 nt, Human
gcagccaugcacgucauuauga

SEQ ID NO: 157889 - RNA, 22 nt, Human
gcagccugaguuuagcucgucg

SEQ ID NO: 157890 - RNA, 22 nt, Human
gcggcccggguccccagcagca

SEQ ID NO: 157891 - RNA, 22 nt, Human
gaugaaguaguccacuggaagg

SEQ ID NO: 157892 - RNA, 22 nt, Human
gcauuucuguuuuuuuaaauga

SEQ ID NO: 157893 - RNA, 22 nt, Human
gauauucauaggcagguauuua

SEQ ID NO: 157894 - RNA, 22 nt, Human
gcauuuuaauuggggcaguuag

SEQ ID NO: 157895 - RNA, 22 nt, Human
gauggacgguuuuaccagacag

SEQ ID NO: 157896 - RNA, 22 nt, Human
gauggauuuuuuauuaaaucag

SEQ ID NO: 157897 - RNA, 22 nt, Human
gccaucuucggcagccgccugg

SEQ ID NO: 157898 - RNA, 22 nt, Human
gcccagccucagggcaucagcu

SEQ ID NO: 157899 - RNA, 22 nt, Human
gaugccggggucguagccgugg

SEQ ID NO: 157900 - RNA, 22 nt, Human
gauacaugucacaaguugugca

SEQ ID NO: 157901 - RNA, 22 nt, Human
gauagaaagagaaucagaacuu

SEQ ID NO: 157902 - RNA, 22 nt, Human
gcauguucaaguuaguauauuu

SEQ ID NO: 157903 - RNA, 22 nt, Human
gauaauuauaggcuaagccacu

SEQ ID NO: 157904 - RNA, 22 nt, Human
gauaggaggaugggaccuguga

SEQ ID NO: 157905 - RNA, 22 nt, Human
gauaaauaguguuuggggacau

SEQ ID NO: 157906 - RNA, 20 nt, Human
gagguugcucagaguggggu

SEQ ID NO: 157907 - RNA, 19 nt, Human
gaguaaaacuagagagaaa

SEQ ID NO: 157908 - RNA, 22 nt, Human
gauuuuaaaagauguauaaggu

SEQ ID NO: 157909 - RNA, 22 nt, Human
gcacaaguccuccgacagcacg

SEQ ID NO: 157910 - RNA, 22 nt, Human
gccuugagcucaugucccagcu

SEQ ID NO: 157911 - RNA, 22 nt, Human
gcccugaaggccuccaggacuc

SEQ ID NO: 157912 - RNA, 22 nt, Human
gaugguggggggcagcugggag

SEQ ID NO: 157913 - RNA, 22 nt, Human
gccgcaacggacccugggaguc

SEQ ID NO: 157914 - RNA, 22 nt, Human
gccgcagauucugagacgugua

SEQ ID NO: 157915 - RNA, 18 nt, Human
gccgccuugcucgugaac

SEQ ID NO: 157916 - RNA, 22 nt, Human
gccgcgggucugggucuggcuc

SEQ ID NO: 157917 - RNA, 22 nt, Human
gccgccgccgccuuuguugcgg

SEQ ID NO: 157918 - RNA, 22 nt, Human
gauugauguaggugauaaaucu

SEQ ID NO: 157919 - RNA, 22 nt, Human
gauugcugccagcguguccgug

SEQ ID NO: 157920 - RNA, 21 nt, Human
gccgugcgccuccaggcgcgc

SEQ ID NO: 157921 - RNA, 22 nt, Human
gauugggagugugacauuguau

SEQ ID NO: 157922 - RNA, 22 nt, Human
gaugccuccaggaaagaggacg

SEQ ID NO: 157923 - RNA, 22 nt, Human
gaugcuaauuaaugaagaggag

SEQ ID NO: 157924 - RNA, 18 nt, Human
gagaggcauuuagcugau

SEQ ID NO: 157925 - RNA, 22 nt, Human
gaugauugaauaaauaugguca

SEQ ID NO: 157926 - RNA, 22 nt, Human
gaugauuuuguaacuggggaca

SEQ ID NO: 157927 - RNA, 20 nt, Human
gagaauuccagguuucugug

SEQ ID NO: 157928 - RNA, 22 nt, Human
gagauuugaguuccuacugagu

SEQ ID NO: 157929 - RNA, 22 nt, Human
gauggugcaauuaucgugcaug

SEQ ID NO: 157930 - RNA, 22 nt, Human
gaugggaaggugguaaaguuua

SEQ ID NO: 157931 - RNA, 22 nt, Human
gauggguuugagauguuugggu

SEQ ID NO: 157932 - RNA, 22 nt, Human
gagauuguggcagcagcuguuu

SEQ ID NO: 157933 - RNA, 22 nt, Human
gauuuugcuuuagugaaggaag

SEQ ID NO: 157934 - RNA, 18 nt, Human
gagcucuucccuuuucuc

SEQ ID NO: 157935 - RNA, 22 nt, Human
gaggaaaauggaguguaauuaa

SEQ ID NO: 157936 - RNA, 22 nt, Human
gcaaaaacaguguagucuucug

SEQ ID NO: 157937 - RNA, 22 nt, Human
gcaaagaauugauucauuuugc

SEQ ID NO: 157938 - RNA, 22 nt, Human
gauuuucauuauagcuaguuuc

SEQ ID NO: 157939 - RNA, 22 nt, Human
gauuucuucauuuaaaaauauu

SEQ ID NO: 157940 - RNA, 21 nt, Human
gauuuuagggcagccaaacac

SEQ ID NO: 157941 - RNA, 22 nt, Human
gagccuuucuggagggcacuug

SEQ ID NO: 157942 - RNA, 20 nt, Human
gauuuaacgcugcgucuguc

SEQ ID NO: 157943 - RNA, 22 nt, Human
gauucuaucauucuguauauua

SEQ ID NO: 157944 - RNA, 22 nt, Human
gagccgcagcugcguagggucc

SEQ ID NO: 157945 - RNA, 22 nt, Human
gagcaggucuuugguaaugcuu

SEQ ID NO: 157946 - RNA, 22 nt, Human
gauguuggugcauucacuucug

SEQ ID NO: 157947 - RNA, 22 nt, Human
gauguuuugaaagaagaauaca

SEQ ID NO: 157948 - RNA, 22 nt, Human
gcaauaaguuuucucuucuguc

SEQ ID NO: 157949 - RNA, 22 nt, Human
gaggagcuucagaggaaucuua

SEQ ID NO: 157950 - RNA, 22 nt, Human
gaggaggacauuggaaagaacu

SEQ ID NO: 157951 - RNA, 21 nt, Human
gcacaacucucacauucuucu

SEQ ID NO: 157952 - RNA, 22 nt, Human
gcacagcuaugagcugaauugu

SEQ ID NO: 157953 - RNA, 19 nt, Human
gcacacccugcaccaccau

SEQ ID NO: 157954 - RNA, 22 nt, Human
gaggcugguucccuugaucuuu

SEQ ID NO: 157955 - RNA, 22 nt, Human
gagggaaaggggccaugauugg

SEQ ID NO: 157956 - RNA, 22 nt, Human
gaggcggugguggcgagaguca

SEQ ID NO: 157957 - RNA, 22 nt, Human
gaggcuaugucuacgcucagcg

SEQ ID NO: 157958 - RNA, 22 nt, Human
gaggcagaggaugggacuguau

SEQ ID NO: 157959 - RNA, 22 nt, Human
gcacagucaacacuuauucacc

SEQ ID NO: 157960 - RNA, 22 nt, Human
gcacaggcugcacgaccccagc

SEQ ID NO: 157961 - RNA, 22 nt, Human
gcaccauagagaagagacacaa

SEQ ID NO: 157962 - RNA, 22 nt, Human
gcacauaugcuguaagcacaug

SEQ ID NO: 157963 - RNA, 22 nt, Human
gcagcucagcacgcacagguaa

SEQ ID NO: 157964 - RNA, 22 nt, Human
gcaggacuucuguuuaaccagu

SEQ ID NO: 157965 - RNA, 22 nt, Human
gcaggcagauccagaagcacua

SEQ ID NO: 157966 - RNA, 22 nt, Human
gcaggagggggccuggagccca

SEQ ID NO: 157967 - RNA, 22 nt, Human
gaggguuucagugggacggguu

SEQ ID NO: 157968 - RNA, 22 nt, Human
gagguagaggaaaagauuauca

SEQ ID NO: 157969 - RNA, 22 nt, Human
gaggucagugugggggcaaggg

SEQ ID NO: 157970 - RNA, 22 nt, Human
gcagccauuugcaucuaauuaa

SEQ ID NO: 157971 - RNA, 22 nt, Human
gcagccauggcuggccgggcau

SEQ ID NO: 157972 - RNA, 23 nt, Human
gcagccaacccacgugagagaag

SEQ ID NO: 157973 - RNA, 22 nt, Human
gcagcauuaccaagacauggca

SEQ ID NO: 157974 - RNA, 22 nt, Human
gcagccagggaccuuugacuau

SEQ ID NO: 157975 - RNA, 22 nt, Human
gcagacuaacuuuugucagccu

SEQ ID NO: 157976 - RNA, 22 nt, Human
gcagaggcugccgugggcagga

SEQ ID NO: 157977 - RNA, 22 nt, Human
gcagagcacccugcagugguau

SEQ ID NO: 157978 - RNA, 22 nt, Human
gagggcauugucuucuuaguuu

SEQ ID NO: 157979 - RNA, 22 nt, Human
gcagauuggguacauaaacagu

SEQ ID NO: 157980 - RNA, 22 nt, Human
gcagcagugugggcugaaccua

SEQ ID NO: 157981 - RNA, 22 nt, Human
gaggggcggggcgggaggagag

SEQ ID NO: 157982 - RNA, 22 nt, Human
gaauguuugagugccaugugac

SEQ ID NO: 157983 - RNA, 22 nt, Human
gagggaaauauggguuugguua

SEQ ID NO: 157984 - RNA, 22 nt, Human
gaauggcagaaugaagcagugu

SEQ ID NO: 157985 - RNA, 22 nt, Human
gaaugggaauuauggugggacu

SEQ ID NO: 157986 - RNA, 19 nt, Human
gaauugcacgagcagaggc

SEQ ID NO: 157987 - RNA, 22 nt, Human
gacaagaagaacggagguuuca

SEQ ID NO: 157988 - RNA, 22 nt, Human
gaggggcgaggacgcugaagua

SEQ ID NO: 157989 - RNA, 22 nt, Human
gaauuagacggcaucacauggg

SEQ ID NO: 157990 - RNA, 16 nt, Human
gaauuccauugcucug

SEQ ID NO: 157991 - RNA, 22 nt, Human
gaauucuaguucuguaucucug

SEQ ID NO: 157992 - RNA, 22 nt, Human
gaaguauuucugaguugcccag

SEQ ID NO: 157993 - RNA, 22 nt, Human
gaauauuuaucucagcugcaga

SEQ ID NO: 157994 - RNA, 22 nt, Human
gaauacaagccugccaccugga

SEQ ID NO: 157995 - RNA, 22 nt, Human
gaauccccugucggaacagugg

SEQ ID NO: 157996 - RNA, 22 nt, Human
gaauaauuuugaucagaaggga

SEQ ID NO: 157997 - RNA, 22 nt, Human
gaaugccugggguucuucgauc

SEQ ID NO: 157998 - RNA, 22 nt, Human
gaaugacuugcucauucugugu

SEQ ID NO: 157999 - RNA, 22 nt, Human
gaggcggcgacgcgggcccggg

SEQ ID NO: 158000 - RNA, 20 nt, Human
gaaucuggucaaaugucuau

SEQ ID NO: 158001 - RNA, 22 nt, Human
gaggcaggaagggaggguugug

SEQ ID NO: 158002 - RNA, 22 nt, Human
gaagguuuuguuugcaaaucau

SEQ ID NO: 158003 - RNA, 22 nt, Human
gaaggcagucuggggagcagcc

SEQ ID NO: 158004 - RNA, 22 nt, Human
gagcuggacauacaggaaacca

SEQ ID NO: 158005 - RNA, 22 nt, Human
gaaggaaaagacgugcuaagua

SEQ ID NO: 158006 - RNA, 22 nt, Human
gaaggaagcugucuggaugugu

SEQ ID NO: 158007 - RNA, 22 nt, Human
gagcgugaggcagcuuucuaag

SEQ ID NO: 158008 - RNA, 22 nt, Human
gagcguuucccugggggucugc

SEQ ID NO: 158009 - RNA, 22 nt, Human
gagcgcacagaaggaagcagcc

SEQ ID NO: 158010 - RNA, 22 nt, Human
gagcggcggugagaaguguggg

SEQ ID NO: 158011 - RNA, 22 nt, Human
gagccuguuaggcaccuguguu

SEQ ID NO: 158012 - RNA, 22 nt, Human
gaagcccuggaggggcuggagg

SEQ ID NO: 158013 - RNA, 22 nt, Human
gagcggcucaguggccauguga

SEQ ID NO: 158014 - RNA, 22 nt, Human
gaagcaccuggacggugccugg

SEQ ID NO: 158015 - RNA, 22 nt, Human
gaagcagguucuucaggaugaa

SEQ ID NO: 158016 - RNA, 18 nt, Human
gaagcaacaguucugagu

SEQ ID NO: 158017 - RNA, 22 nt, Human
gaaaaucaugaaaguguguugu

SEQ ID NO: 158018 - RNA, 22 nt, Human
gaagauucugacccugacucag

SEQ ID NO: 158019 - RNA, 22 nt, Human
gaucauuuucauuaauguugca

SEQ ID NO: 158020 - RNA, 22 nt, Human
gagaacagauaugaugacuuca

SEQ ID NO: 158021 - RNA, 22 nt, Human
gauauuuugugaaaaaacaacu

SEQ ID NO: 158022 - RNA, 19 nt, Human
gauauugagcugagaauuc

SEQ ID NO: 158023 - RNA, 22 nt, Human
gagaaguaggaauaucaggagu

SEQ ID NO: 158024 - RNA, 22 nt, Human
gagaaugagucagagcuggcug

SEQ ID NO: 158025 - RNA, 22 nt, Human
gagaaauagauucaugguagau

SEQ ID NO: 158026 - RNA, 22 nt, Human
gauauauuucaaauucuuuugc

SEQ ID NO: 158027 - RNA, 22 nt, Human
gagaaaaauuucuuugcugcac

SEQ ID NO: 158028 - RNA, 22 nt, Human
gacuugcucaaaucagauuuua

SEQ ID NO: 158029 - RNA, 22 nt, Human
gacuugaagcucucugguuuug

SEQ ID NO: 158030 - RNA, 22 nt, Human
gaguuucacguagaucaggguc

SEQ ID NO: 158031 - RNA, 22 nt, Human
gauaaugcuuuggucagacaug

SEQ ID NO: 158032 - RNA, 22 nt, Human
gacuggaaucucugcuuguuaa

SEQ ID NO: 158033 - RNA, 22 nt, Human
gacauuuauuggauuuuacgag

SEQ ID NO: 158034 - RNA, 22 nt, Human
gaccagaacuucuagucuaagu

SEQ ID NO: 158035 - RNA, 22 nt, Human
gacaucuguccauggcacugga

SEQ ID NO: 158036 - RNA, 22 nt, Human
gacccggauguuguacucgagg

SEQ ID NO: 158037 - RNA, 22 nt, Human
gacccucucagacuuccaggca

SEQ ID NO: 158038 - RNA, 22 nt, Human
gaguaucagauuggaguccuca

SEQ ID NO: 158039 - RNA, 20 nt, Human
gacgaacuagaacaguggua

SEQ ID NO: 158040 - RNA, 22 nt, Human
gaccuuguucuggcauucucag

SEQ ID NO: 158041 - RNA, 22 nt, Human
gaggguggggaauagacugcua

SEQ ID NO: 158042 - RNA, 22 nt, Human
gaggguaagcugggacuccucg

SEQ ID NO: 158043 - RNA, 22 nt, Human
gacacccgccggcgccugccuc

SEQ ID NO: 158044 - RNA, 22 nt, Human
gacaauuucucaauauagaaac

SEQ ID NO: 158045 - RNA, 22 nt, Human
gaggucggaagugaggguaacu

SEQ ID NO: 158046 - RNA, 22 nt, Human
gaaguggggaggagaagacuga

SEQ ID NO: 158047 - RNA, 22 nt, Human
cuucuuuuggggaugaaaaugg

SEQ ID NO: 158048 - RNA, 20 nt, Human
cuugaguucagagcugucau

SEQ ID NO: 158049 - RNA, 22 nt, Human
cuucucuuggguguggugucuu

SEQ ID NO: 158050 - RNA, 22 nt, Human
gaagucaggaaggagauugaag

SEQ ID NO: 158051 - RNA, 22 nt, Human
gaaguaaaacaguaacuuuguu

SEQ ID NO: 158052 - RNA, 23 nt, Human
cuucggcgcucgcugggcggagg

SEQ ID NO: 158053 - RNA, 22 nt, Human
gaaggcugaauuauuuguuccu

SEQ ID NO: 158054 - RNA, 22 nt, Human
gaaggcuguggcuggucucagu

SEQ ID NO: 158055 - RNA, 22 nt, Human
gaagguuuacugaagauuuaaa

SEQ ID NO: 158056 - RNA, 22 nt, Human
gaagaugacaucggaucugucu

SEQ ID NO: 158057 - RNA, 22 nt, Human
gacaagaugacaucauggcuuc

SEQ ID NO: 158058 - RNA, 22 nt, Human
cuuguaccuuuguguuuauuuu

SEQ ID NO: 158059 - RNA, 22 nt, Human
gacacaacuauccaguauggga

SEQ ID NO: 158060 - RNA, 22 nt, Human
gacacucauauuaagccuauuu

SEQ ID NO: 158061 - RNA, 23 nt, Human
cuuggcuagccacuuccacgcuc

SEQ ID NO: 158062 - RNA, 22 nt, Human
cuugccaguguugcagaagcuc

SEQ ID NO: 158063 - RNA, 22 nt, Human
cuugccagggacucagucaggg

SEQ ID NO: 158064 - RNA, 22 nt, Human
gaauguuaaugcacuucuagcu

SEQ ID NO: 158065 - RNA, 22 nt, Human
gagaaagauuguccuucagggg

SEQ ID NO: 158066 - RNA, 22 nt, Human
gagaaaacauacuuaguguccu

SEQ ID NO: 158067 - RNA, 22 nt, Human
cuuuuuuucuccauauuucugg

SEQ ID NO: 158068 - RNA, 22 nt, Human
cuuuuugcccuugggcuuccug

SEQ ID NO: 158069 - RNA, 22 nt, Human
gacuuaaccacggucacauggu

SEQ ID NO: 158070 - RNA, 22 nt, Human
gacuguuggcagauguuugagu

SEQ ID NO: 158071 - RNA, 18 nt, Human
gacugccuugaacuauug

SEQ ID NO: 158072 - RNA, 22 nt, Human
cuuuuuaaaguaaauggcuaga

SEQ ID NO: 158073 - RNA, 22 nt, Human
cuuuugcaauagugacacugau

SEQ ID NO: 158074 - RNA, 22 nt, Human
gaccuuucccuaucucacucuc

SEQ ID NO: 158075 - RNA, 22 nt, Human
gaccugcucagcccuguguguu

SEQ ID NO: 158076 - RNA, 22 nt, Human
gacacugccaagugccccgaga

SEQ ID NO: 158077 - RNA, 22 nt, Human
cuuuccaugucuucuuucucca

SEQ ID NO: 158078 - RNA, 22 nt, Human
cuuucucucaaacacacauaca

SEQ ID NO: 158079 - RNA, 22 nt, Human
gacagguagacaugaauauuaa

SEQ ID NO: 158080 - RNA, 22 nt, Human
gacaggcagagaggaagagaga

SEQ ID NO: 158081 - RNA, 22 nt, Human
gacaggaauuaucuaaaguaga

SEQ ID NO: 158082 - RNA, 23 nt, Human
cuucagaccucagaaggucuguu

SEQ ID NO: 158083 - RNA, 22 nt, Human
cuggccugugggcugucuccgg

SEQ ID NO: 158084 - RNA, 22 nt, Human
cuggaucgccccgaugugcccc

SEQ ID NO: 158085 - RNA, 22 nt, Human
cuggcggcccgaggcagaggag

SEQ ID NO: 158086 - RNA, 22 nt, Human
cugggaaggaagggaaaaacag

SEQ ID NO: 158087 - RNA, 22 nt, Human
cuggcuuucauggcgcaguuga

SEQ ID NO: 158088 - RNA, 22 nt, Human
cuggcuguguguuugugcaucu

SEQ ID NO: 158089 - RNA, 21 nt, Human
cuuuucuagucccagccccgc

SEQ ID NO: 158090 - RNA, 22 nt, Human
gaaaaacucagugggggucuuu

SEQ ID NO: 158091 - RNA, 22 nt, Human
gaaaaauggguuguuugaagau

SEQ ID NO: 158092 - RNA, 22 nt, Human
gaaaaagucuuaaaguaaggca

SEQ ID NO: 158093 - RNA, 22 nt, Human
cugggcuuucaggcccuaaggc

SEQ ID NO: 158094 - RNA, 22 nt, Human
cuuuuugccuugaagugaccuc

SEQ ID NO: 158095 - RNA, 22 nt, Human
cuuuuggcaucagccucaggaa

SEQ ID NO: 158096 - RNA, 22 nt, Human
cuuuuucaugggugaugagugg

SEQ ID NO: 158097 - RNA, 22 nt, Human
cugggaugagcuguuuccuggu

SEQ ID NO: 158098 - RNA, 22 nt, Human
gaacugaauguguaauguuggc

SEQ ID NO: 158099 - RNA, 22 nt, Human
gaagaagagauaauggggagca

SEQ ID NO: 158100 - RNA, 22 nt, Human
gaagaaggaagaucaugcuuga

SEQ ID NO: 158101 - RNA, 22 nt, Human
gaacuugagugugcuauuucuu

SEQ ID NO: 158102 - RNA, 22 nt, Human
gaacaaggauucccaaagaaga

SEQ ID NO: 158103 - RNA, 22 nt, Human
gaaagaggcugucagggaaugg

SEQ ID NO: 158104 - RNA, 22 nt, Human
gaaaaugcacacauacacaccc

SEQ ID NO: 158105 - RNA, 21 nt, Human
gaaaaucuaaugugacaaugc

SEQ ID NO: 158106 - RNA, 22 nt, Human
cugguuuuccaauguuuugacu

SEQ ID NO: 158107 - RNA, 22 nt, Human
gaaaauaguucaucacaaugau

SEQ ID NO: 158108 - RNA, 22 nt, Human
gaaaaucaggauggaugugagg

SEQ ID NO: 158109 - RNA, 22 nt, Human
gaaaaguuuaaccuuguacauu

SEQ ID NO: 158110 - RNA, 22 nt, Human
cuggguuuggcugugcuugaau

SEQ ID NO: 158111 - RNA, 22 nt, Human
cuggucuugguauucgcagaag

SEQ ID NO: 158112 - RNA, 22 nt, Human
gaaaacccuguauguagcguuu

SEQ ID NO: 158113 - RNA, 22 nt, Human
gaaaagaaaggaugguaugugu

SEQ ID NO: 158114 - RNA, 22 nt, Human
gaaaagaaggcaggagcccaag

SEQ ID NO: 158115 - RNA, 22 nt, Human
cugguuuauuucauaguuuguu

SEQ ID NO: 158116 - RNA, 22 nt, Human
cuggugggucacgugugggugg

SEQ ID NO: 158117 - RNA, 22 nt, Human
cuggugcuguagccugauugag

SEQ ID NO: 158118 - RNA, 22 nt, Human
gaaaaguauuaugugaggguuc

SEQ ID NO: 158119 - RNA, 22 nt, Human
gaaaaggaggggaggcagaugg

SEQ ID NO: 158120 - RNA, 22 nt, Human
cugcgcgagcacugccggcggg

SEQ ID NO: 158121 - RNA, 22 nt, Human
cuagagaaaaagcuuagguacg

SEQ ID NO: 158122 - RNA, 22 nt, Human
cugccgaugcgcaguggcgccu

SEQ ID NO: 158123 - RNA, 22 nt, Human
cugccugugcgccaagugcacg

SEQ ID NO: 158124 - RNA, 22 nt, Human
cuaacuuugucuugguaauugc

SEQ ID NO: 158125 - RNA, 22 nt, Human
cuaaauuuuuuagugaaauagg

SEQ ID NO: 158126 - RNA, 22 nt, Human
cugcugcuugauugcaggaagu

SEQ ID NO: 158127 - RNA, 22 nt, Human
cugcuggugcugcccacacggu

SEQ ID NO: 158128 - RNA, 22 nt, Human
cugcugucuuuauuucacugcu

SEQ ID NO: 158129 - RNA, 22 nt, Human
cuagguuuuuuccuuuccccac

SEQ ID NO: 158130 - RNA, 22 nt, Human
cuaguuuucacaaaggaagggc

SEQ ID NO: 158131 - RNA, 22 nt, Human
cuagcaggacucagcagauauu

SEQ ID NO: 158132 - RNA, 22 nt, Human
cugcgguucuguuuaguggcga

SEQ ID NO: 158133 - RNA, 22 nt, Human
cuaguauuaagugugaguaaaa

SEQ ID NO: 158134 - RNA, 22 nt, Human
cgucauuuguaaaugaucaaga

SEQ ID NO: 158135 - RNA, 22 nt, Human
cugaguuuuucaaaucugaauu

SEQ ID NO: 158136 - RNA, 19 nt, Human
cggugcugauuggugcagu

SEQ ID NO: 158137 - RNA, 22 nt, Human
cggugcuuuccauaucagcagc

SEQ ID NO: 158138 - RNA, 22 nt, Human
cugagcaucaaaugggcaauua

SEQ ID NO: 158139 - RNA, 22 nt, Human
cugauggagagugugauuuggg

SEQ ID NO: 158140 - RNA, 22 nt, Human
cugaucuuaaguaacauuauuu

SEQ ID NO: 158141 - RNA, 22 nt, Human
cgugaaaugcagaaaguugugg

SEQ ID NO: 158142 - RNA, 22 nt, Human
cgugcaggagcuggagguccga

SEQ ID NO: 158143 - RNA, 22 nt, Human
cuaaaaauguucuaguaguuca

SEQ ID NO: 158144 - RNA, 22 nt, Human
cguuuugaguagauagccauau

SEQ ID NO: 158145 - RNA, 22 nt, Human
cugcagauguagcugcuuuccu

SEQ ID NO: 158146 - RNA, 22 nt, Human
cuaaagacagcaagacaucauc

SEQ ID NO: 158147 - RNA, 22 nt, Human
cuaaauucuauauccuugcuuc

SEQ ID NO: 158148 - RNA, 20 nt, Human
cuaaaacaggugucuaguga

SEQ ID NO: 158149 - RNA, 20 nt, Human
cugauguucgugcuuccugg

SEQ ID NO: 158150 - RNA, 22 nt, Human
cugauguuuaucucaagaguuc

SEQ ID NO: 158151 - RNA, 22 nt, Human
cugauuguagccacugugauga

SEQ ID NO: 158152 - RNA, 22 nt, Human
cgugugugugcgugugcgugug

SEQ ID NO: 158153 - RNA, 22 nt, Human
cuguuuuugccugugacaaaaa

SEQ ID NO: 158154 - RNA, 22 nt, Human
cuguuuggcuuccacugcuucu

SEQ ID NO: 158155 - RNA, 22 nt, Human
cugagggagacagugcggacua

SEQ ID NO: 158156 - RNA, 22 nt, Human
cugagggagcugcuggccuugg

SEQ ID NO: 158157 - RNA, 22 nt, Human
cuuacauuuguuuaguguuucc

SEQ ID NO: 158158 - RNA, 22 nt, Human
cuuauuugcccauguuucuuua

SEQ ID NO: 158159 - RNA, 22 nt, Human
cuuauucuucuggacuuggagu

SEQ ID NO: 158160 - RNA, 22 nt, Human
cuguuguucacuuugcugguga

SEQ ID NO: 158161 - RNA, 22 nt, Human
cugaagaaagaaaauggccauc

SEQ ID NO: 158162 - RNA, 22 nt, Human
cugaaagacagccaggcaaagc

SEQ ID NO: 158163 - RNA, 22 nt, Human
cugaaagcaaaguaauucuuaa

SEQ ID NO: 158164 - RNA, 22 nt, Human
cucuuuuuuugucuuaagaacc

SEQ ID NO: 158165 - RNA, 21 nt, Human
cugugggaaggccugaggucu

SEQ ID NO: 158166 - RNA, 19 nt, Human
cugaaacacagagagggcu

SEQ ID NO: 158167 - RNA, 22 nt, Human
cuguuaauugugaauuuuacau

SEQ ID NO: 158168 - RNA, 22 nt, Human
cucuggcaacgauggugcuuau

SEQ ID NO: 158169 - RNA, 22 nt, Human
cuguccuguggccugcuccggu

SEQ ID NO: 158170 - RNA, 22 nt, Human
cuguccugauggugccacuggu

SEQ ID NO: 158171 - RNA, 22 nt, Human
cugggguaucuggugucuuggu

SEQ ID NO: 158172 - RNA, 22 nt, Human
cucacgguuugcaucaagagug

SEQ ID NO: 158173 - RNA, 22 nt, Human
cucaaauggguuuguagaauau

SEQ ID NO: 158174 - RNA, 22 nt, Human
cucaaaauccauaaaaucaggu

SEQ ID NO: 158175 - RNA, 22 nt, Human
cugcuugaugaggaaaggauug

SEQ ID NO: 158176 - RNA, 22 nt, Human
cugcuucacccugccugagaac

SEQ ID NO: 158177 - RNA, 22 nt, Human
cucaucagagcccuccucuggc

SEQ ID NO: 158178 - RNA, 22 nt, Human
cuggcaguguccagcucgugau

SEQ ID NO: 158179 - RNA, 22 nt, Human
cucagcaacccacacacggucu

SEQ ID NO: 158180 - RNA, 22 nt, Human
cucagcgggagucuggccgaac

SEQ ID NO: 158181 - RNA, 22 nt, Human
cuauuuucccauaugguugaca

SEQ ID NO: 158182 - RNA, 22 nt, Human
cgccgugucuggucuguacguc

SEQ ID NO: 158183 - RNA, 22 nt, Human
cucaaagcagacuuuucccuuu

SEQ ID NO: 158184 - RNA, 22 nt, Human
cgcgcgguguuccgcauucugc

SEQ ID NO: 158185 - RNA, 22 nt, Human
cgcaucggguagaggagcugga

SEQ ID NO: 158186 - RNA, 18 nt, Human
cuaguuuguuuucuacau

SEQ ID NO: 158187 - RNA, 22 nt, Human
cgccgccgccugcccgcgcccc

SEQ ID NO: 158188 - RNA, 22 nt, Human
cggagggcccucaggacugggu

SEQ ID NO: 158189 - RNA, 22 nt, Human
cggccgcgggauggcgggcagc

SEQ ID NO: 158190 - RNA, 22 nt, Human
cucugauuuuucuaauacuuca

SEQ ID NO: 158191 - RNA, 22 nt, Human
cuccuauugaucaguacuauuu

SEQ ID NO: 158192 - RNA, 22 nt, Human
cuccaaaucugauugcuaccuu

SEQ ID NO: 158193 - RNA, 22 nt, Human
ccuuugcccugagaaauguucc

SEQ ID NO: 158194 - RNA, 22 nt, Human
ccuuuccuggaaaugguaaguu

SEQ ID NO: 158195 - RNA, 22 nt, Human
cgucuaaggaacuccauucaca

SEQ ID NO: 158196 - RNA, 22 nt, Human
ccuggcccagcuggaagcggga

SEQ ID NO: 158197 - RNA, 22 nt, Human
cgggagaugaggagagcuucgg

SEQ ID NO: 158198 - RNA, 22 nt, Human
ccuugguuuagcaauuuuucuu

SEQ ID NO: 158199 - RNA, 22 nt, Human
cgauuccugauaagugaauaag

SEQ ID NO: 158200 - RNA, 22 nt, Human
cuacuuucuucuucagaauugu

SEQ ID NO: 158201 - RNA, 18 nt, Human
cgauguguaugugauuug

SEQ ID NO: 158202 - RNA, 22 nt, Human
cuaaacacuauucuggaaauag

SEQ ID NO: 158203 - RNA, 20 nt, Human
cguguacauuuaugccccug

SEQ ID NO: 158204 - RNA, 22 nt, Human
cuaccccaggccccucgaugcc

SEQ ID NO: 158205 - RNA, 22 nt, Human
cuacauaaauuuaucacagacu

SEQ ID NO: 158206 - RNA, 22 nt, Human
cgagguuuaugaguuuguguuc

SEQ ID NO: 158207 - RNA, 22 nt, Human
cgaggcuugcaaggacgaggag

SEQ ID NO: 158208 - RNA, 22 nt, Human
cgcccccgaucggggccgccgc

SEQ ID NO: 158209 - RNA, 22 nt, Human
cgcccggcugagacgcucgccc

SEQ ID NO: 158210 - RNA, 22 nt, Human
cgcacacaaaugcauacgccag

SEQ ID NO: 158211 - RNA, 22 nt, Human
cgaaggaaucacuuaacacuuu

SEQ ID NO: 158212 - RNA, 19 nt, Human
ccuccguguuaccuguccu

SEQ ID NO: 158213 - RNA, 22 nt, Human
ccuagcauagcuuuugccuccc

SEQ ID NO: 158214 - RNA, 22 nt, Human
cgaaaaagaagugcaccauguu

SEQ ID NO: 158215 - RNA, 22 nt, Human
ccguaugacuuuuuguuguugu

SEQ ID NO: 158216 - RNA, 22 nt, Human
cggaagcacuagacacugacac

SEQ ID NO: 158217 - RNA, 22 nt, Human
cgcuuugguaauagggcagccu

SEQ ID NO: 158218 - RNA, 22 nt, Human
cggcuucucgggucggauuccg

SEQ ID NO: 158219 - RNA, 22 nt, Human
cgggagagacagaggaggcgcc

SEQ ID NO: 158220 - RNA, 22 nt, Human
cggcugcgguucaccuagggca

SEQ ID NO: 158221 - RNA, 22 nt, Human
cggaggcugcuuucuguugcua

SEQ ID NO: 158222 - RNA, 19 nt, Human
cgcugcucccgcuguggcu

SEQ ID NO: 158223 - RNA, 22 nt, Human
cgcugcugucaucgucuacggu

SEQ ID NO: 158224 - RNA, 22 nt, Human
cgccgugcagucagcccagaag

SEQ ID NO: 158225 - RNA, 22 nt, Human
cgcccguacuuugccggcauga

SEQ ID NO: 158226 - RNA, 22 nt, Human
ccugacgcugauauauaguuaa

SEQ ID NO: 158227 - RNA, 22 nt, Human
ccuuuccucuucaugacuuucu

SEQ ID NO: 158228 - RNA, 22 nt, Human
ccuuucuaacagauuguggauc

SEQ ID NO: 158229 - RNA, 22 nt, Human
ccggauuugggagccaccaggg

SEQ ID NO: 158230 - RNA, 22 nt, Human
ccggcugagccucgccgcggcc

SEQ ID NO: 158231 - RNA, 22 nt, Human
ccgggcggcauccagccguucc

SEQ ID NO: 158232 - RNA, 22 nt, Human
ccuuuuaucgcgaagaacucca

SEQ ID NO: 158233 - RNA, 22 nt, Human
ccuuuggaugucauucuuggca

SEQ ID NO: 158234 - RNA, 21 nt, Human
ccuuuggagacugcagcaaug

SEQ ID NO: 158235 - RNA, 22 nt, Human
ccgaaccacacgacagugcuca

SEQ ID NO: 158236 - RNA, 22 nt, Human
ccgcgcccccggcugugccccc

SEQ ID NO: 158237 - RNA, 21 nt, Human
ccgacggcgcagaugccggcc

SEQ ID NO: 158238 - RNA, 22 nt, Human
ccgcggcagaggcgggggcgcc

SEQ ID NO: 158239 - RNA, 22 nt, Human
ccgcggcugcgcggugccccuc

SEQ ID NO: 158240 - RNA, 22 nt, Human
ccugucugaaggcagggggaug

SEQ ID NO: 158241 - RNA, 20 nt, Human
ccuguucacugcgcaguuuc

SEQ ID NO: 158242 - RNA, 22 nt, Human
ccuuagaaaaucauggaauauu

SEQ ID NO: 158243 - RNA, 22 nt, Human
ccugucuuuucugaucauacua

SEQ ID NO: 158244 - RNA, 22 nt, Human
cauuccccaacucaacagggcu

SEQ ID NO: 158245 - RNA, 22 nt, Human
ccacuacauugagugcuuucuc

SEQ ID NO: 158246 - RNA, 21 nt, Human
ccacaucaugucaccuccuag

SEQ ID NO: 158247 - RNA, 19 nt, Human
ccacacacuggucucuggg

SEQ ID NO: 158248 - RNA, 21 nt, Human
ccacaauucuaguuacauaug

SEQ ID NO: 158249 - RNA, 22 nt, Human
cauguauguuaguggcugcuuu

SEQ ID NO: 158250 - RNA, 22 nt, Human
ccaaccaguuaucuccuaaggu

SEQ ID NO: 158251 - RNA, 22 nt, Human
caugcgucugcauuggguggug

SEQ ID NO: 158252 - RNA, 22 nt, Human
caugggaauaaaguuauuucaa

SEQ ID NO: 158253 - RNA, 22 nt, Human
caugggaaauauaagaauuuuc

SEQ ID NO: 158254 - RNA, 22 nt, Human
cauggccaaagaauuauauuuu

SEQ ID NO: 158255 - RNA, 22 nt, Human
ccaaauuguuguuguuguuguu

SEQ ID NO: 158256 - RNA, 22 nt, Human
ccaaagaauuuggaaaaucuga

SEQ ID NO: 158257 - RNA, 22 nt, Human
ccaaagaagcaaugagaauagu

SEQ ID NO: 158258 - RNA, 22 nt, Human
ccaaaauauuagugcuuaagua

SEQ ID NO: 158259 - RNA, 22 nt, Human
cauuuuuuuuccccuccuggua

SEQ ID NO: 158260 - RNA, 22 nt, Human
caugcagcagaauaaugacuau

SEQ ID NO: 158261 - RNA, 22 nt, Human
cauuuugguccucauguguagc

SEQ ID NO: 158262 - RNA, 22 nt, Human
cauuuugguaauguucguuugc

SEQ ID NO: 158263 - RNA, 20 nt, Human
caugaguccgugaguggccc

SEQ ID NO: 158264 - RNA, 22 nt, Human
cauuuaucacuugcuaaacaua

SEQ ID NO: 158265 - RNA, 22 nt, Human
cauuucaaacaguuacagcugc

SEQ ID NO: 158266 - RNA, 22 nt, Human
cauuuacguaacaguaacgcug

SEQ ID NO: 158267 - RNA, 22 nt, Human
cauugcuguuaauugucucuag

SEQ ID NO: 158268 - RNA, 22 nt, Human
caucuaaaauaagccuuauaau

SEQ ID NO: 158269 - RNA, 22 nt, Human
caucacggagcaugagaagaca

SEQ ID NO: 158270 - RNA, 22 nt, Human
cauuccaaguauauacaugaua

SEQ ID NO: 158271 - RNA, 22 nt, Human
cauuccaagaaguaguucugca

SEQ ID NO: 158272 - RNA, 22 nt, Human
cagguuuuuauuacaacuuuga

SEQ ID NO: 158273 - RNA, 22 nt, Human
caucaggcugggaacacagauc

SEQ ID NO: 158274 - RNA, 21 nt, Human
caucaagaucaauggagggcu

SEQ ID NO: 158275 - RNA, 21 nt, Human
ccaucuugaaccaugcccacu

SEQ ID NO: 158276 - RNA, 23 nt, Human
ccacaugugagcccaccgugccc

SEQ ID NO: 158277 - RNA, 19 nt, Human
ccaguuuuuuaauauucaa

SEQ ID NO: 158278 - RNA, 22 nt, Human
cccacgccuucuuucuucaaau

SEQ ID NO: 158279 - RNA, 22 nt, Human
ccauuucacaucccugacaugu

SEQ ID NO: 158280 - RNA, 22 nt, Human
ccacucucucccucuguagggg

SEQ ID NO: 158281 - RNA, 22 nt, Human
ccacuauaucaaggauuuuguu

SEQ ID NO: 158282 - RNA, 22 nt, Human
ccauguaagcuggacuccuggg

SEQ ID NO: 158283 - RNA, 22 nt, Human
ccacuuugagaagcugaugaaa

SEQ ID NO: 158284 - RNA, 22 nt, Human
ccaaucaacuguguggcuuucu

SEQ ID NO: 158285 - RNA, 22 nt, Human
ccaauuuuggaauuauuaggca

SEQ ID NO: 158286 - RNA, 22 nt, Human
ccaaggcugcagccgugacgcg

SEQ ID NO: 158287 - RNA, 22 nt, Human
cauuuuuccucaggcaauuuga

SEQ ID NO: 158288 - RNA, 22 nt, Human
ccagcuuuucagaaucugccug

SEQ ID NO: 158289 - RNA, 22 nt, Human
ccagccugagcuugcugcccuc

SEQ ID NO: 158290 - RNA, 22 nt, Human
ccagcucgaggcaggggcugca

SEQ ID NO: 158291 - RNA, 22 nt, Human
cauuuucugcaagucugcucaa

SEQ ID NO: 158292 - RNA, 22 nt, Human
cauuuuaucagcacacgucacu

SEQ ID NO: 158293 - RNA, 22 nt, Human
cauuucuggccuggggagcggg

SEQ ID NO: 158294 - RNA, 22 nt, Human
cauuuagagaagauuacaagga

SEQ ID NO: 158295 - RNA, 22 nt, Human
cauuuaaccccuugguacugaa

SEQ ID NO: 158296 - RNA, 22 nt, Human
cauuggcacauguauucugggc

SEQ ID NO: 158297 - RNA, 22 nt, Human
ccagauaaacauuccuuggccu

SEQ ID NO: 158298 - RNA, 22 nt, Human
ccacuuucuaaauuggcgauuu

SEQ ID NO: 158299 - RNA, 19 nt, Human
ccacuucuuugugugugag

SEQ ID NO: 158300 - RNA, 22 nt, Human
cauuccuucucagguacuggca

SEQ ID NO: 158301 - RNA, 20 nt, Human
cauuccugaggaauucaugu

SEQ ID NO: 158302 - RNA, 22 nt, Human
cauugcaaccccaaaaagaaca

SEQ ID NO: 158303 - RNA, 22 nt, Human
cauugcugugggcauuugcugc

SEQ ID NO: 158304 - RNA, 22 nt, Human
cagaaauuggcagagaagaccu

SEQ ID NO: 158305 - RNA, 22 nt, Human
cacuguugagcaauguacagug

SEQ ID NO: 158306 - RNA, 22 nt, Human
cagccauucuaacacugccagu

SEQ ID NO: 158307 - RNA, 22 nt, Human
cagacaaauccuuaugagacug

SEQ ID NO: 158308 - RNA, 22 nt, Human
cagcauugagcacagaaggaaa

SEQ ID NO: 158309 - RNA, 22 nt, Human
cagacgguuaaacgauuuugcu

SEQ ID NO: 158310 - RNA, 22 nt, Human
cagcccuggccucuucgcuuuc

SEQ ID NO: 158311 - RNA, 22 nt, Human
cacccugacuggcccugcagga

SEQ ID NO: 158312 - RNA, 22 nt, Human
caccccauccccucccaauucc

SEQ ID NO: 158313 - RNA, 18 nt, Human
cacgcaacuguaaaaccc

SEQ ID NO: 158314 - RNA, 22 nt, Human
caccgaacuuugcaaaugcaau

SEQ ID NO: 158315 - RNA, 23 nt, Human
cagagaaaauagaauaugcugug

SEQ ID NO: 158316 - RNA, 22 nt, Human
cacugcaaccuccaccucccgg

SEQ ID NO: 158317 - RNA, 22 nt, Human
caaaagcaaagaucuuugauug

SEQ ID NO: 158318 - RNA, 22 nt, Human
cacuauaaugugauuucgcccu

SEQ ID NO: 158319 - RNA, 22 nt, Human
cacugcugaggcccguguuacu

SEQ ID NO: 158320 - RNA, 22 nt, Human
cacaucugaaggcggcucuagg

SEQ ID NO: 158321 - RNA, 22 nt, Human
cacauuuuccagaagaaucaga

SEQ ID NO: 158322 - RNA, 22 nt, Human
caccaaaauaucccuuuguaca

SEQ ID NO: 158323 - RNA, 22 nt, Human
cagacagagucuucccaucagu

SEQ ID NO: 158324 - RNA, 22 nt, Human
cagaaugugacaucaaaggcuc

SEQ ID NO: 158325 - RNA, 22 nt, Human
cacaguuuuaucuuauacugau

SEQ ID NO: 158326 - RNA, 22 nt, Human
cacaucaaacuuacuaagauuu

SEQ ID NO: 158327 - RNA, 22 nt, Human
caggauuuaauaagauaguguu

SEQ ID NO: 158328 - RNA, 22 nt, Human
caggccgcccucuccuguuagc

SEQ ID NO: 158329 - RNA, 22 nt, Human
caggcgcauggugagcagauga

SEQ ID NO: 158330 - RNA, 22 nt, Human
caggguuuuauuuggcuuuaaa

SEQ ID NO: 158331 - RNA, 22 nt, Human
cagcuucaugacaaacaguuuu

SEQ ID NO: 158332 - RNA, 22 nt, Human
cagcccuugcgacacccuggcu

SEQ ID NO: 158333 - RNA, 21 nt, Human
cagagcuuuggagacggagga

SEQ ID NO: 158334 - RNA, 22 nt, Human
cagccgcucaugggcccggagc

SEQ ID NO: 158335 - RNA, 22 nt, Human
cagcgguggcaaggugacugug

SEQ ID NO: 158336 - RNA, 22 nt, Human
caggagaaauucacauuaguga

SEQ ID NO: 158337 - RNA, 22 nt, Human
caggugauuuuguuuucaaaug

SEQ ID NO: 158338 - RNA, 22 nt, Human
cauaaucaagggguugugaugu

SEQ ID NO: 158339 - RNA, 22 nt, Human
caguuuuucaaaauuacaugau

SEQ ID NO: 158340 - RNA, 22 nt, Human
cauaaauuuuaccuuguaagug

SEQ ID NO: 158341 - RNA, 22 nt, Human
cauagcauguguuuauuuucuu

SEQ ID NO: 158342 - RNA, 22 nt, Human
cauaucuccagguucugcugga

SEQ ID NO: 158343 - RNA, 22 nt, Human
caguucuguaccaggagaagcu

SEQ ID NO: 158344 - RNA, 22 nt, Human
caggguuuuaguugcagguuau

SEQ ID NO: 158345 - RNA, 22 nt, Human
caggcacaagaucggcuagaua

SEQ ID NO: 158346 - RNA, 22 nt, Human
cagguuucuggaugcagcccca

SEQ ID NO: 158347 - RNA, 22 nt, Human
cagguuuggaagucacgaagcu

SEQ ID NO: 158348 - RNA, 22 nt, Human
cagugccggccaggaccuccug

SEQ ID NO: 158349 - RNA, 22 nt, Human
caggcacaaugagcgccaucuu

SEQ ID NO: 158350 - RNA, 22 nt, Human
cagguguugcaguugaagacug

SEQ ID NO: 158351 - RNA, 23 nt, Human
cagguuacacuuuaaaauaugca

SEQ ID NO: 158352 - RNA, 20 nt, Human
cagguugcugcccccgccuc

SEQ ID NO: 158353 - RNA, 22 nt, Human
auggaauuuaaauuuugguguc

SEQ ID NO: 158354 - RNA, 19 nt, Human
augguauugcuggguuuuu

SEQ ID NO: 158355 - RNA, 22 nt, Human
auggggaauugaccguggaucu

SEQ ID NO: 158356 - RNA, 22 nt, Human
auggauggaagcagccugaacu

SEQ ID NO: 158357 - RNA, 22 nt, Human
augcugccuccucuucagccgc

SEQ ID NO: 158358 - RNA, 22 nt, Human
auggagggguuguugcuugagu

SEQ ID NO: 158359 - RNA, 22 nt, Human
auggagcgggaggauggaggag

SEQ ID NO: 158360 - RNA, 22 nt, Human
auggagcagagcugaugggccu

SEQ ID NO: 158361 - RNA, 22 nt, Human
auggaggaugugcagcaugggc

SEQ ID NO: 158362 - RNA, 22 nt, Human
auggaagagacaaugcuaucug

SEQ ID NO: 158363 - RNA, 22 nt, Human
auggaacccgggcgucugcucu

SEQ ID NO: 158364 - RNA, 22 nt, Human
augauuuguuaacagacuuaau

SEQ ID NO: 158365 - RNA, 22 nt, Human
augcaaaaucuuauuuuuucua

SEQ ID NO: 158366 - RNA, 22 nt, Human
auguuuucauuuagaagcuaau

SEQ ID NO: 158367 - RNA, 22 nt, Human
auguuugugauugcugaaaaga

SEQ ID NO: 158368 - RNA, 22 nt, Human
auguuuucuugucuggagaagu

SEQ ID NO: 158369 - RNA, 22 nt, Human
auguuuugaguuuuuuuacacc

SEQ ID NO: 158370 - RNA, 22 nt, Human
auguuuuuugaaaauguauuuu

SEQ ID NO: 158371 - RNA, 22 nt, Human
auuaaaaaugagaguagggauu

SEQ ID NO: 158372 - RNA, 22 nt, Human
auuaaagcaugaauaauaugua

SEQ ID NO: 158373 - RNA, 22 nt, Human
augugugugcgagcgugugugu

SEQ ID NO: 158374 - RNA, 22 nt, Human
auguguuuccaacagagaggga

SEQ ID NO: 158375 - RNA, 22 nt, Human
auguuguuuauggguuaucaag

SEQ ID NO: 158376 - RNA, 22 nt, Human
auggggaucugcaguguugauc

SEQ ID NO: 158377 - RNA, 22 nt, Human
augggcggugcauuugcacagu

SEQ ID NO: 158378 - RNA, 22 nt, Human
augggcauacaaaugcuacccu

SEQ ID NO: 158379 - RNA, 22 nt, Human
auggcagcggagcuggaaauga

SEQ ID NO: 158380 - RNA, 22 nt, Human
auggugugugugugugugugug

SEQ ID NO: 158381 - RNA, 22 nt, Human
augggagggagcagugaguguu

SEQ ID NO: 158382 - RNA, 22 nt, Human
augggaauggauugagugggug

SEQ ID NO: 158383 - RNA, 22 nt, Human
auguccugguccacagaaggga

SEQ ID NO: 158384 - RNA, 22 nt, Human
auguaaugucaaucuucagugg

SEQ ID NO: 158385 - RNA, 22 nt, Human
auguggaaagcuugucuuagag

SEQ ID NO: 158386 - RNA, 22 nt, Human
augaggauuagcaucugcaaau

SEQ ID NO: 158387 - RNA, 19 nt, Human
augcacgugaaaugcauuu

SEQ ID NO: 158388 - RNA, 22 nt, Human
augcacaagguagauuauuauu

SEQ ID NO: 158389 - RNA, 23 nt, Human
augaacgcacugagaucauaauu

SEQ ID NO: 158390 - RNA, 22 nt, Human
aucuuuuuucacaauuuauuuu

SEQ ID NO: 158391 - RNA, 22 nt, Human
augaaggauagggcaaaauuuu

SEQ ID NO: 158392 - RNA, 22 nt, Human
aucuguucuucaaaauauuaca

SEQ ID NO: 158393 - RNA, 22 nt, Human
augaauuaucugguguuggaaa

SEQ ID NO: 158394 - RNA, 22 nt, Human
augaaaacggaccagagcuauu

SEQ ID NO: 158395 - RNA, 22 nt, Human
aucuuggauccuuugccagcuu

SEQ ID NO: 158396 - RNA, 22 nt, Human
augacugaugcugacucauggg

SEQ ID NO: 158397 - RNA, 22 nt, Human
aucuuugauuuuggcuuuuagg

SEQ ID NO: 158398 - RNA, 22 nt, Human
aucuagguuuggaagauagagu

SEQ ID NO: 158399 - RNA, 22 nt, Human
aucuugaaacauauaugcauuu

SEQ ID NO: 158400 - RNA, 22 nt, Human
aucugcauguggcagguggauu

SEQ ID NO: 158401 - RNA, 22 nt, Human
aucucuguaaaccauaaauuga

SEQ ID NO: 158402 - RNA, 22 nt, Human
aucuuuguaaguaaucaaagcu

SEQ ID NO: 158403 - RNA, 22 nt, Human
aucugcugccuaggguuugucu

SEQ ID NO: 158404 - RNA, 22 nt, Human
aucuccaguuagcaguacugau

SEQ ID NO: 158405 - RNA, 22 nt, Human
auaaugccucauaggguguucc

SEQ ID NO: 158406 - RNA, 22 nt, Human
caaaguaggcuaagaccuucca

SEQ ID NO: 158407 - RNA, 22 nt, Human
caaauacguuuggcuggagcac

SEQ ID NO: 158408 - RNA, 22 nt, Human
caaacauuuguuggaaccccug

SEQ ID NO: 158409 - RNA, 22 nt, Human
caaaccuagagaggagaggaca

SEQ ID NO: 158410 - RNA, 22 nt, Human
auuuuguugaaacccuuguugu

SEQ ID NO: 158411 - RNA, 22 nt, Human
caaaauuguugaugcugcuuug

SEQ ID NO: 158412 - RNA, 22 nt, Human
auuuuugugcuuuauuggggua

SEQ ID NO: 158413 - RNA, 22 nt, Human
auuuuugguuucaccugcacgc

SEQ ID NO: 158414 - RNA, 22 nt, Human
auuuuugugucacaucuaggaa

SEQ ID NO: 158415 - RNA, 22 nt, Human
caaauuuuuauuuaccaucugc

SEQ ID NO: 158416 - RNA, 22 nt, Human
auuuuuuuuccugucucuuuca

SEQ ID NO: 158417 - RNA, 22 nt, Human
auuuuuuuggucauaugagaua

SEQ ID NO: 158418 - RNA, 22 nt, Human
auuuuuucaugugugguugaga

SEQ ID NO: 158419 - RNA, 22 nt, Human
auuuuggguguuaacaaugaaa

SEQ ID NO: 158420 - RNA, 22 nt, Human
auuuuuagagugaaagaauuaa

SEQ ID NO: 158421 - RNA, 22 nt, Human
auuucuguaauucugaggagug

SEQ ID NO: 158422 - RNA, 22 nt, Human
auuuugcaguuuauugccaauc

SEQ ID NO: 158423 - RNA, 17 nt, Human
auuuccgaguuucuuuc

SEQ ID NO: 158424 - RNA, 22 nt, Human
auuuuuagucuugcugcaauca

SEQ ID NO: 158425 - RNA, 22 nt, Human
auuuuucacauuuugggggaca

SEQ ID NO: 158426 - RNA, 21 nt, Human
auuuuucagaaggaugugaua

SEQ ID NO: 158427 - RNA, 19 nt, Human
auuuugguucuuuccauuc

SEQ ID NO: 158428 - RNA, 22 nt, Human
auuuucauauggguuauuugua

SEQ ID NO: 158429 - RNA, 22 nt, Human
auuuuagagaaacaaacguagg

SEQ ID NO: 158430 - RNA, 22 nt, Human
auuuuauuuugggaucuuuuua

SEQ ID NO: 158431 - RNA, 22 nt, Human
auuuuacuaugauaguugagaa

SEQ ID NO: 158432 - RNA, 22 nt, Human
auugacagaaaauuggauggca

SEQ ID NO: 158433 - RNA, 22 nt, Human
auucuugauauagauaguuaau

SEQ ID NO: 158434 - RNA, 19 nt, Human
auugguuugcucgggaaug

SEQ ID NO: 158435 - RNA, 22 nt, Human
auugaauuagauguuguagucc

SEQ ID NO: 158436 - RNA, 22 nt, Human
auuggcugucagcccggauggg

SEQ ID NO: 158437 - RNA, 22 nt, Human
auugguuucuuguggguuaucc

SEQ ID NO: 158438 - RNA, 20 nt, Human
auucuuguuccauuucccag

SEQ ID NO: 158439 - RNA, 22 nt, Human
auucuuuagaguccuucaaaua

SEQ ID NO: 158440 - RNA, 22 nt, Human
auugauuuugugcuuuccuacg

SEQ ID NO: 158441 - RNA, 22 nt, Human
auugaugccugaaaaauaugua

SEQ ID NO: 158442 - RNA, 23 nt, Human
auugccuguagaucuucacuuuc

SEQ ID NO: 158443 - RNA, 22 nt, Human
auugccauaauagagccaugua

SEQ ID NO: 158444 - RNA, 22 nt, Human
auugcauucaugcuccccuuag

SEQ ID NO: 158445 - RNA, 22 nt, Human
auugaguauuguaaauaaaaca

SEQ ID NO: 158446 - RNA, 22 nt, Human
auuucauuuuagaaauaagugu

SEQ ID NO: 158447 - RNA, 22 nt, Human
auuucagcagcccauguuugga

SEQ ID NO: 158448 - RNA, 22 nt, Human
auuucaguuugcaguuucucuc

SEQ ID NO: 158449 - RNA, 22 nt, Human
auuucccugcagugcuuaggaa

SEQ ID NO: 158450 - RNA, 22 nt, Human
auuuagacaacaagccuucucc

SEQ ID NO: 158451 - RNA, 22 nt, Human
auuuaggacagugucugaauug

SEQ ID NO: 158452 - RNA, 22 nt, Human
auuuagagaaguagcaaggucc

SEQ ID NO: 158453 - RNA, 22 nt, Human
auuugccaguuacucacaccac

SEQ ID NO: 158454 - RNA, 22 nt, Human
auuugacuugguaagacuuaag

SEQ ID NO: 158455 - RNA, 22 nt, Human
auuguuuccccggaauuauuca

SEQ ID NO: 158456 - RNA, 22 nt, Human
auuggaagacgcuggaggcacu

SEQ ID NO: 158457 - RNA, 22 nt, Human
auucuagaguuucaauccaagg

SEQ ID NO: 158458 - RNA, 22 nt, Human
auucucuauugguaaauuugac

SEQ ID NO: 158459 - RNA, 22 nt, Human
auguugcugauccuguggcugu

SEQ ID NO: 158460 - RNA, 22 nt, Human
auguuguugaacucuuugcaug

SEQ ID NO: 158461 - RNA, 22 nt, Human
auuaaagcuaguugagauuuaa

SEQ ID NO: 158462 - RNA, 22 nt, Human
auuccccagcaggccuuuuguu

SEQ ID NO: 158463 - RNA, 22 nt, Human
auuauaguuuugcccuuaagaa

SEQ ID NO: 158464 - RNA, 22 nt, Human
auucuguugguuuaauagucaa

SEQ ID NO: 158465 - RNA, 22 nt, Human
auucuguuuuaccauuuucuuu

SEQ ID NO: 158466 - RNA, 22 nt, Human
auucugcugccuaguuuaugaa

SEQ ID NO: 158467 - RNA, 21 nt, Human
auucugauguuucuauuguuu

SEQ ID NO: 158468 - RNA, 22 nt, Human
auucugaagcagaaaaggcaga

SEQ ID NO: 158469 - RNA, 22 nt, Human
auucaagauaagggucugggag

SEQ ID NO: 158470 - RNA, 22 nt, Human
auuauugcaagcagugaaggga

SEQ ID NO: 158471 - RNA, 22 nt, Human
auugacuucccaucaggugagu

SEQ ID NO: 158472 - RNA, 22 nt, Human
auugaagcauggagaugaggca

SEQ ID NO: 158473 - RNA, 22 nt, Human
auugaaguguacguuugaucua

SEQ ID NO: 158474 - RNA, 22 nt, Human
auucuacucuuuaaauaugaaa

SEQ ID NO: 158475 - RNA, 20 nt, Human
auucucaccaugugacaugg

SEQ ID NO: 158476 - RNA, 22 nt, Human
auucccuuugacgaucccuagg

SEQ ID NO: 158477 - RNA, 22 nt, Human
auugaaauuaauuucugcuuuc

SEQ ID NO: 158478 - RNA, 22 nt, Human
auugaguucaccucuuucagaa

SEQ ID NO: 158479 - RNA, 22 nt, Human
auugaugaaaauaguuauuuua

SEQ ID NO: 158480 - RNA, 18 nt, Human
auugagcaugacagaccu

SEQ ID NO: 158481 - RNA, 22 nt, Human
auugaguacuugcugggcucuc

SEQ ID NO: 158482 - RNA, 22 nt, Human
auugcaggucguguggaaguga

SEQ ID NO: 158483 - RNA, 22 nt, Human
auucucugaugcagguggaaga

SEQ ID NO: 158484 - RNA, 22 nt, Human
auucucuguacagaagguaccg

SEQ ID NO: 158485 - RNA, 22 nt, Human
auucuguuuaauacacgaaagg

SEQ ID NO: 158486 - RNA, 22 nt, Human
auaaaaaguggcugcuauugga

SEQ ID NO: 158487 - RNA, 22 nt, Human
auaaaaauguuuuuguguggua

SEQ ID NO: 158488 - RNA, 22 nt, Human
auaaauuugccagcauauguuc

SEQ ID NO: 158489 - RNA, 22 nt, Human
auaaauucuaugauggauuggg

SEQ ID NO: 158490 - RNA, 22 nt, Human
auaaaucaagggcaguauuucc

SEQ ID NO: 158491 - RNA, 22 nt, Human
auaaagggccuuauuuuagcaa

SEQ ID NO: 158492 - RNA, 22 nt, Human
auaaaaucugaagcaagaauaa

SEQ ID NO: 158493 - RNA, 22 nt, Human
auaaaagcacaauagaguuaug

SEQ ID NO: 158494 - RNA, 22 nt, Human
auaaaacagaucaggagaauga

SEQ ID NO: 158495 - RNA, 22 nt, Human
auaacgaaagcaauuauuuuca

SEQ ID NO: 158496 - RNA, 22 nt, Human
auaagguuuucuuuuguucccu

SEQ ID NO: 158497 - RNA, 22 nt, Human
auaaauuugacagcucuucaug

SEQ ID NO: 158498 - RNA, 22 nt, Human
auacacauguuauuguggaagc

SEQ ID NO: 158499 - RNA, 22 nt, Human
auaaucuuugaguagaguugag

SEQ ID NO: 158500 - RNA, 22 nt, Human
auaaucuuuccagucaguuucc

SEQ ID NO: 158501 - RNA, 21 nt, Human
auaccaaaagaacaccuuguu

SEQ ID NO: 158502 - RNA, 22 nt, Human
auacaaaaaguggugaguguau

SEQ ID NO: 158503 - RNA, 22 nt, Human
aguuguuuuucuuagauuuuag

SEQ ID NO: 158504 - RNA, 22 nt, Human
aguuuggauccugcuaaaccag

SEQ ID NO: 158505 - RNA, 22 nt, Human
aguuuggaggagaaagugcggg

SEQ ID NO: 158506 - RNA, 22 nt, Human
aguuucaguuaguugggugaca

SEQ ID NO: 158507 - RNA, 22 nt, Human
aguuuaaauuguucuaucagaa

SEQ ID NO: 158508 - RNA, 18 nt, Human
aguuuuuuuggcaaaagg

SEQ ID NO: 158509 - RNA, 22 nt, Human
aguuucuugaagacugauguuu

SEQ ID NO: 158510 - RNA, 22 nt, Human
aguuucccucacaggucugcau

SEQ ID NO: 158511 - RNA, 22 nt, Human
aguuuuugccucgaauucugcg

SEQ ID NO: 158512 - RNA, 22 nt, Human
aguuuuugagaauucuucugaa

SEQ ID NO: 158513 - RNA, 22 nt, Human
aguuuuuaacgccauguuugaa

SEQ ID NO: 158514 - RNA, 22 nt, Human
aguuuucugccucuggaugcgu

SEQ ID NO: 158515 - RNA, 22 nt, Human
aguugguucgucucgccuugag

SEQ ID NO: 158516 - RNA, 22 nt, Human
aguugcagguucacguaucuug

SEQ ID NO: 158517 - RNA, 22 nt, Human
aguuggaagacacccugaaauc

SEQ ID NO: 158518 - RNA, 22 nt, Human
aguucuguucccccaguuacau

SEQ ID NO: 158519 - RNA, 22 nt, Human
aguuccaaauuugcaagaaaau

SEQ ID NO: 158520 - RNA, 22 nt, Human
aguucggauuguaauagauaau

SEQ ID NO: 158521 - RNA, 19 nt, Human
agugggcaaggaagaugac

SEQ ID NO: 158522 - RNA, 22 nt, Human
agugccuucuagaaucucuuaa

SEQ ID NO: 158523 - RNA, 22 nt, Human
agugauguaauggugaauguga

SEQ ID NO: 158524 - RNA, 22 nt, Human
agugaugauccaaaugaauuga

SEQ ID NO: 158525 - RNA, 22 nt, Human
aguaggaauucaaagagacaaa

SEQ ID NO: 158526 - RNA, 22 nt, Human
agugaagauagagccaggucug

SEQ ID NO: 158527 - RNA, 22 nt, Human
agugaauuagccuauuuguaaa

SEQ ID NO: 158528 - RNA, 22 nt, Human
agugaugcuuuggagaagaucc

SEQ ID NO: 158529 - RNA, 22 nt, Human
aguucauccucauuuacaagga

SEQ ID NO: 158530 - RNA, 22 nt, Human
aguuauuuuucacuauuaggcu

SEQ ID NO: 158531 - RNA, 22 nt, Human
aguuaugcaagcaaguaccacu

SEQ ID NO: 158532 - RNA, 23 nt, Human
aguuaucuaaugaaguucuucca

SEQ ID NO: 158533 - RNA, 22 nt, Human
aguguuugggagagggugugag

SEQ ID NO: 158534 - RNA, 22 nt, Human
aguguuuuaugugccaguuuaa

SEQ ID NO: 158535 - RNA, 22 nt, Human
aguuaaucuuguauuaaugguu

SEQ ID NO: 158536 - RNA, 22 nt, Human
aguguguauauaugugugugug

SEQ ID NO: 158537 - RNA, 22 nt, Human
aguguucaauuugagcucaaag

SEQ ID NO: 158538 - RNA, 20 nt, Human
aguguugaacuacacuuccc

SEQ ID NO: 158539 - RNA, 22 nt, Human
aguguuuuaagaaaguaauuuu

SEQ ID NO: 158540 - RNA, 22 nt, Human
agugucagcagcuucauugucu

SEQ ID NO: 158541 - RNA, 22 nt, Human
aguguauuugccuauaaaaaug

SEQ ID NO: 158542 - RNA, 22 nt, Human
aguggggaaauaucaauauuug

SEQ ID NO: 158543 - RNA, 22 nt, Human
agugggaaagcugccuuguaga

SEQ ID NO: 158544 - RNA, 23 nt, Human
aguguucagcauguaguaaauac

SEQ ID NO: 158545 - RNA, 22 nt, Human
agggggaaaauguggauuaugg

SEQ ID NO: 158546 - RNA, 22 nt, Human
aggguuucucuccaguguggac

SEQ ID NO: 158547 - RNA, 22 nt, Human
agguauuuuaugucgugugaug

SEQ ID NO: 158548 - RNA, 22 nt, Human
aggucggcuuuuuuccuuucac

SEQ ID NO: 158549 - RNA, 22 nt, Human
aggucguauaguuaccuccuug

SEQ ID NO: 158550 - RNA, 22 nt, Human
aggggcugagaguuugaugugg

SEQ ID NO: 158551 - RNA, 22 nt, Human
aggggcuuguggaguugcuggu

SEQ ID NO: 158552 - RNA, 22 nt, Human
aggcuucaaggacagcagccac

SEQ ID NO: 158553 - RNA, 22 nt, Human
aggcuuuugcucuggcuccucu

SEQ ID NO: 158554 - RNA, 22 nt, Human
aggcuuagaugaguucccacau

SEQ ID NO: 158555 - RNA, 18 nt, Human
aggcuggggaucacaggg

SEQ ID NO: 158556 - RNA, 22 nt, Human
aggcugucucaccucaggaggg

SEQ ID NO: 158557 - RNA, 22 nt, Human
agggcaguguggugggacugac

SEQ ID NO: 158558 - RNA, 22 nt, Human
agggcugggcuuggcaggcugg

SEQ ID NO: 158559 - RNA, 22 nt, Human
agggcaguuuuacugaaaggug

SEQ ID NO: 158560 - RNA, 21 nt, Human
agggccagaucaccaaggagc

SEQ ID NO: 158561 - RNA, 22 nt, Human
agguuuuugucauuuucuggua

SEQ ID NO: 158562 - RNA, 22 nt, Human
agguuuggaaguggcgauccau

SEQ ID NO: 158563 - RNA, 22 nt, Human
agguuuauggagcaccacaucu

SEQ ID NO: 158564 - RNA, 20 nt, Human
agguuugcuguauaucaugg

SEQ ID NO: 158565 - RNA, 22 nt, Human
agguuuuagagagccaggaugu

SEQ ID NO: 158566 - RNA, 22 nt, Human
aguaacuuaagcaauuguguau

SEQ ID NO: 158567 - RNA, 22 nt, Human
agguuguugagaucaucuggcu

SEQ ID NO: 158568 - RNA, 22 nt, Human
agguuuaggaaaacugagaguc

SEQ ID NO: 158569 - RNA, 22 nt, Human
agguuuggccuuggggggaguu

SEQ ID NO: 158570 - RNA, 18 nt, Human
agguugcaucugugcaga

SEQ ID NO: 158571 - RNA, 18 nt, Human
agguuguguaaaaagaag

SEQ ID NO: 158572 - RNA, 22 nt, Human
aggugggaauaauaaucaaagc

SEQ ID NO: 158573 - RNA, 22 nt, Human
agguuuggguucauugcuggcu

SEQ ID NO: 158574 - RNA, 19 nt, Human
aggugaugugacucuagaa

SEQ ID NO: 158575 - RNA, 18 nt, Human
agguguguuucuaggagc

SEQ ID NO: 158576 - RNA, 22 nt, Human
aggauuuagcaugaaaugugaa

SEQ ID NO: 158577 - RNA, 22 nt, Human
aggauauguccuuuuuuucccc

SEQ ID NO: 158578 - RNA, 22 nt, Human
aggauaaaggucauuauuccca

SEQ ID NO: 158579 - RNA, 22 nt, Human
aggauugauggcauguuuacug

SEQ ID NO: 158580 - RNA, 22 nt, Human
aggacaaaggaccagaucugga

SEQ ID NO: 158581 - RNA, 22 nt, Human
aggauuuauuccagaaaugcaa

SEQ ID NO: 158582 - RNA, 22 nt, Human
aggcaacagacaggcuugguuc

SEQ ID NO: 158583 - RNA, 22 nt, Human
aggauugucuccugugaugugc

SEQ ID NO: 158584 - RNA, 22 nt, Human
aggauucuccuguuucccaccc

SEQ ID NO: 158585 - RNA, 22 nt, Human
aggcacagaauccagucugcug

SEQ ID NO: 158586 - RNA, 22 nt, Human
aggagcugccggauggggcaug

SEQ ID NO: 158587 - RNA, 22 nt, Human
aggaauuuuaauaugcuugucu

SEQ ID NO: 158588 - RNA, 22 nt, Human
aggaauguugagacauggcuaa

SEQ ID NO: 158589 - RNA, 22 nt, Human
aggaauugucgucauguauaau

SEQ ID NO: 158590 - RNA, 22 nt, Human
aggaauuucacugcguuuuuua

SEQ ID NO: 158591 - RNA, 22 nt, Human
aggaauuugggguuacaugaug

SEQ ID NO: 158592 - RNA, 22 nt, Human
agcggcaagguguauguggcag

SEQ ID NO: 158593 - RNA, 22 nt, Human
agcggcaggaagcgcgcaagcg

SEQ ID NO: 158594 - RNA, 22 nt, Human
aggaaauaagggcacuucagau

SEQ ID NO: 158595 - RNA, 22 nt, Human
agcgcugugaaggcugggccac

SEQ ID NO: 158596 - RNA, 21 nt, Human
aggcauuuucuuggagauucu

SEQ ID NO: 158597 - RNA, 22 nt, Human
aggcaguggagcuggaauaggc

SEQ ID NO: 158598 - RNA, 22 nt, Human
aggcaguguggagggcuguugc

SEQ ID NO: 158599 - RNA, 22 nt, Human
aggcaucguguuuuucugcuuu

SEQ ID NO: 158600 - RNA, 22 nt, Human
aggcauuuaucaggaaauguuc

SEQ ID NO: 158601 - RNA, 22 nt, Human
aggcauuuaaagauguaagacu

SEQ ID NO: 158602 - RNA, 22 nt, Human
aggcauuuucuuguuauuuuua

SEQ ID NO: 158603 - RNA, 19 nt, Human
aggcugccucacccucccu

SEQ ID NO: 158604 - RNA, 22 nt, Human
aggcuaagugauuagugacaua

SEQ ID NO: 158605 - RNA, 22 nt, Human
aggcguggcuucugcuggguug

SEQ ID NO: 158606 - RNA, 22 nt, Human
aggccgcgguggcgaaggcguu

SEQ ID NO: 158607 - RNA, 22 nt, Human
aggcagaugggagcuggaaguu

SEQ ID NO: 158608 - RNA, 22 nt, Human
aggcaagauuaggaccagaaga

SEQ ID NO: 158609 - RNA, 22 nt, Human
aggcagcagggagggagaaaug

SEQ ID NO: 158610 - RNA, 22 nt, Human
aggcaggauuugcgaugugguu

SEQ ID NO: 158611 - RNA, 20 nt, Human
aggcagacaaggagucuguu

SEQ ID NO: 158612 - RNA, 22 nt, Human
aggcagagaggucuuccuggaa

SEQ ID NO: 158613 - RNA, 22 nt, Human
aggcagagauggcugcagggcc

SEQ ID NO: 158614 - RNA, 19 nt, Human
aggcagccccaacuugcau

SEQ ID NO: 158615 - RNA, 21 nt, Human
aggcagcgauuuucauauugc

SEQ ID NO: 158616 - RNA, 22 nt, Human
aggcagugguguuugcuggugg

SEQ ID NO: 158617 - RNA, 22 nt, Human
aggcauauaguguuuaaaaaaa

SEQ ID NO: 158618 - RNA, 22 nt, Human
aggcaguggcuuuuguuguguu

SEQ ID NO: 158619 - RNA, 23 nt, Human
aggcagaguccuggggcacagcc

SEQ ID NO: 158620 - RNA, 22 nt, Human
aggcaggcucaaugcccagucu

SEQ ID NO: 158621 - RNA, 22 nt, Human
acgccugccuguacuugugggg

SEQ ID NO: 158622 - RNA, 22 nt, Human
acgcgcuccagcaggugcuuca

SEQ ID NO: 158623 - RNA, 22 nt, Human
acgggggagucuuuuacaucau

SEQ ID NO: 158624 - RNA, 22 nt, Human
acgcacuuuaugcuuuuaacaa

SEQ ID NO: 158625 - RNA, 22 nt, Human
acggccgaugacuccagcaugg

SEQ ID NO: 158626 - RNA, 22 nt, Human
acggcggguuccgggccagccc

SEQ ID NO: 158627 - RNA, 22 nt, Human
acagucucucaagcauauccug

SEQ ID NO: 158628 - RNA, 22 nt, Human
acgcauguacuuguaugcaaug

SEQ ID NO: 158629 - RNA, 22 nt, Human
acgccuugagccuugccugaau

SEQ ID NO: 158630 - RNA, 22 nt, Human
acuauauaaugcacacaguaua

SEQ ID NO: 158631 - RNA, 22 nt, Human
acuauacaguauguacgugcac

SEQ ID NO: 158632 - RNA, 22 nt, Human
acggguuccuugagggcaggau

SEQ ID NO: 158633 - RNA, 22 nt, Human
acgguuuugugagguaguacuu

SEQ ID NO: 158634 - RNA, 22 nt, Human
acgucaucguugucaucgucau

SEQ ID NO: 158635 - RNA, 22 nt, Human
acguccgcugauucuuuggaag

SEQ ID NO: 158636 - RNA, 22 nt, Human
acuaauuuacagaaauuucuua

SEQ ID NO: 158637 - RNA, 22 nt, Human
acuaggaaguaaauaugucauc

SEQ ID NO: 158638 - RNA, 22 nt, Human
acucaaccaucugcauuuuuga

SEQ ID NO: 158639 - RNA, 22 nt, Human
acucaaacuuuuuguggacauu

SEQ ID NO: 158640 - RNA, 22 nt, Human
acugauuuuauauauuaccccg

SEQ ID NO: 158641 - RNA, 22 nt, Human
acugcauuaucaccaagaugua

SEQ ID NO: 158642 - RNA, 22 nt, Human
acugcuguugugauggguauuu

SEQ ID NO: 158643 - RNA, 22 nt, Human
acugaaaguugaugagucacug

SEQ ID NO: 158644 - RNA, 22 nt, Human
acugaaauggggacaguccuua

SEQ ID NO: 158645 - RNA, 22 nt, Human
acugaaauuuauauuuugggca

SEQ ID NO: 158646 - RNA, 22 nt, Human
acuauuguccgauuucuuuacu

SEQ ID NO: 158647 - RNA, 22 nt, Human
acuaugugucuguaucuggugc

SEQ ID NO: 158648 - RNA, 22 nt, Human
acucggcggccucgagugcugg

SEQ ID NO: 158649 - RNA, 22 nt, Human
acucgggggccgcugcagggag

SEQ ID NO: 158650 - RNA, 22 nt, Human
acuuccuuccagcaaauggcau

SEQ ID NO: 158651 - RNA, 22 nt, Human
acuuccuuuuuuggggauagca

SEQ ID NO: 158652 - RNA, 23 nt, Human
acuggauuguucuugggcgcuga

SEQ ID NO: 158653 - RNA, 22 nt, Human
acuggauucucuuacacagaug

SEQ ID NO: 158654 - RNA, 22 nt, Human
acuugcaucuuagagacucacc

SEQ ID NO: 158655 - RNA, 22 nt, Human
acuguugugaauaaugaaaugc

SEQ ID NO: 158656 - RNA, 22 nt, Human
acuuugccuucuuacuguguug

SEQ ID NO: 158657 - RNA, 22 nt, Human
acuuguuuacaagcaguucuga

SEQ ID NO: 158658 - RNA, 22 nt, Human
acuuuaaaucuguugcuuagcu

SEQ ID NO: 158659 - RNA, 22 nt, Human
acuuuaaauaucauuugguagg

SEQ ID NO: 158660 - RNA, 22 nt, Human
acuuugaauuagaauuuugcug

SEQ ID NO: 158661 - RNA, 22 nt, Human
acuucccacugcagugacugag

SEQ ID NO: 158662 - RNA, 19 nt, Human
agaaauagccuuccuuguc

SEQ ID NO: 158663 - RNA, 20 nt, Human
agaaaggaguaaagaagaga

SEQ ID NO: 158664 - RNA, 22 nt, Human
agaaacacaaguaaagcuccca

SEQ ID NO: 158665 - RNA, 22 nt, Human
agaaacaagcccuagaaguccu

SEQ ID NO: 158666 - RNA, 22 nt, Human
agaaaagagacaauguuuuugg

SEQ ID NO: 158667 - RNA, 22 nt, Human
agaaaauagguaguagacgggc

SEQ ID NO: 158668 - RNA, 22 nt, Human
agaaaagaggcuuucuaagcau

SEQ ID NO: 158669 - RNA, 22 nt, Human
acuuuuaauaguagauuuuuaa

SEQ ID NO: 158670 - RNA, 22 nt, Human
agaaugucaagucaagaacaau

SEQ ID NO: 158671 - RNA, 22 nt, Human
agacaaucaacuguugaugccu

SEQ ID NO: 158672 - RNA, 22 nt, Human
agaauauaguaaauauuuucua

SEQ ID NO: 158673 - RNA, 22 nt, Human
agaaucugcauuuuaacaagau

SEQ ID NO: 158674 - RNA, 22 nt, Human
agaauaagucuaauauauuggu

SEQ ID NO: 158675 - RNA, 22 nt, Human
agaaguagacaguuggauauaa

SEQ ID NO: 158676 - RNA, 22 nt, Human
agaaguguacuuagagaacaua

SEQ ID NO: 158677 - RNA, 22 nt, Human
agaaguuuguuauguaaacaaa

SEQ ID NO: 158678 - RNA, 16 nt, Human
agaaggcuaguaacag

SEQ ID NO: 158679 - RNA, 22 nt, Human
agaaggcaucugcucgcuucca

SEQ ID NO: 158680 - RNA, 20 nt, Human
agaaggagagaugaggcaaa

SEQ ID NO: 158681 - RNA, 22 nt, Human
agaagcagaaggaagcagggcc

SEQ ID NO: 158682 - RNA, 22 nt, Human
agaaauggggugaagcaaaugg

SEQ ID NO: 158683 - RNA, 22 nt, Human
agaagauucagcaguagggugg

SEQ ID NO: 158684 - RNA, 22 nt, Human
agaagaaugguuugaaagauuu

SEQ ID NO: 158685 - RNA, 22 nt, Human
agauagaaggauugugacacau

SEQ ID NO: 158686 - RNA, 22 nt, Human
agaucugucaccauccuggagc

SEQ ID NO: 158687 - RNA, 22 nt, Human
agauauuauuuucuauuuauca

SEQ ID NO: 158688 - RNA, 22 nt, Human
agauaaaucauuuauuaagcgg

SEQ ID NO: 158689 - RNA, 23 nt, Human
agauaaggaagcauuugagccag

SEQ ID NO: 158690 - RNA, 21 nt, Human
agaguugaaggcaguaaagag

SEQ ID NO: 158691 - RNA, 22 nt, Human
agauaaacaacucuuagcuguu

SEQ ID NO: 158692 - RNA, 22 nt, Human
agagccggagucuucuuguuug

SEQ ID NO: 158693 - RNA, 22 nt, Human
agagcugggacuuggacucaau

SEQ ID NO: 158694 - RNA, 23 nt, Human
agagggaagagcuuagaugggga

SEQ ID NO: 158695 - RNA, 22 nt, Human
agaggcagagcugggguuugac

SEQ ID NO: 158696 - RNA, 22 nt, Human
agagggcugugcuaaauuucag

SEQ ID NO: 158697 - RNA, 22 nt, Human
agacuacggggaggggagggaa

SEQ ID NO: 158698 - RNA, 22 nt, Human
agacgggacagacuuuugagug

SEQ ID NO: 158699 - RNA, 22 nt, Human
agacgacucuuaaggcagaauu

SEQ ID NO: 158700 - RNA, 22 nt, Human
agacgcgcagaaggaagcggcc

SEQ ID NO: 158701 - RNA, 22 nt, Human
agaccguguguggguugcggug

SEQ ID NO: 158702 - RNA, 19 nt, Human
agagauuuucuguuuuagu

SEQ ID NO: 158703 - RNA, 22 nt, Human
agacagaaaaguugucaaucau

SEQ ID NO: 158704 - RNA, 22 nt, Human
agagauuuacaacuugggcuuu

SEQ ID NO: 158705 - RNA, 22 nt, Human
agacacauuuucagcucugcca

SEQ ID NO: 158706 - RNA, 22 nt, Human
agcaaaauuccaaaaugcuaau

SEQ ID NO: 158707 - RNA, 22 nt, Human
agcaaggagcugaaaccgggcu

SEQ ID NO: 158708 - RNA, 22 nt, Human
agauuguaugaggacuccauga

SEQ ID NO: 158709 - RNA, 22 nt, Human
agauucgucuuuaauucaccau

SEQ ID NO: 158710 - RNA, 22 nt, Human
agauugaacgagcuggcaugga

SEQ ID NO: 158711 - RNA, 22 nt, Human
agauuucaauggauauugcaag

SEQ ID NO: 158712 - RNA, 17 nt, Human
agaucugaaggagaaca

SEQ ID NO: 158713 - RNA, 22 nt, Human
agaugaacuuuuuuaaacugga

SEQ ID NO: 158714 - RNA, 19 nt, Human
agauggcaaaaugcaaaga

SEQ ID NO: 158715 - RNA, 22 nt, Human
agauguugucucuuacguuuga

SEQ ID NO: 158716 - RNA, 23 nt, Human
agaugaugaauaaagagugagga

SEQ ID NO: 158717 - RNA, 22 nt, Human
agauaggccauuaagaaggaua

SEQ ID NO: 158718 - RNA, 22 nt, Human
agccccaauuacagcugugcug

SEQ ID NO: 158719 - RNA, 22 nt, Human
agccgauaaauuguuuucuugg

SEQ ID NO: 158720 - RNA, 22 nt, Human
agccaucuggugucaaugauuc

SEQ ID NO: 158721 - RNA, 22 nt, Human
agccagcauauauauaguugaa

SEQ ID NO: 158722 - RNA, 22 nt, Human
agccacacuuagucacaaagau

SEQ ID NO: 158723 - RNA, 22 nt, Human
agcauauaugcaugagugugca

SEQ ID NO: 158724 - RNA, 22 nt, Human
agccugaaccaauauagcagcc

SEQ ID NO: 158725 - RNA, 22 nt, Human
agcgaaaagaauggaguggagu

SEQ ID NO: 158726 - RNA, 22 nt, Human
agccgcugaauuugaaacaagc

SEQ ID NO: 158727 - RNA, 22 nt, Human
agcccuuucuuguuuaacugca

SEQ ID NO: 158728 - RNA, 22 nt, Human
agccgcgcuguuccugcugcug

SEQ ID NO: 158729 - RNA, 22 nt, Human
agccgcgcagccucauuaagga

SEQ ID NO: 158730 - RNA, 22 nt, Human
agccugugacucugugaaacca

SEQ ID NO: 158731 - RNA, 21 nt, Human
agcgcugcauccaccauggcu

SEQ ID NO: 158732 - RNA, 22 nt, Human
agcgcccguugagucgcgcggu

SEQ ID NO: 158733 - RNA, 22 nt, Human
agcacguucuucauuacuucac

SEQ ID NO: 158734 - RNA, 22 nt, Human
agcacucacuagaguuagaacc

SEQ ID NO: 158735 - RNA, 22 nt, Human
agcacuugggugauaguacuuu

SEQ ID NO: 158736 - RNA, 22 nt, Human
agcaaauaauugucuuugaggg

SEQ ID NO: 158737 - RNA, 22 nt, Human
agcaaaguacugagcucaaagg

SEQ ID NO: 158738 - RNA, 22 nt, Human
agauucucccuccuggcgcugu

SEQ ID NO: 158739 - RNA, 22 nt, Human
agcaauguuggccuauauaccu

SEQ ID NO: 158740 - RNA, 22 nt, Human
agauuuuacggaguauuagggu

SEQ ID NO: 158741 - RNA, 22 nt, Human
agcaaaacuaaagacacagaca

SEQ ID NO: 158742 - RNA, 22 nt, Human
agcacagugccugacauauaug

SEQ ID NO: 158743 - RNA, 22 nt, Human
agcacgcccaccuccugcggcg

SEQ ID NO: 158744 - RNA, 22 nt, Human
agcagcaaugacaauucaacca

SEQ ID NO: 158745 - RNA, 22 nt, Human
agcaggauggaguaacgugaaa

SEQ ID NO: 158746 - RNA, 20 nt, Human
agcauucaacuuucuauguu

SEQ ID NO: 158747 - RNA, 22 nt, Human
agcagcugagccccagcuguga

SEQ ID NO: 158748 - RNA, 22 nt, Human
agcagccgccgccgccgcgcac

SEQ ID NO: 158749 - RNA, 22 nt, Human
agcagcaggugaccucgaugcc

SEQ ID NO: 158750 - RNA, 22 nt, Human
acaacagaacuccugggauuuu

SEQ ID NO: 158751 - RNA, 20 nt, Human
acaaccacugcucacaguuu

SEQ ID NO: 158752 - RNA, 22 nt, Human
acaaaucccuguaaacacagcu

SEQ ID NO: 158753 - RNA, 22 nt, Human
acaaauuuaaauguugucuguu

SEQ ID NO: 158754 - RNA, 22 nt, Human
acaaacugggauaggauccugu

SEQ ID NO: 158755 - RNA, 21 nt, Human
acaaaaccuaacuuggcugcu

SEQ ID NO: 158756 - RNA, 22 nt, Human
acaaaaauauuguagaagugcu

SEQ ID NO: 158757 - RNA, 22 nt, Human
aauuucuuucagcugcuuuaag

SEQ ID NO: 158758 - RNA, 22 nt, Human
aauuuuauuuuuuccccuagau

SEQ ID NO: 158759 - RNA, 18 nt, Human
acaaaaauagugcuuugg

SEQ ID NO: 158760 - RNA, 22 nt, Human
aauuuuauuagacaggcauaau

SEQ ID NO: 158761 - RNA, 22 nt, Human
aauuuuagcuaaagauccaugg

SEQ ID NO: 158762 - RNA, 22 nt, Human
aauuauucucucaacugagaug

SEQ ID NO: 158763 - RNA, 22 nt, Human
aauuauugucuuuuuuaaaagc

SEQ ID NO: 158764 - RNA, 22 nt, Human
aauuauucaugucugggcagcc

SEQ ID NO: 158765 - RNA, 21 nt, Human
aauugccuaauauaugggaag

SEQ ID NO: 158766 - RNA, 22 nt, Human
aauugcauucauuuguauauuu

SEQ ID NO: 158767 - RNA, 22 nt, Human
aauuucaucugagacugggagc

SEQ ID NO: 158768 - RNA, 22 nt, Human
aauuuauccuuuugcuaaagca

SEQ ID NO: 158769 - RNA, 22 nt, Human
aauuucagaccaacgagucagg

SEQ ID NO: 158770 - RNA, 22 nt, Human
aauuuaaguuauugcuaaugug

SEQ ID NO: 158771 - RNA, 22 nt, Human
aauugugagaguuagagagcau

SEQ ID NO: 158772 - RNA, 22 nt, Human
aauuguuagaaaugacuguuuu

SEQ ID NO: 158773 - RNA, 22 nt, Human
aauuuaauugguuuuuacuugu

SEQ ID NO: 158774 - RNA, 22 nt, Human
aaugcugugauuuauuaaguau

SEQ ID NO: 158775 - RNA, 22 nt, Human
aauggaaaggagccugacuaua

SEQ ID NO: 158776 - RNA, 22 nt, Human
aaugcugugggauagggcuccu

SEQ ID NO: 158777 - RNA, 22 nt, Human
aauggcaaaaguuucggaaauu

SEQ ID NO: 158778 - RNA, 22 nt, Human
aauggaaaaagaacuguuuaaa

SEQ ID NO: 158779 - RNA, 22 nt, Human
aauggauaacaccgguucuguc

SEQ ID NO: 158780 - RNA, 22 nt, Human
aauccucguagugguuagaaag

SEQ ID NO: 158781 - RNA, 22 nt, Human
aaugcugaaugcauguuuccau

SEQ ID NO: 158782 - RNA, 22 nt, Human
aaucacuucuuugucuucuuca

SEQ ID NO: 158783 - RNA, 22 nt, Human
aaucauaacaaaagcaauuaua

SEQ ID NO: 158784 - RNA, 22 nt, Human
aaucaagcugcuguuuguucua

SEQ ID NO: 158785 - RNA, 22 nt, Human
aaucaugagguguuucuuugca

SEQ ID NO: 158786 - RNA, 22 nt, Human
aaucccaguugacagaacuguu

SEQ ID NO: 158787 - RNA, 22 nt, Human
aaugugugggagaacagucuuu

SEQ ID NO: 158788 - RNA, 22 nt, Human
aauggcagauaauuuuccagau

SEQ ID NO: 158789 - RNA, 22 nt, Human
aauggugaggagugcauugaga

SEQ ID NO: 158790 - RNA, 22 nt, Human
aauuauuauguggaagacgacg

SEQ ID NO: 158791 - RNA, 22 nt, Human
aauuaaauguuugguuugagcu

SEQ ID NO: 158792 - RNA, 22 nt, Human
aauguuuaguuuuauuuuagua

SEQ ID NO: 158793 - RNA, 22 nt, Human
aauguuuuucaaguguggagca

SEQ ID NO: 158794 - RNA, 22 nt, Human
aauguuaguauuuaagagcuug

SEQ ID NO: 158795 - RNA, 22 nt, Human
acaguuuuccuugguauagaac

SEQ ID NO: 158796 - RNA, 22 nt, Human
acagugguggagggcuguccug

SEQ ID NO: 158797 - RNA, 22 nt, Human
acauauggcagguugaucaaug

SEQ ID NO: 158798 - RNA, 22 nt, Human
acauccagcagauuguccagag

SEQ ID NO: 158799 - RNA, 22 nt, Human
acaggggauaggcaggaaggca

SEQ ID NO: 158800 - RNA, 22 nt, Human
acaggccuggguucaaauuugg

SEQ ID NO: 158801 - RNA, 19 nt, Human
acaggaaggaaaauuucaa

SEQ ID NO: 158802 - RNA, 22 nt, Human
acagguuucuccccugguuauu

SEQ ID NO: 158803 - RNA, 22 nt, Human
acaggacgugugugcgcaugug

SEQ ID NO: 158804 - RNA, 22 nt, Human
acaggauuuucagggaagguga

SEQ ID NO: 158805 - RNA, 22 nt, Human
acaggcugcccgcuccccaccu

SEQ ID NO: 158806 - RNA, 22 nt, Human
acaggcgucgccugcucuugcc

SEQ ID NO: 158807 - RNA, 22 nt, Human
acagcuggaggucugugagcac

SEQ ID NO: 158808 - RNA, 22 nt, Human
acaggaaaugaaaugguaucua

SEQ ID NO: 158809 - RNA, 19 nt, Human
acagccuguugguggggcu

SEQ ID NO: 158810 - RNA, 22 nt, Human
acagcucaggcccaucaacccc

SEQ ID NO: 158811 - RNA, 22 nt, Human
acaggacaaaaaucuggauggc

SEQ ID NO: 158812 - RNA, 22 nt, Human
acaggaaugaagaugagagagu

SEQ ID NO: 158813 - RNA, 22 nt, Human
acagaugccagcuacaccaccg

SEQ ID NO: 158814 - RNA, 22 nt, Human
acagccaacgucuuucuuacuu

SEQ ID NO: 158815 - RNA, 20 nt, Human
acagccguaaugguccuugg

SEQ ID NO: 158816 - RNA, 22 nt, Human
acagaauugggguucuugggga

SEQ ID NO: 158817 - RNA, 23 nt, Human
acagaggcaucagagcagcaggc

SEQ ID NO: 158818 - RNA, 23 nt, Human
acagcaagaggaccagaugugag

SEQ ID NO: 158819 - RNA, 22 nt, Human
acacgguggccagcaguaggug

SEQ ID NO: 158820 - RNA, 22 nt, Human
acacccuuuagcaauucuucaa

SEQ ID NO: 158821 - RNA, 20 nt, Human
acacaccugcucagacugag

SEQ ID NO: 158822 - RNA, 21 nt, Human
acacagcuggagcaucccggu

SEQ ID NO: 158823 - RNA, 22 nt, Human
acacagugaccuacauuccaaa

SEQ ID NO: 158824 - RNA, 22 nt, Human
acacgcacaccugugcacucgu

SEQ ID NO: 158825 - RNA, 22 nt, Human
acacgauguuuuaagccccuaa

SEQ ID NO: 158826 - RNA, 20 nt, Human
acacagccuagaguuuggcu

SEQ ID NO: 158827 - RNA, 22 nt, Human
acaaugugcuuaugaaggcagu

SEQ ID NO: 158828 - RNA, 17 nt, Human
acaaugggcaacaauau

SEQ ID NO: 158829 - RNA, 22 nt, Human
acaaggccugagggugacagca

SEQ ID NO: 158830 - RNA, 22 nt, Human
acaagguugauucuggcaucug

SEQ ID NO: 158831 - RNA, 22 nt, Human
acaaguuucauuguuuagaacc

SEQ ID NO: 158832 - RNA, 21 nt, Human
acaaugaguuugaggcaucag

SEQ ID NO: 158833 - RNA, 22 nt, Human
acaaucagcacugaguuuaucu

SEQ ID NO: 158834 - RNA, 22 nt, Human
acaaggaagaaaacauuacuuu

SEQ ID NO: 158835 - RNA, 22 nt, Human
acaagaaaggucugggaacaau

SEQ ID NO: 158836 - RNA, 20 nt, Human
aaguugaaguuacuucaugg

SEQ ID NO: 158837 - RNA, 23 nt, Human
aagugcucaguggacagcauugc

SEQ ID NO: 158838 - RNA, 22 nt, Human
aagugauuuuccuacuugcuaa

SEQ ID NO: 158839 - RNA, 22 nt, Human
aauaacuuaaugacuguguaca

SEQ ID NO: 158840 - RNA, 22 nt, Human
aauaauacaugugaugagaauu

SEQ ID NO: 158841 - RNA, 20 nt, Human
aauaaauauaacccauaauu

SEQ ID NO: 158842 - RNA, 16 nt, Human
aaguuuuaucuucuca

SEQ ID NO: 158843 - RNA, 22 nt, Human
aauaugaugccaaauugcuaca

SEQ ID NO: 158844 - RNA, 22 nt, Human
aauaucuugaguuauaaauuca

SEQ ID NO: 158845 - RNA, 20 nt, Human
aauagcacagcucaaacauu

SEQ ID NO: 158846 - RNA, 22 nt, Human
aauagagacaguuuaacaauau

SEQ ID NO: 158847 - RNA, 22 nt, Human
aauauuuaccuaccugucaucu

SEQ ID NO: 158848 - RNA, 22 nt, Human
aaucacuggcuccucacggcaa

SEQ ID NO: 158849 - RNA, 22 nt, Human
aauaugcaaagcguguuaucug

SEQ ID NO: 158850 - RNA, 22 nt, Human
aauaugccaaauccugucacau

SEQ ID NO: 158851 - RNA, 22 nt, Human
aauauuuaaauagaauuacauc

SEQ ID NO: 158852 - RNA, 22 nt, Human
aagucuguucuacagcaccaga

SEQ ID NO: 158853 - RNA, 22 nt, Human
aagucuuugagaucggacauag

SEQ ID NO: 158854 - RNA, 22 nt, Human
aagugaaaaaagucaguacuga

SEQ ID NO: 158855 - RNA, 22 nt, Human
aagugauuuagagagcucuuag

SEQ ID NO: 158856 - RNA, 22 nt, Human
aagugauuuucccaccaucuac

SEQ ID NO: 158857 - RNA, 22 nt, Human
aaguccgggcagcaggaauucu

SEQ ID NO: 158858 - RNA, 20 nt, Human
aagucuauuuagaguugcuu

SEQ ID NO: 158859 - RNA, 22 nt, Human
aaggggauuuaagguaagaaga

SEQ ID NO: 158860 - RNA, 22 nt, Human
aaggucuuggcucuggccgcac

SEQ ID NO: 158861 - RNA, 22 nt, Human
aaggcgguuccgguucgcggcg

SEQ ID NO: 158862 - RNA, 22 nt, Human
aaggcuuguugucacgcucuug

SEQ ID NO: 158863 - RNA, 22 nt, Human
aaggaaaaaauggcuugugaua

SEQ ID NO: 158864 - RNA, 22 nt, Human
aagauuugaaaguggugcauuu

SEQ ID NO: 158865 - RNA, 22 nt, Human
aagcaaaaucgcaucuggggcc

SEQ ID NO: 158866 - RNA, 22 nt, Human
aagcaaagucaucuagaguagu

SEQ ID NO: 158867 - RNA, 22 nt, Human
aagauauauaaggaaguucagu

SEQ ID NO: 158868 - RNA, 23 nt, Human
aagcaacagacuucaucagauau

SEQ ID NO: 158869 - RNA, 22 nt, Human
aagaaggaaggcaagagauggg

SEQ ID NO: 158870 - RNA, 22 nt, Human
aagagaaacauauggccagauu

SEQ ID NO: 158871 - RNA, 22 nt, Human
aagacagaaaagcagagagagg

SEQ ID NO: 158872 - RNA, 22 nt, Human
aaccaaguaaagagguuucauu

SEQ ID NO: 158873 - RNA, 22 nt, Human
aaccaaaguugguauuuaauaa

SEQ ID NO: 158874 - RNA, 22 nt, Human
aagaaagaucugaaagaagcga

SEQ ID NO: 158875 - RNA, 22 nt, Human
aagaaaccauauuaguuccugg

SEQ ID NO: 158876 - RNA, 22 nt, Human
aagaaaagcaucuuuguaguag

SEQ ID NO: 158877 - RNA, 22 nt, Human
aaggcagagggaaaacgggaau

SEQ ID NO: 158878 - RNA, 22 nt, Human
aaggcacuugcccagagcugca

SEQ ID NO: 158879 - RNA, 22 nt, Human
aaggaugguaacaguuucauuu

SEQ ID NO: 158880 - RNA, 22 nt, Human
aaggauuuccaggccugcgccu

SEQ ID NO: 158881 - RNA, 22 nt, Human
aaggagaggagucauugggaua

SEQ ID NO: 158882 - RNA, 22 nt, Human
aaggacaaaacagcuguucuaa

SEQ ID NO: 158883 - RNA, 22 nt, Human
aagcuguuauuucacagguuca

SEQ ID NO: 158884 - RNA, 22 nt, Human
aagcugccugggaggaagggcu

SEQ ID NO: 158885 - RNA, 22 nt, Human
aagcgcaaggugucagcagguu

SEQ ID NO: 158886 - RNA, 22 nt, Human
aaggcgauuuaaagauguuagg

SEQ ID NO: 158887 - RNA, 22 nt, Human
aaggaaaguuaagguaaacucu

SEQ ID NO: 158888 - RNA, 22 nt, Human
aaggaaaaccugacugaagaac

SEQ ID NO: 158889 - RNA, 22 nt, Human
aagccuguugacagcugucagu

SEQ ID NO: 158890 - RNA, 22 nt, Human
aagcugcagacccccugucuca

SEQ ID NO: 158891 - RNA, 22 nt, Human
aagcgcggccgccgcggucgcu

SEQ ID NO: 158892 - RNA, 22 nt, Human
aagcaggaaaugaaaugcuugc

SEQ ID NO: 158893 - RNA, 20 nt, Human
aaauccuugggaguggugca

SEQ ID NO: 158894 - RNA, 22 nt, Human
aaaucugaaggaaacagcuuca

SEQ ID NO: 158895 - RNA, 22 nt, Human
aaauguaaacuguauuuauaaa

SEQ ID NO: 158896 - RNA, 22 nt, Human
aaaucaagucagcugaauucca

SEQ ID NO: 158897 - RNA, 22 nt, Human
aaaucaaaagugguuauuuuau

SEQ ID NO: 158898 - RNA, 22 nt, Human
aaaguuacccaaucucuaugaa

SEQ ID NO: 158899 - RNA, 22 nt, Human
aaauauagugacacuuauaguc

SEQ ID NO: 158900 - RNA, 22 nt, Human
aaauauauccuucuguccugcc

SEQ ID NO: 158901 - RNA, 22 nt, Human
aaaugcacaauaaaguaaaggc

SEQ ID NO: 158902 - RNA, 22 nt, Human
aaaucuuucacauauuuuuuau

SEQ ID NO: 158903 - RNA, 22 nt, Human
aaaucuuccugaaauuuguuca

SEQ ID NO: 158904 - RNA, 22 nt, Human
aaaucugaauuaaaaucugguu

SEQ ID NO: 158905 - RNA, 22 nt, Human
aacagagauucuucccuucuuu

SEQ ID NO: 158906 - RNA, 22 nt, Human
aacagaauaucaaaagauuaug

SEQ ID NO: 158907 - RNA, 22 nt, Human
aaauuaaaguuuuauuuagagc

SEQ ID NO: 158908 - RNA, 22 nt, Human
aaaugucugagacuucugaacu

SEQ ID NO: 158909 - RNA, 22 nt, Human
aaauguauuagccuaugugaga

SEQ ID NO: 158910 - RNA, 22 nt, Human
aaauuuauaacuuaaagugaau

SEQ ID NO: 158911 - RNA, 22 nt, Human
aacagggcgugaauaaugaaga

SEQ ID NO: 158912 - RNA, 22 nt, Human
aacaggcuaaauuguccauuuc

SEQ ID NO: 158913 - RNA, 22 nt, Human
aacaggaagaauccagauggug

SEQ ID NO: 158914 - RNA, 19 nt, Human
aacaaaauaguucuaguua

SEQ ID NO: 158915 - RNA, 22 nt, Human
aacacaucagcacacuaacgga

SEQ ID NO: 158916 - RNA, 22 nt, Human
aacaaguagaauagguuuuuuu

SEQ ID NO: 158917 - RNA, 22 nt, Human
aaaggcaugugcaacuacaaau

SEQ ID NO: 158918 - RNA, 22 nt, Human
aaagcugaaacgaaaugacaac

SEQ ID NO: 158919 - RNA, 22 nt, Human
aaagcgagccggcuuggaggga

SEQ ID NO: 158920 - RNA, 22 nt, Human
aaagcuccaaauggguggaagu

SEQ ID NO: 158921 - RNA, 22 nt, Human
aaaguagaauaauaaacccuug

SEQ ID NO: 158922 - RNA, 22 nt, Human
aaaguguuaacacuggcuacuu

SEQ ID NO: 158923 - RNA, 22 nt, Human
aaaguaaagccuauuuaauaau

SEQ ID NO: 158924 - RNA, 23 nt, Human
aaauaauaauuucucuguuggga

SEQ ID NO: 158925 - RNA, 22 nt, Human
aaaguugcauccuaugaccuca

SEQ ID NO: 158926 - RNA, 22 nt, Human
aaauauauauaauauauauauu

SEQ ID NO: 158927 - RNA, 22 nt, Human
aaaguuacacgacuauuuaugu

SEQ ID NO: 158928 - RNA, 22 nt, Human
aaaguagaugagaauuuuguug

SEQ ID NO: 158929 - RNA, 22 nt, Human
aaauauugaauuugaggaugua

SEQ ID NO: 158930 - RNA, 22 nt, Human
aaauauuugaaugguguaagau

SEQ ID NO: 158931 - RNA, 22 nt, Human
aaauauuaaugaugaagguagu

SEQ ID NO: 158932 - RNA, 22 nt, Human
aaauauuagacauaccuggaga

SEQ ID NO: 158933 - RNA, 22 nt, Human
aaaucauagccaugaacauuug

SEQ ID NO: 158934 - RNA, 22 nt, Human
aaaucauguuaaagagggaguu

SEQ ID NO: 158935 - RNA, 21 nt, Human
aaauccagugaucuccucuaa

SEQ ID NO: 158936 - RNA, 22 nt, Human
aaauaggucaaucagacuauga

SEQ ID NO: 158937 - RNA, 22 nt, Human
aaauagucagaaaucaacgugc

SEQ ID NO: 158938 - RNA, 22 nt, Human
aaauaggaguagugauguauua

SEQ ID NO: 158939 - RNA, 22 nt, Human
aaagaugaaguucagcgaagaa

SEQ ID NO: 158940 - RNA, 22 nt, Human
aaagaugucauacacauuaaga

SEQ ID NO: 158941 - RNA, 22 nt, Human
aaagccaagucugauuuuguug

SEQ ID NO: 158942 - RNA, 17 nt, Human
aaagccgaucagauguu

SEQ ID NO: 158943 - RNA, 22 nt, Human
aaagccaagguccauguacuuu

SEQ ID NO: 158944 - RNA, 22 nt, Human
aaaggucagaugugucgaggag

SEQ ID NO: 158945 - RNA, 22 nt, Human
aaagguggugguuagggaauau

SEQ ID NO: 158946 - RNA, 22 nt, Human
aaagguguagacucaguuaugc

SEQ ID NO: 158947 - RNA, 22 nt, Human
aaagggaugauuucugaagaua

SEQ ID NO: 158948 - RNA, 22 nt, Human
aaaccgguacccuccugccugc

SEQ ID NO: 158949 - RNA, 22 nt, Human
aaacccuagcguuguuuauuga

SEQ ID NO: 158950 - RNA, 22 nt, Human
aaacuuuugaaggaggaaaaag

SEQ ID NO: 158951 - RNA, 18 nt, Human
aaacgguuucaugcugua

SEQ ID NO: 158952 - RNA, 22 nt, Human
aaagacaauaauucucucuagc

SEQ ID NO: 158953 - RNA, 22 nt, Human
aaagacagccuguuggcuuucu

SEQ ID NO: 158954 - RNA, 22 nt, Human
aaagcaaagaucuguagcccaa

SEQ ID NO: 158955 - RNA, 22 nt, Human
aaagcaaauaguugcuuaauau

SEQ ID NO: 158956 - RNA, 22 nt, Human
aaacgcaauuucuugcauguca

SEQ ID NO: 158957 - RNA, 22 nt, Human
aaacagguuugaacuucuuaac

SEQ ID NO: 158958 - RNA, 22 nt, Human
aaaaugggaaaauuuuagauua

SEQ ID NO: 158959 - RNA, 22 nt, Human
aaacccaggguuuugucuuccc

SEQ ID NO: 158960 - RNA, 22 nt, Human
aaacaaauccaauaauaaaauu

SEQ ID NO: 158961 - RNA, 22 nt, Human
aaaauuuccuuggaccauuuuu

SEQ ID NO: 158962 - RNA, 22 nt, Human
aaacaccaagagcuagcuauua

SEQ ID NO: 158963 - RNA, 22 nt, Human
aaacagcugcaguacacggccu

SEQ ID NO: 158964 - RNA, 17 nt, Human
aaaaucaaaggaggugc

SEQ ID NO: 158965 - RNA, 22 nt, Human
aaaaucucagaaaaguuuaggu

SEQ ID NO: 158966 - RNA, 22 nt, Human
aaaauauucuauaucaaagaua

SEQ ID NO: 158967 - RNA, 22 nt, Human
aaaagcgaagagaacugaaguu

SEQ ID NO: 158968 - RNA, 22 nt, Human
aaaaggauauuuggugcaaagc

SEQ ID NO: 158969 - RNA, 22 nt, Human
aaaaauuucuggugaaaugccu

SEQ ID NO: 158970 - RNA, 22 nt, Human
aaaacauuuuacugccaucuca

SEQ ID NO: 158971 - RNA, 22 nt, Human
uuuguguuacaguccuagaacu

SEQ ID NO: 158972 - RNA, 22 nt, Human
uuucuugugauuuugaugaacu

SEQ ID NO: 158973 - RNA, 22 nt, Human
uuucuuugcugguuggcucucc

SEQ ID NO: 158974 - RNA, 18 nt, Human
uuucuuuuauuccagguc

SEQ ID NO: 158975 - RNA, 22 nt, Human
uuucuuuuucuacaccuuagcu

SEQ ID NO: 158976 - RNA, 22 nt, Human
uuucuguucuguuggauucuuu

SEQ ID NO: 158977 - RNA, 22 nt, Human
uuucugcauuuguauuggaaaa

SEQ ID NO: 158978 - RNA, 22 nt, Human
uuucuauuuacagugcuaggua

SEQ ID NO: 158979 - RNA, 22 nt, Human
uuucgggauuucaaagagcaaa

SEQ ID NO: 158980 - RNA, 22 nt, Human
uuuccuguuuugguuuggagag

SEQ ID NO: 158981 - RNA, 22 nt, Human
uuuccugacuucaccuuuuacc

SEQ ID NO: 158982 - RNA, 22 nt, Human
uuucuaaaauuacugcagucgg

SEQ ID NO: 158983 - RNA, 22 nt, Human
uuucuauauucaguuucauaaa

SEQ ID NO: 158984 - RNA, 22 nt, Human
uuucuaguauauaacuagaucu

SEQ ID NO: 158985 - RNA, 22 nt, Human
uuucauguuggauacuguuuca

SEQ ID NO: 158986 - RNA, 22 nt, Human
uuuccacacucacugcacucau

SEQ ID NO: 158987 - RNA, 22 nt, Human
uuucagguggaaguuuuagaug

SEQ ID NO: 158988 - RNA, 22 nt, Human
uuucagcaugacuguuaucuuu

SEQ ID NO: 158989 - RNA, 22 nt, Human
uuuggguuuuuccuuagggacu

SEQ ID NO: 158990 - RNA, 22 nt, Human
uuugguaccucucgucacaaug

SEQ ID NO: 158991 - RNA, 22 nt, Human
uuuggguuaguuuuccaaucuu

SEQ ID NO: 158992 - RNA, 20 nt, Human
uuugguuggcuaggggaagc

SEQ ID NO: 158993 - RNA, 20 nt, Human
uuugugaggccagagaacag

SEQ ID NO: 158994 - RNA, 22 nt, Human
uuuguaguuguggaugcugaag

SEQ ID NO: 158995 - RNA, 22 nt, Human
uuuggcgucucucaggagcuca

SEQ ID NO: 158996 - RNA, 22 nt, Human
uuuggaugcugucauaugcugc

SEQ ID NO: 158997 - RNA, 22 nt, Human
uuugcuuugacuuugggaguau

SEQ ID NO: 158998 - RNA, 22 nt, Human
uuuggggcucauuugcuuuugu

SEQ ID NO: 158999 - RNA, 22 nt, Human
uuuggcuuugauccuaggauuc

SEQ ID NO: 159000 - RNA, 22 nt, Human
uuugaugagaaaugacuuaagu

SEQ ID NO: 159001 - RNA, 22 nt, Human
uuugaugauuuucuagagugua

SEQ ID NO: 159002 - RNA, 22 nt, Human
uuugagugcccauguuucccag

SEQ ID NO: 159003 - RNA, 22 nt, Human
uuugagaagauaggggaauacu

SEQ ID NO: 159004 - RNA, 22 nt, Human
uuugaguacagcugccuuuuug

SEQ ID NO: 159005 - RNA, 22 nt, Human
uuugaguaagauguugauacug

SEQ ID NO: 159006 - RNA, 22 nt, Human
uuugaagaccuuaucucuaaau

SEQ ID NO: 159007 - RNA, 22 nt, Human
uuugaauauacuucaaacaaag

SEQ ID NO: 159008 - RNA, 22 nt, Human
uuugaauauuaugucccacuuu

SEQ ID NO: 159009 - RNA, 21 nt, Human
uuugacagaccagguauaguu

SEQ ID NO: 159010 - RNA, 22 nt, Human
uuugcauuaguuuagauuucaa

SEQ ID NO: 159011 - RNA, 23 nt, Human
uuugcaaauuggacacaaccaca

SEQ ID NO: 159012 - RNA, 22 nt, Human
uuugcaaaguccauugaaguua

SEQ ID NO: 159013 - RNA, 22 nt, Human
uuugauuuuguuuauagugccg

SEQ ID NO: 159014 - RNA, 22 nt, Human
uuugccggaucugucuccagcu

SEQ ID NO: 159015 - RNA, 22 nt, Human
uuugcauuugagagaggaaaca

SEQ ID NO: 159016 - RNA, 19 nt, Human
uuugccugugguucagaag

SEQ ID NO: 159017 - RNA, 23 nt, Human
uuugccuaaugaagacuauguca

SEQ ID NO: 159018 - RNA, 22 nt, Human
uuugcuccucuucauuuguauc

SEQ ID NO: 159019 - RNA, 22 nt, Human
uuugccccacaggcagcuuugg

SEQ ID NO: 159020 - RNA, 22 nt, Human
uuguuguuguuguuauuuaguu

SEQ ID NO: 159021 - RNA, 20 nt, Human
uuguuagguucaguguuucc

SEQ ID NO: 159022 - RNA, 22 nt, Human
uuguuccuuucuucuguagucg

SEQ ID NO: 159023 - RNA, 18 nt, Human
uuuacgaacucacuugag

SEQ ID NO: 159024 - RNA, 22 nt, Human
uuuagcaaggagaaauaauccu

SEQ ID NO: 159025 - RNA, 22 nt, Human
uuuaggauaacuccaguuuucc

SEQ ID NO: 159026 - RNA, 22 nt, Human
uuuauaauuacguaaaauauuu

SEQ ID NO: 159027 - RNA, 22 nt, Human
uuuaucaggccaucuuaugucu

SEQ ID NO: 159028 - RNA, 22 nt, Human
uuuauguugagcaaaauaccac

SEQ ID NO: 159029 - RNA, 22 nt, Human
uuuauugcuaugucuugauugu

SEQ ID NO: 159030 - RNA, 22 nt, Human
uuuauuuacuuucgguucugcu

SEQ ID NO: 159031 - RNA, 22 nt, Human
uuucacuucgaucagaguuuuu

SEQ ID NO: 159032 - RNA, 22 nt, Human
uuucagaaauggcacugaaauc

SEQ ID NO: 159033 - RNA, 22 nt, Human
uuucaagccucacugcguuuug

SEQ ID NO: 159034 - RNA, 22 nt, Human
uugugcauuuuguuuuacuuau

SEQ ID NO: 159035 - RNA, 22 nt, Human
uugugauuaauaacuuuucucu

SEQ ID NO: 159036 - RNA, 22 nt, Human
uugucaguggccugaggacaga

SEQ ID NO: 159037 - RNA, 22 nt, Human
uugucaggaacuaugauuaugc

SEQ ID NO: 159038 - RNA, 22 nt, Human
uugucaugauccuucuguuagg

SEQ ID NO: 159039 - RNA, 22 nt, Human
uuguauguuucugugcacauga

SEQ ID NO: 159040 - RNA, 22 nt, Human
uuguauuguuugcgucuguguu

SEQ ID NO: 159041 - RNA, 22 nt, Human
uugguguuucacuuccuugucg

SEQ ID NO: 159042 - RNA, 22 nt, Human
uuggggauugggugcaagggac

SEQ ID NO: 159043 - RNA, 22 nt, Human
uuguaagacuguagaaugcaaa

SEQ ID NO: 159044 - RNA, 22 nt, Human
uugggauucugucagugugugu

SEQ ID NO: 159045 - RNA, 20 nt, Human
uugggaagccuacaccauuc

SEQ ID NO: 159046 - RNA, 22 nt, Human
uugggaaauuugaaaauaaaag

SEQ ID NO: 159047 - RNA, 22 nt, Human
uuggccuuacgcauggucggca

SEQ ID NO: 159048 - RNA, 22 nt, Human
uuggccguuucacugggcaguu

SEQ ID NO: 159049 - RNA, 22 nt, Human
uuggcgcuauuauuaccacauu

SEQ ID NO: 159050 - RNA, 22 nt, Human
uugauuugcagaagguguagag

SEQ ID NO: 159051 - RNA, 22 nt, Human
uugauuccagcguuccaucagc

SEQ ID NO: 159052 - RNA, 22 nt, Human
uuggaguucuucaugcucugua

SEQ ID NO: 159053 - RNA, 22 nt, Human
uugagaugacuuaaaucacugu

SEQ ID NO: 159054 - RNA, 22 nt, Human
uugagauuuggagguaauuccc

SEQ ID NO: 159055 - RNA, 22 nt, Human
uugagauggccuuuuuuauacu

SEQ ID NO: 159056 - RNA, 22 nt, Human
uuuuuuuccaguuauucauuuu

SEQ ID NO: 159057 - RNA, 22 nt, Human
uugauagauuuuagaggcaggc

SEQ ID NO: 159058 - RNA, 22 nt, Human
uugacacauggcuucaauugca

SEQ ID NO: 159059 - RNA, 22 nt, Human
uuuuuuccagcuucuagaggcc

SEQ ID NO: 159060 - RNA, 22 nt, Human
uugaauaaggcauaaagauacu

SEQ ID NO: 159061 - RNA, 20 nt, Human
uuuuuuaaauagagcuguug

SEQ ID NO: 159062 - RNA, 22 nt, Human
uuuuuguaaaugaaguuuuauu

SEQ ID NO: 159063 - RNA, 22 nt, Human
uuuuugggccaaauauauuuac

SEQ ID NO: 159064 - RNA, 22 nt, Human
uugaaaaaauguguuuaaggag

SEQ ID NO: 159065 - RNA, 22 nt, Human
uugaacauuagaauaaguaauu

SEQ ID NO: 159066 - RNA, 22 nt, Human
uucuuugcccauguuuccuaag

SEQ ID NO: 159067 - RNA, 22 nt, Human
uucuuugcucaccugccgcucc

SEQ ID NO: 159068 - RNA, 22 nt, Human
uuuuugaauaagugcaucauca

SEQ ID NO: 159069 - RNA, 22 nt, Human
uuuuucuuugcuuuccacuggc

SEQ ID NO: 159070 - RNA, 22 nt, Human
uuuuugcccuaaagaagucauu

SEQ ID NO: 159071 - RNA, 22 nt, Human
uuuuugcuuuuuugucaucuaa

SEQ ID NO: 159072 - RNA, 20 nt, Human
uuuuguccaccugcaggaag

SEQ ID NO: 159073 - RNA, 22 nt, Human
uucuugcuuccggugcuccagg

SEQ ID NO: 159074 - RNA, 21 nt, Human
uucuuugaagacccauuugag

SEQ ID NO: 159075 - RNA, 22 nt, Human
uuuucuucucauucugaccuca

SEQ ID NO: 159076 - RNA, 22 nt, Human
uuuucugauccuucuaacuuga

SEQ ID NO: 159077 - RNA, 22 nt, Human
uuuucuguuuaugaaauugugu

SEQ ID NO: 159078 - RNA, 22 nt, Human
uuuucucuuugcuucucuaaaa

SEQ ID NO: 159079 - RNA, 22 nt, Human
uuuucggggcgacuuagguucu

SEQ ID NO: 159080 - RNA, 22 nt, Human
uucugagccacaguaaggaucu

SEQ ID NO: 159081 - RNA, 22 nt, Human
uuuucuaggcccuggauuaugu

SEQ ID NO: 159082 - RNA, 22 nt, Human
uuuugguauggcuugauagagu

SEQ ID NO: 159083 - RNA, 22 nt, Human
uuuugguauaauuuaaaauuaa

SEQ ID NO: 159084 - RNA, 22 nt, Human
uuuugggugcaaauuguuuguu

SEQ ID NO: 159085 - RNA, 22 nt, Human
uuuugcuucuaguauauuuuuu

SEQ ID NO: 159086 - RNA, 22 nt, Human
uuuuagccagcaucugggucga

SEQ ID NO: 159087 - RNA, 22 nt, Human
uucuauaagagaugaauacagu

SEQ ID NO: 159088 - RNA, 21 nt, Human
uucuauauugagaauuggcua

SEQ ID NO: 159089 - RNA, 22 nt, Human
uuuuaucagagcuugcagugug

SEQ ID NO: 159090 - RNA, 22 nt, Human
uuuucauagccagaaacugaaa

SEQ ID NO: 159091 - RNA, 22 nt, Human
uuuuccccuacuaacacugagu

SEQ ID NO: 159092 - RNA, 22 nt, Human
uucgucaauaugcagccuguga

SEQ ID NO: 159093 - RNA, 22 nt, Human
uuuuaaucagguauuugaguau

SEQ ID NO: 159094 - RNA, 22 nt, Human
uuuuaauucaacauuugcuuuu

SEQ ID NO: 159095 - RNA, 22 nt, Human
uuuuacauuuuauucguuuauu

SEQ ID NO: 159096 - RNA, 22 nt, Human
uuccuggaguggagggagguga

SEQ ID NO: 159097 - RNA, 22 nt, Human
uuccuuuaaccaagagcaguac

SEQ ID NO: 159098 - RNA, 20 nt, Human
uuccuuaucuguaaagugga

SEQ ID NO: 159099 - RNA, 22 nt, Human
uuuuaaaguaauugaagcuugu

SEQ ID NO: 159100 - RNA, 22 nt, Human
uucgcggccaggcggggaggcc

SEQ ID NO: 159101 - RNA, 22 nt, Human
uuuuaaauggcuuuuacuuuuc

SEQ ID NO: 159102 - RNA, 22 nt, Human
uuuuaaaacaugucaaaaugug

SEQ ID NO: 159103 - RNA, 22 nt, Human
uuuguuuuggugucaugcguga

SEQ ID NO: 159104 - RNA, 22 nt, Human
uuuguuugcugagugaauucaa

SEQ ID NO: 159105 - RNA, 22 nt, Human
uuuguuuccagccuuuugucuu

SEQ ID NO: 159106 - RNA, 22 nt, Human
uuuguuuauuuacuuugggccu

SEQ ID NO: 159107 - RNA, 17 nt, Human
uuuguuucauacuucau

SEQ ID NO: 159108 - RNA, 22 nt, Human
uuccugaucuuuucccagaguu

SEQ ID NO: 159109 - RNA, 22 nt, Human
uuugugguuuugagagaguugc

SEQ ID NO: 159110 - RNA, 19 nt, Human
uuccacugcuuagcauugc

SEQ ID NO: 159111 - RNA, 22 nt, Human
uucaucuucaaaccccagugcc

SEQ ID NO: 159112 - RNA, 22 nt, Human
uucaugucuuugauucugauaa

SEQ ID NO: 159113 - RNA, 21 nt, Human
uucauucauggcauaauauag

SEQ ID NO: 159114 - RNA, 22 nt, Human
uuuguugguugcacuggugggu

SEQ ID NO: 159115 - RNA, 22 nt, Human
uucccggccgccccccgcucgg

SEQ ID NO: 159116 - RNA, 22 nt, Human
uuuguguuggaagaaaugcuac

SEQ ID NO: 159117 - RNA, 22 nt, Human
uucccaggugugagugagguga

SEQ ID NO: 159118 - RNA, 22 nt, Human
uuuguucaccuagcaaacuuuu

SEQ ID NO: 159119 - RNA, 21 nt, Human
uuuguucaggggcaaaguuaa

SEQ ID NO: 159120 - RNA, 22 nt, Human
uuuggcuccccaggaucugaaa

SEQ ID NO: 159121 - RNA, 22 nt, Human
uuuggcugucauuugaaaaugu

SEQ ID NO: 159122 - RNA, 22 nt, Human
uucaggacacauuauuuaugaa

SEQ ID NO: 159123 - RNA, 22 nt, Human
uuuggcuacucuucauugguga

SEQ ID NO: 159124 - RNA, 20 nt, Human
uucaggaccuuccaguccau

SEQ ID NO: 159125 - RNA, 22 nt, Human
uucaggaaacaaauuugcaguu

SEQ ID NO: 159126 - RNA, 22 nt, Human
uucaucauuuuccauuccucuu

SEQ ID NO: 159127 - RNA, 22 nt, Human
uucauauuguggucuugcauuc

SEQ ID NO: 159128 - RNA, 22 nt, Human
uucagguuauugaagagcuuuc

SEQ ID NO: 159129 - RNA, 22 nt, Human
uucauagaagggaguuuuuccu

SEQ ID NO: 159130 - RNA, 22 nt, Human
uuugcuguaaugcaugucagag

SEQ ID NO: 159131 - RNA, 22 nt, Human
uuugcuguccaauauucagggu

SEQ ID NO: 159132 - RNA, 22 nt, Human
uucagcacuggacagcgagucu

SEQ ID NO: 159133 - RNA, 22 nt, Human
uucagcauaggcugcucuucaa

SEQ ID NO: 159134 - RNA, 22 nt, Human
uucaaccuucagcuugaguugg

SEQ ID NO: 159135 - RNA, 22 nt, Human
uuagugaagaagcaucuuuagu

SEQ ID NO: 159136 - RNA, 22 nt, Human
uuuauuugggauuucucaucug

SEQ ID NO: 159137 - RNA, 22 nt, Human
uuuauuuggugguguuacuguu

SEQ ID NO: 159138 - RNA, 22 nt, Human
uuugauuuuuugagcaguguau

SEQ ID NO: 159139 - RNA, 22 nt, Human
uucacuuuuucucugcuugaga

SEQ ID NO: 159140 - RNA, 22 nt, Human
uucagaaagugaaucuuguuau

SEQ ID NO: 159141 - RNA, 22 nt, Human
uucagaacugucuguccuuuuc

SEQ ID NO: 159142 - RNA, 22 nt, Human
uucagaauguacugauagaaca

SEQ ID NO: 159143 - RNA, 22 nt, Human
uucagaagguaggaaugucccu

SEQ ID NO: 159144 - RNA, 22 nt, Human
uucagaauuaucauaauuuuga

SEQ ID NO: 159145 - RNA, 22 nt, Human
uugguuuuuugguguaucuuau

SEQ ID NO: 159146 - RNA, 22 nt, Human
uguuucaguaugauuuucccuc

SEQ ID NO: 159147 - RNA, 22 nt, Human
uugucagcuagugaugcuguuc

SEQ ID NO: 159148 - RNA, 22 nt, Human
uguuuguaugauggcacaucca

SEQ ID NO: 159149 - RNA, 22 nt, Human
uuggggaugccccuacgggcua

SEQ ID NO: 159150 - RNA, 22 nt, Human
uguucuuaacuuuuguguauau

SEQ ID NO: 159151 - RNA, 22 nt, Human
uugguauuuguuuaaauuacac

SEQ ID NO: 159152 - RNA, 22 nt, Human
uugguauucaguuggauuugga

SEQ ID NO: 159153 - RNA, 22 nt, Human
uugguuuuauucguauuuguau

SEQ ID NO: 159154 - RNA, 22 nt, Human
uugguuuacucuggggauaucu

SEQ ID NO: 159155 - RNA, 22 nt, Human
uguuuuuucccccccuucuaaa

SEQ ID NO: 159156 - RNA, 22 nt, Human
uguuuuucaagcauuuauuaau

SEQ ID NO: 159157 - RNA, 22 nt, Human
uuguggcaggauggacagcaga

SEQ ID NO: 159158 - RNA, 21 nt, Human
uugugaaaguccaggaacaac

SEQ ID NO: 159159 - RNA, 22 nt, Human
uguuuuguuuagguuuguuuuu

SEQ ID NO: 159160 - RNA, 22 nt, Human
uguuuucccacugguuuguaca

SEQ ID NO: 159161 - RNA, 22 nt, Human
uguuuucaucucucacccagaa

SEQ ID NO: 159162 - RNA, 22 nt, Human
uguuuucuauuaccugagauug

SEQ ID NO: 159163 - RNA, 22 nt, Human
uguguuucggauagcagauucu

SEQ ID NO: 159164 - RNA, 22 nt, Human
uguguuucucugaggggucccu

SEQ ID NO: 159165 - RNA, 22 nt, Human
uuggcauuccagaugcuuuucu

SEQ ID NO: 159166 - RNA, 22 nt, Human
uuggcagagaacagaaugauuu

SEQ ID NO: 159167 - RNA, 22 nt, Human
uguuccuggggaccugccuucc

SEQ ID NO: 159168 - RNA, 22 nt, Human
uuggcguuuccuguucugggug

SEQ ID NO: 159169 - RNA, 22 nt, Human
uguuccaacuacugaauuggca

SEQ ID NO: 159170 - RNA, 22 nt, Human
uguuauugccucaugagacucc

SEQ ID NO: 159171 - RNA, 22 nt, Human
uuggaauuugagaccaagaaaa

SEQ ID NO: 159172 - RNA, 22 nt, Human
uuggacuucauuuaccucucuc

SEQ ID NO: 159173 - RNA, 22 nt, Human
uuggagaaagcugcaggcucug

SEQ ID NO: 159174 - RNA, 22 nt, Human
uguguauaugugugugugugug

SEQ ID NO: 159175 - RNA, 22 nt, Human
uugcguaucuacauugccugua

SEQ ID NO: 159176 - RNA, 22 nt, Human
uugcggaucuucauggccucag

SEQ ID NO: 159177 - RNA, 22 nt, Human
uugcggauguccacgucacacu

SEQ ID NO: 159178 - RNA, 22 nt, Human
ugugucuuuggcgaugucugga

SEQ ID NO: 159179 - RNA, 22 nt, Human
uguguguaugagcauuuguaug

SEQ ID NO: 159180 - RNA, 22 nt, Human
uguguguuguuuugccagaaua

SEQ ID NO: 159181 - RNA, 22 nt, Human
uuggauugugaaaguauucucu

SEQ ID NO: 159182 - RNA, 22 nt, Human
uguguguguguguguaauauau

SEQ ID NO: 159183 - RNA, 23 nt, Human
ugugugugugugugugugugugu

SEQ ID NO: 159184 - RNA, 22 nt, Human
uuguuuuaaaaagaauaacuac

SEQ ID NO: 159185 - RNA, 22 nt, Human
uuaauacugugucuuuuuuaau

SEQ ID NO: 159186 - RNA, 22 nt, Human
uuaauauuaagauauugagugg

SEQ ID NO: 159187 - RNA, 22 nt, Human
uuaauguggaagaguuuggcua

SEQ ID NO: 159188 - RNA, 22 nt, Human
uuaauucuugagcugucuuucc

SEQ ID NO: 159189 - RNA, 22 nt, Human
uuaauguugacacacuagcaca

SEQ ID NO: 159190 - RNA, 22 nt, Human
uuuaaacuaacaguacacguug

SEQ ID NO: 159191 - RNA, 22 nt, Human
uuuaaagucaggcuguaguggu

SEQ ID NO: 159192 - RNA, 22 nt, Human
uuuaaauuucugaaucuugagg

SEQ ID NO: 159193 - RNA, 22 nt, Human
uuuaaaauguuuuauuuauuua

SEQ ID NO: 159194 - RNA, 23 nt, Human
uuuaaacaauguggucguggugg

SEQ ID NO: 159195 - RNA, 22 nt, Human
uuguguuuaaucuguuccacua

SEQ ID NO: 159196 - RNA, 22 nt, Human
uuguuauaggaucagugucacu

SEQ ID NO: 159197 - RNA, 22 nt, Human
uuaaaauuguuaacuuugguga

SEQ ID NO: 159198 - RNA, 22 nt, Human
uuaaagaguuuauuacuuguaa

SEQ ID NO: 159199 - RNA, 22 nt, Human
uuaaaucaggcaucauuucagu

SEQ ID NO: 159200 - RNA, 22 nt, Human
uuaacauuguccuuagcagauu

SEQ ID NO: 159201 - RNA, 22 nt, Human
uuaacccagccauuuucaauuu

SEQ ID NO: 159202 - RNA, 22 nt, Human
uuaauaaauugugguaccagag

SEQ ID NO: 159203 - RNA, 22 nt, Human
uuguuuggcaaaugugugugug

SEQ ID NO: 159204 - RNA, 22 nt, Human
uuguuugcacuuuagagacugu

SEQ ID NO: 159205 - RNA, 22 nt, Human
uuguuuaaagaacuucugacuu

SEQ ID NO: 159206 - RNA, 22 nt, Human
uuuagguuguguucuggcaugu

SEQ ID NO: 159207 - RNA, 22 nt, Human
uuagaguucaagcuuuaggaaa

SEQ ID NO: 159208 - RNA, 22 nt, Human
uuuagagguacaguaggcauga

SEQ ID NO: 159209 - RNA, 22 nt, Human
uuacuuuuuucccccuuagaug

SEQ ID NO: 159210 - RNA, 22 nt, Human
uuaguauuuucaccauaugagg

SEQ ID NO: 159211 - RNA, 22 nt, Human
uuuauguuuguuuuugaaauaa

SEQ ID NO: 159212 - RNA, 22 nt, Human
uuuaugguacaggaaugcuguu

SEQ ID NO: 159213 - RNA, 22 nt, Human
uuuagugaagcuuugcauuuca

SEQ ID NO: 159214 - RNA, 22 nt, Human
uuaggcuuuauugaaaacaaua

SEQ ID NO: 159215 - RNA, 22 nt, Human
uuuaauauuacacuuaccuugu

SEQ ID NO: 159216 - RNA, 22 nt, Human
uuuaagguacagcuagcagcau

SEQ ID NO: 159217 - RNA, 22 nt, Human
uuuaccugucuguagaacauaa

SEQ ID NO: 159218 - RNA, 22 nt, Human
uuuaaugucuuuggccuuuaau

SEQ ID NO: 159219 - RNA, 22 nt, Human
uuuaaugucuuggaaaaagacu

SEQ ID NO: 159220 - RNA, 22 nt, Human
uuuacuuguuuugcucuuuucc

SEQ ID NO: 159221 - RNA, 19 nt, Human
uuuacuuaggccacagaau

SEQ ID NO: 159222 - RNA, 22 nt, Human
uuuagaaugaaugcaagagaau

SEQ ID NO: 159223 - RNA, 22 nt, Human
uugaagccaccacuguaaguca

SEQ ID NO: 159224 - RNA, 22 nt, Human
uugaagaagucaaaagcugcag

SEQ ID NO: 159225 - RNA, 23 nt, Human
uguacugucuuucagguucuuau

SEQ ID NO: 159226 - RNA, 22 nt, Human
uugaaaaaugcccagcagacaa

SEQ ID NO: 159227 - RNA, 22 nt, Human
uguaaauucuauacacuuaaaa

SEQ ID NO: 159228 - RNA, 22 nt, Human
uugaaaaaaucugaggaggacc

SEQ ID NO: 159229 - RNA, 23 nt, Human
ugguuuucagaagaccuuguuag

SEQ ID NO: 159230 - RNA, 22 nt, Human
ugguuuuuuguaggauaaacau

SEQ ID NO: 159231 - RNA, 21 nt, Human
uucuuugcugcuguuuuugua

SEQ ID NO: 159232 - RNA, 22 nt, Human
uguaagaagaaaaccguaugga

SEQ ID NO: 159233 - RNA, 22 nt, Human
uucuuuguccuagcauucuaca

SEQ ID NO: 159234 - RNA, 22 nt, Human
uucuuuuaauagagauccugug

SEQ ID NO: 159235 - RNA, 22 nt, Human
uucuuuucuucccuguuuauua

SEQ ID NO: 159236 - RNA, 22 nt, Human
uucuuuuaauuucugucugcag

SEQ ID NO: 159237 - RNA, 22 nt, Human
uucuugcgaaagaaugagcuga

SEQ ID NO: 159238 - RNA, 22 nt, Human
uucuugcuucucugucugccuc

SEQ ID NO: 159239 - RNA, 22 nt, Human
uggugugggauccugggaagga

SEQ ID NO: 159240 - RNA, 22 nt, Human
ugguuauauaaggauuaaauac

SEQ ID NO: 159241 - RNA, 22 nt, Human
ugguucggcuguaaguauaucu

SEQ ID NO: 159242 - RNA, 22 nt, Human
uggucggugguguggggaggca

SEQ ID NO: 159243 - RNA, 22 nt, Human
uucuguuuuuauucuaucucug

SEQ ID NO: 159244 - RNA, 22 nt, Human
uugccgacuggccaaggaguaa

SEQ ID NO: 159245 - RNA, 22 nt, Human
uugcccuaccccaggccuuuuu

SEQ ID NO: 159246 - RNA, 22 nt, Human
ugugccuguugguguagacaua

SEQ ID NO: 159247 - RNA, 22 nt, Human
uugccuacaaacgaaucuaucu

SEQ ID NO: 159248 - RNA, 22 nt, Human
uugcaugugugaaaugcacaga

SEQ ID NO: 159249 - RNA, 22 nt, Human
ugucugggauguuggcagccac

SEQ ID NO: 159250 - RNA, 22 nt, Human
ugucauuuauucucuuauucua

SEQ ID NO: 159251 - RNA, 22 nt, Human
uugaugagucacuuucuguaaa

SEQ ID NO: 159252 - RNA, 22 nt, Human
uugaggaagggaggcaaaacug

SEQ ID NO: 159253 - RNA, 22 nt, Human
uugaguaaugcaagccuuugua

SEQ ID NO: 159254 - RNA, 22 nt, Human
uugaauuuagguuuaugugaaa

SEQ ID NO: 159255 - RNA, 22 nt, Human
uguaguguuuagucuagugucg

SEQ ID NO: 159256 - RNA, 22 nt, Human
uuccugacacuggcaggcuucu

SEQ ID NO: 159257 - RNA, 22 nt, Human
ugggagagaagcugaggcaggg

SEQ ID NO: 159258 - RNA, 22 nt, Human
uucccuacuagccuuaauguuu

SEQ ID NO: 159259 - RNA, 22 nt, Human
uucccgcugcuggaguuggggc

SEQ ID NO: 159260 - RNA, 22 nt, Human
uuccuaauugccaugaaguuau

SEQ ID NO: 159261 - RNA, 22 nt, Human
uucgucauuaugcagccuguga

SEQ ID NO: 159262 - RNA, 18 nt, Human
uucgucauggggaucgua

SEQ ID NO: 159263 - RNA, 22 nt, Human
uucggcagaaagucauuugucu

SEQ ID NO: 159264 - RNA, 22 nt, Human
uggcuuuuuucuccccuuggau

SEQ ID NO: 159265 - RNA, 22 nt, Human
ugggaauuuaugagaaaauaua

SEQ ID NO: 159266 - RNA, 22 nt, Human
ugggaagaguuagagacagcug

SEQ ID NO: 159267 - RNA, 22 nt, Human
ugggaacuggaaaaaaugaagu

SEQ ID NO: 159268 - RNA, 22 nt, Human
uuccaaaugacaaugggcugua

SEQ ID NO: 159269 - RNA, 22 nt, Human
uucauuuuauauuagagcuguu

SEQ ID NO: 159270 - RNA, 22 nt, Human
uuccaacaugugcuuguguuga

SEQ ID NO: 159271 - RNA, 22 nt, Human
uuccaagcaccaugaaggccuc

SEQ ID NO: 159272 - RNA, 22 nt, Human
uggagcuggcuuguggaaguug

SEQ ID NO: 159273 - RNA, 22 nt, Human
uuauggauuagaguuugauucu

SEQ ID NO: 159274 - RNA, 22 nt, Human
ugguauauuugaccauaugugu

SEQ ID NO: 159275 - RNA, 22 nt, Human
ugguccgagaacuguccugguu

SEQ ID NO: 159276 - RNA, 22 nt, Human
uggucaaauccuagauccuuug

SEQ ID NO: 159277 - RNA, 18 nt, Human
uucugcggugacagauau

SEQ ID NO: 159278 - RNA, 21 nt, Human
uucugcuguucaccaccaccc

SEQ ID NO: 159279 - RNA, 20 nt, Human
uucugcucuagagucuagaa

SEQ ID NO: 159280 - RNA, 22 nt, Human
uucucuauuugcugcaccucuc

SEQ ID NO: 159281 - RNA, 22 nt, Human
uggguuugcuuguucagguucu

SEQ ID NO: 159282 - RNA, 22 nt, Human
uggguucugaucccaggacugc

SEQ ID NO: 159283 - RNA, 22 nt, Human
uucucgaacaaccuacagggug

SEQ ID NO: 159284 - RNA, 22 nt, Human
ugggugggcagagucuaagaua

SEQ ID NO: 159285 - RNA, 22 nt, Human
uggguggauucgggaacuuguu

SEQ ID NO: 159286 - RNA, 22 nt, Human
uggguguggaagcagcgugggg

SEQ ID NO: 159287 - RNA, 22 nt, Human
uucuaguuacucuuaaaugcug

SEQ ID NO: 159288 - RNA, 22 nt, Human
uucuccugacuggccauucagu

SEQ ID NO: 159289 - RNA, 22 nt, Human
uggaaugaaagaaaaauuguag

SEQ ID NO: 159290 - RNA, 22 nt, Human
uggaagugggcaucaccaucca

SEQ ID NO: 159291 - RNA, 21 nt, Human
uggaauuggaaaccauucuau

SEQ ID NO: 159292 - RNA, 22 nt, Human
uuauaagugccucuuuauuuuc

SEQ ID NO: 159293 - RNA, 22 nt, Human
uggaaugccgggccaggcuccg

SEQ ID NO: 159294 - RNA, 22 nt, Human
uggagauauucuauauuuuaua

SEQ ID NO: 159295 - RNA, 22 nt, Human
uggagcaagaagggaggcagaa

SEQ ID NO: 159296 - RNA, 19 nt, Human
uuauccggacuuaauuuau

SEQ ID NO: 159297 - RNA, 22 nt, Human
uuaucugcccauuguagaauug

SEQ ID NO: 159298 - RNA, 22 nt, Human
uggaagggguuacgcagcagga

SEQ ID NO: 159299 - RNA, 22 nt, Human
uggaaggggccaggcgcggagu

SEQ ID NO: 159300 - RNA, 22 nt, Human
uggaaguggcaggggagacgua

SEQ ID NO: 159301 - RNA, 22 nt, Human
uuagucauucccucuugauauu

SEQ ID NO: 159302 - RNA, 22 nt, Human
uuaguggguuccauuucuaugg

SEQ ID NO: 159303 - RNA, 22 nt, Human
uuaguuaauaaauauugagugu

SEQ ID NO: 159304 - RNA, 22 nt, Human
uggaagaaaugguugagccaug

SEQ ID NO: 159305 - RNA, 22 nt, Human
uggaagaucugguguagcuccu

SEQ ID NO: 159306 - RNA, 22 nt, Human
uuaguauuuuuugaaugaugaa

SEQ ID NO: 159307 - RNA, 22 nt, Human
uggaagaagcuacaagcgguga

SEQ ID NO: 159308 - RNA, 22 nt, Human
uuaggucuugggccugccucca

SEQ ID NO: 159309 - RNA, 22 nt, Human
uuagguuuaugaggucugcauu

SEQ ID NO: 159310 - RNA, 22 nt, Human
uuaggaauugcuucauguuugg

SEQ ID NO: 159311 - RNA, 22 nt, Human
uggaacugguuugcuucagacu

SEQ ID NO: 159312 - RNA, 22 nt, Human
uggaaaugcuuagaggugaucu

SEQ ID NO: 159313 - RNA, 22 nt, Human
uggaaauaguugugagucaggc

SEQ ID NO: 159314 - RNA, 22 nt, Human
uggaaagauuuaaaauaacgag

SEQ ID NO: 159315 - RNA, 22 nt, Human
uuacuuaucugaugugauuuuu

SEQ ID NO: 159316 - RNA, 22 nt, Human
uuagaaaaaggcuguggucuua

SEQ ID NO: 159317 - RNA, 22 nt, Human
uggaaauagauguaggaaauug

SEQ ID NO: 159318 - RNA, 22 nt, Human
uuagaauggaaucauuugcauu

SEQ ID NO: 159319 - RNA, 22 nt, Human
uggaaauacaagaaguauguca

SEQ ID NO: 159320 - RNA, 22 nt, Human
uuacaucacuuuacuuaauaau

SEQ ID NO: 159321 - RNA, 22 nt, Human
uuacccuugaauuugugacaaa

SEQ ID NO: 159322 - RNA, 22 nt, Human
ugcuuucaaaacucagaggaau

SEQ ID NO: 159323 - RNA, 22 nt, Human
ugcuuuaccuuccauuuaagga

SEQ ID NO: 159324 - RNA, 22 nt, Human
ugcuuuauucgacaucugguag

SEQ ID NO: 159325 - RNA, 22 nt, Human
uuacuguguguaaaauaucuuu

SEQ ID NO: 159326 - RNA, 22 nt, Human
ugcuuuuguaucagaguauuca

SEQ ID NO: 159327 - RNA, 22 nt, Human
uuaccugccucaaacacgaaug

SEQ ID NO: 159328 - RNA, 22 nt, Human
ugcuuuuggcagcaguguuuau

SEQ ID NO: 159329 - RNA, 22 nt, Human
uuacucucugaggcacucaaaa

SEQ ID NO: 159330 - RNA, 20 nt, Human
ugcugugugucuacuguggg

SEQ ID NO: 159331 - RNA, 22 nt, Human
ugcugugcuggcggcagaggcc

SEQ ID NO: 159332 - RNA, 22 nt, Human
uuaauauuuauugguaaucacu

SEQ ID NO: 159333 - RNA, 22 nt, Human
ugcuguugacuuuguuguucuu

SEQ ID NO: 159334 - RNA, 22 nt, Human
uuaaucuauuucauauaaggga

SEQ ID NO: 159335 - RNA, 22 nt, Human
ugcuugaacccaggaaguggag

SEQ ID NO: 159336 - RNA, 22 nt, Human
uuaaugcauguaaaugugcaaa

SEQ ID NO: 159337 - RNA, 22 nt, Human
ugcuucuuugggggugaagaga

SEQ ID NO: 159338 - RNA, 22 nt, Human
ugcuggugauuaaauccugaag

SEQ ID NO: 159339 - RNA, 22 nt, Human
ugcugguuucugaguaaccaca

SEQ ID NO: 159340 - RNA, 20 nt, Human
ugcugggccaucuugcaugc

SEQ ID NO: 159341 - RNA, 22 nt, Human
ugcugcucaagcugcagcaaaa

SEQ ID NO: 159342 - RNA, 22 nt, Human
ugcuggaaggguaguauuaacu

SEQ ID NO: 159343 - RNA, 22 nt, Human
uguuuucuuuccccuucuuuuc

SEQ ID NO: 159344 - RNA, 23 nt, Human
uguuugggcuaucuuuuguucuc

SEQ ID NO: 159345 - RNA, 22 nt, Human
uguuuguuuuguauuuuuaauu

SEQ ID NO: 159346 - RNA, 22 nt, Human
uguuuuuuagagugauacuuuu

SEQ ID NO: 159347 - RNA, 21 nt, Human
uguuuuguaauagauacuaug

SEQ ID NO: 159348 - RNA, 22 nt, Human
uguuuuuagcuguuuuuuggau

SEQ ID NO: 159349 - RNA, 22 nt, Human
uguuuuuauucuuaauguuuca

SEQ ID NO: 159350 - RNA, 22 nt, Human
ugcucuuucaggcauagaccuu

SEQ ID NO: 159351 - RNA, 22 nt, Human
uguuuagcucugacuaugugau

SEQ ID NO: 159352 - RNA, 22 nt, Human
uguuuaucaguagacucaaguu

SEQ ID NO: 159353 - RNA, 22 nt, Human
uguuuaguuuugcaccaauaaa

SEQ ID NO: 159354 - RNA, 19 nt, Human
ugcugcaggaauucucaag

SEQ ID NO: 159355 - RNA, 22 nt, Human
uguuugagaauuugcugauguu

SEQ ID NO: 159356 - RNA, 22 nt, Human
ugcugcacucacaggaagaguu

SEQ ID NO: 159357 - RNA, 22 nt, Human
ugcugaccggccuccccccagc

SEQ ID NO: 159358 - RNA, 19 nt, Human
uguugugggccacuaacua

SEQ ID NO: 159359 - RNA, 22 nt, Human
uguuguagaaaggaaaguggcc

SEQ ID NO: 159360 - RNA, 22 nt, Human
uguuuaaauagaacauacugca

SEQ ID NO: 159361 - RNA, 22 nt, Human
uguuguucuuuuucuucuuguu

SEQ ID NO: 159362 - RNA, 22 nt, Human
ugccugucuaucuuugucaucu

SEQ ID NO: 159363 - RNA, 22 nt, Human
ugccuguguauuuccggccugc

SEQ ID NO: 159364 - RNA, 22 nt, Human
ugugugugugugugugugugug

SEQ ID NO: 159365 - RNA, 21 nt, Human
uguuggccuucauucucuguc

SEQ ID NO: 159366 - RNA, 22 nt, Human
ugcuccguucuucugcuucuug

SEQ ID NO: 159367 - RNA, 23 nt, Human
uggguuucagugccaaugcugcc

SEQ ID NO: 159368 - RNA, 22 nt, Human
uggguuuauuguauuucccuua

SEQ ID NO: 159369 - RNA, 22 nt, Human
ugguaaaugucuaacaaucacu

SEQ ID NO: 159370 - RNA, 22 nt, Human
ugagaauuuaacuugauuagga

SEQ ID NO: 159371 - RNA, 22 nt, Human
ugguaugaaggaggccggcagc

SEQ ID NO: 159372 - RNA, 22 nt, Human
ugagagggagacagcucuagca

SEQ ID NO: 159373 - RNA, 22 nt, Human
ugagaaaacaguuuguaauaau

SEQ ID NO: 159374 - RNA, 22 nt, Human
uggguguuccuggggugcaagg

SEQ ID NO: 159375 - RNA, 22 nt, Human
uggguuaaaguuugucacugac

SEQ ID NO: 159376 - RNA, 22 nt, Human
uggguguguccauauuuugacu

SEQ ID NO: 159377 - RNA, 22 nt, Human
ugaccuuaguuuuuucaaugag

SEQ ID NO: 159378 - RNA, 22 nt, Human
uggguagggagcuggaauccua

SEQ ID NO: 159379 - RNA, 22 nt, Human
ugaaaaaugcuuuaaugcaugu

SEQ ID NO: 159380 - RNA, 22 nt, Human
ugaaagccuacagcucacuguu

SEQ ID NO: 159381 - RNA, 22 nt, Human
ucuuuuucccugguuccuuuuu

SEQ ID NO: 159382 - RNA, 22 nt, Human
ucuuuuuaugucaaaaucgaug

SEQ ID NO: 159383 - RNA, 20 nt, Human
ugauaugcgguacagagagg

SEQ ID NO: 159384 - RNA, 15 nt, Human
ugguuucagaugaug

SEQ ID NO: 159385 - RNA, 22 nt, Human
ugauauaaaagauucuuauuga

SEQ ID NO: 159386 - RNA, 22 nt, Human
ugaugaaguuggaaggaaaguu

SEQ ID NO: 159387 - RNA, 20 nt, Human
uguacuauaaaagguugagu

SEQ ID NO: 159388 - RNA, 22 nt, Human
ugguuuccugauggacacuugg

SEQ ID NO: 159389 - RNA, 22 nt, Human
ugguuuguauauguuugugaga

SEQ ID NO: 159390 - RNA, 22 nt, Human
ugguuuucuuaauuagcaguca

SEQ ID NO: 159391 - RNA, 21 nt, Human
ugguuuuaucuugguggcugc

SEQ ID NO: 159392 - RNA, 22 nt, Human
ugagcagagcacuugggaacga

SEQ ID NO: 159393 - RNA, 22 nt, Human
uggucugauggucccaccaccg

SEQ ID NO: 159394 - RNA, 19 nt, Human
uggugcgcuguuccugagc

SEQ ID NO: 159395 - RNA, 22 nt, Human
ugguuacagaugaagaucggcc

SEQ ID NO: 159396 - RNA, 22 nt, Human
ugaggaggugggcacacagagu

SEQ ID NO: 159397 - RNA, 22 nt, Human
ugaggaugaggaagaagaagaa

SEQ ID NO: 159398 - RNA, 22 nt, Human
uggucugggaagaucacaauua

SEQ ID NO: 159399 - RNA, 22 nt, Human
ugucugaauuguaauguugcgu

SEQ ID NO: 159400 - RNA, 22 nt, Human
ugucuagacauuagcuucagcu

SEQ ID NO: 159401 - RNA, 23 nt, Human
ugcaaugcagcuagauguaaaau

SEQ ID NO: 159402 - RNA, 22 nt, Human
ugcagaacacaguagacagaac

SEQ ID NO: 159403 - RNA, 22 nt, Human
ugugaaggaaaguaggagggac

SEQ ID NO: 159404 - RNA, 22 nt, Human
ugucuuuuaaaaauguguaaaa

SEQ ID NO: 159405 - RNA, 22 nt, Human
ugauuucauaugacagcuuuuu

SEQ ID NO: 159406 - RNA, 22 nt, Human
ugaugaugccaaaauuuggcau

SEQ ID NO: 159407 - RNA, 22 nt, Human
ugauuugaaaccuuuggcaaga

SEQ ID NO: 159408 - RNA, 21 nt, Human
uguccucggaucaguccacaa

SEQ ID NO: 159409 - RNA, 21 nt, Human
ugucagaaagccugugacuuu

SEQ ID NO: 159410 - RNA, 22 nt, Human
ugcaugaucucacuuacaggug

SEQ ID NO: 159411 - RNA, 22 nt, Human
ugugauugcauugcagauuacu

SEQ ID NO: 159412 - RNA, 22 nt, Human
ugugauaauauuauuagagcuc

SEQ ID NO: 159413 - RNA, 20 nt, Human
ugcagcucccccgcaguuuc

SEQ ID NO: 159414 - RNA, 22 nt, Human
ugcagcuucucugcaacaggag

SEQ ID NO: 159415 - RNA, 22 nt, Human
ugcagcuuuugguuucuagaug

SEQ ID NO: 159416 - RNA, 22 nt, Human
ugcaggaacucgaaaacuauag

SEQ ID NO: 159417 - RNA, 22 nt, Human
ugcaggaagcucagcggggccg

SEQ ID NO: 159418 - RNA, 19 nt, Human
ugccggccgcgggguuccu

SEQ ID NO: 159419 - RNA, 22 nt, Human
ugccgccgugggucccgacgcg

SEQ ID NO: 159420 - RNA, 17 nt, Human
uguguauucuccaggug

SEQ ID NO: 159421 - RNA, 22 nt, Human
ugccgcuuucuggcccucaguc

SEQ ID NO: 159422 - RNA, 22 nt, Human
uguggugcagcgggaacagcuu

SEQ ID NO: 159423 - RNA, 22 nt, Human
ugcccagcagggagcuaccugg

SEQ ID NO: 159424 - RNA, 22 nt, Human
ugauugcucgacacucugcuug

SEQ ID NO: 159425 - RNA, 22 nt, Human
ugauucaguacuuucucuaacu

SEQ ID NO: 159426 - RNA, 19 nt, Human
uccaccgcgugcaccucua

SEQ ID NO: 159427 - RNA, 22 nt, Human
uccaagcgcuucuggagcuccu

SEQ ID NO: 159428 - RNA, 22 nt, Human
ugauguuucugaagggguuacu

SEQ ID NO: 159429 - RNA, 20 nt, Human
ugauuauuccaacaagaaug

SEQ ID NO: 159430 - RNA, 22 nt, Human
ugauuagauacuucagaugaca

SEQ ID NO: 159431 - RNA, 22 nt, Human
ucauuugggauuuuuuauaauu

SEQ ID NO: 159432 - RNA, 19 nt, Human
uccaaaauacuuguuacug

SEQ ID NO: 159433 - RNA, 18 nt, Human
ugauggcuaagagccggg

SEQ ID NO: 159434 - RNA, 22 nt, Human
ugaugaugaagaaauauuauca

SEQ ID NO: 159435 - RNA, 22 nt, Human
ugauaugguaauaagauauucu

SEQ ID NO: 159436 - RNA, 22 nt, Human
ugaggcuuucacuuggcaaaga

SEQ ID NO: 159437 - RNA, 22 nt, Human
ucauaagucucauauaugucca

SEQ ID NO: 159438 - RNA, 22 nt, Human
ucauccugucucuguucggaau

SEQ ID NO: 159439 - RNA, 22 nt, Human
ucaucggcugucaucuucacgu

SEQ ID NO: 159440 - RNA, 22 nt, Human
ucaugcagaguagaaagggcaa

SEQ ID NO: 159441 - RNA, 22 nt, Human
ucaugggcaaacuuggggauca

SEQ ID NO: 159442 - RNA, 22 nt, Human
ugaggaugagaaggaagagaag

SEQ ID NO: 159443 - RNA, 22 nt, Human
ugaggaaugugacaaaaccaag

SEQ ID NO: 159444 - RNA, 22 nt, Human
ugagauuuagaacuggauuuca

SEQ ID NO: 159445 - RNA, 19 nt, Human
ugagauuguaugaggagau

SEQ ID NO: 159446 - RNA, 22 nt, Human
ugagauguaauguaguacuuug

SEQ ID NO: 159447 - RNA, 22 nt, Human
ucagucacugugaaaugaauuu

SEQ ID NO: 159448 - RNA, 22 nt, Human
ucagguuuuuaaggagcuagga

SEQ ID NO: 159449 - RNA, 22 nt, Human
ugagaggaagggaaagaugauu

SEQ ID NO: 159450 - RNA, 22 nt, Human
ucagucauguuuaccagacgua

SEQ ID NO: 159451 - RNA, 22 nt, Human
ucagucauacuuuaugauugaa

SEQ ID NO: 159452 - RNA, 22 nt, Human
ucaggucacugauaaaguggaa

SEQ ID NO: 159453 - RNA, 22 nt, Human
ucagguuuaagcuacuggaauc

SEQ ID NO: 159454 - RNA, 22 nt, Human
ucagguuugcaaccucgggcaa

SEQ ID NO: 159455 - RNA, 22 nt, Human
ucuucaucucuaaaaugggaac

SEQ ID NO: 159456 - RNA, 22 nt, Human
ugauugggacauuuuguuuucu

SEQ ID NO: 159457 - RNA, 22 nt, Human
uccagccugaacuuuguccaga

SEQ ID NO: 159458 - RNA, 23 nt, Human
ucccaacuuugaaauauuccaca

SEQ ID NO: 159459 - RNA, 22 nt, Human
ucccggcaccgggagccccugc

SEQ ID NO: 159460 - RNA, 22 nt, Human
ucccucacacagcugggagaac

SEQ ID NO: 159461 - RNA, 20 nt, Human
ugcacggcugugugugugca

SEQ ID NO: 159462 - RNA, 22 nt, Human
ucccagccugacagugcaucaa

SEQ ID NO: 159463 - RNA, 22 nt, Human
ucccacugucuucucgugcucg

SEQ ID NO: 159464 - RNA, 22 nt, Human
ugcauaaauauuguugggagua

SEQ ID NO: 159465 - RNA, 22 nt, Human
ugcagguuuucagauguguguu

SEQ ID NO: 159466 - RNA, 22 nt, Human
uccgaccuuuacuucuugucuc

SEQ ID NO: 159467 - RNA, 22 nt, Human
uccgacacacgugcucgcagcg

SEQ ID NO: 159468 - RNA, 22 nt, Human
uccggcgaccuccagauguucc

SEQ ID NO: 159469 - RNA, 22 nt, Human
uccgggagcccccggaggagga

SEQ ID NO: 159470 - RNA, 23 nt, Human
ucccuguuucagggccagaacug

SEQ ID NO: 159471 - RNA, 22 nt, Human
ucccugccuccuggcagugcca

SEQ ID NO: 159472 - RNA, 22 nt, Human
ugcgccucugucacucagcauc

SEQ ID NO: 159473 - RNA, 22 nt, Human
ugcgccuccugcugccugcccu

SEQ ID NO: 159474 - RNA, 22 nt, Human
ugccuuguagccaccgggucac

SEQ ID NO: 159475 - RNA, 21 nt, Human
ugccuggccuuugcuuuuccu

SEQ ID NO: 159476 - RNA, 19 nt, Human
ugccuggcaccagcuccac

SEQ ID NO: 159477 - RNA, 17 nt, Human
ugccuucgucuucaguu

SEQ ID NO: 159478 - RNA, 22 nt, Human
uccuuucaaauuuauuugacau

SEQ ID NO: 159479 - RNA, 19 nt, Human
uccuugacuguauucagag

SEQ ID NO: 159480 - RNA, 22 nt, Human
uccuggcgugggcuggcugcag

SEQ ID NO: 159481 - RNA, 22 nt, Human
uccugcuucaaucugcugcugg

SEQ ID NO: 159482 - RNA, 22 nt, Human
ugcccugaagcugucaauuuug

SEQ ID NO: 159483 - RNA, 22 nt, Human
ugcauuguuuauggaauaaaau

SEQ ID NO: 159484 - RNA, 22 nt, Human
ugcauuuuuaauuuggaaaaaa

SEQ ID NO: 159485 - RNA, 22 nt, Human
ugcauuuugaaggaaaaaaaug

SEQ ID NO: 159486 - RNA, 22 nt, Human
uccucaaauccuagccucaucg

SEQ ID NO: 159487 - RNA, 22 nt, Human
ugccaacaggcuugccugaugu

SEQ ID NO: 159488 - RNA, 22 nt, Human
uccuccacuuagcgccacuggg

SEQ ID NO: 159489 - RNA, 22 nt, Human
uccucgccgucacgcagccucu

SEQ ID NO: 159490 - RNA, 22 nt, Human
uccucguccucauccgcgucau

SEQ ID NO: 159491 - RNA, 22 nt, Human
ucucaaacuauauaugggguuc

SEQ ID NO: 159492 - RNA, 22 nt, Human
ucucaaagagcuacuggucuau

SEQ ID NO: 159493 - RNA, 22 nt, Human
ugcugcuguuaucauuuuacca

SEQ ID NO: 159494 - RNA, 23 nt, Human
ugcugcuggaguaucuacaaugc

SEQ ID NO: 159495 - RNA, 22 nt, Human
ucucagaagaaacaucugcugg

SEQ ID NO: 159496 - RNA, 23 nt, Human
ugcugcgggacccgagcgcgcgc

SEQ ID NO: 159497 - RNA, 22 nt, Human
ugcugcggcgcaggcacuccag

SEQ ID NO: 159498 - RNA, 22 nt, Human
ugcugcggauauacaggaucug

SEQ ID NO: 159499 - RNA, 22 nt, Human
ucgccccccgccucacccucgg

SEQ ID NO: 159500 - RNA, 22 nt, Human
ugcgcgccgacggcuccgugac

SEQ ID NO: 159501 - RNA, 22 nt, Human
ucuagguuguaauuuguaguaa

SEQ ID NO: 159502 - RNA, 21 nt, Human
ucuauccuggcuuuccacuug

SEQ ID NO: 159503 - RNA, 22 nt, Human
ucuaugaagucuuccuuuccuc

SEQ ID NO: 159504 - RNA, 19 nt, Human
ucggaaugugggaagcaug

SEQ ID NO: 159505 - RNA, 22 nt, Human
ucgcuuuaauggucuucacagc

SEQ ID NO: 159506 - RNA, 22 nt, Human
ucuccuaauuacauacuugauu

SEQ ID NO: 159507 - RNA, 18 nt, Human
ucuccgaccccgcggucc

SEQ ID NO: 159508 - RNA, 22 nt, Human
ugcugcuguuuccuacaucuca

SEQ ID NO: 159509 - RNA, 20 nt, Human
ucucauuuugauuucgcauu

SEQ ID NO: 159510 - RNA, 22 nt, Human
ucucuugcuauugcgaacaggu

SEQ ID NO: 159511 - RNA, 22 nt, Human
ugcuuucagauaucuguuucaa

SEQ ID NO: 159512 - RNA, 22 nt, Human
ugcuuuccuucccuauguugag

SEQ ID NO: 159513 - RNA, 22 nt, Human
ugcuuucaaugaauuguauacu

SEQ ID NO: 159514 - RNA, 22 nt, Human
ucugaauauguuuaucaucucu

SEQ ID NO: 159515 - RNA, 22 nt, Human
ucugaagagaacucuuaguguu

SEQ ID NO: 159516 - RNA, 22 nt, Human
ucugaaaggagaguagggcaga

SEQ ID NO: 159517 - RNA, 21 nt, Human
ugcuuucugugcuuuuucugc

SEQ ID NO: 159518 - RNA, 21 nt, Human
ugcuuuuguugucagcugcug

SEQ ID NO: 159519 - RNA, 22 nt, Human
uggaaaagaugucuuccugaau

SEQ ID NO: 159520 - RNA, 22 nt, Human
uggaaaacgcaguuuaauuuuu

SEQ ID NO: 159521 - RNA, 22 nt, Human
ugcuuacgcaaccuguguuugg

SEQ ID NO: 159522 - RNA, 22 nt, Human
ugcuuaucuccuuaguuuuugc

SEQ ID NO: 159523 - RNA, 22 nt, Human
ucuccuuuggggccucaggguu

SEQ ID NO: 159524 - RNA, 22 nt, Human
ugcuuguuuguuuucuuccauu

SEQ ID NO: 159525 - RNA, 22 nt, Human
ugcuuguuuuguggcuucagcu

SEQ ID NO: 159526 - RNA, 22 nt, Human
ugcuuggauuuccaaaugguuu

SEQ ID NO: 159527 - RNA, 20 nt, Human
ucucugccaaccaccuccuc

SEQ ID NO: 159528 - RNA, 22 nt, Human
ucucugaccuccaccccaggag

SEQ ID NO: 159529 - RNA, 22 nt, Human
ugcuugacucagcaucggcaau

SEQ ID NO: 159530 - RNA, 22 nt, Human
ucuucagacuguuguucuuuug

SEQ ID NO: 159531 - RNA, 22 nt, Human
ucuuauuucuuucuuuuccugu

SEQ ID NO: 159532 - RNA, 22 nt, Human
ucuucaaauacagucauauuga

SEQ ID NO: 159533 - RNA, 22 nt, Human
uggcaaaaccugcaauuacuuu

SEQ ID NO: 159534 - RNA, 22 nt, Human
uggaugacaaccauuggaagag

SEQ ID NO: 159535 - RNA, 22 nt, Human
uggauuuuggaauguuucagua

SEQ ID NO: 159536 - RNA, 22 nt, Human
ucuuccucuccuggggcauuug

SEQ ID NO: 159537 - RNA, 22 nt, Human
ucuuccuuacucuggauguuau

SEQ ID NO: 159538 - RNA, 22 nt, Human
ucuuccaaacaaaaaucugugu

SEQ ID NO: 159539 - RNA, 22 nt, Human
ucuucauuucuggggaauuggc

SEQ ID NO: 159540 - RNA, 21 nt, Human
ucuuccaacacugacaccaug

SEQ ID NO: 159541 - RNA, 22 nt, Human
uggcgugaagcuggaaggcgga

SEQ ID NO: 159542 - RNA, 22 nt, Human
uggcggagacauggacuucaga

SEQ ID NO: 159543 - RNA, 22 nt, Human
uggcggcggggagguaggcaga

SEQ ID NO: 159544 - RNA, 22 nt, Human
ucuuuaucugugagcagucucc

SEQ ID NO: 159545 - RNA, 22 nt, Human
uggcaucacagacaaggcagca

SEQ ID NO: 159546 - RNA, 22 nt, Human
uggcauuuuguagcuguguauc

SEQ ID NO: 159547 - RNA, 22 nt, Human
ucugucaguguccucguguggu

SEQ ID NO: 159548 - RNA, 22 nt, Human
ucuguaacaucaguguaauuuu

SEQ ID NO: 159549 - RNA, 22 nt, Human
ucugugcuccuuccuugucauc

SEQ ID NO: 159550 - RNA, 19 nt, Human
ucuguggagcucagaguag

SEQ ID NO: 159551 - RNA, 22 nt, Human
ucuguguguguggcuaaacaag

SEQ ID NO: 159552 - RNA, 22 nt, Human
uggauaugaaacaaaacaagag

SEQ ID NO: 159553 - RNA, 21 nt, Human
uggauauugaguaguuucuga

SEQ ID NO: 159554 - RNA, 19 nt, Human
ucuguugcuuuguguccuc

SEQ ID NO: 159555 - RNA, 22 nt, Human
ucuguuguauggcugucuaauu

SEQ ID NO: 159556 - RNA, 20 nt, Human
uggaucaccauccuguugcu

SEQ ID NO: 159557 - RNA, 22 nt, Human
ucuguuuuuaucuauucuguua

SEQ ID NO: 159558 - RNA, 22 nt, Human
uggaaggugauucucugguuaa

SEQ ID NO: 159559 - RNA, 22 nt, Human
ucuggcuucaguaggguucacu

SEQ ID NO: 159560 - RNA, 22 nt, Human
uggaagugucagcaggcugguu

SEQ ID NO: 159561 - RNA, 22 nt, Human
ucugcuggugucauuuuugcua

SEQ ID NO: 159562 - RNA, 22 nt, Human
ucugcguggcgugguucugugc

SEQ ID NO: 159563 - RNA, 22 nt, Human
ucugcuguugaucaugacuagc

SEQ ID NO: 159564 - RNA, 22 nt, Human
ucugauaaggaaggauuaaaag

SEQ ID NO: 159565 - RNA, 23 nt, Human
uggaagaaaaugguuuggcugug

SEQ ID NO: 159566 - RNA, 23 nt, Human
ucuccccuccagcccucccuccu

SEQ ID NO: 159567 - RNA, 22 nt, Human
uaguuucuaauguugaaauuau

SEQ ID NO: 159568 - RNA, 22 nt, Human
ucucauaauuguuucccagcua

SEQ ID NO: 159569 - RNA, 22 nt, Human
uaguuuucuuuuguguuauucu

SEQ ID NO: 159570 - RNA, 22 nt, Human
uaguuuucaagugaguuggaag

SEQ ID NO: 159571 - RNA, 22 nt, Human
ucucccgcuuccugcuggcugc

SEQ ID NO: 159572 - RNA, 22 nt, Human
uauaagaaacaaggcaaauuuu

SEQ ID NO: 159573 - RNA, 22 nt, Human
uauacauauacaaaugcacaua

SEQ ID NO: 159574 - RNA, 22 nt, Human
uaggacuugaauucagccucca

SEQ ID NO: 159575 - RNA, 22 nt, Human
ucgauccaggaaggcugguuua

SEQ ID NO: 159576 - RNA, 22 nt, Human
uagcuucacuuuuguugaugcg

SEQ ID NO: 159577 - RNA, 20 nt, Human
ucuaggacaggcaaaguaca

SEQ ID NO: 159578 - RNA, 22 nt, Human
uaggagccagaauugcauuagu

SEQ ID NO: 159579 - RNA, 22 nt, Human
uaggauaacaauuuguaguuuc

SEQ ID NO: 159580 - RNA, 22 nt, Human
uaguuagaucuccaguuugguu

SEQ ID NO: 159581 - RNA, 22 nt, Human
ucucaaagguuuuccucuuuuu

SEQ ID NO: 159582 - RNA, 22 nt, Human
ucugagucgcucccuggaucca

SEQ ID NO: 159583 - RNA, 22 nt, Human
ucugaggacagugcugugccug

SEQ ID NO: 159584 - RNA, 22 nt, Human
ucucuucggagagaccuuugga

SEQ ID NO: 159585 - RNA, 22 nt, Human
uaucugaugcaggcucccagga

SEQ ID NO: 159586 - RNA, 22 nt, Human
ucucuucacuuguaugcuauca

SEQ ID NO: 159587 - RNA, 22 nt, Human
uauccauaccuucaaguuugcu

SEQ ID NO: 159588 - RNA, 20 nt, Human
ucucuuuuucuucuuuucuc

SEQ ID NO: 159589 - RNA, 22 nt, Human
ucugaaauuuuaguuauagaaa

SEQ ID NO: 159590 - RNA, 22 nt, Human
uauauuaaagugcuuugcagug

SEQ ID NO: 159591 - RNA, 22 nt, Human
uauauuuguccuagcuccuagc

SEQ ID NO: 159592 - RNA, 22 nt, Human
uaucaguccaggguuuugugac

SEQ ID NO: 159593 - RNA, 22 nt, Human
ucucuagaggaauuguucuagg

SEQ ID NO: 159594 - RNA, 22 nt, Human
uauauacacugauuaggauuuu

SEQ ID NO: 159595 - RNA, 22 nt, Human
ucugauucucuuguugaccuag

SEQ ID NO: 159596 - RNA, 22 nt, Human
ucugcacagcucaccucccugg

SEQ ID NO: 159597 - RNA, 17 nt, Human
ucugcagaggcaaaccu

SEQ ID NO: 159598 - RNA, 22 nt, Human
uauguggcaggugggagaucag

SEQ ID NO: 159599 - RNA, 22 nt, Human
ucuggcaguugccgcuucaguc

SEQ ID NO: 159600 - RNA, 22 nt, Human
uaugugaaauggaauauagaaa

SEQ ID NO: 159601 - RNA, 22 nt, Human
uauguauauccagguaagggcu

SEQ ID NO: 159602 - RNA, 22 nt, Human
uaugguuucuccugcagauuug

SEQ ID NO: 159603 - RNA, 22 nt, Human
uauuaugguuguagguuaacaa

SEQ ID NO: 159604 - RNA, 22 nt, Human
uauuauggguuuuuguguaaau

SEQ ID NO: 159605 - RNA, 18 nt, Human
uauuccucuuccucuauc

SEQ ID NO: 159606 - RNA, 22 nt, Human
ucuguucaugucuuuuuaagug

SEQ ID NO: 159607 - RNA, 22 nt, Human
ucuguucucuuguucugacggu

SEQ ID NO: 159608 - RNA, 22 nt, Human
ucuguuuacaugucagcagcaa

SEQ ID NO: 159609 - RNA, 22 nt, Human
ucuguuuuccaggaaucucaua

SEQ ID NO: 159610 - RNA, 20 nt, Human
ucuucagcuccaagucuggc

SEQ ID NO: 159611 - RNA, 21 nt, Human
ucuuauacagcaauagaucug

SEQ ID NO: 159612 - RNA, 22 nt, Human
ucuguuuuucagaccuuuuugg

SEQ ID NO: 159613 - RNA, 22 nt, Human
ucuguuuugugcuuuguuuucu

SEQ ID NO: 159614 - RNA, 22 nt, Human
uauguuuugcaaauaucaaaca

SEQ ID NO: 159615 - RNA, 22 nt, Human
uauuacugccacaucauuaggu

SEQ ID NO: 159616 - RNA, 22 nt, Human
uauguuugcaguucuaggucuu

SEQ ID NO: 159617 - RNA, 22 nt, Human
ucugugcuggacugauuucaua

SEQ ID NO: 159618 - RNA, 17 nt, Human
ucuguguccgcucaguc

SEQ ID NO: 159619 - RNA, 22 nt, Human
ucugguuucccaguuccuccgu

SEQ ID NO: 159620 - RNA, 22 nt, Human
ucugguuuggguugcuauggcu

SEQ ID NO: 159621 - RNA, 22 nt, Human
ucuggggaugagugaugucgua

SEQ ID NO: 159622 - RNA, 22 nt, Human
ucauauugguagagauguguaa

SEQ ID NO: 159623 - RNA, 22 nt, Human
ucaguugagguggucuauugcg

SEQ ID NO: 159624 - RNA, 22 nt, Human
ucauaaaaucaguguccauugu

SEQ ID NO: 159625 - RNA, 22 nt, Human
uaagucaagagcuagaaaaagc

SEQ ID NO: 159626 - RNA, 22 nt, Human
uaauauauuuuuuaagggaugu

SEQ ID NO: 159627 - RNA, 22 nt, Human
uaauuucauuuugcaaugaucu

SEQ ID NO: 159628 - RNA, 22 nt, Human
ucauuuguauucuacaaagcac

SEQ ID NO: 159629 - RNA, 22 nt, Human
ucauuuuaucaggaauggaauc

SEQ ID NO: 159630 - RNA, 22 nt, Human
ucauuuaauuuggaacucagag

SEQ ID NO: 159631 - RNA, 18 nt, Human
uccaaaccuuuuacuucc

SEQ ID NO: 159632 - RNA, 20 nt, Human
ucagugggaaagugagagug

SEQ ID NO: 159633 - RNA, 22 nt, Human
uaacgcaucuggaaacaggaca

SEQ ID NO: 159634 - RNA, 22 nt, Human
uaacauuucggugacaguggga

SEQ ID NO: 159635 - RNA, 22 nt, Human
uaaauuugugaauuagcuauca

SEQ ID NO: 159636 - RNA, 22 nt, Human
uaacaacuuucugguguaacuu

SEQ ID NO: 159637 - RNA, 21 nt, Human
ucaagcggcagagcaguuauu

SEQ ID NO: 159638 - RNA, 22 nt, Human
guuggguaauuaagcacagaaa

SEQ ID NO: 159639 - RNA, 22 nt, Human
ucaagcaaggaauccuuuugua

SEQ ID NO: 159640 - RNA, 22 nt, Human
ucaagcuggaaaugaagaaucu

SEQ ID NO: 159641 - RNA, 22 nt, Human
ucaguacaagauuuucuaaauc

SEQ ID NO: 159642 - RNA, 22 nt, Human
ucagguuuaagugacuggaauc

SEQ ID NO: 159643 - RNA, 22 nt, Human
ucaguauuagugcauuaucagg

SEQ ID NO: 159644 - RNA, 22 nt, Human
uaaaugaaaugaagugaaagcu

SEQ ID NO: 159645 - RNA, 22 nt, Human
uaaaggcaaacucuccaaggau

SEQ ID NO: 159646 - RNA, 22 nt, Human
uccuuagccagggcagcucaaa

SEQ ID NO: 159647 - RNA, 22 nt, Human
uagcuggaggggcaggaugcug

SEQ ID NO: 159648 - RNA, 22 nt, Human
uagcagcacuauuuguuguagu

SEQ ID NO: 159649 - RNA, 22 nt, Human
uccuccauguugugcacuugaa

SEQ ID NO: 159650 - RNA, 22 nt, Human
uagaucucugccuuguucagag

SEQ ID NO: 159651 - RNA, 20 nt, Human
uccgaaucaugacuuugcac

SEQ ID NO: 159652 - RNA, 22 nt, Human
ucccuguggauuaaggagaugu

SEQ ID NO: 159653 - RNA, 22 nt, Human
uacuuugucauucuaaccuucc

SEQ ID NO: 159654 - RNA, 22 nt, Human
uagaagaacaugucaaacuaua

SEQ ID NO: 159655 - RNA, 22 nt, Human
uccucagcaagacgcuggcagc

SEQ ID NO: 159656 - RNA, 22 nt, Human
uccgugggucuugaagugucac

SEQ ID NO: 159657 - RNA, 22 nt, Human
ucccgcccugcguucucccaug

SEQ ID NO: 159658 - RNA, 22 nt, Human
ucccguuucacuccuugccagc

SEQ ID NO: 159659 - RNA, 22 nt, Human
uacugauggagauaggcuauca

SEQ ID NO: 159660 - RNA, 22 nt, Human
uacugaguuucacugucugugc

SEQ ID NO: 159661 - RNA, 22 nt, Human
uacugacguaguagaguugcuu

SEQ ID NO: 159662 - RNA, 22 nt, Human
uacugagcauaaaacccauacu

SEQ ID NO: 159663 - RNA, 22 nt, Human
uccccgcuccguagagaaagag

SEQ ID NO: 159664 - RNA, 22 nt, Human
uccacaaagucuaugagaguug

SEQ ID NO: 159665 - RNA, 22 nt, Human
uacaguauuuuuuaagaaaaaa

SEQ ID NO: 159666 - RNA, 22 nt, Human
uccaugcgcgauggccuggcuu

SEQ ID NO: 159667 - RNA, 22 nt, Human
uccauguauugcuaacaaauag

SEQ ID NO: 159668 - RNA, 22 nt, Human
uccaucuacgagauuuuccaga

SEQ ID NO: 159669 - RNA, 22 nt, Human
uccauaugaucuguuguauggu

SEQ ID NO: 159670 - RNA, 22 nt, Human
uacguuuuauaucuuuuggaau

SEQ ID NO: 159671 - RNA, 22 nt, Human
guggaagggaaaccgcacuggc

SEQ ID NO: 159672 - RNA, 22 nt, Human
gugcuggcaaagagaacaucuu

SEQ ID NO: 159673 - RNA, 22 nt, Human
gugcuguuagcgguuuauaaca

SEQ ID NO: 159674 - RNA, 22 nt, Human
guggagaagggaccgggaagga

SEQ ID NO: 159675 - RNA, 22 nt, Human
guggaggaagaucuuugaugau

SEQ ID NO: 159676 - RNA, 22 nt, Human
guggauaaguuguuugaccuac

SEQ ID NO: 159677 - RNA, 22 nt, Human
uaggauugguguauguagguuu

SEQ ID NO: 159678 - RNA, 22 nt, Human
guggauuguaccacgaaaagug

SEQ ID NO: 159679 - RNA, 22 nt, Human
guggauuucaggcuccccucag

SEQ ID NO: 159680 - RNA, 22 nt, Human
uagccguugggguaacuggaca

SEQ ID NO: 159681 - RNA, 17 nt, Human
uagccagcuugugauuu

SEQ ID NO: 159682 - RNA, 22 nt, Human
uagaacaaacagcauguuugau

SEQ ID NO: 159683 - RNA, 22 nt, Human
uagaagagcaugucaaacuaua

SEQ ID NO: 159684 - RNA, 22 nt, Human
uagaagaugccuuaaaguugaa

SEQ ID NO: 159685 - RNA, 22 nt, Human
uagcguaugcugugugaugaau

SEQ ID NO: 159686 - RNA, 20 nt, Human
uagcuucaccuagagauagc

SEQ ID NO: 159687 - RNA, 18 nt, Human
gugggcacacacucuguu

SEQ ID NO: 159688 - RNA, 22 nt, Human
uaguggaaccuucuaaaugacg

SEQ ID NO: 159689 - RNA, 22 nt, Human
gugggugaguggggccgccuga

SEQ ID NO: 159690 - RNA, 22 nt, Human
uaguauuguguuguuugacagu

SEQ ID NO: 159691 - RNA, 22 nt, Human
uagguauguuaacugugcaauu

SEQ ID NO: 159692 - RNA, 22 nt, Human
guggcaaguuuucugacaagga

SEQ ID NO: 159693 - RNA, 22 nt, Human
guggcaguaaagcuggaaaagu

SEQ ID NO: 159694 - RNA, 22 nt, Human
uagguaauacuuagaccugauu

SEQ ID NO: 159695 - RNA, 22 nt, Human
uaggguuucaugcugguuucca

SEQ ID NO: 159696 - RNA, 22 nt, Human
uaggcaguagcuuuggauguca

SEQ ID NO: 159697 - RNA, 22 nt, Human
uaggcaauauuagacuuugucu

SEQ ID NO: 159698 - RNA, 22 nt, Human
uaggcagggauuaggguugauu

SEQ ID NO: 159699 - RNA, 22 nt, Human
uagguuguuguggggauuaagu

SEQ ID NO: 159700 - RNA, 22 nt, Human
uagguggaaccauaugaaauuu

SEQ ID NO: 159701 - RNA, 22 nt, Human
uagguuuugugucagaguagaa

SEQ ID NO: 159702 - RNA, 22 nt, Human
guggcuuuguuuccaaaugaaa

SEQ ID NO: 159703 - RNA, 22 nt, Human
guggccuuccuguuccuuugaa

SEQ ID NO: 159704 - RNA, 22 nt, Human
ucaaaggcuugugguucuggga

SEQ ID NO: 159705 - RNA, 22 nt, Human
ucaaaucugauaggcgacaccu

SEQ ID NO: 159706 - RNA, 22 nt, Human
guugggugccagaggcuucacg

SEQ ID NO: 159707 - RNA, 22 nt, Human
guuggggccuggagucucuugg

SEQ ID NO: 159708 - RNA, 22 nt, Human
guuggaaauaucagucacguga

SEQ ID NO: 159709 - RNA, 22 nt, Human
ucaaaaauaagauauucuggac

SEQ ID NO: 159710 - RNA, 22 nt, Human
guugcuucuuggcuuuuccaac

SEQ ID NO: 159711 - RNA, 23 nt, Human
uauuuuccccuguaauauguauu

SEQ ID NO: 159712 - RNA, 22 nt, Human
guugcggaguguagcgaugcuu

SEQ ID NO: 159713 - RNA, 22 nt, Human
uauuuuucacagauuggugcuu

SEQ ID NO: 159714 - RNA, 23 nt, Human
guugccuuugcaucuucauccau

SEQ ID NO: 159715 - RNA, 22 nt, Human
guugccugguuucaaaaggaau

SEQ ID NO: 159716 - RNA, 22 nt, Human
uauuuuuguuuaccaguuaaca

SEQ ID NO: 159717 - RNA, 22 nt, Human
guucuucucuuguaauggaauc

SEQ ID NO: 159718 - RNA, 22 nt, Human
guucuucagauuccauuucagu

SEQ ID NO: 159719 - RNA, 22 nt, Human
guucuuagcacuucugcccauu

SEQ ID NO: 159720 - RNA, 22 nt, Human
uauuuuaaaagcauuaauucuu

SEQ ID NO: 159721 - RNA, 22 nt, Human
uauuuguuuuuaaugcugggug

SEQ ID NO: 159722 - RNA, 21 nt, Human
guucuuaguuauauucucaau

SEQ ID NO: 159723 - RNA, 22 nt, Human
guuccugagcaguuccuggcca

SEQ ID NO: 159724 - RNA, 22 nt, Human
guucaaucucucaugcauuuuc

SEQ ID NO: 159725 - RNA, 22 nt, Human
guuccugugcccuguucuuucc

SEQ ID NO: 159726 - RNA, 22 nt, Human
guucgucuguggugugaggugc

SEQ ID NO: 159727 - RNA, 22 nt, Human
uauuggguagguccuuuggagu

SEQ ID NO: 159728 - RNA, 22 nt, Human
guguugacacagccaucuuguc

SEQ ID NO: 159729 - RNA, 22 nt, Human
guguugaugugucuguauucua

SEQ ID NO: 159730 - RNA, 22 nt, Human
guguuggugagcucauuuccac

SEQ ID NO: 159731 - RNA, 22 nt, Human
uauguauaacuugauaggauga

SEQ ID NO: 159732 - RNA, 23 nt, Human
gugugccuuuaucuucuguacuc

SEQ ID NO: 159733 - RNA, 23 nt, Human
guguuguugauuuucgaaucuuu

SEQ ID NO: 159734 - RNA, 22 nt, Human
guguuucccuggcacaagaacc

SEQ ID NO: 159735 - RNA, 22 nt, Human
guguugugauuggucagucacu

SEQ ID NO: 159736 - RNA, 22 nt, Human
guguuuguauccuccauauaac

SEQ ID NO: 159737 - RNA, 22 nt, Human
uaugucuauugacuuaggauuu

SEQ ID NO: 159738 - RNA, 22 nt, Human
guuaaaugcagauucugacuca

SEQ ID NO: 159739 - RNA, 22 nt, Human
uauguugucuuguucagccaua

SEQ ID NO: 159740 - RNA, 22 nt, Human
guguauuucuagaagaaaugaa

SEQ ID NO: 159741 - RNA, 22 nt, Human
uaugcaucaguaugguuggaaa

SEQ ID NO: 159742 - RNA, 22 nt, Human
uaugccaaaaauaaguuuuaug

SEQ ID NO: 159743 - RNA, 22 nt, Human
uaugcuguauucuguauguuag

SEQ ID NO: 159744 - RNA, 22 nt, Human
uauccaucuucuuugagaaugg

SEQ ID NO: 159745 - RNA, 22 nt, Human
uauccaaaggaacaaucacagc

SEQ ID NO: 159746 - RNA, 22 nt, Human
guggugaacauuugcaucugcu

SEQ ID NO: 159747 - RNA, 22 nt, Human
guggguuggguuuuugaaggga

SEQ ID NO: 159748 - RNA, 22 nt, Human
gucacuccuucccagagggagc

SEQ ID NO: 159749 - RNA, 22 nt, Human
gucaucugagggacgagauuuc

SEQ ID NO: 159750 - RNA, 22 nt, Human
uaagauuuuuacaaauagagug

SEQ ID NO: 159751 - RNA, 22 nt, Human
guauugauuguuuuaaaagauu

SEQ ID NO: 159752 - RNA, 22 nt, Human
uaagaccuuuuugaaaucacug

SEQ ID NO: 159753 - RNA, 22 nt, Human
uaauaucuuuacacauuuucaa

SEQ ID NO: 159754 - RNA, 22 nt, Human
uaauauccaguuauuucccuca

SEQ ID NO: 159755 - RNA, 22 nt, Human
guccugaaaaaaaucccugagu

SEQ ID NO: 159756 - RNA, 22 nt, Human
guccuguccuguccuggagaca

SEQ ID NO: 159757 - RNA, 22 nt, Human
guccuguccugcugagcuccug

SEQ ID NO: 159758 - RNA, 22 nt, Human
uaauugaacguucauuuuuaau

SEQ ID NO: 159759 - RNA, 22 nt, Human
uaauuccacacucccgcaagcg

SEQ ID NO: 159760 - RNA, 22 nt, Human
uaauucuacagggaacucugga

SEQ ID NO: 159761 - RNA, 22 nt, Human
uaauuauuaauuuuagguugcu

SEQ ID NO: 159762 - RNA, 22 nt, Human
uacuugaaaugggcaucaagag

SEQ ID NO: 159763 - RNA, 22 nt, Human
gugaagguccugauuugugacc

SEQ ID NO: 159764 - RNA, 22 nt, Human
uacuuuaauugcaaaaauaaau

SEQ ID NO: 159765 - RNA, 22 nt, Human
uacuuuuuucacuucuagcccc

SEQ ID NO: 159766 - RNA, 22 nt, Human
uacuucccacuggggucuacca

SEQ ID NO: 159767 - RNA, 22 nt, Human
gugaaauuguacacucaguacc

SEQ ID NO: 159768 - RNA, 22 nt, Human
gugaaacuggaugugaaaacaa

SEQ ID NO: 159769 - RNA, 22 nt, Human
uacauccuuuugaaaucccaga

SEQ ID NO: 159770 - RNA, 22 nt, Human
uacagauaaaaaugcuguucuu

SEQ ID NO: 159771 - RNA, 22 nt, Human
gucuuugagccucaguuuccuc

SEQ ID NO: 159772 - RNA, 22 nt, Human
gugaaaaauggccaucaggaca

SEQ ID NO: 159773 - RNA, 22 nt, Human
gucuuucuuuuacauauuugug

SEQ ID NO: 159774 - RNA, 22 nt, Human
gucuugugaagacggcagaaag

SEQ ID NO: 159775 - RNA, 22 nt, Human
uacaaaauucaaauaauguuug

SEQ ID NO: 159776 - RNA, 22 nt, Human
uaauuuugucacagugacaugc

SEQ ID NO: 159777 - RNA, 22 nt, Human
guaaggcaggagucuuaaaccu

SEQ ID NO: 159778 - RNA, 22 nt, Human
guaagaauauacccaggaguca

SEQ ID NO: 159779 - RNA, 22 nt, Human
uaaaugaaaggguuuaauuuau

SEQ ID NO: 159780 - RNA, 22 nt, Human
gguuuucuuguucauuuuuuaa

SEQ ID NO: 159781 - RNA, 22 nt, Human
guacuaguuaaaaauagaauua

SEQ ID NO: 159782 - RNA, 22 nt, Human
guaagguuggaugcaaucaacu

SEQ ID NO: 159783 - RNA, 22 nt, Human
uaaauuccuagucacaaacuuc

SEQ ID NO: 159784 - RNA, 22 nt, Human
uaaaaugcucagauaaauauau

SEQ ID NO: 159785 - RNA, 22 nt, Human
uaaaccuuauuugaauaccaac

SEQ ID NO: 159786 - RNA, 22 nt, Human
uaaaauaccacauauggugcuc

SEQ ID NO: 159787 - RNA, 22 nt, Human
uaaaaucaugacagauugacau

SEQ ID NO: 159788 - RNA, 22 nt, Human
uaaacgaagcuucaugcuugaa

SEQ ID NO: 159789 - RNA, 22 nt, Human
ggugucucagauuguaaaaugu

SEQ ID NO: 159790 - RNA, 22 nt, Human
gguuugccagugcuggaaugca

SEQ ID NO: 159791 - RNA, 22 nt, Human
gguuuguggagcuggaaacacu

SEQ ID NO: 159792 - RNA, 22 nt, Human
gguuuuuggcucaauauuuugg

SEQ ID NO: 159793 - RNA, 22 nt, Human
gguguagggaaacuugacuaau

SEQ ID NO: 159794 - RNA, 22 nt, Human
guuuuggagauguccauuuucc

SEQ ID NO: 159795 - RNA, 22 nt, Human
gguguguaggugaaggccaaga

SEQ ID NO: 159796 - RNA, 21 nt, Human
uaaaagaugacaagacagcuc

SEQ ID NO: 159797 - RNA, 22 nt, Human
uaaaaccauucauugaccuaug

SEQ ID NO: 159798 - RNA, 22 nt, Human
ggugugugugugugugugugug

SEQ ID NO: 159799 - RNA, 23 nt, Human
guuuuugcugcagcugaagaagg

SEQ ID NO: 159800 - RNA, 22 nt, Human
uaaaaaccuuguauuuaacucu

SEQ ID NO: 159801 - RNA, 22 nt, Human
uaaaaauuagauauguauuuag

SEQ ID NO: 159802 - RNA, 22 nt, Human
guuuguuugccagcuuaguaaa

SEQ ID NO: 159803 - RNA, 22 nt, Human
guuuguguauauguguauuuuu

SEQ ID NO: 159804 - RNA, 22 nt, Human
gguguacgaagaggcgggaguc

SEQ ID NO: 159805 - RNA, 22 nt, Human
guuuggguugcucauucuacau

SEQ ID NO: 159806 - RNA, 22 nt, Human
ggucggggcuggccggcguggu

SEQ ID NO: 159807 - RNA, 22 nt, Human
ggucgucuguccugucgccgcu

SEQ ID NO: 159808 - RNA, 19 nt, Human
gguccguuacaggcuuucc

SEQ ID NO: 159809 - RNA, 22 nt, Human
guugggaauucggagagaaaua

SEQ ID NO: 159810 - RNA, 22 nt, Human
guuggcgaaggaccuggaggag

SEQ ID NO: 159811 - RNA, 22 nt, Human
guuggaggaaggacaggaacag

SEQ ID NO: 159812 - RNA, 22 nt, Human
guuuaaaagcaaccaacaggcu

SEQ ID NO: 159813 - RNA, 19 nt, Human
ggucugcggggugaccgug

SEQ ID NO: 159814 - RNA, 22 nt, Human
ggucugcgauggcaagggucuu

SEQ ID NO: 159815 - RNA, 22 nt, Human
ggucuucauucuaccagacuuu

SEQ ID NO: 159816 - RNA, 22 nt, Human
guuuaagcagauugcuguggug

SEQ ID NO: 159817 - RNA, 22 nt, Human
guuuaaguuaaaauuuaccugc

SEQ ID NO: 159818 - RNA, 22 nt, Human
guuugcagacuauguaaacuuc

SEQ ID NO: 159819 - RNA, 22 nt, Human
guuucucuuugguggguugaga

SEQ ID NO: 159820 - RNA, 22 nt, Human
guuucuguggacucugcuuagg

SEQ ID NO: 159821 - RNA, 22 nt, Human
guuuccaagucucucaacaccc

SEQ ID NO: 159822 - RNA, 22 nt, Human
ggugaaggaucccucuuggccu

SEQ ID NO: 159823 - RNA, 22 nt, Human
gucuauuuauagacagauccua

SEQ ID NO: 159824 - RNA, 22 nt, Human
ggcuggacuuucugcugggcuc

SEQ ID NO: 159825 - RNA, 22 nt, Human
ggcugggagguggcgaggaggc

SEQ ID NO: 159826 - RNA, 22 nt, Human
gucgucgcucccaccuuccgcu

SEQ ID NO: 159827 - RNA, 22 nt, Human
ggcugcuugggcuguuucuuuu

SEQ ID NO: 159828 - RNA, 22 nt, Human
gucguuugucaauuuugaugug

SEQ ID NO: 159829 - RNA, 22 nt, Human
ggcugcuugauagauaugagua

SEQ ID NO: 159830 - RNA, 22 nt, Human
ggcuggaacuucuucuggcauu

SEQ ID NO: 159831 - RNA, 22 nt, Human
ggcucagaggagcuggaacggu

SEQ ID NO: 159832 - RNA, 22 nt, Human
ggcugcagugcaacucuuucua

SEQ ID NO: 159833 - RNA, 22 nt, Human
ggcugaugacgccugagucuga

SEQ ID NO: 159834 - RNA, 22 nt, Human
guccugauggccauuuuucacu

SEQ ID NO: 159835 - RNA, 22 nt, Human
guccguaauuuuugcuugcaga

SEQ ID NO: 159836 - RNA, 22 nt, Human
guauuugacaccagugaauggu

SEQ ID NO: 159837 - RNA, 22 nt, Human
guauuugcaaucacaaacaaaa

SEQ ID NO: 159838 - RNA, 22 nt, Human
gucaaaguuaacuagcaggugc

SEQ ID NO: 159839 - RNA, 22 nt, Human
gucaaaggcggugcaggaggag

SEQ ID NO: 159840 - RNA, 22 nt, Human
guauuuggacugccuguucauu

SEQ ID NO: 159841 - RNA, 22 nt, Human
gucagaagauagaggaaguuug

SEQ ID NO: 159842 - RNA, 22 nt, Human
ggcggcaagggaauggagaaga

SEQ ID NO: 159843 - RNA, 22 nt, Human
ggcggugcgaggaugcagggcu

SEQ ID NO: 159844 - RNA, 22 nt, Human
ggcggcugcuccuugcccucgg

SEQ ID NO: 159845 - RNA, 22 nt, Human
guauaaauaucuauauuguuac

SEQ ID NO: 159846 - RNA, 22 nt, Human
gguuuucagaaugcaguccugu

SEQ ID NO: 159847 - RNA, 22 nt, Human
gguuuucacgauccucccuuuu

SEQ ID NO: 159848 - RNA, 22 nt, Human
gguuugggaagaacuauucccu

SEQ ID NO: 159849 - RNA, 21 nt, Human
gguuucugcaaaccuuguaca

SEQ ID NO: 159850 - RNA, 22 nt, Human
gguuucuuuccucucugugccu

SEQ ID NO: 159851 - RNA, 22 nt, Human
guaucuuuauuuuaauuaagau

SEQ ID NO: 159852 - RNA, 22 nt, Human
guauauuuaugagcauuagccu

SEQ ID NO: 159853 - RNA, 21 nt, Human
guaucuuucuuuuaaaauauc

SEQ ID NO: 159854 - RNA, 22 nt, Human
ggcgccuuguggaaugagagcu

SEQ ID NO: 159855 - RNA, 22 nt, Human
gggaauguuaaccuuucuauuu

SEQ ID NO: 159856 - RNA, 22 nt, Human
gugauggucgagcgcuuguugu

SEQ ID NO: 159857 - RNA, 22 nt, Human
gugauggggagagcgcagcuuu

SEQ ID NO: 159858 - RNA, 22 nt, Human
gugaugaaggccugcaccuggu

SEQ ID NO: 159859 - RNA, 20 nt, Human
gggaauggauggauugcucc

SEQ ID NO: 159860 - RNA, 20 nt, Human
gggacugagccuuguuugug

SEQ ID NO: 159861 - RNA, 22 nt, Human
gggacugguuguguguggugug

SEQ ID NO: 159862 - RNA, 19 nt, Human
gggagaaaaucuuuauccu

SEQ ID NO: 159863 - RNA, 22 nt, Human
gggagaaccagccagugcaagg

SEQ ID NO: 159864 - RNA, 22 nt, Human
gggacaggacuccuggggccug

SEQ ID NO: 159865 - RNA, 22 nt, Human
gggacucugaaucuagauuccu

SEQ ID NO: 159866 - RNA, 22 nt, Human
gugccaaauagcuugauuaaga

SEQ ID NO: 159867 - RNA, 22 nt, Human
gggaggaagaguaggaauuuga

SEQ ID NO: 159868 - RNA, 22 nt, Human
gggagcugagcuggaagagaau

SEQ ID NO: 159869 - RNA, 22 nt, Human
gggagguaaugggggugcaggg

SEQ ID NO: 159870 - RNA, 22 nt, Human
gggagggaggagccccggccau

SEQ ID NO: 159871 - RNA, 22 nt, Human
gugccugcucauucucaauauu

SEQ ID NO: 159872 - RNA, 22 nt, Human
gggaugaaugccuggcuccccc

SEQ ID NO: 159873 - RNA, 22 nt, Human
gugcucgagcugugcgcgcugc

SEQ ID NO: 159874 - RNA, 22 nt, Human
gggauguauguuuguguggaga

SEQ ID NO: 159875 - RNA, 22 nt, Human
gugcucaagacauuaggaauau

SEQ ID NO: 159876 - RNA, 22 nt, Human
gggcaagaagcuggaagcauuc

SEQ ID NO: 159877 - RNA, 22 nt, Human
gggauuaaaaaucaccaaagua

SEQ ID NO: 159878 - RNA, 22 nt, Human
gggauuuaaugggaaaaauaug

SEQ ID NO: 159879 - RNA, 22 nt, Human
gggaaaucugcuuccuagggcu

SEQ ID NO: 159880 - RNA, 23 nt, Human
gggaaaucaaaagauauuucuuc

SEQ ID NO: 159881 - RNA, 22 nt, Human
gggaaaugugucuuggcauucu

SEQ ID NO: 159882 - RNA, 22 nt, Human
gugacugagcuggcaaaguaug

SEQ ID NO: 159883 - RNA, 22 nt, Human
gggaaaauguuucugagacaaa

SEQ ID NO: 159884 - RNA, 22 nt, Human
gugaaggcaugugugcugugcu

SEQ ID NO: 159885 - RNA, 22 nt, Human
gugaagcacaugggcguugggu

SEQ ID NO: 159886 - RNA, 22 nt, Human
ggcuuuuucccuaggguaagag

SEQ ID NO: 159887 - RNA, 17 nt, Human
gugagcugagucaggac

SEQ ID NO: 159888 - RNA, 22 nt, Human
gugaguuuucgugacacuauuu

SEQ ID NO: 159889 - RNA, 22 nt, Human
gggaaauagagcuggaaccuug

SEQ ID NO: 159890 - RNA, 18 nt, Human
gggaagaugccacaguga

SEQ ID NO: 159891 - RNA, 22 nt, Human
gggaagugagcuggaaucaagg

SEQ ID NO: 159892 - RNA, 19 nt, Human
gugauauuuauuauuuauu

SEQ ID NO: 159893 - RNA, 22 nt, Human
gggaagaagaaaagagguggga

SEQ ID NO: 159894 - RNA, 20 nt, Human
gugaacuggagaacugaugu

SEQ ID NO: 159895 - RNA, 19 nt, Human
ggcuuugcccuucgcuccg

SEQ ID NO: 159896 - RNA, 22 nt, Human
ggcuuguccuucugguugucuu

SEQ ID NO: 159897 - RNA, 22 nt, Human
ggcuuuuguuauaaucaggccu

SEQ ID NO: 159898 - RNA, 22 nt, Human
ggcuguggcagcuggaaguggu

SEQ ID NO: 159899 - RNA, 22 nt, Human
ggcuggggccuguugaagaugc

SEQ ID NO: 159900 - RNA, 22 nt, Human
gucuguacugccguuauucaga

SEQ ID NO: 159901 - RNA, 18 nt, Human
gucuguuccuuuaauguc

SEQ ID NO: 159902 - RNA, 22 nt, Human
gggaaaaaggaguuagagauaa

SEQ ID NO: 159903 - RNA, 22 nt, Human
gcuguuucuuuggcaaacugau

SEQ ID NO: 159904 - RNA, 22 nt, Human
gcuguuuaaguggaauuuguuu

SEQ ID NO: 159905 - RNA, 22 nt, Human
gcuguugagucagacaaguuuu

SEQ ID NO: 159906 - RNA, 22 nt, Human
gcuguugcaaucaaggccaugg

SEQ ID NO: 159907 - RNA, 22 nt, Human
gggaaaaaggaaccuuauuacu

SEQ ID NO: 159908 - RNA, 20 nt, Human
ggcauuuuuuaguugagcuu

SEQ ID NO: 159909 - RNA, 22 nt, Human
ggccaaagagcacaaugaauag

SEQ ID NO: 159910 - RNA, 22 nt, Human
gcuugcugaacaggaaccuggc

SEQ ID NO: 159911 - RNA, 22 nt, Human
gcuucuguuaggauguggcuua

SEQ ID NO: 159912 - RNA, 20 nt, Human
gcuugaauuugauggccaga

SEQ ID NO: 159913 - RNA, 22 nt, Human
gggaaguugguaagaggcuguu

SEQ ID NO: 159914 - RNA, 22 nt, Human
gggaauuuuaggaugacuccua

SEQ ID NO: 159915 - RNA, 18 nt, Human
gcuuggguggcuauguuu

SEQ ID NO: 159916 - RNA, 22 nt, Human
gggaacgacuguuaguacuugg

SEQ ID NO: 159917 - RNA, 22 nt, Human
gggaagaaccucugcuaccaau

SEQ ID NO: 159918 - RNA, 21 nt, Human
gggaagagaagagaaaggagg

SEQ ID NO: 159919 - RNA, 22 nt, Human
gggaagagggagcuggaaugau

SEQ ID NO: 159920 - RNA, 22 nt, Human
gggaagaacugauuucacacca

SEQ ID NO: 159921 - RNA, 22 nt, Human
gcuucugugagugcagaugcug

SEQ ID NO: 159922 - RNA, 22 nt, Human
gcuucucauguuuauuuuuaca

SEQ ID NO: 159923 - RNA, 19 nt, Human
gggcuuguuggcaaaugac

SEQ ID NO: 159924 - RNA, 22 nt, Human
ggaccagagcuaaugcgcgccc

SEQ ID NO: 159925 - RNA, 22 nt, Human
ggaaugcagugagcauuagaua

SEQ ID NO: 159926 - RNA, 22 nt, Human
ggaaugcuuggcaugagaaccu

SEQ ID NO: 159927 - RNA, 21 nt, Human
ggacucguucgccgugccagc

SEQ ID NO: 159928 - RNA, 22 nt, Human
ggacggggagcuggaaagggga

SEQ ID NO: 159929 - RNA, 22 nt, Human
ggaauauaaaucagaugcuccg

SEQ ID NO: 159930 - RNA, 22 nt, Human
ggaagccugggcgcaggcaggg

SEQ ID NO: 159931 - RNA, 22 nt, Human
ggaaaggggaaaauacagagag

SEQ ID NO: 159932 - RNA, 22 nt, Human
ggaaaggaagggaaggagaugc

SEQ ID NO: 159933 - RNA, 22 nt, Human
ggaaaaauggguggugauauga

SEQ ID NO: 159934 - RNA, 22 nt, Human
ggaacaguacucggaggccaga

SEQ ID NO: 159935 - RNA, 22 nt, Human
gggcaggcuggguggugguccc

SEQ ID NO: 159936 - RNA, 22 nt, Human
gggcaggacccguuagaguggc

SEQ ID NO: 159937 - RNA, 22 nt, Human
gcuuuccuggcccugucccugc

SEQ ID NO: 159938 - RNA, 22 nt, Human
gcuuucccaaccuucuugguau

SEQ ID NO: 159939 - RNA, 22 nt, Human
gggagauuuguguaggaaaacu

SEQ ID NO: 159940 - RNA, 22 nt, Human
gcuuuugaauacuacaggaguu

SEQ ID NO: 159941 - RNA, 21 nt, Human
gggagaguagcgguagggagg

SEQ ID NO: 159942 - RNA, 22 nt, Human
gggagaguagcuggaagguucu

SEQ ID NO: 159943 - RNA, 22 nt, Human
ggguucugggaggacuagggga

SEQ ID NO: 159944 - RNA, 22 nt, Human
ggguuacgaugauuucaugugu

SEQ ID NO: 159945 - RNA, 22 nt, Human
ggagguggagcuggaaguucca

SEQ ID NO: 159946 - RNA, 22 nt, Human
ggagggcuggacguacuagggc

SEQ ID NO: 159947 - RNA, 22 nt, Human
gggcuuuuccauuccaggguuc

SEQ ID NO: 159948 - RNA, 20 nt, Human
gggcuuugagcucagggcuu

SEQ ID NO: 159949 - RNA, 22 nt, Human
gggcuuuuccaacacucuggag

SEQ ID NO: 159950 - RNA, 18 nt, Human
gggcuuugggguucuauc

SEQ ID NO: 159951 - RNA, 22 nt, Human
ggagaugacaucccagcccggc

SEQ ID NO: 159952 - RNA, 22 nt, Human
gggggaggcucggcgccgcggu

SEQ ID NO: 159953 - RNA, 22 nt, Human
ggacucuaccuggagcagccuc

SEQ ID NO: 159954 - RNA, 22 nt, Human
ggaggaugaggguggugguguu

SEQ ID NO: 159955 - RNA, 22 nt, Human
ggagccuggaguuucugauggg

SEQ ID NO: 159956 - RNA, 22 nt, Human
ggaggaaauccuuaguaaggca

SEQ ID NO: 159957 - RNA, 20 nt, Human
ggagcgggcauuuguguucc

SEQ ID NO: 159958 - RNA, 22 nt, Human
ggaugcugcuccacaucccaca

SEQ ID NO: 159959 - RNA, 22 nt, Human
ggauggaugugaucugccuccu

SEQ ID NO: 159960 - RNA, 22 nt, Human
ggaugggcuuggggaggucuag

SEQ ID NO: 159961 - RNA, 22 nt, Human
ggucaucacugagagcagaucc

SEQ ID NO: 159962 - RNA, 22 nt, Human
ggcagaggagcuggaaacaugg

SEQ ID NO: 159963 - RNA, 20 nt, Human
ggcagcaaccauaugcuaca

SEQ ID NO: 159964 - RNA, 22 nt, Human
ggcagauaaacaauguuguaua

SEQ ID NO: 159965 - RNA, 22 nt, Human
ggcagaaaacaauaaccauuuc

SEQ ID NO: 159966 - RNA, 22 nt, Human
ggcaauauuauaagggcauuua

SEQ ID NO: 159967 - RNA, 22 nt, Human
ggcacagcgacuaccaucgaaa

SEQ ID NO: 159968 - RNA, 22 nt, Human
ggugugaauagagccuggagca

SEQ ID NO: 159969 - RNA, 22 nt, Human
gguguuaaccagcuaaaguuug

SEQ ID NO: 159970 - RNA, 22 nt, Human
ggcauugauggggucuugggga

SEQ ID NO: 159971 - RNA, 22 nt, Human
gguugcggaccagcugggcugc

SEQ ID NO: 159972 - RNA, 22 nt, Human
gguggcagaggaggcgggagag

SEQ ID NO: 159973 - RNA, 22 nt, Human
ggcauuccucucuguucaugga

SEQ ID NO: 159974 - RNA, 22 nt, Human
gaugucccuggaggggacagga

SEQ ID NO: 159975 - RNA, 22 nt, Human
gaugucuauguccagggccauc

SEQ ID NO: 159976 - RNA, 22 nt, Human
gaugguggaggaaucgcugaag

SEQ ID NO: 159977 - RNA, 22 nt, Human
gccccgcgcgcguagcgccgcu

SEQ ID NO: 159978 - RNA, 22 nt, Human
gcccugccauugaucggcccag

SEQ ID NO: 159979 - RNA, 22 nt, Human
gcccuguuauagucugaggccu

SEQ ID NO: 159980 - RNA, 22 nt, Human
gcccuguguguuugcacugauu

SEQ ID NO: 159981 - RNA, 22 nt, Human
gcccugucagcucucauggaca

SEQ ID NO: 159982 - RNA, 22 nt, Human
gccaguuuguuuacugaugguu

SEQ ID NO: 159983 - RNA, 22 nt, Human
gccaucugcuuagauugcuggg

SEQ ID NO: 159984 - RNA, 22 nt, Human
gccaggcagcagcgaggauggu

SEQ ID NO: 159985 - RNA, 22 nt, Human
gcaugcaggaagggcuugggga

SEQ ID NO: 159986 - RNA, 22 nt, Human
gaguauuagaagaguaguuauu

SEQ ID NO: 159987 - RNA, 22 nt, Human
gcagugccauguggaggaucuc

SEQ ID NO: 159988 - RNA, 22 nt, Human
gcauccaaggagcagaagugau

SEQ ID NO: 159989 - RNA, 22 nt, Human
gaguuaaauagcuuaggauuca

SEQ ID NO: 159990 - RNA, 22 nt, Human
gcauaauauugagaaauuauua

SEQ ID NO: 159991 - RNA, 22 nt, Human
gcagucauggguagaacucaag

SEQ ID NO: 159992 - RNA, 22 nt, Human
gcaguauuguguguggucaugg

SEQ ID NO: 159993 - RNA, 22 nt, Human
gcagguggaagcagcagacuca

SEQ ID NO: 159994 - RNA, 22 nt, Human
gaguaaaagaugaggcaguaga

SEQ ID NO: 159995 - RNA, 22 nt, Human
gaguacagaagauaaaggcaca

SEQ ID NO: 159996 - RNA, 18 nt, Human
gaugaagaggaagaggag

SEQ ID NO: 159997 - RNA, 22 nt, Human
gaugaagaaacucaaccaagaa

SEQ ID NO: 159998 - RNA, 22 nt, Human
gcaggccuccccugcuggagcu

SEQ ID NO: 159999 - RNA, 22 nt, Human
gauuccugcuauucacagggcu

SEQ ID NO: 160000 - RNA, 22 nt, Human
gauucagagcugcaacaaagaa

SEQ ID NO: 160001 - RNA, 22 nt, Human
gauuaaaggucuugauuauaag

SEQ ID NO: 160002 - RNA, 22 nt, Human
gauuaagaaagauagaugugga

SEQ ID NO: 160003 - RNA, 22 nt, Human
gauuaagauuacauauuuaagu

SEQ ID NO: 160004 - RNA, 22 nt, Human
gauuuugaaccuuauuuggaaa

SEQ ID NO: 160005 - RNA, 22 nt, Human
gcaaggaagcagaguugcuauc

SEQ ID NO: 160006 - RNA, 22 nt, Human
gauuuuuaaaaguaguuuugaa

SEQ ID NO: 160007 - RNA, 22 nt, Human
gccugcacucaaacacucucuu

SEQ ID NO: 160008 - RNA, 22 nt, Human
gcacaaaagguacuucauguag

SEQ ID NO: 160009 - RNA, 22 nt, Human
gccugcagccagggaguucucu

SEQ ID NO: 160010 - RNA, 22 nt, Human
gcgccgacccucccugccggac

SEQ ID NO: 160011 - RNA, 20 nt, Human
gcgcaguuccgggcgcgucu

SEQ ID NO: 160012 - RNA, 22 nt, Human
gcgcgccugccucccgcggugc

SEQ ID NO: 160013 - RNA, 22 nt, Human
gcgccuugccuguccucuaacc

SEQ ID NO: 160014 - RNA, 21 nt, Human
gcagaaagugauuugcuauuc

SEQ ID NO: 160015 - RNA, 22 nt, Human
gcagagaaugucagauuuuguu

SEQ ID NO: 160016 - RNA, 22 nt, Human
gcgcgggugagucacgggcgga

SEQ ID NO: 160017 - RNA, 22 nt, Human
gcgcggcgcggguccucggccu

SEQ ID NO: 160018 - RNA, 22 nt, Human
gcaggcaggauucagagauaca

SEQ ID NO: 160019 - RNA, 23 nt, Human
gcgggcggagccgggaggcgggg

SEQ ID NO: 160020 - RNA, 22 nt, Human
gcgguuggacguucgccucggg

SEQ ID NO: 160021 - RNA, 22 nt, Human
gcaggccgauuuguuagaaguc

SEQ ID NO: 160022 - RNA, 22 nt, Human
gcaguaaauugagagucauguu

SEQ ID NO: 160023 - RNA, 22 nt, Human
gcaguccuugcuguguaauaaa

SEQ ID NO: 160024 - RNA, 23 nt, Human
gcagugacugggauggaaguaga

SEQ ID NO: 160025 - RNA, 18 nt, Human
gcugaaauucuaaacaaa

SEQ ID NO: 160026 - RNA, 22 nt, Human
gcucuagcuggcgcugaccugg

SEQ ID NO: 160027 - RNA, 22 nt, Human
gcucggcuggcucaucucaugu

SEQ ID NO: 160028 - RNA, 22 nt, Human
gcaugcuguuuggaaacgauaa

SEQ ID NO: 160029 - RNA, 22 nt, Human
gcuccagcuccauaaacauaag

SEQ ID NO: 160030 - RNA, 22 nt, Human
gcauauuuuaaaguguaaccug

SEQ ID NO: 160031 - RNA, 22 nt, Human
gcuagaaacuguuuaaucucuu

SEQ ID NO: 160032 - RNA, 22 nt, Human
gcuuggagaacguuuucuagaa

SEQ ID NO: 160033 - RNA, 22 nt, Human
gcuuguuuagcauaggucacug

SEQ ID NO: 160034 - RNA, 22 nt, Human
gcuuucagggucacugucaaca

SEQ ID NO: 160035 - RNA, 20 nt, Human
gcuugcggacagguggcuca

SEQ ID NO: 160036 - RNA, 22 nt, Human
gcuuuggcuucuccuggcagga

SEQ ID NO: 160037 - RNA, 22 nt, Human
gcuuuguugauggugagucugu

SEQ ID NO: 160038 - RNA, 22 nt, Human
gcuuuucucccugcuuucuucc

SEQ ID NO: 160039 - RNA, 23 nt, Human
gcuuugaaaaugcuuucuuccag

SEQ ID NO: 160040 - RNA, 22 nt, Human
gcuuuugagaaaguguuuuccc

SEQ ID NO: 160041 - RNA, 22 nt, Human
gcuuuugcaaagcuggagaauu

SEQ ID NO: 160042 - RNA, 22 nt, Human
gccucaaaaguguuguagaggg

SEQ ID NO: 160043 - RNA, 22 nt, Human
gccggcugggggcggagggcag

SEQ ID NO: 160044 - RNA, 22 nt, Human
gccggcccugcgcggggcggaa

SEQ ID NO: 160045 - RNA, 22 nt, Human
gccgcguggcagucuuggugac

SEQ ID NO: 160046 - RNA, 17 nt, Human
ggaagaaaaggaucauc

SEQ ID NO: 160047 - RNA, 18 nt, Human
gccugccagccgagggac

SEQ ID NO: 160048 - RNA, 22 nt, Human
gccugagucaagauguggcacc

SEQ ID NO: 160049 - RNA, 22 nt, Human
gccugaaaugaaccagaggacu

SEQ ID NO: 160050 - RNA, 22 nt, Human
ggaaauauaagcaguuugugug

SEQ ID NO: 160051 - RNA, 22 nt, Human
gcuucccacagcuggacugggg

SEQ ID NO: 160052 - RNA, 22 nt, Human
gcuuccgacagagaucacauug

SEQ ID NO: 160053 - RNA, 22 nt, Human
gcuuccuuagcuuaccaaguau

SEQ ID NO: 160054 - RNA, 22 nt, Human
gccgccgcucaccugggcgccg

SEQ ID NO: 160055 - RNA, 22 nt, Human
gcuguggagaagcugccuaugg

SEQ ID NO: 160056 - RNA, 22 nt, Human
gcuguguucauccugcccaggu

SEQ ID NO: 160057 - RNA, 22 nt, Human
gcuguugugaggaucagcauau

SEQ ID NO: 160058 - RNA, 22 nt, Human
gcuguuggaggaguucagugcu

SEQ ID NO: 160059 - RNA, 22 nt, Human
gcugguuucucucauugucagu

SEQ ID NO: 160060 - RNA, 22 nt, Human
gcuggugugagauucucgaggg

SEQ ID NO: 160061 - RNA, 22 nt, Human
gcugguggcagagcuccgcggc

SEQ ID NO: 160062 - RNA, 22 nt, Human
gcccucugccacaggacgccag

SEQ ID NO: 160063 - RNA, 22 nt, Human
gcccugaagagguagagaauuu

SEQ ID NO: 160064 - RNA, 22 nt, Human
gcauugcuauuucuguuagugu

SEQ ID NO: 160065 - RNA, 22 nt, Human
gcauuuaaauuugaacuucaga

SEQ ID NO: 160066 - RNA, 22 nt, Human
gcccgccaacuugccagcggug

SEQ ID NO: 160067 - RNA, 22 nt, Human
gcaugguuuccugcaacguucu

SEQ ID NO: 160068 - RNA, 22 nt, Human
gcauuccagaguugcuggaaaa

SEQ ID NO: 160069 - RNA, 22 nt, Human
gcucugaacugucaugaauugg

SEQ ID NO: 160070 - RNA, 23 nt, Human
gcucugauaccagcuacaucuag

SEQ ID NO: 160071 - RNA, 22 nt, Human
gcugagcaaugcacugccgcau

SEQ ID NO: 160072 - RNA, 22 nt, Human
gcugagcagaacaauuagaaau

SEQ ID NO: 160073 - RNA, 22 nt, Human
ggcauggugggggaggacuugg

SEQ ID NO: 160074 - RNA, 22 nt, Human
ggcauuccgggguccccuucuc

SEQ ID NO: 160075 - RNA, 22 nt, Human
ggcaguguggauccuggagaag

SEQ ID NO: 160076 - RNA, 22 nt, Human
ggcaucuuuaaugaacaugaau

SEQ ID NO: 160077 - RNA, 22 nt, Human
gcuagauugucacuugaguguc

SEQ ID NO: 160078 - RNA, 22 nt, Human
ggcagguggcacugcugcuccc

SEQ ID NO: 160079 - RNA, 22 nt, Human
gcgguuguucugugugcaugga

SEQ ID NO: 160080 - RNA, 22 nt, Human
ggcagcccuggacccuggagaa

SEQ ID NO: 160081 - RNA, 22 nt, Human
ggcagcuuucaauaggguuaug

SEQ ID NO: 160082 - RNA, 22 nt, Human
ggcacuggguugcagagagaga

SEQ ID NO: 160083 - RNA, 22 nt, Human
ggcaauuacguauuagucaugu

SEQ ID NO: 160084 - RNA, 19 nt, Human
ggauaagguuggagugauc

SEQ ID NO: 160085 - RNA, 22 nt, Human
ggaguuucugucaucccguccc

SEQ ID NO: 160086 - RNA, 22 nt, Human
ggauaaaugaaggcauacagau

SEQ ID NO: 160087 - RNA, 20 nt, Human
gcgcuucccuacgcucugcu

SEQ ID NO: 160088 - RNA, 22 nt, Human
gcggacaauggaagaugucauu

SEQ ID NO: 160089 - RNA, 23 nt, Human
ggagaaggaugucaucaaaagac

SEQ ID NO: 160090 - RNA, 22 nt, Human
ggaggcggaaguccaagcaggu

SEQ ID NO: 160091 - RNA, 22 nt, Human
ggaauugagcaagggguggggc

SEQ ID NO: 160092 - RNA, 22 nt, Human
ggacauggaaagugugugauuu

SEQ ID NO: 160093 - RNA, 22 nt, Human
ggacauggccguaguccccacg

SEQ ID NO: 160094 - RNA, 18 nt, Human
ggagaagaacagaugugg

SEQ ID NO: 160095 - RNA, 22 nt, Human
gccuuuugcaaugguguuggug

SEQ ID NO: 160096 - RNA, 22 nt, Human
gccuuuuaaggcagagggagau

SEQ ID NO: 160097 - RNA, 22 nt, Human
ggaauuaagaggcuggacaggg

SEQ ID NO: 160098 - RNA, 22 nt, Human
gccugggccgggcgcggccccc

SEQ ID NO: 160099 - RNA, 22 nt, Human
ggaauuauuuuaaauagacauu

SEQ ID NO: 160100 - RNA, 22 nt, Human
ggaaucuucagccaugccaaga

SEQ ID NO: 160101 - RNA, 22 nt, Human
ggaagaagagggagcuguggga

SEQ ID NO: 160102 - RNA, 22 nt, Human
ggaagacuuagaguagcaucag

SEQ ID NO: 160103 - RNA, 22 nt, Human
ggcauuccgggguccccuucuc

SEQ ID NO: 160104 - RNA, 22 nt, Human
cagcagaggagguggcagcacc

SEQ ID NO: 160105 - RNA, 22 nt, Human
uuuaaaccuuggaagccacaua

SEQ ID NO: 160106 - RNA, 22 nt, Human
uguauauguguguagcauguua

SEQ ID NO: 160107 - RNA, 18 nt, Human
uugugccugagaaggugg

SEQ ID NO: 160108 - RNA, 22 nt, Human
auuucagaguagaucguuauuu

SEQ ID NO: 160109 - RNA, 22 nt, Human
uuuagcaaaaaagcucugcgua

SEQ ID NO: 160110 - RNA, 22 nt, Human
gagagagacugggaaaucauca

SEQ ID NO: 160111 - RNA, 22 nt, Human
uauauuaaagugcuuugcagug

SEQ ID NO: 160112 - RNA, 22 nt, Human
aauguuuaguuuuauuuuagua

SEQ ID NO: 160113 - RNA, 20 nt, Human
aggccgcccgcugccgcuuc

SEQ ID NO: 160114 - RNA, 22 nt, Human
ggcagcccuggacccuggagaa

SEQ ID NO: 160115 - RNA, 22 nt, Human
cagagagcguccauccggugcc

SEQ ID NO: 160116 - RNA, 22 nt, Human
acaguuagguccuaaaauucug

SEQ ID NO: 160117 - RNA, 20 nt, Human
cguguacauuuaugccccug

SEQ ID NO: 160118 - RNA, 22 nt, Human
aauguuuaacuguggucagcag

SEQ ID NO: 160119 - RNA, 19 nt, Human
ggcacccagagucccccug

SEQ ID NO: 160120 - RNA, 21 nt, Human
cagcccccauacccugcccag

SEQ ID NO: 160121 - RNA, 22 nt, Human
uccccugccccccauccucugg

SEQ ID NO: 160122 - RNA, 22 nt, Human
gagaaagggagaaaaagaucuu

SEQ ID NO: 160123 - RNA, 22 nt, Human
cagacagagucuucccaucagu

SEQ ID NO: 160124 - RNA, 22 nt, Human
agagcagcuuuucggaaccacu

SEQ ID NO: 160125 - RNA, 22 nt, Human
cccgcucaccccacuccaccag

SEQ ID NO: 160126 - RNA, 22 nt, Human
ccaccccagaaagggaaggcca

SEQ ID NO: 160127 - RNA, 22 nt, Human
ugagacagaccuuggaccaugu

SEQ ID NO: 160128 - RNA, 22 nt, Human
ugugccuagauuccaugcacuc

SEQ ID NO: 160129 - RNA, 22 nt, Human
uuuaaaccuaucuaagaaauag

SEQ ID NO: 160130 - RNA, 22 nt, Human
uucccugugcaguauguuccaa

SEQ ID NO: 160131 - RNA, 22 nt, Human
cacccccaggcuccccuucugg

SEQ ID NO: 160132 - RNA, 22 nt, Human
aggagcacugggcaugucaccc

SEQ ID NO: 160133 - RNA, 22 nt, Human
acccccacuccgcaguagaacu

SEQ ID NO: 160134 - RNA, 23 nt, Human
cagagaaaauagaauaugcugug

SEQ ID NO: 160135 - RNA, 22 nt, Human
cccuccagugucccagugggga

SEQ ID NO: 160136 - RNA, 22 nt, Human
cacauuguuuggucagagcaua

SEQ ID NO: 160137 - RNA, 22 nt, Human
cuguuguguuauuugcagugca

SEQ ID NO: 160138 - RNA, 22 nt, Human
cagccccaguuuucauaagacu

SEQ ID NO: 160139 - RNA, 22 nt, Human
ccaucccugagucacaggaggg

SEQ ID NO: 160140 - RNA, 22 nt, Human
cagacacgucccuguugaccug

SEQ ID NO: 160141 - RNA, 22 nt, Human
uaugugugugcguguguuuugc

SEQ ID NO: 160142 - RNA, 22 nt, Human
ugucagccacggugugaccggc

SEQ ID NO: 160143 - RNA, 22 nt, Human
ggagaaacuaguuagauccaau

SEQ ID NO: 160144 - RNA, 22 nt, Human
ggagagagggaucuuuguggag

SEQ ID NO: 160145 - RNA, 22 nt, Human
uccccaccuaagauacccaucu

SEQ ID NO: 160146 - RNA, 22 nt, Human
uugccucuaauuagcucuguga

SEQ ID NO: 160147 - RNA, 22 nt, Human
agcaaaauuccaaaaugcuaau

SEQ ID NO: 160148 - RNA, 22 nt, Human
aaaauauuuaucuagcucuuaa

SEQ ID NO: 160149 - RNA, 20 nt, Human
gcccacccgcacucccgccg

SEQ ID NO: 160150 - RNA, 22 nt, Human
ggagagcguggaugggcuucca

SEQ ID NO: 160151 - RNA, 22 nt, Human
aaaauaaccuucauuugcauug

SEQ ID NO: 160152 - RNA, 22 nt, Human
acucagaguuugcguuccauac

SEQ ID NO: 160153 - RNA, 22 nt, Human
cuucagagugacucagcaucuu

SEQ ID NO: 160154 - RNA, 22 nt, Human
aagagaaaaaucuuaaucuagu

SEQ ID NO: 160155 - RNA, 22 nt, Human
acuguugugaauaaugaaaugc

SEQ ID NO: 160156 - RNA, 22 nt, Human
aagaggcuacagcccugugucu

SEQ ID NO: 160157 - RNA, 22 nt, Human
ucaggagaguguucaguggagg

SEQ ID NO: 160158 - RNA, 22 nt, Human
aauauuuaaauagaauuacauc

SEQ ID NO: 160159 - RNA, 22 nt, Human
ggcucccccauggcugacagac

SEQ ID NO: 160160 - RNA, 18 nt, Human
cauuguacaaugcuuuau

SEQ ID NO: 160161 - RNA, 22 nt, Human
uagagagaaaccaggguuuggg

SEQ ID NO: 160162 - RNA, 22 nt, Human
acuuuaaaucuguugcuuagcu

SEQ ID NO: 160163 - RNA, 22 nt, Human
acacaggacacaaaagucacca

SEQ ID NO: 160164 - RNA, 22 nt, Human
gccugcaggaaggugugccugu

SEQ ID NO: 160165 - RNA, 22 nt, Human
ucacauugcauuuucucauuug

SEQ ID NO: 160166 - RNA, 22 nt, Human
agagggagagauuggcaaucag

SEQ ID NO: 160167 - RNA, 22 nt, Human
ucagcucucucuuggugaucuc

SEQ ID NO: 160168 - RNA, 22 nt, Human
uuuagcaaggagaaauaauccu

SEQ ID NO: 160169 - RNA, 22 nt, Human
uacauuguguuaaaacagaaga

SEQ ID NO: 160170 - RNA, 22 nt, Human
ugagagaggugaaaugacuuuc

SEQ ID NO: 160171 - RNA, 22 nt, Human
accucccugaaaaagacagugc

SEQ ID NO: 160172 - RNA, 22 nt, Human
ucacuggauucauguuucuuua

SEQ ID NO: 160173 - RNA, 22 nt, Human
ccacucagaagaaacaagagag

SEQ ID NO: 160174 - RNA, 22 nt, Human
ugagugacuguugucaagaugg

SEQ ID NO: 160175 - RNA, 22 nt, Human
ucucuacugcuucugugaguga

SEQ ID NO: 160176 - RNA, 22 nt, Human
cuccccacucaacucccagacc

SEQ ID NO: 160177 - RNA, 22 nt, Human
ugucacagagcgugcaacagaa

SEQ ID NO: 160178 - RNA, 16 nt, Human
ccccucaggaaguaca

SEQ ID NO: 160179 - RNA, 18 nt, Human
gccagcccuccaaccucc

SEQ ID NO: 160180 - RNA, 22 nt, Human
agacagcggugcaauaaauggu

SEQ ID NO: 160181 - RNA, 22 nt, Human
ucuguuguauggcugucuaauu

SEQ ID NO: 160182 - RNA, 22 nt, Human
gaaaugaaacacacaugcagcu

SEQ ID NO: 160183 - RNA, 22 nt, Human
ccagaggcuuaugcagcugcug

SEQ ID NO: 160184 - RNA, 22 nt, Human
cgaccccugaaaauggcagcca

SEQ ID NO: 160185 - RNA, 23 nt, Human
cacaggcagaaaucaagacggua

SEQ ID NO: 160186 - RNA, 22 nt, Human
ccucccaccguaucucaguggc

SEQ ID NO: 160187 - RNA, 22 nt, Human
ccccucuguagcccgagcugcu

SEQ ID NO: 160188 - RNA, 22 nt, Human
accaccacugacaccagcucgg

SEQ ID NO: 160189 - RNA, 22 nt, Human
guucccuugccuuuaguuugau

SEQ ID NO: 160190 - RNA, 22 nt, Human
ucagagagagagaggcggaaga

SEQ ID NO: 160191 - RNA, 20 nt, Human
agagaacaguuuggucacag

SEQ ID NO: 160192 - RNA, 22 nt, Human
ugcccagagccucuuaccucca

SEQ ID NO: 160193 - RNA, 21 nt, Human
ucuguuguguguugaggacuu

SEQ ID NO: 160194 - RNA, 22 nt, Human
ccaccacugaggcacaggagcc

SEQ ID NO: 160195 - RNA, 22 nt, Human
ugccagcuccgaggagcugcag

SEQ ID NO: 160196 - RNA, 22 nt, Human
uaaaugcucuuuaaaagugcuu

SEQ ID NO: 160197 - RNA, 22 nt, Human
aaauauuugaaugguguaagau

SEQ ID NO: 160198 - RNA, 22 nt, Human
aagcaaaagguuacacuucugg

SEQ ID NO: 160199 - RNA, 22 nt, Human
ccagccacagcuuccagcuccu

SEQ ID NO: 160200 - RNA, 22 nt, Human
aaugauuuucugcaaacaguga

SEQ ID NO: 160201 - RNA, 22 nt, Human
cccccucugcugaugcccccau

SEQ ID NO: 160202 - RNA, 22 nt, Human
uugugacaauacagcauggaga

SEQ ID NO: 160203 - RNA, 22 nt, Human
cucaugagucugucagagucau

SEQ ID NO: 160204 - RNA, 22 nt, Human
uaaaugauaguauugaagguag

SEQ ID NO: 160205 - RNA, 22 nt, Human
guucucuccugcuggugaugga

SEQ ID NO: 160206 - RNA, 22 nt, Human
uccucagagacaaguugagagg

SEQ ID NO: 160207 - RNA, 20 nt, Human
cagagacaagagggaaggga

SEQ ID NO: 160208 - RNA, 22 nt, Human
uuagagagguuggagugguaga

SEQ ID NO: 160209 - RNA, 22 nt, Human
aucccacaccccuacaacauau

SEQ ID NO: 160210 - RNA, 22 nt, Human
gagcgcgcaaucucuccagcug

SEQ ID NO: 160211 - RNA, 22 nt, Human
gcucagagaugucugcugccuu

SEQ ID NO: 160212 - RNA, 22 nt, Human
ggagacagauggcgucucaguu

SEQ ID NO: 160213 - RNA, 22 nt, Human
acugcuguugugauggguauuu

SEQ ID NO: 160214 - RNA, 22 nt, Human
ggagacagugacuuagagacug

SEQ ID NO: 160215 - RNA, 22 nt, Human
uagagaaauauuuguagugcug

SEQ ID NO: 160216 - RNA, 22 nt, Human
cccccauccccugaaggagcug

SEQ ID NO: 160217 - RNA, 22 nt, Human
aacauuguuuaaguuaaauugu

SEQ ID NO: 160218 - RNA, 19 nt, Human
gcacacccugcaccaccau

SEQ ID NO: 160219 - RNA, 22 nt, Human
agcuggaaucucggcaaagcgu

SEQ ID NO: 160220 - RNA, 22 nt, Human
cugagcugcucccgcugcagcg

SEQ ID NO: 160221 - RNA, 22 nt, Human
cucagcgagggaaagaggccgc

SEQ ID NO: 160222 - RNA, 22 nt, Human
cugugugcagggcacaauggaa

SEQ ID NO: 160223 - RNA, 22 nt, Human
caaaaauacuugccuguaucug

SEQ ID NO: 160224 - RNA, 22 nt, Human
uacaaaauucaaauaauguuug

SEQ ID NO: 160225 - RNA, 22 nt, Human
agaggcuuuccuaagauugguu

SEQ ID NO: 160226 - RNA, 22 nt, Human
agagacaggguuuugucguguu

SEQ ID NO: 160227 - RNA, 22 nt, Human
cuggccuuaucacaaagcuaga

SEQ ID NO: 160228 - RNA, 20 nt, Human
gcugugccaugacccucgag

SEQ ID NO: 160229 - RNA, 22 nt, Human
aagcaaaaucgcaucuggggcc

SEQ ID NO: 160230 - RNA, 22 nt, Human
aacauuguggacaagggcaggu

SEQ ID NO: 160231 - RNA, 22 nt, Human
ucagagacaucagguuguagca

SEQ ID NO: 160232 - RNA, 22 nt, Human
accucagauuguggcuccgcug

SEQ ID NO: 160233 - RNA, 22 nt, Human
accaguuaaagaauaugaggcc

SEQ ID NO: 160234 - RNA, 22 nt, Human
cugcggcaccaaccccuucaug

SEQ ID NO: 160235 - RNA, 22 nt, Human
ccacccacuucucugcccucca

SEQ ID NO: 160236 - RNA, 22 nt, Human
ccaccucuaccuggccggccuu

SEQ ID NO: 160237 - RNA, 23 nt, Human
ugcaaaauuugcagaguucgaug

SEQ ID NO: 160238 - RNA, 23 nt, Human
acagaggcaucagagcagcaggc

SEQ ID NO: 160239 - RNA, 22 nt, Human
auuuuuauuugccuaugauaua

SEQ ID NO: 160240 - RNA, 22 nt, Human
uuaucaaaaaauaguacuuuga

SEQ ID NO: 160241 - RNA, 22 nt, Human
gcucagagaaaacuggggcuug

SEQ ID NO: 160242 - RNA, 22 nt, Neisseria meningitidis Z2491
cucaaagaagacgagucggaaa

SEQ ID NO: 160243 - RNA, 23 nt, Neisseria meningitidis Z2491
caacgguguggcugccguugagc

SEQ ID NO: 160244 - RNA, 22 nt, Neisseria meningitidis Z2491
uugccgccaauguguuauggac

SEQ ID NO: 160245 - RNA, 22 nt, Neisseria meningitidis Z2491
uccgccaucaucgccgccugca

SEQ ID NO: 160246 - RNA, 22 nt, Neisseria meningitidis Z2491
uacugguuuuuguuaauccacu

SEQ ID NO: 160247 - RNA, 22 nt, Neisseria meningitidis Z2491
ugcgcguauugggcaaccuguu

SEQ ID NO: 160248 - RNA, 22 nt, Neisseria meningitidis Z2491
aaugccgucugaagcgguuucc

SEQ ID NO: 160249 - RNA, 22 nt, Neisseria meningitidis Z2491
uggcgcacggcuugggcgacga

SEQ ID NO: 160250 - RNA, 22 nt, Neisseria meningitidis Z2491
accgcuuuuuggacauucaaau

SEQ ID NO: 160251 - RNA, 22 nt, Neisseria meningitidis Z2491
agacggcauuuuuuaaugcuua

SEQ ID NO: 160252 - RNA, 22 nt, Neisseria meningitidis Z2491
agccaucguugcugccgaacag

SEQ ID NO: 160253 - RNA, 22 nt, Neisseria meningitidis Z2491
aaacuuggcuucuucuucgcga

SEQ ID NO: 160254 - RNA, 21 nt, Neisseria meningitidis Z2491
cggcaacagcauuuugggcgu

SEQ ID NO: 160255 - RNA, 22 nt, Neisseria meningitidis Z2491
ucgauuucguugccgcugucgg

SEQ ID NO: 160256 - RNA, 22 nt, Neisseria meningitidis Z2491
acgguuuccgucagauugagua

SEQ ID NO: 160257 - RNA, 22 nt, Neisseria meningitidis Z2491
augccgucugaaaugccugcga

SEQ ID NO: 160258 - RNA, 19 nt, Neisseria meningitidis Z2491
ggcauaacguucguugaaa

SEQ ID NO: 160259 - RNA, 22 nt, Neisseria meningitidis Z2491
augccgucugaacggcggcuuu

SEQ ID NO: 160260 - RNA, 22 nt, Neisseria meningitidis Z2491
ggaaaucuugcugcgguaacgc

SEQ ID NO: 160261 - RNA, 22 nt, Neisseria meningitidis Z2491
agcgcgauggguaucuuuauga

SEQ ID NO: 160262 - RNA, 22 nt, Neisseria meningitidis Z2491
ggcgaguuucacgcggcaaugu

SEQ ID NO: 160263 - RNA, 22 nt, Neisseria meningitidis Z2491
gauauugcgcgccugcauccgu

SEQ ID NO: 160264 - RNA, 22 nt, Neisseria meningitidis Z2491
aaagcccgcguuuuucgagaag

SEQ ID NO: 160265 - RNA, 22 nt, Neisseria meningitidis Z2491
ugucggcggaguagguuuccuc

SEQ ID NO: 160266 - RNA, 22 nt, Neisseria meningitidis Z2491
uggcaucgcccaagggggugga

SEQ ID NO: 160267 - RNA, 22 nt, Neisseria meningitidis Z2491
gucgggcagguucaaaaucaga

SEQ ID NO: 160268 - RNA, 22 nt, Neisseria meningitidis Z2491
gaaaucgaggguuucuucgaug

SEQ ID NO: 160269 - RNA, 22 nt, Neisseria meningitidis Z2491
cgcggcuuguuugacgggcggg

SEQ ID NO: 160270 - RNA, 22 nt, Neisseria meningitidis Z2491
caacgcuuggauuugccgugca

SEQ ID NO: 160271 - RNA, 22 nt, Neisseria meningitidis Z2491
ggucugaaacccuaacuaugca

SEQ ID NO: 160272 - RNA, 20 nt, Neisseria meningitidis Z2491
ccgucaguacggaaucgcgg

SEQ ID NO: 160273 - RNA, 22 nt, Neisseria meningitidis Z2491
auggcaggcagagcgcgccgca

SEQ ID NO: 160274 - RNA, 22 nt, Neisseria meningitidis Z2491
ggcggcaucaucaaacacgcca

SEQ ID NO: 160275 - RNA, 19 nt, Neisseria meningitidis Z2491
uuuaccgccgaacuguccg

SEQ ID NO: 160276 - RNA, 23 nt, Neisseria meningitidis Z2491
aaauccgccuuuucagacggcau

SEQ ID NO: 160277 - RNA, 22 nt, Neisseria meningitidis Z2491
auccaagagcuucaguuucccg

SEQ ID NO: 160278 - RNA, 22 nt, Neisseria meningitidis Z2491
auucccgccugcgcgggaauga

SEQ ID NO: 160279 - RNA, 22 nt, Neisseria meningitidis Z2491
gcgugcagcggcaggguuugac

SEQ ID NO: 160280 - RNA, 21 nt, Neisseria meningitidis Z2491
ugggaauccagaccuuugggc

SEQ ID NO: 160281 - RNA, 22 nt, Neisseria meningitidis Z2491
ccgucguuuccuuauccagcau

SEQ ID NO: 160282 - RNA, 22 nt, Neisseria meningitidis Z2491
uauuggcggcggaagaacgggu

SEQ ID NO: 160283 - RNA, 22 nt, Neisseria meningitidis Z2491
uuuaggaauuuaucgggagcaa

SEQ ID NO: 160284 - RNA, 22 nt, Neisseria meningitidis Z2491
cacggauaaggaugucguauug

SEQ ID NO: 160285 - RNA, 22 nt, Neisseria meningitidis Z2491
aaugcucgauaccgauacgcgg

SEQ ID NO: 160286 - RNA, 22 nt, Neisseria meningitidis Z2491
aucuagaaucucggacuuucag

SEQ ID NO: 160287 - RNA, 22 nt, Neisseria meningitidis Z2491
ugacaccaagacccaagcugcu

SEQ ID NO: 160288 - RNA, 22 nt, Neisseria meningitidis Z2491
aagauugauucuucagacggca

SEQ ID NO: 160289 - RNA, 22 nt, Neisseria meningitidis Z2491
cagaugaggguuuugcagccga

SEQ ID NO: 160290 - RNA, 22 nt, Neisseria meningitidis Z2491
uugugcauuuucuuuucaaacg

SEQ ID NO: 160291 - RNA, 22 nt, Neisseria meningitidis Z2491
ggcgauaugcccaagaccauca

SEQ ID NO: 160292 - RNA, 22 nt, Neisseria meningitidis Z2491
caguucgcucaaaucgacgccg

SEQ ID NO: 160293 - RNA, 22 nt, Neisseria meningitidis Z2491
uugccgucuugauaaguuuccc

SEQ ID NO: 160294 - RNA, 22 nt, Neisseria meningitidis Z2491
ccggcauuuaugcguacacaau

SEQ ID NO: 160295 - RNA, 22 nt, Neisseria meningitidis Z2491
augaaauccgccaugcucgccg

SEQ ID NO: 160296 - RNA, 22 nt, Neisseria meningitidis Z2491
ugccgauuauuucuacgacuuc

SEQ ID NO: 160297 - RNA, 22 nt, Neisseria meningitidis Z2491
gcacuucuuuggcagcggcacu

SEQ ID NO: 160298 - RNA, 22 nt, Neisseria meningitidis Z2491
gcguucggaguuugccggauua

SEQ ID NO: 160299 - RNA, 22 nt, Neisseria meningitidis Z2491
ccgccguagcugauuuuuucgc

SEQ ID NO: 160300 - RNA, 22 nt, Neisseria meningitidis Z2491
cugcgcgauuuucggugccgua

SEQ ID NO: 160301 - RNA, 19 nt, Neisseria meningitidis Z2491
ugccugauaauguuuuggc

SEQ ID NO: 160302 - RNA, 22 nt, Neisseria meningitidis Z2491
uguuuccaaaucguucggcgac

SEQ ID NO: 160303 - RNA, 22 nt, Neisseria meningitidis Z2491
guuguaucggcguaccgcuucu

SEQ ID NO: 160304 - RNA, 22 nt, Neisseria meningitidis Z2491
agccgcacgguuuugguaaacc

SEQ ID NO: 160305 - RNA, 19 nt, Neisseria meningitidis Z2491
uggcaaugcuuugaccgug

SEQ ID NO: 160306 - RNA, 22 nt, Neisseria meningitidis Z2491
gcgcucaaacaaauggucgaag

SEQ ID NO: 160307 - RNA, 22 nt, Neisseria meningitidis Z2491
auuggauaaagaugcugccuau

SEQ ID NO: 160308 - RNA, 21 nt, Neisseria meningitidis Z2491
aucggguugaaauagcgcaac

SEQ ID NO: 160309 - RNA, 22 nt, Neisseria meningitidis Z2491
auguugaugcccaauacgccac

SEQ ID NO: 160310 - RNA, 22 nt, Neisseria meningitidis Z2491
ucuaaagcggcggaaaucgucg

SEQ ID NO: 160311 - RNA, 22 nt, Neisseria meningitidis Z2491
ccuugccguacugguuuuuguu

SEQ ID NO: 160312 - RNA, 22 nt, Neisseria meningitidis Z2491
uucgcguuggaacgguuggcgg

SEQ ID NO: 160313 - RNA, 22 nt, Neisseria meningitidis Z2491
ucgggaaaacgcugccgcaacu

SEQ ID NO: 160314 - RNA, 22 nt, Neisseria meningitidis Z2491
ucguugccugcgcggacuuguu

SEQ ID NO: 160315 - RNA, 22 nt, Neisseria meningitidis Z2491
uuggcggcugcugccggugagu

SEQ ID NO: 160316 - RNA, 22 nt, Neisseria meningitidis Z2491
aucgcgcccugcccuacgucua

SEQ ID NO: 160317 - RNA, 22 nt, Neisseria meningitidis Z2491
accaaguuggaaaucaguguuu

SEQ ID NO: 160318 - RNA, 22 nt, Neisseria meningitidis Z2491
aaugccgucuaaaauccucauc

SEQ ID NO: 160319 - RNA, 22 nt, Neisseria meningitidis Z2491
cagcggauuguaugugaacgag

SEQ ID NO: 160320 - RNA, 20 nt, Neisseria meningitidis Z2491
uugccgcuuucagacggcau

SEQ ID NO: 160321 - RNA, 22 nt, Neisseria meningitidis Z2491
uuuggcaaacgguaaaaaugga

SEQ ID NO: 160322 - RNA, 22 nt, Neisseria meningitidis Z2491
aacuuugcguuucuagauuccc

SEQ ID NO: 160323 - RNA, 22 nt, Neisseria meningitidis Z2491
ugaaagucaaaugccgucugaa

SEQ ID NO: 160324 - RNA, 22 nt, Neisseria meningitidis Z2491
ugauuucgaugucguagccuuc

SEQ ID NO: 160325 - RNA, 22 nt, Neisseria meningitidis Z2491
gucauucccgcgcaggcgggaa

SEQ ID NO: 160326 - RNA, 22 nt, Neisseria meningitidis Z2491
uuugccuguccgcgcaccgugc

SEQ ID NO: 160327 - RNA, 22 nt, Neisseria meningitidis Z2491
ugaacggcaucgaaccuuuggc

SEQ ID NO: 160328 - RNA, 22 nt, Neisseria meningitidis Z2491
uaacgguaucgaagaagaccuu

SEQ ID NO: 160329 - RNA, 22 nt, Neisseria meningitidis Z2491
augcgguagccgugcugacgau

SEQ ID NO: 160330 - RNA, 22 nt, Neisseria meningitidis Z2491
gugaugcagugcuucgcguggg

SEQ ID NO: 160331 - RNA, 22 nt, Neisseria meningitidis Z2491
ugccgguuugagcgacaccgcc

SEQ ID NO: 160332 - RNA, 22 nt, Neisseria meningitidis Z2491
cgccgcauuugucauuacccgu

SEQ ID NO: 160333 - RNA, 22 nt, Neisseria meningitidis Z2491
acaaugauuuucggccacagca

SEQ ID NO: 160334 - RNA, 22 nt, Neisseria meningitidis Z2491
aauggcgugguguucaucgacg

SEQ ID NO: 160335 - RNA, 20 nt, Neisseria meningitidis Z2491
ugcagcacauaggcggcguu

SEQ ID NO: 160336 - RNA, 22 nt, Neisseria meningitidis Z2491
acuugguuuuauacagcccgau

SEQ ID NO: 160337 - RNA, 21 nt, Neisseria meningitidis Z2491
cgaaagauuuugaccugugca

SEQ ID NO: 160338 - RNA, 22 nt, Neisseria meningitidis Z2491
ucagccugaaagagauguuugc

SEQ ID NO: 160339 - RNA, 22 nt, Neisseria meningitidis Z2491
ccgaagaagauaauaucgccgu

SEQ ID NO: 160340 - RNA, 22 nt, Neisseria meningitidis Z2491
uacugguuaaauuuaauccacu

SEQ ID NO: 160341 - RNA, 22 nt, Neisseria meningitidis Z2491
ucggcggugcggucgaugaguu

SEQ ID NO: 160342 - RNA, 22 nt, Neisseria meningitidis Z2491
gcgaauucaaaaccaagcugac

SEQ ID NO: 160343 - RNA, 23 nt, Neisseria meningitidis Z2491
ucggauuuaagaauccgcccuac

SEQ ID NO: 160344 - RNA, 22 nt, Neisseria meningitidis Z2491
gcauuugaaguaaaggcugcaa

SEQ ID NO: 160345 - RNA, 20 nt, Neisseria meningitidis Z2491
augccgucugaagaaucaau

SEQ ID NO: 160346 - RNA, 22 nt, Neisseria meningitidis Z2491
gcgcaaggcgguuuuuuccaac

SEQ ID NO: 160347 - RNA, 22 nt, Neisseria meningitidis Z2491
ggcgaagcgcaaccaagcuuug

SEQ ID NO: 160348 - RNA, 21 nt, Neisseria meningitidis Z2491
uugucguaaguguugaccagc

SEQ ID NO: 160349 - RNA, 22 nt, Neisseria meningitidis Z2491
acggcauuuuguauccaaacgg

SEQ ID NO: 160350 - RNA, 22 nt, Neisseria meningitidis Z2491
augccguccgaagcgguuuccc

SEQ ID NO: 160351 - RNA, 22 nt, Neisseria meningitidis Z2491
aucgguuuggcgugggcaucgc

SEQ ID NO: 160352 - RNA, 22 nt, Neisseria meningitidis Z2491
guuugaaagacagacaagauaa

SEQ ID NO: 160353 - RNA, 20 nt, Neisseria meningitidis Z2491
ccugacgaacuugccuucca

SEQ ID NO: 160354 - RNA, 22 nt, Neisseria meningitidis Z2491
gacguugccaugaaugucgccg

SEQ ID NO: 160355 - RNA, 22 nt, Neisseria meningitidis Z2491
aucgggaagagcagcucggcgg

SEQ ID NO: 160356 - RNA, 22 nt, Neisseria meningitidis Z2491
gcgggauauuuuugacggacgg

SEQ ID NO: 160357 - RNA, 22 nt, Neisseria meningitidis Z2491
cgggaaugacgaauuuuagguu

SEQ ID NO: 160358 - RNA, 22 nt, Neisseria meningitidis Z2491
gaucccgaaacgcaauuggucg

SEQ ID NO: 160359 - RNA, 22 nt, Neisseria meningitidis Z2491
auccgcacgaagccgccgucga

SEQ ID NO: 160360 - RNA, 22 nt, Neisseria meningitidis Z2491
aaagccguagguuacuuugacu

SEQ ID NO: 160361 - RNA, 22 nt, Neisseria meningitidis Z2491
aggcgguugucggcgugaugac

SEQ ID NO: 160362 - RNA, 22 nt, Neisseria meningitidis Z2491
auuuggaaauuuccugucagau

SEQ ID NO: 160363 - RNA, 22 nt, Neisseria meningitidis Z2491
gaacgcauccggcuuauucaua

SEQ ID NO: 160364 - RNA, 22 nt, Neisseria meningitidis Z2491
ugccgucugaaacuggcccugc

SEQ ID NO: 160365 - RNA, 22 nt, Neisseria meningitidis Z2491
aaucaggcucaaaugugccgca

SEQ ID NO: 160366 - RNA, 22 nt, Neisseria meningitidis Z2491
gcaagcugucccgcaagcuggu

SEQ ID NO: 160367 - RNA, 22 nt, Neisseria meningitidis Z2491
uacgguaucgacuaagauuuug

SEQ ID NO: 160368 - RNA, 22 nt, Neisseria meningitidis Z2491
uacggcuucggcgaauccgucg

SEQ ID NO: 160369 - RNA, 22 nt, Neisseria meningitidis Z2491
ccgcacuuuguuauagaauggc

SEQ ID NO: 160370 - RNA, 21 nt, Neisseria meningitidis Z2491
ugccggacguucagacggcau

SEQ ID NO: 160371 - RNA, 22 nt, Neisseria meningitidis Z2491
guggauuaaauuuaaaccagua

SEQ ID NO: 160372 - RNA, 22 nt, Neisseria meningitidis Z2491
aaugccguccugguugagaucc

SEQ ID NO: 160373 - RNA, 22 nt, Neisseria meningitidis Z2491
aggguucggacggcauuuuuga

SEQ ID NO: 160374 - RNA, 22 nt, Neisseria meningitidis Z2491
acuguuguugggcagugccgcc

SEQ ID NO: 160375 - RNA, 22 nt, Neisseria meningitidis Z2491
cgguacgaaaauaccgucugaa

SEQ ID NO: 160376 - RNA, 23 nt, Neisseria meningitidis Z2491
gcggacuugcucaaaaucggaug

SEQ ID NO: 160377 - RNA, 22 nt, Neisseria meningitidis Z2491
aaaucugcaauaaaucccaguu

SEQ ID NO: 160378 - RNA, 22 nt, Neisseria meningitidis Z2491
cggcaaagcgguuuggacaucu

SEQ ID NO: 160379 - RNA, 22 nt, Neisseria meningitidis Z2491
aggcuuucagacggccuuugga

SEQ ID NO: 160380 - RNA, 22 nt, Neisseria meningitidis Z2491
gugccgaauacgucgacgguua

SEQ ID NO: 160381 - RNA, 22 nt, Neisseria meningitidis Z2491
auuugucguaacggccgccgag

SEQ ID NO: 160382 - RNA, 22 nt, Neisseria meningitidis Z2491
ucaguugcguguagcucauggc

SEQ ID NO: 160383 - RNA, 22 nt, Neisseria meningitidis Z2491
guugaugccuucaaaguuuugg

SEQ ID NO: 160384 - RNA, 22 nt, Neisseria meningitidis Z2491
ugaauacgacgcagauuuauac

SEQ ID NO: 160385 - RNA, 22 nt, Neisseria meningitidis Z2491
ucugucgucgugguuuuacccg

SEQ ID NO: 160386 - RNA, 22 nt, Neisseria meningitidis Z2491
augcuuucucuauuuuuaggcc

SEQ ID NO: 160387 - RNA, 22 nt, Neisseria meningitidis Z2491
aggcgugcccagaaucgucggg

SEQ ID NO: 160388 - RNA, 22 nt, Neisseria meningitidis Z2491
gacggcauacgaaacggguucu

SEQ ID NO: 160389 - RNA, 22 nt, Neisseria meningitidis Z2491
augccgccgaguacgaauuuuu

SEQ ID NO: 160390 - RNA, 22 nt, Neisseria meningitidis Z2491
uggcggcaucgauuuucaggcg

SEQ ID NO: 160391 - RNA, 22 nt, Neisseria meningitidis Z2491
gggaauccagguucguugaguu

SEQ ID NO: 160392 - RNA, 22 nt, Neisseria meningitidis Z2491
acccgugauuuucggcacuuuu

SEQ ID NO: 160393 - RNA, 22 nt, Neisseria meningitidis Z2491
agccgaauggacaaaugccguc

SEQ ID NO: 160394 - RNA, 22 nt, Neisseria meningitidis Z2491
ccgugaagaaguguugcgcagc

SEQ ID NO: 160395 - RNA, 22 nt, Neisseria meningitidis Z2491
uuauccgcgcaaaacagccguu

SEQ ID NO: 160396 - RNA, 22 nt, Neisseria meningitidis Z2491
gucugcaauaguguucaugagu

SEQ ID NO: 160397 - RNA, 20 nt, Neisseria meningitidis Z2491
ugccgcuguugaggauuugu

SEQ ID NO: 160398 - RNA, 22 nt, Neisseria meningitidis Z2491
uucgacaaaggucgucugaaaa

SEQ ID NO: 160399 - RNA, 22 nt, Neisseria meningitidis Z2491
auugaaugaguaaaggccaucu

SEQ ID NO: 160400 - RNA, 21 nt, Neisseria meningitidis Z2491
ucgucugaacguuucacguga

SEQ ID NO: 160401 - RNA, 22 nt, Neisseria meningitidis Z2491
gcggauaaccuugucgauaaac

SEQ ID NO: 160402 - RNA, 22 nt, Neisseria meningitidis Z2491
ugggcauaaggcaaugccgucu

SEQ ID NO: 160403 - RNA, 22 nt, Neisseria meningitidis Z2491
ugaaacucuaaucgcgucauuc

SEQ ID NO: 160404 - RNA, 22 nt, Neisseria meningitidis Z2491
cggcaaucaggcugucggugcg

SEQ ID NO: 160405 - RNA, 23 nt, Neisseria meningitidis Z2491
uuggucgacuucuucacgagucc

SEQ ID NO: 160406 - RNA, 22 nt, Neisseria meningitidis Z2491
caaugccgucugaaaccccaaa

SEQ ID NO: 160407 - RNA, 22 nt, Neisseria meningitidis Z2491
ccgcaaagucuguuucagauga

SEQ ID NO: 160408 - RNA, 22 nt, Neisseria meningitidis Z2491
gacggcauugccguuugcaugc

SEQ ID NO: 160409 - RNA, 22 nt, Neisseria meningitidis Z2491
uaugccgucugaaaaggcggau

SEQ ID NO: 160410 - RNA, 21 nt, Neisseria meningitidis Z2491
ucagacggcauuuuuaugccc

SEQ ID NO: 160411 - RNA, 22 nt, Neisseria meningitidis Z2491
aggccuuugggcgacggcaaua

SEQ ID NO: 160412 - RNA, 22 nt, Neisseria meningitidis Z2491
uagcugccguuuuucgcccacu

SEQ ID NO: 160413 - RNA, 22 nt, Neisseria meningitidis Z2491
ggcuuucguaugaaagcggauc

SEQ ID NO: 160414 - RNA, 22 nt, Neisseria meningitidis Z2491
gccgcgaugguagaggguuuug

SEQ ID NO: 160415 - RNA, 22 nt, Neisseria meningitidis Z2491
auccgccgucagcgacaauuuu

SEQ ID NO: 160416 - RNA, 22 nt, Neisseria meningitidis Z2491
auuccaagauaugaaggcgcac

SEQ ID NO: 160417 - RNA, 22 nt, Neisseria meningitidis Z2491
acaucguugccgcacaagccaa

SEQ ID NO: 160418 - RNA, 22 nt, Neisseria meningitidis Z2491
ugggcagcauuucuuucgggcu

SEQ ID NO: 160419 - RNA, 22 nt, Neisseria meningitidis Z2491
augacggcuucggcaggauugu

SEQ ID NO: 160420 - RNA, 22 nt, Neisseria meningitidis Z2491
ucagacggcauuuuuguauuua

SEQ ID NO: 160421 - RNA, 21 nt, Neisseria meningitidis Z2491
ccaguuugaccuugugcgcuu

SEQ ID NO: 160422 - RNA, 22 nt, Neisseria meningitidis Z2491
ggcggcaaguacggcaucggcu

SEQ ID NO: 160423 - RNA, 22 nt, Neisseria meningitidis Z2491
ucagacggcauuucgcguuuuc

SEQ ID NO: 160424 - RNA, 22 nt, Neisseria meningitidis Z2491
uguacggcgugucgcggcgcag

SEQ ID NO: 160425 - RNA, 22 nt, Neisseria meningitidis Z2491
cgauguguugcgguuuugggac

SEQ ID NO: 160426 - RNA, 22 nt, Neisseria meningitidis Z2491
aagcgcaaaagcggauuggacg

SEQ ID NO: 160427 - RNA, 22 nt, Neisseria meningitidis Z2491
uggcgcaacguguuuugaaaac

SEQ ID NO: 160428 - RNA, 20 nt, Neisseria meningitidis Z2491
acaucacgcccaagcugacu

SEQ ID NO: 160429 - RNA, 22 nt, Neisseria meningitidis Z2491
ggccgucugaaggggucgggcg

SEQ ID NO: 160430 - RNA, 20 nt, Neisseria meningitidis Z2491
aucguuaagcggcuuaagcc

SEQ ID NO: 160431 - RNA, 22 nt, Neisseria meningitidis Z2491
auggaugguuacaaaggcggua

SEQ ID NO: 160432 - RNA, 22 nt, Neisseria meningitidis Z2491
cggcguguugguugaugccgug

SEQ ID NO: 160433 - RNA, 22 nt, Neisseria meningitidis Z2491
uuugcggaacgcugcgaccagc

SEQ ID NO: 160434 - RNA, 22 nt, Neisseria meningitidis Z2491
ucgucgaaaacaacguccaaau

SEQ ID NO: 160435 - RNA, 22 nt, Neisseria meningitidis Z2491
cgcggauaaagccguugugcaa

SEQ ID NO: 160436 - RNA, 21 nt, Neisseria meningitidis Z2491
ugaggauuuuagacggcauug

SEQ ID NO: 160437 - RNA, 22 nt, Neisseria meningitidis Z2491
guaaaccaaggcaagcgacaua

SEQ ID NO: 160438 - RNA, 22 nt, Neisseria meningitidis Z2491
agcacuuugucuucaaaggcuu

SEQ ID NO: 160439 - RNA, 22 nt, Neisseria meningitidis Z2491
guaacgggggcuuugucgaaau

SEQ ID NO: 160440 - RNA, 22 nt, Neisseria meningitidis Z2491
guuugccagcaccgccgccgcu

SEQ ID NO: 160441 - RNA, 22 nt, Neisseria meningitidis Z2491
uggcacgugugggcggucgcua

SEQ ID NO: 160442 - RNA, 22 nt, Neisseria meningitidis Z2491
ugauaguugaguauccugcggu

SEQ ID NO: 160443 - RNA, 22 nt, Neisseria meningitidis Z2491
acguuggaacagcgcgucgaac

SEQ ID NO: 160444 - RNA, 22 nt, Neisseria meningitidis Z2491
guuuagagguucuagauucccg

SEQ ID NO: 160445 - RNA, 22 nt, Neisseria meningitidis Z2491
gaugugcaggacgaaaucgacg

SEQ ID NO: 160446 - RNA, 22 nt, Neisseria meningitidis Z2491
uaugggaaaagugugccgcuuc

SEQ ID NO: 160447 - RNA, 20 nt, Neisseria meningitidis Z2491
ucagcggugucaugugcgcc

SEQ ID NO: 160448 - RNA, 22 nt, Neisseria meningitidis Z2491
agucggauucccgcgcgggcgg

SEQ ID NO: 160449 - RNA, 22 nt, Neisseria meningitidis Z2491
uuucagacggccuuuguucuag

SEQ ID NO: 160450 - RNA, 22 nt, Neisseria meningitidis Z2491
ucugauacaguaucuguccggu

SEQ ID NO: 160451 - RNA, 22 nt, Neisseria meningitidis Z2491
aucgggcugcacgcuuccguau

SEQ ID NO: 160452 - RNA, 22 nt, Neisseria meningitidis Z2491
cgaugcggcgauuguccgcccg

SEQ ID NO: 160453 - RNA, 22 nt, Neisseria meningitidis Z2491
uggcaccguauccaccugcuga

SEQ ID NO: 160454 - RNA, 22 nt, Neisseria meningitidis Z2491
augccgucugaacguccggcag

SEQ ID NO: 160455 - RNA, 22 nt, Neisseria meningitidis Z2491
cguugauguagcgggcggagag

SEQ ID NO: 160456 - RNA, 22 nt, Neisseria meningitidis Z2491
ugccgaagacggaagcugugcc

SEQ ID NO: 160457 - RNA, 22 nt, Neisseria meningitidis Z2491
aaggucgucugaaaagaugccu

SEQ ID NO: 160458 - RNA, 18 nt, Neisseria meningitidis Z2491
aaucugaacuuugauguc

SEQ ID NO: 160459 - RNA, 22 nt, Neisseria meningitidis Z2491
ucagacggcauuuuuucguaug

SEQ ID NO: 160460 - RNA, 22 nt, Neisseria meningitidis Z2491
uccgagaaaccgaugaccuugc

SEQ ID NO: 160461 - RNA, 22 nt, Neisseria meningitidis Z2491
augccgucugaaagcggcaagg

SEQ ID NO: 160462 - RNA, 22 nt, Neisseria meningitidis Z2491
guuugccaaagaccuucaagcg

SEQ ID NO: 160463 - RNA, 22 nt, Neisseria meningitidis Z2491
cggcgguauccaaacagccgag

SEQ ID NO: 160464 - RNA, 22 nt, Neisseria meningitidis Z2491
uacggaaaacacccuaugccgu

SEQ ID NO: 160465 - RNA, 22 nt, Neisseria meningitidis Z2491
ccggcauuugacccgcaacaau

SEQ ID NO: 160466 - RNA, 22 nt, Neisseria meningitidis Z2491
gccguuugaggccgaagucuuc

SEQ ID NO: 160467 - RNA, 22 nt, Neisseria meningitidis Z2491
cguucguuucccaauauaucga

SEQ ID NO: 160468 - RNA, 22 nt, Neisseria meningitidis Z2491
ucagggcguuuauggcuuuuug

SEQ ID NO: 160469 - RNA, 22 nt, Neisseria meningitidis Z2491
cucgccguuaugccuuuauggu

SEQ ID NO: 160470 - RNA, 22 nt, Neisseria meningitidis Z2491
auuugucgaauuuuuccugaac

SEQ ID NO: 160471 - RNA, 22 nt, Neisseria meningitidis Z2491
ucuaaggucuggauucccgccu

SEQ ID NO: 160472 - RNA, 22 nt, Neisseria meningitidis Z2491
cggaaaucugcucugcgguaaa

SEQ ID NO: 160473 - RNA, 22 nt, Neisseria meningitidis Z2491
uugaugauugacggagaacacg

SEQ ID NO: 160474 - RNA, 22 nt, Neisseria meningitidis Z2491
aaagccauauccgaaauuuguu

SEQ ID NO: 160475 - RNA, 22 nt, Neisseria meningitidis Z2491
cguuugccccguucagacggca

SEQ ID NO: 160476 - RNA, 23 nt, Neisseria meningitidis Z2491
ugguuuaaauuuaauccacuaua

SEQ ID NO: 160477 - RNA, 22 nt, Neisseria meningitidis Z2491
ucgggcuguuuucggaaagcga

SEQ ID NO: 160478 - RNA, 22 nt, Neisseria meningitidis Z2491
gccgcugaugauucugauuccc

SEQ ID NO: 160479 - RNA, 20 nt, Neisseria meningitidis Z2491
gcuguauaaaaccaagucca

SEQ ID NO: 160480 - RNA, 21 nt, Neisseria meningitidis Z2491
gccgucugaaaaaucaauuuu

SEQ ID NO: 160481 - RNA, 22 nt, Neisseria meningitidis Z2491
agaguuugccguccaagccguc

SEQ ID NO: 160482 - RNA, 22 nt, Neisseria meningitidis Z2491
auuguguacgcauaaaugccgg

SEQ ID NO: 160483 - RNA, 22 nt, Neisseria meningitidis Z2491
aacugucuauccaucaucauaa

SEQ ID NO: 160484 - RNA, 23 nt, Neisseria meningitidis Z2491
gaaucgacggcaucgaaacugcc

SEQ ID NO: 160485 - RNA, 22 nt, Neisseria meningitidis Z2491
gguaacggguuucuuuaugucg

SEQ ID NO: 160486 - RNA, 22 nt, Neisseria meningitidis Z2491
ccguacugguuuaaauuuaauc

SEQ ID NO: 160487 - RNA, 21 nt, Neisseria meningitidis Z2491
ucggcaaucgguucgaugcgu

SEQ ID NO: 160488 - RNA, 22 nt, Neisseria meningitidis Z2491
uuguccugucgguuucuuugaa

SEQ ID NO: 160489 - RNA, 22 nt, Neisseria meningitidis Z2491
ucaaacucggcuucaaaccgcc

SEQ ID NO: 160490 - RNA, 22 nt, Neisseria meningitidis Z2491
gacggcgaggauuuccugccaa

SEQ ID NO: 160491 - RNA, 21 nt, Neisseria meningitidis Z2491
uuggauaagcugcuugaguuc

SEQ ID NO: 160492 - RNA, 22 nt, Neisseria meningitidis Z2491
augcugaaauguuuucagacga

SEQ ID NO: 160493 - RNA, 22 nt, Neisseria meningitidis Z2491
gcgggaauccagaccuugauuu

SEQ ID NO: 160494 - RNA, 21 nt, Neisseria meningitidis Z2491
cauccggcaauacuuccccaa

SEQ ID NO: 160495 - RNA, 22 nt, Neisseria meningitidis Z2491
ugcuggcgaaauagccuugcag

SEQ ID NO: 160496 - RNA, 22 nt, Neisseria meningitidis Z2491
uuaucggcagcaacaucgucaa

SEQ ID NO: 160497 - RNA, 22 nt, Neisseria meningitidis Z2491
cggcaaucaaaaugccgucuga

SEQ ID NO: 160498 - RNA, 22 nt, Neisseria meningitidis Z2491
aacagaauuauauucccaaaaa

SEQ ID NO: 160499 - RNA, 22 nt, Neisseria meningitidis Z2491
cggucggaauaaagccugcgcc

SEQ ID NO: 160500 - RNA, 15 nt, Neisseria meningitidis Z2491
uaguuucagacggca

SEQ ID NO: 160501 - RNA, 22 nt, Neisseria meningitidis Z2491
gugccgucgaggucgaagagua

SEQ ID NO: 160502 - RNA, 22 nt, Neisseria meningitidis Z2491
auccacagauuuuuccauaugg

SEQ ID NO: 160503 - RNA, 22 nt, Neisseria meningitidis Z2491
aaucuagaaucucggacuuuca

SEQ ID NO: 160504 - RNA, 22 nt, Neisseria meningitidis Z2491
gcggucuggauaaugguggcau

SEQ ID NO: 160505 - RNA, 20 nt, Neisseria meningitidis Z2491
agacggcauuuucauucuca

SEQ ID NO: 160506 - RNA, 22 nt, Neisseria meningitidis Z2491
cgauuugucaaaagcgaugccg

SEQ ID NO: 160507 - RNA, 22 nt, Neisseria meningitidis Z2491
cggauauuucgaugauuuugcu

SEQ ID NO: 160508 - RNA, 22 nt, Neisseria meningitidis Z2491
accgccuguuggauuuccagcc

SEQ ID NO: 160509 - RNA, 22 nt, Neisseria meningitidis Z2491
uuucagguagccugaaugguag

SEQ ID NO: 160510 - RNA, 22 nt, Neisseria meningitidis Z2491
ggguuucagacggcauuuuguu

SEQ ID NO: 160511 - RNA, 22 nt, Neisseria meningitidis Z2491
agucauauuuccacaacugcua

SEQ ID NO: 160512 - RNA, 17 nt, Neisseria meningitidis Z2491
uaacgucgucugaaaua

SEQ ID NO: 160513 - RNA, 21 nt, Neisseria meningitidis Z2491
gguugaagccgcuuuggaagc

SEQ ID NO: 160514 - RNA, 22 nt, Neisseria meningitidis Z2491
uucggcuugggcgaagaagugg

SEQ ID NO: 160515 - RNA, 22 nt, Neisseria meningitidis Z2491
agcggauuaacaaaaaccagua

SEQ ID NO: 160516 - RNA, 22 nt, Neisseria meningitidis Z2491
agacggcauuuucuguuuauuu

SEQ ID NO: 160517 - RNA, 22 nt, Neisseria meningitidis Z2491
uuuggcaguuucgaugccgucg

SEQ ID NO: 160518 - RNA, 22 nt, Neisseria meningitidis Z2491
uuugcgcuauuuggaaagcggu

SEQ ID NO: 160519 - RNA, 17 nt, Neisseria meningitidis Z2491
uugcacgauuucgacga

SEQ ID NO: 160520 - RNA, 22 nt, Neisseria meningitidis Z2491
acgcugauguaucuuugcugcu

SEQ ID NO: 160521 - RNA, 22 nt, Neisseria meningitidis Z2491
aaugccguuuuucaggauauug

SEQ ID NO: 160522 - RNA, 22 nt, Neisseria meningitidis Z2491
auccgcuacgguucgccccaaa

SEQ ID NO: 160523 - RNA, 22 nt, Neisseria meningitidis Z2491
aaacugccguacccacguuuuu

SEQ ID NO: 160524 - RNA, 22 nt, Neisseria meningitidis Z2491
cugcgguuucggcggcggacgc

SEQ ID NO: 160525 - RNA, 22 nt, Neisseria meningitidis Z2491
ggcaggcagcuugacgaccuga

SEQ ID NO: 160526 - RNA, 22 nt, Neisseria meningitidis Z2491
uugacgguuucgggacgggcuu

SEQ ID NO: 160527 - RNA, 22 nt, Neisseria meningitidis Z2491
auaguggauuaaauuuaaauaa

SEQ ID NO: 160528 - RNA, 22 nt, Neisseria meningitidis Z2491
uauuugucgcucguuuccugcc

SEQ ID NO: 160529 - RNA, 22 nt, Neisseria meningitidis Z2491
agccgacaacggcaggaauacc

SEQ ID NO: 160530 - RNA, 22 nt, Neisseria meningitidis Z2491
uguuucagacgaccuuaagaug

SEQ ID NO: 160531 - RNA, 19 nt, Neisseria meningitidis Z2491
cgcaucgaucacgguuugg

SEQ ID NO: 160532 - RNA, 21 nt, Neisseria meningitidis Z2491
gcggaauguccugcacuugga

SEQ ID NO: 160533 - RNA, 22 nt, Neisseria meningitidis Z2491
caggcaggccgccgccuuugug

SEQ ID NO: 160534 - RNA, 22 nt, Neisseria meningitidis Z2491
ucggcgaugcggcggguuuccu

SEQ ID NO: 160535 - RNA, 21 nt, Neisseria meningitidis Z2491
uauucgccggcuucgguuugc

SEQ ID NO: 160536 - RNA, 22 nt, Neisseria meningitidis Z2491
uagaaagcacaggcguugcuac

SEQ ID NO: 160537 - RNA, 19 nt, Neisseria meningitidis Z2491
aggcuuggaccgcuuugcc

SEQ ID NO: 160538 - RNA, 18 nt, Neisseria meningitidis Z2491
uauccgccccccggagga

SEQ ID NO: 160539 - RNA, 20 nt, Neisseria meningitidis Z2491
aagucggugccgccgacagc

SEQ ID NO: 160540 - RNA, 22 nt, Neisseria meningitidis Z2491
uaucugaaaguuuagagguucu

SEQ ID NO: 160541 - RNA, 22 nt, Neisseria meningitidis Z2491
gacgauaugcagggcggagggu

SEQ ID NO: 160542 - RNA, 22 nt, Neisseria meningitidis Z2491
uugagauuuugcauccuggauu

SEQ ID NO: 160543 - RNA, 22 nt, Neisseria meningitidis Z2491
cugcaggcgcgccaguucgucg

SEQ ID NO: 160544 - RNA, 22 nt, Neisseria meningitidis Z2491
cgccgucuucgcggcugacgag

SEQ ID NO: 160545 - RNA, 23 nt, Neisseria meningitidis Z2491
ccgucugaaaaccauuucacuug

SEQ ID NO: 160546 - RNA, 22 nt, Neisseria meningitidis Z2491
cgacauccugcauuuguuugcg

SEQ ID NO: 160547 - RNA, 22 nt, Neisseria meningitidis Z2491
aucacgccguccaaacccaaau

SEQ ID NO: 160548 - RNA, 20 nt, Neisseria meningitidis Z2491
ugucaggcgcgaugacggcg

SEQ ID NO: 160549 - RNA, 22 nt, Neisseria meningitidis Z2491
gaauccaguuuuuugaguuuca

SEQ ID NO: 160550 - RNA, 22 nt, Neisseria meningitidis Z2491
aacacuguuuuucgugguauaa

SEQ ID NO: 160551 - RNA, 18 nt, Neisseria meningitidis Z2491
gcuguucugccgacugga

SEQ ID NO: 160552 - RNA, 22 nt, Neisseria meningitidis Z2491
ugcauuauuaguguuuuagcag

SEQ ID NO: 160553 - RNA, 22 nt, Neisseria meningitidis Z2491
ugaagcagcaucaggcggcauc

SEQ ID NO: 160554 - RNA, 22 nt, Neisseria meningitidis Z2491
ugucgaagaguucuuucggcag

SEQ ID NO: 160555 - RNA, 22 nt, Neisseria meningitidis Z2491
aguuugcccacuucggcgaugg

SEQ ID NO: 160556 - RNA, 22 nt, Neisseria meningitidis Z2491
acgcgcgaugauuuccuucagg

SEQ ID NO: 160557 - RNA, 22 nt, Neisseria meningitidis Z2491
acugggauuuauugcagauuug

SEQ ID NO: 160558 - RNA, 22 nt, Neisseria meningitidis Z2491
uacaacguuacuaugcugguuu

SEQ ID NO: 160559 - RNA, 22 nt, Neisseria meningitidis Z2491
uuaaagaccuagauucccgccu

SEQ ID NO: 160560 - RNA, 22 nt, Neisseria meningitidis Z2491
ugcuucguccauuacaucgaug

SEQ ID NO: 160561 - RNA, 22 nt, Neisseria meningitidis Z2491
gcgcacaggaugauuugcgccg

SEQ ID NO: 160562 - RNA, 21 nt, Neisseria meningitidis Z2491
gcagggauguucaaauguucg

SEQ ID NO: 160563 - RNA, 22 nt, Neisseria meningitidis Z2491
ucgccguuuuggucgauaagga

SEQ ID NO: 160564 - RNA, 22 nt, Neisseria meningitidis Z2491
ugcgcgaugcaguuuucgaugu

SEQ ID NO: 160565 - RNA, 22 nt, Neisseria meningitidis Z2491
uucaggaaaaauucgacaaaua

SEQ ID NO: 160566 - RNA, 22 nt, Neisseria meningitidis Z2491
uaaggcaucuguugcggcaaau

SEQ ID NO: 160567 - RNA, 20 nt, Neisseria meningitidis Z2491
ugcuguauuucgccgcuucg

SEQ ID NO: 160568 - RNA, 22 nt, Neisseria meningitidis Z2491
uucaagcgcagcccgcuuugcc

SEQ ID NO: 160569 - RNA, 22 nt, Neisseria meningitidis Z2491
gccguuauccgcuggaguaucg

SEQ ID NO: 160570 - RNA, 22 nt, Neisseria meningitidis Z2491
gcguuggaaguuuuuggcggcg

SEQ ID NO: 160571 - RNA, 20 nt, Neisseria meningitidis Z2491
aaauccgccacuacgcaauc

SEQ ID NO: 160572 - RNA, 22 nt, Neisseria meningitidis Z2491
gccguaugcuaccgcauacugg

SEQ ID NO: 160573 - RNA, 19 nt, Neisseria meningitidis Z2491
cagacggcauuggguuuug

SEQ ID NO: 160574 - RNA, 22 nt, Neisseria meningitidis Z2491
cuuaaaguugaaacccgcacau

SEQ ID NO: 160575 - RNA, 22 nt, Neisseria meningitidis Z2491
uugcugccaaaguuggcguugu

SEQ ID NO: 160576 - RNA, 22 nt, Neisseria meningitidis Z2491
ggacggauucggacggaugccg

SEQ ID NO: 160577 - RNA, 22 nt, Neisseria meningitidis Z2491
agacggccuuuuguauuuaggc

SEQ ID NO: 160578 - RNA, 22 nt, Neisseria meningitidis Z2491
gucggcaagccagucgaugggg

SEQ ID NO: 160579 - RNA, 22 nt, Neisseria meningitidis Z2491
gccgucgugucuucgcuugccg

SEQ ID NO: 160580 - RNA, 23 nt, Neisseria meningitidis Z2491
guuuaugcaauggcggacaaaga

SEQ ID NO: 160581 - RNA, 22 nt, Neisseria meningitidis Z2491
cugcuggccgguaccgcguucg

SEQ ID NO: 160582 - RNA, 22 nt, Neisseria meningitidis Z2491
gcgcaucgaugacggggucgag

SEQ ID NO: 160583 - RNA, 22 nt, Neisseria meningitidis Z2491
aacacgcugaugaugcaggucg

SEQ ID NO: 160584 - RNA, 19 nt, Neisseria meningitidis Z2491
ucacgucguaaaugcccgc

SEQ ID NO: 160585 - RNA, 22 nt, Neisseria meningitidis Z2491
cggugucgcucaaaccggcaua

SEQ ID NO: 160586 - RNA, 22 nt, Neisseria meningitidis Z2491
guuggacgaaccguccucuuuc

SEQ ID NO: 160587 - RNA, 22 nt, Neisseria meningitidis Z2491
cuaugccguuaucgaaugcgaa

SEQ ID NO: 160588 - RNA, 22 nt, Neisseria meningitidis Z2491
ugugggaaaagcugcuugccgc

SEQ ID NO: 160589 - RNA, 22 nt, Neisseria meningitidis Z2491
ggaauccaguuuuuugaguuuc

SEQ ID NO: 160590 - RNA, 22 nt, Neisseria meningitidis Z2491
gcgggaaugacgaauuucaggu

SEQ ID NO: 160591 - RNA, 22 nt, Neisseria meningitidis Z2491
acgucgcccgcuucgacgcguu

SEQ ID NO: 160592 - RNA, 22 nt, Neisseria meningitidis Z2491
augccgucugcaggaagcaggu

SEQ ID NO: 160593 - RNA, 22 nt, Neisseria meningitidis Z2491
uauccagaaugaugacgauuau

SEQ ID NO: 160594 - RNA, 20 nt, Neisseria meningitidis Z2491
ucggcgagcgguuugcggau

SEQ ID NO: 160595 - RNA, 22 nt, Neisseria meningitidis Z2491
aacagaauuauauucccaaaaa

SEQ ID NO: 160596 - RNA, 22 nt, Neisseria meningitidis Z2491
cacagcgguaaacgucauuuug

SEQ ID NO: 160597 - RNA, 22 nt, Neisseria meningitidis Z2491
cagaugaggguuuugcagccga

SEQ ID NO: 160598 - RNA, 22 nt, Neisseria meningitidis Z2491
augcugaaauguuuucagacga

SEQ ID NO: 160599 - RNA, 22 nt, Neisseria meningitidis Z2491
aggcuuucagacggccuuugga

SEQ ID NO: 160600 - RNA, 22 nt, Neisseria meningitidis Z2491
acuguuguugggcagugccgcc

SEQ ID NO: 160601 - RNA, 22 nt, Neisseria meningitidis Z2491
cucaaagaagacgagucggaaa

SEQ ID NO: 160602 - RNA, 22 nt, Neisseria meningitidis Z2491
gugccgucgaggucgaagagua

SEQ ID NO: 160603 - RNA, 22 nt, Neisseria meningitidis Z2491
gaugugcaggacgaaaucgacg

SEQ ID NO: 160604 - RNA, 22 nt, Human
aaaagcgaagagaacugaaguu

SEQ ID NO: 160605 - RNA, 22 nt, Human
aaaaggaagaguuuucagagac

SEQ ID NO: 160606 - RNA, 22 nt, Human
aaacugcuuucucugccuuucc

SEQ ID NO: 160607 - RNA, 22 nt, Human
aaagaccuucacuuucuggcug

SEQ ID NO: 160608 - RNA, 23 nt, Human
aaagacuagaagccguggcugca

SEQ ID NO: 160609 - RNA, 22 nt, Human
aacacaucagcacacuaacgga

SEQ ID NO: 160610 - RNA, 20 nt, Human
aacagcucucgacuuaucuu

SEQ ID NO: 160611 - RNA, 22 nt, Human
aacaggaagaauccagauggug

SEQ ID NO: 160612 - RNA, 22 nt, Human
aacaguuaagaggaggcagaga

SEQ ID NO: 160613 - RNA, 22 nt, Human
aaaugcuuuaauugaguucaug

SEQ ID NO: 160614 - RNA, 22 nt, Human
aaagaccaagagccccaaguuu

SEQ ID NO: 160615 - RNA, 22 nt, Human
aacgagcugggggggccggggg

SEQ ID NO: 160616 - RNA, 22 nt, Human
aaccuuucucccugcacacugg

SEQ ID NO: 160617 - RNA, 22 nt, Human
aaccugagggcaggaccccaua

SEQ ID NO: 160618 - RNA, 22 nt, Human
aacgcugugcacuggguccagg

SEQ ID NO: 160619 - RNA, 22 nt, Human
aacccuguuguguacaugcaua

SEQ ID NO: 160620 - RNA, 22 nt, Human
aacgcaacaacuggagcuguag

SEQ ID NO: 160621 - RNA, 22 nt, Human
aaccucgggcugcacuuggcac

SEQ ID NO: 160622 - RNA, 22 nt, Human
aaccggauugauccuucuuuga

SEQ ID NO: 160623 - RNA, 22 nt, Human
aacccugaacuuaguucuagga

SEQ ID NO: 160624 - RNA, 22 nt, Human
aaccaggcgagagagcggucag

SEQ ID NO: 160625 - RNA, 22 nt, Human
aacccaagacaagcacuggcca

SEQ ID NO: 160626 - RNA, 22 nt, Human
aaccauggauuucaguucaccu

SEQ ID NO: 160627 - RNA, 22 nt, Human
aaccuggaggaccuuaugcuaa

SEQ ID NO: 160628 - RNA, 22 nt, Human
aaccucuuugugaaugucauga

SEQ ID NO: 160629 - RNA, 22 nt, Human
aagaagcuacugucacuaucag

SEQ ID NO: 160630 - RNA, 22 nt, Human
aagaaggaaggcaagagauggg

SEQ ID NO: 160631 - RNA, 21 nt, Human
aagagcgccgggcagggcuga

SEQ ID NO: 160632 - RNA, 22 nt, Human
aagagcuuguuaugcugcucuu

SEQ ID NO: 160633 - RNA, 22 nt, Human
aagaggaauaauaaaaauugca

SEQ ID NO: 160634 - RNA, 22 nt, Human
aagagggguggucugugaggau

SEQ ID NO: 160635 - RNA, 22 nt, Human
aagaugcuucaugagaguuggg

SEQ ID NO: 160636 - RNA, 22 nt, Human
aagcacagggacucaggaccgg

SEQ ID NO: 160637 - RNA, 22 nt, Human
aagagaggcccaaguggcuggc

SEQ ID NO: 160638 - RNA, 22 nt, Human
aagacccuaccccuggagagga

SEQ ID NO: 160639 - RNA, 22 nt, Human
aagaggaggacgguucccagaa

SEQ ID NO: 160640 - RNA, 22 nt, Human
aagcccucagagccucuuugac

SEQ ID NO: 160641 - RNA, 22 nt, Human
aagccgagggaggugauggaga

SEQ ID NO: 160642 - RNA, 22 nt, Human
aagcagaaaaacugagcuccaa

SEQ ID NO: 160643 - RNA, 22 nt, Human
aagcaguuuagucaucgggauu

SEQ ID NO: 160644 - RNA, 22 nt, Human
aacugggugauucaggcuguuu

SEQ ID NO: 160645 - RNA, 22 nt, Human
aagaaaccauauuaguuccugg

SEQ ID NO: 160646 - RNA, 22 nt, Human
aacuucuggaaacuuccaugug

SEQ ID NO: 160647 - RNA, 22 nt, Human
aacgccgggacucgcagggagc

SEQ ID NO: 160648 - RNA, 22 nt, Human
aacugaaguuuucagauuuugc

SEQ ID NO: 160649 - RNA, 23 nt, Human
aacucuggcuagcauagaauaga

SEQ ID NO: 160650 - RNA, 22 nt, Human
aacuacucugggguggcagguu

SEQ ID NO: 160651 - RNA, 22 nt, Human
aacgugcuuuacaaaugaccuu

SEQ ID NO: 160652 - RNA, 19 nt, Human
aacucugccgaggcaagcc

SEQ ID NO: 160653 - RNA, 22 nt, Human
aacugcauaagcuucgggaccu

SEQ ID NO: 160654 - RNA, 22 nt, Human
aagccugguuauuugaggaugu

SEQ ID NO: 160655 - RNA, 22 nt, Human
aagccuguugacagcugucagu

SEQ ID NO: 160656 - RNA, 22 nt, Human
aaggaguggugaagucagaugu

SEQ ID NO: 160657 - RNA, 22 nt, Human
aaggcugaccaguuuacacuuu

SEQ ID NO: 160658 - RNA, 22 nt, Human
aaggcgccacagugauugcaaa

SEQ ID NO: 160659 - RNA, 22 nt, Human
aaggcgauuuaaagauguuagg

SEQ ID NO: 160660 - RNA, 22 nt, Human
aaggcggcggcggcggcugcgg

SEQ ID NO: 160661 - RNA, 22 nt, Human
aaggcaguuaauuuggcuagaa

SEQ ID NO: 160662 - RNA, 22 nt, Human
aaggcgaggggcacagcugaga

SEQ ID NO: 160663 - RNA, 22 nt, Human
aaggcacuugcccagagcugca

SEQ ID NO: 160664 - RNA, 22 nt, Human
aaggcacauauuuuagagucac

SEQ ID NO: 160665 - RNA, 22 nt, Human
aaggauuuccaggccugcgccu

SEQ ID NO: 160666 - RNA, 22 nt, Human
aagggaccucagcaaucaggga

SEQ ID NO: 160667 - RNA, 22 nt, Human
aagggcuucucgccugugugca

SEQ ID NO: 160668 - RNA, 23 nt, Human
aagggcgauuaacauucgcucga

SEQ ID NO: 160669 - RNA, 22 nt, Human
aagggagaguauccagaaacag

SEQ ID NO: 160670 - RNA, 22 nt, Human
aagggagagggagaagguggga

SEQ ID NO: 160671 - RNA, 22 nt, Human
aagggccacaugccauuuaaaa

SEQ ID NO: 160672 - RNA, 22 nt, Human
aaggggggcaccugcaugcccg

SEQ ID NO: 160673 - RNA, 21 nt, Human
aaguacccuuuugcuacucag

SEQ ID NO: 160674 - RNA, 21 nt, Human
aaguuucucccuaauuguugc

SEQ ID NO: 160675 - RNA, 22 nt, Human
aaguuccacuagugacccagaa

SEQ ID NO: 160676 - RNA, 22 nt, Human
aagugucucugggaggcccgga

SEQ ID NO: 160677 - RNA, 22 nt, Human
aaguguggguaagcauuucuug

SEQ ID NO: 160678 - RNA, 23 nt, Human
aaguggucaucuaucccaugguu

SEQ ID NO: 160679 - RNA, 22 nt, Human
aaguggcccuaauugggccaaa

SEQ ID NO: 160680 - RNA, 22 nt, Human
aagucauuaucucuucuaaucu

SEQ ID NO: 160681 - RNA, 22 nt, Human
aaguagaaaaccgcacuggacu

SEQ ID NO: 160682 - RNA, 20 nt, Human
aaguagguuucaguugcugu

SEQ ID NO: 160683 - RNA, 22 nt, Human
aaucaugguacaaguaagcacg

SEQ ID NO: 160684 - RNA, 22 nt, Human
aauccucguagugguuagaaag

SEQ ID NO: 160685 - RNA, 22 nt, Human
aauggcaaaaguuucggaaauu

SEQ ID NO: 160686 - RNA, 22 nt, Human
aaugguuacuacccugggucuu

SEQ ID NO: 160687 - RNA, 22 nt, Human
aaugguggaugucuguucugac

SEQ ID NO: 160688 - RNA, 18 nt, Human
acugagcccaggacacac

SEQ ID NO: 160689 - RNA, 22 nt, Human
acuaagcugugugguucacuca

SEQ ID NO: 160690 - RNA, 20 nt, Human
acugcaagagacagaugaaa

SEQ ID NO: 160691 - RNA, 22 nt, Human
acugcaggucccaucaccugcg

SEQ ID NO: 160692 - RNA, 22 nt, Human
acuggagcccguggaggcgcag

SEQ ID NO: 160693 - RNA, 22 nt, Human
acugcacuccagcccgagcaac

SEQ ID NO: 160694 - RNA, 22 nt, Human
acugcuguugugauggguauuu

SEQ ID NO: 160695 - RNA, 22 nt, Human
acuguucacccagcacuagcag

SEQ ID NO: 160696 - RNA, 18 nt, Human
acuguccucaggacguug

SEQ ID NO: 160697 - RNA, 22 nt, Human
acuggggcaggaaaguaugcug

SEQ ID NO: 160698 - RNA, 19 nt, Human
acuggggcaggcugggcuu

SEQ ID NO: 160699 - RNA, 22 nt, Human
acuggguuguuugucucaugag

SEQ ID NO: 160700 - RNA, 22 nt, Human
acugggacuguaugugcuggac

SEQ ID NO: 160701 - RNA, 19 nt, Human
acugggaugggcagugcca

SEQ ID NO: 160702 - RNA, 22 nt, Human
acugggcaaggauaugaugggu

SEQ ID NO: 160703 - RNA, 22 nt, Human
acuggcauuccuaggggagggg

SEQ ID NO: 160704 - RNA, 22 nt, Human
acuggcuuauuguuguggagcu

SEQ ID NO: 160705 - RNA, 22 nt, Human
acuggcgucugucuccccugcc

SEQ ID NO: 160706 - RNA, 22 nt, Human
acugguuucaaguuggacugaa

SEQ ID NO: 160707 - RNA, 22 nt, Human
acuggugcucuggccaccgcug

SEQ ID NO: 160708 - RNA, 21 nt, Human
acugggcuagccugacuucug

SEQ ID NO: 160709 - RNA, 15 nt, Human
acugggaaggaguau

SEQ ID NO: 160710 - RNA, 22 nt, Human
acuguugcuuguuuggaauguu

SEQ ID NO: 160711 - RNA, 22 nt, Human
acugugaagagcauucuggcug

SEQ ID NO: 160712 - RNA, 22 nt, Human
acuguggcugcuacccuggcuc

SEQ ID NO: 160713 - RNA, 22 nt, Human
acuucugcccuggcgagggcgu

SEQ ID NO: 160714 - RNA, 22 nt, Human
acuugaagcaugaaaauaagcc

SEQ ID NO: 160715 - RNA, 22 nt, Human
agaagaagacccuaaggaaagg

SEQ ID NO: 160716 - RNA, 22 nt, Human
agaagaaugguuugaaagauuu

SEQ ID NO: 160717 - RNA, 22 nt, Human
agaagaucccugugguuacgac

SEQ ID NO: 160718 - RNA, 21 nt, Human
agaagcggucgaaucgcagac

SEQ ID NO: 160719 - RNA, 22 nt, Human
acuuugccagcucccugcuggc

SEQ ID NO: 160720 - RNA, 22 nt, Human
agaacaagaaacccgaaaagug

SEQ ID NO: 160721 - RNA, 22 nt, Human
agaacaggaggaagccagcucc

SEQ ID NO: 160722 - RNA, 22 nt, Human
agacagaaaaguugucaaucau

SEQ ID NO: 160723 - RNA, 22 nt, Human
agaaucaggaagacagccuggc

SEQ ID NO: 160724 - RNA, 22 nt, Human
agaaucucuagaaaugggucuc

SEQ ID NO: 160725 - RNA, 22 nt, Human
agacagaacauaauuaguacug

SEQ ID NO: 160726 - RNA, 22 nt, Human
agaccauguuauccuucauuuu

SEQ ID NO: 160727 - RNA, 22 nt, Human
agacagcggugcaauaaauggu

SEQ ID NO: 160728 - RNA, 22 nt, Human
agaccccugcuggggcugcugu

SEQ ID NO: 160729 - RNA, 19 nt, Human
agacccaguuuucuagugu

SEQ ID NO: 160730 - RNA, 22 nt, Human
agaccguguguggguugcggug

SEQ ID NO: 160731 - RNA, 22 nt, Human
agacccuugcagucugguuguc

SEQ ID NO: 160732 - RNA, 22 nt, Human
agacuucucuaacuugaggacc

SEQ ID NO: 160733 - RNA, 22 nt, Human
agacuggagucuccuuuggagc

SEQ ID NO: 160734 - RNA, 22 nt, Human
agacuccuucuaagaccucauu

SEQ ID NO: 160735 - RNA, 19 nt, Human
agacugaagggcccgaguc

SEQ ID NO: 160736 - RNA, 22 nt, Human
agacuuuggcagggccaguggu

SEQ ID NO: 160737 - RNA, 22 nt, Human
agagauggugaugaggaaaaau

SEQ ID NO: 160738 - RNA, 22 nt, Human
agagcacaggguuuugugccgg

SEQ ID NO: 160739 - RNA, 22 nt, Human
agagcagaggcauggccguggg

SEQ ID NO: 160740 - RNA, 22 nt, Human
agagacaagggaccucuggaga

SEQ ID NO: 160741 - RNA, 22 nt, Human
agagaagaauccccugguggag

SEQ ID NO: 160742 - RNA, 22 nt, Human
agagcagcaaucuuugaaauua

SEQ ID NO: 160743 - RNA, 22 nt, Human
agagcagcuuuucggaaccacu

SEQ ID NO: 160744 - RNA, 22 nt, Human
agagcagauggagcuggaagag

SEQ ID NO: 160745 - RNA, 22 nt, Human
agagccggagucuucuuguuug

SEQ ID NO: 160746 - RNA, 22 nt, Human
agagagggaugguguccagaga

SEQ ID NO: 160747 - RNA, 22 nt, Human
agagcccagaucccacccugga

SEQ ID NO: 160748 - RNA, 22 nt, Human
agauaaucacaaucuagacuuu

SEQ ID NO: 160749 - RNA, 22 nt, Human
agagggagagauuggcaaucag

SEQ ID NO: 160750 - RNA, 22 nt, Human
agagggcaggcugguugggguc

SEQ ID NO: 160751 - RNA, 22 nt, Human
agagcugggacuuggacucaau

SEQ ID NO: 160752 - RNA, 22 nt, Human
agaggaguagcugagcucugca

SEQ ID NO: 160753 - RNA, 22 nt, Human
acccggccuacucagugcccag

SEQ ID NO: 160754 - RNA, 22 nt, Human
acccagauauccaggccucugc

SEQ ID NO: 160755 - RNA, 22 nt, Human
accagccacccugccgcguccg

SEQ ID NO: 160756 - RNA, 22 nt, Human
accaccacugacaccagcucgg

SEQ ID NO: 160757 - RNA, 22 nt, Human
accauccaaaagcuuuucauca

SEQ ID NO: 160758 - RNA, 22 nt, Human
acauuuuguuuauggaaaagau

SEQ ID NO: 160759 - RNA, 22 nt, Human
acauucucuuuuagaaagcugu

SEQ ID NO: 160760 - RNA, 22 nt, Human
acaugguguggcacuaggggcu

SEQ ID NO: 160761 - RNA, 22 nt, Human
acauggguuaaagaagauggaa

SEQ ID NO: 160762 - RNA, 22 nt, Human
acaugugugucugugugugugu

SEQ ID NO: 160763 - RNA, 22 nt, Human
accaggaguuuugaccaggggc

SEQ ID NO: 160764 - RNA, 22 nt, Human
accagcgcguuuucaguuucau

SEQ ID NO: 160765 - RNA, 22 nt, Human
accaccacauaguaggcacuua

SEQ ID NO: 160766 - RNA, 22 nt, Human
accaggcagcaccaaagccggu

SEQ ID NO: 160767 - RNA, 17 nt, Human
accaggggcagcacugc

SEQ ID NO: 160768 - RNA, 22 nt, Human
acauccagcagauuguccagag

SEQ ID NO: 160769 - RNA, 22 nt, Human
acaucccccuacuuguguccug

SEQ ID NO: 160770 - RNA, 20 nt, Human
acauggagaagcgagguagg

SEQ ID NO: 160771 - RNA, 22 nt, Human
acaugggcaaucgcuuuauuca

SEQ ID NO: 160772 - RNA, 22 nt, Human
acauggaauuucagaagagcau

SEQ ID NO: 160773 - RNA, 22 nt, Human
acauggaccucagauccuggcc

SEQ ID NO: 160774 - RNA, 22 nt, Human
acauggaaacacgcagccccaa

SEQ ID NO: 160775 - RNA, 22 nt, Human
aauucuaaugaguucuuaucua

SEQ ID NO: 160776 - RNA, 22 nt, Human
acauggacugguccauuaugac

SEQ ID NO: 160777 - RNA, 22 nt, Human
acgaggauuuccuuagaugaaa

SEQ ID NO: 160778 - RNA, 22 nt, Human
accugguuucuuacccaagaga

SEQ ID NO: 160779 - RNA, 22 nt, Human
accuucugaccucucggacuuc

SEQ ID NO: 160780 - RNA, 20 nt, Human
accuucuuugguagacggaa

SEQ ID NO: 160781 - RNA, 22 nt, Human
accuucguuuaguacucauuuu

SEQ ID NO: 160782 - RNA, 21 nt, Human
accugguuuacugaucccagg

SEQ ID NO: 160783 - RNA, 19 nt, Human
accuguucaaccucgugcu

SEQ ID NO: 160784 - RNA, 22 nt, Human
acgcaacacugcuauuuuuuuc

SEQ ID NO: 160785 - RNA, 22 nt, Human
accugcucucccucucgcaguc

SEQ ID NO: 160786 - RNA, 22 nt, Human
accuggauauuuucaguugcau

SEQ ID NO: 160787 - RNA, 22 nt, Human
accugguaaccugccugacuaa

SEQ ID NO: 160788 - RNA, 21 nt, Human
accuggugaugaaugggaggc

SEQ ID NO: 160789 - RNA, 23 nt, Human
accuggucccaugggugggccug

SEQ ID NO: 160790 - RNA, 22 nt, Human
accuguagcccaaucauggcag

SEQ ID NO: 160791 - RNA, 22 nt, Human
acggcuugaacgcgccuguggg

SEQ ID NO: 160792 - RNA, 22 nt, Human
acggcggguuccgggccagccc

SEQ ID NO: 160793 - RNA, 22 nt, Human
acggccgaugacuccagcaugg

SEQ ID NO: 160794 - RNA, 22 nt, Human
acgauuugguucagugaagaca

SEQ ID NO: 160795 - RNA, 23 nt, Human
acgcagacacauguaugggccuc

SEQ ID NO: 160796 - RNA, 22 nt, Human
acgaagggggcauggugagagu

SEQ ID NO: 160797 - RNA, 22 nt, Human
acgagguaaucaauuggucuug

SEQ ID NO: 160798 - RNA, 22 nt, Human
acgauacaaucauauaguaccu

SEQ ID NO: 160799 - RNA, 23 nt, Human
acgaccuugcccucauuccaaag

SEQ ID NO: 160800 - RNA, 20 nt, Human
acgaacauauugcaggguuu

SEQ ID NO: 160801 - RNA, 22 nt, Human
accuugggcccagaccggcacg

SEQ ID NO: 160802 - RNA, 22 nt, Human
acgguguuucucguucaggguu

SEQ ID NO: 160803 - RNA, 22 nt, Human
acgggugcuuguucccgcugcu

SEQ ID NO: 160804 - RNA, 22 nt, Human
accuccauggcccacaucuagu

SEQ ID NO: 160805 - RNA, 22 nt, Human
accgagcaggguguuugcgcac

SEQ ID NO: 160806 - RNA, 22 nt, Human
accugaccagguggcuucccaa

SEQ ID NO: 160807 - RNA, 22 nt, Human
accucccgacggcgcgggagaa

SEQ ID NO: 160808 - RNA, 22 nt, Human
accugcagguguuuccacacuu

SEQ ID NO: 160809 - RNA, 22 nt, Human
accgguucccaucuggagaguu

SEQ ID NO: 160810 - RNA, 22 nt, Human
accggucucaccaaacgcccca

SEQ ID NO: 160811 - RNA, 22 nt, Human
accgggcagcucugccccugcc

SEQ ID NO: 160812 - RNA, 22 nt, Human
accgauuucaaauggugcuaga

SEQ ID NO: 160813 - RNA, 22 nt, Human
accuggcccugggucuccugac

SEQ ID NO: 160814 - RNA, 22 nt, Human
accugagauuuuuacucaguaa

SEQ ID NO: 160815 - RNA, 22 nt, Human
accugaucugagaaguggaggg

SEQ ID NO: 160816 - RNA, 22 nt, Human
accuggaccugccaccuaugag

SEQ ID NO: 160817 - RNA, 22 nt, Human
accuggacucugaucacuuuug

SEQ ID NO: 160818 - RNA, 22 nt, Human
accucagauuguggcuccgcug

SEQ ID NO: 160819 - RNA, 22 nt, Human
accgcuggcacuggggacgggg

SEQ ID NO: 160820 - RNA, 23 nt, Human
accgccgcugccgccgcccccgc

SEQ ID NO: 160821 - RNA, 21 nt, Human
acccagaauggagccaagccu

SEQ ID NO: 160822 - RNA, 19 nt, Human
acccaugcucuguggacuu

SEQ ID NO: 160823 - RNA, 20 nt, Human
acccagaguccuccccgcgc

SEQ ID NO: 160824 - RNA, 19 nt, Human
accauggguguguuaagaa

SEQ ID NO: 160825 - RNA, 22 nt, Human
accauccaggugagggagaccu

SEQ ID NO: 160826 - RNA, 22 nt, Human
accaggguacuucuaggugggg

SEQ ID NO: 160827 - RNA, 20 nt, Human
acccaaagcucagcgugucc

SEQ ID NO: 160828 - RNA, 22 nt, Human
acccugacggugggcagcuuga

SEQ ID NO: 160829 - RNA, 22 nt, Human
acccuucugugaccugccuguc

SEQ ID NO: 160830 - RNA, 22 nt, Human
acccugcacagagggcuuuaua

SEQ ID NO: 160831 - RNA, 22 nt, Human
acccuacggacuugacugggcg

SEQ ID NO: 160832 - RNA, 22 nt, Human
accgucagguuagaaugagcac

SEQ ID NO: 160833 - RNA, 22 nt, Human
acccauggcucucugggaugcu

SEQ ID NO: 160834 - RNA, 22 nt, Human
accccagcucugagccacacca

SEQ ID NO: 160835 - RNA, 19 nt, Human
agcaguggagccaugccug

SEQ ID NO: 160836 - RNA, 21 nt, Human
agcagucugcggccggugcgg

SEQ ID NO: 160837 - RNA, 22 nt, Human
agcagggagacagugcagcauu

SEQ ID NO: 160838 - RNA, 22 nt, Human
agcaggggcaggguuuugugcu

SEQ ID NO: 160839 - RNA, 22 nt, Human
agcagggugugggugugagugu

SEQ ID NO: 160840 - RNA, 22 nt, Human
agcagggagaccaucucuuccu

SEQ ID NO: 160841 - RNA, 22 nt, Human
agcaggguggcaagucuuucug

SEQ ID NO: 160842 - RNA, 22 nt, Human
agcaggaaggcuagaagcagga

SEQ ID NO: 160843 - RNA, 22 nt, Human
agcaggacuugcugagcccucc

SEQ ID NO: 160844 - RNA, 22 nt, Human
agcaggagagacuggcccaaaa

SEQ ID NO: 160845 - RNA, 22 nt, Human
agcagccgccgccgccgcgcac

SEQ ID NO: 160846 - RNA, 22 nt, Human
agcagcaggcugggaugagucu

SEQ ID NO: 160847 - RNA, 22 nt, Human
agcagcaggugaccucgaugcc

SEQ ID NO: 160848 - RNA, 22 nt, Human
agauaggcuuagccaagcuuuc

SEQ ID NO: 160849 - RNA, 21 nt, Human
agcaucugaggcaguuuccua

SEQ ID NO: 160850 - RNA, 22 nt, Human
agcaucggacggagcaccugcu

SEQ ID NO: 160851 - RNA, 22 nt, Human
agcaggaggagagccuggcggu

SEQ ID NO: 160852 - RNA, 22 nt, Human
agcaggaggguuuuguagaguc

SEQ ID NO: 160853 - RNA, 22 nt, Human
agcaggucagugguaaucaaaa

SEQ ID NO: 160854 - RNA, 19 nt, Human
agcaucuccacagaaaaag

SEQ ID NO: 160855 - RNA, 21 nt, Human
agccagguuuccuuugaagag

SEQ ID NO: 160856 - RNA, 22 nt, Human
agccagcauauauauaguugaa

SEQ ID NO: 160857 - RNA, 22 nt, Human
agccagauuuuuugagaggcga

SEQ ID NO: 160858 - RNA, 18 nt, Human
agcagugcggaucauuuu

SEQ ID NO: 160859 - RNA, 22 nt, Human
agccacggcaaugauaggcugc

SEQ ID NO: 160860 - RNA, 22 nt, Human
agccacagucuguagccagcuu

SEQ ID NO: 160861 - RNA, 22 nt, Human
agccugggucgagagacgagaa

SEQ ID NO: 160862 - RNA, 22 nt, Human
agcccugaccuguccuguucug

SEQ ID NO: 160863 - RNA, 22 nt, Human
agcauucccuuugcagugucau

SEQ ID NO: 160864 - RNA, 22 nt, Human
agcauucuguggucuucuaugg

SEQ ID NO: 160865 - RNA, 23 nt, Human
agcccagcagagaaccuaggucc

SEQ ID NO: 160866 - RNA, 22 nt, Human
agcccugugugcuuguguuccu

SEQ ID NO: 160867 - RNA, 22 nt, Human
agccuguuacuguccugugcca

SEQ ID NO: 160868 - RNA, 22 nt, Human
agccugugcuguguuugcucca

SEQ ID NO: 160869 - RNA, 22 nt, Human
agccuugcaugauuucauucau

SEQ ID NO: 160870 - RNA, 22 nt, Human
agccuucccuuucaacaauuug

SEQ ID NO: 160871 - RNA, 22 nt, Human
agccuuucugcgcacucuuccg

SEQ ID NO: 160872 - RNA, 22 nt, Human
agcgagccugugcacuucuaac

SEQ ID NO: 160873 - RNA, 22 nt, Human
agcgacuugacagacauguccu

SEQ ID NO: 160874 - RNA, 22 nt, Human
agcgcccguugagucgcgcggu

SEQ ID NO: 160875 - RNA, 22 nt, Human
agcgcaguuaccgcgcggggcu

SEQ ID NO: 160876 - RNA, 22 nt, Human
agcggcucaggccccgugggcu

SEQ ID NO: 160877 - RNA, 22 nt, Human
agcggugacauccuucugugcu

SEQ ID NO: 160878 - RNA, 22 nt, Human
agcggcaggaagcgcgcaagcg

SEQ ID NO: 160879 - RNA, 22 nt, Human
agcggcaagguguauguggcag

SEQ ID NO: 160880 - RNA, 22 nt, Human
agcggcgcgucuccgagcugga

SEQ ID NO: 160881 - RNA, 19 nt, Human
agcggccgccgcgggcgcc

SEQ ID NO: 160882 - RNA, 22 nt, Human
agcggaggaggcggagcaggga

SEQ ID NO: 160883 - RNA, 19 nt, Human
agcggagguuguauauugu

SEQ ID NO: 160884 - RNA, 22 nt, Human
agcgcucauuuuccuccugcuc

SEQ ID NO: 160885 - RNA, 22 nt, Human
agcgggucaugucggccgccca

SEQ ID NO: 160886 - RNA, 22 nt, Human
agcgucaugugaccagcgcgcc

SEQ ID NO: 160887 - RNA, 22 nt, Human
agcuccugcgcacggugcacac

SEQ ID NO: 160888 - RNA, 20 nt, Human
agcugaauaguuuugugaaa

SEQ ID NO: 160889 - RNA, 22 nt, Human
agcugagccagacagguaagca

SEQ ID NO: 160890 - RNA, 22 nt, Human
agcucggcuguccugugccccu

SEQ ID NO: 160891 - RNA, 22 nt, Human
agcuccauauggcacaccauuu

SEQ ID NO: 160892 - RNA, 22 nt, Human
agcucugcuucuugggaagaug

SEQ ID NO: 160893 - RNA, 19 nt, Human
agcucaggcccaucguccc

SEQ ID NO: 160894 - RNA, 22 nt, Human
agcugcugcaaguggugcuaac

SEQ ID NO: 160895 - RNA, 22 nt, Human
agcugcuggcggauguuggacu

SEQ ID NO: 160896 - RNA, 22 nt, Human
agcugaccugauugcuuuucag

SEQ ID NO: 160897 - RNA, 22 nt, Human
agcugcauguauauucuuaaca

SEQ ID NO: 160898 - RNA, 22 nt, Human
agcucuucugacucuaggcuca

SEQ ID NO: 160899 - RNA, 22 nt, Human
agcucuuccuccauucuggcca

SEQ ID NO: 160900 - RNA, 22 nt, Human
agcugaugucucaccuguuaga

SEQ ID NO: 160901 - RNA, 22 nt, Human
agcuucccaggagaucuccgcc

SEQ ID NO: 160902 - RNA, 22 nt, Human
agcuugcccuuguaccagccag

SEQ ID NO: 160903 - RNA, 20 nt, Human
agcugucccugacacuagga

SEQ ID NO: 160904 - RNA, 22 nt, Human
agcugcuuuacuggucggcugg

SEQ ID NO: 160905 - RNA, 20 nt, Human
agcuggcccccgguggccug

SEQ ID NO: 160906 - RNA, 19 nt, Human
agcugcugauugguggagg

SEQ ID NO: 160907 - RNA, 22 nt, Human
agcugaggccccgcagcagggu

SEQ ID NO: 160908 - RNA, 22 nt, Human
agcuuggcaagcacuguuugag

SEQ ID NO: 160909 - RNA, 20 nt, Human
agcuuucaccaguacuucca

SEQ ID NO: 160910 - RNA, 22 nt, Human
aggacguaacccaggacagccu

SEQ ID NO: 160911 - RNA, 22 nt, Human
aggauagacuucagaaggcaua

SEQ ID NO: 160912 - RNA, 22 nt, Human
aggagacaguuuggacguguag

SEQ ID NO: 160913 - RNA, 22 nt, Human
aggacagagggaccagagccca

SEQ ID NO: 160914 - RNA, 22 nt, Human
aggaagucucucaaaacuggaa

SEQ ID NO: 160915 - RNA, 22 nt, Human
aggagaccugguugugugugug

SEQ ID NO: 160916 - RNA, 22 nt, Human
aggacuggucucuuuucuccaa

SEQ ID NO: 160917 - RNA, 22 nt, Human
aggagaaagaccagccugccga

SEQ ID NO: 160918 - RNA, 22 nt, Human
aggacacuuccugaguggacaa

SEQ ID NO: 160919 - RNA, 22 nt, Human
aggaagagcuggaccagaggac

SEQ ID NO: 160920 - RNA, 20 nt, Human
aggaaggagaaucugagcaa

SEQ ID NO: 160921 - RNA, 23 nt, Human
aggaagucugacacuacagcguu

SEQ ID NO: 160922 - RNA, 22 nt, Human
aggaagccuggaguccugccca

SEQ ID NO: 160923 - RNA, 22 nt, Human
aggaaaaagaagaaaagaauca

SEQ ID NO: 160924 - RNA, 22 nt, Human
agcuugagauaauucaagcuga

SEQ ID NO: 160925 - RNA, 22 nt, Human
aggaaaggcucugugguuccua

SEQ ID NO: 160926 - RNA, 22 nt, Human
agcuggauuaaucacagugacu

SEQ ID NO: 160927 - RNA, 22 nt, Human
agcuggaaucucggcaaagcgu

SEQ ID NO: 160928 - RNA, 22 nt, Human
aggaacaguuucaaagagugaa

SEQ ID NO: 160929 - RNA, 22 nt, Human
agcuucuucugccuugucccug

SEQ ID NO: 160930 - RNA, 22 nt, Human
agcuuccaaagaccaggauuga

SEQ ID NO: 160931 - RNA, 22 nt, Human
agcugugccuauucguggcaag

SEQ ID NO: 160932 - RNA, 22 nt, Human
agguaguagagaacucugcucu

SEQ ID NO: 160933 - RNA, 22 nt, Human
agguagggaggguagaugcucu

SEQ ID NO: 160934 - RNA, 22 nt, Human
aggucggcuuuuuuccuuucac

SEQ ID NO: 160935 - RNA, 22 nt, Human
agguccugucuuaucucuguaa

SEQ ID NO: 160936 - RNA, 22 nt, Human
aggguuugugaagacuuggcca

SEQ ID NO: 160937 - RNA, 22 nt, Human
aggggauggagcuggaaggcag

SEQ ID NO: 160938 - RNA, 22 nt, Human
agggguagaacagaaaccugcc

SEQ ID NO: 160939 - RNA, 22 nt, Human
aggguuuucauauauuauuagu

SEQ ID NO: 160940 - RNA, 22 nt, Human
aggguuugaauccucuuucuua

SEQ ID NO: 160941 - RNA, 22 nt, Human
aggggaguuauuagacagggag

SEQ ID NO: 160942 - RNA, 22 nt, Human
aggggcaaacuuguucuagggu

SEQ ID NO: 160943 - RNA, 22 nt, Human
aggguggaggacaggccaguga

SEQ ID NO: 160944 - RNA, 22 nt, Human
agguaguggaaccaaggcauca

SEQ ID NO: 160945 - RNA, 22 nt, Human
aggggaggggaguaucaggauu

SEQ ID NO: 160946 - RNA, 22 nt, Human
aggggagaagcacuccuugccu

SEQ ID NO: 160947 - RNA, 22 nt, Human
aggggagaguuaaugugaaugu

SEQ ID NO: 160948 - RNA, 19 nt, Human
aggggccugcuuggccuug

SEQ ID NO: 160949 - RNA, 22 nt, Human
aggggcuuguggaguugcuggu

SEQ ID NO: 160950 - RNA, 22 nt, Human
aggggcugugucauuuguccua

SEQ ID NO: 160951 - RNA, 22 nt, Human
aggggaggcugcgggcugccgu

SEQ ID NO: 160952 - RNA, 22 nt, Human
agggcugcugcuccgggcccag

SEQ ID NO: 160953 - RNA, 22 nt, Human
agggcuugggggccuugaaggc

SEQ ID NO: 160954 - RNA, 19 nt, Human
agggagagucccaagagaa

SEQ ID NO: 160955 - RNA, 22 nt, Human
agggaaguucuagggagucugg

SEQ ID NO: 160956 - RNA, 22 nt, Human
agggaagagaaacaaagauuca

SEQ ID NO: 160957 - RNA, 22 nt, Human
agggaagccggagcgacggggg

SEQ ID NO: 160958 - RNA, 22 nt, Human
agggaccgugagcuccuugggg

SEQ ID NO: 160959 - RNA, 22 nt, Human
agggcccauagaucgucagcuu

SEQ ID NO: 160960 - RNA, 22 nt, Human
agggccggggagggcugugggg

SEQ ID NO: 160961 - RNA, 22 nt, Human
agggcgugguggugcuggagca

SEQ ID NO: 160962 - RNA, 22 nt, Human
agggcggucccugagacucucc

SEQ ID NO: 160963 - RNA, 22 nt, Human
agggcccaccuuggugcugagg

SEQ ID NO: 160964 - RNA, 22 nt, Human
aggcugcuggcaggcguggacg

SEQ ID NO: 160965 - RNA, 22 nt, Human
aggcugggaaguguguccugag

SEQ ID NO: 160966 - RNA, 22 nt, Human
aggcugccuaugaaggcagaag

SEQ ID NO: 160967 - RNA, 22 nt, Human
aggcugaagcacacucaugcag

SEQ ID NO: 160968 - RNA, 23 nt, Human
aggcugccacucagggugaggcu

SEQ ID NO: 160969 - RNA, 22 nt, Human
agggaagaggaccagagucucu

SEQ ID NO: 160970 - RNA, 22 nt, Human
aggccugcccuuggggagccuu

SEQ ID NO: 160971 - RNA, 22 nt, Human
aggcgaagggaccagacgguag

SEQ ID NO: 160972 - RNA, 22 nt, Human
aggcgguuggcuuugucugggu

SEQ ID NO: 160973 - RNA, 22 nt, Human
aggcugucucagccugcuugca

SEQ ID NO: 160974 - RNA, 17 nt, Human
agggaaguagggugggc

SEQ ID NO: 160975 - RNA, 22 nt, Human
aggcuucauuacagugguucaa

SEQ ID NO: 160976 - RNA, 22 nt, Human
aggcuuuugcucuggcuccucu

SEQ ID NO: 160977 - RNA, 22 nt, Human
agggagcugcucugcuuccgug

SEQ ID NO: 160978 - RNA, 19 nt, Human
agggaggcaagagaaaugu

SEQ ID NO: 160979 - RNA, 22 nt, Human
aggcgagcgcggccggugcccc

SEQ ID NO: 160980 - RNA, 22 nt, Human
aggccugcuccucuucucaucc

SEQ ID NO: 160981 - RNA, 22 nt, Human
aggccgcuggggcagcgcccga

SEQ ID NO: 160982 - RNA, 22 nt, Human
aggccugaggaccagauaaaug

SEQ ID NO: 160983 - RNA, 22 nt, Human
aggccgguggaggagguggagg

SEQ ID NO: 160984 - RNA, 22 nt, Human
aggcuccucugggggccccgga

SEQ ID NO: 160985 - RNA, 22 nt, Human
aggcguggcuucugcuggguug

SEQ ID NO: 160986 - RNA, 22 nt, Human
aggcggguuuaggacaaugcuu

SEQ ID NO: 160987 - RNA, 22 nt, Human
aggauggauagcaaggaagccg

SEQ ID NO: 160988 - RNA, 22 nt, Human
aggauggaaguaacuggauaau

SEQ ID NO: 160989 - RNA, 22 nt, Human
aggacccacccugugaaaguuc

SEQ ID NO: 160990 - RNA, 22 nt, Human
aggagcauuuugguggguuuug

SEQ ID NO: 160991 - RNA, 22 nt, Human
aggagcccggucgucaugguaa

SEQ ID NO: 160992 - RNA, 22 nt, Human
aggagcugccggauggggcaug

SEQ ID NO: 160993 - RNA, 16 nt, Human
aggagcagaaagcagu

SEQ ID NO: 160994 - RNA, 22 nt, Human
aggagcacugggcaugucaccc

SEQ ID NO: 160995 - RNA, 22 nt, Human
aggaggcguuugcuaaacgggc

SEQ ID NO: 160996 - RNA, 22 nt, Human
aggaggcucucagguccucccc

SEQ ID NO: 160997 - RNA, 22 nt, Human
aggaggaggacucgccaggcca

SEQ ID NO: 160998 - RNA, 22 nt, Human
aggcccugcugaggccucccuc

SEQ ID NO: 160999 - RNA, 22 nt, Human
agguggcguauguguucguguu

SEQ ID NO: 161000 - RNA, 22 nt, Human
aggugggcuuagaaaucuguau

SEQ ID NO: 161001 - RNA, 22 nt, Human
agguggggacuccaccgaugcu

SEQ ID NO: 161002 - RNA, 22 nt, Human
agguggugacgaugcuccguac

SEQ ID NO: 161003 - RNA, 22 nt, Human
aggugggucgcaggcaucagug

SEQ ID NO: 161004 - RNA, 22 nt, Human
aggucugcccaggaugcugcuu

SEQ ID NO: 161005 - RNA, 21 nt, Human
aggugaaggcgagggggacag

SEQ ID NO: 161006 - RNA, 22 nt, Human
aggugcuugcauacugcuugac

SEQ ID NO: 161007 - RNA, 22 nt, Human
aggugcccucucuggcuccucc

SEQ ID NO: 161008 - RNA, 22 nt, Human
aggugcauuuacuuggggcccu

SEQ ID NO: 161009 - RNA, 22 nt, Human
aguaucugccagaaucucaguu

SEQ ID NO: 161010 - RNA, 21 nt, Human
agucaagcugccugcuuggca

SEQ ID NO: 161011 - RNA, 22 nt, Human
agucaagguggaccagaaaaau

SEQ ID NO: 161012 - RNA, 22 nt, Human
aguccagggcuuagucagcggg

SEQ ID NO: 161013 - RNA, 22 nt, Human
agucggguugcagacacauccu

SEQ ID NO: 161014 - RNA, 22 nt, Human
agucccugauggacuggaugag

SEQ ID NO: 161015 - RNA, 22 nt, Human
auacuuccuuaauuuggggaaa

SEQ ID NO: 161016 - RNA, 22 nt, Human
agugacauuauuuuguguacua

SEQ ID NO: 161017 - RNA, 19 nt, Human
auagagggaauguuuuccu

SEQ ID NO: 161018 - RNA, 22 nt, Human
auaggcggagccauaucaucca

SEQ ID NO: 161019 - RNA, 22 nt, Human
auagaagguaaugccccaaggg

SEQ ID NO: 161020 - RNA, 22 nt, Human
auaggggagcagccagagaaga

SEQ ID NO: 161021 - RNA, 22 nt, Human
auagauuuuaucagauuuuauc

SEQ ID NO: 161022 - RNA, 22 nt, Human
auauccugguucuaucaaaagg

SEQ ID NO: 161023 - RNA, 22 nt, Human
auccucucugugacagggaacg

SEQ ID NO: 161024 - RNA, 22 nt, Human
auccucugcucaugagaaaugu

SEQ ID NO: 161025 - RNA, 18 nt, Human
auccccagucccuggaau

SEQ ID NO: 161026 - RNA, 22 nt, Human
auccaggguuggggucacgagu

SEQ ID NO: 161027 - RNA, 22 nt, Human
auccuccuuugcccugagauca

SEQ ID NO: 161028 - RNA, 22 nt, Human
aucauaccaguuuccaucagga

SEQ ID NO: 161029 - RNA, 22 nt, Human
auccacccugcaggccaacucu

SEQ ID NO: 161030 - RNA, 22 nt, Human
aucaucuaaaauuggcucagau

SEQ ID NO: 161031 - RNA, 22 nt, Human
aucaugggauagugggacgagc

SEQ ID NO: 161032 - RNA, 22 nt, Human
aucccuggccacgaagcugccc

SEQ ID NO: 161033 - RNA, 22 nt, Human
aucgcagaguggaaauugauga

SEQ ID NO: 161034 - RNA, 22 nt, Human
aucuacuuugggaguuucucuu

SEQ ID NO: 161035 - RNA, 22 nt, Human
auccuccuggggcagucuuccc

SEQ ID NO: 161036 - RNA, 22 nt, Human
auccgugagcgagcgagcaccc

SEQ ID NO: 161037 - RNA, 20 nt, Human
auccuggucuuuggaagcuu

SEQ ID NO: 161038 - RNA, 22 nt, Human
auccuggcuuuccugauuuacu

SEQ ID NO: 161039 - RNA, 22 nt, Human
auccacggucaauuccccaucc

SEQ ID NO: 161040 - RNA, 22 nt, Human
auccaggggucugaauggauau

SEQ ID NO: 161041 - RNA, 22 nt, Human
aucauccuagaaggaagcuagg

SEQ ID NO: 161042 - RNA, 21 nt, Human
aucagaggacaucucagggcc

SEQ ID NO: 161043 - RNA, 22 nt, Human
aucaacacuguuggcggggacc

SEQ ID NO: 161044 - RNA, 22 nt, Human
aucaacucacagugugcuggca

SEQ ID NO: 161045 - RNA, 22 nt, Human
aucaagacaaaggaaaggcuaa

SEQ ID NO: 161046 - RNA, 20 nt, Human
aucaagugucuugccaggca

SEQ ID NO: 161047 - RNA, 22 nt, Human
augugaacuccagcugccaacc

SEQ ID NO: 161048 - RNA, 22 nt, Human
auggucugcucagucucuugac

SEQ ID NO: 161049 - RNA, 22 nt, Human
auggcuucugucuuggaaauuu

SEQ ID NO: 161050 - RNA, 22 nt, Human
auggccguggccagggucaggg

SEQ ID NO: 161051 - RNA, 19 nt, Human
augggaagcggccagcgga

SEQ ID NO: 161052 - RNA, 22 nt, Human
auggccugaagcuaaccccccu

SEQ ID NO: 161053 - RNA, 22 nt, Human
auggccuguuuccucugaaaga

SEQ ID NO: 161054 - RNA, 20 nt, Human
auggcgagucagcacaaaac

SEQ ID NO: 161055 - RNA, 22 nt, Human
auggcuguguuguuccucugaa

SEQ ID NO: 161056 - RNA, 19 nt, Human
auguucugaauuacuguaa

SEQ ID NO: 161057 - RNA, 18 nt, Human
auguuccugcaguuauuu

SEQ ID NO: 161058 - RNA, 22 nt, Human
auguuccaugacuaugcaugaa

SEQ ID NO: 161059 - RNA, 22 nt, Human
auguccugguccacagaaggga

SEQ ID NO: 161060 - RNA, 22 nt, Human
auuccagggaaauggggaugga

SEQ ID NO: 161061 - RNA, 22 nt, Human
auucccagucccucccaccccu

SEQ ID NO: 161062 - RNA, 22 nt, Human
aucuacuaagugccaagcacag

SEQ ID NO: 161063 - RNA, 19 nt, Human
augagccccaguucguucc

SEQ ID NO: 161064 - RNA, 22 nt, Human
aucuucaggggcaauggagaua

SEQ ID NO: 161065 - RNA, 22 nt, Human
aucugggaaggggaaaaugcug

SEQ ID NO: 161066 - RNA, 14 nt, Human
augauuucugggaa

SEQ ID NO: 161067 - RNA, 22 nt, Human
augcagaaucucuuuccugagg

SEQ ID NO: 161068 - RNA, 22 nt, Human
augagcuaagcagaaagcacac

SEQ ID NO: 161069 - RNA, 22 nt, Human
augauuaagguacgucauuucu

SEQ ID NO: 161070 - RNA, 22 nt, Human
augaucaagaauuuuguauucc

SEQ ID NO: 161071 - RNA, 22 nt, Human
augcggcugugggggaauggga

SEQ ID NO: 161072 - RNA, 21 nt, Human
augcgcgguggagugagcgaa

SEQ ID NO: 161073 - RNA, 22 nt, Human
augccgggguggcuccagcacc

SEQ ID NO: 161074 - RNA, 22 nt, Human
augccucuugagagccagugcu

SEQ ID NO: 161075 - RNA, 22 nt, Human
augcugcuccuuuucaggcauu

SEQ ID NO: 161076 - RNA, 22 nt, Human
augcugcuuguccauuuauuug

SEQ ID NO: 161077 - RNA, 22 nt, Human
auggccuuucucaguggugcuu

SEQ ID NO: 161078 - RNA, 22 nt, Human
augcuugaaaguuauuucauuu

SEQ ID NO: 161079 - RNA, 18 nt, Human
augcugacacaaugugga

SEQ ID NO: 161080 - RNA, 22 nt, Human
augcucggcuuucuuucuuucu

SEQ ID NO: 161081 - RNA, 22 nt, Human
augccugcugucaggaacucuu

SEQ ID NO: 161082 - RNA, 22 nt, Human
augcccugggagugcuguacca

SEQ ID NO: 161083 - RNA, 22 nt, Human
augcaccugucuuuuaaggaua

SEQ ID NO: 161084 - RNA, 22 nt, Human
augcagcggucagaggaacuca

SEQ ID NO: 161085 - RNA, 22 nt, Human
augccugggcuuuaggguucuc

SEQ ID NO: 161086 - RNA, 22 nt, Human
augcgcugugcacacucuuaac

SEQ ID NO: 161087 - RNA, 22 nt, Human
augcacuccucagcuguucugg

SEQ ID NO: 161088 - RNA, 22 nt, Human
augcagagacugugggaaagca

SEQ ID NO: 161089 - RNA, 22 nt, Human
augcucuggucucuucuuuccu

SEQ ID NO: 161090 - RNA, 20 nt, Human
cacagcugacgaguauccaa

SEQ ID NO: 161091 - RNA, 22 nt, Human
caagaaccuagcgaucagguaa

SEQ ID NO: 161092 - RNA, 22 nt, Human
cacacagcuagugacaggagaa

SEQ ID NO: 161093 - RNA, 22 nt, Human
cacagcagcaucauuuaucugg

SEQ ID NO: 161094 - RNA, 22 nt, Human
cacagcaggcagaacgugggca

SEQ ID NO: 161095 - RNA, 22 nt, Human
cacagccaagacuuggccccau

SEQ ID NO: 161096 - RNA, 22 nt, Human
caagaugcaagaccagucaggc

SEQ ID NO: 161097 - RNA, 22 nt, Human
caagccacugggagcugcacac

SEQ ID NO: 161098 - RNA, 22 nt, Human
caagcacaauuucuacauguua

SEQ ID NO: 161099 - RNA, 22 nt, Human
caagcgcgccgcuuccuuccgc

SEQ ID NO: 161100 - RNA, 22 nt, Human
cacaguccugcauuuacugccu

SEQ ID NO: 161101 - RNA, 22 nt, Human
cacagcuggggaagcugaggcc

SEQ ID NO: 161102 - RNA, 22 nt, Human
cacaugugugugccuacaugca

SEQ ID NO: 161103 - RNA, 22 nt, Human
caaggaaaugucagaaaggcaa

SEQ ID NO: 161104 - RNA, 22 nt, Human
caccaucagacuucugggcagg

SEQ ID NO: 161105 - RNA, 22 nt, Human
caccaccaguaccaucacacgc

SEQ ID NO: 161106 - RNA, 22 nt, Human
caaggucagacagccaggacag

SEQ ID NO: 161107 - RNA, 22 nt, Human
caagguugugacccaaugacca

SEQ ID NO: 161108 - RNA, 22 nt, Human
caccuggaggcagcaccgggcu

SEQ ID NO: 161109 - RNA, 20 nt, Human
caccggguugcugguuucuu

SEQ ID NO: 161110 - RNA, 22 nt, Human
caccgagagccacuuccggaac

SEQ ID NO: 161111 - RNA, 22 nt, Human
cacccugacuggcccugcagga

SEQ ID NO: 161112 - RNA, 22 nt, Human
caauccccaggucccagaacag

SEQ ID NO: 161113 - RNA, 22 nt, Human
caaagaagagauuuacagagcu

SEQ ID NO: 161114 - RNA, 22 nt, Human
caagaaaaaacaugaugagugu

SEQ ID NO: 161115 - RNA, 22 nt, Human
caagagcuuuagaaaugcucau

SEQ ID NO: 161116 - RNA, 22 nt, Human
caagaaguugacagccagguga

SEQ ID NO: 161117 - RNA, 22 nt, Human
caaguaugagaaagcuauuacc

SEQ ID NO: 161118 - RNA, 22 nt, Human
caaggaguuuggggaccaagga

SEQ ID NO: 161119 - RNA, 22 nt, Human
caagggcagaggcagggccccg

SEQ ID NO: 161120 - RNA, 22 nt, Human
caaggguguacagauaugagag

SEQ ID NO: 161121 - RNA, 22 nt, Human
caagagcgugugcagggcaagu

SEQ ID NO: 161122 - RNA, 22 nt, Human
caaaggagcccuuugccggguu

SEQ ID NO: 161123 - RNA, 22 nt, Human
caacuucuauucagucugcagu

SEQ ID NO: 161124 - RNA, 22 nt, Human
caauugcuuccuucuguaagua

SEQ ID NO: 161125 - RNA, 22 nt, Human
cacacaccagaaagccugggac

SEQ ID NO: 161126 - RNA, 23 nt, Human
auuuuuccacacacagacucagu

SEQ ID NO: 161127 - RNA, 22 nt, Human
auuuuucuuucacauuuucuua

SEQ ID NO: 161128 - RNA, 22 nt, Human
auuuuucucucaugugcaacua

SEQ ID NO: 161129 - RNA, 22 nt, Human
auuuuuuuaggcugucagccgc

SEQ ID NO: 161130 - RNA, 22 nt, Human
caaccaguagcugaguucaaaa

SEQ ID NO: 161131 - RNA, 22 nt, Human
caacguggauucuuccaggggc

SEQ ID NO: 161132 - RNA, 17 nt, Human
caaccaggaaaggaggg

SEQ ID NO: 161133 - RNA, 22 nt, Human
caaaacccaagugcuauugcaa

SEQ ID NO: 161134 - RNA, 22 nt, Human
caaagccuggggagaguaagga

SEQ ID NO: 161135 - RNA, 22 nt, Human
caaagaugccaaaaggaagaca

SEQ ID NO: 161136 - RNA, 22 nt, Human
auuuccagcagcauauuugucu

SEQ ID NO: 161137 - RNA, 22 nt, Human
auuuuaccauuaguuuguaaua

SEQ ID NO: 161138 - RNA, 22 nt, Human
auuuaggacagugucugaauug

SEQ ID NO: 161139 - RNA, 22 nt, Human
auuggcugucagcccggauggg

SEQ ID NO: 161140 - RNA, 22 nt, Human
auuguuuugugaaacauaguga

SEQ ID NO: 161141 - RNA, 22 nt, Human
cagugcaacguugugcauucaa

SEQ ID NO: 161142 - RNA, 22 nt, Human
cagugccggccaggaccuccug

SEQ ID NO: 161143 - RNA, 22 nt, Human
caguccaugaugacuuuugcuc

SEQ ID NO: 161144 - RNA, 22 nt, Human
caucugcagccucugcauuccc

SEQ ID NO: 161145 - RNA, 22 nt, Human
cagugcuggaggggugcuugca

SEQ ID NO: 161146 - RNA, 22 nt, Human
cagugcuccugccccugcccuu

SEQ ID NO: 161147 - RNA, 20 nt, Human
caugaugcaaacaguaacgu

SEQ ID NO: 161148 - RNA, 21 nt, Human
caguucuaagugucaucuuuu

SEQ ID NO: 161149 - RNA, 22 nt, Human
caugaccauuuggguuugugcg

SEQ ID NO: 161150 - RNA, 22 nt, Human
caugcgucugcauuggguggug

SEQ ID NO: 161151 - RNA, 22 nt, Human
caugccugaucagcggccagca

SEQ ID NO: 161152 - RNA, 22 nt, Human
caugccaguagccggcuugacu

SEQ ID NO: 161153 - RNA, 22 nt, Human
caugcuucccacauuccgauuu

SEQ ID NO: 161154 - RNA, 19 nt, Human
cauggcgguaaagaggcug

SEQ ID NO: 161155 - RNA, 22 nt, Human
caugguacugccacagaagagu

SEQ ID NO: 161156 - RNA, 22 nt, Human
cauguauguuaguggcugcuuu

SEQ ID NO: 161157 - RNA, 19 nt, Human
caggggcuuaugcgaccuc

SEQ ID NO: 161158 - RNA, 22 nt, Human
cauccagcuccugggggccacc

SEQ ID NO: 161159 - RNA, 22 nt, Human
caggccccagggacugggcgcu

SEQ ID NO: 161160 - RNA, 22 nt, Human
cagggacgugagccaugucagu

SEQ ID NO: 161161 - RNA, 22 nt, Human
cagggacugcaggaggacaggu

SEQ ID NO: 161162 - RNA, 22 nt, Human
caggcgcauggugagcagauga

SEQ ID NO: 161163 - RNA, 22 nt, Human
caggcgcugacgggaccgggcu

SEQ ID NO: 161164 - RNA, 22 nt, Human
cagggcagaguuaagaugcugg

SEQ ID NO: 161165 - RNA, 22 nt, Human
cagggcacaguuauggaggugg

SEQ ID NO: 161166 - RNA, 22 nt, Human
cagggagguuggauuggggccu

SEQ ID NO: 161167 - RNA, 22 nt, Human
cagggccaggccucaggggcgc

SEQ ID NO: 161168 - RNA, 22 nt, Human
caggggaagccagcugccaugu

SEQ ID NO: 161169 - RNA, 21 nt, Human
caggccaaaagguucaacauu

SEQ ID NO: 161170 - RNA, 23 nt, Human
cagucgacugugcccucccgagc

SEQ ID NO: 161171 - RNA, 22 nt, Human
caguaugagcacagugccugga

SEQ ID NO: 161172 - RNA, 22 nt, Human
cagggggcccagcugggagggg

SEQ ID NO: 161173 - RNA, 22 nt, Human
caggucagcacuuggaggugca

SEQ ID NO: 161174 - RNA, 22 nt, Human
caggucauaacuaugcaugaac

SEQ ID NO: 161175 - RNA, 19 nt, Human
caggucuucuuggaggacu

SEQ ID NO: 161176 - RNA, 22 nt, Human
cagagcugagucuucaagguug

SEQ ID NO: 161177 - RNA, 22 nt, Human
cacaagacuaaguggcagagca

SEQ ID NO: 161178 - RNA, 22 nt, Human
cagagcagaaaccugggugauu

SEQ ID NO: 161179 - RNA, 22 nt, Human
cagagccagcuguccuuggcau

SEQ ID NO: 161180 - RNA, 22 nt, Human
cacaaggagaaauagauauuga

SEQ ID NO: 161181 - RNA, 22 nt, Human
cagaggagcgaguuggacgcca

SEQ ID NO: 161182 - RNA, 22 nt, Human
cagagggagcuaaccagcagcc

SEQ ID NO: 161183 - RNA, 22 nt, Human
cagaggaugucuacaccuugag

SEQ ID NO: 161184 - RNA, 22 nt, Human
cagccccagcacuuagcugagu

SEQ ID NO: 161185 - RNA, 22 nt, Human
cagcccaucaaggggauccuga

SEQ ID NO: 161186 - RNA, 22 nt, Human
cagaggcugagcugcgggauga

SEQ ID NO: 161187 - RNA, 22 nt, Human
cagaggcugggugggguggggg

SEQ ID NO: 161188 - RNA, 22 nt, Human
cagcugacaagaguccuuggag

SEQ ID NO: 161189 - RNA, 22 nt, Human
cagcugcgcagcgccgggccug

SEQ ID NO: 161190 - RNA, 22 nt, Human
cagcuggaggagcagcuuccag

SEQ ID NO: 161191 - RNA, 22 nt, Human
cagaucacauccauccgucacc

SEQ ID NO: 161192 - RNA, 22 nt, Human
cagcugcugguguaucgggucc

SEQ ID NO: 161193 - RNA, 22 nt, Human
cagcuccagcccaggcagcucc

SEQ ID NO: 161194 - RNA, 22 nt, Human
cagcucuggcuauugaggacca

SEQ ID NO: 161195 - RNA, 22 nt, Human
cagcucugcugggaggaugcag

SEQ ID NO: 161196 - RNA, 22 nt, Human
cagcaugguggagcugcucuuu

SEQ ID NO: 161197 - RNA, 22 nt, Human
cagcccaggcucagauguuggg

SEQ ID NO: 161198 - RNA, 22 nt, Human
cagacagaaggcuccuugaggu

SEQ ID NO: 161199 - RNA, 22 nt, Human
cagcauggagacaaagugggca

SEQ ID NO: 161200 - RNA, 22 nt, Human
cagcaugcaaguccagaugugg

SEQ ID NO: 161201 - RNA, 22 nt, Human
cagaaaacauuguguguauaag

SEQ ID NO: 161202 - RNA, 22 nt, Human
cagcuggggagagacauggcag

SEQ ID NO: 161203 - RNA, 22 nt, Human
cagcacugcccuaccccuccac

SEQ ID NO: 161204 - RNA, 22 nt, Human
cagaucacucugggcggcggga

SEQ ID NO: 161205 - RNA, 22 nt, Human
cagccuacaucagaauaccaau

SEQ ID NO: 161206 - RNA, 22 nt, Human
cagcccuguugcgcuuccggcg

SEQ ID NO: 161207 - RNA, 22 nt, Human
cagcuucuccauucuucuggcu

SEQ ID NO: 161208 - RNA, 22 nt, Human
cagccagaucgccuuccgccuc

SEQ ID NO: 161209 - RNA, 22 nt, Human
cagcuuaccucccacagcucuc

SEQ ID NO: 161210 - RNA, 22 nt, Human
cagcuguggagauggggugcau

SEQ ID NO: 161211 - RNA, 22 nt, Human
cagccauucuaacacugccagu

SEQ ID NO: 161212 - RNA, 22 nt, Human
caggcagagagggcagugugga

SEQ ID NO: 161213 - RNA, 22 nt, Human
caggcaggagaaaaggcgcggg

SEQ ID NO: 161214 - RNA, 22 nt, Human
caggcagggagcuggaaaggau

SEQ ID NO: 161215 - RNA, 22 nt, Human
caggccacagcuaaagaggauu

SEQ ID NO: 161216 - RNA, 22 nt, Human
caggccagcuggaggggcagcu

SEQ ID NO: 161217 - RNA, 22 nt, Human
caggcagggcugccuucugcuu

SEQ ID NO: 161218 - RNA, 22 nt, Human
cagcuccaucuugcuuauacca

SEQ ID NO: 161219 - RNA, 22 nt, Human
caggaagucugaauucugagag

SEQ ID NO: 161220 - RNA, 22 nt, Human
cagcuauggaauuggcccagau

SEQ ID NO: 161221 - RNA, 22 nt, Human
cagcucgaauaauggagaacug

SEQ ID NO: 161222 - RNA, 22 nt, Human
cagcucuccacccuccugguuc

SEQ ID NO: 161223 - RNA, 22 nt, Human
cagggcuugaaucaaggaaguc

SEQ ID NO: 161224 - RNA, 22 nt, Human
cagggccagggcuauggugaag

SEQ ID NO: 161225 - RNA, 22 nt, Human
cagggcaucucugaaucuucac

SEQ ID NO: 161226 - RNA, 22 nt, Human
caggggacacuccugcuugggc

SEQ ID NO: 161227 - RNA, 22 nt, Human
cagggcuuuuuccuccucuuug

SEQ ID NO: 161228 - RNA, 22 nt, Human
caggggcuccaggugagccugg

SEQ ID NO: 161229 - RNA, 22 nt, Human
caggggcuuuccuguuuaugga

SEQ ID NO: 161230 - RNA, 22 nt, Human
caggggucccccggcucccugg

SEQ ID NO: 161231 - RNA, 22 nt, Human
caggaaaauaauggugauggga

SEQ ID NO: 161232 - RNA, 22 nt, Human
cagggugaagaugcgccuccug

SEQ ID NO: 161233 - RNA, 18 nt, Human
cucuggacagcaggcauc

SEQ ID NO: 161234 - RNA, 22 nt, Human
cuguauggaggaggugcuagcc

SEQ ID NO: 161235 - RNA, 17 nt, Human
cucugggucuccugcuu

SEQ ID NO: 161236 - RNA, 19 nt, Human
cucuggcuccugggcugcc

SEQ ID NO: 161237 - RNA, 22 nt, Human
cucggcccuggucuuacgggac

SEQ ID NO: 161238 - RNA, 22 nt, Human
cucugagcucgugcaguacuuc

SEQ ID NO: 161239 - RNA, 22 nt, Human
cuguggcuaggaagcuguggga

SEQ ID NO: 161240 - RNA, 22 nt, Human
cuguggcugcgcccugggggag

SEQ ID NO: 161241 - RNA, 22 nt, Human
cugugaaugguggccacgcguu

SEQ ID NO: 161242 - RNA, 22 nt, Human
cucuucauuauucacgcccugu

SEQ ID NO: 161243 - RNA, 22 nt, Human
cugugugcagggcacaauggaa

SEQ ID NO: 161244 - RNA, 22 nt, Human
cugaaucaaaugacuuagccau

SEQ ID NO: 161245 - RNA, 22 nt, Human
cugaccucuaaguaacagagaa

SEQ ID NO: 161246 - RNA, 20 nt, Human
cugaccagcagccugucucc

SEQ ID NO: 161247 - RNA, 19 nt, Human
cugacccaacauuaguuca

SEQ ID NO: 161248 - RNA, 20 nt, Human
cugaauaccacagagccauc

SEQ ID NO: 161249 - RNA, 22 nt, Human
cugagcuauauauuaugcauag

SEQ ID NO: 161250 - RNA, 22 nt, Human
cugagcggugagggcauacagc

SEQ ID NO: 161251 - RNA, 22 nt, Human
cugaguuuuucaaaucugaauu

SEQ ID NO: 161252 - RNA, 22 nt, Human
cugagcuuuucucugcuucuua

SEQ ID NO: 161253 - RNA, 19 nt, Human
cugagcagggaaaaacccu

SEQ ID NO: 161254 - RNA, 22 nt, Human
cugagaucaugggucagguggu

SEQ ID NO: 161255 - RNA, 22 nt, Human
cuggaaagauuuacacggggaa

SEQ ID NO: 161256 - RNA, 22 nt, Human
cugagaaauacccaagucuggu

SEQ ID NO: 161257 - RNA, 22 nt, Human
cugaccugugagcuaugccggc

SEQ ID NO: 161258 - RNA, 22 nt, Human
cuggaagcgucggaggaagggc

SEQ ID NO: 161259 - RNA, 22 nt, Human
cuggagaucaguuggacaacag

SEQ ID NO: 161260 - RNA, 22 nt, Human
cuggagaagagguaguauguag

SEQ ID NO: 161261 - RNA, 22 nt, Human
cuggagaacucugugcuucacu

SEQ ID NO: 161262 - RNA, 22 nt, Human
cuggaugucugggaggcuuccc

SEQ ID NO: 161263 - RNA, 22 nt, Human
cuggaugagcuucgugcgcacg

SEQ ID NO: 161264 - RNA, 22 nt, Human
cuggcagcucugagucccuucu

SEQ ID NO: 161265 - RNA, 22 nt, Human
cucaugcugcaaauggcuguuu

SEQ ID NO: 161266 - RNA, 22 nt, Human
cuggcccugucagcacagaauc

SEQ ID NO: 161267 - RNA, 22 nt, Human
cuccucguccucuucauccucu

SEQ ID NO: 161268 - RNA, 22 nt, Human
cugggaccugugugccugggcc

SEQ ID NO: 161269 - RNA, 22 nt, Human
cucgccugacucggaugggcug

SEQ ID NO: 161270 - RNA, 22 nt, Human
cucggaggaccuguuuuaugca

SEQ ID NO: 161271 - RNA, 22 nt, Human
cuggggccccagcucggccccu

SEQ ID NO: 161272 - RNA, 22 nt, Human
cuccucccagcccaggcgccac

SEQ ID NO: 161273 - RNA, 22 nt, Human
cugggaaggaagggaaaaacag

SEQ ID NO: 161274 - RNA, 22 nt, Human
cuccggggacgcagucgccgcc

SEQ ID NO: 161275 - RNA, 21 nt, Human
cugggaacccgaccaaggccu

SEQ ID NO: 161276 - RNA, 22 nt, Human
cuccaggcccagggccaagagc

SEQ ID NO: 161277 - RNA, 22 nt, Human
cuccaggacugaggacagagcu

SEQ ID NO: 161278 - RNA, 22 nt, Human
cugcugccagcuuaauacucac

SEQ ID NO: 161279 - RNA, 22 nt, Human
cugcugcuugauugcaggaagu

SEQ ID NO: 161280 - RNA, 22 nt, Human
cugcuggugcugcccacacggu

SEQ ID NO: 161281 - RNA, 22 nt, Human
cugcugugcagacagacucucu

SEQ ID NO: 161282 - RNA, 22 nt, Human
cuuggugcgaagagucagggga

SEQ ID NO: 161283 - RNA, 22 nt, Human
cugcuguuuuccccaccaucuc

SEQ ID NO: 161284 - RNA, 22 nt, Human
cugcuguuuucugggcuucuua

SEQ ID NO: 161285 - RNA, 22 nt, Human
cugcuugguuuggagggcccac

SEQ ID NO: 161286 - RNA, 22 nt, Human
cugcggcaccaaccccuucaug

SEQ ID NO: 161287 - RNA, 22 nt, Human
cugcgcagaucugcuguucucu

SEQ ID NO: 161288 - RNA, 22 nt, Human
cugcgguucuguuuaguggcga

SEQ ID NO: 161289 - RNA, 22 nt, Human
cugcucugagaggcucuuccua

SEQ ID NO: 161290 - RNA, 22 nt, Human
cugcuacgguguccgguggggc

SEQ ID NO: 161291 - RNA, 21 nt, Human
cugcugaaggaaccccaugga

SEQ ID NO: 161292 - RNA, 22 nt, Human
cuuuccugaaaucucuucugca

SEQ ID NO: 161293 - RNA, 22 nt, Human
cuuucucucaaacacacauaca

SEQ ID NO: 161294 - RNA, 22 nt, Human
cuuguuaacaauugguaucuuu

SEQ ID NO: 161295 - RNA, 23 nt, Human
cuggacauucgcaaaguucaucu

SEQ ID NO: 161296 - RNA, 22 nt, Human
cuugugggaucuggagacaccg

SEQ ID NO: 161297 - RNA, 22 nt, Human
cuucauguucaugcuaacauuu

SEQ ID NO: 161298 - RNA, 22 nt, Human
cugcacuggguacauagaaaca

SEQ ID NO: 161299 - RNA, 22 nt, Human
cuucaguuaguuucaugugagc

SEQ ID NO: 161300 - RNA, 22 nt, Human
cugauguuuaucucaagaguuc

SEQ ID NO: 161301 - RNA, 22 nt, Human
cugauggagagugugauuuggg

SEQ ID NO: 161302 - RNA, 21 nt, Human
cugcacugugauuuaaaaugu

SEQ ID NO: 161303 - RNA, 22 nt, Human
cugcagauguagcugcuuuccu

SEQ ID NO: 161304 - RNA, 22 nt, Human
cugcaguguccgcuugcucagc

SEQ ID NO: 161305 - RNA, 23 nt, Human
cuucggcgcucgcugggcggagg

SEQ ID NO: 161306 - RNA, 22 nt, Human
cugccaggagaggccagggccc

SEQ ID NO: 161307 - RNA, 21 nt, Human
cuucgcuguuccagcucuugg

SEQ ID NO: 161308 - RNA, 22 nt, Human
cuucuuuccauguguuuugguu

SEQ ID NO: 161309 - RNA, 22 nt, Human
cuucuuucuuuucuucuucucu

SEQ ID NO: 161310 - RNA, 22 nt, Human
cugccggcugcugcagagaggu

SEQ ID NO: 161311 - RNA, 22 nt, Human
cugccuggggaaugugaggauu

SEQ ID NO: 161312 - RNA, 22 nt, Human
cugcccgcaugcaggaaugcug

SEQ ID NO: 161313 - RNA, 22 nt, Human
cugcccugcagcuccacggacu

SEQ ID NO: 161314 - RNA, 22 nt, Human
cuugcagccuggagcucagccu

SEQ ID NO: 161315 - RNA, 22 nt, Human
cuugccuuugaaagcauuucuc

SEQ ID NO: 161316 - RNA, 22 nt, Human
cugccuuggcccuaguucaugg

SEQ ID NO: 161317 - RNA, 22 nt, Human
cuugccagggacucagucaggg

SEQ ID NO: 161318 - RNA, 20 nt, Human
gagaggguuaggauauuugc

SEQ ID NO: 161319 - RNA, 22 nt, Human
gagaggcugagcaguccggguu

SEQ ID NO: 161320 - RNA, 22 nt, Human
gagagcugucagcguagcaccg

SEQ ID NO: 161321 - RNA, 22 nt, Human
gagaggaagugccugcucccag

SEQ ID NO: 161322 - RNA, 22 nt, Human
gagagguuaucugcuaagguag

SEQ ID NO: 161323 - RNA, 22 nt, Human
gagagugggagauuuccagcag

SEQ ID NO: 161324 - RNA, 22 nt, Human
gagcagccugaggauucugcuc

SEQ ID NO: 161325 - RNA, 22 nt, Human
gagcagcucgagaaggaagcag

SEQ ID NO: 161326 - RNA, 22 nt, Human
gagcagcacagaccaaacagaa

SEQ ID NO: 161327 - RNA, 22 nt, Human
gagcaggucuuugguaaugcuu

SEQ ID NO: 161328 - RNA, 22 nt, Human
gaagaggaagaggagccagagc

SEQ ID NO: 161329 - RNA, 22 nt, Human
gaagaugacaucggaucugucu

SEQ ID NO: 161330 - RNA, 22 nt, Human
gagcaggcuggcagggccaggg

SEQ ID NO: 161331 - RNA, 22 nt, Human
gagcaggucucaguucugccuc

SEQ ID NO: 161332 - RNA, 22 nt, Human
gacuggucuuuugugauggaug

SEQ ID NO: 161333 - RNA, 22 nt, Human
gaaaaagagaaggaguucagua

SEQ ID NO: 161334 - RNA, 22 nt, Human
gaaaaggaggggaggcagaugg

SEQ ID NO: 161335 - RNA, 22 nt, Human
gaaaagaaggcaggagcccaag

SEQ ID NO: 161336 - RNA, 22 nt, Human
gagaagugaauaacgaagcagg

SEQ ID NO: 161337 - RNA, 22 nt, Human
cuuuacauuaauuucuacugau

SEQ ID NO: 161338 - RNA, 20 nt, Human
gacaugagggagcaaagagc

SEQ ID NO: 161339 - RNA, 21 nt, Human
cuuuucuagucccagccccgc

SEQ ID NO: 161340 - RNA, 22 nt, Human
gacggggcagccagcugguggc

SEQ ID NO: 161341 - RNA, 22 nt, Human
gacgacgggccccguggccacc

SEQ ID NO: 161342 - RNA, 19 nt, Human
gacuccugagaugugaaac

SEQ ID NO: 161343 - RNA, 22 nt, Human
cuuuuucuuaucuuuuucuaug

SEQ ID NO: 161344 - RNA, 22 nt, Human
cuuuuucuugugguuaauaucu

SEQ ID NO: 161345 - RNA, 22 nt, Human
cuucuggaggcugcagaaaaga

SEQ ID NO: 161346 - RNA, 22 nt, Human
cuucuucaucuuuuggaggaac

SEQ ID NO: 161347 - RNA, 22 nt, Human
cuucccuacuucagugcucccu

SEQ ID NO: 161348 - RNA, 22 nt, Human
cuuccagugcauagguagauca

SEQ ID NO: 161349 - RNA, 22 nt, Human
gaaggcaguaaauggcuguuuu

SEQ ID NO: 161350 - RNA, 22 nt, Human
gaaggaagcugucuggaugugu

SEQ ID NO: 161351 - RNA, 22 nt, Human
gaaggagaggauugugaggcug

SEQ ID NO: 161352 - RNA, 22 nt, Human
cuucauccguaccacggccaca

SEQ ID NO: 161353 - RNA, 22 nt, Human
gaagcuucucaacugguggaau

SEQ ID NO: 161354 - RNA, 22 nt, Human
gaagcggguucacuggauggcu

SEQ ID NO: 161355 - RNA, 22 nt, Human
gaagcccuggaggggcuggagg

SEQ ID NO: 161356 - RNA, 22 nt, Human
cuucuugucagugauuucuucc

SEQ ID NO: 161357 - RNA, 22 nt, Human
cuugcugggagagcuuuagaga

SEQ ID NO: 161358 - RNA, 22 nt, Human
gaauggagaacccuggacacug

SEQ ID NO: 161359 - RNA, 22 nt, Human
gaaugccugggguucuucgauc

SEQ ID NO: 161360 - RNA, 22 nt, Human
cuuggugagcuccuggcgcagc

SEQ ID NO: 161361 - RNA, 22 nt, Human
cuggccagccucccagguaccc

SEQ ID NO: 161362 - RNA, 22 nt, Human
cuggccaggugggggguagugg

SEQ ID NO: 161363 - RNA, 22 nt, Human
cugugcauguucucuagcugau

SEQ ID NO: 161364 - RNA, 22 nt, Human
cugugcuucgagggcuccccgc

SEQ ID NO: 161365 - RNA, 22 nt, Human
cuguguggccuaaguggagaca

SEQ ID NO: 161366 - RNA, 22 nt, Human
cuucagcgucgucaguguugcu

SEQ ID NO: 161367 - RNA, 22 nt, Human
gaagccaugauaaccagugugg

SEQ ID NO: 161368 - RNA, 22 nt, Human
gaagcagguucuucaggaugaa

SEQ ID NO: 161369 - RNA, 22 nt, Human
cuguucuccacuccugacuucu

SEQ ID NO: 161370 - RNA, 20 nt, Human
cuguucucuugccacaugag

SEQ ID NO: 161371 - RNA, 22 nt, Human
cuguuucuuugcugucagagag

SEQ ID NO: 161372 - RNA, 22 nt, Human
cuguuucucugccugcacacau

SEQ ID NO: 161373 - RNA, 22 nt, Human
gaacugggguagggguagcuuu

SEQ ID NO: 161374 - RNA, 22 nt, Human
cccaggccguguaaucagcagc

SEQ ID NO: 161375 - RNA, 22 nt, Human
cccaggaaugagcaggcagggg

SEQ ID NO: 161376 - RNA, 22 nt, Human
cccagggguugaggccguaggg

SEQ ID NO: 161377 - RNA, 22 nt, Human
cccaggucgucagcaguguggu

SEQ ID NO: 161378 - RNA, 22 nt, Human
cccagcgccugcccuccgccgc

SEQ ID NO: 161379 - RNA, 22 nt, Human
cccagccgcuguggucuagggu

SEQ ID NO: 161380 - RNA, 22 nt, Human
ccagccacagcuuccagcuccu

SEQ ID NO: 161381 - RNA, 22 nt, Human
ccagcaucagcucuuggcuggc

SEQ ID NO: 161382 - RNA, 22 nt, Human
ccagcagaagcucccgcugggu

SEQ ID NO: 161383 - RNA, 20 nt, Human
ccccagcauccuuuucaucu

SEQ ID NO: 161384 - RNA, 22 nt, Human
cccauggacuagcuaugagcag

SEQ ID NO: 161385 - RNA, 22 nt, Human
ccagaugggggcugugggaggg

SEQ ID NO: 161386 - RNA, 16 nt, Human
ccagaugaaugggagu

SEQ ID NO: 161387 - RNA, 22 nt, Human
cccagccgaaugcucccuuccc

SEQ ID NO: 161388 - RNA, 22 nt, Human
cccagccugaucucggccagcu

SEQ ID NO: 161389 - RNA, 20 nt, Human
caucaacaccuugucagccu

SEQ ID NO: 161390 - RNA, 22 nt, Human
ccaggcuaggaccgauuucccu

SEQ ID NO: 161391 - RNA, 22 nt, Human
cccgaggagagguccaggcccu

SEQ ID NO: 161392 - RNA, 22 nt, Human
ccagggacuauuaguuguguau

SEQ ID NO: 161393 - RNA, 22 nt, Human
cccgggccgagucuuccagcga

SEQ ID NO: 161394 - RNA, 22 nt, Human
ccaggcccugcuccucacacca

SEQ ID NO: 161395 - RNA, 22 nt, Human
cccggcgccucguuuccuaguc

SEQ ID NO: 161396 - RNA, 22 nt, Human
ccccuuuguagcccagcaguug

SEQ ID NO: 161397 - RNA, 22 nt, Human
cccgacuccuccugguaccuaa

SEQ ID NO: 161398 - RNA, 22 nt, Human
cccggagcagucgggcuccggg

SEQ ID NO: 161399 - RNA, 22 nt, Human
cccgccggccacaccggccgcc

SEQ ID NO: 161400 - RNA, 22 nt, Human
cccgaaaauuguuguacugcag

SEQ ID NO: 161401 - RNA, 22 nt, Human
ccaggcccugccugugguuccu

SEQ ID NO: 161402 - RNA, 22 nt, Human
ccagccugccaagcccagcccu

SEQ ID NO: 161403 - RNA, 22 nt, Human
ccagccugagcuugcugcccuc

SEQ ID NO: 161404 - RNA, 22 nt, Human
ccagccacugacugauuuaaaa

SEQ ID NO: 161405 - RNA, 22 nt, Human
ccagcaugcucagucuaaauug

SEQ ID NO: 161406 - RNA, 22 nt, Human
ccccucuguagcccgagcugcu

SEQ ID NO: 161407 - RNA, 22 nt, Human
ccagcugcugcaccgugcaugg

SEQ ID NO: 161408 - RNA, 17 nt, Human
ccagcugcucccucaga

SEQ ID NO: 161409 - RNA, 23 nt, Human
ccagcugugccuggcccaggagc

SEQ ID NO: 161410 - RNA, 22 nt, Human
ccccugggcccugagccgcgau

SEQ ID NO: 161411 - RNA, 23 nt, Human
ccaugugcaggguucagcacuua

SEQ ID NO: 161412 - RNA, 22 nt, Human
cccaaccagaaauugacagaga

SEQ ID NO: 161413 - RNA, 18 nt, Human
cccaccugcccagguuca

SEQ ID NO: 161414 - RNA, 22 nt, Human
ccgccccaggcccugagccaag

SEQ ID NO: 161415 - RNA, 22 nt, Human
ccauuuuccuguauggacucga

SEQ ID NO: 161416 - RNA, 22 nt, Human
cccacccuacugcuacccagga

SEQ ID NO: 161417 - RNA, 22 nt, Human
ccauggccaauugcaccuugcu

SEQ ID NO: 161418 - RNA, 21 nt, Human
ccgaggagugcggggagcccc

SEQ ID NO: 161419 - RNA, 22 nt, Human
ccgaggaguagggugucuacgg

SEQ ID NO: 161420 - RNA, 22 nt, Human
ccgagguccugaagcaagggcc

SEQ ID NO: 161421 - RNA, 22 nt, Human
ccgcagucugcaaucucccugg

SEQ ID NO: 161422 - RNA, 22 nt, Human
ccaugauguugccuacacugcu

SEQ ID NO: 161423 - RNA, 22 nt, Human
cccuucuguaucuucugaguuu

SEQ ID NO: 161424 - RNA, 21 nt, Human
cccuugccugcacuccucggc

SEQ ID NO: 161425 - RNA, 22 nt, Human
cccuugagccuggaggagcucu

SEQ ID NO: 161426 - RNA, 21 nt, Human
ccgacggcgcagaugccggcc

SEQ ID NO: 161427 - RNA, 19 nt, Human
cccucggcuucugguuacu

SEQ ID NO: 161428 - RNA, 22 nt, Human
ccaggggagagucugagucguu

SEQ ID NO: 161429 - RNA, 22 nt, Human
ccagggcuggguuugucggugu

SEQ ID NO: 161430 - RNA, 22 nt, Human
ccagggucggcaucagcguggg

SEQ ID NO: 161431 - RNA, 22 nt, Human
ccagggaggucauagugcuggu

SEQ ID NO: 161432 - RNA, 22 nt, Human
cccgggcucuggcagaggcggu

SEQ ID NO: 161433 - RNA, 22 nt, Human
cccgguggagaugugggacagg

SEQ ID NO: 161434 - RNA, 22 nt, Human
cccgggucugugugaaauucca

SEQ ID NO: 161435 - RNA, 22 nt, Human
cccguggugggaugacaccaug

SEQ ID NO: 161436 - RNA, 22 nt, Human
cccgguugggguuccagggcgc

SEQ ID NO: 161437 - RNA, 20 nt, Human
cccuggcuggcaucuggacu

SEQ ID NO: 161438 - RNA, 22 nt, Human
ccagucugccggcccggccccu

SEQ ID NO: 161439 - RNA, 17 nt, Human
cccugcauugauccuca

SEQ ID NO: 161440 - RNA, 23 nt, Human
ccagucgagucccaaccuucgcc

SEQ ID NO: 161441 - RNA, 22 nt, Human
ccagugcaguacaaaccuuagu

SEQ ID NO: 161442 - RNA, 22 nt, Human
ccaguguguuuuucucugacuc

SEQ ID NO: 161443 - RNA, 22 nt, Human
cccuggucucugacuugauccu

SEQ ID NO: 161444 - RNA, 22 nt, Human
cccuguccugcuaggcccuggu

SEQ ID NO: 161445 - RNA, 22 nt, Human
cccuguccuucccuccaucuga

SEQ ID NO: 161446 - RNA, 22 nt, Human
ccguccgcuccuccagccgcug

SEQ ID NO: 161447 - RNA, 22 nt, Human
cccaguuguuccuauucuucuu

SEQ ID NO: 161448 - RNA, 22 nt, Human
cccauggaaggguuggcccaga

SEQ ID NO: 161449 - RNA, 22 nt, Human
ccccaggcagcccuccaggagc

SEQ ID NO: 161450 - RNA, 22 nt, Human
ccccauggaaaacccaccuagg

SEQ ID NO: 161451 - RNA, 22 nt, Human
ccccguggcugggggacagagc

SEQ ID NO: 161452 - RNA, 22 nt, Human
ccuaggcccauuaauuccccuu

SEQ ID NO: 161453 - RNA, 22 nt, Human
ccucagcuguuucucucaucag

SEQ ID NO: 161454 - RNA, 22 nt, Human
ccuacccucaagggccuggggg

SEQ ID NO: 161455 - RNA, 22 nt, Human
ccuacccaccccuccucaucac

SEQ ID NO: 161456 - RNA, 21 nt, Human
ccguuauucuucccaccccca

SEQ ID NO: 161457 - RNA, 21 nt, Human
ccccuguggagcacauguggc

SEQ ID NO: 161458 - RNA, 22 nt, Human
ccccugcucagggaggagaccg

SEQ ID NO: 161459 - RNA, 23 nt, Human
ccccugcauggcaccacauuccc

SEQ ID NO: 161460 - RNA, 22 nt, Human
cccagagggcugaggauaugaa

SEQ ID NO: 161461 - RNA, 19 nt, Human
cccagaggaaugccuggaa

SEQ ID NO: 161462 - RNA, 22 nt, Human
cccagaaugauucagcgacagu

SEQ ID NO: 161463 - RNA, 22 nt, Human
cccagaccagagugccuggacg

SEQ ID NO: 161464 - RNA, 22 nt, Human
cccagcccaucauuccugcaaa

SEQ ID NO: 161465 - RNA, 22 nt, Human
cccagcaccauaacucaggccu

SEQ ID NO: 161466 - RNA, 22 nt, Human
ccggaggaaauugcauugguug

SEQ ID NO: 161467 - RNA, 22 nt, Human
ccgcggauggggagucaccacc

SEQ ID NO: 161468 - RNA, 22 nt, Human
ccgcggcagaggcgggggcgcc

SEQ ID NO: 161469 - RNA, 22 nt, Human
ccgcgcccccggcugugccccc

SEQ ID NO: 161470 - RNA, 22 nt, Human
ccgcggcugcgcggugccccuc

SEQ ID NO: 161471 - RNA, 22 nt, Human
ccggcggaaacauggcggcgcc

SEQ ID NO: 161472 - RNA, 22 nt, Human
ccggcugagccucgccgcggcc

SEQ ID NO: 161473 - RNA, 22 nt, Human
ccgggcggcauccagccguucc

SEQ ID NO: 161474 - RNA, 22 nt, Human
ccggcugcugaggcggccccgg

SEQ ID NO: 161475 - RNA, 22 nt, Human
cccagcucuggaagguggggga

SEQ ID NO: 161476 - RNA, 22 nt, Human
cccagccuuugcuuccugguuc

SEQ ID NO: 161477 - RNA, 22 nt, Human
cccagcuuugcggacccgggag

SEQ ID NO: 161478 - RNA, 22 nt, Human
cccagcuggcaaaggcguccuu

SEQ ID NO: 161479 - RNA, 22 nt, Human
cccagcugaacuugcauuccaa

SEQ ID NO: 161480 - RNA, 22 nt, Human
cccgcucaccccacuccaccag

SEQ ID NO: 161481 - RNA, 22 nt, Human
cccggcucggcuucuuccccac

SEQ ID NO: 161482 - RNA, 19 nt, Human
ccuccguguuaccuguccu

SEQ ID NO: 161483 - RNA, 22 nt, Human
ccucgcucauggauucugccug

SEQ ID NO: 161484 - RNA, 22 nt, Human
ccuccugggccuugcucuguga

SEQ ID NO: 161485 - RNA, 22 nt, Human
ccuccgguucucagggcuccac

SEQ ID NO: 161486 - RNA, 22 nt, Human
ccuccacgaggggucuucucuu

SEQ ID NO: 161487 - RNA, 22 nt, Human
ccucuccuugcuccccuuccuu

SEQ ID NO: 161488 - RNA, 22 nt, Human
cccuccgccagugcccgccccg

SEQ ID NO: 161489 - RNA, 22 nt, Human
cccgugggaugagaggcccugg

SEQ ID NO: 161490 - RNA, 22 nt, Human
ccucucccugcagggcccaggg

SEQ ID NO: 161491 - RNA, 22 nt, Human
cccugaggcccacaagucccag

SEQ ID NO: 161492 - RNA, 22 nt, Human
cccuccagugucccagugggga

SEQ ID NO: 161493 - RNA, 22 nt, Human
ccugaagaugguugauccccuu

SEQ ID NO: 161494 - RNA, 22 nt, Human
cccugggucagagcgacuucuc

SEQ ID NO: 161495 - RNA, 21 nt, Human
ccugagccuguuuauccagaa

SEQ ID NO: 161496 - RNA, 22 nt, Human
ccugagccgagcgcucuuucuc

SEQ ID NO: 161497 - RNA, 22 nt, Human
cccuggcucaggcagcuuuguu

SEQ ID NO: 161498 - RNA, 22 nt, Human
cccugggccccgaacugcugag

SEQ ID NO: 161499 - RNA, 20 nt, Human
cccuggaaugagaugcauau

SEQ ID NO: 161500 - RNA, 22 nt, Human
cccuggacuccauuuucccgua

SEQ ID NO: 161501 - RNA, 17 nt, Human
cccugcacccuacucuc

SEQ ID NO: 161502 - RNA, 22 nt, Human
cccugcacuguguggacucugg

SEQ ID NO: 161503 - RNA, 22 nt, Human
ccugccagaaaagagggaguuc

SEQ ID NO: 161504 - RNA, 18 nt, Human
ccugcguggauguccucu

SEQ ID NO: 161505 - RNA, 22 nt, Human
ccugcaguagagguugguaggg

SEQ ID NO: 161506 - RNA, 19 nt, Human
ccugcugaagugaugcagc

SEQ ID NO: 161507 - RNA, 22 nt, Human
ccugcaguuuuuccaugauaca

SEQ ID NO: 161508 - RNA, 22 nt, Human
ccugcaugacuuugucagaccu

SEQ ID NO: 161509 - RNA, 22 nt, Human
cccuuuucuaauuuagccuguu

SEQ ID NO: 161510 - RNA, 22 nt, Human
ccugcacuaccuggggcugcug

SEQ ID NO: 161511 - RNA, 21 nt, Human
ccugcacuucccuccucaagu

SEQ ID NO: 161512 - RNA, 22 nt, Human
cccuuuuuugccauuccuuccu

SEQ ID NO: 161513 - RNA, 22 nt, Human
cccuuuuuuauggaguuggcca

SEQ ID NO: 161514 - RNA, 22 nt, Human
cucuggacaucugcggugcuuc

SEQ ID NO: 161515 - RNA, 22 nt, Human
cucuggcaacgauggugcuuau

SEQ ID NO: 161516 - RNA, 22 nt, Human
cucucacucccuccuucccucu

SEQ ID NO: 161517 - RNA, 22 nt, Human
cucuccagucauauucucaguc

SEQ ID NO: 161518 - RNA, 22 nt, Human
cucuccaguuauagcugauuug

SEQ ID NO: 161519 - RNA, 22 nt, Human
cucuguggucugaagccuguga

SEQ ID NO: 161520 - RNA, 22 nt, Human
cucuggggaagugcacucgcug

SEQ ID NO: 161521 - RNA, 22 nt, Human
cucuucauguuggugcagaagc

SEQ ID NO: 161522 - RNA, 22 nt, Human
cggcggcgaaccgaccugggug

SEQ ID NO: 161523 - RNA, 22 nt, Human
cggcuacccaugucauauucgu

SEQ ID NO: 161524 - RNA, 22 nt, Human
cggcgcugguacaguggaagag

SEQ ID NO: 161525 - RNA, 22 nt, Human
cgggagcagcucuggggcuggg

SEQ ID NO: 161526 - RNA, 22 nt, Human
cggggcaaggggggcuggugga

SEQ ID NO: 161527 - RNA, 22 nt, Human
cggcuucucgggucggauuccg

SEQ ID NO: 161528 - RNA, 22 nt, Human
cggggcggcgagcgggccgggc

SEQ ID NO: 161529 - RNA, 22 nt, Human
cggggaggagccagcggaggau

SEQ ID NO: 161530 - RNA, 22 nt, Human
cggggcucugcacaggccagga

SEQ ID NO: 161531 - RNA, 22 nt, Human
cugaacuaagcccaaagacacu

SEQ ID NO: 161532 - RNA, 22 nt, Human
cugaauucuuguugucggagca

SEQ ID NO: 161533 - RNA, 22 nt, Human
cugaccgugccgcgguacugcu

SEQ ID NO: 161534 - RNA, 22 nt, Human
cugaaggacacgugaggagcca

SEQ ID NO: 161535 - RNA, 22 nt, Human
cugaaggcuuugaauggaauga

SEQ ID NO: 161536 - RNA, 22 nt, Human
cggggugugacggugcgggccu

SEQ ID NO: 161537 - RNA, 22 nt, Human
cgggucgcacaggagaaaggcg

SEQ ID NO: 161538 - RNA, 22 nt, Human
cgguccugcucuuccucccguu

SEQ ID NO: 161539 - RNA, 22 nt, Human
cggucggagagaaugaccugga

SEQ ID NO: 161540 - RNA, 22 nt, Human
cuacaaggucuuuaucugcuuu

SEQ ID NO: 161541 - RNA, 22 nt, Human
cgacuacuaacuacuguagaaa

SEQ ID NO: 161542 - RNA, 22 nt, Human
cgacgacaggcgcccgaggagg

SEQ ID NO: 161543 - RNA, 22 nt, Human
cgaccccugaaaauggcagcca

SEQ ID NO: 161544 - RNA, 22 nt, Human
cgagcccaacccucccguccuc

SEQ ID NO: 161545 - RNA, 23 nt, Human
cgagagccugcaggaccuucgga

SEQ ID NO: 161546 - RNA, 22 nt, Human
cggggucuggaguuguggugug

SEQ ID NO: 161547 - RNA, 22 nt, Human
cucacugucagcugcagggcuu

SEQ ID NO: 161548 - RNA, 22 nt, Human
cucaccugccuccccgcccucc

SEQ ID NO: 161549 - RNA, 22 nt, Human
cgcugcagcggcugagucccgc

SEQ ID NO: 161550 - RNA, 22 nt, Human
cgcucggugagccaguggcgga

SEQ ID NO: 161551 - RNA, 22 nt, Human
cgcucugccugcccuaacuucc

SEQ ID NO: 161552 - RNA, 19 nt, Human
cgcugcucccgcuguggcu

SEQ ID NO: 161553 - RNA, 22 nt, Human
cuccaucccccugugugucaau

SEQ ID NO: 161554 - RNA, 22 nt, Human
cuccagggcuaccagguuuuag

SEQ ID NO: 161555 - RNA, 22 nt, Human
cuccugcuuuuucuucuuccga

SEQ ID NO: 161556 - RNA, 22 nt, Human
cuccuggagcagcaggcgcagg

SEQ ID NO: 161557 - RNA, 22 nt, Human
cggagagacaagucugcuuugg

SEQ ID NO: 161558 - RNA, 22 nt, Human
cggaagcacuagacacugacac

SEQ ID NO: 161559 - RNA, 22 nt, Human
cucggggcguggcaguagcaug

SEQ ID NO: 161560 - RNA, 22 nt, Human
cucguccugguuuaaguguccu

SEQ ID NO: 161561 - RNA, 22 nt, Human
cucggagggcaaguacuggcug

SEQ ID NO: 161562 - RNA, 22 nt, Human
cuccuuuuuauaucuuucucug

SEQ ID NO: 161563 - RNA, 21 nt, Human
cuccuguaaaucaccuccgca

SEQ ID NO: 161564 - RNA, 22 nt, Human
ccugggccuaaacaaacaagag

SEQ ID NO: 161565 - RNA, 22 nt, Human
ccugugcaugccaggguacacc

SEQ ID NO: 161566 - RNA, 19 nt, Human
ccugugaguuaagcuaugu

SEQ ID NO: 161567 - RNA, 22 nt, Human
cgggcccaggcaggggcucccc

SEQ ID NO: 161568 - RNA, 22 nt, Human
ccugugucaucagcuguggcua

SEQ ID NO: 161569 - RNA, 22 nt, Human
ccugggugaugugcugcccucg

SEQ ID NO: 161570 - RNA, 20 nt, Human
ccugggcuccaggagccccg

SEQ ID NO: 161571 - RNA, 22 nt, Human
ccugggcauuuguuucacaggu

SEQ ID NO: 161572 - RNA, 22 nt, Human
cggcgccccgcgcgggcggcuc

SEQ ID NO: 161573 - RNA, 23 nt, Human
ccuggcugaccugaagguguagu

SEQ ID NO: 161574 - RNA, 20 nt, Human
ccuguucacugcgcaguuuc

SEQ ID NO: 161575 - RNA, 22 nt, Human
cggggcgggcgugggaggugga

SEQ ID NO: 161576 - RNA, 22 nt, Human
cggggccccccagugaaccucu

SEQ ID NO: 161577 - RNA, 22 nt, Human
cggggcuggcguuagggaggca

SEQ ID NO: 161578 - RNA, 19 nt, Human
cggggcuugguggguucuc

SEQ ID NO: 161579 - RNA, 22 nt, Human
ccuuccaguucuugguuguaau

SEQ ID NO: 161580 - RNA, 22 nt, Human
cggggcuccgaagagcucgguu

SEQ ID NO: 161581 - RNA, 22 nt, Human
cggguccuucugucuucucugg

SEQ ID NO: 161582 - RNA, 22 nt, Human
ccuucaguguuacuagaaagcg

SEQ ID NO: 161583 - RNA, 22 nt, Human
cgguugcaggaugugcgggcag

SEQ ID NO: 161584 - RNA, 22 nt, Human
cgguggcccauuguacgcagcu

SEQ ID NO: 161585 - RNA, 22 nt, Human
cggugccccuagcgcgccgccc

SEQ ID NO: 161586 - RNA, 22 nt, Human
cgggucgagugcuguaguucga

SEQ ID NO: 161587 - RNA, 22 nt, Human
cgugccugguggagagcgaggg

SEQ ID NO: 161588 - RNA, 20 nt, Human
cguugccagcccggcccggg

SEQ ID NO: 161589 - RNA, 22 nt, Human
cgacagauuauuuugugacugc

SEQ ID NO: 161590 - RNA, 18 nt, Human
cuaagaggucguuucuca

SEQ ID NO: 161591 - RNA, 22 nt, Human
cgcucggcuuucccuccgccgg

SEQ ID NO: 161592 - RNA, 22 nt, Human
cgcgggcuugggcaccugcgga

SEQ ID NO: 161593 - RNA, 22 nt, Human
ccugaaaugaguucugcucacu

SEQ ID NO: 161594 - RNA, 22 nt, Human
ccugaauuuaucugaauggugg

SEQ ID NO: 161595 - RNA, 22 nt, Human
ccugacagcgugucccuggccc

SEQ ID NO: 161596 - RNA, 22 nt, Human
cggcccggccucgcggcgcaug

SEQ ID NO: 161597 - RNA, 22 nt, Human
ccugcucccccugcaagccuug

SEQ ID NO: 161598 - RNA, 22 nt, Human
ccugcucuaauucauucaugcu

SEQ ID NO: 161599 - RNA, 22 nt, Human
ccugcccaucccaccccagcau

SEQ ID NO: 161600 - RNA, 22 nt, Human
ccugccagccugccaucccaca

SEQ ID NO: 161601 - RNA, 22 nt, Human
cggccuuugcccgucauucugg

SEQ ID NO: 161602 - RNA, 22 nt, Human
ccugcuggagucuaguuggucu

SEQ ID NO: 161603 - RNA, 22 nt, Human
ccugcugagccuggugggcagc

SEQ ID NO: 161604 - RNA, 22 nt, Human
cgacaagagaaaugcuuuguuu

SEQ ID NO: 161605 - RNA, 22 nt, Human
ccgccacggggcaugggaggca

SEQ ID NO: 161606 - RNA, 22 nt, Human
ccgcaccgucugccauacacgc

SEQ ID NO: 161607 - RNA, 22 nt, Human
ccgcagggcccggcgggcucag

SEQ ID NO: 161608 - RNA, 22 nt, Human
ccugcugcugaugcuguuucac

SEQ ID NO: 161609 - RNA, 22 nt, Human
cgccaaccaggcuguccuccca

SEQ ID NO: 161610 - RNA, 22 nt, Human
cgcagcuucagggccaggaggg

SEQ ID NO: 161611 - RNA, 22 nt, Human
cgcacaggcacagacacuggga

SEQ ID NO: 161612 - RNA, 22 nt, Human
ccucgugcgauaguuaugucag

SEQ ID NO: 161613 - RNA, 19 nt, Human
cgacauggguaaugggaga

SEQ ID NO: 161614 - RNA, 22 nt, Human
uuuuucuccucucucuuucauu

SEQ ID NO: 161615 - RNA, 21 nt, Human
uuuuucuccagaguuuccacu

SEQ ID NO: 161616 - RNA, 22 nt, Human
uuuuucuccauuccaggugccu

SEQ ID NO: 161617 - RNA, 22 nt, Human
uuuuuucuucucuaucuuaaua

SEQ ID NO: 161618 - RNA, 22 nt, Human
uuuuuucuggaguuugggguuu

SEQ ID NO: 161619 - RNA, 22 nt, Human
uuuuuuccuguuugucuuuggg

SEQ ID NO: 161620 - RNA, 22 nt, Human
uuuuuuccagcuucuagaggcc

SEQ ID NO: 161621 - RNA, 18 nt, Human
uuuuuuguucuguuuugu

SEQ ID NO: 161622 - RNA, 22 nt, Human
uuuuuuguggcuggaagaaaaa

SEQ ID NO: 161623 - RNA, 22 nt, Human
uuuuuuuguagguguaugaaaa

SEQ ID NO: 161624 - RNA, 22 nt, Human
uuuucaacuuuauuuuccccca

SEQ ID NO: 161625 - RNA, 22 nt, Human
uuuucacugacuuggucuggaa

SEQ ID NO: 161626 - RNA, 22 nt, Human
uuuucuucggugcuggguugau

SEQ ID NO: 161627 - RNA, 22 nt, Human
uuuuccuguccuugggucugca

SEQ ID NO: 161628 - RNA, 23 nt, Human
uuuuccaaaucgacucucuaguu

SEQ ID NO: 161629 - RNA, 22 nt, Human
uuuuuaccugguguccagcuuc

SEQ ID NO: 161630 - RNA, 22 nt, Human
gaggggcggggcgggaggagag

SEQ ID NO: 161631 - RNA, 22 nt, Human
gaggggcuccagguguugagga

SEQ ID NO: 161632 - RNA, 22 nt, Human
gcagcagugugggcugaaccua

SEQ ID NO: 161633 - RNA, 22 nt, Human
gaggggcucuugggcaugaagg

SEQ ID NO: 161634 - RNA, 22 nt, Human
gagggggcggccccugugggca

SEQ ID NO: 161635 - RNA, 22 nt, Human
gagggggcaggcucggcaccgg

SEQ ID NO: 161636 - RNA, 22 nt, Human
gagggcauugucuucuuaguuu

SEQ ID NO: 161637 - RNA, 22 nt, Human
gcagagcacccugcagugguau

SEQ ID NO: 161638 - RNA, 22 nt, Human
gcagaggcaaagucuggaugac

SEQ ID NO: 161639 - RNA, 22 nt, Human
gcagagcugucuaagucacuuc

SEQ ID NO: 161640 - RNA, 22 nt, Human
gcagaguauaaguguggagcug

SEQ ID NO: 161641 - RNA, 22 nt, Human
gaggggcaagaaguuggccucu

SEQ ID NO: 161642 - RNA, 22 nt, Human
gaggggacugucuggcuccgag

SEQ ID NO: 161643 - RNA, 22 nt, Human
gaggggaauguuccugagcugg

SEQ ID NO: 161644 - RNA, 22 nt, Human
gcagccagggaccuuugacuau

SEQ ID NO: 161645 - RNA, 22 nt, Human
gcagcauuaccaagacauggca

SEQ ID NO: 161646 - RNA, 22 nt, Human
gcagccauggcuggccgggcau

SEQ ID NO: 161647 - RNA, 22 nt, Human
gaggucagugugggggcaaggg

SEQ ID NO: 161648 - RNA, 22 nt, Human
gagguagaggaaaagauuauca

SEQ ID NO: 161649 - RNA, 22 nt, Human
gaggucggaagugaggguaacu

SEQ ID NO: 161650 - RNA, 22 nt, Human
gaggucaugcagcucugaguuc

SEQ ID NO: 161651 - RNA, 22 nt, Human
gaggugaacccaggugcuucac

SEQ ID NO: 161652 - RNA, 22 nt, Human
gcaggagggggccuggagccca

SEQ ID NO: 161653 - RNA, 22 nt, Human
gcaggaagauugcagaaggcug

SEQ ID NO: 161654 - RNA, 22 nt, Human
gcagcguuaacauuuuuccugu

SEQ ID NO: 161655 - RNA, 21 nt, Human
gcagcucaggauauagacuug

SEQ ID NO: 161656 - RNA, 22 nt, Human
gcagccucugcaguucaggagg

SEQ ID NO: 161657 - RNA, 22 nt, Human
gcagccugaguuuagcucgucg

SEQ ID NO: 161658 - RNA, 22 nt, Human
gcagcgcugagaugauuuguug

SEQ ID NO: 161659 - RNA, 22 nt, Human
gcaccgagaaggaagcaugccu

SEQ ID NO: 161660 - RNA, 22 nt, Human
gcacgugugugagagauaugaa

SEQ ID NO: 161661 - RNA, 22 nt, Human
gcacaggcugcacgaccccagc

SEQ ID NO: 161662 - RNA, 22 nt, Human
gaggaucuuuagcgggacugcu

SEQ ID NO: 161663 - RNA, 22 nt, Human
gcaccacccaaaggcggggcuc

SEQ ID NO: 161664 - RNA, 22 nt, Human
gaggcagaggaaacagcucauu

SEQ ID NO: 161665 - RNA, 22 nt, Human
gaggcuaugucuacgcucagcg

SEQ ID NO: 161666 - RNA, 22 nt, Human
gaggcucagagggacuuucaag

SEQ ID NO: 161667 - RNA, 23 nt, Human
gcacuccgagggcacgugucucu

SEQ ID NO: 161668 - RNA, 22 nt, Human
gcacucugggucaucugcugcc

SEQ ID NO: 161669 - RNA, 22 nt, Human
gaggcugguucccuugaucuuu

SEQ ID NO: 161670 - RNA, 22 nt, Human
gaggcuccgccggggcgggccg

SEQ ID NO: 161671 - RNA, 22 nt, Human
gagggaaauauggguuugguua

SEQ ID NO: 161672 - RNA, 22 nt, Human
gagggagagaugcuggaccggg

SEQ ID NO: 161673 - RNA, 23 nt, Human
gcacuguuugaggagcacugugc

SEQ ID NO: 161674 - RNA, 19 nt, Human
gcacacccugcaccaccau

SEQ ID NO: 161675 - RNA, 22 nt, Human
gcacacaaaaauauguguugaa

SEQ ID NO: 161676 - RNA, 22 nt, Human
gaggagggagcuggaagcucuu

SEQ ID NO: 161677 - RNA, 22 nt, Human
gaggaggagacggaggccuggg

SEQ ID NO: 161678 - RNA, 22 nt, Human
gaggagcggugcaugugggggc

SEQ ID NO: 161679 - RNA, 22 nt, Human
gcaauuggaaugaauucuauuu

SEQ ID NO: 161680 - RNA, 22 nt, Human
gcaauagccuacaugcgucaga

SEQ ID NO: 161681 - RNA, 22 nt, Human
gaggagcaggcaggaucugguc

SEQ ID NO: 161682 - RNA, 22 nt, Human
gaggacuucaggccuggccagg

SEQ ID NO: 161683 - RNA, 22 nt, Human
gaggacccuuaggucagacaga

SEQ ID NO: 161684 - RNA, 22 nt, Human
gauguuggugcauucacuucug

SEQ ID NO: 161685 - RNA, 22 nt, Human
gagcagguuauuagaaauggaa

SEQ ID NO: 161686 - RNA, 22 nt, Human
gagcagcugagcuggaaugaga

SEQ ID NO: 161687 - RNA, 22 nt, Human
gagcagggagaggcagagaggc

SEQ ID NO: 161688 - RNA, 22 nt, Human
gagcaugacgcaacaccaagug

SEQ ID NO: 161689 - RNA, 22 nt, Human
gagcaguuagggaccgcaggcu

SEQ ID NO: 161690 - RNA, 19 nt, Human
gagcaugacuggccuugca

SEQ ID NO: 161691 - RNA, 22 nt, Human
gagccaugagauaagagcaccu

SEQ ID NO: 161692 - RNA, 22 nt, Human
gagccauggaggaugugcagca

SEQ ID NO: 161693 - RNA, 22 nt, Human
gagcagucuuugaaaggcacca

SEQ ID NO: 161694 - RNA, 22 nt, Human
gagcccuguagcaagucauguc

SEQ ID NO: 161695 - RNA, 22 nt, Human
gauucugaaauuaacagacugg

SEQ ID NO: 161696 - RNA, 22 nt, Human
gauuccuuucgccugccgagcu

SEQ ID NO: 161697 - RNA, 22 nt, Human
gagcgcacagaaggaagcagcc

SEQ ID NO: 161698 - RNA, 22 nt, Human
gagcgacucuuuuaguccagag

SEQ ID NO: 161699 - RNA, 22 nt, Human
gagccuguuaggcaccuguguu

SEQ ID NO: 161700 - RNA, 19 nt, Human
gagccgcucccgcagccgg

SEQ ID NO: 161701 - RNA, 22 nt, Human
gcaaaaacaguguagucuucug

SEQ ID NO: 161702 - RNA, 22 nt, Human
gcaacguauauggguaaggaua

SEQ ID NO: 161703 - RNA, 22 nt, Human
gcaacccugggucaugguugac

SEQ ID NO: 161704 - RNA, 21 nt, Human
gcaaccagaccacagggcagu

SEQ ID NO: 161705 - RNA, 22 nt, Human
gagcuggagaaacacauaagaa

SEQ ID NO: 161706 - RNA, 22 nt, Human
gagcuggacauacaggaaacca

SEQ ID NO: 161707 - RNA, 22 nt, Human
gagcggcucaguggccauguga

SEQ ID NO: 161708 - RNA, 22 nt, Human
gagauuguggcagcagcuguuu

SEQ ID NO: 161709 - RNA, 22 nt, Human
gagaucuguguuugcugaagcu

SEQ ID NO: 161710 - RNA, 22 nt, Human
gagagucuuaaguuacagaacu

SEQ ID NO: 161711 - RNA, 22 nt, Human
gauggguugaguucauggagcc

SEQ ID NO: 161712 - RNA, 22 nt, Human
gagcaacacauugaaugaggau

SEQ ID NO: 161713 - RNA, 22 nt, Human
gagcacauguggagagucuggg

SEQ ID NO: 161714 - RNA, 22 nt, Human
gagcacugagcuggaauuggag

SEQ ID NO: 161715 - RNA, 22 nt, Human
gagcagacugcacaguucuugc

SEQ ID NO: 161716 - RNA, 22 nt, Human
gaugguggaggaaucgcugaag

SEQ ID NO: 161717 - RNA, 22 nt, Human
gaugguggggggcagcugggag

SEQ ID NO: 161718 - RNA, 22 nt, Human
gagcagcaggccagguugcagg

SEQ ID NO: 161719 - RNA, 22 nt, Human
gaugucauguuggcagacaguu

SEQ ID NO: 161720 - RNA, 22 nt, Human
gauguaucugagcugcuuaggu

SEQ ID NO: 161721 - RNA, 22 nt, Human
gaugucuauguccagggccauc

SEQ ID NO: 161722 - RNA, 22 nt, Human
gaugauugaauaaauaugguca

SEQ ID NO: 161723 - RNA, 18 nt, Human
gagaggcauuuagcugau

SEQ ID NO: 161724 - RNA, 22 nt, Human
gagaggguugggaggcagcaga

SEQ ID NO: 161725 - RNA, 22 nt, Human
gaugccggggucguagccgugg

SEQ ID NO: 161726 - RNA, 22 nt, Human
gaugccuccaggaaagaggacg

SEQ ID NO: 161727 - RNA, 22 nt, Human
gauggauuuuuuauuaaaucag

SEQ ID NO: 161728 - RNA, 22 nt, Human
gauggacgguuuuaccagacag

SEQ ID NO: 161729 - RNA, 22 nt, Human
gccggguguuccugggaagaug

SEQ ID NO: 161730 - RNA, 21 nt, Human
gccgugcgccuccaggcgcgc

SEQ ID NO: 161731 - RNA, 22 nt, Human
gccguuccuacucucucugugu

SEQ ID NO: 161732 - RNA, 22 nt, Human
gauugcugccagcguguccgug

SEQ ID NO: 161733 - RNA, 22 nt, Human
gccgggagugcagcgggcgcgc

SEQ ID NO: 161734 - RNA, 22 nt, Human
gccgggagaggcggcgcagggg

SEQ ID NO: 161735 - RNA, 22 nt, Human
gccggcugggggcggagggcag

SEQ ID NO: 161736 - RNA, 22 nt, Human
gccgcguggcagucuuggugac

SEQ ID NO: 161737 - RNA, 22 nt, Human
gccggcccugcgcggggcggaa

SEQ ID NO: 161738 - RNA, 22 nt, Human
gccgccgccgccuuuguugcgg

SEQ ID NO: 161739 - RNA, 22 nt, Human
gccgcgggucugggucuggcuc

SEQ ID NO: 161740 - RNA, 18 nt, Human
gccgccuugcucgugaac

SEQ ID NO: 161741 - RNA, 21 nt, Human
gccgaugugacucuacguagu

SEQ ID NO: 161742 - RNA, 22 nt, Human
gcccucugccacaggacgccag

SEQ ID NO: 161743 - RNA, 22 nt, Human
gccugggugcugugggguggag

SEQ ID NO: 161744 - RNA, 22 nt, Human
gccuucccuccucugcucucag

SEQ ID NO: 161745 - RNA, 22 nt, Human
gccugggccgggcgcggccccc

SEQ ID NO: 161746 - RNA, 22 nt, Human
gcacugagacuuuagauuggag

SEQ ID NO: 161747 - RNA, 22 nt, Human
gccuggggaacuugauccuguc

SEQ ID NO: 161748 - RNA, 22 nt, Human
gccugggauuggggauuuuuug

SEQ ID NO: 161749 - RNA, 22 nt, Human
gcacagcuaugagcugaauugu

SEQ ID NO: 161750 - RNA, 22 nt, Human
gcacagauaaucugccuuacca

SEQ ID NO: 161751 - RNA, 22 nt, Human
gccugagucaagauguggcacc

SEQ ID NO: 161752 - RNA, 22 nt, Human
gccugcaaagacuuccuucucu

SEQ ID NO: 161753 - RNA, 22 nt, Human
gccuggaaugcaaugugacgaa

SEQ ID NO: 161754 - RNA, 22 nt, Human
gccuggccaaucgccgucuagg

SEQ ID NO: 161755 - RNA, 22 nt, Human
gcaacuccuaggcgaggccuuc

SEQ ID NO: 161756 - RNA, 22 nt, Human
gcacacuguaugcugguauuug

SEQ ID NO: 161757 - RNA, 22 nt, Human
gcaggccgauuuguuagaaguc

SEQ ID NO: 161758 - RNA, 22 nt, Human
gagguuggagggcugcccugca

SEQ ID NO: 161759 - RNA, 22 nt, Human
gaggugggaggcgggccugcau

SEQ ID NO: 161760 - RNA, 22 nt, Human
gcaugcgugcgugcgugcaugu

SEQ ID NO: 161761 - RNA, 20 nt, Human
gcauggcuggcugcugucug

SEQ ID NO: 161762 - RNA, 22 nt, Human
gcauucuugucaguggggucag

SEQ ID NO: 161763 - RNA, 22 nt, Human
gauagaaagagaaucagaacuu

SEQ ID NO: 161764 - RNA, 22 nt, Human
gccauguuuugguaaauaccau

SEQ ID NO: 161765 - RNA, 22 nt, Human
gcccagaagguagcgaguaguc

SEQ ID NO: 161766 - RNA, 22 nt, Human
gauggcaaugcuagaaauuuag

SEQ ID NO: 161767 - RNA, 23 nt, Human
gcccagaggccccuggccugagc

SEQ ID NO: 161768 - RNA, 22 nt, Human
gcccgccaacuugccagcggug

SEQ ID NO: 161769 - RNA, 22 nt, Human
gcccguuuagcaaacgccuccu

SEQ ID NO: 161770 - RNA, 22 nt, Human
gccaugguggggccucccugac

SEQ ID NO: 161771 - RNA, 22 nt, Human
gaugcucuugauuggaccaggg

SEQ ID NO: 161772 - RNA, 22 nt, Human
gcauuuuaauuggggcaguuag

SEQ ID NO: 161773 - RNA, 22 nt, Human
gaucacuuugauuagauguccu

SEQ ID NO: 161774 - RNA, 22 nt, Human
gaugauaacagcauuucaacug

SEQ ID NO: 161775 - RNA, 23 nt, Human
gaugauggcaacuacauccggug

SEQ ID NO: 161776 - RNA, 22 nt, Human
gcggcccggguccccagcagca

SEQ ID NO: 161777 - RNA, 22 nt, Human
gcggcaguccuuccaguacagg

SEQ ID NO: 161778 - RNA, 22 nt, Human
gcagccuccggccuggcccccu

SEQ ID NO: 161779 - RNA, 22 nt, Human
gcggagaggcagagacuccgcg

SEQ ID NO: 161780 - RNA, 22 nt, Human
gcggaucuccuugagugggcaa

SEQ ID NO: 161781 - RNA, 22 nt, Human
gccuuggacuaccacucccaca

SEQ ID NO: 161782 - RNA, 22 nt, Human
gcaggaaugguacauaccuguu

SEQ ID NO: 161783 - RNA, 22 nt, Human
gcgguuguucugugugcaugga

SEQ ID NO: 161784 - RNA, 22 nt, Human
gcguaccugaaauuacggcacu

SEQ ID NO: 161785 - RNA, 22 nt, Human
gcgggugagauucgagagaugg

SEQ ID NO: 161786 - RNA, 22 nt, Human
gcagcguguggcuaauggcucu

SEQ ID NO: 161787 - RNA, 22 nt, Human
gcagcucagcacgcacagguaa

SEQ ID NO: 161788 - RNA, 22 nt, Human
gcggcuggcuguccaaacuggg

SEQ ID NO: 161789 - RNA, 22 nt, Human
gcggcgucccagcuccgacggc

SEQ ID NO: 161790 - RNA, 22 nt, Human
gcguggaugauuuugagucggu

SEQ ID NO: 161791 - RNA, 22 nt, Human
gcgugcauguguguaugcgugu

SEQ ID NO: 161792 - RNA, 22 nt, Human
gcgucucugggcugacccaggu

SEQ ID NO: 161793 - RNA, 22 nt, Human
gcuaagcuuugagucuggacag

SEQ ID NO: 161794 - RNA, 22 nt, Human
gcaggggguaaggggcagggcu

SEQ ID NO: 161795 - RNA, 22 nt, Human
gcguggccugcugaaggacuuc

SEQ ID NO: 161796 - RNA, 22 nt, Human
gcaguugguccagccucggcug

SEQ ID NO: 161797 - RNA, 22 nt, Human
gcuauuggcuaauuguugcaac

SEQ ID NO: 161798 - RNA, 22 nt, Human
gcuacaggggucaguccuuugc

SEQ ID NO: 161799 - RNA, 22 nt, Human
gcuacaacugugucuguggggc

SEQ ID NO: 161800 - RNA, 22 nt, Human
gcaguuguagcuguuucuacuc

SEQ ID NO: 161801 - RNA, 22 nt, Human
gcaucuguuagagugugcaugc

SEQ ID NO: 161802 - RNA, 22 nt, Human
gcuaguucugccuccccuagug

SEQ ID NO: 161803 - RNA, 22 nt, Human
gcucaaggucacacagggguga

SEQ ID NO: 161804 - RNA, 19 nt, Human
gcuccugcagcuagagugc

SEQ ID NO: 161805 - RNA, 21 nt, Human
gcucccgaagugcucggcguu

SEQ ID NO: 161806 - RNA, 22 nt, Human
gccagucgucuuuauuacagcu

SEQ ID NO: 161807 - RNA, 22 nt, Human
gcuggaaauaacuuguguagaa

SEQ ID NO: 161808 - RNA, 22 nt, Human
gccaggcggcccaggagauggc

SEQ ID NO: 161809 - RNA, 22 nt, Human
gcugcgcugggacgccaccaac

SEQ ID NO: 161810 - RNA, 22 nt, Human
gccaggcagcagcgaggauggu

SEQ ID NO: 161811 - RNA, 22 nt, Human
gccaggccuggguggagcgcuc

SEQ ID NO: 161812 - RNA, 22 nt, Human
gcugcuggcggagcuggcgcug

SEQ ID NO: 161813 - RNA, 22 nt, Human
gcugcuggcuuccugcuguuuu

SEQ ID NO: 161814 - RNA, 22 nt, Human
gcuggaagggccagcuuucagg

SEQ ID NO: 161815 - RNA, 22 nt, Human
gccaguggucagugggagggug

SEQ ID NO: 161816 - RNA, 23 nt, Human
gccaucugcugggugccccggcc

SEQ ID NO: 161817 - RNA, 22 nt, Human
gcuggccugcgagggcaggcug

SEQ ID NO: 161818 - RNA, 22 nt, Human
gcuggcgauggccgagucuccg

SEQ ID NO: 161819 - RNA, 22 nt, Human
gcccagacaucuguugggaccu

SEQ ID NO: 161820 - RNA, 20 nt, Human
gcccacccgcacucccgccg

SEQ ID NO: 161821 - RNA, 22 nt, Human
gccauggugagccaccuggugg

SEQ ID NO: 161822 - RNA, 22 nt, Human
gccauguucuugaaucuggguc

SEQ ID NO: 161823 - RNA, 23 nt, Human
gcugagcaccagccauaucuuuu

SEQ ID NO: 161824 - RNA, 22 nt, Human
gcugagcagaacaauuagaaau

SEQ ID NO: 161825 - RNA, 23 nt, Human
gcugcagugaauguuguuguugu

SEQ ID NO: 161826 - RNA, 22 nt, Human
gcugcccauugcucucccacuc

SEQ ID NO: 161827 - RNA, 20 nt, Human
gccaaggaggagaaacaggc

SEQ ID NO: 161828 - RNA, 23 nt, Human
gcugccguuucccaucgugguga

SEQ ID NO: 161829 - RNA, 22 nt, Human
gcugcgccgggagccggggccg

SEQ ID NO: 161830 - RNA, 22 nt, Human
gcugccuugaacuuggccuggg

SEQ ID NO: 161831 - RNA, 22 nt, Human
gggucggcacucuggcagcacc

SEQ ID NO: 161832 - RNA, 22 nt, Human
gggucagggaggccccaccaug

SEQ ID NO: 161833 - RNA, 22 nt, Human
gggucuggagauccgggugaag

SEQ ID NO: 161834 - RNA, 22 nt, Human
ggguggugauacugcuucugcc

SEQ ID NO: 161835 - RNA, 22 nt, Human
ggagggagugcaggcaggcaga

SEQ ID NO: 161836 - RNA, 22 nt, Human
ggaguucacagcaauggaacag

SEQ ID NO: 161837 - RNA, 22 nt, Human
gggugguggagguuugacagac

SEQ ID NO: 161838 - RNA, 22 nt, Human
ggggcggcgugggcgcggugau

SEQ ID NO: 161839 - RNA, 21 nt, Human
ggggccucaucagaaauguua

SEQ ID NO: 161840 - RNA, 22 nt, Human
ggggccaugauggacgagguga

SEQ ID NO: 161841 - RNA, 22 nt, Human
ggggccccuguggcuugaugcc

SEQ ID NO: 161842 - RNA, 22 nt, Human
ggagaucuuggacuggccggcc

SEQ ID NO: 161843 - RNA, 22 nt, Human
ggggccaaggcaaacuugaggg

SEQ ID NO: 161844 - RNA, 22 nt, Human
gggguauuugguagacauuuug

SEQ ID NO: 161845 - RNA, 22 nt, Human
ggggugggcuggguguccaagg

SEQ ID NO: 161846 - RNA, 22 nt, Human
gggggggcagguuggaugucag

SEQ ID NO: 161847 - RNA, 22 nt, Human
gggggcugugugcccgcucccc

SEQ ID NO: 161848 - RNA, 22 nt, Human
ggggcugggaggccggcgcgca

SEQ ID NO: 161849 - RNA, 22 nt, Human
ggggaagugguggggcuccgag

SEQ ID NO: 161850 - RNA, 22 nt, Human
ggagaaacuaguuagauccaau

SEQ ID NO: 161851 - RNA, 22 nt, Human
gggcugcuccgcccgcugcgcc

SEQ ID NO: 161852 - RNA, 22 nt, Human
gggcugagagcuggaaucugag

SEQ ID NO: 161853 - RNA, 22 nt, Human
ggacauuguuguuggauccuug

SEQ ID NO: 161854 - RNA, 22 nt, Human
ggacauggaaagugugugauuu

SEQ ID NO: 161855 - RNA, 17 nt, Human
ggacuuucugccugucc

SEQ ID NO: 161856 - RNA, 22 nt, Human
ggagaagaggagcuggaagccu

SEQ ID NO: 161857 - RNA, 22 nt, Human
ggagaggaggugagaggaagua

SEQ ID NO: 161858 - RNA, 22 nt, Human
gggcgagcgucucagccgggcg

SEQ ID NO: 161859 - RNA, 22 nt, Human
gggcgcaagcaugugucugggu

SEQ ID NO: 161860 - RNA, 22 nt, Human
gggccuuggaggagaaggacuu

SEQ ID NO: 161861 - RNA, 22 nt, Human
gggccaaggggagcuggaaggg

SEQ ID NO: 161862 - RNA, 22 nt, Human
gggcaugcagcaauucuguggu

SEQ ID NO: 161863 - RNA, 22 nt, Human
gggcaguuucaugugguucaac

SEQ ID NO: 161864 - RNA, 22 nt, Human
gggcagucagauucgggggccu

SEQ ID NO: 161865 - RNA, 22 nt, Human
ggaacaguacucggaggccaga

SEQ ID NO: 161866 - RNA, 20 nt, Human
ggaacccuagacuugcgcag

SEQ ID NO: 161867 - RNA, 17 nt, Human
ggaagaaaaggaucauc

SEQ ID NO: 161868 - RNA, 22 nt, Human
gggcggggcuuccguccuccac

SEQ ID NO: 161869 - RNA, 22 nt, Human
gggcggugccugucuccgaagc

SEQ ID NO: 161870 - RNA, 22 nt, Human
gggcggcguccucagucgggug

SEQ ID NO: 161871 - RNA, 22 nt, Human
ggaaguggauucagggcugcua

SEQ ID NO: 161872 - RNA, 22 nt, Human
gggcgcuuucugggucagggcu

SEQ ID NO: 161873 - RNA, 22 nt, Human
gggcgcgcggagccucgccggg

SEQ ID NO: 161874 - RNA, 22 nt, Human
ggacagagcaacccuacgcagc

SEQ ID NO: 161875 - RNA, 22 nt, Human
gggcuacugagcuggaacuggg

SEQ ID NO: 161876 - RNA, 22 nt, Human
ggacaauuguacucgauuucaa

SEQ ID NO: 161877 - RNA, 22 nt, Human
gcuuuguugauggugagucugu

SEQ ID NO: 161878 - RNA, 22 nt, Human
gggaggcagacgcuggagccca

SEQ ID NO: 161879 - RNA, 22 nt, Human
gcuguggagaagcugccuaugg

SEQ ID NO: 161880 - RNA, 22 nt, Human
gggagcugagcuggaagagaau

SEQ ID NO: 161881 - RNA, 22 nt, Human
ggcuuccuggugcagaguuaua

SEQ ID NO: 161882 - RNA, 22 nt, Human
gggaguggagagugaagcuaau

SEQ ID NO: 161883 - RNA, 22 nt, Human
gggagggggauucuggcgagaa

SEQ ID NO: 161884 - RNA, 22 nt, Human
gggagggucugagagcugcacc

SEQ ID NO: 161885 - RNA, 22 nt, Human
gggcagaaaggaaggcuggggg

SEQ ID NO: 161886 - RNA, 22 nt, Human
gggcacggaaggcgccaggggu

SEQ ID NO: 161887 - RNA, 22 nt, Human
gggcaagaagcuggaagcauuc

SEQ ID NO: 161888 - RNA, 22 nt, Human
ggccugcuaccagcugugaccu

SEQ ID NO: 161889 - RNA, 22 nt, Human
ggccuucuuuucaugucuuucg

SEQ ID NO: 161890 - RNA, 22 nt, Human
ggccucucuccuuggcuugcag

SEQ ID NO: 161891 - RNA, 22 nt, Human
ggccugagaagcaaggacacaa

SEQ ID NO: 161892 - RNA, 20 nt, Human
ggccugagcauggcuggcag

SEQ ID NO: 161893 - RNA, 22 nt, Human
ggccgggcaugcgagcugagcg

SEQ ID NO: 161894 - RNA, 22 nt, Human
ggccgccacuuuccagugcugc

SEQ ID NO: 161895 - RNA, 22 nt, Human
ggccgccgcuuagcugagcccc

SEQ ID NO: 161896 - RNA, 22 nt, Human
guacugguuuucuuacucuggc

SEQ ID NO: 161897 - RNA, 22 nt, Human
guaggugggcuuccaagguccu

SEQ ID NO: 161898 - RNA, 22 nt, Human
guagccauuuucuagagaguua

SEQ ID NO: 161899 - RNA, 22 nt, Human
guaccuuucuaucuagaaggua

SEQ ID NO: 161900 - RNA, 22 nt, Human
guaauugcucauauggcaccug

SEQ ID NO: 161901 - RNA, 22 nt, Human
ggcccgcgcugcuggcgcgcca

SEQ ID NO: 161902 - RNA, 22 nt, Human
gguugccuguggcucccuguua

SEQ ID NO: 161903 - RNA, 22 nt, Human
ggccgccacacagauucccccg

SEQ ID NO: 161904 - RNA, 22 nt, Human
gguucuggaaaagaaagcaaag

SEQ ID NO: 161905 - RNA, 22 nt, Human
ggccagcgugggggaguagcgg

SEQ ID NO: 161906 - RNA, 21 nt, Human
ggccagauucucccauagcug

SEQ ID NO: 161907 - RNA, 22 nt, Human
ggucuagcucggugcuggcgac

SEQ ID NO: 161908 - RNA, 22 nt, Human
ggucuucauaugccacagaguc

SEQ ID NO: 161909 - RNA, 22 nt, Human
ggugaaggaucccucuuggccu

SEQ ID NO: 161910 - RNA, 22 nt, Human
ggucuuccuugggggacuugaa

SEQ ID NO: 161911 - RNA, 22 nt, Human
ggucggggcuggccggcguggu

SEQ ID NO: 161912 - RNA, 22 nt, Human
ggucgucuguccugucgccgcu

SEQ ID NO: 161913 - RNA, 22 nt, Human
ggcacgagccaguguguguguu

SEQ ID NO: 161914 - RNA, 22 nt, Human
ggcaagauccagcacaaacaca

SEQ ID NO: 161915 - RNA, 22 nt, Human
ggcaccuuucaucccaucuaga

SEQ ID NO: 161916 - RNA, 22 nt, Human
ggcaaagaguacaucguccugg

SEQ ID NO: 161917 - RNA, 22 nt, Human
gguaccuggcccuggggcugcu

SEQ ID NO: 161918 - RNA, 22 nt, Human
gguagagagugaggaggggcuc

SEQ ID NO: 161919 - RNA, 22 nt, Human
ggauugaagggaaccucagaau

SEQ ID NO: 161920 - RNA, 22 nt, Human
ggcagcagaaccaacuguggcu

SEQ ID NO: 161921 - RNA, 22 nt, Human
ggugcguggcccauccuccacc

SEQ ID NO: 161922 - RNA, 22 nt, Human
ggcagcccuggacccuggagaa

SEQ ID NO: 161923 - RNA, 22 nt, Human
ggcagcagaacuggcccuguau

SEQ ID NO: 161924 - RNA, 18 nt, Human
ggcagggcucagcugcuc

SEQ ID NO: 161925 - RNA, 22 nt, Human
ggcagguccugaguccugaggc

SEQ ID NO: 161926 - RNA, 22 nt, Human
ggcagggagagcaugcugauaa

SEQ ID NO: 161927 - RNA, 22 nt, Human
ggcagggagagcgccgccaugc

SEQ ID NO: 161928 - RNA, 22 nt, Human
ggcagcgcuuggcugcucgaca

SEQ ID NO: 161929 - RNA, 22 nt, Human
ggcagggaauucagagggaagg

SEQ ID NO: 161930 - RNA, 22 nt, Human
ggcaggauggagcagggcuaaa

SEQ ID NO: 161931 - RNA, 19 nt, Human
ggugggacaggugagauau

SEQ ID NO: 161932 - RNA, 22 nt, Human
gguggucaggagcgcccguugg

SEQ ID NO: 161933 - RNA, 22 nt, Human
ggugguucagugguuagggcca

SEQ ID NO: 161934 - RNA, 22 nt, Human
gguguaaucacaagcuggaauu

SEQ ID NO: 161935 - RNA, 22 nt, Human
gguguacgaagaggcgggaguc

SEQ ID NO: 161936 - RNA, 22 nt, Human
ggcagguggcacugcugcuccc

SEQ ID NO: 161937 - RNA, 22 nt, Human
ggcagucuuucccuugagcucu

SEQ ID NO: 161938 - RNA, 22 nt, Human
gguggcuucuguuugcaagagg

SEQ ID NO: 161939 - RNA, 21 nt, Human
gcuggcugucucuuacacggu

SEQ ID NO: 161940 - RNA, 22 nt, Human
ggcucccgugggaugguggagc

SEQ ID NO: 161941 - RNA, 22 nt, Human
gcugggagaggcagcuuucgga

SEQ ID NO: 161942 - RNA, 22 nt, Human
gcuggcggguuggggaggcgga

SEQ ID NO: 161943 - RNA, 22 nt, Human
ggcugcagugcaacucuuucua

SEQ ID NO: 161944 - RNA, 22 nt, Human
ggcugcuggaguugggucucuc

SEQ ID NO: 161945 - RNA, 22 nt, Human
ggcugaggccucuggggaggga

SEQ ID NO: 161946 - RNA, 22 nt, Human
ggcucuggcgagcuuuaguaca

SEQ ID NO: 161947 - RNA, 22 nt, Human
ggcugagguguggggaacuaua

SEQ ID NO: 161948 - RNA, 22 nt, Human
ggcugaugacgccugagucuga

SEQ ID NO: 161949 - RNA, 22 nt, Human
gcugcuucgcugcacacccgag

SEQ ID NO: 161950 - RNA, 22 nt, Human
gcuggaugucugugccaggcac

SEQ ID NO: 161951 - RNA, 22 nt, Human
ggcuccaggguaccccuggaug

SEQ ID NO: 161952 - RNA, 22 nt, Human
ggcuccugggcgucuucgaaca

SEQ ID NO: 161953 - RNA, 18 nt, Human
gcuguccgguagcuggug

SEQ ID NO: 161954 - RNA, 22 nt, Human
gcuguccugggaacaggcacua

SEQ ID NO: 161955 - RNA, 22 nt, Human
gcugugacaagaggcugcuucu

SEQ ID NO: 161956 - RNA, 22 nt, Human
gcuguaacuuuuucauuuucaa

SEQ ID NO: 161957 - RNA, 22 nt, Human
ggcuguggcagcuggaaguggu

SEQ ID NO: 161958 - RNA, 22 nt, Human
gcuguacugucugccaagccag

SEQ ID NO: 161959 - RNA, 22 nt, Human
ggcuucaaaacacaugucaaga

SEQ ID NO: 161960 - RNA, 22 nt, Human
gcugguggcagagcuccgcggc

SEQ ID NO: 161961 - RNA, 22 nt, Human
gcuggucuggcaauccucaugg

SEQ ID NO: 161962 - RNA, 22 nt, Human
gcugggucucucccugguccug

SEQ ID NO: 161963 - RNA, 22 nt, Human
gcuggguuguucuccuggucca

SEQ ID NO: 161964 - RNA, 22 nt, Human
ggcuggacuuucugcugggcuc

SEQ ID NO: 161965 - RNA, 22 nt, Human
ggcugggaggcggaggcugaga

SEQ ID NO: 161966 - RNA, 22 nt, Human
ggcugggagguggcgaggaggc

SEQ ID NO: 161967 - RNA, 22 nt, Human
ggcugguggcgggcagcacaga

SEQ ID NO: 161968 - RNA, 18 nt, Human
ggcugggcugugccccuu

SEQ ID NO: 161969 - RNA, 22 nt, Human
ggcuggggccuguugaagaugc

SEQ ID NO: 161970 - RNA, 22 nt, Human
ggcuggagcaggcugcacagug

SEQ ID NO: 161971 - RNA, 22 nt, Human
gcugcgcgcagccggcgccgag

SEQ ID NO: 161972 - RNA, 22 nt, Human
gcugcuacagagcuggaggggg

SEQ ID NO: 161973 - RNA, 22 nt, Human
gcugcucaaaaaaacacuagcu

SEQ ID NO: 161974 - RNA, 22 nt, Human
ggcgaugaggucuuagaaucua

SEQ ID NO: 161975 - RNA, 22 nt, Human
ggcgacuacugaaugcuugaaa

SEQ ID NO: 161976 - RNA, 22 nt, Human
ggccuugguggcuuugcugaug

SEQ ID NO: 161977 - RNA, 23 nt, Human
ggccuuuuuaaccgcgagcgaca

SEQ ID NO: 161978 - RNA, 22 nt, Human
ggcgaguacagacggggccugg

SEQ ID NO: 161979 - RNA, 22 nt, Human
ggcgccugguauucuuccucuc

SEQ ID NO: 161980 - RNA, 22 nt, Human
ggcgcuccccgccugcgucgcg

SEQ ID NO: 161981 - RNA, 22 nt, Human
ggcgcccucccuguccgucuuc

SEQ ID NO: 161982 - RNA, 22 nt, Human
ggcggcaagggaauggagaaga

SEQ ID NO: 161983 - RNA, 22 nt, Human
ggcguccuccucgucugaggcg

SEQ ID NO: 161984 - RNA, 22 nt, Human
ggcggugcgaggaugcagggcu

SEQ ID NO: 161985 - RNA, 22 nt, Human
ggcggcugcuccuugcccucgg

SEQ ID NO: 161986 - RNA, 22 nt, Human
ggcgggggagccaggaacccag

SEQ ID NO: 161987 - RNA, 22 nt, Human
ggccuggcacauaguaggcagu

SEQ ID NO: 161988 - RNA, 22 nt, Human
ggccuggccuccugcuuuucca

SEQ ID NO: 161989 - RNA, 22 nt, Human
ggccugcucuggcuguggucag

SEQ ID NO: 161990 - RNA, 22 nt, Human
ggccgggugggaggcagcggag

SEQ ID NO: 161991 - RNA, 18 nt, Human
ggccucagccuggccgga

SEQ ID NO: 161992 - RNA, 22 nt, Human
ggccccagggauuaggccaacc

SEQ ID NO: 161993 - RNA, 22 nt, Human
ggccaguauacaaacuuccggu

SEQ ID NO: 161994 - RNA, 22 nt, Human
ggccgcuuucuggggagugagg

SEQ ID NO: 161995 - RNA, 22 nt, Human
ggcccugcuuccccaguguaca

SEQ ID NO: 161996 - RNA, 22 nt, Human
ggcccuggggcaggagcagagg

SEQ ID NO: 161997 - RNA, 22 nt, Human
gcugcagggagcuggaaggcuc

SEQ ID NO: 161998 - RNA, 22 nt, Human
gcugcacgguccuggcaccacg

SEQ ID NO: 161999 - RNA, 22 nt, Human
gcugcaggaggugguagggucu

SEQ ID NO: 162000 - RNA, 22 nt, Human
gcugcccucccagggcaagcuu

SEQ ID NO: 162001 - RNA, 22 nt, Human
gcugccgcugcggggcgcgggc

SEQ ID NO: 162002 - RNA, 23 nt, Human
gcugaagcccacucccugggucu

SEQ ID NO: 162003 - RNA, 22 nt, Human
gcucugcuccaucuguuuccuc

SEQ ID NO: 162004 - RNA, 22 nt, Human
gcucuggcugccuuaguuuugu

SEQ ID NO: 162005 - RNA, 22 nt, Human
gcucccaguucccaaagugacc

SEQ ID NO: 162006 - RNA, 22 nt, Human
gcucuggcuacuguggcuaccg

SEQ ID NO: 162007 - RNA, 22 nt, Human
gcgguuauggcagagauuacag

SEQ ID NO: 162008 - RNA, 22 nt, Human
gcggguggaggagggacgggca

SEQ ID NO: 162009 - RNA, 22 nt, Human
gcgguguuuuaacacucccucg

SEQ ID NO: 162010 - RNA, 22 nt, Human
gcgguggcuacuaaaguucgaa

SEQ ID NO: 162011 - RNA, 22 nt, Human
gcgugugugauaugccucugca

SEQ ID NO: 162012 - RNA, 22 nt, Human
gcgguuggacguucgccucggg

SEQ ID NO: 162013 - RNA, 22 nt, Human
ggcaggaaguaaggaugcuaca

SEQ ID NO: 162014 - RNA, 22 nt, Human
gcggggcucuacuuggccugga

SEQ ID NO: 162015 - RNA, 22 nt, Human
gcggggggcucgggcagcucgg

SEQ ID NO: 162016 - RNA, 22 nt, Human
gcgggcuuggcuccagggccca

SEQ ID NO: 162017 - RNA, 20 nt, Human
ggcagagcuaugucuguugc

SEQ ID NO: 162018 - RNA, 22 nt, Human
gcucccagcuuuuguccacggc

SEQ ID NO: 162019 - RNA, 23 nt, Human
ggauccugacauauaccaucacc

SEQ ID NO: 162020 - RNA, 22 nt, Human
ggaucccaucgagcuggcuguc

SEQ ID NO: 162021 - RNA, 22 nt, Human
ggaucaccagguuuguuguugg

SEQ ID NO: 162022 - RNA, 22 nt, Human
gcggccucuuugcugccucagg

SEQ ID NO: 162023 - RNA, 19 nt, Human
gcggcggugccggcuggga

SEQ ID NO: 162024 - RNA, 22 nt, Human
gcgggcgcuguggccccggccu

SEQ ID NO: 162025 - RNA, 22 nt, Human
ggcaagcacugggugucuuagc

SEQ ID NO: 162026 - RNA, 22 nt, Human
ggcaaggaagaaagcagaaguu

SEQ ID NO: 162027 - RNA, 22 nt, Human
gcgggccggcaggggaggaguu

SEQ ID NO: 162028 - RNA, 19 nt, Human
gcgggcucuccaccccauc

SEQ ID NO: 162029 - RNA, 22 nt, Human
gcggcggcggaggcgggggcag

SEQ ID NO: 162030 - RNA, 22 nt, Human
ggaugggcuuggggaggucuag

SEQ ID NO: 162031 - RNA, 20 nt, Human
gcgcaguuccgggcgcgucu

SEQ ID NO: 162032 - RNA, 22 nt, Human
gcgcgccugccucccgcggugc

SEQ ID NO: 162033 - RNA, 21 nt, Human
gcgcgcucgugcucgacgcgc

SEQ ID NO: 162034 - RNA, 20 nt, Human
ggagagggaaaggcuguacu

SEQ ID NO: 162035 - RNA, 22 nt, Human
ggagcaguggaggggccagggu

SEQ ID NO: 162036 - RNA, 19 nt, Human
ggagcagauaaacauacuu

SEQ ID NO: 162037 - RNA, 22 nt, Human
ggagauggucacagguaaacau

SEQ ID NO: 162038 - RNA, 22 nt, Human
ggagaugaaugugguaaaacug

SEQ ID NO: 162039 - RNA, 22 nt, Human
gccuuucuugguuugucaggca

SEQ ID NO: 162040 - RNA, 22 nt, Human
gccuucgauaugaggguuugcc

SEQ ID NO: 162041 - RNA, 22 nt, Human
ggacccagggcuuauucauguu

SEQ ID NO: 162042 - RNA, 22 nt, Human
ggacagacuuuacagccccggg

SEQ ID NO: 162043 - RNA, 22 nt, Human
ggacggcuagcagcagaauuca

SEQ ID NO: 162044 - RNA, 21 nt, Human
ggacccucagauggcagugag

SEQ ID NO: 162045 - RNA, 22 nt, Human
ggacggggagcuggaaagggga

SEQ ID NO: 162046 - RNA, 22 nt, Human
gcgcacaaccccguggcgguga

SEQ ID NO: 162047 - RNA, 22 nt, Human
gcgauugguuuggggccagagu

SEQ ID NO: 162048 - RNA, 22 nt, Human
ggacucucaggcugucggcuuc

SEQ ID NO: 162049 - RNA, 22 nt, Human
ggaagucuacucuuccgaaaac

SEQ ID NO: 162050 - RNA, 22 nt, Human
ggaagugagcucauuacuuuag

SEQ ID NO: 162051 - RNA, 18 nt, Human
ggaaggugcuggagugca

SEQ ID NO: 162052 - RNA, 22 nt, Human
ggaaggugagugcugugugauu

SEQ ID NO: 162053 - RNA, 22 nt, Human
gccccaaccccuccuuggucua

SEQ ID NO: 162054 - RNA, 22 nt, Human
ggaaggggagcuggaaagggua

SEQ ID NO: 162055 - RNA, 21 nt, Human
gccugcuguucacccugccac

SEQ ID NO: 162056 - RNA, 22 nt, Human
gccugcuugaaagcacuuucug

SEQ ID NO: 162057 - RNA, 22 nt, Human
gccuggcagggagauuguaaga

SEQ ID NO: 162058 - RNA, 22 nt, Human
gcuggggaucgaaggcagagcc

SEQ ID NO: 162059 - RNA, 22 nt, Human
gcugggccucuuacuucuuacg

SEQ ID NO: 162060 - RNA, 22 nt, Human
gcugggacacacagucuucuuu

SEQ ID NO: 162061 - RNA, 22 nt, Human
gcccagccucagggcaucagcu

SEQ ID NO: 162062 - RNA, 22 nt, Human
gccaucuucggcagccgccugg

SEQ ID NO: 162063 - RNA, 22 nt, Human
gcugggagucgcgucuguggcc

SEQ ID NO: 162064 - RNA, 22 nt, Human
ggaagcugucugcccggcgcuc

SEQ ID NO: 162065 - RNA, 22 nt, Human
ggaagcuguugugagugcagca

SEQ ID NO: 162066 - RNA, 22 nt, Human
gcccauggagaccucaggcugg

SEQ ID NO: 162067 - RNA, 22 nt, Human
guguuucccuggcacaagaacc

SEQ ID NO: 162068 - RNA, 22 nt, Human
guguugcaggaagauauagcug

SEQ ID NO: 162069 - RNA, 22 nt, Human
ggggagggcugagcacgguuga

SEQ ID NO: 162070 - RNA, 22 nt, Human
ggggaagagagaagaaugaucu

SEQ ID NO: 162071 - RNA, 22 nt, Human
ggggaggaagcuggaacacggg

SEQ ID NO: 162072 - RNA, 22 nt, Human
ggggacaagggugucaguaggc

SEQ ID NO: 162073 - RNA, 22 nt, Human
ggggacggcuggccggggcccc

SEQ ID NO: 162074 - RNA, 22 nt, Human
ggggacugccgacagucucaaa

SEQ ID NO: 162075 - RNA, 22 nt, Human
ggggcaucguugauugcauggu

SEQ ID NO: 162076 - RNA, 21 nt, Human
ggggcccccacacaugccucc

SEQ ID NO: 162077 - RNA, 22 nt, Human
ggggccgggccggcagacuggg

SEQ ID NO: 162078 - RNA, 22 nt, Human
ggggccuuugaguugggucccu

SEQ ID NO: 162079 - RNA, 22 nt, Human
ggggcgaguguggaccgcagcc

SEQ ID NO: 162080 - RNA, 17 nt, Human
ggggcguguauuugaug

SEQ ID NO: 162081 - RNA, 22 nt, Human
ggggcggggagcaugagcuggg

SEQ ID NO: 162082 - RNA, 23 nt, Human
guuauugcuggugcuggccagcc

SEQ ID NO: 162083 - RNA, 22 nt, Human
gggguguuuugaagagguucag

SEQ ID NO: 162084 - RNA, 22 nt, Human
ggggucugaucccuucuggcuu

SEQ ID NO: 162085 - RNA, 22 nt, Human
ggguauuugacaaacugacacu

SEQ ID NO: 162086 - RNA, 22 nt, Human
ggguacaccaauggaugccagg

SEQ ID NO: 162087 - RNA, 22 nt, Human
gggguaggaagagaaaauagug

SEQ ID NO: 162088 - RNA, 22 nt, Human
gggggcgcguggagggccgugg

SEQ ID NO: 162089 - RNA, 22 nt, Human
gggggaggcucggcgccgcggu

SEQ ID NO: 162090 - RNA, 23 nt, Human
gggggagcuggacuccuagaucc

SEQ ID NO: 162091 - RNA, 22 nt, Human
ggggcuuccagcgcccgccggu

SEQ ID NO: 162092 - RNA, 22 nt, Human
ggggcuggguuugcgcaggcuc

SEQ ID NO: 162093 - RNA, 22 nt, Human
gggggaaaguggagguucguga

SEQ ID NO: 162094 - RNA, 22 nt, Human
gggggacagugugccuggugug

SEQ ID NO: 162095 - RNA, 22 nt, Human
ggggcuuggguaagaaugcaaa

SEQ ID NO: 162096 - RNA, 22 nt, Human
gggugucugcugaauuucccuu

SEQ ID NO: 162097 - RNA, 22 nt, Human
gggugguuccuggaucugacug

SEQ ID NO: 162098 - RNA, 22 nt, Human
guucuggaggagagccuggugu

SEQ ID NO: 162099 - RNA, 22 nt, Human
ggguggggcaugcucucuucug

SEQ ID NO: 162100 - RNA, 22 nt, Human
guuccucugugguggaggaagg

SEQ ID NO: 162101 - RNA, 22 nt, Human
guuccgcugcaaggccaggaaa

SEQ ID NO: 162102 - RNA, 22 nt, Human
guuccucucacaggcuggagcu

SEQ ID NO: 162103 - RNA, 22 nt, Human
guuccucugaaggauuuucaga

SEQ ID NO: 162104 - RNA, 22 nt, Human
guucaccaguagcugggcuguu

SEQ ID NO: 162105 - RNA, 22 nt, Human
guucuacaacuucgcuugcaga

SEQ ID NO: 162106 - RNA, 22 nt, Human
guucuacaugacacucaacauu

SEQ ID NO: 162107 - RNA, 20 nt, Human
gggucuggcaucucucucug

SEQ ID NO: 162108 - RNA, 22 nt, Human
gguacgagcccugccuaguguc

SEQ ID NO: 162109 - RNA, 22 nt, Human
ggguuccugaagugguucagga

SEQ ID NO: 162110 - RNA, 22 nt, Human
ggguuuccugcucgcggguagc

SEQ ID NO: 162111 - RNA, 22 nt, Human
ggguuuuaccagauguguggug

SEQ ID NO: 162112 - RNA, 22 nt, Human
guucuucagcccucagguccua

SEQ ID NO: 162113 - RNA, 22 nt, Human
gggcuggcaguuuucugaguuc

SEQ ID NO: 162114 - RNA, 22 nt, Human
gggcucuuaauuuuuuucucua

SEQ ID NO: 162115 - RNA, 22 nt, Human
gggcugaugcuuauacauacug

SEQ ID NO: 162116 - RNA, 22 nt, Human
gggcuggggcucuggggcuagg

SEQ ID NO: 162117 - RNA, 22 nt, Human
gggcuguaggagcuggaauggg

SEQ ID NO: 162118 - RNA, 22 nt, Human
gggcuguggggccugcagaagg

SEQ ID NO: 162119 - RNA, 22 nt, Human
guguggcgacucagagcugccu

SEQ ID NO: 162120 - RNA, 22 nt, Human
gggcuuguuaacuuggcuucca

SEQ ID NO: 162121 - RNA, 18 nt, Human
gggcuuugggguucuauc

SEQ ID NO: 162122 - RNA, 22 nt, Human
ggggaagaaauagaacauuuug

SEQ ID NO: 162123 - RNA, 22 nt, Human
guguucccauccacaccaagcc

SEQ ID NO: 162124 - RNA, 22 nt, Human
gggcgcuguguuaggugcugua

SEQ ID NO: 162125 - RNA, 22 nt, Human
gugguaccaguaggucagccau

SEQ ID NO: 162126 - RNA, 22 nt, Human
gggcgcgccaggagcugcgcgg

SEQ ID NO: 162127 - RNA, 22 nt, Human
gggcgccgggagugagagugag

SEQ ID NO: 162128 - RNA, 22 nt, Human
guggugauuugggucuagcuuu

SEQ ID NO: 162129 - RNA, 22 nt, Human
guggucaagaccgggaauagga

SEQ ID NO: 162130 - RNA, 22 nt, Human
guggugaacauuugcaucugcu

SEQ ID NO: 162131 - RNA, 22 nt, Human
gggcggggggagcuggaaugaa

SEQ ID NO: 162132 - RNA, 22 nt, Human
gggcggggcucacggugcggca

SEQ ID NO: 162133 - RNA, 22 nt, Human
gggcggccugcucuguggggag

SEQ ID NO: 162134 - RNA, 22 nt, Human
gggcuacagaugggagggauga

SEQ ID NO: 162135 - RNA, 22 nt, Human
gggcuagggucagggggccacu

SEQ ID NO: 162136 - RNA, 22 nt, Human
gugguggggaguuggauggaag

SEQ ID NO: 162137 - RNA, 22 nt, Human
guggguccaaccugugugugug

SEQ ID NO: 162138 - RNA, 22 nt, Human
gugggggcuaaauugaggggug

SEQ ID NO: 162139 - RNA, 22 nt, Human
guggggguaggggguuuccugg

SEQ ID NO: 162140 - RNA, 22 nt, Human
gggccuguccccccaggagaac

SEQ ID NO: 162141 - RNA, 22 nt, Human
gggccugcgcuggggggagccg

SEQ ID NO: 162142 - RNA, 22 nt, Human
gugggugaguggggccgccuga

SEQ ID NO: 162143 - RNA, 22 nt, Human
guggggcgggucccccgccugg

SEQ ID NO: 162144 - RNA, 18 nt, Human
gugggcacacacucuguu

SEQ ID NO: 162145 - RNA, 22 nt, Human
guggcagagccuugcggcuuug

SEQ ID NO: 162146 - RNA, 22 nt, Human
guggcaaguuuucugacaagga

SEQ ID NO: 162147 - RNA, 22 nt, Human
guggauggagcuggaagccauu

SEQ ID NO: 162148 - RNA, 22 nt, Human
guggauuguaccacgaaaagug

SEQ ID NO: 162149 - RNA, 22 nt, Human
guggcuggguggaacugagucu

SEQ ID NO: 162150 - RNA, 18 nt, Human
guggccauugaccagcuu

SEQ ID NO: 162151 - RNA, 22 nt, Human
guggcauggggagcagcuagaa

SEQ ID NO: 162152 - RNA, 22 nt, Human
guggccuuccuguuccuuugaa

SEQ ID NO: 162153 - RNA, 22 nt, Human
gggcagagagcuggaacuccuu

SEQ ID NO: 162154 - RNA, 22 nt, Human
guggaagggaaaccgcacuggc

SEQ ID NO: 162155 - RNA, 22 nt, Human
gggcaggcuggguggugguccc

SEQ ID NO: 162156 - RNA, 22 nt, Human
gggcaggggcagugguggcauu

SEQ ID NO: 162157 - RNA, 22 nt, Human
guggaaggaauuaacagacuag

SEQ ID NO: 162158 - RNA, 22 nt, Human
ggccuugggauguggcugcagc

SEQ ID NO: 162159 - RNA, 22 nt, Human
ggccuugauuccggucauugaa

SEQ ID NO: 162160 - RNA, 22 nt, Human
gggccggcuggggcggggcggg

SEQ ID NO: 162161 - RNA, 22 nt, Human
gggcccggguaggggaagagag

SEQ ID NO: 162162 - RNA, 22 nt, Human
gggcccaacuguuggcagccuc

SEQ ID NO: 162163 - RNA, 20 nt, Human
gggccagguggaccaggggc

SEQ ID NO: 162164 - RNA, 22 nt, Human
gggccaggaugugguucauuuu

SEQ ID NO: 162165 - RNA, 22 nt, Human
guggagaucuggugcccccugg

SEQ ID NO: 162166 - RNA, 22 nt, Human
guggacagacauaauccuaauu

SEQ ID NO: 162167 - RNA, 22 nt, Human
guagguggaggcaacacagcca

SEQ ID NO: 162168 - RNA, 22 nt, Human
ggugcuggggaaauuaggguag

SEQ ID NO: 162169 - RNA, 22 nt, Human
gguaugaggaugaggguggcau

SEQ ID NO: 162170 - RNA, 22 nt, Human
gguggcagaggaggcgggagag

SEQ ID NO: 162171 - RNA, 22 nt, Human
gguggccggcaccccacccucg

SEQ ID NO: 162172 - RNA, 22 nt, Human
gguggccuaacaaugguggcaa

SEQ ID NO: 162173 - RNA, 22 nt, Human
gguugggauuauccaaggcaga

SEQ ID NO: 162174 - RNA, 23 nt, Human
gguuggcuguacccaggcucccu

SEQ ID NO: 162175 - RNA, 22 nt, Human
gguuccagacaguuauaugggc

SEQ ID NO: 162176 - RNA, 22 nt, Human
uaaagaagaaaaggcuucaggc

SEQ ID NO: 162177 - RNA, 22 nt, Human
gguguuccgguucugcucuggg

SEQ ID NO: 162178 - RNA, 22 nt, Human
gugauuucaaauauagagugag

SEQ ID NO: 162179 - RNA, 19 nt, Human
uagagcagcuucagauucc

SEQ ID NO: 162180 - RNA, 22 nt, Human
gugaugugugaaggucugcagg

SEQ ID NO: 162181 - RNA, 22 nt, Human
gugaggugauugcugguguuug

SEQ ID NO: 162182 - RNA, 22 nt, Human
gugaugaaggccugcaccuggu

SEQ ID NO: 162183 - RNA, 22 nt, Human
gugcagcugggcgcugaccuuc

SEQ ID NO: 162184 - RNA, 22 nt, Human
uagaugaacagaaagccacugu

SEQ ID NO: 162185 - RNA, 22 nt, Human
gugccgcuggagcuggaauuga

SEQ ID NO: 162186 - RNA, 22 nt, Human
gugccgggcugcggcaaggugu

SEQ ID NO: 162187 - RNA, 22 nt, Human
uagcagaacaauagucaaugau

SEQ ID NO: 162188 - RNA, 22 nt, Human
uagcaggagagaaguuuuaagu

SEQ ID NO: 162189 - RNA, 22 nt, Human
gugccuggugcaggauaaucac

SEQ ID NO: 162190 - RNA, 21 nt, Human
uacaagaccggauucgggccc

SEQ ID NO: 162191 - RNA, 22 nt, Human
gucugaaauaucuuuugucuug

SEQ ID NO: 162192 - RNA, 22 nt, Human
gucugaggagaggcagcauaac

SEQ ID NO: 162193 - RNA, 22 nt, Human
gucuccugcccacccugguccc

SEQ ID NO: 162194 - RNA, 23 nt, Human
gucagcuugaccaguggagaguc

SEQ ID NO: 162195 - RNA, 22 nt, Human
gucuaccuucuuucucaacugg

SEQ ID NO: 162196 - RNA, 19 nt, Human
uacccggauagccagguag

SEQ ID NO: 162197 - RNA, 20 nt, Human
uacccgcagcugggucuggc

SEQ ID NO: 162198 - RNA, 20 nt, Human
uaccagggguuugggacagc

SEQ ID NO: 162199 - RNA, 22 nt, Human
uacaggaggaugugcagccagg

SEQ ID NO: 162200 - RNA, 22 nt, Human
uacuggaugcaacaaagcccag

SEQ ID NO: 162201 - RNA, 21 nt, Human
uacugugccagggcagcucug

SEQ ID NO: 162202 - RNA, 22 nt, Human
uacucgaaaucagagagaauaa

SEQ ID NO: 162203 - RNA, 22 nt, Human
uacucuggaguugagaugcgag

SEQ ID NO: 162204 - RNA, 20 nt, Human
uacaaggauguucaucagag

SEQ ID NO: 162205 - RNA, 22 nt, Human
uacaagcucuuguagggggaaa

SEQ ID NO: 162206 - RNA, 22 nt, Human
uaagauggaagaaaaggcggau

SEQ ID NO: 162207 - RNA, 23 nt, Human
uaagccugugccugcuaccugcu

SEQ ID NO: 162208 - RNA, 22 nt, Human
ucauccgcaaccacuuuagccu

SEQ ID NO: 162209 - RNA, 22 nt, Human
ucauccucguccucuggugccc

SEQ ID NO: 162210 - RNA, 22 nt, Human
uccaccuaagucuccgggagcu

SEQ ID NO: 162211 - RNA, 22 nt, Human
uccacgggagcgucggucucgg

SEQ ID NO: 162212 - RNA, 22 nt, Human
uccacgcucuuucuacuuuuca

SEQ ID NO: 162213 - RNA, 22 nt, Human
uccaccaccaucacagucagac

SEQ ID NO: 162214 - RNA, 22 nt, Human
uccacuguguagucucccaagu

SEQ ID NO: 162215 - RNA, 21 nt, Human
uaccacugaaauugaucguuc

SEQ ID NO: 162216 - RNA, 22 nt, Human
uccagagcuguccuacugugag

SEQ ID NO: 162217 - RNA, 22 nt, Human
uccagaaagccguugacuuauu

SEQ ID NO: 162218 - RNA, 20 nt, Human
uaccaucauuggcaaaccuc

SEQ ID NO: 162219 - RNA, 22 nt, Human
uccagcacacagguggcucuca

SEQ ID NO: 162220 - RNA, 19 nt, Human
uaccagguuggagaggccc

SEQ ID NO: 162221 - RNA, 22 nt, Human
uacugccauuauccugcugaaa

SEQ ID NO: 162222 - RNA, 23 nt, Human
ucccaacuuugaaauauuccaca

SEQ ID NO: 162223 - RNA, 22 nt, Human
ucccacagcuuccuagccacag

SEQ ID NO: 162224 - RNA, 22 nt, Human
uccauguugauaaucuugugaa

SEQ ID NO: 162225 - RNA, 22 nt, Human
uccauucccugacagccucuuu

SEQ ID NO: 162226 - RNA, 22 nt, Human
uccagugguggcucccggaccu

SEQ ID NO: 162227 - RNA, 22 nt, Human
uccagccauaucuuguagcccu

SEQ ID NO: 162228 - RNA, 22 nt, Human
uaccgaagcugcuuuugcaugu

SEQ ID NO: 162229 - RNA, 22 nt, Human
uccagcuccugaguucacugcu

SEQ ID NO: 162230 - RNA, 22 nt, Human
ucgccccccgccucacccucgg

SEQ ID NO: 162231 - RNA, 22 nt, Human
ucgcucgcuggcuccugcccgc

SEQ ID NO: 162232 - RNA, 22 nt, Human
ucgaugcuggcgcagguuucac

SEQ ID NO: 162233 - RNA, 22 nt, Human
ucgcccagguuggagugcagug

SEQ ID NO: 162234 - RNA, 22 nt, Human
ucgaaugccaacaccgaaguuu

SEQ ID NO: 162235 - RNA, 22 nt, Human
uccuuuuuagguuauuguacau

SEQ ID NO: 162236 - RNA, 22 nt, Human
ucgagaccagcuagaaggaagu

SEQ ID NO: 162237 - RNA, 22 nt, Human
ucgacguuguuuuuucucuguc

SEQ ID NO: 162238 - RNA, 22 nt, Human
ucgacuccauuuuucuugguuc

SEQ ID NO: 162239 - RNA, 22 nt, Human
ucgagcacaccagacuugcaga

SEQ ID NO: 162240 - RNA, 22 nt, Human
uaggccugcugaagagcaagcu

SEQ ID NO: 162241 - RNA, 22 nt, Human
ucggccuuuucuuauacccaca

SEQ ID NO: 162242 - RNA, 22 nt, Human
ucggcgaccugucauggaccaa

SEQ ID NO: 162243 - RNA, 22 nt, Human
ucgcuguguccuuuucacuuau

SEQ ID NO: 162244 - RNA, 22 nt, Human
ucguccaauaaccugccagcgc

SEQ ID NO: 162245 - RNA, 23 nt, Human
ucgucgucagccacuaccucccc

SEQ ID NO: 162246 - RNA, 21 nt, Human
ucgggcggcggcugaggcggc

SEQ ID NO: 162247 - RNA, 22 nt, Human
ucgggaggaggcggagcucguu

SEQ ID NO: 162248 - RNA, 22 nt, Human
ucgggccacauccacacaucca

SEQ ID NO: 162249 - RNA, 22 nt, Human
ucgggcgaauguuguuuuucuc

SEQ ID NO: 162250 - RNA, 22 nt, Human
uaggucaaggccacuucuugga

SEQ ID NO: 162251 - RNA, 22 nt, Human
ucgggacccccgcccgggcccg

SEQ ID NO: 162252 - RNA, 22 nt, Human
ucggcuccucccuggaaagggg

SEQ ID NO: 162253 - RNA, 22 nt, Human
uaggugucuggacaacuuugua

SEQ ID NO: 162254 - RNA, 22 nt, Human
uagucggcuaggagggccuucu

SEQ ID NO: 162255 - RNA, 22 nt, Human
uccugcccuguccuugccucug

SEQ ID NO: 162256 - RNA, 22 nt, Human
uagccacagaauucugaguaga

SEQ ID NO: 162257 - RNA, 17 nt, Human
uagccagcuugugauuu

SEQ ID NO: 162258 - RNA, 22 nt, Human
uagcgggucacccugcugugaa

SEQ ID NO: 162259 - RNA, 22 nt, Human
uccucuucucuagagccggaau

SEQ ID NO: 162260 - RNA, 22 nt, Human
uagcaaucugugaugugugugu

SEQ ID NO: 162261 - RNA, 22 nt, Human
uccugaggaaauuucaccuagu

SEQ ID NO: 162262 - RNA, 23 nt, Human
uccugcagauaagcugguugaca

SEQ ID NO: 162263 - RNA, 22 nt, Human
uagccaaguguuuuucaugacc

SEQ ID NO: 162264 - RNA, 22 nt, Human
uagcauccugugugaauguauu

SEQ ID NO: 162265 - RNA, 17 nt, Human
uccuacaggugugcuga

SEQ ID NO: 162266 - RNA, 22 nt, Human
uccuaguucugaccucgcucac

SEQ ID NO: 162267 - RNA, 22 nt, Human
uccuaccucaaaaggcaccagc

SEQ ID NO: 162268 - RNA, 22 nt, Human
uccuacccccuucuccagcucc

SEQ ID NO: 162269 - RNA, 19 nt, Human
uccuacaugagacagagag

SEQ ID NO: 162270 - RNA, 22 nt, Human
uccucugagguccucucggcca

SEQ ID NO: 162271 - RNA, 22 nt, Human
uagaccugugggggcagcgggc

SEQ ID NO: 162272 - RNA, 22 nt, Human
uagacuggaagcuccuugaggc

SEQ ID NO: 162273 - RNA, 22 nt, Human
uagaaugggaggggaaucaucc

SEQ ID NO: 162274 - RNA, 22 nt, Human
uagaagaugccuuaaaguugaa

SEQ ID NO: 162275 - RNA, 22 nt, Human
ucccagcaggcaccgcuucugc

SEQ ID NO: 162276 - RNA, 22 nt, Human
ucccagccugacagugcaucaa

SEQ ID NO: 162277 - RNA, 22 nt, Human
ucccauauuauggggaaaaacu

SEQ ID NO: 162278 - RNA, 22 nt, Human
ucccaugaguuugguguagucu

SEQ ID NO: 162279 - RNA, 22 nt, Human
uacuuaucuuagggaugcuugc

SEQ ID NO: 162280 - RNA, 22 nt, Human
guuuucuuguuaauuuugaacg

SEQ ID NO: 162281 - RNA, 22 nt, Human
guuuuucuagaaaucuccuccu

SEQ ID NO: 162282 - RNA, 21 nt, Human
ucagaccaacucuuguauccu

SEQ ID NO: 162283 - RNA, 22 nt, Human
guuuucuccugcuauacagugc

SEQ ID NO: 162284 - RNA, 22 nt, Human
ucagaaacuaaauguggauuug

SEQ ID NO: 162285 - RNA, 22 nt, Human
ucagcaggugcuuuguuuacuc

SEQ ID NO: 162286 - RNA, 23 nt, Human
ucagccgcuggcgaguccacugg

SEQ ID NO: 162287 - RNA, 22 nt, Human
ucagccuugguuuugguguugg

SEQ ID NO: 162288 - RNA, 22 nt, Human
ucagauggucauucacuagggu

SEQ ID NO: 162289 - RNA, 19 nt, Human
ucagcagauuuugcaaaca

SEQ ID NO: 162290 - RNA, 22 nt, Human
ucagcgucuccaaaagagcccg

SEQ ID NO: 162291 - RNA, 22 nt, Human
guuuuucuuugauuuagaacca

SEQ ID NO: 162292 - RNA, 21 nt, Human
uaaaagaugacaagacagcuc

SEQ ID NO: 162293 - RNA, 22 nt, Human
ucagcguuggccuccuccaggg

SEQ ID NO: 162294 - RNA, 22 nt, Human
ucagcuucaucuugagcccaca

SEQ ID NO: 162295 - RNA, 22 nt, Human
uaaacgaagcuucaugcuugaa

SEQ ID NO: 162296 - RNA, 22 nt, Human
guuuccaggcuuugguaugguu

SEQ ID NO: 162297 - RNA, 22 nt, Human
ucaccauguacaugaagggcgg

SEQ ID NO: 162298 - RNA, 22 nt, Human
ucacccuguggcuauaaggcaa

SEQ ID NO: 162299 - RNA, 22 nt, Human
ucaccauguuuucauaggaaca

SEQ ID NO: 162300 - RNA, 22 nt, Human
ucacccagacugucugacucuu

SEQ ID NO: 162301 - RNA, 22 nt, Human
guugauuuaggguuuugguuuu

SEQ ID NO: 162302 - RNA, 22 nt, Human
gugcucaagacauuaggaauau

SEQ ID NO: 162303 - RNA, 22 nt, Human
gugcuaugugcugaacucaggu

SEQ ID NO: 162304 - RNA, 22 nt, Human
guguccaaagguaggaggaggg

SEQ ID NO: 162305 - RNA, 22 nt, Human
guguccuguagaaacuguucca

SEQ ID NO: 162306 - RNA, 22 nt, Human
uaugagguuaucuaugucguau

SEQ ID NO: 162307 - RNA, 22 nt, Human
uaugcacacguguccaugugca

SEQ ID NO: 162308 - RNA, 19 nt, Human
uaucccccauagcagugcg

SEQ ID NO: 162309 - RNA, 22 nt, Human
guugauuuaaccucaccuuuga

SEQ ID NO: 162310 - RNA, 22 nt, Human
guucuguauauauccuagcaaa

SEQ ID NO: 162311 - RNA, 22 nt, Human
guuccgcggccucgcgcugagc

SEQ ID NO: 162312 - RNA, 22 nt, Human
ucaagaagauaaugucuagggu

SEQ ID NO: 162313 - RNA, 22 nt, Human
ucaagcuggaaaugaagaaucu

SEQ ID NO: 162314 - RNA, 22 nt, Human
ugaaggccagggauuugcagcc

SEQ ID NO: 162315 - RNA, 22 nt, Human
ucaaggaagggguaggaauaau

SEQ ID NO: 162316 - RNA, 22 nt, Human
ucaaccucccugcucaccccuc

SEQ ID NO: 162317 - RNA, 22 nt, Human
ugaaggggaaagucuugcuaua

SEQ ID NO: 162318 - RNA, 22 nt, Human
ugaagguggcuugcagcuaguc

SEQ ID NO: 162319 - RNA, 22 nt, Human
ugaaucaaugaauugcacuuca

SEQ ID NO: 162320 - RNA, 23 nt, Human
ucacaaggcuauguuauauguac

SEQ ID NO: 162321 - RNA, 21 nt, Human
ucaaguccuggcuuugcucuu

SEQ ID NO: 162322 - RNA, 22 nt, Human
ucaagggaccaagcauucauua

SEQ ID NO: 162323 - RNA, 22 nt, Human
ucaauuggcuacaaauaaugua

SEQ ID NO: 162324 - RNA, 22 nt, Human
ugaaugaguucaccgcucaguu

SEQ ID NO: 162325 - RNA, 22 nt, Human
ugaaugcuacccugcuggcucu

SEQ ID NO: 162326 - RNA, 22 nt, Human
ucaccaugcccuucucugcucu

SEQ ID NO: 162327 - RNA, 22 nt, Human
ucaccaggauugggcuguaggc

SEQ ID NO: 162328 - RNA, 22 nt, Human
ucaccugccuggguggucaccu

SEQ ID NO: 162329 - RNA, 22 nt, Human
ucaccuggagagcuugcuaaua

SEQ ID NO: 162330 - RNA, 19 nt, Human
ucacggucaaccagagccu

SEQ ID NO: 162331 - RNA, 22 nt, Human
ucacucgccuuuucguucgccg

SEQ ID NO: 162332 - RNA, 23 nt, Human
ugacagguucuaugguuuccaac

SEQ ID NO: 162333 - RNA, 22 nt, Human
ucagaaggagagacagcgugga

SEQ ID NO: 162334 - RNA, 22 nt, Human
ucagagccagacacacagcaga

SEQ ID NO: 162335 - RNA, 23 nt, Human
ucagaccaaccucuugcuggaac

SEQ ID NO: 162336 - RNA, 22 nt, Human
ucacuuccuugcagcuguagaa

SEQ ID NO: 162337 - RNA, 22 nt, Human
ucacuucuaugaucugucucuu

SEQ ID NO: 162338 - RNA, 22 nt, Human
ucaggacacuuaauaggaacag

SEQ ID NO: 162339 - RNA, 22 nt, Human
ucaggagaguguucaguggagg

SEQ ID NO: 162340 - RNA, 22 nt, Human
ucaggcaggaucccagggaagg

SEQ ID NO: 162341 - RNA, 22 nt, Human
ugacugguauuuguaaaccaua

SEQ ID NO: 162342 - RNA, 22 nt, Human
ucagcucacaauguugagaaag

SEQ ID NO: 162343 - RNA, 21 nt, Human
ucaggaagagccaguucaugc

SEQ ID NO: 162344 - RNA, 22 nt, Human
ucagcucaggggauguggggga

SEQ ID NO: 162345 - RNA, 22 nt, Human
ugaccgucagcugucuuccauu

SEQ ID NO: 162346 - RNA, 22 nt, Human
ugaccuacauuuauagcuguca

SEQ ID NO: 162347 - RNA, 22 nt, Human
ugacgcauggccagcucugucu

SEQ ID NO: 162348 - RNA, 21 nt, Human
ucagccuguccaguguuaacc

SEQ ID NO: 162349 - RNA, 22 nt, Human
ucuuuuucccugguuccuuuuu

SEQ ID NO: 162350 - RNA, 22 nt, Human
ugaaagcuggcucugcagagug

SEQ ID NO: 162351 - RNA, 22 nt, Human
ucaaccagcuuaucugcaggau

SEQ ID NO: 162352 - RNA, 22 nt, Human
ugaaccgcuucauggugccugu

SEQ ID NO: 162353 - RNA, 22 nt, Human
ugaacuggauuugugagcuccu

SEQ ID NO: 162354 - RNA, 22 nt, Human
ugaacuguccuuguugucuaga

SEQ ID NO: 162355 - RNA, 22 nt, Human
ugaacuucccauguacagacug

SEQ ID NO: 162356 - RNA, 22 nt, Human
ugaaccuaacauuucuggcagu

SEQ ID NO: 162357 - RNA, 22 nt, Human
ucuuucucuccagccuggaccu

SEQ ID NO: 162358 - RNA, 22 nt, Human
ucuugcuguggcagaucuggag

SEQ ID NO: 162359 - RNA, 22 nt, Human
ucuugcucuguucuaaaggauu

SEQ ID NO: 162360 - RNA, 22 nt, Human
uauucuucaacuuuucuccucu

SEQ ID NO: 162361 - RNA, 22 nt, Human
ucuucccgggcaucucugcuca

SEQ ID NO: 162362 - RNA, 22 nt, Human
ucuacgugggaguucaggauuc

SEQ ID NO: 162363 - RNA, 22 nt, Human
uaguggccacugaagugcuaga

SEQ ID NO: 162364 - RNA, 22 nt, Human
ucuacuccaucugccagggcuu

SEQ ID NO: 162365 - RNA, 22 nt, Human
ucuaccuucagaaugugggguu

SEQ ID NO: 162366 - RNA, 22 nt, Human
ugagggagggggagccguucua

SEQ ID NO: 162367 - RNA, 22 nt, Human
ugagggaggggaaugugugcag

SEQ ID NO: 162368 - RNA, 22 nt, Human
ugagggucgcaagcaccaggcc

SEQ ID NO: 162369 - RNA, 22 nt, Human
ugaggucaggcagggguuuggc

SEQ ID NO: 162370 - RNA, 22 nt, Human
ugagucaccucucagaagccac

SEQ ID NO: 162371 - RNA, 22 nt, Human
ugaguucugacugagcaugggg

SEQ ID NO: 162372 - RNA, 22 nt, Human
ugagugggaggugggaagggua

SEQ ID NO: 162373 - RNA, 22 nt, Human
ugagucuguugcuagggggaau

SEQ ID NO: 162374 - RNA, 20 nt, Human
ugauccacucucauugcucu

SEQ ID NO: 162375 - RNA, 22 nt, Human
ucauuagaccucucugguucag

SEQ ID NO: 162376 - RNA, 19 nt, Human
ugaucuccaguacagacau

SEQ ID NO: 162377 - RNA, 22 nt, Human
ugaugaucaugcagguugguuu

SEQ ID NO: 162378 - RNA, 22 nt, Human
uccaaguuugagacugagagug

SEQ ID NO: 162379 - RNA, 22 nt, Human
uccaggucgggggugggccggc

SEQ ID NO: 162380 - RNA, 22 nt, Human
uccagguggcuuuccuggggga

SEQ ID NO: 162381 - RNA, 22 nt, Human
uccagguccuacuggcccauag

SEQ ID NO: 162382 - RNA, 22 nt, Human
ugcaaaaagagcgaggagcccu

SEQ ID NO: 162383 - RNA, 22 nt, Human
ugcaaaaguuuuauacacagau

SEQ ID NO: 162384 - RNA, 22 nt, Human
uccaccugucccugcuuccugc

SEQ ID NO: 162385 - RNA, 22 nt, Human
uccacagggaugccugcggcuu

SEQ ID NO: 162386 - RNA, 22 nt, Human
uccaccacgaaacugcagcugc

SEQ ID NO: 162387 - RNA, 22 nt, Human
uccagggaggggcggcaggggu

SEQ ID NO: 162388 - RNA, 22 nt, Human
uccaugcaguagaggcgcuggg

SEQ ID NO: 162389 - RNA, 22 nt, Human
ugcagccucacgcauccgcauu

SEQ ID NO: 162390 - RNA, 22 nt, Human
uccccggagucccuggccaggg

SEQ ID NO: 162391 - RNA, 22 nt, Human
ugcagcagaauauggcugcagg

SEQ ID NO: 162392 - RNA, 22 nt, Human
uccccgcugcgcccgcugcugc

SEQ ID NO: 162393 - RNA, 18 nt, Human
ugcagcuuugugauuggc

SEQ ID NO: 162394 - RNA, 22 nt, Human
ugcagaacacaguagacagaac

SEQ ID NO: 162395 - RNA, 22 nt, Human
ugcacgcgcccuucgauggccc

SEQ ID NO: 162396 - RNA, 23 nt, Human
ugcucgccuucaggacuugggcu

SEQ ID NO: 162397 - RNA, 22 nt, Human
ucgggggaaccggcccgggccu

SEQ ID NO: 162398 - RNA, 22 nt, Human
ucgggcccggcucccgacgccc

SEQ ID NO: 162399 - RNA, 22 nt, Human
ugcucugguccucccucggcgc

SEQ ID NO: 162400 - RNA, 22 nt, Human
ugcugcacccuucauuuuccca

SEQ ID NO: 162401 - RNA, 22 nt, Human
ugcuauucuuggagcugaugga

SEQ ID NO: 162402 - RNA, 22 nt, Human
ugcuagggcaggaggugaggag

SEQ ID NO: 162403 - RNA, 22 nt, Human
ugcucgauuauuucauuuugca

SEQ ID NO: 162404 - RNA, 22 nt, Human
ugcuccugaacacagcccuaug

SEQ ID NO: 162405 - RNA, 22 nt, Human
ucggccggagggggcgggcgca

SEQ ID NO: 162406 - RNA, 22 nt, Human
ugcuccucugcaugucugcggc

SEQ ID NO: 162407 - RNA, 22 nt, Human
ugcucagaagacuuacugguua

SEQ ID NO: 162408 - RNA, 22 nt, Human
ugcuauuuuguuuucaguccau

SEQ ID NO: 162409 - RNA, 22 nt, Human
ucgaggagagucgccagcugcu

SEQ ID NO: 162410 - RNA, 22 nt, Human
ucgccauguacaugaagggcgg

SEQ ID NO: 162411 - RNA, 22 nt, Human
ugcgccaggacacccguggcgg

SEQ ID NO: 162412 - RNA, 22 nt, Human
ucgagcgcucccugugcucucg

SEQ ID NO: 162413 - RNA, 22 nt, Human
ugccugucuaucuuugucaucu

SEQ ID NO: 162414 - RNA, 22 nt, Human
ucgauccaggaaggcugguuua

SEQ ID NO: 162415 - RNA, 22 nt, Human
ugcggugcgcccgggcgagugc

SEQ ID NO: 162416 - RNA, 22 nt, Human
ugcggugcagcccugcccucuc

SEQ ID NO: 162417 - RNA, 22 nt, Human
ugcgucccagcauguagggcag

SEQ ID NO: 162418 - RNA, 19 nt, Human
ugcgggcugcggucagggc

SEQ ID NO: 162419 - RNA, 22 nt, Human
ugcguggauuuaggagugaggg

SEQ ID NO: 162420 - RNA, 22 nt, Human
ugcaugaucucacuuacaggug

SEQ ID NO: 162421 - RNA, 22 nt, Human
ugcaugcagcuggucgggcgcc

SEQ ID NO: 162422 - RNA, 23 nt, Human
ugcaugagcaucuccaccucagu

SEQ ID NO: 162423 - RNA, 23 nt, Human
ucccuuuguucuugcuaggaugu

SEQ ID NO: 162424 - RNA, 22 nt, Human
ucccuuuucauccuaucccagc

SEQ ID NO: 162425 - RNA, 22 nt, Human
ucccuuuuuaauugugucccug

SEQ ID NO: 162426 - RNA, 22 nt, Human
ucccuuuuuccugaucugugaa

SEQ ID NO: 162427 - RNA, 22 nt, Human
ugcauuccagcucccuucuggc

SEQ ID NO: 162428 - RNA, 22 nt, Human
ugcauucugaacguaaauguga

SEQ ID NO: 162429 - RNA, 22 nt, Human
ugccagucggcacuuuaucugg

SEQ ID NO: 162430 - RNA, 16 nt, Human
ugccaagggguuaaug

SEQ ID NO: 162431 - RNA, 23 nt, Human
ugccaggaagaaugaccucugcu

SEQ ID NO: 162432 - RNA, 22 nt, Human
ugccaugguuguacaguagcag

SEQ ID NO: 162433 - RNA, 22 nt, Human
ugcccugcagacccugcagugu

SEQ ID NO: 162434 - RNA, 22 nt, Human
uccugggucugugagccauacu

SEQ ID NO: 162435 - RNA, 21 nt, Human
uccugcagggcagcagagugg

SEQ ID NO: 162436 - RNA, 22 nt, Human
ugccgccccggggcccccagcc

SEQ ID NO: 162437 - RNA, 22 nt, Human
ugccgccgugggucccgacgcg

SEQ ID NO: 162438 - RNA, 22 nt, Human
ugccuguguauuuccggccugc

SEQ ID NO: 162439 - RNA, 21 nt, Human
ugccuggccuuugcuuuuccu

SEQ ID NO: 162440 - RNA, 22 nt, Human
ucuucaguaaucgacauuccac

SEQ ID NO: 162441 - RNA, 22 nt, Human
uggcagcauuuuuuccagaaca

SEQ ID NO: 162442 - RNA, 22 nt, Human
uggcacugaagcuggaaagccu

SEQ ID NO: 162443 - RNA, 22 nt, Human
uggcacagcuugucauaaacuc

SEQ ID NO: 162444 - RNA, 22 nt, Human
uggcacaggcagaaggugccgc

SEQ ID NO: 162445 - RNA, 22 nt, Human
uggaugccuugggggaggagga

SEQ ID NO: 162446 - RNA, 22 nt, Human
uggaguucauauuggacauaag

SEQ ID NO: 162447 - RNA, 22 nt, Human
uggcagcucauuuggaaaugga

SEQ ID NO: 162448 - RNA, 22 nt, Human
uggcagccugcgugaaggagcu

SEQ ID NO: 162449 - RNA, 21 nt, Human
uggcaggcagcuggaagcuug

SEQ ID NO: 162450 - RNA, 22 nt, Human
uggcaggggaaaagggguggga

SEQ ID NO: 162451 - RNA, 20 nt, Human
uggcaugcucucuuuuuagg

SEQ ID NO: 162452 - RNA, 22 nt, Human
uggccagucuuagcugugccug

SEQ ID NO: 162453 - RNA, 22 nt, Human
uggccaaucagcugugaccugc

SEQ ID NO: 162454 - RNA, 22 nt, Human
uggcccauccggcuccuccuug

SEQ ID NO: 162455 - RNA, 22 nt, Human
uggcccagaucucugaccuuga

SEQ ID NO: 162456 - RNA, 22 nt, Human
uggacagugguggggaggagga

SEQ ID NO: 162457 - RNA, 22 nt, Human
uggacccaccccagggccugcu

SEQ ID NO: 162458 - RNA, 23 nt, Human
uggaaguugagagucugcuuugu

SEQ ID NO: 162459 - RNA, 22 nt, Human
uggaaugccgggccaggcuccg

SEQ ID NO: 162460 - RNA, 22 nt, Human
ucuggggaugagugaugucgua

SEQ ID NO: 162461 - RNA, 22 nt, Human
uggaagcccagaaggaagcaga

SEQ ID NO: 162462 - RNA, 22 nt, Human
uggagccagcaggacucagagg

SEQ ID NO: 162463 - RNA, 22 nt, Human
uggagcugaaguacucucacua

SEQ ID NO: 162464 - RNA, 22 nt, Human
uggagccuugugagaccacaau

SEQ ID NO: 162465 - RNA, 21 nt, Human
uggagcagggaggauuugggg

SEQ ID NO: 162466 - RNA, 22 nt, Human
uggagcaagaagggaggcagaa

SEQ ID NO: 162467 - RNA, 22 nt, Human
uggagagcaaugaggggcaggc

SEQ ID NO: 162468 - RNA, 22 nt, Human
uggaggcccagcugggggccgg

SEQ ID NO: 162469 - RNA, 22 nt, Human
uggaggagaacugauuuggcuu

SEQ ID NO: 162470 - RNA, 22 nt, Human
uggaggaggagaacuuggcacu

SEQ ID NO: 162471 - RNA, 22 nt, Human
ugcugccgccgccaccgccgcc

SEQ ID NO: 162472 - RNA, 19 nt, Human
ugcugcaggaauucucaag

SEQ ID NO: 162473 - RNA, 22 nt, Human
ugcugccucccaucccucccga

SEQ ID NO: 162474 - RNA, 22 nt, Human
ucuacgugacagaacagacuga

SEQ ID NO: 162475 - RNA, 22 nt, Human
uggaaaguuggaagucucagga

SEQ ID NO: 162476 - RNA, 22 nt, Human
uggaaagaagacugugguugag

SEQ ID NO: 162477 - RNA, 22 nt, Human
uggaaagcagcccugcucccca

SEQ ID NO: 162478 - RNA, 22 nt, Human
uggaagaaaacuuggaaggcau

SEQ ID NO: 162479 - RNA, 22 nt, Human
uggaacugguuugcuucagacu

SEQ ID NO: 162480 - RNA, 22 nt, Human
uggaagaagcuacaagcgguga

SEQ ID NO: 162481 - RNA, 22 nt, Human
ucugccuucaggagcagacucu

SEQ ID NO: 162482 - RNA, 23 nt, Human
ucugccuccuaauuguugguguc

SEQ ID NO: 162483 - RNA, 17 nt, Human
ucugccaguuuuagaau

SEQ ID NO: 162484 - RNA, 22 nt, Human
uggaacugauuaaaagggcaga

SEQ ID NO: 162485 - RNA, 22 nt, Human
ucugcggccggaauucccuuca

SEQ ID NO: 162486 - RNA, 22 nt, Human
uggggcuggccaggaggagucu

SEQ ID NO: 162487 - RNA, 22 nt, Human
uggggcuuucgcggagcgucgg

SEQ ID NO: 162488 - RNA, 22 nt, Human
ugaauggugcccuagagggaug

SEQ ID NO: 162489 - RNA, 22 nt, Human
ugggggaggaggagacagacug

SEQ ID NO: 162490 - RNA, 22 nt, Human
ugaaucuuguuuacugauuccu

SEQ ID NO: 162491 - RNA, 22 nt, Human
ugacagaaaccaccccccaggu

SEQ ID NO: 162492 - RNA, 22 nt, Human
ugacacacagggggauggaguu

SEQ ID NO: 162493 - RNA, 22 nt, Human
ugacaagagaccccuccgcagg

SEQ ID NO: 162494 - RNA, 17 nt, Human
ugacagcuaaggggcuu

SEQ ID NO: 162495 - RNA, 22 nt, Human
ugggccucuguuuccucaucug

SEQ ID NO: 162496 - RNA, 22 nt, Human
uggggagacauggaguaaaaga

SEQ ID NO: 162497 - RNA, 22 nt, Human
ugggcccaucauugcugugggc

SEQ ID NO: 162498 - RNA, 22 nt, Human
ugggccccucuucuucaguugg

SEQ ID NO: 162499 - RNA, 22 nt, Human
ugggccgugagacgucucuggg

SEQ ID NO: 162500 - RNA, 22 nt, Human
ugggcagggauuuggggaaacu

SEQ ID NO: 162501 - RNA, 22 nt, Human
ugggcagggagcuggaaccaca

SEQ ID NO: 162502 - RNA, 22 nt, Human
ugggcagagggugaggaaggcg

SEQ ID NO: 162503 - RNA, 20 nt, Human
ugggauggaaucaccugcac

SEQ ID NO: 162504 - RNA, 22 nt, Human
ugaaggaggugaauccaugcau

SEQ ID NO: 162505 - RNA, 22 nt, Human
ugaagcuagguucaugaggucg

SEQ ID NO: 162506 - RNA, 22 nt, Human
ugaaauuuuuuggagauaauuu

SEQ ID NO: 162507 - RNA, 22 nt, Human
uggcuuuucaccugcuccucug

SEQ ID NO: 162508 - RNA, 22 nt, Human
uggcuucuggccaggcacagga

SEQ ID NO: 162509 - RNA, 22 nt, Human
uggcuguuggagcuggaagaug

SEQ ID NO: 162510 - RNA, 22 nt, Human
uggcugaugucuguucuguuau

SEQ ID NO: 162511 - RNA, 23 nt, Human
uggcucugagcuuccugguggcc

SEQ ID NO: 162512 - RNA, 22 nt, Human
uggccugauuuugcuaagagaa

SEQ ID NO: 162513 - RNA, 22 nt, Human
ugggaaggggagcuggaaagga

SEQ ID NO: 162514 - RNA, 22 nt, Human
ugggaagccaguaucagacuaa

SEQ ID NO: 162515 - RNA, 18 nt, Human
ugggacucugacuugguu

SEQ ID NO: 162516 - RNA, 22 nt, Human
ugggagagauaggcuucuggac

SEQ ID NO: 162517 - RNA, 22 nt, Human
ugggauauagaauuggcagagu

SEQ ID NO: 162518 - RNA, 21 nt, Human
ugaagcccugugaggugcuua

SEQ ID NO: 162519 - RNA, 22 nt, Human
ugaagacuucuuuuggucacca

SEQ ID NO: 162520 - RNA, 22 nt, Human
ugaagccacacuagcuuguccu

SEQ ID NO: 162521 - RNA, 22 nt, Human
ugggaagaggaggcagggggca

SEQ ID NO: 162522 - RNA, 22 nt, Human
ugauggugagaugucccguguu

SEQ ID NO: 162523 - RNA, 22 nt, Human
uguauaugucugugagcuauua

SEQ ID NO: 162524 - RNA, 22 nt, Human
ugauguuucugaagggguuacu

SEQ ID NO: 162525 - RNA, 22 nt, Human
ugauugaauaauguuaugugaa

SEQ ID NO: 162526 - RNA, 22 nt, Human
uguccagcuauauguguaugug

SEQ ID NO: 162527 - RNA, 21 nt, Human
ugcaacugaaaggaauauggu

SEQ ID NO: 162528 - RNA, 22 nt, Human
ugucccuaucagucccaaguca

SEQ ID NO: 162529 - RNA, 22 nt, Human
ugucugggauguuggcagccac

SEQ ID NO: 162530 - RNA, 20 nt, Human
ugucugguaagacgcccauc

SEQ ID NO: 162531 - RNA, 18 nt, Human
ugcacccuaagggcccca

SEQ ID NO: 162532 - RNA, 16 nt, Human
ugcaccgggaacacug

SEQ ID NO: 162533 - RNA, 22 nt, Human
ugcacgcacuugcucuccagcg

SEQ ID NO: 162534 - RNA, 22 nt, Human
ugcaaggcacccacucugcuuu

SEQ ID NO: 162535 - RNA, 22 nt, Human
ugcacccacuuagcugaaguuc

SEQ ID NO: 162536 - RNA, 22 nt, Human
ugguucugucugugcugggggg

SEQ ID NO: 162537 - RNA, 22 nt, Human
ugagugugugucuuggguaccg

SEQ ID NO: 162538 - RNA, 22 nt, Human
ugaguugcagucaauauugcaa

SEQ ID NO: 162539 - RNA, 22 nt, Human
ugaguuucuuacucaggagcug

SEQ ID NO: 162540 - RNA, 22 nt, Human
uguaagaagaaaaccguaugga

SEQ ID NO: 162541 - RNA, 22 nt, Human
uggugaggacccagauuuuccu

SEQ ID NO: 162542 - RNA, 20 nt, Human
ugggguucccuuuagggcuu

SEQ ID NO: 162543 - RNA, 22 nt, Human
ugggggguuuagaaucugcccu

SEQ ID NO: 162544 - RNA, 22 nt, Human
ugggggauucaucucagagcgu

SEQ ID NO: 162545 - RNA, 17 nt, Human
ugaggcugucucccugg

SEQ ID NO: 162546 - RNA, 19 nt, Human
ugaggauugagguccagua

SEQ ID NO: 162547 - RNA, 22 nt, Human
uggugcacgugggcagucggcc

SEQ ID NO: 162548 - RNA, 22 nt, Human
ugagcuauuucaccauauagau

SEQ ID NO: 162549 - RNA, 21 nt, Human
ugagcccaaagcuguauuggu

SEQ ID NO: 162550 - RNA, 22 nt, Human
ugaggaagugguuguaugguuu

SEQ ID NO: 162551 - RNA, 22 nt, Human
ugaggaaugugacaaaaccaag

SEQ ID NO: 162552 - RNA, 22 nt, Human
uguuccggucuaucgugucaau

SEQ ID NO: 162553 - RNA, 22 nt, Human
ugccuuuuguguuuggcuaauc

SEQ ID NO: 162554 - RNA, 19 nt, Human
ugccuggcaccagcuccac

SEQ ID NO: 162555 - RNA, 22 nt, Human
uguguucagaagaggcugccgg

SEQ ID NO: 162556 - RNA, 22 nt, Human
uguguuagguuuugggauggcu

SEQ ID NO: 162557 - RNA, 19 nt, Human
uguguuccauccaccaccc

SEQ ID NO: 162558 - RNA, 20 nt, Human
ugccuuccgccccgggcacc

SEQ ID NO: 162559 - RNA, 22 nt, Human
ugccuguguuugggguggggaa

SEQ ID NO: 162560 - RNA, 22 nt, Human
ugccuucugccaaggacggugc

SEQ ID NO: 162561 - RNA, 17 nt, Human
ugccuucgucuucaguu

SEQ ID NO: 162562 - RNA, 22 nt, Human
uguugaucucuuuccaaauucu

SEQ ID NO: 162563 - RNA, 19 nt, Human
uguugcagcuugaucggua

SEQ ID NO: 162564 - RNA, 22 nt, Human
ugcguugaggaccgcgagggcg

SEQ ID NO: 162565 - RNA, 21 nt, Human
ugcuaagugucacaugucugc

SEQ ID NO: 162566 - RNA, 22 nt, Human
uguucugauggauuacaugucu

SEQ ID NO: 162567 - RNA, 22 nt, Human
uguucuucaaacucaguuccac

SEQ ID NO: 162568 - RNA, 19 nt, Human
uguucuacuugcuaguauu

SEQ ID NO: 162569 - RNA, 22 nt, Human
ugcgcgcaccugcauauauaug

SEQ ID NO: 162570 - RNA, 22 nt, Human
ugcggcucaaagggaaggccuu

SEQ ID NO: 162571 - RNA, 23 nt, Human
uguuccugaugccucguccuguc

SEQ ID NO: 162572 - RNA, 22 nt, Human
uguuccacgcguaguuccugcu

SEQ ID NO: 162573 - RNA, 22 nt, Human
ugcgccuccugcugccugcccu

SEQ ID NO: 162574 - RNA, 22 nt, Human
ugcauucugggucgcagagugg

SEQ ID NO: 162575 - RNA, 22 nt, Human
ugcaguugcguuugcauuccau

SEQ ID NO: 162576 - RNA, 21 nt, Human
uguggccauuugaaaacaggg

SEQ ID NO: 162577 - RNA, 22 nt, Human
uguggccaccagagcugcuauu

SEQ ID NO: 162578 - RNA, 18 nt, Human
ugcaggggaggggugaua

SEQ ID NO: 162579 - RNA, 22 nt, Human
ugcagggucuccuguacuuggg

SEQ ID NO: 162580 - RNA, 22 nt, Human
ugcaggguuucaauacacagga

SEQ ID NO: 162581 - RNA, 22 nt, Human
ugugcgcgugugcuuugugugu

SEQ ID NO: 162582 - RNA, 22 nt, Human
ugugcgucuguguacagaugug

SEQ ID NO: 162583 - RNA, 22 nt, Human
ugcaggagaaaguacggagcgu

SEQ ID NO: 162584 - RNA, 22 nt, Human
ugcaggagcaccagcucacccu

SEQ ID NO: 162585 - RNA, 20 nt, Human
ugcacggcugugugugugca

SEQ ID NO: 162586 - RNA, 22 nt, Human
uguggguggucagcgugugaug

SEQ ID NO: 162587 - RNA, 22 nt, Human
ugugggcguggguuggggaggg

SEQ ID NO: 162588 - RNA, 18 nt, Human
ugcccaccagaagaggga

SEQ ID NO: 162589 - RNA, 22 nt, Human
ugccaaagauagagguuugagu

SEQ ID NO: 162590 - RNA, 22 nt, Human
uguggacauuccaaaaggacca

SEQ ID NO: 162591 - RNA, 22 nt, Human
uugcugggauucauugaagggu

SEQ ID NO: 162592 - RNA, 21 nt, Human
uugcuggagcaauguaaauca

SEQ ID NO: 162593 - RNA, 22 nt, Human
uugcugcgcugaccuccaguga

SEQ ID NO: 162594 - RNA, 22 nt, Human
uugcugccagcgcccugcaggg

SEQ ID NO: 162595 - RNA, 22 nt, Human
ugugggaggauuuaggugaauc

SEQ ID NO: 162596 - RNA, 22 nt, Human
ugugcuugucguggagccaggc

SEQ ID NO: 162597 - RNA, 22 nt, Human
ugugcugcagcgagagcuacga

SEQ ID NO: 162598 - RNA, 22 nt, Human
uguggugcucagggaggauggg

SEQ ID NO: 162599 - RNA, 22 nt, Human
ugugguuggggucagauaggga

SEQ ID NO: 162600 - RNA, 22 nt, Human
uguggugcagcgggaacagcuu

SEQ ID NO: 162601 - RNA, 19 nt, Human
uuggagcaucccaaaggcu

SEQ ID NO: 162602 - RNA, 22 nt, Human
ugugugguaaugagagauccaa

SEQ ID NO: 162603 - RNA, 22 nt, Human
uuggaggcagagucuugcugag

SEQ ID NO: 162604 - RNA, 22 nt, Human
uuggaggaagcucaugggggau

SEQ ID NO: 162605 - RNA, 22 nt, Human
uugcuugaacccaggaagugga

SEQ ID NO: 162606 - RNA, 23 nt, Human
uugcuugagcccaggaaguggag

SEQ ID NO: 162607 - RNA, 22 nt, Human
uuggccuuacgcauggucggca

SEQ ID NO: 162608 - RNA, 22 nt, Human
uuggcuucuugcuaggaagcug

SEQ ID NO: 162609 - RNA, 22 nt, Human
uuggccugcuccagaacaaggg

SEQ ID NO: 162610 - RNA, 22 nt, Human
uuggcgcuauuauuaccacauu

SEQ ID NO: 162611 - RNA, 22 nt, Human
uguuaacugccaggacagaucg

SEQ ID NO: 162612 - RNA, 22 nt, Human
uguugaagcaccucugucuuuc

SEQ ID NO: 162613 - RNA, 22 nt, Human
uuggucagaugugucuccuccu

SEQ ID NO: 162614 - RNA, 22 nt, Human
uguugaugaccacaauuuaugc

SEQ ID NO: 162615 - RNA, 22 nt, Human
uguuguagacaguucacucgug

SEQ ID NO: 162616 - RNA, 23 nt, Human
uguuguccaacugaucuccaggc

SEQ ID NO: 162617 - RNA, 21 nt, Human
uguugcuugucugagacuaug

SEQ ID NO: 162618 - RNA, 22 nt, Human
uuggugauguagcagcaauugu

SEQ ID NO: 162619 - RNA, 20 nt, Human
ugucccuggagagcugcaga

SEQ ID NO: 162620 - RNA, 22 nt, Human
uugauuuccauuguccagcauu

SEQ ID NO: 162621 - RNA, 22 nt, Human
ugucauuggugaucugaugccu

SEQ ID NO: 162622 - RNA, 22 nt, Human
ugucaccucauacaguaccuca

SEQ ID NO: 162623 - RNA, 23 nt, Human
ugucugccuaucaugugaaggac

SEQ ID NO: 162624 - RNA, 22 nt, Human
ugucguaaaagggccgcagugg

SEQ ID NO: 162625 - RNA, 22 nt, Human
uugcaagcccugaagggcugga

SEQ ID NO: 162626 - RNA, 22 nt, Human
uugcacagaugcacaugguugc

SEQ ID NO: 162627 - RNA, 22 nt, Human
ugucugcauucgaguucaugga

SEQ ID NO: 162628 - RNA, 22 nt, Human
ugugagucuugcaggucgcuca

SEQ ID NO: 162629 - RNA, 22 nt, Human
ugugcagaaggagguucuccgg

SEQ ID NO: 162630 - RNA, 22 nt, Human
ugugaagcgugugcaggggaca

SEQ ID NO: 162631 - RNA, 22 nt, Human
ugugacaugauggcgucaugua

SEQ ID NO: 162632 - RNA, 22 nt, Human
uugcagauuucuuguccccauu

SEQ ID NO: 162633 - RNA, 22 nt, Human
ugugagccuuuauuaaccucau

SEQ ID NO: 162634 - RNA, 23 nt, Human
uguaaaacaccguuauugcaccu

SEQ ID NO: 162635 - RNA, 19 nt, Human
ugguggaggugcaccugac

SEQ ID NO: 162636 - RNA, 22 nt, Human
ugguggaggugggggguauuuu

SEQ ID NO: 162637 - RNA, 22 nt, Human
ugguggcuuuucguagguucac

SEQ ID NO: 162638 - RNA, 22 nt, Human
ugguggccucaguggcuucugu

SEQ ID NO: 162639 - RNA, 22 nt, Human
ugguggagucugggggaggcuu

SEQ ID NO: 162640 - RNA, 22 nt, Human
uucugaaccauugagcacugcc

SEQ ID NO: 162641 - RNA, 22 nt, Human
uucugagguagccacucacugg

SEQ ID NO: 162642 - RNA, 20 nt, Human
uucugcagcagguguugaag

SEQ ID NO: 162643 - RNA, 22 nt, Human
uucuguucugcuuucuccaucc

SEQ ID NO: 162644 - RNA, 23 nt, Human
uggugcagcgcaggccggguggc

SEQ ID NO: 162645 - RNA, 22 nt, Human
uggugcaggauuuauuuaacua

SEQ ID NO: 162646 - RNA, 22 nt, Human
uggugcagacaggagccccgcu

SEQ ID NO: 162647 - RNA, 20 nt, Human
ugcuccaggaacacuggccg

SEQ ID NO: 162648 - RNA, 22 nt, Human
ugcuauccagacacauaugauc

SEQ ID NO: 162649 - RNA, 22 nt, Human
ugcuaucuagaaauacuggguu

SEQ ID NO: 162650 - RNA, 22 nt, Human
uggagcugguucuggggaagcu

SEQ ID NO: 162651 - RNA, 22 nt, Human
uggaggaggaugcauuuguugu

SEQ ID NO: 162652 - RNA, 19 nt, Human
uggaggcggguggcccaga

SEQ ID NO: 162653 - RNA, 21 nt, Human
uggaggcguaaucacuguuga

SEQ ID NO: 162654 - RNA, 22 nt, Human
uggagguagcugacuccagccc

SEQ ID NO: 162655 - RNA, 20 nt, Human
uggagggaggaggggcccaa

SEQ ID NO: 162656 - RNA, 22 nt, Human
uucaaccuucagcuugaguugg

SEQ ID NO: 162657 - RNA, 22 nt, Human
uucaaugcaagggaggucugaa

SEQ ID NO: 162658 - RNA, 22 nt, Human
uggaugacaaccauuggaagag

SEQ ID NO: 162659 - RNA, 22 nt, Human
uggaugccauuugauuaaggcu

SEQ ID NO: 162660 - RNA, 22 nt, Human
uggcaagcuguuggcagauagc

SEQ ID NO: 162661 - RNA, 22 nt, Human
uggcaaaaccugcaauuacuuu

SEQ ID NO: 162662 - RNA, 18 nt, Human
uggcaaugccaaaggcuu

SEQ ID NO: 162663 - RNA, 22 nt, Human
uucacccuucucuggcuuucag

SEQ ID NO: 162664 - RNA, 22 nt, Human
uucacccaaaucaagcuggccu

SEQ ID NO: 162665 - RNA, 22 nt, Human
uggcagccucugguccuuaguu

SEQ ID NO: 162666 - RNA, 22 nt, Human
uggcacugcccugucucggugg

SEQ ID NO: 162667 - RNA, 22 nt, Human
uggcagaaugaagacuggggcc

SEQ ID NO: 162668 - RNA, 22 nt, Human
uucaccucuuuuuggggacauc

SEQ ID NO: 162669 - RNA, 20 nt, Human
uucacggaggccgcgccccc

SEQ ID NO: 162670 - RNA, 22 nt, Human
uucaggacacauuauuuaugaa

SEQ ID NO: 162671 - RNA, 22 nt, Human
uucagcugcuugccugaaguca

SEQ ID NO: 162672 - RNA, 22 nt, Human
uucaggaaacaaauuugcaguu

SEQ ID NO: 162673 - RNA, 22 nt, Human
uucagcacuggacagcgagucu

SEQ ID NO: 162674 - RNA, 18 nt, Human
uggcaugcuuugauacau

SEQ ID NO: 162675 - RNA, 22 nt, Human
uggcagugggaagcuggaaguc

SEQ ID NO: 162676 - RNA, 22 nt, Human
uggcagugagauuucucuucug

SEQ ID NO: 162677 - RNA, 22 nt, Human
uggcaguaaagcuggaaaagug

SEQ ID NO: 162678 - RNA, 22 nt, Human
uggcaguugcaguaacuuguau

SEQ ID NO: 162679 - RNA, 22 nt, Human
uucauugcagaauuuggccuca

SEQ ID NO: 162680 - RNA, 22 nt, Human
uucauuauuaauaauagcagcu

SEQ ID NO: 162681 - RNA, 22 nt, Human
uggcgcgcagccugcuggugcu

SEQ ID NO: 162682 - RNA, 22 nt, Human
uggccuucagcucuggggugca

SEQ ID NO: 162683 - RNA, 22 nt, Human
uggcggcuggacuggggggcca

SEQ ID NO: 162684 - RNA, 22 nt, Human
uggcgcucacccugcggcccug

SEQ ID NO: 162685 - RNA, 22 nt, Human
uggcucaggccuacgacgccuu

SEQ ID NO: 162686 - RNA, 22 nt, Human
uggcucagcgcggccuggucuu

SEQ ID NO: 162687 - RNA, 22 nt, Human
uggcucacaggaggcagaggug

SEQ ID NO: 162688 - RNA, 22 nt, Human
uggcuacauuuauacucucauu

SEQ ID NO: 162689 - RNA, 22 nt, Human
uuccagaacaauguggacguau

SEQ ID NO: 162690 - RNA, 22 nt, Human
uggcuucugguuuauccuuaua

SEQ ID NO: 162691 - RNA, 22 nt, Human
uggccgaugagcaugcgcugau

SEQ ID NO: 162692 - RNA, 20 nt, Human
uggccgacccugaggaguug

SEQ ID NO: 162693 - RNA, 22 nt, Human
uucauauuguggucuugcauuc

SEQ ID NO: 162694 - RNA, 21 nt, Human
uggcccgagccgggguuggcu

SEQ ID NO: 162695 - RNA, 22 nt, Human
uggccccauuuuucuggagccu

SEQ ID NO: 162696 - RNA, 22 nt, Human
uggcccaagggaggcuuggccu

SEQ ID NO: 162697 - RNA, 22 nt, Human
uggcccaucagggcaccugaga

SEQ ID NO: 162698 - RNA, 20 nt, Human
uggcccagcacgacgaggac

SEQ ID NO: 162699 - RNA, 21 nt, Human
uggccaaggaauagaagcucu

SEQ ID NO: 162700 - RNA, 22 nt, Human
uggccaugagaaucuuugcugu

SEQ ID NO: 162701 - RNA, 22 nt, Human
uggggcuuggcucacagaagcu

SEQ ID NO: 162702 - RNA, 22 nt, Human
ugggggagggagaguugauggg

SEQ ID NO: 162703 - RNA, 23 nt, Human
uggggucaaggcugccuuggggu

SEQ ID NO: 162704 - RNA, 22 nt, Human
uggggucuggcauaugguagau

SEQ ID NO: 162705 - RNA, 22 nt, Human
uggggugccccccucgguuugc

SEQ ID NO: 162706 - RNA, 22 nt, Human
ugggucagauacaguguuuggu

SEQ ID NO: 162707 - RNA, 22 nt, Human
ugggucacuggccaagcucgac

SEQ ID NO: 162708 - RNA, 22 nt, Human
uuccccagaaaaguaaacaagg

SEQ ID NO: 162709 - RNA, 22 nt, Human
ugggagccuuccacugggggaa

SEQ ID NO: 162710 - RNA, 23 nt, Human
ugggagcuauguuuggaaugggg

SEQ ID NO: 162711 - RNA, 22 nt, Human
ugggaggcugugggaauggguc

SEQ ID NO: 162712 - RNA, 22 nt, Human
uggcuuuugaaaaggugaugua

SEQ ID NO: 162713 - RNA, 22 nt, Human
uggcuugagcugggcccaccug

SEQ ID NO: 162714 - RNA, 22 nt, Human
uggggaagaacuugccauuuca

SEQ ID NO: 162715 - RNA, 23 nt, Human
ugggccucuccacccuuuucugu

SEQ ID NO: 162716 - RNA, 21 nt, Human
uggggaugcauugcagaggca

SEQ ID NO: 162717 - RNA, 22 nt, Human
uggggcugguaccguaauauau

SEQ ID NO: 162718 - RNA, 22 nt, Human
ugggcaguccagcuggaaacgg

SEQ ID NO: 162719 - RNA, 22 nt, Human
ugggccacguggagucuguagg

SEQ ID NO: 162720 - RNA, 22 nt, Human
ugggccaaaugucugcauaagu

SEQ ID NO: 162721 - RNA, 19 nt, Human
uuccucaggugugaguuag

SEQ ID NO: 162722 - RNA, 22 nt, Human
uuaccugccucaaacacgaaug

SEQ ID NO: 162723 - RNA, 22 nt, Human
uguuugagaauuugcugauguu

SEQ ID NO: 162724 - RNA, 22 nt, Human
uguuucguugguggagagcuac

SEQ ID NO: 162725 - RNA, 22 nt, Human
uuaccugcagagacguggaggc

SEQ ID NO: 162726 - RNA, 22 nt, Human
uuauucuuagccucgguauuuc

SEQ ID NO: 162727 - RNA, 22 nt, Human
uuuccugacuucaccuuuuacc

SEQ ID NO: 162728 - RNA, 22 nt, Human
uuuccaguaaguggcaaggagc

SEQ ID NO: 162729 - RNA, 22 nt, Human
uuucucagcauauugccuuuga

SEQ ID NO: 162730 - RNA, 22 nt, Human
uuucuauuuacagugcuaggua

SEQ ID NO: 162731 - RNA, 22 nt, Human
uuucuacauuuguaaccagauu

SEQ ID NO: 162732 - RNA, 22 nt, Human
uuucuacacuucgugguguuuu

SEQ ID NO: 162733 - RNA, 19 nt, Human
uuauccacagggaauuuau

SEQ ID NO: 162734 - RNA, 22 nt, Human
uuuguggaaaagagcccaggag

SEQ ID NO: 162735 - RNA, 17 nt, Human
uuugugauggcagaugc

SEQ ID NO: 162736 - RNA, 22 nt, Human
uuccagguggcuuuccuggggg

SEQ ID NO: 162737 - RNA, 22 nt, Human
uuugugauaaguggauucaagg

SEQ ID NO: 162738 - RNA, 22 nt, Human
uuccaugccuaagagccugaag

SEQ ID NO: 162739 - RNA, 22 nt, Human
uuccccaccagagacagagcug

SEQ ID NO: 162740 - RNA, 22 nt, Human
uuccccgagccuggggaagcug

SEQ ID NO: 162741 - RNA, 22 nt, Human
uucccugggggggccgcuuucc

SEQ ID NO: 162742 - RNA, 22 nt, Human
uucagguuuuuaaguucugccu

SEQ ID NO: 162743 - RNA, 22 nt, Human
uuugcauuugagagaggaaaca

SEQ ID NO: 162744 - RNA, 22 nt, Human
uuugcaggaaauguacugaaug

SEQ ID NO: 162745 - RNA, 22 nt, Human
uucagaccucaaauccacaugc

SEQ ID NO: 162746 - RNA, 22 nt, Human
uucaguagagguggaaauaaca

SEQ ID NO: 162747 - RNA, 22 nt, Human
uucaaacacugugcaauugggu

SEQ ID NO: 162748 - RNA, 22 nt, Human
uucaacacaaguugugcaguaa

SEQ ID NO: 162749 - RNA, 22 nt, Human
uuugagugccucgaguguggga

SEQ ID NO: 162750 - RNA, 22 nt, Human
uuucucuuguauuugaaucacu

SEQ ID NO: 162751 - RNA, 22 nt, Human
uuucucugggugaugagguggc

SEQ ID NO: 162752 - RNA, 22 nt, Human
uuucuggauaagcagggucucu

SEQ ID NO: 162753 - RNA, 22 nt, Human
uugcggaucuucauggccucag

SEQ ID NO: 162754 - RNA, 22 nt, Human
uugcccuaccccaggccuuuuu

SEQ ID NO: 162755 - RNA, 22 nt, Human
uugccaggggacaucuggagcc

SEQ ID NO: 162756 - RNA, 23 nt, Human
uugcauuaauguggaggcacagg

SEQ ID NO: 162757 - RNA, 22 nt, Human
uugccgacuggccaaggaguaa

SEQ ID NO: 162758 - RNA, 22 nt, Human
uugcguaauuugagauuguaaa

SEQ ID NO: 162759 - RNA, 22 nt, Human
uugcaugugugaaaugcacaga

SEQ ID NO: 162760 - RNA, 22 nt, Human
uugcagagaacuaaagggagua

SEQ ID NO: 162761 - RNA, 20 nt, Human
uugcaaagugaauagcaauu

SEQ ID NO: 162762 - RNA, 22 nt, Human
uugcagaauucuucccacucag

SEQ ID NO: 162763 - RNA, 22 nt, Human
uugcuggaguagaaaacuuaac

SEQ ID NO: 162764 - RNA, 22 nt, Human
uugcugagcugaaccagccacc

SEQ ID NO: 162765 - RNA, 22 nt, Human
uugcugguggcucugauuucau

SEQ ID NO: 162766 - RNA, 22 nt, Human
uuggagaaagcugcaggcucug

SEQ ID NO: 162767 - RNA, 23 nt, Human
uugcuuuugccccaaaagaguua

SEQ ID NO: 162768 - RNA, 22 nt, Human
uuggugaugcuaggaauguagu

SEQ ID NO: 162769 - RNA, 22 nt, Human
uuggugaugcccaccuuuucau

SEQ ID NO: 162770 - RNA, 22 nt, Human
uuggugaugaaagugcugcgcu

SEQ ID NO: 162771 - RNA, 22 nt, Human
uuggggcugcguauuuccaugu

SEQ ID NO: 162772 - RNA, 22 nt, Human
uuggggggucagacuugauaca

SEQ ID NO: 162773 - RNA, 22 nt, Human
uugggucaugggaucccagcau

SEQ ID NO: 162774 - RNA, 22 nt, Human
uucugcccuugccagacaagua

SEQ ID NO: 162775 - RNA, 22 nt, Human
uucugaaggcaggggcuaucuu

SEQ ID NO: 162776 - RNA, 22 nt, Human
uucucugcgcuccggcccaguu

SEQ ID NO: 162777 - RNA, 22 nt, Human
uucucuggggacugucucuauu

SEQ ID NO: 162778 - RNA, 22 nt, Human
uucuggucucucugaccuagga

SEQ ID NO: 162779 - RNA, 22 nt, Human
uucugggguaagcacugaggau

SEQ ID NO: 162780 - RNA, 21 nt, Human
uucugcuguucaccaccaccc

SEQ ID NO: 162781 - RNA, 22 nt, Human
uucuggagacccagcaacaggg

SEQ ID NO: 162782 - RNA, 19 nt, Human
uuuucaacguccgguucau

SEQ ID NO: 162783 - RNA, 22 nt, Human
uucuccacguucuucucggccu

SEQ ID NO: 162784 - RNA, 22 nt, Human
uucuccaccugcuccucccacc

SEQ ID NO: 162785 - RNA, 22 nt, Human
uucuccugcccuuggacuucca

SEQ ID NO: 162786 - RNA, 22 nt, Human
uucuccugacuggccauucagu

SEQ ID NO: 162787 - RNA, 22 nt, Human
uuccgcuuucaauggcuuggcu

SEQ ID NO: 162788 - RNA, 22 nt, Human
uuuuuguggggggcggugugaa

SEQ ID NO: 162789 - RNA, 22 nt, Human
uuuuuuguuccuugguuuuugu

SEQ ID NO: 162790 - RNA, 22 nt, Human
uucuucuuuccuauaauuaauu

SEQ ID NO: 162791 - RNA, 22 nt, Human
uucuuaggauuauuuaaaauuc

SEQ ID NO: 162792 - RNA, 22 nt, Human
uuuugucagggcaggaggaaga

SEQ ID NO: 162793 - RNA, 22 nt, Human
aaaaggaacaauaugguauuuu

SEQ ID NO: 162794 - RNA, 22 nt, Human
aaaagcucucuucuucggcuuu

SEQ ID NO: 162795 - RNA, 22 nt, Human
aaaagggucugacacugcuuga

SEQ ID NO: 162796 - RNA, 22 nt, Human
aaacccaggguuuugucuuccc

SEQ ID NO: 162797 - RNA, 23 nt, Human
aaacuacauuuauaguuuuucuc

SEQ ID NO: 162798 - RNA, 22 nt, Human
aaagagacaacaacaacuucua

SEQ ID NO: 162799 - RNA, 22 nt, Human
aaagagccaacuaccgcaaauu

SEQ ID NO: 162800 - RNA, 21 nt, Human
aaagaagagcucagagguaga

SEQ ID NO: 162801 - RNA, 22 nt, Human
aaagggcugaaguagucucugu

SEQ ID NO: 162802 - RNA, 22 nt, Human
aaaggucagaugugucgaggag

SEQ ID NO: 162803 - RNA, 22 nt, Human
aaaggugccucuuacaaggcuu

SEQ ID NO: 162804 - RNA, 22 nt, Human
aaagccagggacagugugcaug

SEQ ID NO: 162805 - RNA, 17 nt, Human
aaagccgaucagauguu

SEQ ID NO: 162806 - RNA, 22 nt, Human
aaagcagguugcaauuacagug

SEQ ID NO: 162807 - RNA, 22 nt, Human
aaagaugaaguucagcgaagaa

SEQ ID NO: 162808 - RNA, 22 nt, Human
aaauccaucaaaucuucuagaa

SEQ ID NO: 162809 - RNA, 22 nt, Human
aaagguggugguuagggaauau

SEQ ID NO: 162810 - RNA, 22 nt, Human
aaagcuccaaauggguggaagu

SEQ ID NO: 162811 - RNA, 22 nt, Human
aaagcugaaacgaaaugacaac

SEQ ID NO: 162812 - RNA, 22 nt, Human
aacaaccuaguaguaucuuuca

SEQ ID NO: 162813 - RNA, 22 nt, Human
aaauugcauuuuaaagguagau

SEQ ID NO: 162814 - RNA, 22 nt, Human
aaaucuuucacauauuuuuuau

SEQ ID NO: 162815 - RNA, 22 nt, Human
aaaucgcuugaacccaggaagu

SEQ ID NO: 162816 - RNA, 22 nt, Human
aagccucaugccagauccaggu

SEQ ID NO: 162817 - RNA, 22 nt, Human
aagccagccaguuccagcagcu

SEQ ID NO: 162818 - RNA, 22 nt, Human
aagcaacccagugcuuguauag

SEQ ID NO: 162819 - RNA, 22 nt, Human
aagcuagguccuccugaacugc

SEQ ID NO: 162820 - RNA, 22 nt, Human
aagcugaguaggaaugguaggu

SEQ ID NO: 162821 - RNA, 22 nt, Human
aagcucugggacugaggcuccu

SEQ ID NO: 162822 - RNA, 22 nt, Human
aagccuccgugcugcuggaucu

SEQ ID NO: 162823 - RNA, 22 nt, Human
aaggaaaaccugacugaagaac

SEQ ID NO: 162824 - RNA, 22 nt, Human
aaggaacuucagggcgaaugga

SEQ ID NO: 162825 - RNA, 22 nt, Human
aagcgcaaggugucagcagguu

SEQ ID NO: 162826 - RNA, 22 nt, Human
aagcgcggccgccgcggucgcu

SEQ ID NO: 162827 - RNA, 22 nt, Human
aagcgggcagcggccugcgcca

SEQ ID NO: 162828 - RNA, 22 nt, Human
aagcugccugggaggaagggcu

SEQ ID NO: 162829 - RNA, 22 nt, Human
aagcugcagacccccugucuca

SEQ ID NO: 162830 - RNA, 22 nt, Human
aagcuguuauuucacagguuca

SEQ ID NO: 162831 - RNA, 22 nt, Human
aagcuguuagggagugguaggu

SEQ ID NO: 162832 - RNA, 22 nt, Human
aaggacaaaacagcuguucuaa

SEQ ID NO: 162833 - RNA, 22 nt, Human
aaggaggaugaauugucugcaa

SEQ ID NO: 162834 - RNA, 18 nt, Human
aaggaggaaugaauagca

SEQ ID NO: 162835 - RNA, 22 nt, Human
aaggaguacagggagggucccu

SEQ ID NO: 162836 - RNA, 20 nt, Human
aaggaggcuuaaaguuagaa

SEQ ID NO: 162837 - RNA, 22 nt, Human
aaggcaggagaguaggaggugg

SEQ ID NO: 162838 - RNA, 22 nt, Human
aaggccacacuugcuggccagc

SEQ ID NO: 162839 - RNA, 22 nt, Human
aaggccuaggaguugacauggg

SEQ ID NO: 162840 - RNA, 22 nt, Human
aagaaaagguaaccgcuuaucu

SEQ ID NO: 162841 - RNA, 22 nt, Human
aagaagagaauauauuuacguc

SEQ ID NO: 162842 - RNA, 22 nt, Human
aagaaguccuugaggcgcaccc

SEQ ID NO: 162843 - RNA, 22 nt, Human
aagaaggcggaccagaagggag

SEQ ID NO: 162844 - RNA, 21 nt, Human
aagacguaguuggguggacca

SEQ ID NO: 162845 - RNA, 23 nt, Human
aagaaugcuucugaagagcugcc

SEQ ID NO: 162846 - RNA, 22 nt, Human
aagaugaguuacaaaggaguaa

SEQ ID NO: 162847 - RNA, 22 nt, Human
aagcagaacuguuuuguuuucu

SEQ ID NO: 162848 - RNA, 22 nt, Human
aagcagacugggccauaaggaa

SEQ ID NO: 162849 - RNA, 22 nt, Human
aagcagcauaugacagcaucca

SEQ ID NO: 162850 - RNA, 21 nt, Human
aagcagcugcagaauuucagu

SEQ ID NO: 162851 - RNA, 22 nt, Human
aagaucugaccgugauggcggc

SEQ ID NO: 162852 - RNA, 22 nt, Human
aagaugaucagagggcaagagg

SEQ ID NO: 162853 - RNA, 22 nt, Human
aagaguggagcuggaaaguggg

SEQ ID NO: 162854 - RNA, 22 nt, Human
aaggaaaaaauggcuugugaua

SEQ ID NO: 162855 - RNA, 22 nt, Human
aaggagaggagucauugggaua

SEQ ID NO: 162856 - RNA, 22 nt, Human
aaggcuuguugucacgcucuug

SEQ ID NO: 162857 - RNA, 22 nt, Human
aaggcgguuccgguucgcggcg

SEQ ID NO: 162858 - RNA, 22 nt, Human
aaggucuuggcucuggccgcac

SEQ ID NO: 162859 - RNA, 22 nt, Human
aagguccuguagccacagagcc

SEQ ID NO: 162860 - RNA, 22 nt, Human
aaggucaggggcuuuugaaaca

SEQ ID NO: 162861 - RNA, 22 nt, Human
aaggucucucgggcuuugcuga

SEQ ID NO: 162862 - RNA, 22 nt, Human
aaggggauuuaagguaagaaga

SEQ ID NO: 162863 - RNA, 22 nt, Human
aaggggaggccugcgcuuucgg

SEQ ID NO: 162864 - RNA, 23 nt, Human
aaggugaagccaccaggugagga

SEQ ID NO: 162865 - RNA, 22 nt, Human
aaggugcauuaguuuggagggg

SEQ ID NO: 162866 - RNA, 22 nt, Human
aagggccuccuggggagccugg

SEQ ID NO: 162867 - RNA, 22 nt, Human
aagggaggguaggaagagggag

SEQ ID NO: 162868 - RNA, 21 nt, Human
aaguccaauaccuaaggcucc

SEQ ID NO: 162869 - RNA, 22 nt, Human
aagucccaucugccuccaugua

SEQ ID NO: 162870 - RNA, 22 nt, Human
aaguacugauucuguuccucaa

SEQ ID NO: 162871 - RNA, 22 nt, Human
aaggugcugaggguccuggcuu

SEQ ID NO: 162872 - RNA, 22 nt, Human
aagugagaugggagucagagga

SEQ ID NO: 162873 - RNA, 22 nt, Human
aagugaggagaccucuucuuca

SEQ ID NO: 162874 - RNA, 22 nt, Human
aaucaucuguuguucccuugga

SEQ ID NO: 162875 - RNA, 22 nt, Human
aauaaagcuugaaagcagggaa

SEQ ID NO: 162876 - RNA, 22 nt, Human
aauaaugguuugauucucacau

SEQ ID NO: 162877 - RNA, 20 nt, Human
aagugcuguuagcugccuga

SEQ ID NO: 162878 - RNA, 22 nt, Human
aaguucuuauguucugaugugc

SEQ ID NO: 162879 - RNA, 22 nt, Human
acaaggaagaaaacauuacuuu

SEQ ID NO: 162880 - RNA, 22 nt, Human
acaaggccaagcauucuagcaa

SEQ ID NO: 162881 - RNA, 23 nt, Human
acaaguguuuccaauauggcugg

SEQ ID NO: 162882 - RNA, 22 nt, Human
acaaggccugagggugacagca

SEQ ID NO: 162883 - RNA, 22 nt, Human
acaagaccagcagggagggugc

SEQ ID NO: 162884 - RNA, 17 nt, Human
acaaugggcaacaauau

SEQ ID NO: 162885 - RNA, 21 nt, Human
acacagcuggagcaucccggu

SEQ ID NO: 162886 - RNA, 22 nt, Human
acacaggacacaaaagucacca

SEQ ID NO: 162887 - RNA, 20 nt, Human
acacaccugcucagacugag

SEQ ID NO: 162888 - RNA, 19 nt, Human
acacaccagugccugugac

SEQ ID NO: 162889 - RNA, 22 nt, Human
acacgauguuuuaagccccuaa

SEQ ID NO: 162890 - RNA, 22 nt, Human
acacgguggccagcaguaggug

SEQ ID NO: 162891 - RNA, 23 nt, Human
acagcaagaggaccagaugugag

SEQ ID NO: 162892 - RNA, 23 nt, Human
acagaggcaucagagcagcaggc

SEQ ID NO: 162893 - RNA, 22 nt, Human
acagaucugcacagugaacaau

SEQ ID NO: 162894 - RNA, 22 nt, Human
acacugguucucuuaacccuau

SEQ ID NO: 162895 - RNA, 22 nt, Human
acagaugccagcuacaccaccg

SEQ ID NO: 162896 - RNA, 22 nt, Human
acagccaacgucuuucuuacuu

SEQ ID NO: 162897 - RNA, 22 nt, Human
acagcagguuauuguuauggca

SEQ ID NO: 162898 - RNA, 22 nt, Human
acaggacaaaaaucuggauggc

SEQ ID NO: 162899 - RNA, 19 nt, Human
acaggaaggaaaauuucaa

SEQ ID NO: 162900 - RNA, 22 nt, Human
acagcucaggcccaucaacccc

SEQ ID NO: 162901 - RNA, 19 nt, Human
acagccuguugguggggcu

SEQ ID NO: 162902 - RNA, 22 nt, Human
acaggacgugugugcgcaugug

SEQ ID NO: 162903 - RNA, 22 nt, Human
acagcuggaggucugugagcac

SEQ ID NO: 162904 - RNA, 22 nt, Human
acagcugagaugcuacuugugg

SEQ ID NO: 162905 - RNA, 22 nt, Human
acaggcgucgccugcucuugcc

SEQ ID NO: 162906 - RNA, 22 nt, Human
acaggcugcccgcuccccaccu

SEQ ID NO: 162907 - RNA, 22 nt, Human
acaggccuggguucaaauuugg

SEQ ID NO: 162908 - RNA, 22 nt, Human
acaggaaaugaaaugguaucua

SEQ ID NO: 162909 - RNA, 21 nt, Human
acauccaggguccucacugcc

SEQ ID NO: 162910 - RNA, 20 nt, Human
acauccacugagugggauga

SEQ ID NO: 162911 - RNA, 22 nt, Human
acagugguggagggcuguccug

SEQ ID NO: 162912 - RNA, 22 nt, Human
aaugugcugguaacugcuuugc

SEQ ID NO: 162913 - RNA, 22 nt, Human
aauuucagaccaacgagucagg

SEQ ID NO: 162914 - RNA, 22 nt, Human
aauugaggaaccuuagggcaaa

SEQ ID NO: 162915 - RNA, 19 nt, Human
agcagccaucgaccaugga

SEQ ID NO: 162916 - RNA, 16 nt, Human
agcagcgugggggugg

SEQ ID NO: 162917 - RNA, 17 nt, Human
agcagcuggguugaucu

SEQ ID NO: 162918 - RNA, 22 nt, Human
agcaugucuaacucuucagggu

SEQ ID NO: 162919 - RNA, 22 nt, Human
agcaggccuuucaccucugucc

SEQ ID NO: 162920 - RNA, 22 nt, Human
agcaggagaaagaguaugggcu

SEQ ID NO: 162921 - RNA, 22 nt, Human
agcagcugagccccagcuguga

SEQ ID NO: 162922 - RNA, 22 nt, Human
agcagagaacauucauucaugu

SEQ ID NO: 162923 - RNA, 22 nt, Human
agcacgcccaccuccugcggcg

SEQ ID NO: 162924 - RNA, 22 nt, Human
agcagcaccuguccucgcugcu

SEQ ID NO: 162925 - RNA, 22 nt, Human
agcaaagccucuuugaaaaaaa

SEQ ID NO: 162926 - RNA, 22 nt, Human
agcaaggguugguuuucugaca

SEQ ID NO: 162927 - RNA, 20 nt, Human
agcacaggcagucauucagu

SEQ ID NO: 162928 - RNA, 22 nt, Human
agcaagggucucucauggcuug

SEQ ID NO: 162929 - RNA, 22 nt, Human
agcaaggagcugaaaccgggcu

SEQ ID NO: 162930 - RNA, 22 nt, Human
agcacuaccggucacggccaug

SEQ ID NO: 162931 - RNA, 22 nt, Human
agcgccgcugugauuggugagg

SEQ ID NO: 162932 - RNA, 19 nt, Human
agcgccucuacugcaugga

SEQ ID NO: 162933 - RNA, 22 nt, Human
agcgcgcggggcugcggcaggg

SEQ ID NO: 162934 - RNA, 21 nt, Human
agcgcugcauccaccauggcu

SEQ ID NO: 162935 - RNA, 22 nt, Human
agcgcggccuuacacccagggg

SEQ ID NO: 162936 - RNA, 22 nt, Human
agccugugacucugugaaacca

SEQ ID NO: 162937 - RNA, 22 nt, Human
agccugagucugcacauagaac

SEQ ID NO: 162938 - RNA, 22 nt, Human
agccucucugaugugacagcua

SEQ ID NO: 162939 - RNA, 22 nt, Human
agccugaaccaauauagcagcc

SEQ ID NO: 162940 - RNA, 22 nt, Human
agccuggagcaggcucugcucu

SEQ ID NO: 162941 - RNA, 22 nt, Human
agccgcgcagccucauuaagga

SEQ ID NO: 162942 - RNA, 22 nt, Human
agccgcgcuguuccugcugcug

SEQ ID NO: 162943 - RNA, 22 nt, Human
agccgcugaauuugaaacaagc

SEQ ID NO: 162944 - RNA, 22 nt, Human
agccggccucggacagagggag

SEQ ID NO: 162945 - RNA, 22 nt, Human
agcgacuguaagagggccccgg

SEQ ID NO: 162946 - RNA, 21 nt, Human
agccgggacaacguggacccc

SEQ ID NO: 162947 - RNA, 22 nt, Human
agccuggacagcuacggagaac

SEQ ID NO: 162948 - RNA, 22 nt, Human
agcccgggagggcugucuggga

SEQ ID NO: 162949 - RNA, 22 nt, Human
agcauucagacaucugauggau

SEQ ID NO: 162950 - RNA, 18 nt, Human
agcccucuguuacuggaa

SEQ ID NO: 162951 - RNA, 22 nt, Human
agccauggagauguggguuggg

SEQ ID NO: 162952 - RNA, 22 nt, Human
agccaugcuguuuugccuggga

SEQ ID NO: 162953 - RNA, 22 nt, Human
agccaucuggugucaaugauuc

SEQ ID NO: 162954 - RNA, 22 nt, Human
agccaagucucacugagucugu

SEQ ID NO: 162955 - RNA, 22 nt, Human
agccgauaaauuguuuucuugg

SEQ ID NO: 162956 - RNA, 22 nt, Human
agcccuucccuuucacuggugc

SEQ ID NO: 162957 - RNA, 22 nt, Human
agcccagguggagugugugggg

SEQ ID NO: 162958 - RNA, 22 nt, Human
agccccggugagggaguccugu

SEQ ID NO: 162959 - RNA, 22 nt, Human
agccauggaggaugugcagcau

SEQ ID NO: 162960 - RNA, 22 nt, Human
agccauggagaacagacuugaa

SEQ ID NO: 162961 - RNA, 22 nt, Human
agaugaugugugucuucagcua

SEQ ID NO: 162962 - RNA, 21 nt, Human
agaugcaguuugcaggugggu

SEQ ID NO: 162963 - RNA, 22 nt, Human
agaugacuuuguccugagcuga

SEQ ID NO: 162964 - RNA, 21 nt, Human
agaugaggauacugaggccua

SEQ ID NO: 162965 - RNA, 19 nt, Human
agauggcaaaaugcaaaga

SEQ ID NO: 162966 - RNA, 22 nt, Human
agaugucauguguugcuccaag

SEQ ID NO: 162967 - RNA, 22 nt, Human
agaucugucaccauccuggagc

SEQ ID NO: 162968 - RNA, 20 nt, Human
agaugcccaacucuguuuug

SEQ ID NO: 162969 - RNA, 22 nt, Human
agauggcuccaguguccagagg

SEQ ID NO: 162970 - RNA, 22 nt, Human
agauggaguccugaagccagaa

SEQ ID NO: 162971 - RNA, 22 nt, Human
agcaacauggaguuugugcgca

SEQ ID NO: 162972 - RNA, 21 nt, Human
agauguucaguguccuaaccc

SEQ ID NO: 162973 - RNA, 22 nt, Human
agacucuaguggaggugcuagg

SEQ ID NO: 162974 - RNA, 22 nt, Human
agacgcgcagaaggaagcggcc

SEQ ID NO: 162975 - RNA, 22 nt, Human
agacgggacagacuuuugagug

SEQ ID NO: 162976 - RNA, 22 nt, Human
agacuacggggaggggagggaa

SEQ ID NO: 162977 - RNA, 22 nt, Human
agaggugcuuaugcucaugguu

SEQ ID NO: 162978 - RNA, 23 nt, Human
agagggaagagcuuagaugggga

SEQ ID NO: 162979 - RNA, 23 nt, Human
agaggccaacuucuugccccucc

SEQ ID NO: 162980 - RNA, 22 nt, Human
agagcuauuucuuaaaagcugu

SEQ ID NO: 162981 - RNA, 22 nt, Human
agagcaucgguggaguccccac

SEQ ID NO: 162982 - RNA, 22 nt, Human
agauagaaggauugugacacau

SEQ ID NO: 162983 - RNA, 22 nt, Human
agaugaccaguaagugguugaa

SEQ ID NO: 162984 - RNA, 22 nt, Human
agaguucaccccacugaugagu

SEQ ID NO: 162985 - RNA, 22 nt, Human
agaguggcaccuuaccugagac

SEQ ID NO: 162986 - RNA, 22 nt, Human
agaagauucagcaguagggugg

SEQ ID NO: 162987 - RNA, 22 nt, Human
agaagguggaguagaacaagcu

SEQ ID NO: 162988 - RNA, 19 nt, Human
agaacccccuuccucugcu

SEQ ID NO: 162989 - RNA, 22 nt, Human
agaagggcugcuuagaauauac

SEQ ID NO: 162990 - RNA, 22 nt, Human
agaaaaggaagcuuagacugua

SEQ ID NO: 162991 - RNA, 22 nt, Human
agaaggcaucugcucgcuucca

SEQ ID NO: 162992 - RNA, 22 nt, Human
agaagcagaaggaagcagggcc

SEQ ID NO: 162993 - RNA, 22 nt, Human
agaaggcagaaaagcuuuacaa

SEQ ID NO: 162994 - RNA, 22 nt, Human
agaagggaagcaggagaggcau

SEQ ID NO: 162995 - RNA, 22 nt, Human
agacccugauucugcuggcggu

SEQ ID NO: 162996 - RNA, 22 nt, Human
agacaagagcugaggacauauu

SEQ ID NO: 162997 - RNA, 22 nt, Human
agacaaggggauuuuugauggu

SEQ ID NO: 162998 - RNA, 20 nt, Human
agaaaggaguaaagaagaga

SEQ ID NO: 162999 - RNA, 22 nt, Human
agaaauggccagacuugccccu

SEQ ID NO: 163000 - RNA, 22 nt, Human
acuucagugugguauaaaacgu

SEQ ID NO: 163001 - RNA, 16 nt, Human
acuuguuguuuugguu

SEQ ID NO: 163002 - RNA, 22 nt, Human
acuucccacugcagugacugag

SEQ ID NO: 163003 - RNA, 21 nt, Human
acuuccacaucacugaguaga

SEQ ID NO: 163004 - RNA, 22 nt, Human
acucugaaaggcuacaaaugcu

SEQ ID NO: 163005 - RNA, 22 nt, Human
acucggcggccucgagugcugg

SEQ ID NO: 163006 - RNA, 22 nt, Human
acucgggggccgcugcagggag

SEQ ID NO: 163007 - RNA, 22 nt, Human
acucucaauuaucuggacugaa

SEQ ID NO: 163008 - RNA, 21 nt, Human
acucaucuuuuuggagaccag

SEQ ID NO: 163009 - RNA, 21 nt, Human
acuccagccacugacugucuc

SEQ ID NO: 163010 - RNA, 22 nt, Human
acuccuauuugguagauggaag

SEQ ID NO: 163011 - RNA, 22 nt, Human
acucaaccaucugcauuuuuga

SEQ ID NO: 163012 - RNA, 22 nt, Human
acugaacuaaagaaaugggcaa

SEQ ID NO: 163013 - RNA, 22 nt, Human
acugaaggcuggaccaugcauc

SEQ ID NO: 163014 - RNA, 22 nt, Human
acugaaaguugaugagucacug

SEQ ID NO: 163015 - RNA, 22 nt, Human
acugagcaaaacugauccuguu

SEQ ID NO: 163016 - RNA, 22 nt, Human
acugcucugugguuggaagccu

SEQ ID NO: 163017 - RNA, 21 nt, Human
acugccaugcaggagccucca

SEQ ID NO: 163018 - RNA, 22 nt, Human
acugcugauuauugaaguagag

SEQ ID NO: 163019 - RNA, 22 nt, Human
acugcagauccucugagaaacc

SEQ ID NO: 163020 - RNA, 22 nt, Human
acugaggaagccugucaucauc

SEQ ID NO: 163021 - RNA, 22 nt, Human
acuauugcuuuagggggaaacc

SEQ ID NO: 163022 - RNA, 20 nt, Human
acuaccaugcaauuccgcuu

SEQ ID NO: 163023 - RNA, 22 nt, Human
acuagagguuccagugaaggua

SEQ ID NO: 163024 - RNA, 22 nt, Human
acguccgcugauucuuuggaag

SEQ ID NO: 163025 - RNA, 22 nt, Human
acgucaucguugucaucgucau

SEQ ID NO: 163026 - RNA, 22 nt, Human
acguagggauuccucgucucau

SEQ ID NO: 163027 - RNA, 22 nt, Human
acggugagacuggcgaaggaaa

SEQ ID NO: 163028 - RNA, 22 nt, Human
acgugaccuuauuugaaaaaug

SEQ ID NO: 163029 - RNA, 22 nt, Human
acguugaaaugggcauuuuccg

SEQ ID NO: 163030 - RNA, 22 nt, Human
acgcgcuccagcaggugcuuca

SEQ ID NO: 163031 - RNA, 22 nt, Human
acgccggguaaggucauucugc

SEQ ID NO: 163032 - RNA, 22 nt, Human
acgccugccuguacuugugggg

SEQ ID NO: 163033 - RNA, 20 nt, Human
acgccgcgaggugagcuggu

SEQ ID NO: 163034 - RNA, 22 nt, Human
acauccaguaucagaagcauca

SEQ ID NO: 163035 - RNA, 22 nt, Human
acggagggagagagggaggaga

SEQ ID NO: 163036 - RNA, 23 nt, Human
acgggaggcggggcagggcugag

SEQ ID NO: 163037 - RNA, 22 nt, Human
acguccaccccguaccagauca

SEQ ID NO: 163038 - RNA, 22 nt, Human
acgcuucacaggugcgcauugu

SEQ ID NO: 163039 - RNA, 22 nt, Human
acgcugagcucauggagaugca

SEQ ID NO: 163040 - RNA, 22 nt, Human
acgcggagccagaggguguggg

SEQ ID NO: 163041 - RNA, 22 nt, Human
acgcauguacuuguaugcaaug

SEQ ID NO: 163042 - RNA, 22 nt, Human
acgccaggagcuucuccguuca

SEQ ID NO: 163043 - RNA, 22 nt, Human
acgccuugagccuugccugaau

SEQ ID NO: 163044 - RNA, 22 nt, Human
aggcaggcucaaugcccagucu

SEQ ID NO: 163045 - RNA, 23 nt, Human
aggcagaguccuggggcacagcc

SEQ ID NO: 163046 - RNA, 22 nt, Human
aggcaguggcuuuuguuguguu

SEQ ID NO: 163047 - RNA, 22 nt, Human
aggcaggggagcuggaagggua

SEQ ID NO: 163048 - RNA, 21 nt, Human
aggcagcgauuuucauauugc

SEQ ID NO: 163049 - RNA, 19 nt, Human
aggcagccccaacuugcau

SEQ ID NO: 163050 - RNA, 20 nt, Human
aggcagacaaggagucuguu

SEQ ID NO: 163051 - RNA, 22 nt, Human
aggcacagaauccagucugcug

SEQ ID NO: 163052 - RNA, 22 nt, Human
aggcaggauuugcgaugugguu

SEQ ID NO: 163053 - RNA, 22 nt, Human
aggcaggagcugugguggugag

SEQ ID NO: 163054 - RNA, 22 nt, Human
aggcaauuauacuagguuuugg

SEQ ID NO: 163055 - RNA, 22 nt, Human
aggcagcagggagggagaaaug

SEQ ID NO: 163056 - RNA, 23 nt, Human
aggcagcaugcaacaggccauuu

SEQ ID NO: 163057 - RNA, 22 nt, Human
aggcagagauggcugcagggcc

SEQ ID NO: 163058 - RNA, 22 nt, Human
aggccgcgguggcgaaggcguu

SEQ ID NO: 163059 - RNA, 22 nt, Human
aggcccucucggucccccgccg

SEQ ID NO: 163060 - RNA, 20 nt, Human
aggccgcccgcugccgcuuc

SEQ ID NO: 163061 - RNA, 22 nt, Human
aggccgagaugacagagccacu

SEQ ID NO: 163062 - RNA, 22 nt, Human
aggcccagcaccagcggucuuc

SEQ ID NO: 163063 - RNA, 22 nt, Human
aggcucagcaucugauucauau

SEQ ID NO: 163064 - RNA, 19 nt, Human
aggcugccucacccucccu

SEQ ID NO: 163065 - RNA, 22 nt, Human
aggccagggacaaugaggcaga

SEQ ID NO: 163066 - RNA, 21 nt, Human
aggccaaguuggauuucuuca

SEQ ID NO: 163067 - RNA, 22 nt, Human
aggcugcucucgccggcggugu

SEQ ID NO: 163068 - RNA, 22 nt, Human
aggcauuuucuuguuauuuuua

SEQ ID NO: 163069 - RNA, 22 nt, Human
aggccaggcgccggcgcgagac

SEQ ID NO: 163070 - RNA, 22 nt, Human
aggccacucagggggccaagau

SEQ ID NO: 163071 - RNA, 22 nt, Human
aggcaucguguuuuucugcuuu

SEQ ID NO: 163072 - RNA, 22 nt, Human
aggcaguguguagcuggaagag

SEQ ID NO: 163073 - RNA, 22 nt, Human
aggcauuuaucaggaaauguuc

SEQ ID NO: 163074 - RNA, 22 nt, Human
agcgcugugaaggcugggccac

SEQ ID NO: 163075 - RNA, 22 nt, Human
agcggccucgcugccugcucag

SEQ ID NO: 163076 - RNA, 22 nt, Human
agcggcaggacgucuucuucga

SEQ ID NO: 163077 - RNA, 22 nt, Human
agcgcuguguucccgugggcau

SEQ ID NO: 163078 - RNA, 22 nt, Human
aggaauguugagacauggcuaa

SEQ ID NO: 163079 - RNA, 22 nt, Human
aggaagaagggacagaauuuug

SEQ ID NO: 163080 - RNA, 22 nt, Human
aggaaauaguuuagucccaaaa

SEQ ID NO: 163081 - RNA, 22 nt, Human
aggacacagaguauggaagugu

SEQ ID NO: 163082 - RNA, 20 nt, Human
aggaacuggaagggaggaaa

SEQ ID NO: 163083 - RNA, 22 nt, Human
aggagcccaaagcacuuggcug

SEQ ID NO: 163084 - RNA, 22 nt, Human
aggaggcaaaugagagggcuca

SEQ ID NO: 163085 - RNA, 22 nt, Human
aggcaauuuuuaggguuguugu

SEQ ID NO: 163086 - RNA, 22 nt, Human
aggcaagauuaggaccagaaga

SEQ ID NO: 163087 - RNA, 23 nt, Human
aggcaagaacggguuguucaccc

SEQ ID NO: 163088 - RNA, 22 nt, Human
aggcaacagacaggcuugguuc

SEQ ID NO: 163089 - RNA, 22 nt, Human
aggcagagaggucuuccuggaa

SEQ ID NO: 163090 - RNA, 22 nt, Human
aggacaagacaaggaccagaga

SEQ ID NO: 163091 - RNA, 22 nt, Human
aggauaaaugggucauuaggca

SEQ ID NO: 163092 - RNA, 22 nt, Human
agguuaaaagagugaguggaua

SEQ ID NO: 163093 - RNA, 22 nt, Human
agguggucccaauggcugggca

SEQ ID NO: 163094 - RNA, 22 nt, Human
agguggucuuguggaugccgca

SEQ ID NO: 163095 - RNA, 22 nt, Human
agguggcuaugaggaugcaguc

SEQ ID NO: 163096 - RNA, 22 nt, Human
aggugcagcugguggagucugg

SEQ ID NO: 163097 - RNA, 22 nt, Human
aggugcacugguacaggcuuca

SEQ ID NO: 163098 - RNA, 22 nt, Human
aggugcucaguaauugauuguu

SEQ ID NO: 163099 - RNA, 19 nt, Human
aggugaugugacucuagaa

SEQ ID NO: 163100 - RNA, 22 nt, Human
aggugauaugggcuucucugag

SEQ ID NO: 163101 - RNA, 22 nt, Human
aggugagaacguggaggggcgg

SEQ ID NO: 163102 - RNA, 18 nt, Human
agguugcaucugugcaga

SEQ ID NO: 163103 - RNA, 21 nt, Human
aguaccugugugccugugugu

SEQ ID NO: 163104 - RNA, 22 nt, Human
aguaagaaagaaugauaggccu

SEQ ID NO: 163105 - RNA, 21 nt, Human
agggccagaucaccaaggagc

SEQ ID NO: 163106 - RNA, 22 nt, Human
agggccaagaaagaguggcuuu

SEQ ID NO: 163107 - RNA, 22 nt, Human
agggccagcagcuuggccaacc

SEQ ID NO: 163108 - RNA, 22 nt, Human
agggcaugugaaguaaccuagg

SEQ ID NO: 163109 - RNA, 22 nt, Human
aggggcagaggaugauggaaga

SEQ ID NO: 163110 - RNA, 22 nt, Human
agggcauacauuuuccugagau

SEQ ID NO: 163111 - RNA, 22 nt, Human
agggcuguuggugcccucgagg

SEQ ID NO: 163112 - RNA, 22 nt, Human
agggcaguguggugggacugac

SEQ ID NO: 163113 - RNA, 22 nt, Human
agggcaggguuggugcuggugc

SEQ ID NO: 163114 - RNA, 22 nt, Human
agggaguuccgaucugugcacc

SEQ ID NO: 163115 - RNA, 22 nt, Human
agggaugcaguaaaaacuguag

SEQ ID NO: 163116 - RNA, 22 nt, Human
agggaggcccagcagacuggcg

SEQ ID NO: 163117 - RNA, 22 nt, Human
agggcacuuccucugggucccu

SEQ ID NO: 163118 - RNA, 21 nt, Human
aggcuuggaucuagacaggcc

SEQ ID NO: 163119 - RNA, 22 nt, Human
aggcugucucaccucaggaggg

SEQ ID NO: 163120 - RNA, 18 nt, Human
aggcuggggaucacaggg

SEQ ID NO: 163121 - RNA, 21 nt, Human
aggguccugaggaagugagau

SEQ ID NO: 163122 - RNA, 22 nt, Human
aggguauguuuuuaucuacugu

SEQ ID NO: 163123 - RNA, 22 nt, Human
agggucgucuggguccgugggg

SEQ ID NO: 163124 - RNA, 22 nt, Human
aggguggcacucugggggcucc

SEQ ID NO: 163125 - RNA, 22 nt, Human
aggguggcuggaguggucuggu

SEQ ID NO: 163126 - RNA, 22 nt, Human
aggggcugagaguuugaugugg

SEQ ID NO: 163127 - RNA, 20 nt, Human
aggggcuguaguuagaugac

SEQ ID NO: 163128 - RNA, 22 nt, Human
agggcuucugcugcagagaccu

SEQ ID NO: 163129 - RNA, 22 nt, Human
agggcucuuucauuguuaagaa

SEQ ID NO: 163130 - RNA, 22 nt, Human
agggcugggcuuggcaggcugg

SEQ ID NO: 163131 - RNA, 22 nt, Human
aggucgugggugagagagagac

SEQ ID NO: 163132 - RNA, 23 nt, Human
aggucucggaugaagguaaggag

SEQ ID NO: 163133 - RNA, 22 nt, Human
aggguugaagucugguccucau

SEQ ID NO: 163134 - RNA, 18 nt, Human
agggggaagccaggagga

SEQ ID NO: 163135 - RNA, 22 nt, Human
agggggccggggcucaggagcc

SEQ ID NO: 163136 - RNA, 22 nt, Human
agggggccucucccgcggcgcc

SEQ ID NO: 163137 - RNA, 22 nt, Human
aggggguugcgcaggggcuccc

SEQ ID NO: 163138 - RNA, 22 nt, Human
aguguucaauuugagcucaaag

SEQ ID NO: 163139 - RNA, 22 nt, Human
aguggcuguuccaggugaggac

SEQ ID NO: 163140 - RNA, 22 nt, Human
aguggcuggcaggggagggucc

SEQ ID NO: 163141 - RNA, 19 nt, Human
agugggcaaggaagaugac

SEQ ID NO: 163142 - RNA, 22 nt, Human
aguguggccaaugaggaugggc

SEQ ID NO: 163143 - RNA, 22 nt, Human
aguguucaucacaggcuagaga

SEQ ID NO: 163144 - RNA, 23 nt, Human
aguguucagcauguaguaaauac

SEQ ID NO: 163145 - RNA, 22 nt, Human
aguucaauuguuuuguaaaagu

SEQ ID NO: 163146 - RNA, 22 nt, Human
agugaugcuuuggagaagaucc

SEQ ID NO: 163147 - RNA, 23 nt, Human
agugaagcugguuagugaugacc

SEQ ID NO: 163148 - RNA, 22 nt, Human
agugaagauagagccaggucug

SEQ ID NO: 163149 - RNA, 21 nt, Human
agugaagagugggcuugauca

SEQ ID NO: 163150 - RNA, 23 nt, Human
agugaugcaguaucugggucugu

SEQ ID NO: 163151 - RNA, 22 nt, Human
agugcuuuauguuguugugcaa

SEQ ID NO: 163152 - RNA, 22 nt, Human
aguggugaucuguuacagucac

SEQ ID NO: 163153 - RNA, 22 nt, Human
aguggugccuaagcgcggaggc

SEQ ID NO: 163154 - RNA, 23 nt, Human
aguggccgaucaucucgggcuug

SEQ ID NO: 163155 - RNA, 23 nt, Human
aguggaggucgggguggggagac

SEQ ID NO: 163156 - RNA, 22 nt, Human
aguggcugugaaauacauggga

SEQ ID NO: 163157 - RNA, 22 nt, Human
agugcgagaugaggacagaagc

SEQ ID NO: 163158 - RNA, 22 nt, Human
agugccuggcugauggguccug

SEQ ID NO: 163159 - RNA, 22 nt, Human
aguucuggcccugaaacaggga

SEQ ID NO: 163160 - RNA, 22 nt, Human
aguucugggaggugcacgucca

SEQ ID NO: 163161 - RNA, 22 nt, Human
aguucccgcgggagggcgcagg

SEQ ID NO: 163162 - RNA, 22 nt, Human
aguugcagguucacguaucuug

SEQ ID NO: 163163 - RNA, 22 nt, Human
aguuccucagaagggccuggga

SEQ ID NO: 163164 - RNA, 22 nt, Human
aguucccuguuuuuuuccacug

SEQ ID NO: 163165 - RNA, 22 nt, Human
aguugcugccagguccugggag

SEQ ID NO: 163166 - RNA, 22 nt, Human
aguugggaaaugcugcaguagu

SEQ ID NO: 163167 - RNA, 22 nt, Human
aguugguauuuacugcaguugg

SEQ ID NO: 163168 - RNA, 22 nt, Human
aguugugagaaugaacacugaa

SEQ ID NO: 163169 - RNA, 22 nt, Human
aguuuucugccucuggaugcgu

SEQ ID NO: 163170 - RNA, 22 nt, Human
aguuuccacuggagacacugug

SEQ ID NO: 163171 - RNA, 18 nt, Human
auaccaggauagggacaa

SEQ ID NO: 163172 - RNA, 21 nt, Human
auacaguucagcuuuuacuau

SEQ ID NO: 163173 - RNA, 22 nt, Human
auaaguuauuuuaguaaaucag

SEQ ID NO: 163174 - RNA, 22 nt, Human
auaacccuauuaaauggugcgc

SEQ ID NO: 163175 - RNA, 22 nt, Human
auaaugccucauaggguguucc

SEQ ID NO: 163176 - RNA, 22 nt, Human
auaaaaaguggcugcuauugga

SEQ ID NO: 163177 - RNA, 23 nt, Human
auugccuguagaucuucacuuuc

SEQ ID NO: 163178 - RNA, 22 nt, Human
auucuuuucucuaaaugaugaa

SEQ ID NO: 163179 - RNA, 22 nt, Human
auucuugauauagauaguuaau

SEQ ID NO: 163180 - RNA, 22 nt, Human
auucccuuugacgaucccuagg

SEQ ID NO: 163181 - RNA, 22 nt, Human
auucccucaagagacccacagc

SEQ ID NO: 163182 - RNA, 22 nt, Human
auucuccucaaaacaucugcug

SEQ ID NO: 163183 - RNA, 22 nt, Human
auucgcggcuugaucugcuugc

SEQ ID NO: 163184 - RNA, 22 nt, Human
auucgaucacugccgaggaccu

SEQ ID NO: 163185 - RNA, 22 nt, Human
auucuacucuuuaaauaugaaa

SEQ ID NO: 163186 - RNA, 22 nt, Human
auucuaugaaugacuguuagau

SEQ ID NO: 163187 - RNA, 23 nt, Human
auuugcugaucguagaugacuag

SEQ ID NO: 163188 - RNA, 22 nt, Human
auugcaggucguguggaaguga

SEQ ID NO: 163189 - RNA, 22 nt, Human
auuggccaguggacagcgccgu

SEQ ID NO: 163190 - RNA, 22 nt, Human
auuuuucacauuuugggggaca

SEQ ID NO: 163191 - RNA, 22 nt, Human
auuuccugugaacuuuucugau

SEQ ID NO: 163192 - RNA, 19 nt, Human
auuuccuggcauauaucac

SEQ ID NO: 163193 - RNA, 22 nt, Human
caaaggaaagagaaaaagucuu

SEQ ID NO: 163194 - RNA, 22 nt, Human
caaaggaauuacauguuucgga

SEQ ID NO: 163195 - RNA, 22 nt, Human
auacagccuaguuugaguccca

SEQ ID NO: 163196 - RNA, 22 nt, Human
aucuccaguuagcaguacugau

SEQ ID NO: 163197 - RNA, 22 nt, Human
auacuuccugcuucccugaucu

SEQ ID NO: 163198 - RNA, 22 nt, Human
auccugugggguauugcugcau

SEQ ID NO: 163199 - RNA, 22 nt, Human
aucugcauguggcagguggauu

SEQ ID NO: 163200 - RNA, 18 nt, Human
auccuucggccuagugga

SEQ ID NO: 163201 - RNA, 22 nt, Human
aucugcuguaguuggugccagu

SEQ ID NO: 163202 - RNA, 23 nt, Human
aucugagccuggucccacccgcu

SEQ ID NO: 163203 - RNA, 22 nt, Human
aucucaagcucugagggaggcc

SEQ ID NO: 163204 - RNA, 22 nt, Human
aucguggcacgucgccgcagcg

SEQ ID NO: 163205 - RNA, 23 nt, Human
aucgcccggguccagucccggcu

SEQ ID NO: 163206 - RNA, 22 nt, Human
augacugaugcugacucauggg

SEQ ID NO: 163207 - RNA, 22 nt, Human
augaaugccggucucgggggaa

SEQ ID NO: 163208 - RNA, 22 nt, Human
augaacuaagagucauuagugu

SEQ ID NO: 163209 - RNA, 23 nt, Human
augcaacauugccaguaugggca

SEQ ID NO: 163210 - RNA, 22 nt, Human
augaaacucuagcuuucagcac

SEQ ID NO: 163211 - RNA, 22 nt, Human
augaggagucaaggagucggag

SEQ ID NO: 163212 - RNA, 22 nt, Human
augcaguuagguaauagucuca

SEQ ID NO: 163213 - RNA, 22 nt, Human
augcaggcuaagaguaaagacg

SEQ ID NO: 163214 - RNA, 22 nt, Human
augaguuaaguagcccuucaug

SEQ ID NO: 163215 - RNA, 22 nt, Human
augugcucaggucuauaucuca

SEQ ID NO: 163216 - RNA, 22 nt, Human
auguccugacaguccaagggcg

SEQ ID NO: 163217 - RNA, 22 nt, Human
auggugaaaugauuugauguca

SEQ ID NO: 163218 - RNA, 22 nt, Human
augggagggagcagugaguguu

SEQ ID NO: 163219 - RNA, 22 nt, Human
auggugaugaugaugaugauaa

SEQ ID NO: 163220 - RNA, 22 nt, Human
augggucccuggccgcccucgg

SEQ ID NO: 163221 - RNA, 22 nt, Human
augggagggugaggaggcagcu

SEQ ID NO: 163222 - RNA, 22 nt, Human
augggcggugcauuugcacagu

SEQ ID NO: 163223 - RNA, 22 nt, Human
augggcauggauggccgagucu

SEQ ID NO: 163224 - RNA, 22 nt, Human
auguugcugauccuguggcugu

SEQ ID NO: 163225 - RNA, 22 nt, Human
auguugagaaucucucuucuaa

SEQ ID NO: 163226 - RNA, 22 nt, Human
augugccugagggcuccuugug

SEQ ID NO: 163227 - RNA, 22 nt, Human
augcaugaucccgguaugugaa

SEQ ID NO: 163228 - RNA, 17 nt, Human
augcccagggcucccug

SEQ ID NO: 163229 - RNA, 22 nt, Human
augccaccucuucugauuccag

SEQ ID NO: 163230 - RNA, 22 nt, Human
augcccagaacccccuggaugg

SEQ ID NO: 163231 - RNA, 22 nt, Human
auggaacauuaaucuucaaaug

SEQ ID NO: 163232 - RNA, 22 nt, Human
auggacguuuguguauuaugua

SEQ ID NO: 163233 - RNA, 22 nt, Human
auggacagcucuuaugugggca

SEQ ID NO: 163234 - RNA, 20 nt, Human
auggaaacacgcagccccaa

SEQ ID NO: 163235 - RNA, 22 nt, Human
auggaggaugugcagcaugggc

SEQ ID NO: 163236 - RNA, 22 nt, Human
auggaggagcagaggguuucca

SEQ ID NO: 163237 - RNA, 22 nt, Human
auggagcagagcugaugggccu

SEQ ID NO: 163238 - RNA, 22 nt, Human
auggagcgggaggauggaggag

SEQ ID NO: 163239 - RNA, 22 nt, Human
augcugccuccucuucagccgc

SEQ ID NO: 163240 - RNA, 22 nt, Human
auggaguguggccaggcaguaa

SEQ ID NO: 163241 - RNA, 22 nt, Human
augcugccuaaagcuacuuaca

SEQ ID NO: 163242 - RNA, 22 nt, Human
augggcuuuacccucagagcuu

SEQ ID NO: 163243 - RNA, 22 nt, Human
auggggaggcggauggagugcu

SEQ ID NO: 163244 - RNA, 22 nt, Human
auggauggaagcagccugaacu

SEQ ID NO: 163245 - RNA, 22 nt, Human
auggaaggggagguagggagga

SEQ ID NO: 163246 - RNA, 22 nt, Human
augggcauacaaaugcuacccu

SEQ ID NO: 163247 - RNA, 22 nt, Human
auggaacccgggcgucugcucu

SEQ ID NO: 163248 - RNA, 22 nt, Human
auggaagagacaaugcuaucug

SEQ ID NO: 163249 - RNA, 22 nt, Human
augggaggguagagugaacaga

SEQ ID NO: 163250 - RNA, 22 nt, Human
auggcagcggagcuggaaauga

SEQ ID NO: 163251 - RNA, 20 nt, Human
cagguugcugcccccgccuc

SEQ ID NO: 163252 - RNA, 22 nt, Human
cagguuguucugggcauggagg

SEQ ID NO: 163253 - RNA, 22 nt, Human
caggacccaaccucccugcucu

SEQ ID NO: 163254 - RNA, 22 nt, Human
caggacacaaaagguggagaag

SEQ ID NO: 163255 - RNA, 22 nt, Human
caggaacucggagcccaucucu

SEQ ID NO: 163256 - RNA, 22 nt, Human
caggaacucuucugggugcuug

SEQ ID NO: 163257 - RNA, 22 nt, Human
caggaacagcaccaggagcuag

SEQ ID NO: 163258 - RNA, 22 nt, Human
caggaagagaacugcucagccu

SEQ ID NO: 163259 - RNA, 22 nt, Human
caggcacagcuaagacuggcca

SEQ ID NO: 163260 - RNA, 22 nt, Human
cagucugcuggcuuuuucagca

SEQ ID NO: 163261 - RNA, 22 nt, Human
cagguuucuggaugcagcccca

SEQ ID NO: 163262 - RNA, 22 nt, Human
caggaggaggccgggaggaagc

SEQ ID NO: 163263 - RNA, 22 nt, Human
caggaggaaaguuccacucaac

SEQ ID NO: 163264 - RNA, 22 nt, Human
caggauuuaauaagauaguguu

SEQ ID NO: 163265 - RNA, 22 nt, Human
caggguuuuaguugcagguuau

SEQ ID NO: 163266 - RNA, 23 nt, Human
caggggacaggugaccugggcuc

SEQ ID NO: 163267 - RNA, 22 nt, Human
caggaucccuggccuccgccca

SEQ ID NO: 163268 - RNA, 22 nt, Human
caguggagaccugccugcugga

SEQ ID NO: 163269 - RNA, 22 nt, Human
caguguugcuaaugaauucauu

SEQ ID NO: 163270 - RNA, 22 nt, Human
caggugggauuuugcugcuuga

SEQ ID NO: 163271 - RNA, 22 nt, Human
caggugcucugauauggggcug

SEQ ID NO: 163272 - RNA, 22 nt, Human
cagguggauggcgagcccugca

SEQ ID NO: 163273 - RNA, 22 nt, Human
cagguggccggguaggaggugg

SEQ ID NO: 163274 - RNA, 22 nt, Human
caggacccaacggugcaauguc

SEQ ID NO: 163275 - RNA, 22 nt, Human
caggacagaaauaaggaauaua

SEQ ID NO: 163276 - RNA, 22 nt, Human
cagcccuggccucuucgcuuuc

SEQ ID NO: 163277 - RNA, 19 nt, Human
caggacaguuugccaagaa

SEQ ID NO: 163278 - RNA, 22 nt, Human
cagccccucuucucuccucgga

SEQ ID NO: 163279 - RNA, 22 nt, Human
cagccgcucaugggcccggagc

SEQ ID NO: 163280 - RNA, 22 nt, Human
cagccuggccucuggauauuug

SEQ ID NO: 163281 - RNA, 22 nt, Human
cagcccuugcgacacccuggcu

SEQ ID NO: 163282 - RNA, 22 nt, Human
cagagaugaggcuggcgugguu

SEQ ID NO: 163283 - RNA, 22 nt, Human
cagagcugucauuugccaguga

SEQ ID NO: 163284 - RNA, 22 nt, Human
cagcgguggcaaggugacugug

SEQ ID NO: 163285 - RNA, 22 nt, Human
cagcuucaaaggcccugauggu

SEQ ID NO: 163286 - RNA, 22 nt, Human
cagcuucacuuaaaacaugcaa

SEQ ID NO: 163287 - RNA, 22 nt, Human
cagcuucaugacaaacaguuuu

SEQ ID NO: 163288 - RNA, 22 nt, Human
caggugccucugccccacgcgg

SEQ ID NO: 163289 - RNA, 22 nt, Human
caggugauuuuguuuucaaaug

SEQ ID NO: 163290 - RNA, 22 nt, Human
caggccgcccucuccuguuagc

SEQ ID NO: 163291 - RNA, 22 nt, Human
caggccgccacugcagcagcug

SEQ ID NO: 163292 - RNA, 22 nt, Human
caggcacaaugagcgccaucuu

SEQ ID NO: 163293 - RNA, 20 nt, Human
caggccuucaggauggcugg

SEQ ID NO: 163294 - RNA, 22 nt, Human
cagggagcggggagaucucggg

SEQ ID NO: 163295 - RNA, 22 nt, Human
caggcacaagaucggcuagaua

SEQ ID NO: 163296 - RNA, 22 nt, Human
caggaggugugucccaccgggu

SEQ ID NO: 163297 - RNA, 22 nt, Human
caggaguggugagguuagcaga

SEQ ID NO: 163298 - RNA, 22 nt, Human
cacaggacuuggcuucucacag

SEQ ID NO: 163299 - RNA, 23 nt, Human
cacaggcagaaaucaagacggua

SEQ ID NO: 163300 - RNA, 22 nt, Human
cagacagagucuucccaucagu

SEQ ID NO: 163301 - RNA, 22 nt, Human
cagaacugaauaaagccaggau

SEQ ID NO: 163302 - RNA, 22 nt, Human
caccaaaauaucccuuuguaca

SEQ ID NO: 163303 - RNA, 22 nt, Human
cacugcguaguggcccgaagcu

SEQ ID NO: 163304 - RNA, 22 nt, Human
cacacgagcccuggagccagca

SEQ ID NO: 163305 - RNA, 22 nt, Human
cacacguuuagcuucuggcggc

SEQ ID NO: 163306 - RNA, 18 nt, Human
cacagcauccaaguuaug

SEQ ID NO: 163307 - RNA, 22 nt, Human
cacugguugccucuuucuguuc

SEQ ID NO: 163308 - RNA, 22 nt, Human
cacgggcgacgugaucuaggac

SEQ ID NO: 163309 - RNA, 22 nt, Human
cacugcaaccuccaccucccgg

SEQ ID NO: 163310 - RNA, 23 nt, Human
cacucgcaggcccagcucucagg

SEQ ID NO: 163311 - RNA, 22 nt, Human
caaugccaggaaccugggggaa

SEQ ID NO: 163312 - RNA, 22 nt, Human
caaagaaccuucgagacagggc

SEQ ID NO: 163313 - RNA, 22 nt, Human
cacugcacuccagccugggcaa

SEQ ID NO: 163314 - RNA, 22 nt, Human
cacugcugaggcccguguuacu

SEQ ID NO: 163315 - RNA, 23 nt, Human
cagagaaaauagaauaugcugug

SEQ ID NO: 163316 - RNA, 22 nt, Human
cagacuccugcuccucuggggc

SEQ ID NO: 163317 - RNA, 22 nt, Human
cagaccuggaaaacaggcuugc

SEQ ID NO: 163318 - RNA, 22 nt, Human
cagagagcguccauccggugcc

SEQ ID NO: 163319 - RNA, 22 nt, Human
cagagaagaggucuugaccccu

SEQ ID NO: 163320 - RNA, 22 nt, Human
caccgaacuuugcaaaugcaau

SEQ ID NO: 163321 - RNA, 22 nt, Human
caccuuccgcccacugaccgcc

SEQ ID NO: 163322 - RNA, 23 nt, Human
cagaccccuggcucugacccccu

SEQ ID NO: 163323 - RNA, 22 nt, Human
cagaccagaaggaagccgacaa

SEQ ID NO: 163324 - RNA, 23 nt, Human
caccaugacaugccuauagggga

SEQ ID NO: 163325 - RNA, 22 nt, Human
cacccgacugaggacgccgccc

SEQ ID NO: 163326 - RNA, 20 nt, Human
cacccgguccucagcgacuc

SEQ ID NO: 163327 - RNA, 22 nt, Human
caccagcgacugugaccagcaa

SEQ ID NO: 163328 - RNA, 22 nt, Human
cagcccugagagaaccaucuau

SEQ ID NO: 163329 - RNA, 22 nt, Human
cagccccaguuuucauaagacu

SEQ ID NO: 163330 - RNA, 22 nt, Human
cagccccgcuggccucgccucc

SEQ ID NO: 163331 - RNA, 22 nt, Human
cacuucaguacuagaggaugaa

SEQ ID NO: 163332 - RNA, 22 nt, Human
cagcacaggugugaggccugau

SEQ ID NO: 163333 - RNA, 22 nt, Human
cagaaagugauuugcuauucca

SEQ ID NO: 163334 - RNA, 20 nt, Human
cagcagucagcucuccaaug

SEQ ID NO: 163335 - RNA, 22 nt, Human
cagcacuuccuccgugagcccc

SEQ ID NO: 163336 - RNA, 22 nt, Human
cagcagccuccccggccgaccu

SEQ ID NO: 163337 - RNA, 22 nt, Human
cagcagaggagguggcagcacc

SEQ ID NO: 163338 - RNA, 21 nt, Human
cagcagaaaugagaggagaaa

SEQ ID NO: 163339 - RNA, 22 nt, Human
cagcagaugacuauuggagcug

SEQ ID NO: 163340 - RNA, 21 nt, Human
cagcagaugccagggucucug

SEQ ID NO: 163341 - RNA, 22 nt, Human
cauugcuguuaauugucucuag

SEQ ID NO: 163342 - RNA, 22 nt, Human
cauugcugccaaggugagcugg

SEQ ID NO: 163343 - RNA, 22 nt, Human
ccagaacgacgggcagaggcgc

SEQ ID NO: 163344 - RNA, 22 nt, Human
cauugcaaccauuccaaauggc

SEQ ID NO: 163345 - RNA, 22 nt, Human
ccagaggcuuaugcagcugcug

SEQ ID NO: 163346 - RNA, 22 nt, Human
cauuuacauaacaguaacgcug

SEQ ID NO: 163347 - RNA, 22 nt, Human
ccagcaagacucgcagugggau

SEQ ID NO: 163348 - RNA, 22 nt, Human
cauuucuggccuggggagcggg

SEQ ID NO: 163349 - RNA, 22 nt, Human
ccagcucgaggcaggggcugca

SEQ ID NO: 163350 - RNA, 22 nt, Human
ccagcaaguaagucagugucag

SEQ ID NO: 163351 - RNA, 22 nt, Human
ccagcaggagacuagcaacaua

SEQ ID NO: 163352 - RNA, 22 nt, Human
ccagcuuuucagaaucugccug

SEQ ID NO: 163353 - RNA, 22 nt, Human
ccaggacuuauuacaguauaac

SEQ ID NO: 163354 - RNA, 22 nt, Human
ccaggcagaggggucuggagca

SEQ ID NO: 163355 - RNA, 22 nt, Human
ccagcugggucccugcuggggc

SEQ ID NO: 163356 - RNA, 22 nt, Human
ccagccuucugaugggacccuc

SEQ ID NO: 163357 - RNA, 22 nt, Human
ccaaggcugcagccgugacgcg

SEQ ID NO: 163358 - RNA, 22 nt, Human
ccagugcagacgcggaacuggc

SEQ ID NO: 163359 - RNA, 23 nt, Human
ccagucgagucccaaccuucacc

SEQ ID NO: 163360 - RNA, 22 nt, Human
ccaguccugucaggggagggga

SEQ ID NO: 163361 - RNA, 22 nt, Human
ccagguuggccaccuucacggg

SEQ ID NO: 163362 - RNA, 22 nt, Human
ccagugcuuccaggaauacggu

SEQ ID NO: 163363 - RNA, 22 nt, Human
ccaaggugcagcccauggugaa

SEQ ID NO: 163364 - RNA, 22 nt, Human
ccaaggcuggagggcuuaugua

SEQ ID NO: 163365 - RNA, 22 nt, Human
ccaaggcuguggggcugugcag

SEQ ID NO: 163366 - RNA, 22 nt, Human
ccaaccaguuaucuccuaaggu

SEQ ID NO: 163367 - RNA, 22 nt, Human
ccagguggacggcgaguacagg

SEQ ID NO: 163368 - RNA, 22 nt, Human
ccagggcuggaggaggucagga

SEQ ID NO: 163369 - RNA, 22 nt, Human
ccagggcuggaccagugcuugg

SEQ ID NO: 163370 - RNA, 22 nt, Human
ccagggcugcugccugggcugg

SEQ ID NO: 163371 - RNA, 22 nt, Human
ccagggcggacaaggucuuuga

SEQ ID NO: 163372 - RNA, 22 nt, Human
ccaggcuccccaggaggcccuu

SEQ ID NO: 163373 - RNA, 22 nt, Human
ccaggcucaccuggagccccug

SEQ ID NO: 163374 - RNA, 22 nt, Human
ccagggagggccacagggccau

SEQ ID NO: 163375 - RNA, 22 nt, Human
ccacucucucccucuguagggg

SEQ ID NO: 163376 - RNA, 22 nt, Human
ccauuucacaucccugacaugu

SEQ ID NO: 163377 - RNA, 22 nt, Human
ccaugggugucuggagcacccu

SEQ ID NO: 163378 - RNA, 22 nt, Human
cccacgccuucuuucuucaaau

SEQ ID NO: 163379 - RNA, 16 nt, Human
cccaccuggacuaccu

SEQ ID NO: 163380 - RNA, 22 nt, Human
ccagaacguuugugcgaggcag

SEQ ID NO: 163381 - RNA, 22 nt, Human
ccaguggugcauguuugagcaa

SEQ ID NO: 163382 - RNA, 22 nt, Human
ccaucccugagucacaggaggg

SEQ ID NO: 163383 - RNA, 22 nt, Human
ccauggaaaagacgggcaggcc

SEQ ID NO: 163384 - RNA, 22 nt, Human
ccacccacuucucugcccucca

SEQ ID NO: 163385 - RNA, 16 nt, Human
ccacccagagaauauu

SEQ ID NO: 163386 - RNA, 21 nt, Human
caucaagaucaauggagggcu

SEQ ID NO: 163387 - RNA, 22 nt, Human
cagguugaaaguggaggagcua

SEQ ID NO: 163388 - RNA, 22 nt, Human
cagguguugcaguugaagacug

SEQ ID NO: 163389 - RNA, 22 nt, Human
cauguguuucuuaagccaggcc

SEQ ID NO: 163390 - RNA, 22 nt, Human
caucaggcugggaacacagauc

SEQ ID NO: 163391 - RNA, 22 nt, Human
caucagucugaaagccagggag

SEQ ID NO: 163392 - RNA, 22 nt, Human
caucauuuggcuuuagggccug

SEQ ID NO: 163393 - RNA, 22 nt, Human
cauugcugugggcauuugcugc

SEQ ID NO: 163394 - RNA, 22 nt, Human
cauugcaaccccaaaaagaaca

SEQ ID NO: 163395 - RNA, 22 nt, Human
caucgagaauuggcagcuaaag

SEQ ID NO: 163396 - RNA, 22 nt, Human
caucucagguuuguucugagac

SEQ ID NO: 163397 - RNA, 22 nt, Human
cauccagggguacccuggagcc

SEQ ID NO: 163398 - RNA, 22 nt, Human
caucccaacaggugaucuggua

SEQ ID NO: 163399 - RNA, 22 nt, Human
cauccagagcugccugaccccg

SEQ ID NO: 163400 - RNA, 22 nt, Human
cauugggcggggaccucggcug

SEQ ID NO: 163401 - RNA, 20 nt, Human
caugaguccgugaguggccc

SEQ ID NO: 163402 - RNA, 22 nt, Human
caugaggauccuccaggggaaa

SEQ ID NO: 163403 - RNA, 22 nt, Human
cauuuucugcaagucugcucaa

SEQ ID NO: 163404 - RNA, 22 nt, Human
caugagaguaaccuagagaaga

SEQ ID NO: 163405 - RNA, 22 nt, Human
caugcagcagaauaaugacuau

SEQ ID NO: 163406 - RNA, 22 nt, Human
caugcagauugccaggcucccu

SEQ ID NO: 163407 - RNA, 22 nt, Human
ccaaagaagcaaugagaauagu

SEQ ID NO: 163408 - RNA, 22 nt, Human
cauggcacuuuugugucuaaau

SEQ ID NO: 163409 - RNA, 22 nt, Human
cauggcacagaagaugucguuu

SEQ ID NO: 163410 - RNA, 22 nt, Human
ccaagagcuucccauagcuucu

SEQ ID NO: 163411 - RNA, 22 nt, Human
caugggcucuucuggacugcac

SEQ ID NO: 163412 - RNA, 22 nt, Human
cauggcggcgcucucccugccu

SEQ ID NO: 163413 - RNA, 22 nt, Human
caugcuggcacugaccagccua

SEQ ID NO: 163414 - RNA, 22 nt, Human
ccaagcguguuuaggaaaugcu

SEQ ID NO: 163415 - RNA, 22 nt, Human
ccaaccaguuucuuggcuuuag

SEQ ID NO: 163416 - RNA, 19 nt, Human
ccacacacuggucucuggg

SEQ ID NO: 163417 - RNA, 22 nt, Human
caugugguauugugagauccac

SEQ ID NO: 163418 - RNA, 22 nt, Human
ccacguguugcucagacagggu

SEQ ID NO: 163419 - RNA, 22 nt, Human
ccaccucuaccuggccggccuu

SEQ ID NO: 163420 - RNA, 22 nt, Human
ccaccuggcagcaggcucggca

SEQ ID NO: 163421 - RNA, 22 nt, Human
ccacccugguuacugugccagg

SEQ ID NO: 163422 - RNA, 22 nt, Human
ccaccacugaggcacaggagcc

SEQ ID NO: 163423 - RNA, 22 nt, Human
ccaccacauuugccuagacuuu

SEQ ID NO: 163424 - RNA, 22 nt, Human
ccugugcuucacucaacaagcc

SEQ ID NO: 163425 - RNA, 22 nt, Human
ccuguuccaacccucccuggcu

SEQ ID NO: 163426 - RNA, 22 nt, Human
ccuguguucguccucaccuugc

SEQ ID NO: 163427 - RNA, 22 nt, Human
ccugucugaaggcagggggaug

SEQ ID NO: 163428 - RNA, 22 nt, Human
ccuggggcucugcacagagcag

SEQ ID NO: 163429 - RNA, 22 nt, Human
ccuggguccucacaaucccagg

SEQ ID NO: 163430 - RNA, 22 nt, Human
ccugggcucgcgcacuucaccc

SEQ ID NO: 163431 - RNA, 22 nt, Human
ccuggcccagcuggaagcggga

SEQ ID NO: 163432 - RNA, 22 nt, Human
ccugggcauaaaucacuccaag

SEQ ID NO: 163433 - RNA, 22 nt, Human
ccuggccacagggcucugcauu

SEQ ID NO: 163434 - RNA, 22 nt, Human
ccgccucucgcucccagcuugc

SEQ ID NO: 163435 - RNA, 19 nt, Human
ccgagcagauugauguuuc

SEQ ID NO: 163436 - RNA, 22 nt, Human
ccgagaucagaguaggauuugg

SEQ ID NO: 163437 - RNA, 22 nt, Human
ccgagcagggcgcccugcccca

SEQ ID NO: 163438 - RNA, 22 nt, Human
ccgaaccacacgacagugcuca

SEQ ID NO: 163439 - RNA, 22 nt, Human
ccuggaccgacacaggaaggga

SEQ ID NO: 163440 - RNA, 22 nt, Human
ccagagcaccgaaacgagcuuu

SEQ ID NO: 163441 - RNA, 22 nt, Human
cccagagacuuuguccgacgac

SEQ ID NO: 163442 - RNA, 18 nt, Human
cccagaggaaugccugga

SEQ ID NO: 163443 - RNA, 22 nt, Human
ccagacuggggcuccuugaggg

SEQ ID NO: 163444 - RNA, 22 nt, Human
ccgggcuuccuuagagcaagau

SEQ ID NO: 163445 - RNA, 22 nt, Human
ccggcggguggagcaugcgcgg

SEQ ID NO: 163446 - RNA, 22 nt, Human
ccuucccagacggcucagcugu

SEQ ID NO: 163447 - RNA, 22 nt, Human
ccgcuggccgacuuccgagagc

SEQ ID NO: 163448 - RNA, 22 nt, Human
ccgcuggaagcgaguggugggc

SEQ ID NO: 163449 - RNA, 22 nt, Human
ccgcucuuugagacucucccga

SEQ ID NO: 163450 - RNA, 22 nt, Human
ccgcucgggugcagagggcaga

SEQ ID NO: 163451 - RNA, 22 nt, Human
ccgcgggcagggcuucaccuuu

SEQ ID NO: 163452 - RNA, 22 nt, Human
ccgcggcuguaguggaggugga

SEQ ID NO: 163453 - RNA, 22 nt, Human
ccuugcuucuagcauucccaug

SEQ ID NO: 163454 - RNA, 22 nt, Human
ccuucugcuggucaucccagug

SEQ ID NO: 163455 - RNA, 22 nt, Human
ccuucgcuggcaucuccaggua

SEQ ID NO: 163456 - RNA, 18 nt, Human
ccuucaucucugcuucuu

SEQ ID NO: 163457 - RNA, 22 nt, Human
ccugaccauuugccacaugggu

SEQ ID NO: 163458 - RNA, 22 nt, Human
ccugacucugauuucgcugcau

SEQ ID NO: 163459 - RNA, 22 nt, Human
ccucuggacuugggacagugag

SEQ ID NO: 163460 - RNA, 22 nt, Human
cgccgccgccugcccgcgcccc

SEQ ID NO: 163461 - RNA, 22 nt, Human
cgccgugcagucagcccagaag

SEQ ID NO: 163462 - RNA, 22 nt, Human
ccucuccucugugcagacugcc

SEQ ID NO: 163463 - RNA, 22 nt, Human
cgcugcugucaucgucuacggu

SEQ ID NO: 163464 - RNA, 22 nt, Human
ccugagacucuccugugcagcc

SEQ ID NO: 163465 - RNA, 22 nt, Human
ccugaggcccuggcugugcuga

SEQ ID NO: 163466 - RNA, 21 nt, Human
ccugagucccccagacccugg

SEQ ID NO: 163467 - RNA, 22 nt, Human
cggaggcugcuuucuguugcua

SEQ ID NO: 163468 - RNA, 22 nt, Human
cggagggcccucaggacugggu

SEQ ID NO: 163469 - RNA, 22 nt, Human
cggcugcgguucaccuagggca

SEQ ID NO: 163470 - RNA, 22 nt, Human
cggcugcagcggagcaggcugg

SEQ ID NO: 163471 - RNA, 22 nt, Human
cgggagagacagaggaggcgcc

SEQ ID NO: 163472 - RNA, 20 nt, Human
cgggacacucaagcucuggg

SEQ ID NO: 163473 - RNA, 22 nt, Human
cgggaaguaaacauuauuucag

SEQ ID NO: 163474 - RNA, 22 nt, Human
cggagguccagucacaaguaac

SEQ ID NO: 163475 - RNA, 22 nt, Human
cgggacaauagcagugcugaug

SEQ ID NO: 163476 - RNA, 22 nt, Human
cgcuuugguaauagggcagccu

SEQ ID NO: 163477 - RNA, 22 nt, Human
cgcuuuccaggcacauccucuu

SEQ ID NO: 163478 - RNA, 22 nt, Human
cgcuggagagcaagugcgugca

SEQ ID NO: 163479 - RNA, 22 nt, Human
cgcuucauugugggggccccca

SEQ ID NO: 163480 - RNA, 22 nt, Human
ccugccugggcucacuugccag

SEQ ID NO: 163481 - RNA, 22 nt, Human
cggacugaccugcucggggaga

SEQ ID NO: 163482 - RNA, 22 nt, Human
ccgugcaguuucucacacacau

SEQ ID NO: 163483 - RNA, 22 nt, Human
ccggguucuuguucuaggaugu

SEQ ID NO: 163484 - RNA, 22 nt, Human
ccggguccagugggcacugggc

SEQ ID NO: 163485 - RNA, 22 nt, Human
ccgguguggguuucucgguagu

SEQ ID NO: 163486 - RNA, 22 nt, Human
ccgugccuuuaguuucuucugu

SEQ ID NO: 163487 - RNA, 22 nt, Human
ccgugggugggguacgggcugg

SEQ ID NO: 163488 - RNA, 22 nt, Human
ccguuugugcugcaggagaucg

SEQ ID NO: 163489 - RNA, 22 nt, Human
cgaaaaagaagugcaccauguu

SEQ ID NO: 163490 - RNA, 22 nt, Human
cgaacggcagagagcccguccc

SEQ ID NO: 163491 - RNA, 20 nt, Human
ccucaaccuccuuucucucc

SEQ ID NO: 163492 - RNA, 20 nt, Human
ccuagacacagggagggccg

SEQ ID NO: 163493 - RNA, 22 nt, Human
ccuccuggaguuacuuccaaaa

SEQ ID NO: 163494 - RNA, 22 nt, Human
ccucggacuugggugggcuccu

SEQ ID NO: 163495 - RNA, 21 nt, Human
ccuccagccagagggucugga

SEQ ID NO: 163496 - RNA, 22 nt, Human
cgcacacaaaugcauacgccag

SEQ ID NO: 163497 - RNA, 22 nt, Human
cgcccccgaucggggccgccgc

SEQ ID NO: 163498 - RNA, 22 nt, Human
cgaggcuugcaaggacgaggag

SEQ ID NO: 163499 - RNA, 22 nt, Human
cgagggcuggaggggagacaga

SEQ ID NO: 163500 - RNA, 22 nt, Human
cgaggagguccaggagcaguag

SEQ ID NO: 163501 - RNA, 22 nt, Human
cuaccccaggccccucgaugcc

SEQ ID NO: 163502 - RNA, 22 nt, Human
cgagcccacacuccuguccucu

SEQ ID NO: 163503 - RNA, 22 nt, Human
cgaggccgcuucauggcuggca

SEQ ID NO: 163504 - RNA, 22 nt, Human
cguggccacaguggagcugagc

SEQ ID NO: 163505 - RNA, 22 nt, Human
cuacuucucccuagaucagaaa

SEQ ID NO: 163506 - RNA, 22 nt, Human
cgagugauuauucuggcugaga

SEQ ID NO: 163507 - RNA, 22 nt, Human
cgagguacuuacccuggucugu

SEQ ID NO: 163508 - RNA, 22 nt, Human
cgagguuuaugaguuuguguuc

SEQ ID NO: 163509 - RNA, 22 nt, Human
cgauuccugauaagugaauaag

SEQ ID NO: 163510 - RNA, 22 nt, Human
cuagaggaacaguuucagguuu

SEQ ID NO: 163511 - RNA, 22 nt, Human
cgcacuugugagcgacagggcu

SEQ ID NO: 163512 - RNA, 22 nt, Human
cgcacuggagcuggaacgaguc

SEQ ID NO: 163513 - RNA, 22 nt, Human
ccuugggagcgcccuguccggg

SEQ ID NO: 163514 - RNA, 22 nt, Human
ccuugcgaggaugcugugagcu

SEQ ID NO: 163515 - RNA, 22 nt, Human
cgggagaugaggagagcuucgg

SEQ ID NO: 163516 - RNA, 22 nt, Human
cgggaggcggagcuccgcgggg

SEQ ID NO: 163517 - RNA, 22 nt, Human
cgggcacagguugagguagaug

SEQ ID NO: 163518 - RNA, 22 nt, Human
cgggcacucagggucgaggugg

SEQ ID NO: 163519 - RNA, 22 nt, Human
ccuggcccugcugcuugccagc

SEQ ID NO: 163520 - RNA, 22 nt, Human
ccuggcauuagaaauuccguca

SEQ ID NO: 163521 - RNA, 19 nt, Human
ccuggccaacgucaacauu

SEQ ID NO: 163522 - RNA, 21 nt, Human
ccuggagacaaagacagggug

SEQ ID NO: 163523 - RNA, 22 nt, Human
cgccuggccccgcagcgcuugu

SEQ ID NO: 163524 - RNA, 22 nt, Human
cguggaggucgcauauuccucu

SEQ ID NO: 163525 - RNA, 22 nt, Human
cguggcaguagagcuggaacuu

SEQ ID NO: 163526 - RNA, 22 nt, Human
cgugcuaccugagcugacagcu

SEQ ID NO: 163527 - RNA, 22 nt, Human
cuccaacugccacuguacugga

SEQ ID NO: 163528 - RNA, 22 nt, Human
cgcugggugguugauguacagc

SEQ ID NO: 163529 - RNA, 22 nt, Human
cuccagagagaaaggaggccgc

SEQ ID NO: 163530 - RNA, 22 nt, Human
cuccaccucagugucaucuucu

SEQ ID NO: 163531 - RNA, 22 nt, Human
cuccagcucgcgagcucugcuc

SEQ ID NO: 163532 - RNA, 22 nt, Human
cuccggccuucugacuccccug

SEQ ID NO: 163533 - RNA, 22 nt, Human
cuccgcagcugggguuggcgcu

SEQ ID NO: 163534 - RNA, 22 nt, Human
cuccgaaaugcaucccagggca

SEQ ID NO: 163535 - RNA, 22 nt, Human
cuccugauuucuaggccuuauc

SEQ ID NO: 163536 - RNA, 22 nt, Human
cggaggagcugcgcggaggggg

SEQ ID NO: 163537 - RNA, 22 nt, Human
cggagcgagaaggggaaagccc

SEQ ID NO: 163538 - RNA, 22 nt, Human
cggagcauacugccuggagaug

SEQ ID NO: 163539 - RNA, 22 nt, Human
cucugcccacaguccccgagga

SEQ ID NO: 163540 - RNA, 22 nt, Human
cggccgcgggauggcgggcagc

SEQ ID NO: 163541 - RNA, 22 nt, Human
cucucuccuuagcugcagacca

SEQ ID NO: 163542 - RNA, 21 nt, Human
cgcccggccggaaaccccuuc

SEQ ID NO: 163543 - RNA, 22 nt, Human
cgcccguacuuugccggcauga

SEQ ID NO: 163544 - RNA, 22 nt, Human
cgcccggcugagacgcucgccc

SEQ ID NO: 163545 - RNA, 22 nt, Human
cgccaguggcagcuggaacagg

SEQ ID NO: 163546 - RNA, 22 nt, Human
cgcaucggguagaggagcugga

SEQ ID NO: 163547 - RNA, 22 nt, Human
cgcauugcaauucaggggauaa

SEQ ID NO: 163548 - RNA, 22 nt, Human
cuagguggcagcacuccgaggu

SEQ ID NO: 163549 - RNA, 22 nt, Human
cgcgcgguguuccgcauucugc

SEQ ID NO: 163550 - RNA, 22 nt, Human
cgcgcuuugggcaguguggcug

SEQ ID NO: 163551 - RNA, 22 nt, Human
cgcuagggagcacuuggcagug

SEQ ID NO: 163552 - RNA, 22 nt, Human
cgccugucugcauggccacugg

SEQ ID NO: 163553 - RNA, 22 nt, Human
cucagcaauuaccugugucucu

SEQ ID NO: 163554 - RNA, 22 nt, Human
cucaaagcagacuuuucccuuu

SEQ ID NO: 163555 - RNA, 22 nt, Human
cgccgugucuggucuguacguc

SEQ ID NO: 163556 - RNA, 22 nt, Human
cucaagagaaaucggaaucaga

SEQ ID NO: 163557 - RNA, 22 nt, Human
cucagcgggagucuggccgaac

SEQ ID NO: 163558 - RNA, 22 nt, Human
cucagcgagggaaagaggccgc

SEQ ID NO: 163559 - RNA, 22 nt, Human
cucagcaacccacacacggucu

SEQ ID NO: 163560 - RNA, 22 nt, Human
cucagaagaacaaaggcucuac

SEQ ID NO: 163561 - RNA, 22 nt, Human
cuggcaguguccagcucgugau

SEQ ID NO: 163562 - RNA, 22 nt, Human
cucaggaaaauauugaagaagu

SEQ ID NO: 163563 - RNA, 22 nt, Human
cucagugacuuccugcucaauu

SEQ ID NO: 163564 - RNA, 22 nt, Human
cugcuucacccugccugagaac

SEQ ID NO: 163565 - RNA, 22 nt, Human
cugcuuuggaucucucucugcc

SEQ ID NO: 163566 - RNA, 22 nt, Human
cugcuuguguugcucagaguca

SEQ ID NO: 163567 - RNA, 22 nt, Human
cucaagugacucagccugguug

SEQ ID NO: 163568 - RNA, 22 nt, Human
cugggggacagagagaggcggu

SEQ ID NO: 163569 - RNA, 22 nt, Human
cuccuuuuccuacucauacuau

SEQ ID NO: 163570 - RNA, 22 nt, Human
cugggcuuucaggcccuaaggc

SEQ ID NO: 163571 - RNA, 22 nt, Human
cugggcucccucucccgccucg

SEQ ID NO: 163572 - RNA, 22 nt, Human
cuggguuuggcugugcuugaau

SEQ ID NO: 163573 - RNA, 22 nt, Human
cuggguguuccuuucauuuuaa

SEQ ID NO: 163574 - RNA, 22 nt, Human
cucuaccugcacaugccugacu

SEQ ID NO: 163575 - RNA, 22 nt, Human
cuccagcagaaagggcgagugg

SEQ ID NO: 163576 - RNA, 22 nt, Human
cuccacagccccuccaguggca

SEQ ID NO: 163577 - RNA, 22 nt, Human
cuccacccuagagggcccaugc

SEQ ID NO: 163578 - RNA, 22 nt, Human
cuggcuguguguuugugcaucu

SEQ ID NO: 163579 - RNA, 21 nt, Human
cuggcucgccaugguucuuuu

SEQ ID NO: 163580 - RNA, 22 nt, Human
cucccugagaugcaggagagag

SEQ ID NO: 163581 - RNA, 22 nt, Human
cuccgccuguccugggcccacg

SEQ ID NO: 163582 - RNA, 22 nt, Human
cuggcggugaucccgauggugu

SEQ ID NO: 163583 - RNA, 22 nt, Human
cuggcuaaugugcugauagcca

SEQ ID NO: 163584 - RNA, 22 nt, Human
cuguccugauggugccacuggu

SEQ ID NO: 163585 - RNA, 22 nt, Human
cugucagcaaaucagugucugg

SEQ ID NO: 163586 - RNA, 22 nt, Human
cucuggagggaggcugagcugg

SEQ ID NO: 163587 - RNA, 22 nt, Human
cuggugggucacgugugggugg

SEQ ID NO: 163588 - RNA, 22 nt, Human
cuggugcuguagccugauugag

SEQ ID NO: 163589 - RNA, 22 nt, Human
cugugggcucucaugggaccug

SEQ ID NO: 163590 - RNA, 19 nt, Human
cugaaacacagagagggcu

SEQ ID NO: 163591 - RNA, 22 nt, Human
cugaaacucaagauaggaggaa

SEQ ID NO: 163592 - RNA, 22 nt, Human
cugugccagucagggggcaagu

SEQ ID NO: 163593 - RNA, 22 nt, Human
cuguuccuccaccucaacaaac

SEQ ID NO: 163594 - RNA, 22 nt, Human
cugaagaaagaaaauggccauc

SEQ ID NO: 163595 - RNA, 22 nt, Human
cuguuguucacuuugcugguga

SEQ ID NO: 163596 - RNA, 22 nt, Human
cuguuuggcuuccacugcuucu

SEQ ID NO: 163597 - RNA, 20 nt, Human
cuguuugcuaucaugagcug

SEQ ID NO: 163598 - RNA, 17 nt, Human
cguuccagaacaaauga

SEQ ID NO: 163599 - RNA, 22 nt, Human
cguucccuccugccacgggagg

SEQ ID NO: 163600 - RNA, 22 nt, Human
cguugguggguguguggucgga

SEQ ID NO: 163601 - RNA, 20 nt, Human
cugauguucgugcuuccugg

SEQ ID NO: 163602 - RNA, 22 nt, Human
cugcagagaccuaggucagguu

SEQ ID NO: 163603 - RNA, 22 nt, Human
cugauuucaaauggugcuagau

SEQ ID NO: 163604 - RNA, 22 nt, Human
cugcaucacagcaggaggcaca

SEQ ID NO: 163605 - RNA, 22 nt, Human
cugccacuaccaugcuggauga

SEQ ID NO: 163606 - RNA, 22 nt, Human
cgugcaggagcuggagguccga

SEQ ID NO: 163607 - RNA, 17 nt, Human
cgugaggaccaggcagc

SEQ ID NO: 163608 - RNA, 22 nt, Human
cggugcuuuccauaucagcagc

SEQ ID NO: 163609 - RNA, 22 nt, Human
cucugcguggcugggcccaggg

SEQ ID NO: 163610 - RNA, 19 nt, Human
cggugcugauuggugcagu

SEQ ID NO: 163611 - RNA, 22 nt, Human
cgucagccacagcugccccggg

SEQ ID NO: 163612 - RNA, 22 nt, Human
cugagggagacagugcggacua

SEQ ID NO: 163613 - RNA, 23 nt, Human
cugagggcuggucugaagucugc

SEQ ID NO: 163614 - RNA, 22 nt, Human
cugaggaguaguucuggaggac

SEQ ID NO: 163615 - RNA, 21 nt, Human
cgucccggcgugagagagcug

SEQ ID NO: 163616 - RNA, 22 nt, Human
cugagcugcucccgcugcagcg

SEQ ID NO: 163617 - RNA, 22 nt, Human
cugcugucuuuauuucacugcu

SEQ ID NO: 163618 - RNA, 22 nt, Human
cugcuguugagguuccaggcca

SEQ ID NO: 163619 - RNA, 22 nt, Human
cugccccucgcucaccagcucu

SEQ ID NO: 163620 - RNA, 22 nt, Human
cugcccauggcuccuggcugug

SEQ ID NO: 163621 - RNA, 22 nt, Human
cuaccagcacgccuuccucuac

SEQ ID NO: 163622 - RNA, 22 nt, Human
cugccgaugcgcaguggcgccu

SEQ ID NO: 163623 - RNA, 22 nt, Human
cugccucucaugccugcuugcu

SEQ ID NO: 163624 - RNA, 22 nt, Human
cuacugaugccccgcugugccu

SEQ ID NO: 163625 - RNA, 22 nt, Human
cugcgcgagcacugccggcggg

SEQ ID NO: 163626 - RNA, 20 nt, Human
cuggugccuucugcgauuua

SEQ ID NO: 163627 - RNA, 22 nt, Human
gaaaagaaaggaugguaugugu

SEQ ID NO: 163628 - RNA, 22 nt, Human
gaaaacccuguauguagcguuu

SEQ ID NO: 163629 - RNA, 22 nt, Human
cuggugaagccuucggagaccc

SEQ ID NO: 163630 - RNA, 22 nt, Human
cuggucuugguauucgcagaag

SEQ ID NO: 163631 - RNA, 22 nt, Human
cuggucaauaaucauguaguac

SEQ ID NO: 163632 - RNA, 22 nt, Human
cugguacuggaggaguucagag

SEQ ID NO: 163633 - RNA, 22 nt, Human
cuggugagaccgacuuccacuu

SEQ ID NO: 163634 - RNA, 22 nt, Human
cuguccuguggccugcuccggu

SEQ ID NO: 163635 - RNA, 22 nt, Human
cuguccccauugcugucccugg

SEQ ID NO: 163636 - RNA, 19 nt, Human
cuguccacacacucgcuuc

SEQ ID NO: 163637 - RNA, 22 nt, Human
gaaaugaaacacacaugcagcu

SEQ ID NO: 163638 - RNA, 22 nt, Human
gaacaaggauucccaaagaaga

SEQ ID NO: 163639 - RNA, 22 nt, Human
gaaaugggggcaugcguuacau

SEQ ID NO: 163640 - RNA, 22 nt, Human
cuguccauuuucgugccuccuu

SEQ ID NO: 163641 - RNA, 22 nt, Human
gaagaaggaagaucaugcuuga

SEQ ID NO: 163642 - RNA, 22 nt, Human
gaacggccucguuccucggugu

SEQ ID NO: 163643 - RNA, 22 nt, Human
gaaccuggcagcccuauaucug

SEQ ID NO: 163644 - RNA, 22 nt, Human
cuguguugggauggugcgcgca

SEQ ID NO: 163645 - RNA, 22 nt, Human
cugggaggagacaggggauggg

SEQ ID NO: 163646 - RNA, 22 nt, Human
cugggagggguagccaauccua

SEQ ID NO: 163647 - RNA, 22 nt, Human
cugggagaugacucagagcagg

SEQ ID NO: 163648 - RNA, 22 nt, Human
cugggagaggaaccucgagggu

SEQ ID NO: 163649 - RNA, 19 nt, Human
cugggacaaugaaagcauc

SEQ ID NO: 163650 - RNA, 22 nt, Human
cugggacacguugugcuuuaac

SEQ ID NO: 163651 - RNA, 22 nt, Human
cuuuuucaugggugaugagugg

SEQ ID NO: 163652 - RNA, 22 nt, Human
cugggcaugggaacuucaaggc

SEQ ID NO: 163653 - RNA, 22 nt, Human
cugggguggugcaggccucaug

SEQ ID NO: 163654 - RNA, 22 nt, Human
cugggugagcuggccagagggu

SEQ ID NO: 163655 - RNA, 22 nt, Human
cuggguguggugggugcugccg

SEQ ID NO: 163656 - RNA, 22 nt, Human
cugggugggcacccagccuggg

SEQ ID NO: 163657 - RNA, 22 nt, Human
cuuuuaccuuaauuucgacaca

SEQ ID NO: 163658 - RNA, 22 nt, Human
cuggcgagcugggccuggggga

SEQ ID NO: 163659 - RNA, 22 nt, Human
cuggccuuaucacaaagcuaga

SEQ ID NO: 163660 - RNA, 22 nt, Human
cuggcgauugcgagagucgccu

SEQ ID NO: 163661 - RNA, 22 nt, Human
cuggcuuucauggcgcaguuga

SEQ ID NO: 163662 - RNA, 22 nt, Human
cuggcggcccgaggcagaggag

SEQ ID NO: 163663 - RNA, 22 nt, Human
cuggaucgccccgaugugcccc

SEQ ID NO: 163664 - RNA, 22 nt, Human
cuggccugugggcugucuccgg

SEQ ID NO: 163665 - RNA, 22 nt, Human
cuggauagaggaugguaggcac

SEQ ID NO: 163666 - RNA, 20 nt, Human
cuggaguguagcaguggcug

SEQ ID NO: 163667 - RNA, 22 nt, Human
cuggagucagcaaggacgaggc

SEQ ID NO: 163668 - RNA, 22 nt, Human
cuggagcuucaggguucucggg

SEQ ID NO: 163669 - RNA, 22 nt, Human
cuggagcucugggcaucucagg

SEQ ID NO: 163670 - RNA, 23 nt, Human
cuucagaccucagaaggucuguu

SEQ ID NO: 163671 - RNA, 22 nt, Human
cugauccuauauugguaugagg

SEQ ID NO: 163672 - RNA, 22 nt, Human
cuucacugcagucauggcucug

SEQ ID NO: 163673 - RNA, 22 nt, Human
cugagguccucagagggaaagg

SEQ ID NO: 163674 - RNA, 20 nt, Human
cuuauuuuggagaacuuuuc

SEQ ID NO: 163675 - RNA, 22 nt, Human
cugaugcucuggauguagucaa

SEQ ID NO: 163676 - RNA, 22 nt, Human
gacagggacacagccagugagg

SEQ ID NO: 163677 - RNA, 22 nt, Human
gacaggaccgagguggggcggg

SEQ ID NO: 163678 - RNA, 22 nt, Human
gacagcguguuuugcaugaaca

SEQ ID NO: 163679 - RNA, 22 nt, Human
gacacugccaagugccccgaga

SEQ ID NO: 163680 - RNA, 22 nt, Human
gacagcaggaugugaggggaug

SEQ ID NO: 163681 - RNA, 22 nt, Human
gaccugcucagcccuguguguu

SEQ ID NO: 163682 - RNA, 22 nt, Human
gacccugaggauucccugcuga

SEQ ID NO: 163683 - RNA, 22 nt, Human
gacccucucagacuuccaggca

SEQ ID NO: 163684 - RNA, 22 nt, Human
gaccgggcucugcugacggucu

SEQ ID NO: 163685 - RNA, 21 nt, Human
cuuugccuccagcagccgcag

SEQ ID NO: 163686 - RNA, 18 nt, Human
gacugccuugaacuauug

SEQ ID NO: 163687 - RNA, 22 nt, Human
gacuugaagcucucugguuuug

SEQ ID NO: 163688 - RNA, 22 nt, Human
gagacugcguggcucugacaca

SEQ ID NO: 163689 - RNA, 22 nt, Human
gagagagacugggaaaucauca

SEQ ID NO: 163690 - RNA, 22 nt, Human
gagaacuauagaaaccuggucu

SEQ ID NO: 163691 - RNA, 22 nt, Human
gaaaaauggguuguuugaagau

SEQ ID NO: 163692 - RNA, 22 nt, Human
gagaccaagcgugggugauaau

SEQ ID NO: 163693 - RNA, 22 nt, Human
gaauggcagaaugaagcagugu

SEQ ID NO: 163694 - RNA, 22 nt, Human
cuuggcuccuucacagggagau

SEQ ID NO: 163695 - RNA, 22 nt, Human
gaauuccaggugagagaaggua

SEQ ID NO: 163696 - RNA, 22 nt, Human
gacaccuucuacugacuaugga

SEQ ID NO: 163697 - RNA, 22 nt, Human
gacacccgccggcgccugccuc

SEQ ID NO: 163698 - RNA, 22 nt, Human
gacaagaugacaucauggcuuc

SEQ ID NO: 163699 - RNA, 22 nt, Human
gacaagaagaacggagguuuca

SEQ ID NO: 163700 - RNA, 22 nt, Human
gaagaugcugcuuguucacggg

SEQ ID NO: 163701 - RNA, 22 nt, Human
gaagggccaggggcaggcugga

SEQ ID NO: 163702 - RNA, 22 nt, Human
gaaggcugaauuauuuguuccu

SEQ ID NO: 163703 - RNA, 22 nt, Human
cuuccugcaacaccuguguugc

SEQ ID NO: 163704 - RNA, 22 nt, Human
gaaggggccuggggcaaggcua

SEQ ID NO: 163705 - RNA, 22 nt, Human
cuucucugcugccugccucuuu

SEQ ID NO: 163706 - RNA, 22 nt, Human
gaaguggggaggagaagacuga

SEQ ID NO: 163707 - RNA, 22 nt, Human
cuugagcugaguuugcagcucu

SEQ ID NO: 163708 - RNA, 22 nt, Human
gagguccaggguggggccugag

SEQ ID NO: 163709 - RNA, 22 nt, Human
gagguagcgugcagggcccgaa

SEQ ID NO: 163710 - RNA, 22 nt, Human
gaggucagcaagccaugcuugu

SEQ ID NO: 163711 - RNA, 22 nt, Human
gagggugugguauggauguguu

SEQ ID NO: 163712 - RNA, 20 nt, Human
gacaagccacagcucccaga

SEQ ID NO: 163713 - RNA, 22 nt, Human
gaggguggagccuccuggaagu

SEQ ID NO: 163714 - RNA, 22 nt, Human
gaggguggggaauagacugcua

SEQ ID NO: 163715 - RNA, 22 nt, Human
gagggugguggcggccggcacc

SEQ ID NO: 163716 - RNA, 22 nt, Human
gagguuggagggcuggccugca

SEQ ID NO: 163717 - RNA, 20 nt, Human
gagguugcucagaguggggu

SEQ ID NO: 163718 - RNA, 22 nt, Human
gaggugcaggggcccgggcugg

SEQ ID NO: 163719 - RNA, 22 nt, Human
gacagguagacaugaauauuaa

SEQ ID NO: 163720 - RNA, 22 nt, Human
gacagaccucugcugacuggag

SEQ ID NO: 163721 - RNA, 22 nt, Human
gaggugauuccucccauguaau

SEQ ID NO: 163722 - RNA, 22 nt, Human
gaccuuguucuggcauucucag

SEQ ID NO: 163723 - RNA, 22 nt, Human
gaccucauggaguaagugagug

SEQ ID NO: 163724 - RNA, 22 nt, Human
gaccugguggccauugucccag

SEQ ID NO: 163725 - RNA, 22 nt, Human
gaccugaccucauuagcaaguu

SEQ ID NO: 163726 - RNA, 22 nt, Human
gaguauuuaccacuaaaugguu

SEQ ID NO: 163727 - RNA, 20 nt, Human
gacgaacuagaacaguggua

SEQ ID NO: 163728 - RNA, 22 nt, Human
gacggagugcgcuugcuguuca

SEQ ID NO: 163729 - RNA, 22 nt, Human
gacggaggacaucagcaguguc

SEQ ID NO: 163730 - RNA, 19 nt, Human
gagugaggagcaucguuua

SEQ ID NO: 163731 - RNA, 22 nt, Human
gagugaucuguaggcagcaugg

SEQ ID NO: 163732 - RNA, 22 nt, Human
gacccggauguuguacucgagg

SEQ ID NO: 163733 - RNA, 22 nt, Human
gaguagccucagucugcaagug

SEQ ID NO: 163734 - RNA, 22 nt, Human
gacaucuguccauggcacugga

SEQ ID NO: 163735 - RNA, 22 nt, Human
gaccagaacuucuagucuaagu

SEQ ID NO: 163736 - RNA, 22 nt, Human
gacccgacaaguaaucagguga

SEQ ID NO: 163737 - RNA, 22 nt, Human
gaccaggagauuugagcuaggc

SEQ ID NO: 163738 - RNA, 22 nt, Human
gacuggcucuaucaggauaaau

SEQ ID NO: 163739 - RNA, 22 nt, Human
gacugggacucaacccaccauu

SEQ ID NO: 163740 - RNA, 22 nt, Human
gacuccugccucucuacuucug

SEQ ID NO: 163741 - RNA, 22 nt, Human
gacuccuuaauguggcugaugu

SEQ ID NO: 163742 - RNA, 22 nt, Human
gaguggugagaauacaacggaa

SEQ ID NO: 163743 - RNA, 22 nt, Human
gagugggugaaugugcucauaa

SEQ ID NO: 163744 - RNA, 22 nt, Human
gauaccugccaagcugcacuca

SEQ ID NO: 163745 - RNA, 20 nt, Human
gacuucaauuucuaucuuuu

SEQ ID NO: 163746 - RNA, 22 nt, Human
gauacuuuguggaauccuggau

SEQ ID NO: 163747 - RNA, 22 nt, Human
gagaaagauuguccuucagggg

SEQ ID NO: 163748 - RNA, 22 nt, Human
gagaaugagucagagcuggcug

SEQ ID NO: 163749 - RNA, 22 nt, Human
gagaagguggaccugaaggagc

SEQ ID NO: 163750 - RNA, 22 nt, Human
gagaacagauaugaugacuuca

SEQ ID NO: 163751 - RNA, 22 nt, Human
gauauucauaggcagguauuua

SEQ ID NO: 163752 - RNA, 22 nt, Human
gaucccaguccuacccucauaa

SEQ ID NO: 163753 - RNA, 22 nt, Human
gaagauucugacccugacucag

SEQ ID NO: 163754 - RNA, 22 nt, Human
gaaaaugcacacauacacaccc

SEQ ID NO: 163755 - RNA, 22 nt, Human
gagagaggggaagagaagcucu

SEQ ID NO: 163756 - RNA, 18 nt, Human
gaagcaacaguucugagu

SEQ ID NO: 163757 - RNA, 22 nt, Human
gaagcaccuggacggugccugg

SEQ ID NO: 163758 - RNA, 22 nt, Human
gagccgcagcugcguagggucc

SEQ ID NO: 163759 - RNA, 22 nt, Human
gaagccaacacgugggagggag

SEQ ID NO: 163760 - RNA, 22 nt, Human
gagccuggagcuggaacgaagc

SEQ ID NO: 163761 - RNA, 22 nt, Human
gagccggggcucccugaggucc

SEQ ID NO: 163762 - RNA, 22 nt, Human
gaagcgucaugaaagaaaggcu

SEQ ID NO: 163763 - RNA, 22 nt, Human
gagcggcggugagaaguguggg

SEQ ID NO: 163764 - RNA, 22 nt, Human
gagcgcgcaaucucuccagcug

SEQ ID NO: 163765 - RNA, 22 nt, Human
gagcguuucccugggggucugc

SEQ ID NO: 163766 - RNA, 22 nt, Human
gaagcgugcagguccguauacu

SEQ ID NO: 163767 - RNA, 22 nt, Human
gagcgugaggcagcuuucuaag

SEQ ID NO: 163768 - RNA, 22 nt, Human
gagcucucgggcuggggcguug

SEQ ID NO: 163769 - RNA, 21 nt, Human
gaagcugcuaugaagggggac

SEQ ID NO: 163770 - RNA, 22 nt, Human
gaagcuccaggaugccugcacu

SEQ ID NO: 163771 - RNA, 22 nt, Human
gaaggauaauuuugcuggaugu

SEQ ID NO: 163772 - RNA, 22 nt, Human
gaaggaaaagacgugcuaagua

SEQ ID NO: 163773 - RNA, 22 nt, Human
gagcuuuguuccgugguggcac

SEQ ID NO: 163774 - RNA, 22 nt, Human
gaaggcagucuggggagcagcc

SEQ ID NO: 163775 - RNA, 22 nt, Human
gaggaagucuuaucuggaugca

SEQ ID NO: 163776 - RNA, 22 nt, Human
gaggaaaauggaguguaauuaa

SEQ ID NO: 163777 - RNA, 22 nt, Human
gaggagaaacagccgugauagu

SEQ ID NO: 163778 - RNA, 22 nt, Human
gaggagacaguggagccgcuac

SEQ ID NO: 163779 - RNA, 22 nt, Human
gaggacugguugggaaugugaa

SEQ ID NO: 163780 - RNA, 22 nt, Human
gaaggugcugaaacagaaauuu

SEQ ID NO: 163781 - RNA, 22 nt, Human
gaaggcuguggcuggucucagu

SEQ ID NO: 163782 - RNA, 22 nt, Human
gaggagcugggucagggagaca

SEQ ID NO: 163783 - RNA, 22 nt, Human
gaggaggacauuggaaagaacu

SEQ ID NO: 163784 - RNA, 22 nt, Human
gaggagcuucagaggaaucuua

SEQ ID NO: 163785 - RNA, 22 nt, Human
gaggaggagaagcggcggcgga

SEQ ID NO: 163786 - RNA, 22 nt, Human
gaggaggcuggagaggccagga

SEQ ID NO: 163787 - RNA, 22 nt, Human
gaggaggucaccuggugagcaa

SEQ ID NO: 163788 - RNA, 22 nt, Human
gaggcaggaagggaggguugug

SEQ ID NO: 163789 - RNA, 22 nt, Human
gaggcaggcggggcccaggugg

SEQ ID NO: 163790 - RNA, 22 nt, Human
gaggcgcgcugcgagggcgcgg

SEQ ID NO: 163791 - RNA, 22 nt, Human
gaggccuucauuucuccgucug

SEQ ID NO: 163792 - RNA, 22 nt, Human
gaggccauguggcccgggcugc

SEQ ID NO: 163793 - RNA, 22 nt, Human
gaggccagcacccagaugcaug

SEQ ID NO: 163794 - RNA, 22 nt, Human
gaggcggcgacgcgggcccggg

SEQ ID NO: 163795 - RNA, 22 nt, Human
gaggcggugguggcgagaguca

SEQ ID NO: 163796 - RNA, 22 nt, Human
gaaucucuuugucccugaguuu

SEQ ID NO: 163797 - RNA, 22 nt, Human
gaggcccugagauugcugcccu

SEQ ID NO: 163798 - RNA, 22 nt, Human
gaggcagaggaugggacuguau

SEQ ID NO: 163799 - RNA, 22 nt, Human
gaggauuugagggucacuccac

SEQ ID NO: 163800 - RNA, 22 nt, Human
gaggaugacaaagaaggcagac

SEQ ID NO: 163801 - RNA, 22 nt, Human
gaggggcacaguggggccuggg

SEQ ID NO: 163802 - RNA, 22 nt, Human
gaggggcgaggacgcugaagua

SEQ ID NO: 163803 - RNA, 19 nt, Human
gaauugcacgagcagaggc

SEQ ID NO: 163804 - RNA, 22 nt, Human
gaggggcugggguugacuccaa

SEQ ID NO: 163805 - RNA, 22 nt, Human
gagggggaaaagggcagcagag

SEQ ID NO: 163806 - RNA, 22 nt, Human
gagggagugggcccgugggcac

SEQ ID NO: 163807 - RNA, 22 nt, Human
gagggcugccacguugggcgag

SEQ ID NO: 163808 - RNA, 22 nt, Human
gagggcucaacuacuacuaggc

SEQ ID NO: 163809 - RNA, 22 nt, Human
gaggggaaggagcgaaggcggg

SEQ ID NO: 163810 - RNA, 22 nt, Human
uuguuccagaaacccaggggaa

SEQ ID NO: 163811 - RNA, 22 nt, Human
uuuguggugagcagggaacguc

SEQ ID NO: 163812 - RNA, 22 nt, Human
ggaagaagagggagcuguggga

SEQ ID NO: 163813 - RNA, 22 nt, Human
ggaagaggaagaugaggcagca

SEQ ID NO: 163814 - RNA, 20 nt, Human
gccugggagaagaucaggga

SEQ ID NO: 163815 - RNA, 22 nt, Human
gccugggcuuccgggacccggg

SEQ ID NO: 163816 - RNA, 18 nt, Human
ggagaagaacagaugugg

SEQ ID NO: 163817 - RNA, 22 nt, Human
ggacagggagcaaaaacguccc

SEQ ID NO: 163818 - RNA, 22 nt, Human
ggaggccgugcugugcugccag

SEQ ID NO: 163819 - RNA, 22 nt, Human
ggaggcccagaaggaagcccag

SEQ ID NO: 163820 - RNA, 22 nt, Human
ggaggaggggcggggaggggag

SEQ ID NO: 163821 - RNA, 22 nt, Human
ggaggaagagaccagggggcuu

SEQ ID NO: 163822 - RNA, 22 nt, Human
ggagcugaacccuuaacuggcu

SEQ ID NO: 163823 - RNA, 22 nt, Human
ggaggagggaguucaggaguau

SEQ ID NO: 163824 - RNA, 22 nt, Human
ggaggaugaggguggugguguu

SEQ ID NO: 163825 - RNA, 22 nt, Human
ggaggggaguuugccucugggg

SEQ ID NO: 163826 - RNA, 23 nt, Human
ggaggcccagaggucggccccac

SEQ ID NO: 163827 - RNA, 19 nt, Human
ggaggguguccucaguguc

SEQ ID NO: 163828 - RNA, 22 nt, Human
ggaggguggaggagggaauuga

SEQ ID NO: 163829 - RNA, 22 nt, Human
ggagguggagcuggaaguucca

SEQ ID NO: 163830 - RNA, 22 nt, Human
ggagaccagaaggaagcuucga

SEQ ID NO: 163831 - RNA, 22 nt, Human
ggagaccaauuaaugaaggaau

SEQ ID NO: 163832 - RNA, 22 nt, Human
ggagagcuagugagcuggaggu

SEQ ID NO: 163833 - RNA, 22 nt, Human
gcgcggcgcggguccucggccu

SEQ ID NO: 163834 - RNA, 22 nt, Human
ggagagcguggaugggcuucca

SEQ ID NO: 163835 - RNA, 22 nt, Human
ggagagagggaucuuuguggag

SEQ ID NO: 163836 - RNA, 22 nt, Human
gcggacaauggaagaugucauu

SEQ ID NO: 163837 - RNA, 20 nt, Human
gcgcuucccuacgcucugcu

SEQ ID NO: 163838 - RNA, 22 nt, Human
gcggagcuaaagauuggcuccu

SEQ ID NO: 163839 - RNA, 22 nt, Human
ggaguuucugucaucccguccc

SEQ ID NO: 163840 - RNA, 19 nt, Human
ggaguugccaggagaagga

SEQ ID NO: 163841 - RNA, 22 nt, Human
ggaguucaaaucuggaccuugc

SEQ ID NO: 163842 - RNA, 22 nt, Human
ggaguucaaaucuuuuggaucu

SEQ ID NO: 163843 - RNA, 22 nt, Human
ggagugaguauguucugaugca

SEQ ID NO: 163844 - RNA, 19 nt, Human
ggauaagguuggagugauc

SEQ ID NO: 163845 - RNA, 22 nt, Human
ggcacuggguugcagagagaga

SEQ ID NO: 163846 - RNA, 22 nt, Human
ggcacagcgacuaccaucgaaa

SEQ ID NO: 163847 - RNA, 22 nt, Human
ggcagcuuucaauaggguuaug

SEQ ID NO: 163848 - RNA, 21 nt, Human
ggcagccuggcaggggcacug

SEQ ID NO: 163849 - RNA, 22 nt, Human
gcguagaagaaagcugcugcua

SEQ ID NO: 163850 - RNA, 22 nt, Human
gcuagcugugcuuggaaguuug

SEQ ID NO: 163851 - RNA, 22 nt, Human
gcucacuuguaaccccuuccuc

SEQ ID NO: 163852 - RNA, 22 nt, Human
gcucagagaugucugcugccuu

SEQ ID NO: 163853 - RNA, 22 nt, Human
gcucuagcuggcgcugaccugg

SEQ ID NO: 163854 - RNA, 22 nt, Human
gcuccggggguuccagaucauc

SEQ ID NO: 163855 - RNA, 22 nt, Human
ggcagugguaggagcccaggag

SEQ ID NO: 163856 - RNA, 22 nt, Human
ggcaugcaaaugugggugaccu

SEQ ID NO: 163857 - RNA, 20 nt, Human
ggcaucugacaacuaguugc

SEQ ID NO: 163858 - RNA, 22 nt, Human
gcugagcaaugcacugccgcau

SEQ ID NO: 163859 - RNA, 22 nt, Human
gcucucuggccugggaggagga

SEQ ID NO: 163860 - RNA, 22 nt, Human
gcauuccagaguugcuggaaaa

SEQ ID NO: 163861 - RNA, 22 nt, Human
gcauuagacuaguacacggcag

SEQ ID NO: 163862 - RNA, 22 nt, Human
gcaugguuagacaucaauguga

SEQ ID NO: 163863 - RNA, 22 nt, Human
gcccgaccgcgccggcccgcac

SEQ ID NO: 163864 - RNA, 22 nt, Human
gcccccauuccugcggccuuca

SEQ ID NO: 163865 - RNA, 22 nt, Human
gccccaggggaggugcccugca

SEQ ID NO: 163866 - RNA, 22 nt, Human
gcccugaagagguagagaauuu

SEQ ID NO: 163867 - RNA, 22 nt, Human
gcccugaaggccuccaggacuc

SEQ ID NO: 163868 - RNA, 22 nt, Human
gcccuggagauggaaguucuga

SEQ ID NO: 163869 - RNA, 22 nt, Human
gcccuagaguugagagcaccca

SEQ ID NO: 163870 - RNA, 22 nt, Human
gcccuggucguggagggcaaca

SEQ ID NO: 163871 - RNA, 22 nt, Human
gcccuguguguuugcacugauu

SEQ ID NO: 163872 - RNA, 22 nt, Human
gcccugucagcucucauggaca

SEQ ID NO: 163873 - RNA, 20 nt, Human
gcccuucccccuccgcgagc

SEQ ID NO: 163874 - RNA, 22 nt, Human
gcugucccccaaagaugcuccu

SEQ ID NO: 163875 - RNA, 22 nt, Human
gcuggugugagauucucgaggg

SEQ ID NO: 163876 - RNA, 22 nt, Human
gcuguguucauccugcccaggu

SEQ ID NO: 163877 - RNA, 22 nt, Human
gcuguggcuccaauggugagcc

SEQ ID NO: 163878 - RNA, 22 nt, Human
gcuguggaaaaugggucuccaa

SEQ ID NO: 163879 - RNA, 20 nt, Human
gcugugccaugacccucgag

SEQ ID NO: 163880 - RNA, 22 nt, Human
gccgccgcucaccugggcgccg

SEQ ID NO: 163881 - RNA, 22 nt, Human
gccgcaacggacccugggaguc

SEQ ID NO: 163882 - RNA, 22 nt, Human
gccgcagauucugagacgugua

SEQ ID NO: 163883 - RNA, 22 nt, Human
gcuucuguuaggauguggcuua

SEQ ID NO: 163884 - RNA, 22 nt, Human
gcuuccuccaucuggggcuugc

SEQ ID NO: 163885 - RNA, 22 nt, Human
gcuucccacagcuggacugggg

SEQ ID NO: 163886 - RNA, 21 nt, Human
gcuucaauucauccaccucuc

SEQ ID NO: 163887 - RNA, 22 nt, Human
ggaaauauaagcaguuugugug

SEQ ID NO: 163888 - RNA, 22 nt, Human
ggaaauguguguaagaaaguau

SEQ ID NO: 163889 - RNA, 22 nt, Human
gccugaaaugaaccagaggacu

SEQ ID NO: 163890 - RNA, 22 nt, Human
ggaaaggaagggaaggagaugc

SEQ ID NO: 163891 - RNA, 22 nt, Human
gccugcacucaaacacucucuu

SEQ ID NO: 163892 - RNA, 22 nt, Human
gccuagaagaaugagcgcaggg

SEQ ID NO: 163893 - RNA, 20 nt, Human
gccggggcauaggggccguc

SEQ ID NO: 163894 - RNA, 22 nt, Human
gccuccgccuuccugucucccc

SEQ ID NO: 163895 - RNA, 22 nt, Human
gccuccggagucgcagugucuu

SEQ ID NO: 163896 - RNA, 18 nt, Human
gccucuguugacagaguu

SEQ ID NO: 163897 - RNA, 22 nt, Human
gccuccuccaucauugcuucau

SEQ ID NO: 163898 - RNA, 22 nt, Human
gccucucagcuagaaggcaggu

SEQ ID NO: 163899 - RNA, 22 nt, Human
ggaaaaugcugaagcaucugaa

SEQ ID NO: 163900 - RNA, 22 nt, Human
ggaaaagccauauuauaggcaa

SEQ ID NO: 163901 - RNA, 22 nt, Human
gccggagagccaacaccacgga

SEQ ID NO: 163902 - RNA, 22 nt, Human
gcuuuucucccugcuuucuucc

SEQ ID NO: 163903 - RNA, 22 nt, Human
gcuuuggcuucuccuggcagga

SEQ ID NO: 163904 - RNA, 22 nt, Human
gcccuuuuaucaacuccuagaa

SEQ ID NO: 163905 - RNA, 15 nt, Human
gccgcgcuggggagc

SEQ ID NO: 163906 - RNA, 18 nt, Human
gcuuggguggcuauguuu

SEQ ID NO: 163907 - RNA, 22 nt, Human
gcuugggcugaaggccuggguc

SEQ ID NO: 163908 - RNA, 22 nt, Human
gcuagaaacuguuuaaucucuu

SEQ ID NO: 163909 - RNA, 22 nt, Human
gcuacauuagcuucaauggcua

SEQ ID NO: 163910 - RNA, 22 nt, Human
gcagugcauggaagggggugug

SEQ ID NO: 163911 - RNA, 22 nt, Human
gcuagaaggaagccccugcuga

SEQ ID NO: 163912 - RNA, 22 nt, Human
gcuaggagccucgacucuggag

SEQ ID NO: 163913 - RNA, 22 nt, Human
gcucagcuggagagggacgggu

SEQ ID NO: 163914 - RNA, 22 nt, Human
gcucagccuuuuguucuauuca

SEQ ID NO: 163915 - RNA, 21 nt, Human
gcauccucguacucuucaggu

SEQ ID NO: 163916 - RNA, 22 nt, Human
gcauccugacuauggugguggu

SEQ ID NO: 163917 - RNA, 20 nt, Human
gcucaguggagaaaugcacc

SEQ ID NO: 163918 - RNA, 22 nt, Human
gcucaugggcccagagcagccc

SEQ ID NO: 163919 - RNA, 22 nt, Human
gcaugcuguuuggaaacgauaa

SEQ ID NO: 163920 - RNA, 22 nt, Human
gcucggcuggcucaucucaugu

SEQ ID NO: 163921 - RNA, 23 nt, Human
gcaugcccauauguguauauaua

SEQ ID NO: 163922 - RNA, 22 nt, Human
gcagugccauguggaggaucuc

SEQ ID NO: 163923 - RNA, 22 nt, Human
gcaggucacagcugauuggcca

SEQ ID NO: 163924 - RNA, 22 nt, Human
gcagggcucuggagucaggcug

SEQ ID NO: 163925 - RNA, 23 nt, Human
gcgggcggagccgggaggcgggg

SEQ ID NO: 163926 - RNA, 22 nt, Human
gcaggcaggauucagagauaca

SEQ ID NO: 163927 - RNA, 22 nt, Human
gcaggcagauccagaagcacua

SEQ ID NO: 163928 - RNA, 21 nt, Human
gcagcaugagaaagccccaaa

SEQ ID NO: 163929 - RNA, 22 nt, Human
gcgcgggugagucacgggcgga

SEQ ID NO: 163930 - RNA, 22 nt, Human
gcgcugagcuuuucuuauugaa

SEQ ID NO: 163931 - RNA, 22 nt, Human
gcgcucuccugcagacagccuc

SEQ ID NO: 163932 - RNA, 20 nt, Human
gcagcugacccuagugcuug

SEQ ID NO: 163933 - RNA, 21 nt, Human
gcagaaagugauuugcuauuc

SEQ ID NO: 163934 - RNA, 22 nt, Human
gcacucuguggagacaagauag

SEQ ID NO: 163935 - RNA, 22 nt, Human
gccugcugggcucuuccugcug

SEQ ID NO: 163936 - RNA, 22 nt, Human
gcagaugagagugugaucuggg

SEQ ID NO: 163937 - RNA, 22 nt, Human
gcagaggcugccgugggcagga

SEQ ID NO: 163938 - RNA, 22 nt, Human
gccugggguuugcggggcugca

SEQ ID NO: 163939 - RNA, 22 nt, Human
gcgccuugccuguccucuaacc

SEQ ID NO: 163940 - RNA, 22 nt, Human
gcgcgcucugcgaggacacgcu

SEQ ID NO: 163941 - RNA, 22 nt, Human
gcgccgacccucccugccggac

SEQ ID NO: 163942 - RNA, 22 nt, Human
gcagauccaaauauaguucuug

SEQ ID NO: 163943 - RNA, 22 nt, Human
gcgcagugagguuaagaaugca

SEQ ID NO: 163944 - RNA, 22 nt, Human
gcagcaaucuucacagugucau

SEQ ID NO: 163945 - RNA, 20 nt, Human
gcagcagacagacaggggac

SEQ ID NO: 163946 - RNA, 22 nt, Human
gccugcagccagggaguucucu

SEQ ID NO: 163947 - RNA, 22 nt, Human
gccugcaggaaggugugccugu

SEQ ID NO: 163948 - RNA, 22 nt, Human
gcaauaaguuuucucuucuguc

SEQ ID NO: 163949 - RNA, 22 nt, Human
gcaauuguauugucaagacaug

SEQ ID NO: 163950 - RNA, 22 nt, Human
gccugccucugacuggggcuga

SEQ ID NO: 163951 - RNA, 18 nt, Human
gccugccagccgagggac

SEQ ID NO: 163952 - RNA, 22 nt, Human
gcacagucaacacuuauucacc

SEQ ID NO: 163953 - RNA, 22 nt, Human
gcacccagggcaggaagugagg

SEQ ID NO: 163954 - RNA, 22 nt, Human
gcacuaccaguaauuaaaucug

SEQ ID NO: 163955 - RNA, 22 nt, Human
gcacggucagggugggggagug

SEQ ID NO: 163956 - RNA, 22 nt, Human
gcaaggaagcagaguugcuauc

SEQ ID NO: 163957 - RNA, 22 nt, Human
gcaaggacagaagcccacacag

SEQ ID NO: 163958 - RNA, 22 nt, Human
gcccuguuuucuggguuccuug

SEQ ID NO: 163959 - RNA, 22 nt, Human
gcaggccuccccugcuggagcu

SEQ ID NO: 163960 - RNA, 22 nt, Human
gcagggcucagccgcucccacc

SEQ ID NO: 163961 - RNA, 22 nt, Human
gcaggguaggugacagguaguc

SEQ ID NO: 163962 - RNA, 21 nt, Human
gcaggggugugugagcugggg

SEQ ID NO: 163963 - RNA, 22 nt, Human
gaucuuacucacuucagcuggc

SEQ ID NO: 163964 - RNA, 21 nt, Human
gaucgcaaugugggaaucaug

SEQ ID NO: 163965 - RNA, 22 nt, Human
gcagguccgagagggucgggua

SEQ ID NO: 163966 - RNA, 22 nt, Human
gcagguggaagcagcagacuca

SEQ ID NO: 163967 - RNA, 22 nt, Human
gcagucauggguagaacucaag

SEQ ID NO: 163968 - RNA, 22 nt, Human
gcagucuacuuaagaaucucag

SEQ ID NO: 163969 - RNA, 22 nt, Human
gcaguugugguuucguuuccuu

SEQ ID NO: 163970 - RNA, 22 nt, Human
gcauagacaccuuagagcaaua

SEQ ID NO: 163971 - RNA, 22 nt, Human
gaguggccugccccagccaggc

SEQ ID NO: 163972 - RNA, 22 nt, Human
gcagugcugcgacagucgggug

SEQ ID NO: 163973 - RNA, 19 nt, Human
gcaguuccucuuaagagaa

SEQ ID NO: 163974 - RNA, 22 nt, Human
gaguccuggagagcccgagcgc

SEQ ID NO: 163975 - RNA, 22 nt, Human
gcaugcaggaagggcuugggga

SEQ ID NO: 163976 - RNA, 22 nt, Human
gcaucuccugagucagauuuug

SEQ ID NO: 163977 - RNA, 22 nt, Human
gccaaccagucgguccaggaag

SEQ ID NO: 163978 - RNA, 22 nt, Human
gccaaucaggaggcuguacauc

SEQ ID NO: 163979 - RNA, 21 nt, Human
gccacugcugcucauucucug

SEQ ID NO: 163980 - RNA, 19 nt, Human
gccacccaucauauggagg

SEQ ID NO: 163981 - RNA, 22 nt, Human
gccacucaguuuaggggcaagc

SEQ ID NO: 163982 - RNA, 19 nt, Human
gccacguuggcuaguugcc

SEQ ID NO: 163983 - RNA, 22 nt, Human
gccagcuuagaucccccagccc

SEQ ID NO: 163984 - RNA, 22 nt, Human
gccaggagaaaaggcgaaugau

SEQ ID NO: 163985 - RNA, 22 nt, Human
gccagccggugaguggaagcgg

SEQ ID NO: 163986 - RNA, 22 nt, Human
gccaggugauuucaaaguccuu

SEQ ID NO: 163987 - RNA, 22 nt, Human
gaugcauccuuucugucuucuc

SEQ ID NO: 163988 - RNA, 18 nt, Human
gccagcccuccaaccucc

SEQ ID NO: 163989 - RNA, 22 nt, Human
gauccagauauuugggcuggua

SEQ ID NO: 163990 - RNA, 22 nt, Human
gauccucagacccuccucuggu

SEQ ID NO: 163991 - RNA, 22 nt, Human
gcccagcucucuggccugucuu

SEQ ID NO: 163992 - RNA, 22 nt, Human
gcccagcuuuuugaggcaggca

SEQ ID NO: 163993 - RNA, 22 nt, Human
gccauaggggcuuacauaguua

SEQ ID NO: 163994 - RNA, 22 nt, Human
gccagggcucgagcaggccagc

SEQ ID NO: 163995 - RNA, 22 nt, Human
gaucccccaucuacuaucccca

SEQ ID NO: 163996 - RNA, 22 nt, Human
gauggugcaauuaucgugcaug

SEQ ID NO: 163997 - RNA, 22 nt, Human
gcccuguuauagucugaggccu

SEQ ID NO: 163998 - RNA, 22 nt, Human
gcccugccauugaucggcccag

SEQ ID NO: 163999 - RNA, 22 nt, Human
gcccuggcauuucuauucaugu

SEQ ID NO: 164000 - RNA, 22 nt, Human
gccccgcgcgcguagcgccgcu

SEQ ID NO: 164001 - RNA, 22 nt, Human
gcccccgccuugcugggccagg

SEQ ID NO: 164002 - RNA, 22 nt, Human
gaugucccuggaggggacagga

SEQ ID NO: 164003 - RNA, 22 nt, Human
gaugugugugcccugggccugc

SEQ ID NO: 164004 - RNA, 22 nt, Human
ggcauuccucucuguucaugga

SEQ ID NO: 164005 - RNA, 22 nt, Human
ggcaguguggauccuggagaag

SEQ ID NO: 164006 - RNA, 22 nt, Human
gguggcauguaccucacagacu

SEQ ID NO: 164007 - RNA, 22 nt, Human
ggugaggggauccuguuaccau

SEQ ID NO: 164008 - RNA, 22 nt, Human
gguugcggaccagcugggcugc

SEQ ID NO: 164009 - RNA, 22 nt, Human
ggccacgggguuugcugaaacu

SEQ ID NO: 164010 - RNA, 22 nt, Human
ggccacauuccagagggcugaa

SEQ ID NO: 164011 - RNA, 19 nt, Human
gguuaccagugugucuggc

SEQ ID NO: 164012 - RNA, 22 nt, Human
ggccaagagaggauggagggau

SEQ ID NO: 164013 - RNA, 22 nt, Human
ggccaaagagcacaaugaauag

SEQ ID NO: 164014 - RNA, 22 nt, Human
ggugucguuucacaugacccag

SEQ ID NO: 164015 - RNA, 22 nt, Human
ggcauuccgggguccccuucuc

SEQ ID NO: 164016 - RNA, 19 nt, Human
ggcacccagagucccccug

SEQ ID NO: 164017 - RNA, 23 nt, Human
ggugagccuuucuaguagucuug

SEQ ID NO: 164018 - RNA, 22 nt, Human
ggugacuucugaaccuggagug

SEQ ID NO: 164019 - RNA, 22 nt, Human
ggcacccugcauuggcuugagu

SEQ ID NO: 164020 - RNA, 18 nt, Human
ggugagggagcuggaagc

SEQ ID NO: 164021 - RNA, 20 nt, Human
ggcagcaaccauaugcuaca

SEQ ID NO: 164022 - RNA, 22 nt, Human
ggcagaggaagcuggaaguggg

SEQ ID NO: 164023 - RNA, 22 nt, Human
ggcagagcugugcgcccaccca

SEQ ID NO: 164024 - RNA, 22 nt, Human
ggucauacaaggcacuggugau

SEQ ID NO: 164025 - RNA, 22 nt, Human
ggucgagcagcacccguucggc

SEQ ID NO: 164026 - RNA, 22 nt, Human
ggucccacgauguaccugucug

SEQ ID NO: 164027 - RNA, 22 nt, Human
gguauccaaauaaagcagguaa

SEQ ID NO: 164028 - RNA, 22 nt, Human
ggauggugauguacccagucau

SEQ ID NO: 164029 - RNA, 22 nt, Human
ggaugcugcuccacaucccaca

SEQ ID NO: 164030 - RNA, 23 nt, Human
ggauggacauacguaugcacagg

SEQ ID NO: 164031 - RNA, 22 nt, Human
ggaugcagcagagaccuggagu

SEQ ID NO: 164032 - RNA, 20 nt, Human
ggagcgggcauuuguguucc

SEQ ID NO: 164033 - RNA, 22 nt, Human
ggaggaaauccuuaguaaggca

SEQ ID NO: 164034 - RNA, 22 nt, Human
ggagccuggaguuucugauggg

SEQ ID NO: 164035 - RNA, 22 nt, Human
ggagccaguuuagaccucaguu

SEQ ID NO: 164036 - RNA, 22 nt, Human
ggagcauggcuucuuggggcug

SEQ ID NO: 164037 - RNA, 22 nt, Human
ggaggccagagaagagccaggc

SEQ ID NO: 164038 - RNA, 21 nt, Human
gggguuuuguucuuauaaugu

SEQ ID NO: 164039 - RNA, 22 nt, Human
ggaggcacugaaaguccuacag

SEQ ID NO: 164040 - RNA, 22 nt, Human
ggaggccccccaugcagcucca

SEQ ID NO: 164041 - RNA, 21 nt, Human
gggugcacagcaaauuugaga

SEQ ID NO: 164042 - RNA, 22 nt, Human
gggugcauggcagcccuucugg

SEQ ID NO: 164043 - RNA, 22 nt, Human
gggugcucauggauaaggcgaa

SEQ ID NO: 164044 - RNA, 22 nt, Human
gggugcucagugccaaggagug

SEQ ID NO: 164045 - RNA, 22 nt, Human
gggggagaauaugugaaggggg

SEQ ID NO: 164046 - RNA, 22 nt, Human
gggggcgccgccgcucaucuca

SEQ ID NO: 164047 - RNA, 22 nt, Human
gggggcagguuccaggccagcu

SEQ ID NO: 164048 - RNA, 22 nt, Human
ggagaugacaucccagcccggc

SEQ ID NO: 164049 - RNA, 22 nt, Human
ggagcaagagugagcaagcaga

SEQ ID NO: 164050 - RNA, 22 nt, Human
ggagcagaggaaagaguagcau

SEQ ID NO: 164051 - RNA, 22 nt, Human
gggcuuuuccaacacucuggag

SEQ ID NO: 164052 - RNA, 22 nt, Human
gggcuuuuccauuccaggguuc

SEQ ID NO: 164053 - RNA, 22 nt, Human
ggagggcuggacguacuagggc

SEQ ID NO: 164054 - RNA, 22 nt, Human
ggaggcggaaguccaagcaggu

SEQ ID NO: 164055 - RNA, 22 nt, Human
ggagugaaugguggccguguuu

SEQ ID NO: 164056 - RNA, 22 nt, Human
ggaggucagcuggaggggaggc

SEQ ID NO: 164057 - RNA, 22 nt, Human
gggugcuucauaggugaugcug

SEQ ID NO: 164058 - RNA, 22 nt, Human
ggguggugagagaacuuugcag

SEQ ID NO: 164059 - RNA, 22 nt, Human
gggugggguaggugacucucgc

SEQ ID NO: 164060 - RNA, 22 nt, Human
ggaucagcgagaagggcugaaa

SEQ ID NO: 164061 - RNA, 22 nt, Human
ggguuuguuccuacuucuacuc

SEQ ID NO: 164062 - RNA, 21 nt, Human
gggagaguagcgguagggagg

SEQ ID NO: 164063 - RNA, 22 nt, Human
gggagauuuguguaggaaaacu

SEQ ID NO: 164064 - RNA, 22 nt, Human
gggacugguuguguguggugug

SEQ ID NO: 164065 - RNA, 22 nt, Human
gcuuuccuggcccugucccugc

SEQ ID NO: 164066 - RNA, 22 nt, Human
gcuuucacugcaauagaugaau

SEQ ID NO: 164067 - RNA, 22 nt, Human
gggcaggacccguuagaguggc

SEQ ID NO: 164068 - RNA, 22 nt, Human
gggcagagggcgagcugggaga

SEQ ID NO: 164069 - RNA, 22 nt, Human
ggaaaggacuggagcccagcgc

SEQ ID NO: 164070 - RNA, 22 nt, Human
ggaagacuuagaguagcaucag

SEQ ID NO: 164071 - RNA, 22 nt, Human
gggccgcagccucuccggccug

SEQ ID NO: 164072 - RNA, 22 nt, Human
gggccccgggcgcggcugcggg

SEQ ID NO: 164073 - RNA, 22 nt, Human
ggaagccugggcgcaggcaggg

SEQ ID NO: 164074 - RNA, 22 nt, Human
gggccucccggagcugcuccca

SEQ ID NO: 164075 - RNA, 22 nt, Human
gggccggagaagguagcugaag

SEQ ID NO: 164076 - RNA, 21 nt, Human
gggccugggccagggccgggu

SEQ ID NO: 164077 - RNA, 22 nt, Human
ggaccucagccaucccucggag

SEQ ID NO: 164078 - RNA, 23 nt, Human
ggacgugaggcgcccuuuuuccc

SEQ ID NO: 164079 - RNA, 20 nt, Human
ggacccuggguucuucugag

SEQ ID NO: 164080 - RNA, 22 nt, Human
ggacuccuguguuuuggcugag

SEQ ID NO: 164081 - RNA, 22 nt, Human
ggacugggagaauggaggcaag

SEQ ID NO: 164082 - RNA, 22 nt, Human
ggacuucuggggacuguagauu

SEQ ID NO: 164083 - RNA, 22 nt, Human
ggaaugcuuggcaugagaaccu

SEQ ID NO: 164084 - RNA, 22 nt, Human
ggaccagagcuaaugcgcgccc

SEQ ID NO: 164085 - RNA, 19 nt, Human
gggcuuguuggcaaaugac

SEQ ID NO: 164086 - RNA, 22 nt, Human
gggaagccugggugauccuaaa

SEQ ID NO: 164087 - RNA, 21 nt, Human
gggaagagaagagaaaggagg

SEQ ID NO: 164088 - RNA, 22 nt, Human
gggaagaagaaaagagguggga

SEQ ID NO: 164089 - RNA, 22 nt, Human
gcuucacucugagacuuggagc

SEQ ID NO: 164090 - RNA, 22 nt, Human
gggaacuguaguuuacgcugcc

SEQ ID NO: 164091 - RNA, 22 nt, Human
gcuuccucaccucaaauuuccg

SEQ ID NO: 164092 - RNA, 22 nt, Human
gcuucccagaccaggcucccuc

SEQ ID NO: 164093 - RNA, 22 nt, Human
gcuuguuuagcauaggucacug

SEQ ID NO: 164094 - RNA, 22 nt, Human
gggacagcuggggguaaagcau

SEQ ID NO: 164095 - RNA, 22 nt, Human
gggacgggcuagcugccguggc

SEQ ID NO: 164096 - RNA, 20 nt, Human
gcuugcggacagguggcuca

SEQ ID NO: 164097 - RNA, 20 nt, Human
gcuugcgugggaggaggggg

SEQ ID NO: 164098 - RNA, 22 nt, Human
gcuugcugaacaggaaccuggc

SEQ ID NO: 164099 - RNA, 20 nt, Human
gggaauggauggauugcucc

SEQ ID NO: 164100 - RNA, 22 nt, Human
gggaagugcaguuuucuuuugg

SEQ ID NO: 164101 - RNA, 22 nt, Human
gcuguguaugaugcaggcaccu

SEQ ID NO: 164102 - RNA, 22 nt, Human
gcugagcagcgaaggcacaugc

SEQ ID NO: 164103 - RNA, 22 nt, Human
ggccaccuaagguugugcauca

SEQ ID NO: 164104 - RNA, 22 nt, Human
ggcuuugggaggaugaggcggu

SEQ ID NO: 164105 - RNA, 22 nt, Human
ggcuucuuaacauuuggacacc

SEQ ID NO: 164106 - RNA, 22 nt, Human
gcuguugcaaucaaggccaugg

SEQ ID NO: 164107 - RNA, 22 nt, Human
gcuguuggaggaguucagugcu

SEQ ID NO: 164108 - RNA, 22 nt, Human
gcuguuucuuuggcaaacugau

SEQ ID NO: 164109 - RNA, 22 nt, Human
gggaaaugugucuuggcauucu

SEQ ID NO: 164110 - RNA, 22 nt, Human
gggaacccaaauaggaaaauug

SEQ ID NO: 164111 - RNA, 22 nt, Human
gggaaaucugcuuccuagggcu

SEQ ID NO: 164112 - RNA, 22 nt, Human
ggcugugaaguacguugaaggu

SEQ ID NO: 164113 - RNA, 22 nt, Human
ggcugugguggacgcgggaaac

SEQ ID NO: 164114 - RNA, 22 nt, Human
ggcugugggguccuguggugug

SEQ ID NO: 164115 - RNA, 22 nt, Human
ggcuuacgcgcuaacagugaau

SEQ ID NO: 164116 - RNA, 22 nt, Human
ggcuuguaggugauggagaacu

SEQ ID NO: 164117 - RNA, 22 nt, Human
ggcuuguccuucugguugucuu

SEQ ID NO: 164118 - RNA, 19 nt, Human
ggcuuugcccuucgcuccg

SEQ ID NO: 164119 - RNA, 22 nt, Human
ggcuuaugaucugacccaucga

SEQ ID NO: 164120 - RNA, 22 nt, Human
gggaagaacugauuucacacca

SEQ ID NO: 164121 - RNA, 22 nt, Human
gugaucagaagaaccugccgaa

SEQ ID NO: 164122 - RNA, 22 nt, Human
gggaagugagcuggaaucaagg

SEQ ID NO: 164123 - RNA, 22 nt, Human
gggaagagggagcuggaaugau

SEQ ID NO: 164124 - RNA, 22 nt, Human
gggaagaaccucugcuaccaau

SEQ ID NO: 164125 - RNA, 17 nt, Human
gugagcugagucaggac

SEQ ID NO: 164126 - RNA, 22 nt, Human
ggcuuuuucccuaggguaagag

SEQ ID NO: 164127 - RNA, 22 nt, Human
gugaagcacaugggcguugggu

SEQ ID NO: 164128 - RNA, 20 nt, Human
gugaaguuuucugaagacag

SEQ ID NO: 164129 - RNA, 22 nt, Human
ggcuucucuuggccaugguccc

SEQ ID NO: 164130 - RNA, 22 nt, Human
gggcaagagaggaagagauggc

SEQ ID NO: 164131 - RNA, 22 nt, Human
gugcugcaaggauggagaggca

SEQ ID NO: 164132 - RNA, 22 nt, Human
gggcaagaggguuugacaugag

SEQ ID NO: 164133 - RNA, 20 nt, Human
gugcggcucuaccacucggu

SEQ ID NO: 164134 - RNA, 22 nt, Human
gugccugcucauucucaauauu

SEQ ID NO: 164135 - RNA, 22 nt, Human
gggagggcuuggacccagaugu

SEQ ID NO: 164136 - RNA, 22 nt, Human
gugccgaugaggccuggcauuc

SEQ ID NO: 164137 - RNA, 22 nt, Human
gugcccaguugaggccaggacu

SEQ ID NO: 164138 - RNA, 22 nt, Human
gugccaccagaugcuguugcua

SEQ ID NO: 164139 - RNA, 22 nt, Human
gggagguaaugggggugcaggg

SEQ ID NO: 164140 - RNA, 22 nt, Human
gggaggucgaggcugggccgca

SEQ ID NO: 164141 - RNA, 22 nt, Human
gggaguauguccgggcucuaga

SEQ ID NO: 164142 - RNA, 21 nt, Human
gggagugaguaaugauggggg

SEQ ID NO: 164143 - RNA, 22 nt, Human
gugccuggaaucuuuucuucac

SEQ ID NO: 164144 - RNA, 20 nt, Human
gggaucgaguaccuccgggu

SEQ ID NO: 164145 - RNA, 22 nt, Human
gggagcucaccaugcucugcau

SEQ ID NO: 164146 - RNA, 21 nt, Human
gggaggagcuucccuuugccc

SEQ ID NO: 164147 - RNA, 22 nt, Human
gggagcuggagcuggaagacuc

SEQ ID NO: 164148 - RNA, 22 nt, Human
gugcaucuguaauuacaauggu

SEQ ID NO: 164149 - RNA, 22 nt, Human
gugcaaugaguguggcaaagcc

SEQ ID NO: 164150 - RNA, 19 nt, Human
gugcacugucacuuugcuc

SEQ ID NO: 164151 - RNA, 22 nt, Human
gugauuucagguuuuucauacu

SEQ ID NO: 164152 - RNA, 22 nt, Human
gggagaguagcuggaagguucu

SEQ ID NO: 164153 - RNA, 22 nt, Human
gugcagcugguggagucugggg

SEQ ID NO: 164154 - RNA, 22 nt, Human
gggacaggacuccuggggccug

SEQ ID NO: 164155 - RNA, 22 nt, Human
gggaaguugguaagaggcuguu

SEQ ID NO: 164156 - RNA, 22 nt, Human
gugauggggagagcgcagcuuu

SEQ ID NO: 164157 - RNA, 22 nt, Human
gugauggucgagcgcuuguugu

SEQ ID NO: 164158 - RNA, 22 nt, Human
ggcgccuuguggaaugagagcu

SEQ ID NO: 164159 - RNA, 22 nt, Human
ggcgccauuuuugccuucggag

SEQ ID NO: 164160 - RNA, 22 nt, Human
ggcgaggcgggccgcggggucu

SEQ ID NO: 164161 - RNA, 22 nt, Human
ggcgcaguguucgcccucucgc

SEQ ID NO: 164162 - RNA, 22 nt, Human
ggcgauuggccgggaggaggca

SEQ ID NO: 164163 - RNA, 22 nt, Human
ggccagcuuugagcugcaggaa

SEQ ID NO: 164164 - RNA, 22 nt, Human
ggccagucaaggggauccugaa

SEQ ID NO: 164165 - RNA, 22 nt, Human
ggccccggaggccguuagcuua

SEQ ID NO: 164166 - RNA, 22 nt, Human
ggcggcccaggugcuccaggcg

SEQ ID NO: 164167 - RNA, 22 nt, Human
ggcggaggucacgcacccgcca

SEQ ID NO: 164168 - RNA, 20 nt, Human
gucaucucagggacugucug

SEQ ID NO: 164169 - RNA, 22 nt, Human
ggcggagggcuguguccccggc

SEQ ID NO: 164170 - RNA, 22 nt, Human
gucaucugagggacgagauuuc

SEQ ID NO: 164171 - RNA, 20 nt, Human
gucagaggacccuagagcga

SEQ ID NO: 164172 - RNA, 22 nt, Human
gucaaugcuuaguuugccugaa

SEQ ID NO: 164173 - RNA, 22 nt, Human
gucacgucgggacagacugggg

SEQ ID NO: 164174 - RNA, 22 nt, Human
gucacucuuuuucagcuagcuc

SEQ ID NO: 164175 - RNA, 22 nt, Human
gucacuuugcuugcgaugcucc

SEQ ID NO: 164176 - RNA, 22 nt, Human
gucaccgguuuuuagguaaaca

SEQ ID NO: 164177 - RNA, 22 nt, Human
guauuaagaaaugccugugaaa

SEQ ID NO: 164178 - RNA, 22 nt, Human
guccucgggcucacucccaggg

SEQ ID NO: 164179 - RNA, 22 nt, Human
guccccugcuguggaucugugg

SEQ ID NO: 164180 - RNA, 22 nt, Human
ggcugcagggaacaggaugggu

SEQ ID NO: 164181 - RNA, 22 nt, Human
gucccuggucuaccguggcuuc

SEQ ID NO: 164182 - RNA, 22 nt, Human
guccuggugccaccugcgggau

SEQ ID NO: 164183 - RNA, 22 nt, Human
guccuguccugcugagcuccug

SEQ ID NO: 164184 - RNA, 22 nt, Human
ggcugcaagacguuauuagcgu

SEQ ID NO: 164185 - RNA, 22 nt, Human
ggcuccagauguccccuggcaa

SEQ ID NO: 164186 - RNA, 22 nt, Human
ggcucacuguaccugccgccgc

SEQ ID NO: 164187 - RNA, 22 nt, Human
ggcuagggaucuagaccaggac

SEQ ID NO: 164188 - RNA, 22 nt, Human
ggcuagggagacagagggcaug

SEQ ID NO: 164189 - RNA, 22 nt, Human
ggcuaaucaagaaggcccagug

SEQ ID NO: 164190 - RNA, 22 nt, Human
ggcuauuguuuuaaaaaaugag

SEQ ID NO: 164191 - RNA, 22 nt, Human
ggcgucuugcgggcgguagcgc

SEQ ID NO: 164192 - RNA, 22 nt, Human
ggcgggucuagggcccuggagu

SEQ ID NO: 164193 - RNA, 22 nt, Human
ggcuaaggacgggcaaguccca

SEQ ID NO: 164194 - RNA, 23 nt, Human
ggcgugcugggcugacccuuggc

SEQ ID NO: 164195 - RNA, 22 nt, Human
guccauauuuauccuuaaagua

SEQ ID NO: 164196 - RNA, 22 nt, Human
guccaauguggcaccacagggg

SEQ ID NO: 164197 - RNA, 22 nt, Human
ggcuggaacuucuucuggcauu

SEQ ID NO: 164198 - RNA, 22 nt, Human
ggcugcuugggcuguuucuuuu

SEQ ID NO: 164199 - RNA, 22 nt, Human
ggcugcugcccaccccugcaug

SEQ ID NO: 164200 - RNA, 21 nt, Human
ggcugcucgugaugaacuuca

SEQ ID NO: 164201 - RNA, 22 nt, Human
ggcugcuauuggucuggcuugg

SEQ ID NO: 164202 - RNA, 17 nt, Human
ggcugccaggcaacaua

SEQ ID NO: 164203 - RNA, 22 nt, Human
gucggagcggcugcacaggggg

SEQ ID NO: 164204 - RNA, 22 nt, Human
gucgagaacauucauuaugcaa

SEQ ID NO: 164205 - RNA, 22 nt, Human
gucgccuaauuaggguauccua

SEQ ID NO: 164206 - RNA, 22 nt, Human
guccuucgcggcugaggccauu

SEQ ID NO: 164207 - RNA, 22 nt, Human
guccuuuauuugaacaugacau

SEQ ID NO: 164208 - RNA, 22 nt, Human
gucugcagcacugugcacgguc

SEQ ID NO: 164209 - RNA, 22 nt, Human
gucugccagauucugcuggauc

SEQ ID NO: 164210 - RNA, 22 nt, Human
gucugcccuuggccugggacuu

SEQ ID NO: 164211 - RNA, 22 nt, Human
ggugaggagaaacucugccccu

SEQ ID NO: 164212 - RNA, 22 nt, Human
ggugaucucagucuagaugguu

SEQ ID NO: 164213 - RNA, 22 nt, Human
ggugaucucuggcucugcuugu

SEQ ID NO: 164214 - RNA, 22 nt, Human
ggucuucauucuaccagacuuu

SEQ ID NO: 164215 - RNA, 22 nt, Human
ggucugcgauggcaagggucuu

SEQ ID NO: 164216 - RNA, 19 nt, Human
ggucugcggggugaccgug

SEQ ID NO: 164217 - RNA, 22 nt, Human
ggucugagcaaguuaccauggg

SEQ ID NO: 164218 - RNA, 22 nt, Human
guuggaggaaggacaggaacag

SEQ ID NO: 164219 - RNA, 22 nt, Human
guuggcgaaggaccuggaggag

SEQ ID NO: 164220 - RNA, 22 nt, Human
guugggauugaaggugccucua

SEQ ID NO: 164221 - RNA, 22 nt, Human
guugggcugaagugugugcuua

SEQ ID NO: 164222 - RNA, 22 nt, Human
guugggguuucaguggcaguca

SEQ ID NO: 164223 - RNA, 22 nt, Human
gugcucuauguugauuccuuga

SEQ ID NO: 164224 - RNA, 22 nt, Human
gguccgcgcgcagaggcccugg

SEQ ID NO: 164225 - RNA, 22 nt, Human
ggucaucacugagagcagaucc

SEQ ID NO: 164226 - RNA, 22 nt, Human
guugguggaggcgagagaagaa

SEQ ID NO: 164227 - RNA, 22 nt, Human
ggugcugcugcugaacccagcu

SEQ ID NO: 164228 - RNA, 19 nt, Human
ggugaucugucccuugcuc

SEQ ID NO: 164229 - RNA, 22 nt, Human
ggugccugggcacggaaagcau

SEQ ID NO: 164230 - RNA, 22 nt, Human
ggugggccaaauuaaacauaua

SEQ ID NO: 164231 - RNA, 22 nt, Human
gguggggacuuggggucagcgg

SEQ ID NO: 164232 - RNA, 22 nt, Human
gguggggugagggggcgaggcc

SEQ ID NO: 164233 - RNA, 22 nt, Human
gguggguccuuugacagagaug

SEQ ID NO: 164234 - RNA, 22 nt, Human
gguugaagcuacuuucuggaug

SEQ ID NO: 164235 - RNA, 22 nt, Human
ggugugggcagaugcccuacuu

SEQ ID NO: 164236 - RNA, 22 nt, Human
gguguggcaguggaccugugaa

SEQ ID NO: 164237 - RNA, 22 nt, Human
gguuuuccaguagaucagaaga

SEQ ID NO: 164238 - RNA, 22 nt, Human
gguuuucagaaugcaguccugu

SEQ ID NO: 164239 - RNA, 22 nt, Human
guacugggaauggagccugggc

SEQ ID NO: 164240 - RNA, 22 nt, Human
guaagaauauacccaggaguca

SEQ ID NO: 164241 - RNA, 22 nt, Human
gucugcucauguuugguuugug

SEQ ID NO: 164242 - RNA, 22 nt, Human
gucuggagccacugcugcugcu

SEQ ID NO: 164243 - RNA, 22 nt, Human
gucgagcuggaggagcgaaugg

SEQ ID NO: 164244 - RNA, 22 nt, Human
gucgucgcucccaccuuccgcu

SEQ ID NO: 164245 - RNA, 22 nt, Human
gucgguacuaguacugguguug

SEQ ID NO: 164246 - RNA, 22 nt, Human
gucuguuggcacagggggaggu

SEQ ID NO: 164247 - RNA, 22 nt, Human
gugaaaaauggccaucaggaca

SEQ ID NO: 164248 - RNA, 22 nt, Human
uacauccuuuugaaaucccaga

SEQ ID NO: 164249 - RNA, 22 nt, Human
uacaugggcguguucaguuagu

SEQ ID NO: 164250 - RNA, 22 nt, Human
uacauggauguuauccuuacug

SEQ ID NO: 164251 - RNA, 22 nt, Human
gugaaauuguacacucaguacc

SEQ ID NO: 164252 - RNA, 22 nt, Human
uaccucauguucaggaggauca

SEQ ID NO: 164253 - RNA, 22 nt, Human
uaccuaacauugugcagagguu

SEQ ID NO: 164254 - RNA, 22 nt, Human
uaccgcagagucauugugagga

SEQ ID NO: 164255 - RNA, 22 nt, Human
uacgugucacugaugaaguuua

SEQ ID NO: 164256 - RNA, 20 nt, Human
uacguguccgaugaucacag

SEQ ID NO: 164257 - RNA, 22 nt, Human
gugaaggcaugugugcugugcu

SEQ ID NO: 164258 - RNA, 22 nt, Human
gugaccagacagagucuagccc

SEQ ID NO: 164259 - RNA, 22 nt, Human
guccuguccuguccuggagaca

SEQ ID NO: 164260 - RNA, 22 nt, Human
guccucugggagccuugagccu

SEQ ID NO: 164261 - RNA, 22 nt, Human
guccuggagcagcuggaagaug

SEQ ID NO: 164262 - RNA, 22 nt, Human
gucccagaaugguuucccagaa

SEQ ID NO: 164263 - RNA, 22 nt, Human
guccccugcguguucauccugg

SEQ ID NO: 164264 - RNA, 22 nt, Human
gucccucauaacuggcaggugu

SEQ ID NO: 164265 - RNA, 22 nt, Human
guccaugugcuaacagugcuua

SEQ ID NO: 164266 - RNA, 22 nt, Human
guaugaguggauagauguaucu

SEQ ID NO: 164267 - RNA, 22 nt, Human
guacuuccauccacauauaugu

SEQ ID NO: 164268 - RNA, 22 nt, Human
gugggugauacugccgugggag

SEQ ID NO: 164269 - RNA, 22 nt, Human
gugguccuaggugcucaaguca

SEQ ID NO: 164270 - RNA, 22 nt, Human
guggugguguuggugacaaguu

SEQ ID NO: 164271 - RNA, 22 nt, Human
gugguggugaggcaaggggugu

SEQ ID NO: 164272 - RNA, 22 nt, Human
uauccaucuucuuugagaaugg

SEQ ID NO: 164273 - RNA, 22 nt, Human
guguucucagcacccacuucau

SEQ ID NO: 164274 - RNA, 22 nt, Human
uaugcgguccaucaggggcacu

SEQ ID NO: 164275 - RNA, 19 nt, Human
guguucuguuauacaguug

SEQ ID NO: 164276 - RNA, 22 nt, Human
guguugaaaaguagcacugcuu

SEQ ID NO: 164277 - RNA, 22 nt, Human
guguucuuuguagaggaucuug

SEQ ID NO: 164278 - RNA, 22 nt, Human
guucggcuuccuaugucaugag

SEQ ID NO: 164279 - RNA, 22 nt, Human
guuccugagcaguuccuggcca

SEQ ID NO: 164280 - RNA, 18 nt, Human
guucaagcauuuugcucu

SEQ ID NO: 164281 - RNA, 22 nt, Human
guucaaggagcagcuugcuaca

SEQ ID NO: 164282 - RNA, 21 nt, Human
guucuuaguuauauucucaau

SEQ ID NO: 164283 - RNA, 22 nt, Human
guucuucagauuccauuucagu

SEQ ID NO: 164284 - RNA, 22 nt, Human
uauuuccugcguuucugugagc

SEQ ID NO: 164285 - RNA, 22 nt, Human
guucugcccaggccuccccaac

SEQ ID NO: 164286 - RNA, 22 nt, Human
guucucuccugcuggugaugga

SEQ ID NO: 164287 - RNA, 22 nt, Human
guugccugguuucaaaaggaau

SEQ ID NO: 164288 - RNA, 22 nt, Human
guugcggaguguagcgaugcuu

SEQ ID NO: 164289 - RNA, 22 nt, Human
guugcuggggcugaguccccag

SEQ ID NO: 164290 - RNA, 22 nt, Human
guuggaaauaucagucacguga

SEQ ID NO: 164291 - RNA, 22 nt, Human
guuggggccuggagucucuugg

SEQ ID NO: 164292 - RNA, 22 nt, Human
guuggugagaguuagggauuua

SEQ ID NO: 164293 - RNA, 21 nt, Human
ucaaccagguguugaaggcac

SEQ ID NO: 164294 - RNA, 20 nt, Human
guugggagaagugucagcug

SEQ ID NO: 164295 - RNA, 22 nt, Human
guggccugacagaucggaacag

SEQ ID NO: 164296 - RNA, 22 nt, Human
guggcgucgaugauggugucau

SEQ ID NO: 164297 - RNA, 22 nt, Human
guggcuuuguuuccaaaugaaa

SEQ ID NO: 164298 - RNA, 22 nt, Human
uaggucugaggcugcaucuugg

SEQ ID NO: 164299 - RNA, 22 nt, Human
guggccaaggcagagaaagagc

SEQ ID NO: 164300 - RNA, 22 nt, Human
uaggggcccgugggauggacag

SEQ ID NO: 164301 - RNA, 22 nt, Human
guggcaguaaagcuggaaaagu

SEQ ID NO: 164302 - RNA, 22 nt, Human
guggcagguguacagcucagcu

SEQ ID NO: 164303 - RNA, 20 nt, Human
guggcagugguggcagcagu

SEQ ID NO: 164304 - RNA, 22 nt, Human
uaguggaaacagacugagcccg

SEQ ID NO: 164305 - RNA, 22 nt, Human
gugggccaguuccucacaggua

SEQ ID NO: 164306 - RNA, 22 nt, Human
guggggguaggggguuuucugg

SEQ ID NO: 164307 - RNA, 22 nt, Human
gugggggugaggaauguucuau

SEQ ID NO: 164308 - RNA, 22 nt, Human
gugggcccaagcagcggcggcc

SEQ ID NO: 164309 - RNA, 22 nt, Human
gugggggauggcgugugggucu

SEQ ID NO: 164310 - RNA, 22 nt, Human
gugggggcagaagcgagugcag

SEQ ID NO: 164311 - RNA, 22 nt, Human
gugcucgagcugugcgcgcugc

SEQ ID NO: 164312 - RNA, 22 nt, Human
gugcucuagaaauugucagugg

SEQ ID NO: 164313 - RNA, 23 nt, Human
uagcggccaugacgggggucaca

SEQ ID NO: 164314 - RNA, 22 nt, Human
uagcuaccucugcaaggugaua

SEQ ID NO: 164315 - RNA, 22 nt, Human
uagcugacagcagaagaguauu

SEQ ID NO: 164316 - RNA, 22 nt, Human
uagcuggaggggcaggaugcug

SEQ ID NO: 164317 - RNA, 22 nt, Human
uagccaaguuuucuuugaaagu

SEQ ID NO: 164318 - RNA, 22 nt, Human
uagaagagcuuccaccuggggc

SEQ ID NO: 164319 - RNA, 22 nt, Human
uagccguugggguaacuggaca

SEQ ID NO: 164320 - RNA, 22 nt, Human
uaggaagagauuuucacauggc

SEQ ID NO: 164321 - RNA, 22 nt, Human
guggaggaagaucuuugaugau

SEQ ID NO: 164322 - RNA, 22 nt, Human
guggagaaauauguucagcuuc

SEQ ID NO: 164323 - RNA, 22 nt, Human
gugcuguuagcgguuuauaaca

SEQ ID NO: 164324 - RNA, 22 nt, Human
gugcuggcaaagagaacaucuu

SEQ ID NO: 164325 - RNA, 22 nt, Human
gugcugcaugagcaucacguag

SEQ ID NO: 164326 - RNA, 22 nt, Human
gugcuugcgcauaacuggggcc

SEQ ID NO: 164327 - RNA, 22 nt, Human
gugcugucguggaacugggcug

SEQ ID NO: 164328 - RNA, 22 nt, Human
gugcugggaggcccaggaugga

SEQ ID NO: 164329 - RNA, 22 nt, Human
guggacuuuggucugugccauc

SEQ ID NO: 164330 - RNA, 22 nt, Human
guggacuagaguaggaguugca

SEQ ID NO: 164331 - RNA, 22 nt, Human
guggagaaagcuggaaucugag

SEQ ID NO: 164332 - RNA, 22 nt, Human
guggaaauaugggcaacaaaga

SEQ ID NO: 164333 - RNA, 22 nt, Human
guggaagauauuucugguccag

SEQ ID NO: 164334 - RNA, 22 nt, Human
uccaggucauucucuccgaccg

SEQ ID NO: 164335 - RNA, 22 nt, Human
uaccuggauaaauguacaaccg

SEQ ID NO: 164336 - RNA, 22 nt, Human
uaccugguuucuuaaacccaaa

SEQ ID NO: 164337 - RNA, 22 nt, Human
uacuaccugcaggaacaauuag

SEQ ID NO: 164338 - RNA, 22 nt, Human
uccauggucgauggcugcuggg

SEQ ID NO: 164339 - RNA, 22 nt, Human
uccaugcgcgauggccuggcuu

SEQ ID NO: 164340 - RNA, 21 nt, Human
uccaggagcacgggacuagga

SEQ ID NO: 164341 - RNA, 22 nt, Human
uccagcuucugccugcugcugc

SEQ ID NO: 164342 - RNA, 22 nt, Human
uccaggaggacugagggggcug

SEQ ID NO: 164343 - RNA, 22 nt, Human
uccagguaggagaccaggcugu

SEQ ID NO: 164344 - RNA, 22 nt, Human
uccacagcagagcacgguaccu

SEQ ID NO: 164345 - RNA, 22 nt, Human
uacuucccacuggggucuacca

SEQ ID NO: 164346 - RNA, 22 nt, Human
uacugagcauaaaacccauacu

SEQ ID NO: 164347 - RNA, 22 nt, Human
uacugaagaugccaucacaagc

SEQ ID NO: 164348 - RNA, 22 nt, Human
uacugaguuucacugucugugc

SEQ ID NO: 164349 - RNA, 23 nt, Human
uccccagcugcccgugucccggg

SEQ ID NO: 164350 - RNA, 22 nt, Human
uacugcaguuccugcugucucc

SEQ ID NO: 164351 - RNA, 22 nt, Human
ucccgcccugcguucucccaug

SEQ ID NO: 164352 - RNA, 22 nt, Human
ucccugcaggcauguacucuga

SEQ ID NO: 164353 - RNA, 21 nt, Human
ucccugcagccccaggccccc

SEQ ID NO: 164354 - RNA, 22 nt, Human
ucccucgccccggguucuuucu

SEQ ID NO: 164355 - RNA, 22 nt, Human
ucccugccuccuggcagugcca

SEQ ID NO: 164356 - RNA, 22 nt, Human
ucccugccuuauuuucauaugc

SEQ ID NO: 164357 - RNA, 22 nt, Human
ucccugcgugagaaagcacuua

SEQ ID NO: 164358 - RNA, 22 nt, Human
ucccugcugggcgaucuucucu

SEQ ID NO: 164359 - RNA, 22 nt, Human
uccgugguguuggcucuccggc

SEQ ID NO: 164360 - RNA, 21 nt, Human
uccuaaaggaaauacucaauu

SEQ ID NO: 164361 - RNA, 22 nt, Human
ucccuuguguaggacaccccag

SEQ ID NO: 164362 - RNA, 22 nt, Human
uccggcgaccuccagauguucc

SEQ ID NO: 164363 - RNA, 22 nt, Human
uccucagcaagacgcuggcagc

SEQ ID NO: 164364 - RNA, 22 nt, Human
uccguugaggcugccaggcgag

SEQ ID NO: 164365 - RNA, 22 nt, Human
uccucagcaaacacuucacucu

SEQ ID NO: 164366 - RNA, 22 nt, Human
uccuccacuuagcgccacuggg

SEQ ID NO: 164367 - RNA, 23 nt, Human
uagauccuuccaacuacucuuac

SEQ ID NO: 164368 - RNA, 22 nt, Human
uagaggguccaggagggcaaga

SEQ ID NO: 164369 - RNA, 20 nt, Human
uccgaaucaugacuuugcac

SEQ ID NO: 164370 - RNA, 22 nt, Human
uccgacacacgugcucgcagcg

SEQ ID NO: 164371 - RNA, 22 nt, Human
ucccuuuuagccccgcccuccu

SEQ ID NO: 164372 - RNA, 22 nt, Human
ucccuugacauuacuugggagg

SEQ ID NO: 164373 - RNA, 22 nt, Human
uccuccauguugugcacuugaa

SEQ ID NO: 164374 - RNA, 22 nt, Human
uccucgccgucacgcagccucu

SEQ ID NO: 164375 - RNA, 22 nt, Human
uagcacauaguaggcacaggcu

SEQ ID NO: 164376 - RNA, 22 nt, Human
uccucccgaaugaguagaaggg

SEQ ID NO: 164377 - RNA, 22 nt, Human
uccucccugcacucagugaagu

SEQ ID NO: 164378 - RNA, 22 nt, Human
uagcagcacuauuuguuguagu

SEQ ID NO: 164379 - RNA, 21 nt, Human
uccugccuuaguccagagcag

SEQ ID NO: 164380 - RNA, 21 nt, Human
uccugccuggccuucugacua

SEQ ID NO: 164381 - RNA, 22 nt, Human
uccuucagaggacggcagccag

SEQ ID NO: 164382 - RNA, 22 nt, Human
uccuggccuuggggagagaagu

SEQ ID NO: 164383 - RNA, 22 nt, Human
uccuggaagggaugguugagga

SEQ ID NO: 164384 - RNA, 22 nt, Human
uccugcucucuccauuccuucc

SEQ ID NO: 164385 - RNA, 22 nt, Human
uccuggcuguuagagaggcaag

SEQ ID NO: 164386 - RNA, 22 nt, Human
uccugggcuugcucuuuccauu

SEQ ID NO: 164387 - RNA, 22 nt, Human
uccuggccucugagucaagaac

SEQ ID NO: 164388 - RNA, 22 nt, Human
guugucguucccccugcuuaaa

SEQ ID NO: 164389 - RNA, 21 nt, Human
ucaagcggcagagcaguuauu

SEQ ID NO: 164390 - RNA, 22 nt, Human
ucaagcacugugcaaugagcuu

SEQ ID NO: 164391 - RNA, 19 nt, Human
ucaggaggucgaccuggca

SEQ ID NO: 164392 - RNA, 22 nt, Human
ucaggcgcucuucguggcugcc

SEQ ID NO: 164393 - RNA, 18 nt, Human
ucagggaaacuuugccug

SEQ ID NO: 164394 - RNA, 20 nt, Human
ucaggguuucccauucuugg

SEQ ID NO: 164395 - RNA, 22 nt, Human
ucagucugguggaugcucauug

SEQ ID NO: 164396 - RNA, 18 nt, Human
ucaguccuccauagagcu

SEQ ID NO: 164397 - RNA, 19 nt, Human
ucagugggacauuugcuuu

SEQ ID NO: 164398 - RNA, 21 nt, Human
uccaaaggagacugagugugu

SEQ ID NO: 164399 - RNA, 22 nt, Human
ucaugcagauaagaauaaguaa

SEQ ID NO: 164400 - RNA, 22 nt, Human
ucaugggcaaacuuggggauca

SEQ ID NO: 164401 - RNA, 22 nt, Human
ucaugccugcgauugucccugg

SEQ ID NO: 164402 - RNA, 22 nt, Human
ucaucgauggggagcucuacaa

SEQ ID NO: 164403 - RNA, 22 nt, Human
ucugggguucuuaauuuggaag

SEQ ID NO: 164404 - RNA, 22 nt, Human
ucugggucuaucccaugccuuu

SEQ ID NO: 164405 - RNA, 22 nt, Human
ucuggucugccgagauccauuu

SEQ ID NO: 164406 - RNA, 22 nt, Human
ucuguagcuaauucucuuuaaa

SEQ ID NO: 164407 - RNA, 22 nt, Human
ucuguaacaucaguguaauuuu

SEQ ID NO: 164408 - RNA, 22 nt, Human
ucuggugcacucugauauuuga

SEQ ID NO: 164409 - RNA, 19 nt, Human
ucuguggccuucccugaug

SEQ ID NO: 164410 - RNA, 20 nt, Human
ucuguggcagguggcgcuug

SEQ ID NO: 164411 - RNA, 22 nt, Human
ucuguucucuuguucugacggu

SEQ ID NO: 164412 - RNA, 18 nt, Human
uauuccucuuccucuauc

SEQ ID NO: 164413 - RNA, 22 nt, Human
ucuguaccuuauguucagagug

SEQ ID NO: 164414 - RNA, 22 nt, Human
ucuggaggucucagggcgggaa

SEQ ID NO: 164415 - RNA, 22 nt, Human
ucuggaaauggaaguaacuaug

SEQ ID NO: 164416 - RNA, 22 nt, Human
ucugcguggcgugguucugugc

SEQ ID NO: 164417 - RNA, 22 nt, Human
ucugcuggugucauuuuugcua

SEQ ID NO: 164418 - RNA, 22 nt, Human
ucuggcucaggagcuguguuca

SEQ ID NO: 164419 - RNA, 21 nt, Human
ucuggccuauaaaguagucgc

SEQ ID NO: 164420 - RNA, 22 nt, Human
uauguggcaggugggagaucag

SEQ ID NO: 164421 - RNA, 22 nt, Human
ucugggccaacccuuccauggg

SEQ ID NO: 164422 - RNA, 22 nt, Human
ucugggccacccgccuccaggg

SEQ ID NO: 164423 - RNA, 17 nt, Human
ucugcagaggcaaaccu

SEQ ID NO: 164424 - RNA, 22 nt, Human
ucugcacagcucaccucccugg

SEQ ID NO: 164425 - RNA, 22 nt, Human
uaugagugccaaguuaccuggg

SEQ ID NO: 164426 - RNA, 22 nt, Human
uaugacccccugcacaugugac

SEQ ID NO: 164427 - RNA, 22 nt, Human
uaugaccuuaggaagcaagaag

SEQ ID NO: 164428 - RNA, 22 nt, Human
ucugcccaggaggucccauggg

SEQ ID NO: 164429 - RNA, 22 nt, Human
ucugcaugccucaggaggccug

SEQ ID NO: 164430 - RNA, 22 nt, Human
ucugcccguucaaauccuuguu

SEQ ID NO: 164431 - RNA, 20 nt, Human
uaugcgaagccuuucuggac

SEQ ID NO: 164432 - RNA, 22 nt, Human
ucugcgggccuggcucccagcg

SEQ ID NO: 164433 - RNA, 22 nt, Human
ucugcggccuagcgcccggcgc

SEQ ID NO: 164434 - RNA, 22 nt, Human
ucugcagggcccuuggcuccug

SEQ ID NO: 164435 - RNA, 21 nt, Human
ucugccaguuucucuuacuuu

SEQ ID NO: 164436 - RNA, 22 nt, Human
ucucuacugcuucugugaguga

SEQ ID NO: 164437 - RNA, 21 nt, Human
ucucuaucguauaccagccgg

SEQ ID NO: 164438 - RNA, 22 nt, Human
ucucucugcuguccagcguuau

SEQ ID NO: 164439 - RNA, 22 nt, Human
uaucauuaggagugcugcucgg

SEQ ID NO: 164440 - RNA, 22 nt, Human
ucucuggcuuuuuuuccauuuu

SEQ ID NO: 164441 - RNA, 22 nt, Human
ucugaccaggcucuuguagccu

SEQ ID NO: 164442 - RNA, 22 nt, Human
ucugaccccccuugccuccacu

SEQ ID NO: 164443 - RNA, 22 nt, Human
ucugaaaggagaguagggcaga

SEQ ID NO: 164444 - RNA, 22 nt, Human
uaucugaugcaggcucccagga

SEQ ID NO: 164445 - RNA, 22 nt, Human
ucugaggacagugcugugccug

SEQ ID NO: 164446 - RNA, 22 nt, Human
ucugacguugguucugcccuuu

SEQ ID NO: 164447 - RNA, 23 nt, Human
ucucaccaggauaugacugucac

SEQ ID NO: 164448 - RNA, 22 nt, Human
ucuagcccucauggcugaaggc

SEQ ID NO: 164449 - RNA, 22 nt, Human
ucgagcucagcagggaggugcg

SEQ ID NO: 164450 - RNA, 21 nt, Human
uaggaacuguucugagugguc

SEQ ID NO: 164451 - RNA, 22 nt, Human
ucucccauuuuacaggugagga

SEQ ID NO: 164452 - RNA, 18 nt, Human
ucuccgaccccgcggucc

SEQ ID NO: 164453 - RNA, 16 nt, Human
ucucccuguucuccaa

SEQ ID NO: 164454 - RNA, 17 nt, Human
ucuccuggcucuaucag

SEQ ID NO: 164455 - RNA, 22 nt, Human
uaguugguggagcgauuugucu

SEQ ID NO: 164456 - RNA, 22 nt, Human
ucucauacguuuccagguguca

SEQ ID NO: 164457 - RNA, 19 nt, Human
ucucccaugccugugucua

SEQ ID NO: 164458 - RNA, 22 nt, Human
ucuccagcugaggccuucuucc

SEQ ID NO: 164459 - RNA, 22 nt, Human
ucuccaccccugggaggcagaa

SEQ ID NO: 164460 - RNA, 22 nt, Human
ucuccaggaaagacacuggacu

SEQ ID NO: 164461 - RNA, 22 nt, Human
ucugaucagaagacaaaugagg

SEQ ID NO: 164462 - RNA, 22 nt, Human
ucugcuguugaucaugacuagc

SEQ ID NO: 164463 - RNA, 22 nt, Human
ucuggcaguugccgcuucaguc

SEQ ID NO: 164464 - RNA, 20 nt, Human
uggaaggaaagguguaucuu

SEQ ID NO: 164465 - RNA, 22 nt, Human
uggaagcuagggguuucuguug

SEQ ID NO: 164466 - RNA, 22 nt, Human
ucugguuccugcauucauucaa

SEQ ID NO: 164467 - RNA, 22 nt, Human
ucuggguuuccuucacaagcac

SEQ ID NO: 164468 - RNA, 22 nt, Human
uggaagggguuacgcagcagga

SEQ ID NO: 164469 - RNA, 22 nt, Human
uggaagugggcaucaccaucca

SEQ ID NO: 164470 - RNA, 19 nt, Human
uggaagugauaguauagua

SEQ ID NO: 164471 - RNA, 20 nt, Human
uggaucaccauccuguugcu

SEQ ID NO: 164472 - RNA, 22 nt, Human
ucuguuucaggggucuggaaug

SEQ ID NO: 164473 - RNA, 19 nt, Human
ucuguugcuuuguguccuc

SEQ ID NO: 164474 - RNA, 22 nt, Human
uggagucagaaugcgacaggcc

SEQ ID NO: 164475 - RNA, 17 nt, Human
ucuguguccgcucaguc

SEQ ID NO: 164476 - RNA, 22 nt, Human
ucuguggcaaacacagugacca

SEQ ID NO: 164477 - RNA, 22 nt, Human
uggcauuuuguagcuguguauc

SEQ ID NO: 164478 - RNA, 22 nt, Human
uggcauuugagcuggaaggaug

SEQ ID NO: 164479 - RNA, 20 nt, Human
uggcccgcgcuccuccugcu

SEQ ID NO: 164480 - RNA, 22 nt, Human
uggcccugaaucaaggccagca

SEQ ID NO: 164481 - RNA, 23 nt, Human
uggccguccccugacucucuggc

SEQ ID NO: 164482 - RNA, 22 nt, Human
uggcaucacagacaaggcagca

SEQ ID NO: 164483 - RNA, 22 nt, Human
uggcaucucggugcugguucuu

SEQ ID NO: 164484 - RNA, 20 nt, Human
uggcaugaaauuuuccaagc

SEQ ID NO: 164485 - RNA, 22 nt, Human
ucuugcuggagucaaggcuaca

SEQ ID NO: 164486 - RNA, 22 nt, Human
ucuugcuguagcuguuucuucu

SEQ ID NO: 164487 - RNA, 22 nt, Human
uggcgacuggaauuaaucuuuu

SEQ ID NO: 164488 - RNA, 22 nt, Human
uggcggcggggagguaggcaga

SEQ ID NO: 164489 - RNA, 22 nt, Human
uggcggagacauggacuucaga

SEQ ID NO: 164490 - RNA, 22 nt, Human
uggcgcgcucgcucucgcugag

SEQ ID NO: 164491 - RNA, 22 nt, Human
uggcgugaagcuggaaggcgga

SEQ ID NO: 164492 - RNA, 22 nt, Human
uggcuacguacaauggaacuuu

SEQ ID NO: 164493 - RNA, 22 nt, Human
ucuuccacuugaaccuucuguc

SEQ ID NO: 164494 - RNA, 22 nt, Human
ucuuccagauacuuccugacuu

SEQ ID NO: 164495 - RNA, 22 nt, Human
uggcaaggccacaggugcaguu

SEQ ID NO: 164496 - RNA, 22 nt, Human
ucuuccucuccuggggcauuug

SEQ ID NO: 164497 - RNA, 20 nt, Human
uggaugacuucaggcagccu

SEQ ID NO: 164498 - RNA, 20 nt, Human
uggaucgaccucacuuccau

SEQ ID NO: 164499 - RNA, 22 nt, Human
uggaucaugcgaggccuccccu

SEQ ID NO: 164500 - RNA, 22 nt, Human
uggcaacucaauuucuacaaga

SEQ ID NO: 164501 - RNA, 20 nt, Human
ucuucagcuccaagucuggc

SEQ ID NO: 164502 - RNA, 22 nt, Human
ugcuugcuaucuaaguguuuca

SEQ ID NO: 164503 - RNA, 22 nt, Human
ucucucgguacagcuggcugga

SEQ ID NO: 164504 - RNA, 22 nt, Human
ucucgcuguuccugcuucaggu

SEQ ID NO: 164505 - RNA, 22 nt, Human
ucugaguaauacucuugccuug

SEQ ID NO: 164506 - RNA, 22 nt, Human
ucugagcaggaaagagcagaga

SEQ ID NO: 164507 - RNA, 22 nt, Human
ucugagagcuguagaagccuau

SEQ ID NO: 164508 - RNA, 22 nt, Human
ucugaggaauaagaugucuaaa

SEQ ID NO: 164509 - RNA, 22 nt, Human
ucugaagagaacucuuaguguu

SEQ ID NO: 164510 - RNA, 18 nt, Human
ucugaaggaaugauucca

SEQ ID NO: 164511 - RNA, 22 nt, Human
ugcuuucagauaucuguuucaa

SEQ ID NO: 164512 - RNA, 22 nt, Human
ucucugugaauggcgucaccug

SEQ ID NO: 164513 - RNA, 22 nt, Human
ugcugcuguuuccuacaucuca

SEQ ID NO: 164514 - RNA, 22 nt, Human
ugcugcucuucaccauggccuc

SEQ ID NO: 164515 - RNA, 22 nt, Human
ucucagcuggcugggagcccug

SEQ ID NO: 164516 - RNA, 22 nt, Human
ugcuggagucucuugacccugg

SEQ ID NO: 164517 - RNA, 22 nt, Human
ugcuggaaggguaguauuaacu

SEQ ID NO: 164518 - RNA, 22 nt, Human
ugcuggagccauguuuucucua

SEQ ID NO: 164519 - RNA, 22 nt, Human
ucucccuggccagcccuuuccc

SEQ ID NO: 164520 - RNA, 22 nt, Human
ugcuguacaagacccucuguuu

SEQ ID NO: 164521 - RNA, 22 nt, Human
ugcugguuucugaguaaccaca

SEQ ID NO: 164522 - RNA, 22 nt, Human
ucucccgcuuccugcuggcugc

SEQ ID NO: 164523 - RNA, 23 nt, Human
ucucccagaaguucucggggacu

SEQ ID NO: 164524 - RNA, 22 nt, Human
ucuccaggggcagggucuggag

SEQ ID NO: 164525 - RNA, 22 nt, Human
ucgcuucugaguuggugacccc

SEQ ID NO: 164526 - RNA, 22 nt, Human
ugccuccucccuccuccuaggu

SEQ ID NO: 164527 - RNA, 22 nt, Human
ugcgcgccgacggcuccgugac

SEQ ID NO: 164528 - RNA, 22 nt, Human
ugcggaaggcagcgcagggugg

SEQ ID NO: 164529 - RNA, 22 nt, Human
ucgccuccucccagaucaacaa

SEQ ID NO: 164530 - RNA, 22 nt, Human
ugcgccccgcgggccuucgggc

SEQ ID NO: 164531 - RNA, 22 nt, Human
ugcggagggagcagucggcugu

SEQ ID NO: 164532 - RNA, 22 nt, Human
ucgcgcgugccacgcgccgcgg

SEQ ID NO: 164533 - RNA, 20 nt, Human
ucgcugcaagggaaauggag

SEQ ID NO: 164534 - RNA, 22 nt, Human
ucgcggccgcuccacaugcaca

SEQ ID NO: 164535 - RNA, 22 nt, Human
ugcugcggcgcaggcacuccag

SEQ ID NO: 164536 - RNA, 22 nt, Human
ugcugcucaagcugcagcaaaa

SEQ ID NO: 164537 - RNA, 22 nt, Human
ugcugcuguuaucauuuuacca

SEQ ID NO: 164538 - RNA, 21 nt, Human
ucucaagguaacauuuaagau

SEQ ID NO: 164539 - RNA, 22 nt, Human
uccucguccucauccgcgucau

SEQ ID NO: 164540 - RNA, 22 nt, Human
uccucuccaggugagccgaaau

SEQ ID NO: 164541 - RNA, 22 nt, Human
uccuccucgccacgacucugcu

SEQ ID NO: 164542 - RNA, 22 nt, Human
uccugcaugcuagugagugcuu

SEQ ID NO: 164543 - RNA, 19 nt, Human
ugccccacccucuauccag

SEQ ID NO: 164544 - RNA, 22 nt, Human
ugcccagagccucuuaccucca

SEQ ID NO: 164545 - RNA, 22 nt, Human
ugcccagcagggagcuaccugg

SEQ ID NO: 164546 - RNA, 17 nt, Human
ugcaugcgucugugaua

SEQ ID NO: 164547 - RNA, 22 nt, Human
uccugcuucaaucugcugcugg

SEQ ID NO: 164548 - RNA, 22 nt, Human
uccuggcgugggcuggcugcag

SEQ ID NO: 164549 - RNA, 22 nt, Human
ugccgggcugagcaagugcugc

SEQ ID NO: 164550 - RNA, 22 nt, Human
ugccugaagccugccccugggu

SEQ ID NO: 164551 - RNA, 20 nt, Human
ugccugagcgcagcuccagg

SEQ ID NO: 164552 - RNA, 22 nt, Human
ugccuggacgacaucacaguga

SEQ ID NO: 164553 - RNA, 22 nt, Human
ugccuuccuucuccccuccuuc

SEQ ID NO: 164554 - RNA, 22 nt, Human
ugcgccucugucacucagcauc

SEQ ID NO: 164555 - RNA, 22 nt, Human
ucccugcagggccauugugcag

SEQ ID NO: 164556 - RNA, 23 nt, Human
ucccuguuucagggccagaacug

SEQ ID NO: 164557 - RNA, 22 nt, Human
ucccucuaggggcgggaggcug

SEQ ID NO: 164558 - RNA, 22 nt, Human
ugcaggagcccaggaauacuau

SEQ ID NO: 164559 - RNA, 22 nt, Human
uccgggagcccccggaggagga

SEQ ID NO: 164560 - RNA, 22 nt, Human
uccgggcagcuccuggagcugu

SEQ ID NO: 164561 - RNA, 22 nt, Human
uccgagggugacuaccgcuucc

SEQ ID NO: 164562 - RNA, 18 nt, Human
uccggaggucagaguaaa

SEQ ID NO: 164563 - RNA, 22 nt, Human
uccgaccuuuacuucuugucuc

SEQ ID NO: 164564 - RNA, 22 nt, Human
ugcagguggcagcggggcacca

SEQ ID NO: 164565 - RNA, 22 nt, Human
ugcagugaugcuucuggcucag

SEQ ID NO: 164566 - RNA, 22 nt, Human
uccgucucucccuccccaucac

SEQ ID NO: 164567 - RNA, 22 nt, Human
ugcaggucuggacccccacuuu

SEQ ID NO: 164568 - RNA, 22 nt, Human
ugcagugcagcuggaaguuggc

SEQ ID NO: 164569 - RNA, 22 nt, Human
uccccaccuaagauacccaucu

SEQ ID NO: 164570 - RNA, 22 nt, Human
uccccgcuccguagagaaagag

SEQ ID NO: 164571 - RNA, 22 nt, Human
uccccugccccccauccucugg

SEQ ID NO: 164572 - RNA, 22 nt, Human
ucccggcaccgggagccccugc

SEQ ID NO: 164573 - RNA, 22 nt, Human
ucccguuucacuccuugccagc

SEQ ID NO: 164574 - RNA, 21 nt, Human
uccccugugccuggcauacag

SEQ ID NO: 164575 - RNA, 22 nt, Human
uccagcugugcuccaggaggug

SEQ ID NO: 164576 - RNA, 22 nt, Human
uccaggagucagacagauggug

SEQ ID NO: 164577 - RNA, 22 nt, Human
uccaggacgccgacgugucggc

SEQ ID NO: 164578 - RNA, 22 nt, Human
ucaggcuagcccagugcuuggg

SEQ ID NO: 164579 - RNA, 22 nt, Human
ucagguagugguuaaguucugu

SEQ ID NO: 164580 - RNA, 22 nt, Human
ucagugagauuuuuagcaguag

SEQ ID NO: 164581 - RNA, 22 nt, Human
ugagcaccaggcaccacagcuc

SEQ ID NO: 164582 - RNA, 22 nt, Human
ugagccauguucaugaguucau

SEQ ID NO: 164583 - RNA, 22 nt, Human
ugagcagagcacuugggaacga

SEQ ID NO: 164584 - RNA, 22 nt, Human
ugagcagccagucauucaaaaa

SEQ ID NO: 164585 - RNA, 22 nt, Human
ugaggaggugcuaccagcgucu

SEQ ID NO: 164586 - RNA, 22 nt, Human
ugaggaacaugggagaaauguc

SEQ ID NO: 164587 - RNA, 22 nt, Human
ugaggagggcuagagucuccug

SEQ ID NO: 164588 - RNA, 22 nt, Human
ugagccugaguguguauugaac

SEQ ID NO: 164589 - RNA, 22 nt, Human
ucaguuacucugauguccugug

SEQ ID NO: 164590 - RNA, 22 nt, Human
ucaugcagaguagaaagggcaa

SEQ ID NO: 164591 - RNA, 22 nt, Human
ucaucggcugucaucuucacgu

SEQ ID NO: 164592 - RNA, 22 nt, Human
ucauccugucucuguucggaau

SEQ ID NO: 164593 - RNA, 22 nt, Human
ucauccugaagaaccugcuucc

SEQ ID NO: 164594 - RNA, 22 nt, Human
ucaucagccaaagaguccuuca

SEQ ID NO: 164595 - RNA, 21 nt, Human
ugaggccugccagucucagaa

SEQ ID NO: 164596 - RNA, 21 nt, Human
ucauccagguccugcuucuuc

SEQ ID NO: 164597 - RNA, 22 nt, Human
ugaucaacagggcuggaaagag

SEQ ID NO: 164598 - RNA, 22 nt, Human
ucauggguauaauuuuagaugu

SEQ ID NO: 164599 - RNA, 22 nt, Human
ugaucauguucuccaaaagcgu

SEQ ID NO: 164600 - RNA, 18 nt, Human
ugauggcuaagagccggg

SEQ ID NO: 164601 - RNA, 22 nt, Human
ugauggaucuguuggcggguuu

SEQ ID NO: 164602 - RNA, 19 nt, Human
uccaaaauacuuguuacug

SEQ ID NO: 164603 - RNA, 22 nt, Human
uccaagcgcuucuggagcuccu

SEQ ID NO: 164604 - RNA, 19 nt, Human
uccaccgcgugcaccucua

SEQ ID NO: 164605 - RNA, 22 nt, Human
ugcccccggcugcccaggggaa

SEQ ID NO: 164606 - RNA, 22 nt, Human
ugccccuggaggagagcaaugg

SEQ ID NO: 164607 - RNA, 20 nt, Human
ugccagagagcucauacccu

SEQ ID NO: 164608 - RNA, 22 nt, Human
ugccagauuaugucuccagggc

SEQ ID NO: 164609 - RNA, 22 nt, Human
ugcaugguuauauacuacuagu

SEQ ID NO: 164610 - RNA, 22 nt, Human
ugccagcuccgaggagcugcag

SEQ ID NO: 164611 - RNA, 22 nt, Human
ugccaaugauuccacaauggaa

SEQ ID NO: 164612 - RNA, 22 nt, Human
ugcccugaagcugucaauuuug

SEQ ID NO: 164613 - RNA, 21 nt, Human
ugccccucuuuucuuuccuuc

SEQ ID NO: 164614 - RNA, 22 nt, Human
ugccccuagaggcguugcagcu

SEQ ID NO: 164615 - RNA, 22 nt, Human
ugccgcuuucuggcccucaguc

SEQ ID NO: 164616 - RNA, 22 nt, Human
ugcccugucccuagguuugugg

SEQ ID NO: 164617 - RNA, 22 nt, Human
ugccgcaggaggggcgauuucu

SEQ ID NO: 164618 - RNA, 19 nt, Human
ugccggccgcgggguuccu

SEQ ID NO: 164619 - RNA, 23 nt, Human
ugccggaucuacuuuggguucuc

SEQ ID NO: 164620 - RNA, 22 nt, Human
ugcaggaagcucagcggggccg

SEQ ID NO: 164621 - RNA, 22 nt, Human
ugugcagaaaacacuuaagaac

SEQ ID NO: 164622 - RNA, 22 nt, Human
ugcaggaacucgaaaacuauag

SEQ ID NO: 164623 - RNA, 22 nt, Human
ugcagcuuuugguuucuagaug

SEQ ID NO: 164624 - RNA, 22 nt, Human
ugcagcuucucugcaacaggag

SEQ ID NO: 164625 - RNA, 19 nt, Human
ugcagcuguaugagcuuaa

SEQ ID NO: 164626 - RNA, 20 nt, Human
ugcagcucccccgcaguuuc

SEQ ID NO: 164627 - RNA, 22 nt, Human
ugcagcgugaggacagcugagc

SEQ ID NO: 164628 - RNA, 22 nt, Human
ugcagccuuuguccuugggcua

SEQ ID NO: 164629 - RNA, 22 nt, Human
ugcaucccugaggcauuauccu

SEQ ID NO: 164630 - RNA, 22 nt, Human
ugcaucccaaacaugguuuccu

SEQ ID NO: 164631 - RNA, 22 nt, Human
ugcaucugagcacuacggugga

SEQ ID NO: 164632 - RNA, 22 nt, Human
ugugcuggcuucugugagcuga

SEQ ID NO: 164633 - RNA, 22 nt, Human
ugcagugcagcuggaauaucuu

SEQ ID NO: 164634 - RNA, 21 nt, Human
uguccucggaucaguccacaa

SEQ ID NO: 164635 - RNA, 22 nt, Human
ugucccuggacuccaggagcca

SEQ ID NO: 164636 - RNA, 22 nt, Human
ugucacagagcgugcaacagaa

SEQ ID NO: 164637 - RNA, 22 nt, Human
ugugaagaauuaaugugaauca

SEQ ID NO: 164638 - RNA, 22 nt, Human
ugugaagugaugggugaccgag

SEQ ID NO: 164639 - RNA, 22 nt, Human
ugcagcaucuccuugugccaug

SEQ ID NO: 164640 - RNA, 22 nt, Human
ugcagaauauucuggugacaau

SEQ ID NO: 164641 - RNA, 22 nt, Human
ugcagaggagcuggaaggcugg

SEQ ID NO: 164642 - RNA, 21 nt, Human
ugcaaugcauugacagcagca

SEQ ID NO: 164643 - RNA, 22 nt, Human
ugcaauggauaucugaacgugg

SEQ ID NO: 164644 - RNA, 22 nt, Human
ugucucuagggcagauagagug

SEQ ID NO: 164645 - RNA, 22 nt, Human
ugguggcaauuuuuggggucaa

SEQ ID NO: 164646 - RNA, 22 nt, Human
ugaggaggugggcacacagagu

SEQ ID NO: 164647 - RNA, 22 nt, Human
uggugguaggggugguuucuga

SEQ ID NO: 164648 - RNA, 22 nt, Human
ugguucacaagaauccagguag

SEQ ID NO: 164649 - RNA, 19 nt, Human
uggugcgcuguuccugagc

SEQ ID NO: 164650 - RNA, 22 nt, Human
uggugcucucgauauauaaggc

SEQ ID NO: 164651 - RNA, 22 nt, Human
uggucuccucuuaauugccuac

SEQ ID NO: 164652 - RNA, 22 nt, Human
uggucggugguguggggaggca

SEQ ID NO: 164653 - RNA, 22 nt, Human
ugguccuuuccauuggagacac

SEQ ID NO: 164654 - RNA, 23 nt, Human
ugguuuucagaagaccuuguuag

SEQ ID NO: 164655 - RNA, 22 nt, Human
ugguuuucuuaauuagcaguca

SEQ ID NO: 164656 - RNA, 22 nt, Human
ugauaccugagucuuccccguu

SEQ ID NO: 164657 - RNA, 22 nt, Human
ugagugacuguugucaagaugg

SEQ ID NO: 164658 - RNA, 22 nt, Human
ugagugccagugcuugcucuac

SEQ ID NO: 164659 - RNA, 22 nt, Human
ugguguccccugaguuucuauc

SEQ ID NO: 164660 - RNA, 19 nt, Human
ugaguacuaaugagauuga

SEQ ID NO: 164661 - RNA, 22 nt, Human
uguagaaguuaauugaugagua

SEQ ID NO: 164662 - RNA, 22 nt, Human
ugaugaaguuggaaggaaaguu

SEQ ID NO: 164663 - RNA, 22 nt, Human
ugauaugguaauaagauauucu

SEQ ID NO: 164664 - RNA, 20 nt, Human
ugauaggcauugacauaagg

SEQ ID NO: 164665 - RNA, 22 nt, Human
uggcucaguaaucgagucuccu

SEQ ID NO: 164666 - RNA, 22 nt, Human
ugaaagccuacagcucacuguu

SEQ ID NO: 164667 - RNA, 22 nt, Human
ugggucagauugagccccuggu

SEQ ID NO: 164668 - RNA, 22 nt, Human
ugggucaguagccuugcagaac

SEQ ID NO: 164669 - RNA, 22 nt, Human
uggguccaggauucuguguuuc

SEQ ID NO: 164670 - RNA, 22 nt, Human
ugaccuccuaagugacagaauu

SEQ ID NO: 164671 - RNA, 22 nt, Human
ugaccucaagcaugcggagggc

SEQ ID NO: 164672 - RNA, 22 nt, Human
ugacgggacacaggugccaaca

SEQ ID NO: 164673 - RNA, 22 nt, Human
ugacugaggaaggugggguggg

SEQ ID NO: 164674 - RNA, 19 nt, Human
ugacuggguucuaggcagg

SEQ ID NO: 164675 - RNA, 22 nt, Human
ugacucugaugcaguguguuua

SEQ ID NO: 164676 - RNA, 22 nt, Human
ugacugagacugcaaugaccga

SEQ ID NO: 164677 - RNA, 22 nt, Human
ugggugggcagagucuaagaua

SEQ ID NO: 164678 - RNA, 22 nt, Human
ugggugaugagguccccagccc

SEQ ID NO: 164679 - RNA, 22 nt, Human
ugagagggagacagcucuagca

SEQ ID NO: 164680 - RNA, 22 nt, Human
ugagagcuccacaccuugcccu

SEQ ID NO: 164681 - RNA, 22 nt, Human
uggucccugaagagagaccuug

SEQ ID NO: 164682 - RNA, 22 nt, Human
uggucccuagugugggagcuug

SEQ ID NO: 164683 - RNA, 22 nt, Human
ugagaagaggucuuuugggaug

SEQ ID NO: 164684 - RNA, 22 nt, Human
ugcuccguucuucugcuucuug

SEQ ID NO: 164685 - RNA, 22 nt, Human
ugccuggugcggagugaguggc

SEQ ID NO: 164686 - RNA, 22 nt, Human
ugcugaccggccuccccccagc

SEQ ID NO: 164687 - RNA, 22 nt, Human
ugcugcacucacaggaagaguu

SEQ ID NO: 164688 - RNA, 22 nt, Human
ugcugcacuuauggcucugagg

SEQ ID NO: 164689 - RNA, 22 nt, Human
ugcucuuucaggcauagaccuu

SEQ ID NO: 164690 - RNA, 22 nt, Human
ugcugcggauauacaggaucug

SEQ ID NO: 164691 - RNA, 22 nt, Human
ugcugccucugaauggagcagu

SEQ ID NO: 164692 - RNA, 23 nt, Human
ugcugcgggacccgagcgcgcgc

SEQ ID NO: 164693 - RNA, 23 nt, Human
ugcugcuggaguaucuacaaugc

SEQ ID NO: 164694 - RNA, 22 nt, Human
ugcugggagcugggccucgaca

SEQ ID NO: 164695 - RNA, 22 nt, Human
ugcuggaguggcacuguguggc

SEQ ID NO: 164696 - RNA, 22 nt, Human
ugcuggugauuaaauccugaag

SEQ ID NO: 164697 - RNA, 20 nt, Human
ugcugggccaucuugcaugc

SEQ ID NO: 164698 - RNA, 22 nt, Human
ugcuucuuugggggugaagaga

SEQ ID NO: 164699 - RNA, 22 nt, Human
ugcuucuuuccuuggugacuuc

SEQ ID NO: 164700 - RNA, 22 nt, Human
ugcuucuuuaggauguaguuau

SEQ ID NO: 164701 - RNA, 22 nt, Human
ugcuguugacuuuguuguucuu

SEQ ID NO: 164702 - RNA, 22 nt, Human
ugcugugcuggcggcagaggcc

SEQ ID NO: 164703 - RNA, 20 nt, Human
ugcugugugucuacuguggg

SEQ ID NO: 164704 - RNA, 23 nt, Human
uuacuaugaaaauuccagucacu

SEQ ID NO: 164705 - RNA, 21 nt, Human
uuacuggcagcagaaaccuga

SEQ ID NO: 164706 - RNA, 22 nt, Human
uggaaaagaugucuuccugaau

SEQ ID NO: 164707 - RNA, 22 nt, Human
ugcuuuauucgacaucugguag

SEQ ID NO: 164708 - RNA, 22 nt, Human
uuacccuugaauuugugacaaa

SEQ ID NO: 164709 - RNA, 22 nt, Human
uuacaugcuugugcagguuuug

SEQ ID NO: 164710 - RNA, 22 nt, Human
uuaccgagaacaugacuggaau

SEQ ID NO: 164711 - RNA, 22 nt, Human
uggaaagauuuaaaauaacgag

SEQ ID NO: 164712 - RNA, 22 nt, Human
uggaaaugcuuagaggugaucu

SEQ ID NO: 164713 - RNA, 23 nt, Human
uggaagaaaaugguuuggcugug

SEQ ID NO: 164714 - RNA, 22 nt, Human
uggaagaucugguguagcuccu

SEQ ID NO: 164715 - RNA, 22 nt, Human
uggaagaaaugguugagccaug

SEQ ID NO: 164716 - RNA, 22 nt, Human
uggaaguggcaggggagacgua

SEQ ID NO: 164717 - RNA, 22 nt, Human
uggaaggggccaggcgcggagu

SEQ ID NO: 164718 - RNA, 22 nt, Human
uggaagucuucucucccaugga

SEQ ID NO: 164719 - RNA, 22 nt, Human
uggaaggugauucucugguuaa

SEQ ID NO: 164720 - RNA, 22 nt, Human
uggaagcuggcugaucugacuu

SEQ ID NO: 164721 - RNA, 22 nt, Human
uggaaggggagcuggaaagggg

SEQ ID NO: 164722 - RNA, 22 nt, Human
uggaaggaaauguguaucauaa

SEQ ID NO: 164723 - RNA, 19 nt, Human
uuauccggacuuaauuuau

SEQ ID NO: 164724 - RNA, 22 nt, Human
uggagaugcacgagcaggugga

SEQ ID NO: 164725 - RNA, 22 nt, Human
uggacuguucauugauacugga

SEQ ID NO: 164726 - RNA, 22 nt, Human
uggagaaauaacauuuggauuc

SEQ ID NO: 164727 - RNA, 22 nt, Human
uggaagugucagcaggcugguu

SEQ ID NO: 164728 - RNA, 22 nt, Human
uggacagguacuucacauuauu

SEQ ID NO: 164729 - RNA, 22 nt, Human
uucuccucagcaaggcagcuuu

SEQ ID NO: 164730 - RNA, 22 nt, Human
uggguagcucaauagagccaca

SEQ ID NO: 164731 - RNA, 22 nt, Human
uggguagggagcuggaauccua

SEQ ID NO: 164732 - RNA, 22 nt, Human
uggggcgccuggcugaggcugc

SEQ ID NO: 164733 - RNA, 22 nt, Human
uggggcuauggcccgaccacgu

SEQ ID NO: 164734 - RNA, 22 nt, Human
uggggcggaaggaggagaggug

SEQ ID NO: 164735 - RNA, 22 nt, Human
uggggcuccuccuggcaggagg

SEQ ID NO: 164736 - RNA, 22 nt, Human
uggguguggaagcagcgugggg

SEQ ID NO: 164737 - RNA, 22 nt, Human
uggguguuccuggggugcaagg

SEQ ID NO: 164738 - RNA, 22 nt, Human
ugggugugggguaggguaagag

SEQ ID NO: 164739 - RNA, 22 nt, Human
uggguggugaaauggaugggaa

SEQ ID NO: 164740 - RNA, 23 nt, Human
uggguuucagugccaaugcugcc

SEQ ID NO: 164741 - RNA, 20 nt, Human
uucugcucuagagucuagaa

SEQ ID NO: 164742 - RNA, 18 nt, Human
uucugcggugacagauau

SEQ ID NO: 164743 - RNA, 22 nt, Human
ugguaacgguuuccuugccauu

SEQ ID NO: 164744 - RNA, 22 nt, Human
uggucaagcaaugaauuuauuu

SEQ ID NO: 164745 - RNA, 22 nt, Human
uggucacagauuuacaggaaug

SEQ ID NO: 164746 - RNA, 22 nt, Human
ugguccgagaacuguccugguu

SEQ ID NO: 164747 - RNA, 22 nt, Human
ugguccucacccuacccagcug

SEQ ID NO: 164748 - RNA, 22 nt, Human
ugguccaaaccagugcuguggu

SEQ ID NO: 164749 - RNA, 22 nt, Human
ugguccaccgccucauucucug

SEQ ID NO: 164750 - RNA, 22 nt, Human
ugguccaugcuccaggcacauu

SEQ ID NO: 164751 - RNA, 22 nt, Human
uucuggccagggaagagggguc

SEQ ID NO: 164752 - RNA, 22 nt, Human
uucuggggccgugacgaggggc

SEQ ID NO: 164753 - RNA, 22 nt, Human
uggagcuggcuuguggaaguug

SEQ ID NO: 164754 - RNA, 22 nt, Human
uggcugagcugcagcguggcuu

SEQ ID NO: 164755 - RNA, 22 nt, Human
uggcugaggcuuuucuuaaaga

SEQ ID NO: 164756 - RNA, 22 nt, Human
ugggaagaguuagagacagcug

SEQ ID NO: 164757 - RNA, 22 nt, Human
ugggaagcugagccucgaugug

SEQ ID NO: 164758 - RNA, 22 nt, Human
uggcuuuuuucuccccuuggau

SEQ ID NO: 164759 - RNA, 22 nt, Human
uggcuuuuuauuccuaugugau

SEQ ID NO: 164760 - RNA, 22 nt, Human
uggcugggagcuggaacugggc

SEQ ID NO: 164761 - RNA, 22 nt, Human
uggcugagugaacauguccauu

SEQ ID NO: 164762 - RNA, 22 nt, Human
uucggugagcugcgggcgagga

SEQ ID NO: 164763 - RNA, 18 nt, Human
uucgucauggggaucgua

SEQ ID NO: 164764 - RNA, 22 nt, Human
uucgcggccaggcggggaggcc

SEQ ID NO: 164765 - RNA, 22 nt, Human
uggggcgcaggcccagcgggcu

SEQ ID NO: 164766 - RNA, 21 nt, Human
uucgaaugggucguugcugcc

SEQ ID NO: 164767 - RNA, 19 nt, Human
uuccuuucuauccugggua

SEQ ID NO: 164768 - RNA, 21 nt, Human
uuccuggaggcagaaacguga

SEQ ID NO: 164769 - RNA, 22 nt, Human
uucccgcugcuggaguuggggc

SEQ ID NO: 164770 - RNA, 22 nt, Human
uucccggccgccccccgcucgg

SEQ ID NO: 164771 - RNA, 22 nt, Human
ugggagagaagcugaggcaggg

SEQ ID NO: 164772 - RNA, 22 nt, Human
ugggagagaaauuuaaguuuuu

SEQ ID NO: 164773 - RNA, 22 nt, Human
uuccugacacuggcaggcuucu

SEQ ID NO: 164774 - RNA, 21 nt, Human
uuccuccucuggagaagaaga

SEQ ID NO: 164775 - RNA, 22 nt, Human
uugaccagaaaaguuaguaauu

SEQ ID NO: 164776 - RNA, 22 nt, Human
uugaggucuguguaggcagcaa

SEQ ID NO: 164777 - RNA, 22 nt, Human
ugucagccacggugugaccggc

SEQ ID NO: 164778 - RNA, 22 nt, Human
uugaggguggauugucagggga

SEQ ID NO: 164779 - RNA, 22 nt, Human
uugccaggagacaucuggagcc

SEQ ID NO: 164780 - RNA, 22 nt, Human
ugugccuguugguguagacaua

SEQ ID NO: 164781 - RNA, 20 nt, Human
uugcaugcagccggaugcug

SEQ ID NO: 164782 - RNA, 22 nt, Human
uugcauauguccagccaugcau

SEQ ID NO: 164783 - RNA, 22 nt, Human
uggugcuuuuguggaugcuaac

SEQ ID NO: 164784 - RNA, 22 nt, Human
uggugcucuugauauauaaggc

SEQ ID NO: 164785 - RNA, 22 nt, Human
uggugccuuccgagagcuguga

SEQ ID NO: 164786 - RNA, 22 nt, Human
uggucugggaagaucacaauua

SEQ ID NO: 164787 - RNA, 22 nt, Human
uggugugggauccugggaagga

SEQ ID NO: 164788 - RNA, 22 nt, Human
uucuugcuucucugucugccuc

SEQ ID NO: 164789 - RNA, 20 nt, Human
ugguguccuaugcuugugcu

SEQ ID NO: 164790 - RNA, 22 nt, Human
uucuugcgaaagaaugagcuga

SEQ ID NO: 164791 - RNA, 22 nt, Human
uugaaaaaauguguuuaaggag

SEQ ID NO: 164792 - RNA, 17 nt, Human
ugguucuuuuccugacc

SEQ ID NO: 164793 - RNA, 22 nt, Human
uugaaaaaaucugaggaggacc

SEQ ID NO: 164794 - RNA, 22 nt, Human
uugaaaaaugcccagcagacaa

SEQ ID NO: 164795 - RNA, 22 nt, Human
uugaagaagucaaaagcugcag

SEQ ID NO: 164796 - RNA, 22 nt, Human
uugaagccaccacuguaaguca

SEQ ID NO: 164797 - RNA, 22 nt, Human
uguagcaauauaucagugcaca

SEQ ID NO: 164798 - RNA, 22 nt, Human
uuuaccugucuguagaacauaa

SEQ ID NO: 164799 - RNA, 22 nt, Human
uuguugcuguugaacccugcug

SEQ ID NO: 164800 - RNA, 22 nt, Human
uuguugcaagccuggaaucugg

SEQ ID NO: 164801 - RNA, 22 nt, Human
uuaauguuuuagaaugagagug

SEQ ID NO: 164802 - RNA, 22 nt, Human
uuguuuucuugaugaaauuauu

SEQ ID NO: 164803 - RNA, 22 nt, Human
uugcggauguccacgucacacu

SEQ ID NO: 164804 - RNA, 20 nt, Human
uugcggccuaacagccccuu

SEQ ID NO: 164805 - RNA, 19 nt, Human
uguguaccuaauguuugug

SEQ ID NO: 164806 - RNA, 21 nt, Human
uguguaccuucuuccgagcuc

SEQ ID NO: 164807 - RNA, 22 nt, Human
uguucaguuugcuaucauaauc

SEQ ID NO: 164808 - RNA, 22 nt, Human
uuggccaaggaccuuuuuggag

SEQ ID NO: 164809 - RNA, 21 nt, Human
uuggcuacugcuucagaggga

SEQ ID NO: 164810 - RNA, 22 nt, Human
uguuccucuuagucuuaugugu

SEQ ID NO: 164811 - RNA, 22 nt, Human
uguuccuggggaccugccuucc

SEQ ID NO: 164812 - RNA, 22 nt, Human
uguucggaaaagggcaagcuau

SEQ ID NO: 164813 - RNA, 20 nt, Human
uugggaagccuacaccauuc

SEQ ID NO: 164814 - RNA, 22 nt, Human
uugggagaaaguuaacuuucua

SEQ ID NO: 164815 - RNA, 22 nt, Human
uuggccaaaaaagucauuagaa

SEQ ID NO: 164816 - RNA, 22 nt, Human
uguguuguuuggggauguccau

SEQ ID NO: 164817 - RNA, 22 nt, Human
uguuuucaucucucacccagaa

SEQ ID NO: 164818 - RNA, 22 nt, Human
uguuuuuucccccccuucuaaa

SEQ ID NO: 164819 - RNA, 22 nt, Human
uuggggcugcguguuuccaugu

SEQ ID NO: 164820 - RNA, 22 nt, Human
uuuauucacuuaucaggaacga

SEQ ID NO: 164821 - RNA, 22 nt, Human
uucagcauaggcugcucuucaa

SEQ ID NO: 164822 - RNA, 23 nt, Human
uucagcucuccugaagcaucugu

SEQ ID NO: 164823 - RNA, 22 nt, Human
uucagcauggcuguuuucccuu

SEQ ID NO: 164824 - RNA, 22 nt, Human
uucagcaagugucucuacuguc

SEQ ID NO: 164825 - RNA, 22 nt, Human
uuugcugggaagccuucacucu

SEQ ID NO: 164826 - RNA, 22 nt, Human
uucaggucauuuuuagcccuag

SEQ ID NO: 164827 - RNA, 22 nt, Human
uuccauuccauaucagguacag

SEQ ID NO: 164828 - RNA, 22 nt, Human
uuccauggggcuguugcgcaga

SEQ ID NO: 164829 - RNA, 20 nt, Human
uucaugcagugguugcugug

SEQ ID NO: 164830 - RNA, 22 nt, Human
uucaugcgcuuuucaggagugu

SEQ ID NO: 164831 - RNA, 22 nt, Human
uuccaggacuggguguuugaag

SEQ ID NO: 164832 - RNA, 22 nt, Human
uuccucuugaaucugucugacu

SEQ ID NO: 164833 - RNA, 20 nt, Human
uuccucaaaagucugaugcu

SEQ ID NO: 164834 - RNA, 22 nt, Human
uuccugcuggucaaaguugccu

SEQ ID NO: 164835 - RNA, 22 nt, Human
uuccuggaguggagggagguga

SEQ ID NO: 164836 - RNA, 22 nt, Human
uucgucauuaugcagccuguga

SEQ ID NO: 164837 - RNA, 22 nt, Human
uucgucaauaugcagccuguga

SEQ ID NO: 164838 - RNA, 22 nt, Human
uucggcagaaagucauuugucu

SEQ ID NO: 164839 - RNA, 22 nt, Human
uucgcucuucacacagugcuga

SEQ ID NO: 164840 - RNA, 22 nt, Human
uucuguuuuuauucuaucucug

SEQ ID NO: 164841 - RNA, 22 nt, Human
uuuugccuauuguaucaucgua

SEQ ID NO: 164842 - RNA, 22 nt, Human
uuuugcaaauuacuaaauuucu

SEQ ID NO: 164843 - RNA, 22 nt, Human
uuuucucacugagagccuugau

SEQ ID NO: 164844 - RNA, 20 nt, Human
uucucugcagcaggcggccc

SEQ ID NO: 164845 - RNA, 22 nt, Human
uucuggaguuugaagaucaggu

SEQ ID NO: 164846 - RNA, 22 nt, Human
uuuucuucucauucugaccuca

SEQ ID NO: 164847 - RNA, 22 nt, Human
uuuucuugagucacuccaguga

SEQ ID NO: 164848 - RNA, 22 nt, Human
uucuuccagugaaacgugcauc

SEQ ID NO: 164849 - RNA, 22 nt, Human
uuuuucuuugcuuuccacuggc

SEQ ID NO: 164850 - RNA, 22 nt, Human
uucuuucgaacaagagaaguuc

SEQ ID NO: 164851 - RNA, 22 nt, Human
uuuuuuccugguuacagauugu

SEQ ID NO: 164852 - RNA, 22 nt, Human
uugagcagccauuagcuggggu

SEQ ID NO: 164853 - RNA, 22 nt, Human
uuggccauuacugagccuggag

SEQ ID NO: 164854 - RNA, 22 nt, Human
uuggccuaggcacaggcaggug

SEQ ID NO: 164855 - RNA, 22 nt, Human
uugggcauuucuuauguauuuu

SEQ ID NO: 164856 - RNA, 22 nt, Human
uuggggagaagagcuggucagg

SEQ ID NO: 164857 - RNA, 22 nt, Human
uuggggaggaagauagggugaa

SEQ ID NO: 164858 - RNA, 22 nt, Human
uugguguuucacuuccuugucg

SEQ ID NO: 164859 - RNA, 22 nt, Human
uuggugauugggaauggauggg

SEQ ID NO: 164860 - RNA, 22 nt, Human
uugucagcuagugaugcuguuc

SEQ ID NO: 164861 - RNA, 22 nt, Human
uugugcucaguuguggucuauu

SEQ ID NO: 164862 - RNA, 22 nt, Human
uuucacugaguaggagagcacu

SEQ ID NO: 164863 - RNA, 22 nt, Human
uuuauuuggugguguuacuguu

SEQ ID NO: 164864 - RNA, 22 nt, Human
uuuauccacucauccaugccuc

SEQ ID NO: 164865 - RNA, 22 nt, Human
uuguuccuuucuucuguagucg

SEQ ID NO: 164866 - RNA, 22 nt, Human
uuguuccuaguuguccaucaca

SEQ ID NO: 164867 - RNA, 22 nt, Human
uuguuguuguuguuauuuaguu

SEQ ID NO: 164868 - RNA, 22 nt, Human
uuguuccuucuuuuuguaucag

SEQ ID NO: 164869 - RNA, 19 nt, Human
uuugccugugguucagaag

SEQ ID NO: 164870 - RNA, 22 nt, Human
uuugccggaucugucuccagcu

SEQ ID NO: 164871 - RNA, 22 nt, Human
uuugcauuaguuuagauuucaa

SEQ ID NO: 164872 - RNA, 22 nt, Human
uuuggcuccccaggaucugaaa

SEQ ID NO: 164873 - RNA, 22 nt, Human
uuugcuguccaauauucagggu

SEQ ID NO: 164874 - RNA, 22 nt, Human
uuucauagaggcagcggcggau

SEQ ID NO: 164875 - RNA, 22 nt, Human
uuuccacacucacugcacucau

SEQ ID NO: 164876 - RNA, 22 nt, Human
uuucauggaggccaggacagag

SEQ ID NO: 164877 - RNA, 21 nt, Human
uuuccagaggcagccggacuc

SEQ ID NO: 164878 - RNA, 22 nt, Human
uuuccagacaugguuuuucaaa

SEQ ID NO: 164879 - RNA, 22 nt, Human
uuuccaguuguucuagaaagcu

SEQ ID NO: 164880 - RNA, 22 nt, Human
uuuccuaggaaaugauugaagu

SEQ ID NO: 164881 - RNA, 22 nt, Human
uuucuaacacccuccuuccaga

SEQ ID NO: 164882 - RNA, 22 nt, Human
uuuccugcagacaguuuaagca

SEQ ID NO: 164883 - RNA, 22 nt, Human
uuucuggacuaaagggagagau

SEQ ID NO: 164884 - RNA, 22 nt, Human
uuucugcuuucuaguugguguu

SEQ ID NO: 164885 - RNA, 22 nt, Human
uuucugggggucgugcuggcug

SEQ ID NO: 164886 - RNA, 22 nt, Human
augcaaaaucuuauuuuuucua

SEQ ID NO: 164887 - RNA, 21 nt, Human
uuccauggacccugucagugu

SEQ ID NO: 164888 - RNA, 22 nt, Human
auuuuucuuucacauuuucuua

SEQ ID NO: 164889 - RNA, 22 nt, Human
cugcagagaccuaggucagguu

SEQ ID NO: 164890 - RNA, 22 nt, Human
aaaaaauugcuggcagagcugu

SEQ ID NO: 164891 - RNA, 22 nt, Human
ggcugcagugcaacucuuucua

SEQ ID NO: 164892 - RNA, 22 nt, Human
gggcugcuccgcccgcugcgcc

SEQ ID NO: 164893 - RNA, 22 nt, Human
cagcuuguucugaccugugauu

SEQ ID NO: 164894 - RNA, 22 nt, Human
acugcagauccucugagaaacc

SEQ ID NO: 164895 - RNA, 21 nt, Human
auacaguucagcuuuuacuau

SEQ ID NO: 164896 - RNA, 22 nt, Human
uuuuccuuaacagagggagaaa

SEQ ID NO: 164897 - RNA, 22 nt, Human
uggcccugaaucaaggccagca

SEQ ID NO: 164898 - RNA, 22 nt, Human
gcuggaagggccagcuuucagg

SEQ ID NO: 164899 - RNA, 20 nt, Human
uccccuccacuuuccuccua

SEQ ID NO: 164900 - RNA, 22 nt, Human
guacauauccuuuacguuuugu

SEQ ID NO: 164901 - RNA, 22 nt, Human
uuuacuguuuacagcuaaugca

SEQ ID NO: 164902 - RNA, 22 nt, Human
agcaaggguugguuuucugaca

SEQ ID NO: 164903 - RNA, 22 nt, Human
gcucuucuaaguuuacccuucc

SEQ ID NO: 164904 - RNA, 22 nt, Human
gcgcgcucugcgaggacacgcu

SEQ ID NO: 164905 - RNA, 22 nt, Human
uggggcauacgugaaauaauuu

SEQ ID NO: 164906 - RNA, 20 nt, Human
cuuauuuuggagaacuuuuc

SEQ ID NO: 164907 - RNA, 22 nt, Human
gaagaaggaagaucaugcuuga

SEQ ID NO: 164908 - RNA, 22 nt, Human
uugucaggaacuaugauuaugc

SEQ ID NO: 164909 - RNA, 20 nt, Human
gggaauggauggauugcucc

SEQ ID NO: 164910 - RNA, 22 nt, Human
guuuauucuuuuauuugugaga

SEQ ID NO: 164911 - RNA, 22 nt, Human
ugcucacugcuuguguucaguu

SEQ ID NO: 164912 - RNA, 22 nt, Human
ugacuaauacagaaacuacaag

SEQ ID NO: 164913 - RNA, 22 nt, Human
ucccugcugggcgaucuucucu

SEQ ID NO: 164914 - RNA, 22 nt, Human
agauggggccugaggacacugu

SEQ ID NO: 164915 - RNA, 22 nt, Human
gagcuggagaaacacauaagaa

SEQ ID NO: 164916 - RNA, 21 nt, Human
agcgcugcauccaccauggcu

SEQ ID NO: 164917 - RNA, 22 nt, Human
caagggcagaggcagggccccg

SEQ ID NO: 164918 - RNA, 22 nt, Human
augcugugccuggaaagcggcu

SEQ ID NO: 164919 - RNA, 22 nt, Human
auuuuuauuugccuaugauaua

SEQ ID NO: 164920 - RNA, 22 nt, Human
uuuaaucaguugguaauauuga

SEQ ID NO: 164921 - RNA, 22 nt, Human
agccuggagcaggcucugcucu

SEQ ID NO: 164922 - RNA, 22 nt, Human
cuguuaauugugaauuuuacau

SEQ ID NO: 164923 - RNA, 23 nt, Human
cuuauauaaucauuagaaaccau

SEQ ID NO: 164924 - RNA, 22 nt, Human
uccucccugcacucagugaagu

SEQ ID NO: 164925 - RNA, 22 nt, Human
aaaauauaaaggauguggguuu

SEQ ID NO: 164926 - RNA, 22 nt, Human
auguguguaugacugaaucuau

SEQ ID NO: 164927 - RNA, 22 nt, Human
gccagggcucgagcaggccagc

SEQ ID NO: 164928 - RNA, 19 nt, Human
uuacaugacauaugaagga

SEQ ID NO: 164929 - RNA, 22 nt, Human
ggggaaggaaggggagggcacg

SEQ ID NO: 164930 - RNA, 22 nt, Human
gagaacaaggaagagucggcag

SEQ ID NO: 164931 - RNA, 21 nt, Human
guucuuaguuauauucucaau

SEQ ID NO: 164932 - RNA, 22 nt, Human
acuuauaaauuuaguacacugu

SEQ ID NO: 164933 - RNA, 22 nt, Human
uuggaggcagagucuugcugag

SEQ ID NO: 164934 - RNA, 22 nt, Human
agacuucucuuggcuauauuau

SEQ ID NO: 164935 - RNA, 23 nt, Human
ucugccuccuaauuguugguguc

SEQ ID NO: 164936 - RNA, 22 nt, Human
augcagauguagauucugaaau

SEQ ID NO: 164937 - RNA, 19 nt, Human
agcggccgccgcgggcgcc

SEQ ID NO: 164938 - RNA, 22 nt, Human
uugccaggagacaucuggagcc

SEQ ID NO: 164939 - RNA, 22 nt, Human
aauguaaauaauuguaaaauuu

SEQ ID NO: 164940 - RNA, 22 nt, Human
agauaaacaacucuuagcuguu

SEQ ID NO: 164941 - RNA, 22 nt, Human
cuggccagccucccagguaccc

SEQ ID NO: 164942 - RNA, 22 nt, Human
ucuucacagaugcauauacuuc

SEQ ID NO: 164943 - RNA, 22 nt, Human
aaggggaauaguaggaccuggg

SEQ ID NO: 164944 - RNA, 22 nt, Human
gagcgcgcaaucucuccagcug

SEQ ID NO: 164945 - RNA, 17 nt, Human
ugucuuuuuccuccucc

SEQ ID NO: 164946 - RNA, 22 nt, Human
gaaacauuuguugaguacuugc

SEQ ID NO: 164947 - RNA, 22 nt, Human
guuuacaacaucuuguccuuca

SEQ ID NO: 164948 - RNA, 22 nt, Human
agggaugugcagggcuugccau

SEQ ID NO: 164949 - RNA, 22 nt, Human
uucccaggugugagugagguga

SEQ ID NO: 164950 - RNA, 18 nt, Human
aguaaauguuaaauauug

SEQ ID NO: 164951 - RNA, 21 nt, Human
ccgaggagugcggggagcccc

SEQ ID NO: 164952 - RNA, 22 nt, Human
agcaggagagacuggcccaaaa

SEQ ID NO: 164953 - RNA, 22 nt, Human
ggcuccaggguaccccuggaug

SEQ ID NO: 164954 - RNA, 22 nt, Human
uuguuuucuaguguuuugaaua

SEQ ID NO: 164955 - RNA, 22 nt, Human
uccgggagcccccggaggagga

SEQ ID NO: 164956 - RNA, 22 nt, Human
augugagcuggaugaauuuaua

SEQ ID NO: 164957 - RNA, 22 nt, Human
uuuacaaggcaguuauuuuccu

SEQ ID NO: 164958 - RNA, 22 nt, Human
uauauauaugcaccacaugugu

SEQ ID NO: 164959 - RNA, 22 nt, Human
agagaaauguacuagucuaacu

SEQ ID NO: 164960 - RNA, 22 nt, Human
uuauuuuuguaacacuguauag

SEQ ID NO: 164961 - RNA, 22 nt, Human
cuugucuaguuccuggugaugu

SEQ ID NO: 164962 - RNA, 22 nt, Human
uggaguuuuaaucuguacagaa

SEQ ID NO: 164963 - RNA, 22 nt, Human
gccucucuggcaaagcggugau

SEQ ID NO: 164964 - RNA, 22 nt, Human
caaggaaaacagaugaucaaca

SEQ ID NO: 164965 - RNA, 22 nt, Human
ucuucaucucuaaaaugggaac

SEQ ID NO: 164966 - RNA, 20 nt, Human
gaacauaaauaacucuuuac

SEQ ID NO: 164967 - RNA, 22 nt, Human
ccaggcucaccuggagccccug

SEQ ID NO: 164968 - RNA, 22 nt, Human
uuaauaaauugugguaccagag

SEQ ID NO: 164969 - RNA, 20 nt, Human
gcucuucuccgggucugccu

SEQ ID NO: 164970 - RNA, 22 nt, Human
gggggagcuacaggucccuugg

SEQ ID NO: 164971 - RNA, 17 nt, Human
ucuguguccgcucaguc

SEQ ID NO: 164972 - RNA, 22 nt, Human
acauuccugaagguaaugagaa

SEQ ID NO: 164973 - RNA, 22 nt, Human
ggugucuuugauguugggcuga

SEQ ID NO: 164974 - RNA, 22 nt, Human
gcgcgccugccucccgcggugc

SEQ ID NO: 164975 - RNA, 22 nt, Human
uuuugccuauuguaucaucgua

SEQ ID NO: 164976 - RNA, 22 nt, Human
auucuuuauuuucuguacuugc

SEQ ID NO: 164977 - RNA, 22 nt, Human
cuuuuuuucuccauauuucugg

SEQ ID NO: 164978 - RNA, 22 nt, Human
acauaaaccccccuuccccagg

SEQ ID NO: 164979 - RNA, 20 nt, Human
uacaauauucccacuuugcu

SEQ ID NO: 164980 - RNA, 22 nt, Human
ugagauguaauguaguacuuug

SEQ ID NO: 164981 - RNA, 22 nt, Human
agauauucugccuaacagguuu

SEQ ID NO: 164982 - RNA, 22 nt, Human
uucuccaccugcuccucccacc

SEQ ID NO: 164983 - RNA, 22 nt, Human
aauucuguugguuagaguugga

SEQ ID NO: 164984 - RNA, 22 nt, Human
gcacagauaaucugccuuacca

SEQ ID NO: 164985 - RNA, 22 nt, Human
uucugggguaagcacugaggau

SEQ ID NO: 164986 - RNA, 22 nt, Human
ucagcucucucuuggugaucuc

SEQ ID NO: 164987 - RNA, 22 nt, Human
ugagacucuccugugcagccuc

SEQ ID NO: 164988 - RNA, 22 nt, Human
uucauggauuugugaaauuuag

SEQ ID NO: 164989 - RNA, 22 nt, Human
gucuuuguaguuuuaauuugag

SEQ ID NO: 164990 - RNA, 23 nt, Human
aggcagaguccuggggcacagcc

SEQ ID NO: 164991 - RNA, 22 nt, Human
aaagacaauaauucucucuagc

SEQ ID NO: 164992 - RNA, 20 nt, Human
ccuuguggaugucuuuuuug

SEQ ID NO: 164993 - RNA, 22 nt, Human
ccugaagaugguugauccccuu

SEQ ID NO: 164994 - RNA, 22 nt, Human
ugaauucaaacuuuuuaacaag

SEQ ID NO: 164995 - RNA, 22 nt, Human
gcugcagggagcuggaaggcuc

SEQ ID NO: 164996 - RNA, 22 nt, Human
augggagggugaggaggcagcu

SEQ ID NO: 164997 - RNA, 22 nt, Human
uagggaggguuugggguggagg

SEQ ID NO: 164998 - RNA, 22 nt, Human
auucuuuucucuaaaugaugaa

SEQ ID NO: 164999 - RNA, 22 nt, Human
cagaaguugcuugagagagagc

SEQ ID NO: 165000 - RNA, 22 nt, Human
ugacuagggauauuuucuuucc

SEQ ID NO: 165001 - RNA, 22 nt, Human
uggcgcgcucgcucucgcugag

SEQ ID NO: 165002 - RNA, 22 nt, Human
agcaagggucucucauggcuug

SEQ ID NO: 165003 - RNA, 23 nt, Human
ucucacucauucuccucugucca

SEQ ID NO: 165004 - RNA, 22 nt, Human
cacuguugagcaauguacagug

SEQ ID NO: 165005 - RNA, 22 nt, Human
ccagcaggagacuagcaacaua

SEQ ID NO: 165006 - RNA, 22 nt, Human
uauuaaaagagaaaaagccacc

SEQ ID NO: 165007 - RNA, 22 nt, Human
caguggacacuuccucuacaau

SEQ ID NO: 165008 - RNA, 22 nt, Human
ggauaauguauuuuaaaauggg

SEQ ID NO: 165009 - RNA, 22 nt, Human
ccugccagaaaagagggaguuc

SEQ ID NO: 165010 - RNA, 22 nt, Human
ugaaaaauauuuuuagaaauaa

SEQ ID NO: 165011 - RNA, 22 nt, Human
ggugaguagaaguaguuggcuu

SEQ ID NO: 165012 - RNA, 22 nt, Human
ucauuguuucugcuuuucauga

SEQ ID NO: 165013 - RNA, 22 nt, Human
aagcccucagagccucuuugac

SEQ ID NO: 165014 - RNA, 22 nt, Human
aaauagucagaaaucaacgugc

SEQ ID NO: 165015 - RNA, 22 nt, Human
agauggaguccugaagccagaa

SEQ ID NO: 165016 - RNA, 22 nt, Human
uugaaaaaugcccagcagacaa

SEQ ID NO: 165017 - RNA, 22 nt, Human
ucugaggacagugcugugccug

SEQ ID NO: 165018 - RNA, 20 nt, Human
uucucugcagcaggcggccc

SEQ ID NO: 165019 - RNA, 22 nt, Human
cugauagagcauuagugugaga

SEQ ID NO: 165020 - RNA, 22 nt, Human
uaggauugguguauguagguuu

SEQ ID NO: 165021 - RNA, 22 nt, Human
auuugccaguuacucacaccac

SEQ ID NO: 165022 - RNA, 22 nt, Human
aaauauauccuucuguccugcc

SEQ ID NO: 165023 - RNA, 22 nt, Human
auauauguauauaugugugugu

SEQ ID NO: 165024 - RNA, 22 nt, Human
uuuugaauaauucagaaacagc

SEQ ID NO: 165025 - RNA, 22 nt, Human
uugcuuucuuuguagguuuucc

SEQ ID NO: 165026 - RNA, 20 nt, Human
acacaccugcucagacugag

SEQ ID NO: 165027 - RNA, 22 nt, Human
uggaagugucagcaggcugguu

SEQ ID NO: 165028 - RNA, 22 nt, Human
cauggcaggugcagauucugug

SEQ ID NO: 165029 - RNA, 22 nt, Human
cuggagaacucugugcuucacu

SEQ ID NO: 165030 - RNA, 22 nt, Human
acuuuuccuggguagcuccugg

SEQ ID NO: 165031 - RNA, 22 nt, Human
uuuauaauuacguaaaauauuu

SEQ ID NO: 165032 - RNA, 22 nt, Human
ggcugugguggacgcgggaaac

SEQ ID NO: 165033 - RNA, 22 nt, Human
acagcugguugaaggggaccaa

SEQ ID NO: 165034 - RNA, 20 nt, Human
acuagaaagucacugggggg

SEQ ID NO: 165035 - RNA, 22 nt, Human
uucugugacuccucagagauuu

SEQ ID NO: 165036 - RNA, 22 nt, Human
ugcggaaggcagcgcagggugg

SEQ ID NO: 165037 - RNA, 22 nt, Human
uuuaaaauguuuuauuuauuua

SEQ ID NO: 165038 - RNA, 22 nt, Human
ucuucuuuccuuuugugcauuu

SEQ ID NO: 165039 - RNA, 22 nt, Human
aagcucagcugguggugauugc

SEQ ID NO: 165040 - RNA, 22 nt, Human
aacccugaacuuaguucuagga

SEQ ID NO: 165041 - RNA, 22 nt, Human
uuuuuaaaauuaggacggcacg

SEQ ID NO: 165042 - RNA, 22 nt, Human
gaggaagucuuaucuggaugca

SEQ ID NO: 165043 - RNA, 22 nt, Human
agcggccucgcugccugcucag

SEQ ID NO: 165044 - RNA, 22 nt, Human
gggcgcgccaggagcugcgcgg

SEQ ID NO: 165045 - RNA, 22 nt, Human
aaacccaggguuuugucuuccc

SEQ ID NO: 165046 - RNA, 22 nt, Human
gugggugauacugccgugggag

SEQ ID NO: 165047 - RNA, 22 nt, Human
caccucagagcuccuucuucuc

SEQ ID NO: 165048 - RNA, 22 nt, Human
gaaccauuuaauggagaugcuc

SEQ ID NO: 165049 - RNA, 20 nt, Human
agugauuuguuaguacauug

SEQ ID NO: 165050 - RNA, 22 nt, Human
uuaacauuguccuuagcagauu

SEQ ID NO: 165051 - RNA, 22 nt, Human
uuuguacuuucuaauguauuua

SEQ ID NO: 165052 - RNA, 22 nt, Human
uuuaaaacagcauuuaaaaggu

SEQ ID NO: 165053 - RNA, 22 nt, Human
ggacuggugaagccuucggaga

SEQ ID NO: 165054 - RNA, 22 nt, Human
caggccgccacugcagcagcug

SEQ ID NO: 165055 - RNA, 22 nt, Human
ucacucuuuaucuuuuaugucu

SEQ ID NO: 165056 - RNA, 22 nt, Human
gcggcccggguccccagcagca

SEQ ID NO: 165057 - RNA, 22 nt, Human
aggccgagaugacagagccacu

SEQ ID NO: 165058 - RNA, 22 nt, Human
gcugucccccaaagaugcuccu

SEQ ID NO: 165059 - RNA, 22 nt, Human
uggcucagcgcggccuggucuu

SEQ ID NO: 165060 - RNA, 22 nt, Human
cccagaggcugaguugggagca

SEQ ID NO: 165061 - RNA, 22 nt, Human
agcggcgcgucuccgagcugga

SEQ ID NO: 165062 - RNA, 22 nt, Human
cagcccuugcgacacccuggcu

SEQ ID NO: 165063 - RNA, 17 nt, Human
ccacuagauagguugug

SEQ ID NO: 165064 - RNA, 22 nt, Human
guucuacaugacacucaacauu

SEQ ID NO: 165065 - RNA, 22 nt, Human
ggggcgaguguggaccgcagcc

SEQ ID NO: 165066 - RNA, 22 nt, Human
auagaaauagacaaugcaaaga

SEQ ID NO: 165067 - RNA, 22 nt, Human
gugggagggaguccugggagca

SEQ ID NO: 165068 - RNA, 22 nt, Human
auucuuauaaaaaguguugacu

SEQ ID NO: 165069 - RNA, 22 nt, Human
aaugagauggaggacucuuaau

SEQ ID NO: 165070 - RNA, 21 nt, Human
ugcuuucugugcuuuuucugc

SEQ ID NO: 165071 - RNA, 22 nt, Human
uagcugucauuggaucagaagg

SEQ ID NO: 165072 - RNA, 22 nt, Human
ccaggaguccgugggucuugag

SEQ ID NO: 165073 - RNA, 22 nt, Human
agcaggaaggcuagaagcagga

SEQ ID NO: 165074 - RNA, 22 nt, Human
acuggagcccguggaggcgcag

SEQ ID NO: 165075 - RNA, 22 nt, Human
auuucauuuuagaaauaagugu

SEQ ID NO: 165076 - RNA, 22 nt, Human
guuuggguggcuagagaaagaa

SEQ ID NO: 165077 - RNA, 22 nt, Human
ccucccuucccggcauggcucu

SEQ ID NO: 165078 - RNA, 22 nt, Human
uuuucacugacuuggucuggaa

SEQ ID NO: 165079 - RNA, 20 nt, Human
cagagccaggguuuuguuuu

SEQ ID NO: 165080 - RNA, 22 nt, Human
gccugggccgggcgcggccccc

SEQ ID NO: 165081 - RNA, 22 nt, Human
gaacauuucugcagaugucuga

SEQ ID NO: 165082 - RNA, 22 nt, Human
uauaagaaacaaggcaaauuuu

SEQ ID NO: 165083 - RNA, 22 nt, Human
aaugauuuucugcaaacaguga

SEQ ID NO: 165084 - RNA, 22 nt, Human
guuguuuuuguuaaaacaguga

SEQ ID NO: 165085 - RNA, 22 nt, Human
acagcuggaggucugugagcac

SEQ ID NO: 165086 - RNA, 22 nt, Human
ggcccgcgcugcuggcgcgcca

SEQ ID NO: 165087 - RNA, 22 nt, Human
uuucucuuguauuugaaucacu

SEQ ID NO: 165088 - RNA, 22 nt, Human
agggagucuggccgucggcugg

SEQ ID NO: 165089 - RNA, 22 nt, Human
ccagccugccaagcccagcccu

SEQ ID NO: 165090 - RNA, 22 nt, Human
ucccuguggauuaaggagaugu

SEQ ID NO: 165091 - RNA, 22 nt, Human
ggcagggagagcgccgccaugc

SEQ ID NO: 165092 - RNA, 22 nt, Human
gaggagcugggucagggagaca

SEQ ID NO: 165093 - RNA, 22 nt, Human
ccuucugcuggucaucccagug

SEQ ID NO: 165094 - RNA, 21 nt, Human
uuucauuaguacaucaauuug

SEQ ID NO: 165095 - RNA, 18 nt, Human
acuguccucaggacguug

SEQ ID NO: 165096 - RNA, 22 nt, Human
gagcgcacagaaggaagcagcc

SEQ ID NO: 165097 - RNA, 22 nt, Human
uguuuuuauucuuaauguuuca

SEQ ID NO: 165098 - RNA, 22 nt, Human
aagugugugugcgcaugugcau

SEQ ID NO: 165099 - RNA, 22 nt, Human
agucacuguucugucaugucaa

SEQ ID NO: 165100 - RNA, 22 nt, Human
auucuucauguugaagcuguca

SEQ ID NO: 165101 - RNA, 22 nt, Human
uucuugucuuuguuauguagga

SEQ ID NO: 165102 - RNA, 22 nt, Human
ugggggagggagaguugauggg

SEQ ID NO: 165103 - RNA, 22 nt, Human
ccugcccaucccaccccagcau

SEQ ID NO: 165104 - RNA, 22 nt, Human
uccauuuacuauucucauaucg

SEQ ID NO: 165105 - RNA, 17 nt, Human
auucaugaacauguccu

SEQ ID NO: 165106 - RNA, 22 nt, Human
ggaggaagagaccagggggcuu

SEQ ID NO: 165107 - RNA, 23 nt, Human
agauaaggaagcauuugagccag

SEQ ID NO: 165108 - RNA, 22 nt, Human
uggagccugauggauaggaacg

SEQ ID NO: 165109 - RNA, 22 nt, Human
cgccgccgccugcccgcgcccc

SEQ ID NO: 165110 - RNA, 22 nt, Human
gagccucaggguuuuguugaca

SEQ ID NO: 165111 - RNA, 22 nt, Human
cuguccauuuucgugccuccuu

SEQ ID NO: 165112 - RNA, 22 nt, Human
ggcuuguccuucugguugucuu

SEQ ID NO: 165113 - RNA, 22 nt, Human
cacaugugugugccuacaugca

SEQ ID NO: 165114 - RNA, 22 nt, Human
aggcaacagacaggcuugguuc

SEQ ID NO: 165115 - RNA, 22 nt, Human
ggacauaguugcuauggagagu

SEQ ID NO: 165116 - RNA, 22 nt, Human
cucagaagaacaaaggcucuac

SEQ ID NO: 165117 - RNA, 22 nt, Human
gggggcugugugcccgcucccc

SEQ ID NO: 165118 - RNA, 22 nt, Human
gggcugagagcuggaaucugag

SEQ ID NO: 165119 - RNA, 22 nt, Human
aaaggaaacuaugaaucucugg

SEQ ID NO: 165120 - RNA, 22 nt, Human
cugaccucuaaguaacagagaa

SEQ ID NO: 165121 - RNA, 22 nt, Human
aaaauauguugagauacugaaa

SEQ ID NO: 165122 - RNA, 22 nt, Human
aaaauauuuaucuagcucuuaa

SEQ ID NO: 165123 - RNA, 22 nt, Human
acauuuccaaagaugccaguca

SEQ ID NO: 165124 - RNA, 22 nt, Human
agggggaauccugcuuauggau

SEQ ID NO: 165125 - RNA, 22 nt, Human
aaaugcuuuaauugaguucaug

SEQ ID NO: 165126 - RNA, 22 nt, Human
cgaggagguccaggagcaguag

SEQ ID NO: 165127 - RNA, 22 nt, Human
ggcagcgcuuggcugcucgaca

SEQ ID NO: 165128 - RNA, 22 nt, Human
auagagcuggggaagaagcugg

SEQ ID NO: 165129 - RNA, 22 nt, Human
aggcaguguggagggcuguugc

SEQ ID NO: 165130 - RNA, 22 nt, Human
auggaggaugugcagcaugggc

SEQ ID NO: 165131 - RNA, 22 nt, Human
uaagggagcagaagcugugaaa

SEQ ID NO: 165132 - RNA, 22 nt, Human
uuguuuuaguagaaguuacaug

SEQ ID NO: 165133 - RNA, 21 nt, Human
gccgugcgccuccaggcgcgc

SEQ ID NO: 165134 - RNA, 22 nt, Human
gcugcuacagagcuggaggggg

SEQ ID NO: 165135 - RNA, 22 nt, Human
auuuuuaucuaaaauccacuuu

SEQ ID NO: 165136 - RNA, 22 nt, Human
guucuucagauuccauuucagu

SEQ ID NO: 165137 - RNA, 22 nt, Human
ugcugcacuuauggcucugagg

SEQ ID NO: 165138 - RNA, 22 nt, Human
uugaaaauuaauagguguacaa

SEQ ID NO: 165139 - RNA, 22 nt, Human
auagggaggcggagggagcugg

SEQ ID NO: 165140 - RNA, 22 nt, Human
caaaaaauccauagaaagaggu

SEQ ID NO: 165141 - RNA, 22 nt, Human
aagugaaaaaagucaguacuga

SEQ ID NO: 165142 - RNA, 22 nt, Human
uuuucauuguuaguuucuccuu

SEQ ID NO: 165143 - RNA, 22 nt, Human
gcucagagaaaacuggggcuug

SEQ ID NO: 165144 - RNA, 22 nt, Human
cauggcggcgcucucccugccu

SEQ ID NO: 165145 - RNA, 22 nt, Human
cuccuuugagcaaaucuuugau

SEQ ID NO: 165146 - RNA, 22 nt, Human
ucuggaggucucagggcgggaa

SEQ ID NO: 165147 - RNA, 18 nt, Human
uucucucuggauaguagu

SEQ ID NO: 165148 - RNA, 20 nt, Human
agaaggagagaugaggcaaa

SEQ ID NO: 165149 - RNA, 22 nt, Human
ucgagcgcucccugugcucucg

SEQ ID NO: 165150 - RNA, 22 nt, Human
aaaauacuaggaaaauaaauca

SEQ ID NO: 165151 - RNA, 21 nt, Human
ugagcccaaagcuguauuggu

SEQ ID NO: 165152 - RNA, 22 nt, Human
uuucuaaaauuacugcagucgg

SEQ ID NO: 165153 - RNA, 22 nt, Human
ucuucaugaaauugauugcuua

SEQ ID NO: 165154 - RNA, 22 nt, Human
auuuuuuuuccugucucuuuca

SEQ ID NO: 165155 - RNA, 22 nt, Human
uuuguuuccagccuuuugucuu

SEQ ID NO: 165156 - RNA, 22 nt, Human
agucaccuacagcucaugcuuc

SEQ ID NO: 165157 - RNA, 22 nt, Human
ggagagcuagugagcuggaggu

SEQ ID NO: 165158 - RNA, 22 nt, Human
uggguauauauguugcuacaga

SEQ ID NO: 165159 - RNA, 22 nt, Human
uuuuuaaaagaugauuuaauga

SEQ ID NO: 165160 - RNA, 22 nt, Human
cggggcuggcguuagggaggca

SEQ ID NO: 165161 - RNA, 22 nt, Human
aggggcagccucacaauccucu

SEQ ID NO: 165162 - RNA, 22 nt, Human
guuuuguagucuggagacuguc

SEQ ID NO: 165163 - RNA, 22 nt, Human
uaaagugaaguucagaauggcu

SEQ ID NO: 165164 - RNA, 22 nt, Human
gggcuguggggccugcagaagg

SEQ ID NO: 165165 - RNA, 22 nt, Human
uauaaagaccuuauccuucaua

SEQ ID NO: 165166 - RNA, 19 nt, Human
agugaacuccauaucaggu

SEQ ID NO: 165167 - RNA, 21 nt, Human
gcagcucaggauauagacuug

SEQ ID NO: 165168 - RNA, 22 nt, Human
ucacugaacucucauagagaaa

SEQ ID NO: 165169 - RNA, 22 nt, Human
uuaucuuuuaaaaacacuugug

SEQ ID NO: 165170 - RNA, 22 nt, Human
cgcuggagagcaagugcgugca

SEQ ID NO: 165171 - RNA, 22 nt, Human
agacuagguauagguaauaacu

SEQ ID NO: 165172 - RNA, 22 nt, Human
gcgcggcgcggguccucggccu

SEQ ID NO: 165173 - RNA, 22 nt, Human
uucuuuuaauagagauccugug

SEQ ID NO: 165174 - RNA, 22 nt, Human
uggaaaauuuagaaagauuuau

SEQ ID NO: 165175 - RNA, 22 nt, Human
acucacuguuuugaaauugaac

SEQ ID NO: 165176 - RNA, 22 nt, Human
ugaggaugagaaggaagagaag

SEQ ID NO: 165177 - RNA, 22 nt, Human
acucauuuggauuuuggaguuu

SEQ ID NO: 165178 - RNA, 22 nt, Human
agcuccucagauuuggguggcg

SEQ ID NO: 165179 - RNA, 20 nt, Human
auucuuguuccauuucccag

SEQ ID NO: 165180 - RNA, 22 nt, Human
gcgccgacccucccugccggac

SEQ ID NO: 165181 - RNA, 22 nt, Human
cuucuuaaaguugucacagcug

SEQ ID NO: 165182 - RNA, 22 nt, Human
ggagccaguuuagaccucaguu

SEQ ID NO: 165183 - RNA, 22 nt, Human
agagggagagauuggcaaucag

SEQ ID NO: 165184 - RNA, 22 nt, Human
aagcucuuuccacuaaaccacu

SEQ ID NO: 165185 - RNA, 22 nt, Human
uggaagaucugguguagcuccu

SEQ ID NO: 165186 - RNA, 21 nt, Human
acauccaggguccucacugcc

SEQ ID NO: 165187 - RNA, 22 nt, Human
aaauauagugacacuuauaguc

SEQ ID NO: 165188 - RNA, 22 nt, Human
guuaaaaugauuugugauuuau

SEQ ID NO: 165189 - RNA, 22 nt, Human
ucuugccuuuucuagcuucuag

SEQ ID NO: 165190 - RNA, 22 nt, Human
aucauguauauuuuugcuauua

SEQ ID NO: 165191 - RNA, 22 nt, Human
gauguuggugcauucacuucug

SEQ ID NO: 165192 - RNA, 22 nt, Human
gcucucuggccugggaggagga

SEQ ID NO: 165193 - RNA, 22 nt, Human
aacgagcugggggggccggggg

SEQ ID NO: 165194 - RNA, 22 nt, Human
guggaaggaauuaacagacuag

SEQ ID NO: 165195 - RNA, 22 nt, Human
acuauauaaugcacacaguaua

SEQ ID NO: 165196 - RNA, 22 nt, Human
uuguuauuauuauuuucguucu

SEQ ID NO: 165197 - RNA, 22 nt, Human
ugaggaagugguuguaugguuu

SEQ ID NO: 165198 - RNA, 18 nt, Human
aggcuggggaucacaggg

SEQ ID NO: 165199 - RNA, 22 nt, Human
ggggaggguuuggaugagaguc

SEQ ID NO: 165200 - RNA, 22 nt, Human
auguguuuugaccccugcuaaa

SEQ ID NO: 165201 - RNA, 19 nt, Human
ugcagcuguaugagcuuaa

SEQ ID NO: 165202 - RNA, 23 nt, Human
aaguggugacugugcuacugaga

SEQ ID NO: 165203 - RNA, 19 nt, Human
auguuuccauuucuggaua

SEQ ID NO: 165204 - RNA, 17 nt, Human
ugguucuuuuccugacc

SEQ ID NO: 165205 - RNA, 22 nt, Human
ucagcucacaauguugagaaag

SEQ ID NO: 165206 - RNA, 22 nt, Human
uaauuccacacucccgcaagcg

SEQ ID NO: 165207 - RNA, 22 nt, Human
cagaccuggaaaacaggcuugc

SEQ ID NO: 165208 - RNA, 22 nt, Human
ggcaaggaagaaagcagaaguu

SEQ ID NO: 165209 - RNA, 22 nt, Human
caauggagccaagaggaggaaa

SEQ ID NO: 165210 - RNA, 22 nt, Human
acucugcaguaaggaauuguuu

SEQ ID NO: 165211 - RNA, 22 nt, Human
aauuaaauguuugguuugagcu

SEQ ID NO: 165212 - RNA, 20 nt, Human
accccuccccacuccucgcc

SEQ ID NO: 165213 - RNA, 22 nt, Human
uuccgcuuucaauggcuuggcu

SEQ ID NO: 165214 - RNA, 22 nt, Human
uauguggcaggugggagaucag

SEQ ID NO: 165215 - RNA, 22 nt, Human
agauaaaucauuuauuaagcgg

SEQ ID NO: 165216 - RNA, 22 nt, Human
uaccuggauaaauguacaaccg

SEQ ID NO: 165217 - RNA, 22 nt, Human
ggccugcuaccagcugugaccu

SEQ ID NO: 165218 - RNA, 22 nt, Human
agguggcuaugaggaugcaguc

SEQ ID NO: 165219 - RNA, 22 nt, Human
uuuuaaauaaacuacacugauu

SEQ ID NO: 165220 - RNA, 22 nt, Human
aaaauauucuauaucaaagaua

SEQ ID NO: 165221 - RNA, 22 nt, Human
ggcagaggagcuggaaacaugg

SEQ ID NO: 165222 - RNA, 22 nt, Human
agggcaguuaugaaugucucca

SEQ ID NO: 165223 - RNA, 22 nt, Human
acaggaaugaagaugagagagu

SEQ ID NO: 165224 - RNA, 22 nt, Human
ugagggaggggaaugugugcag

SEQ ID NO: 165225 - RNA, 22 nt, Human
uuucuaaaaccagaguuuauaa

SEQ ID NO: 165226 - RNA, 22 nt, Human
auuuuauuuugggaucuuuuua

SEQ ID NO: 165227 - RNA, 22 nt, Human
ccccauggaaaacccaccuagg

SEQ ID NO: 165228 - RNA, 22 nt, Human
gccaggccuggguggagcgcuc

SEQ ID NO: 165229 - RNA, 22 nt, Human
uauuuuuacuguuugaugauuc

SEQ ID NO: 165230 - RNA, 22 nt, Human
agcgcccguugagucgcgcggu

SEQ ID NO: 165231 - RNA, 22 nt, Human
uugugugugcccaccuguggcc

SEQ ID NO: 165232 - RNA, 21 nt, Human
uaagaacauuaucuucuuccu

SEQ ID NO: 165233 - RNA, 22 nt, Human
uuaggggcuuaggcagaguuug

SEQ ID NO: 165234 - RNA, 22 nt, Human
agucugugguccucuguaucuc

SEQ ID NO: 165235 - RNA, 22 nt, Human
auggugaugaugaugaugauaa

SEQ ID NO: 165236 - RNA, 22 nt, Human
uuuuccuucuuccugccuugcc

SEQ ID NO: 165237 - RNA, 22 nt, Human
gccugggguuugcggggcugca

SEQ ID NO: 165238 - RNA, 22 nt, Human
cguggcaguagagcuggaacuu

SEQ ID NO: 165239 - RNA, 22 nt, Human
uguugaagcaccucugucuuuc

SEQ ID NO: 165240 - RNA, 22 nt, Human
uccagcugugcuccaggaggug

SEQ ID NO: 165241 - RNA, 22 nt, Human
cuguuucucugccugcacacau

SEQ ID NO: 165242 - RNA, 22 nt, Human
gaggcaggaagggaggguugug

SEQ ID NO: 165243 - RNA, 22 nt, Human
agaugaugugugucuucagcua

SEQ ID NO: 165244 - RNA, 22 nt, Human
aacugcauaagcuucgggaccu

SEQ ID NO: 165245 - RNA, 22 nt, Human
aauauuuugggacugaggaauu

SEQ ID NO: 165246 - RNA, 21 nt, Human
acuuccacaucacugaguaga

SEQ ID NO: 165247 - RNA, 20 nt, Human
uuggagaucacguguccagg

SEQ ID NO: 165248 - RNA, 20 nt, Human
cauuccaugcaucuuggucc

SEQ ID NO: 165249 - RNA, 22 nt, Human
auuuccagcagcauauuugucu

SEQ ID NO: 165250 - RNA, 22 nt, Human
gaggcgcgcugcgagggcgcgg

SEQ ID NO: 165251 - RNA, 22 nt, Human
cuauauucuggaauguccauuu

SEQ ID NO: 165252 - RNA, 22 nt, Human
caucuaaaauaagccuuauaau

SEQ ID NO: 165253 - RNA, 22 nt, Human
uccucagcaagacgcuggcagc

SEQ ID NO: 165254 - RNA, 22 nt, Human
ggagauggucacagguaaacau

SEQ ID NO: 165255 - RNA, 22 nt, Human
aacuagugucuguaugauaagg

SEQ ID NO: 165256 - RNA, 22 nt, Human
gggcagagagcuggaacuccuu

SEQ ID NO: 165257 - RNA, 22 nt, Human
ucucucucucuuccagcauguu

SEQ ID NO: 165258 - RNA, 22 nt, Human
cuauguuucagauauauauaua

SEQ ID NO: 165259 - RNA, 22 nt, Human
gaguucuagauguauuauuaau

SEQ ID NO: 165260 - RNA, 23 nt, Human
gugugccuuuaucuucuguacuc

SEQ ID NO: 165261 - RNA, 23 nt, Human
uugcuuuugccccaaaagaguua

SEQ ID NO: 165262 - RNA, 22 nt, Human
cacuaggauccuucuucuucuu

SEQ ID NO: 165263 - RNA, 22 nt, Human
uuauuuaagaucuuaauauaua

SEQ ID NO: 165264 - RNA, 22 nt, Human
ucccaaaacuugaagcaagccu

SEQ ID NO: 165265 - RNA, 22 nt, Human
uugccaggggacaucuggagcc

SEQ ID NO: 165266 - RNA, 22 nt, Human
gaggagggagcuggaagcucuu

SEQ ID NO: 165267 - RNA, 22 nt, Human
uccaaggacuaaauucuagauu

SEQ ID NO: 165268 - RNA, 19 nt, Human
auagcagaagucauuuuca

SEQ ID NO: 165269 - RNA, 22 nt, Human
auaugcacauguacauguauau

SEQ ID NO: 165270 - RNA, 22 nt, Human
uuauuuaaaauguagguuggga

SEQ ID NO: 165271 - RNA, 22 nt, Human
agcuagugcaguucucaaaugg

SEQ ID NO: 165272 - RNA, 22 nt, Human
cuaggaugcuguaauggugucu

SEQ ID NO: 165273 - RNA, 22 nt, Human
gugcugggaggcccaggaugga

SEQ ID NO: 165274 - RNA, 22 nt, Human
aaucauaacaaaagcaauuaua

SEQ ID NO: 165275 - RNA, 22 nt, Human
uggcucacaggaggcagaggug

SEQ ID NO: 165276 - RNA, 22 nt, Human
aaauauuagacauaccuggaga

SEQ ID NO: 165277 - RNA, 22 nt, Human
auuugcauguuuauuucuuaga

SEQ ID NO: 165278 - RNA, 20 nt, Human
gacaugagggagcaaagagc

SEQ ID NO: 165279 - RNA, 22 nt, Human
ucccaaguguuuggcgaggaga

SEQ ID NO: 165280 - RNA, 22 nt, Human
aguuuccacuggagacacugug

SEQ ID NO: 165281 - RNA, 22 nt, Human
acuuguaaaauagagauaggga

SEQ ID NO: 165282 - RNA, 23 nt, Human
gaugauggcaacuacauccggug

SEQ ID NO: 165283 - RNA, 22 nt, Human
ucucugaccuccaccccaggag

SEQ ID NO: 165284 - RNA, 22 nt, Human
ugucuuuuaaaaauguguaaaa

SEQ ID NO: 165285 - RNA, 22 nt, Human
cgaccccugaaaauggcagcca

SEQ ID NO: 165286 - RNA, 22 nt, Human
cagcuggaggagcagcuuccag

SEQ ID NO: 165287 - RNA, 22 nt, Human
ggggaagugguggggcuccgag

SEQ ID NO: 165288 - RNA, 22 nt, Human
ucuucaaauacagucauauuga

SEQ ID NO: 165289 - RNA, 22 nt, Human
uauuuuuuuaacauuuauugua

SEQ ID NO: 165290 - RNA, 22 nt, Human
ucagagccagacacacagcaga

SEQ ID NO: 165291 - RNA, 20 nt, Human
ucagugggaaagugagagug

SEQ ID NO: 165292 - RNA, 22 nt, Human
uggcucaguaaucgagucuccu

SEQ ID NO: 165293 - RNA, 21 nt, Human
augcgcgguggagugagcgaa

SEQ ID NO: 165294 - RNA, 22 nt, Human
ugcugcacccuucauuuuccca

SEQ ID NO: 165295 - RNA, 22 nt, Human
caauccccaggucccagaacag

SEQ ID NO: 165296 - RNA, 22 nt, Human
ggcaggaaguaaggaugcuaca

SEQ ID NO: 165297 - RNA, 22 nt, Human
uuuuccuuagaaauacauugau

SEQ ID NO: 165298 - RNA, 22 nt, Human
agugccaucuuuaacuguccca

SEQ ID NO: 165299 - RNA, 22 nt, Human
gcccagccucagggcaucagcu

SEQ ID NO: 165300 - RNA, 22 nt, Human
acuuuaaauaucauuugguagg

SEQ ID NO: 165301 - RNA, 22 nt, Human
uggcucuucucaagcauuggcu

SEQ ID NO: 165302 - RNA, 22 nt, Human
ggaggaugaggguggugguguu

SEQ ID NO: 165303 - RNA, 22 nt, Human
uguaaauucuauacacuuaaaa

SEQ ID NO: 165304 - RNA, 19 nt, Human
gauauugagcugagaauuc

SEQ ID NO: 165305 - RNA, 20 nt, Human
acacagccuagaguuuggcu

SEQ ID NO: 165306 - RNA, 17 nt, Human
ugaggcugucucccugg

SEQ ID NO: 165307 - RNA, 22 nt, Human
ucggcuccucccuggaaagggg

SEQ ID NO: 165308 - RNA, 22 nt, Human
uuuuuuuaaguuuugauuuuag

SEQ ID NO: 165309 - RNA, 22 nt, Human
uucuaauauuaugauuucuaag

SEQ ID NO: 165310 - RNA, 22 nt, Human
ugaaagcuggcucugcagagug

SEQ ID NO: 165311 - RNA, 22 nt, Human
ccccccaaauguuacagugacc

SEQ ID NO: 165312 - RNA, 22 nt, Human
aaauucuuccaggaggaaauac

SEQ ID NO: 165313 - RNA, 22 nt, Human
gcuguguaugaugcaggcaccu

SEQ ID NO: 165314 - RNA, 22 nt, Human
guguugaugugucuguauucua

SEQ ID NO: 165315 - RNA, 21 nt, Human
caguucuaagugucaucuuuu

SEQ ID NO: 165316 - RNA, 22 nt, Human
ucugcaugccucaggaggccug

SEQ ID NO: 165317 - RNA, 22 nt, Human
ggcugugaaguacguugaaggu

SEQ ID NO: 165318 - RNA, 20 nt, Human
gccaaggaggagaaacaggc

SEQ ID NO: 165319 - RNA, 22 nt, Human
uauauuaaagugcuuugcagug

SEQ ID NO: 165320 - RNA, 20 nt, Human
uuuuuuaaauagagcuguug

SEQ ID NO: 165321 - RNA, 22 nt, Human
aggggcugugucauuuguccua

SEQ ID NO: 165322 - RNA, 22 nt, Human
agggcugggcuuggcaggcugg

SEQ ID NO: 165323 - RNA, 22 nt, Human
aauaugaugccaaauugcuaca

SEQ ID NO: 165324 - RNA, 22 nt, Human
ugguucuagaugagaugaugag

SEQ ID NO: 165325 - RNA, 22 nt, Human
uucauagaagggaguuuuuccu

SEQ ID NO: 165326 - RNA, 22 nt, Human
guaauucugugugaaucuauua

SEQ ID NO: 165327 - RNA, 22 nt, Human
aggggcagaggaugauggaaga

SEQ ID NO: 165328 - RNA, 22 nt, Human
aaucacuucuuugucuucuuca

SEQ ID NO: 165329 - RNA, 22 nt, Human
ggugcuucgauagguguccaua

SEQ ID NO: 165330 - RNA, 22 nt, Human
cuuggggauuuuaaagaccucu

SEQ ID NO: 165331 - RNA, 22 nt, Human
auauuuuugcagaauuuuucgu

SEQ ID NO: 165332 - RNA, 22 nt, Human
gugugucucaguugcuccgaag

SEQ ID NO: 165333 - RNA, 22 nt, Human
ccauuuggccauucaguuguuc

SEQ ID NO: 165334 - RNA, 22 nt, Human
aggguggaggacaggccaguga

SEQ ID NO: 165335 - RNA, 22 nt, Human
cagggggacuuguuagguuuua

SEQ ID NO: 165336 - RNA, 23 nt, Human
uucuuuccuuaucccauuuacuu

SEQ ID NO: 165337 - RNA, 22 nt, Human
uggagagcaaugaggggcaggc

SEQ ID NO: 165338 - RNA, 22 nt, Human
cuccucccagcccaggcgccac

SEQ ID NO: 165339 - RNA, 22 nt, Human
gccugccucugacuggggcuga

SEQ ID NO: 165340 - RNA, 22 nt, Human
gggggacagugugccuggugug

SEQ ID NO: 165341 - RNA, 22 nt, Human
auaaaaauguuuuuguguggua

SEQ ID NO: 165342 - RNA, 22 nt, Human
guaaauaucucacgaaugauuc

SEQ ID NO: 165343 - RNA, 22 nt, Human
aagccagccaguuccagcagcu

SEQ ID NO: 165344 - RNA, 22 nt, Human
uggggcuggccaggaggagucu

SEQ ID NO: 165345 - RNA, 22 nt, Human
cuucuucaucuuuuggaggaac

SEQ ID NO: 165346 - RNA, 22 nt, Human
cacugguugccucuuucuguuc

SEQ ID NO: 165347 - RNA, 22 nt, Human
uaugaggagaacauuccugaac

SEQ ID NO: 165348 - RNA, 22 nt, Human
aagccucaugccagauccaggu

SEQ ID NO: 165349 - RNA, 20 nt, Human
ugauuauuccaacaagaaug

SEQ ID NO: 165350 - RNA, 21 nt, Human
uaaaagaugacaagacagcuc

SEQ ID NO: 165351 - RNA, 22 nt, Human
gacuggggcauuagaguagcuu

SEQ ID NO: 165352 - RNA, 22 nt, Human
augccugcugucaggaacucuu

SEQ ID NO: 165353 - RNA, 22 nt, Human
uuuuuuccuguuugucuuuggg

SEQ ID NO: 165354 - RNA, 22 nt, Human
ugcuuucaaugaauuguauacu

SEQ ID NO: 165355 - RNA, 22 nt, Human
cacacaccagaaagccugggac

SEQ ID NO: 165356 - RNA, 22 nt, Human
gaggggaaggauuucuucagaa

SEQ ID NO: 165357 - RNA, 22 nt, Human
ggcuguggcagcuggaaguggu

SEQ ID NO: 165358 - RNA, 22 nt, Human
uaaaugaaaggguuuaauuuau

SEQ ID NO: 165359 - RNA, 22 nt, Human
uaguuccucuucucagggccau

SEQ ID NO: 165360 - RNA, 22 nt, Human
aguuauuuuucacuauuaggcu

SEQ ID NO: 165361 - RNA, 22 nt, Human
gggcgcgcggagccucgccggg

SEQ ID NO: 165362 - RNA, 22 nt, Human
agggcaguuuuacugaaaggug

SEQ ID NO: 165363 - RNA, 22 nt, Human
auuaaaaaaagauaaugaguua

SEQ ID NO: 165364 - RNA, 22 nt, Human
agcucuuccuccauucuggcca

SEQ ID NO: 165365 - RNA, 22 nt, Human
gugguuuagccuucauuaaccu

SEQ ID NO: 165366 - RNA, 22 nt, Human
aagaaaccauauuaguuccugg

SEQ ID NO: 165367 - RNA, 17 nt, Human
agcagcuggguugaucu

SEQ ID NO: 165368 - RNA, 22 nt, Human
ugcaggagcccaggaauacuau

SEQ ID NO: 165369 - RNA, 23 nt, Human
aaggugaagccaccaggugagga

SEQ ID NO: 165370 - RNA, 22 nt, Human
uucaaaaugcagaauaguuugg

SEQ ID NO: 165371 - RNA, 22 nt, Human
ggaaguggauucagggcugcua

SEQ ID NO: 165372 - RNA, 22 nt, Human
cggcgccccgcgcgggcggcuc

SEQ ID NO: 165373 - RNA, 22 nt, Human
ggcugcagggaacaggaugggu

SEQ ID NO: 165374 - RNA, 22 nt, Human
aucaaaauguguagucuugauc

SEQ ID NO: 165375 - RNA, 22 nt, Human
auggauggaagcagccugaacu

SEQ ID NO: 165376 - RNA, 22 nt, Human
auacauauaugcacauuaauau

SEQ ID NO: 165377 - RNA, 22 nt, Human
ucccuucccaccccugccuuuu

SEQ ID NO: 165378 - RNA, 22 nt, Human
uucucuugccuucucuuuuauc

SEQ ID NO: 165379 - RNA, 22 nt, Human
caggggcuccaggugagccugg

SEQ ID NO: 165380 - RNA, 22 nt, Human
uucuucuuuccuauaauuaauu

SEQ ID NO: 165381 - RNA, 22 nt, Human
gggcaggggcagugguggcauu

SEQ ID NO: 165382 - RNA, 22 nt, Human
cugaaagacagccaggcaaagc

SEQ ID NO: 165383 - RNA, 22 nt, Human
cuaaauucuauauccuugcuuc

SEQ ID NO: 165384 - RNA, 21 nt, Human
gaaaaucuaaugugacaaugc

SEQ ID NO: 165385 - RNA, 22 nt, Human
aaggugggacugagaggggaca

SEQ ID NO: 165386 - RNA, 22 nt, Human
gcgggcgcuguggccccggccu

SEQ ID NO: 165387 - RNA, 22 nt, Human
aauaagaguuaagaaguauauu

SEQ ID NO: 165388 - RNA, 22 nt, Human
auuuuuuuggucauaugagaua

SEQ ID NO: 165389 - RNA, 20 nt, Human
cugauagauucuuccccaga

SEQ ID NO: 165390 - RNA, 22 nt, Human
cagcucugcugggaggaugcag

SEQ ID NO: 165391 - RNA, 22 nt, Human
aaauuuuguugaaaaauauuuu

SEQ ID NO: 165392 - RNA, 22 nt, Human
ggaagcucaauacuuuccucuu

SEQ ID NO: 165393 - RNA, 22 nt, Human
caguggagaccugccugcugga

SEQ ID NO: 165394 - RNA, 22 nt, Human
gugugugucuacuuucaucucu

SEQ ID NO: 165395 - RNA, 22 nt, Human
uacaaaugaucaucucuuugaa

SEQ ID NO: 165396 - RNA, 22 nt, Human
uacugcaguuccugcugucucc

SEQ ID NO: 165397 - RNA, 22 nt, Human
uguuggaaucuucuagucuucc

SEQ ID NO: 165398 - RNA, 22 nt, Human
cuaaaccaauauauuuucuucc

SEQ ID NO: 165399 - RNA, 22 nt, Human
agguggucccaauggcugggca

SEQ ID NO: 165400 - RNA, 22 nt, Human
uuagaaauguccuacuaauaug

SEQ ID NO: 165401 - RNA, 22 nt, Human
uucaaacaguguagaauauaug

SEQ ID NO: 165402 - RNA, 22 nt, Human
gagcagcucgagaaggaagcag

SEQ ID NO: 165403 - RNA, 22 nt, Human
uuuauguuuguuuuugaaauaa

SEQ ID NO: 165404 - RNA, 22 nt, Human
cuucuuuucuacuggccuagaa

SEQ ID NO: 165405 - RNA, 22 nt, Human
uucuauaagagaugaauacagu

SEQ ID NO: 165406 - RNA, 20 nt, Human
uaguggaccuugaaggccuc

SEQ ID NO: 165407 - RNA, 22 nt, Human
cucaugcugcaaauggcuguuu

SEQ ID NO: 165408 - RNA, 22 nt, Human
gcugcgcgcagccggcgccgag

SEQ ID NO: 165409 - RNA, 22 nt, Human
ggcagagguagcuggaaccagg

SEQ ID NO: 165410 - RNA, 22 nt, Human
ugccagcuccgaggagcugcag

SEQ ID NO: 165411 - RNA, 22 nt, Human
ggggaggugugcaggacaccuc

SEQ ID NO: 165412 - RNA, 22 nt, Human
caguagcuuuuugcagacaaga

SEQ ID NO: 165413 - RNA, 22 nt, Human
ggagcucacuacgaaauaagcu

SEQ ID NO: 165414 - RNA, 22 nt, Human
uacaggaggaugugcagccagg

SEQ ID NO: 165415 - RNA, 22 nt, Human
gaacuuuaauuagcuuuugucu

SEQ ID NO: 165416 - RNA, 22 nt, Human
guuuuucuuugauuuagaacca

SEQ ID NO: 165417 - RNA, 22 nt, Human
gcucucucuucugcaggccuua

SEQ ID NO: 165418 - RNA, 22 nt, Human
gggagcucaccaugcucugcau

SEQ ID NO: 165419 - RNA, 22 nt, Human
cacaugugggcacagggcugca

SEQ ID NO: 165420 - RNA, 22 nt, Human
uguuuagcucugacuaugugau

SEQ ID NO: 165421 - RNA, 22 nt, Human
uuauuuuuguuuguuaagccua

SEQ ID NO: 165422 - RNA, 22 nt, Human
uuuaaugaugucuaugccuguu

SEQ ID NO: 165423 - RNA, 22 nt, Human
uauuuuuaccuaauuuaugaga

SEQ ID NO: 165424 - RNA, 22 nt, Human
aaacuuuaucaaguacucuuca

SEQ ID NO: 165425 - RNA, 22 nt, Human
ugccuucugccaaggacggugc

SEQ ID NO: 165426 - RNA, 22 nt, Human
cagcuggggagagacauggcag

SEQ ID NO: 165427 - RNA, 22 nt, Human
ggaagauagaaguucaaaaguu

SEQ ID NO: 165428 - RNA, 22 nt, Human
uuauuuuuaggaauguagaggu

SEQ ID NO: 165429 - RNA, 22 nt, Human
ggacggggagcuggaaagggga

SEQ ID NO: 165430 - RNA, 22 nt, Human
guauauuuaugagcauuagccu

SEQ ID NO: 165431 - RNA, 23 nt, Human
auuuccuaaaagauaaucauuac

SEQ ID NO: 165432 - RNA, 22 nt, Human
aaugugcauaacuuuauaaauu

SEQ ID NO: 165433 - RNA, 22 nt, Human
auuaauaucaauauauuauaug

SEQ ID NO: 165434 - RNA, 22 nt, Human
guguucuuuguagaggaucuug

SEQ ID NO: 165435 - RNA, 22 nt, Human
ggagacuaagaaaauagagucc

SEQ ID NO: 165436 - RNA, 22 nt, Human
gcuucucacccuuacuaucucu

SEQ ID NO: 165437 - RNA, 22 nt, Human
uaugucuauugacuuaggauuu

SEQ ID NO: 165438 - RNA, 22 nt, Human
ggaagcuguugugagugcagca

SEQ ID NO: 165439 - RNA, 22 nt, Human
cugcugugcagacagacucucu

SEQ ID NO: 165440 - RNA, 22 nt, Human
uuauuugcccauguuuagcaga

SEQ ID NO: 165441 - RNA, 22 nt, Human
uccuuaggaccuagagguagua

SEQ ID NO: 165442 - RNA, 22 nt, Human
aagagaaaaaucuuaaucuagu

SEQ ID NO: 165443 - RNA, 22 nt, Human
ggccgggugggaggcagcggag

SEQ ID NO: 165444 - RNA, 22 nt, Human
gccccaggggaggugcccugca

SEQ ID NO: 165445 - RNA, 22 nt, Human
aaauuaaaguuuuauuuagagc

SEQ ID NO: 165446 - RNA, 22 nt, Human
auuaaauagcagaagaaagaug

SEQ ID NO: 165447 - RNA, 22 nt, Human
uuauaucagaaggugagauuga

SEQ ID NO: 165448 - RNA, 22 nt, Human
ucagcuucaucuugagcccaca

SEQ ID NO: 165449 - RNA, 22 nt, Human
caaggaaaugucagaaaggcaa

SEQ ID NO: 165450 - RNA, 22 nt, Human
auggaggugagccccccauccu

SEQ ID NO: 165451 - RNA, 22 nt, Human
aacagaauaucaaaagauuaug

SEQ ID NO: 165452 - RNA, 22 nt, Human
ugugucuuuggcgaugucugga

SEQ ID NO: 165453 - RNA, 23 nt, Human
ccagcugugccuggcccaggagc

SEQ ID NO: 165454 - RNA, 22 nt, Human
acauuuuaaaaacaguaccugg

SEQ ID NO: 165455 - RNA, 22 nt, Human
uauaagaaaagucauuaucaaa

SEQ ID NO: 165456 - RNA, 22 nt, Human
aaggcuguuugagcacuggagc

SEQ ID NO: 165457 - RNA, 22 nt, Human
aaaauaaccuucauuugcauug

SEQ ID NO: 165458 - RNA, 22 nt, Human
ggcagagcugugcgcccaccca

SEQ ID NO: 165459 - RNA, 22 nt, Human
cuguggcugcgcccugggggag

SEQ ID NO: 165460 - RNA, 22 nt, Human
aucuguuccccuaugcucucua

SEQ ID NO: 165461 - RNA, 22 nt, Human
ugcuggaguggcacuguguggc

SEQ ID NO: 165462 - RNA, 22 nt, Human
agagacaggguuuugucguguu

SEQ ID NO: 165463 - RNA, 22 nt, Human
gcagggcucagccgcucccacc

SEQ ID NO: 165464 - RNA, 22 nt, Human
uccaggagucagacagauggug

SEQ ID NO: 165465 - RNA, 19 nt, Human
aacaaaauaguucuaguua

SEQ ID NO: 165466 - RNA, 22 nt, Human
aaauguuugguggauaaaagga

SEQ ID NO: 165467 - RNA, 22 nt, Human
cuuuuuaaaguaaauggcuaga

SEQ ID NO: 165468 - RNA, 22 nt, Human
gcuggccugcgagggcaggcug

SEQ ID NO: 165469 - RNA, 22 nt, Human
uuuuuauaagauuuaaaaugua

SEQ ID NO: 165470 - RNA, 22 nt, Human
gcuuucacugcaauagaugaau

SEQ ID NO: 165471 - RNA, 22 nt, Human
caaagaugccaaaaggaagaca

SEQ ID NO: 165472 - RNA, 20 nt, Human
aggaacuggaagggaggaaa

SEQ ID NO: 165473 - RNA, 22 nt, Human
ggcugguggcgggcagcacaga

SEQ ID NO: 165474 - RNA, 22 nt, Human
gugauggucgagcgcuuguugu

SEQ ID NO: 165475 - RNA, 22 nt, Human
gggaagaaccucugcuaccaau

SEQ ID NO: 165476 - RNA, 17 nt, Human
uuagagcuacauguuga

SEQ ID NO: 165477 - RNA, 22 nt, Human
cagcuguggagauggggugcau

SEQ ID NO: 165478 - RNA, 22 nt, Human
cacacgagcccuggagccagca

SEQ ID NO: 165479 - RNA, 22 nt, Human
uauuuccugcguuucugugagc

SEQ ID NO: 165480 - RNA, 20 nt, Human
uucacagaucucuaacugag

SEQ ID NO: 165481 - RNA, 22 nt, Human
aaugaaaaucugucaguucaag

SEQ ID NO: 165482 - RNA, 21 nt, Human
cuauaaaaaugguucuuugcg

SEQ ID NO: 165483 - RNA, 22 nt, Human
aagagggguggucugugaggau

SEQ ID NO: 165484 - RNA, 22 nt, Human
uuuguuugcugagugaauucaa

SEQ ID NO: 165485 - RNA, 22 nt, Human
auguaugagagauucuuuuauu

SEQ ID NO: 165486 - RNA, 22 nt, Human
cagcacaggugugaggccugau

SEQ ID NO: 165487 - RNA, 22 nt, Human
uggagucuugcuuugggagugc

SEQ ID NO: 165488 - RNA, 22 nt, Human
acaugugugucugugugugugu

SEQ ID NO: 165489 - RNA, 22 nt, Human
cucagcgagggaaagaggccgc

SEQ ID NO: 165490 - RNA, 22 nt, Human
ucuugcuguggcagaucuggag

SEQ ID NO: 165491 - RNA, 22 nt, Human
uguguuguuuggggauguccau

SEQ ID NO: 165492 - RNA, 20 nt, Human
aauaaauauaacccauaauu

SEQ ID NO: 165493 - RNA, 22 nt, Human
uacauuugauuuuugcuucuuu

SEQ ID NO: 165494 - RNA, 22 nt, Human
aggccaggcgccggcgcgagac

SEQ ID NO: 165495 - RNA, 22 nt, Human
uuuucauagccagaaacugaaa

SEQ ID NO: 165496 - RNA, 22 nt, Human
gagggagugggcccgugggcac

SEQ ID NO: 165497 - RNA, 22 nt, Human
agggaggagggacagaaagagg

SEQ ID NO: 165498 - RNA, 22 nt, Human
ugcuccguucuucugcuucuug

SEQ ID NO: 165499 - RNA, 22 nt, Human
auggagguuugucugguuuugu

SEQ ID NO: 165500 - RNA, 22 nt, Human
ugaguucugacugagcaugggg

SEQ ID NO: 165501 - RNA, 22 nt, Human
aaugaauaaauuuuaaagacag

SEQ ID NO: 165502 - RNA, 22 nt, Human
guugcggaguguagcgaugcuu

SEQ ID NO: 165503 - RNA, 20 nt, Human
ccugggcuccaggagccccg

SEQ ID NO: 165504 - RNA, 22 nt, Human
caaggaguuuggggaccaagga

SEQ ID NO: 165505 - RNA, 22 nt, Human
cccaggccguguaaucagcagc

SEQ ID NO: 165506 - RNA, 22 nt, Human
cagcccuguugcgcuuccggcg

SEQ ID NO: 165507 - RNA, 22 nt, Human
gagggcugccacguugggcgag

SEQ ID NO: 165508 - RNA, 19 nt, Human
cagagacuguaacacuuuu

SEQ ID NO: 165509 - RNA, 22 nt, Human
uguuuucuuuccccuucuuuuc

SEQ ID NO: 165510 - RNA, 22 nt, Human
acauauaugugcauacaacuau

SEQ ID NO: 165511 - RNA, 22 nt, Human
caggggaagccagcugccaugu

SEQ ID NO: 165512 - RNA, 22 nt, Human
ggcucacuguaccugccgccgc

SEQ ID NO: 165513 - RNA, 22 nt, Human
cagagagcguccauccggugcc

SEQ ID NO: 165514 - RNA, 22 nt, Human
agccggccucggacagagggag

SEQ ID NO: 165515 - RNA, 22 nt, Human
cacugcaaccuccaccucccgg

SEQ ID NO: 165516 - RNA, 22 nt, Human
acauucucuuuuagaaagcugu

SEQ ID NO: 165517 - RNA, 22 nt, Human
cagagccagcuguccuuggcau

SEQ ID NO: 165518 - RNA, 22 nt, Human
auaaaagcacaauagaguuaug

SEQ ID NO: 165519 - RNA, 22 nt, Human
uuuuccuuccugucucuuuauu

SEQ ID NO: 165520 - RNA, 22 nt, Human
aagagaggcccaaguggcuggc

SEQ ID NO: 165521 - RNA, 20 nt, Human
uuguacuuaugugagaagga

SEQ ID NO: 165522 - RNA, 22 nt, Human
auccugugggguauugcugcau

SEQ ID NO: 165523 - RNA, 22 nt, Human
ugguggcuuuucguagguucac

SEQ ID NO: 165524 - RNA, 22 nt, Human
guccuguguaaguacuugcuca

SEQ ID NO: 165525 - RNA, 22 nt, Human
agggcucacuacaacccuggga

SEQ ID NO: 165526 - RNA, 22 nt, Human
gcuguugugaggaucagcauau

SEQ ID NO: 165527 - RNA, 22 nt, Human
gaggggaacaggcauucuuaag

SEQ ID NO: 165528 - RNA, 22 nt, Human
aggggaggcugggcuggggggc

SEQ ID NO: 165529 - RNA, 22 nt, Human
cuuucuuucaaguucugcuuua

SEQ ID NO: 165530 - RNA, 22 nt, Human
gguggcagaggaggcgggagag

SEQ ID NO: 165531 - RNA, 22 nt, Human
uggaugccuugggggaggagga

SEQ ID NO: 165532 - RNA, 22 nt, Human
gggcaagaagcuggaagcauuc

SEQ ID NO: 165533 - RNA, 22 nt, Human
ggcagggaauucagagggaagg

SEQ ID NO: 165534 - RNA, 22 nt, Human
auugaaauuugcuuccucacug

SEQ ID NO: 165535 - RNA, 22 nt, Human
uauuuguauugucuuaucacuu

SEQ ID NO: 165536 - RNA, 22 nt, Human
agccccaauuacagcugugcug

SEQ ID NO: 165537 - RNA, 22 nt, Human
gcuucuguuaggauguggcuua

SEQ ID NO: 165538 - RNA, 22 nt, Human
guuauuguuauugcguugucga

SEQ ID NO: 165539 - RNA, 22 nt, Human
uuuuccuucugauacuccauuu

SEQ ID NO: 165540 - RNA, 22 nt, Human
uauauaauacacaaauauguac

SEQ ID NO: 165541 - RNA, 22 nt, Human
gaaggagaggauugugaggcug

SEQ ID NO: 165542 - RNA, 22 nt, Human
guccccugcguguucauccugg

SEQ ID NO: 165543 - RNA, 22 nt, Human
agcagcugagccccagcuguga

SEQ ID NO: 165544 - RNA, 22 nt, Human
agcggaggaggcggagcaggga

SEQ ID NO: 165545 - RNA, 22 nt, Human
uggagccuugugagaccacaau

SEQ ID NO: 165546 - RNA, 22 nt, Human
ugccgccgugggucccgacgcg

SEQ ID NO: 165547 - RNA, 22 nt, Human
cacacacacacacacucucaca

SEQ ID NO: 165548 - RNA, 22 nt, Human
uggaaauagauguaggaaauug

SEQ ID NO: 165549 - RNA, 22 nt, Human
agcugugaccuucaagagcuac

SEQ ID NO: 165550 - RNA, 22 nt, Human
uucugcuuuaaagcucauguuu

SEQ ID NO: 165551 - RNA, 23 nt, Human
uuucugaguuuuuuaaaagucca

SEQ ID NO: 165552 - RNA, 22 nt, Human
ggaauuauuuuaaauagacauu

SEQ ID NO: 165553 - RNA, 22 nt, Human
uacaaauugccugacggcaggu

SEQ ID NO: 165554 - RNA, 22 nt, Human
guguuggugagcucauuuccac

SEQ ID NO: 165555 - RNA, 22 nt, Human
uauuuucucugccacacuucca

SEQ ID NO: 165556 - RNA, 22 nt, Human
uucuucgacuguauaaaaguau

SEQ ID NO: 165557 - RNA, 21 nt, Human
caguuugcuauuuuaguauga

SEQ ID NO: 165558 - RNA, 22 nt, Human
ucgagcucagcagggaggugcg

SEQ ID NO: 165559 - RNA, 22 nt, Human
auauuuuacagcucucguugaa

SEQ ID NO: 165560 - RNA, 22 nt, Human
ggaaauauaagcaguuugugug

SEQ ID NO: 165561 - RNA, 22 nt, Human
uauuuuaaaagcauuaauucuu

SEQ ID NO: 165562 - RNA, 22 nt, Human
agagcaucgguggaguccccac

SEQ ID NO: 165563 - RNA, 22 nt, Human
uuauauuuuauuuaauuaaaua

SEQ ID NO: 165564 - RNA, 22 nt, Human
uccaugaguuuuuuaguuucac

SEQ ID NO: 165565 - RNA, 22 nt, Human
ggggcucauuugcaggggggag

SEQ ID NO: 165566 - RNA, 22 nt, Human
ggcuagggagacagagggcaug

SEQ ID NO: 165567 - RNA, 22 nt, Human
uccuuucaaauuuauuugacau

SEQ ID NO: 165568 - RNA, 18 nt, Human
uuuaauaagccuguuaug

SEQ ID NO: 165569 - RNA, 22 nt, Human
cacugcacuccagccugggcaa

SEQ ID NO: 165570 - RNA, 22 nt, Human
uuucuggacuaaagggagagau

SEQ ID NO: 165571 - RNA, 22 nt, Human
uucuucuucuuccucauccuca

SEQ ID NO: 165572 - RNA, 22 nt, Human
ccucaggaauuuauucuucugu

SEQ ID NO: 165573 - RNA, 22 nt, Human
uuuuuaagguuuguuuauauau

SEQ ID NO: 165574 - RNA, 22 nt, Human
agucccugauggacuggaugag

SEQ ID NO: 165575 - RNA, 22 nt, Human
uuuuucuccucucucuuucauu

SEQ ID NO: 165576 - RNA, 22 nt, Human
aggcaggggagcuggaagggua

SEQ ID NO: 165577 - RNA, 22 nt, Human
gggacugguuguguguggugug

SEQ ID NO: 165578 - RNA, 22 nt, Human
uaaggaaaugcaaauuuaagaa

SEQ ID NO: 165579 - RNA, 22 nt, Human
augaaaacgugugugugugugu

SEQ ID NO: 165580 - RNA, 22 nt, Human
ugaccucaagcaugcggagggc

SEQ ID NO: 165581 - RNA, 22 nt, Human
augaagguggacagauuuuuuu

SEQ ID NO: 165582 - RNA, 22 nt, Human
auaaaucaagggcaguauuucc

SEQ ID NO: 165583 - RNA, 22 nt, Human
gggcaugcagcaauucuguggu

SEQ ID NO: 165584 - RNA, 22 nt, Human
cagggcagaguuaagaugcugg

SEQ ID NO: 165585 - RNA, 22 nt, Human
ggcagcagaacuggcccuguau

SEQ ID NO: 165586 - RNA, 22 nt, Human
uuuaacauaugaaagaauauuu

SEQ ID NO: 165587 - RNA, 18 nt, Human
ggccucagccuggccgga

SEQ ID NO: 165588 - RNA, 22 nt, Human
gagguagcgugcagggcccgaa

SEQ ID NO: 165589 - RNA, 22 nt, Human
uuuuaaaguaauugaagcuugu

SEQ ID NO: 165590 - RNA, 22 nt, Human
agauuuucuuuuccaucuuugu

SEQ ID NO: 165591 - RNA, 22 nt, Human
agcucuucugacucuaggcuca

SEQ ID NO: 165592 - RNA, 22 nt, Human
gccggagagccaacaccacgga

SEQ ID NO: 165593 - RNA, 22 nt, Human
cugcccgcaugcaggaaugcug

SEQ ID NO: 165594 - RNA, 21 nt, Human
agccgggacaacguggacccc

SEQ ID NO: 165595 - RNA, 22 nt, Human
agggaagaggaccagagucucu

SEQ ID NO: 165596 - RNA, 22 nt, Human
gcuguggacacagcucucuuca

SEQ ID NO: 165597 - RNA, 19 nt, Human
ucagcagauuuugcaaaca

SEQ ID NO: 165598 - RNA, 22 nt, Human
aaaacuuucagggauacagaaa

SEQ ID NO: 165599 - RNA, 22 nt, Human
agauucucccuccuggcgcugu

SEQ ID NO: 165600 - RNA, 22 nt, Human
aggugagaacguggaggggcgg

SEQ ID NO: 165601 - RNA, 22 nt, Human
agcaauucugaaauuacuugac

SEQ ID NO: 165602 - RNA, 22 nt, Human
ugcuccucugcaugucugcggc

SEQ ID NO: 165603 - RNA, 22 nt, Human
uggcaagcuguuggcagauagc

SEQ ID NO: 165604 - RNA, 22 nt, Human
aucuaaaacuacgaauacuacc

SEQ ID NO: 165605 - RNA, 22 nt, Human
uguacauacauagauauacaca

SEQ ID NO: 165606 - RNA, 22 nt, Human
guguggcgacucagagcugccu

SEQ ID NO: 165607 - RNA, 22 nt, Human
auuuuuagucuugcugcaauca

SEQ ID NO: 165608 - RNA, 21 nt, Human
ggcugcucgugaugaacuuca

SEQ ID NO: 165609 - RNA, 20 nt, Human
ucucuuuuucuucuuuucuc

SEQ ID NO: 165610 - RNA, 22 nt, Human
cuagcacagugcuuggcacaca

SEQ ID NO: 165611 - RNA, 22 nt, Human
caggaggugugucccaccgggu

SEQ ID NO: 165612 - RNA, 22 nt, Human
aggggaggggaguaucaggauu

SEQ ID NO: 165613 - RNA, 22 nt, Human
agugccuggcugauggguccug

SEQ ID NO: 165614 - RNA, 22 nt, Human
auaaggaaagugagugcuuaaa

SEQ ID NO: 165615 - RNA, 22 nt, Human
agugaaauaugcccauugcugu

SEQ ID NO: 165616 - RNA, 22 nt, Human
caaaaauacuugccuguaucug

SEQ ID NO: 165617 - RNA, 22 nt, Human
uguuuuuuagagugauacuuuu

SEQ ID NO: 165618 - RNA, 22 nt, Human
ugaaauuuuuuggagauaauuu

SEQ ID NO: 165619 - RNA, 22 nt, Human
gucugcagcacugugcacgguc

SEQ ID NO: 165620 - RNA, 18 nt, Human
uuuccucauuugcagacu

SEQ ID NO: 165621 - RNA, 22 nt, Human
gcgggccggcaggggaggaguu

SEQ ID NO: 165622 - RNA, 22 nt, Human
ugcugcacucacaggaagaguu

SEQ ID NO: 165623 - RNA, 22 nt, Human
cggugcuuuccauaucagcagc

SEQ ID NO: 165624 - RNA, 20 nt, Human
cccuggaaugagaugcauau

SEQ ID NO: 165625 - RNA, 21 nt, Human
uuccuggaggcagaaacguga

SEQ ID NO: 165626 - RNA, 22 nt, Human
auuuaaaaacugguacaacagg

SEQ ID NO: 165627 - RNA, 21 nt, Human
cuuugccuccagcagccgcag

SEQ ID NO: 165628 - RNA, 22 nt, Human
gggcggcguccucagucgggug

SEQ ID NO: 165629 - RNA, 22 nt, Human
cucagaugcacacaggugaggg

SEQ ID NO: 165630 - RNA, 22 nt, Human
gcuuucccaaccuucuugguau

SEQ ID NO: 165631 - RNA, 22 nt, Human
ugugccuguugguguagacaua

SEQ ID NO: 165632 - RNA, 22 nt, Human
auaguaaauguuaacagcaaca

SEQ ID NO: 165633 - RNA, 22 nt, Human
uggggggacagauggagaggac

SEQ ID NO: 165634 - RNA, 22 nt, Human
cccgugggaugagaggcccugg

SEQ ID NO: 165635 - RNA, 22 nt, Human
uaaaugauaguauugaagguag

SEQ ID NO: 165636 - RNA, 22 nt, Human
gagcagacugcacaguucuugc

SEQ ID NO: 165637 - RNA, 22 nt, Human
ggggcaucguugauugcauggu

SEQ ID NO: 165638 - RNA, 22 nt, Human
uucaugucuuugauucugauaa

SEQ ID NO: 165639 - RNA, 22 nt, Human
uccuuuauuuaugggcagugua

SEQ ID NO: 165640 - RNA, 22 nt, Human
gcuggggaucgaaggcagagcc

SEQ ID NO: 165641 - RNA, 22 nt, Human
cauuccuucucagguacuggca

SEQ ID NO: 165642 - RNA, 22 nt, Human
cucuugugucaccauggauaaa

SEQ ID NO: 165643 - RNA, 22 nt, Human
aagcugccugggaggaagggcu

SEQ ID NO: 165644 - RNA, 22 nt, Human
uuucagaaauggcacugaaauc

SEQ ID NO: 165645 - RNA, 22 nt, Human
uggcgcgcagccugcuggugcu

SEQ ID NO: 165646 - RNA, 23 nt, Human
aggcugcagaagaauagggucau

SEQ ID NO: 165647 - RNA, 22 nt, Human
ggcagugguaggagcccaggag

SEQ ID NO: 165648 - RNA, 23 nt, Human
gucucacaaccaccugagaaaau

SEQ ID NO: 165649 - RNA, 22 nt, Human
ccagccugagcuugcugcccuc

SEQ ID NO: 165650 - RNA, 22 nt, Human
auguacugacuguacuuuuaaa

SEQ ID NO: 165651 - RNA, 22 nt, Human
aagagaaaugcuuuaacuuuau

SEQ ID NO: 165652 - RNA, 19 nt, Human
uagaggagaauggcaaaga

SEQ ID NO: 165653 - RNA, 22 nt, Human
cauuuugguaauguucguuugc

SEQ ID NO: 165654 - RNA, 22 nt, Human
caucuuuguuuuggauauaauc

SEQ ID NO: 165655 - RNA, 22 nt, Human
cccagcgccugcccuccgccgc

SEQ ID NO: 165656 - RNA, 22 nt, Human
gcuguggagaagcugccuaugg

SEQ ID NO: 165657 - RNA, 22 nt, Human
aauaucuugaguuauaaauuca

SEQ ID NO: 165658 - RNA, 22 nt, Human
guuuucuuguuaauuuugaacg

SEQ ID NO: 165659 - RNA, 19 nt, Human
agcuccucaccucucgcgg

SEQ ID NO: 165660 - RNA, 22 nt, Human
uuucacuucgaucagaguuuuu

SEQ ID NO: 165661 - RNA, 22 nt, Human
caauaccucuuggugauugggc

SEQ ID NO: 165662 - RNA, 22 nt, Human
ugguugauuaauuuugccaagc

SEQ ID NO: 165663 - RNA, 21 nt, Human
uggcaggcagcuggaagcuug

SEQ ID NO: 165664 - RNA, 22 nt, Human
uucccugugcaguauguuccaa

SEQ ID NO: 165665 - RNA, 20 nt, Human
cuggaguguagcaguggcug

SEQ ID NO: 165666 - RNA, 22 nt, Human
ucuuuuaucuguuguguaacaa

SEQ ID NO: 165667 - RNA, 22 nt, Human
augaggaacagcaagaauauuu

SEQ ID NO: 165668 - RNA, 22 nt, Human
aauaauuuuuuugugauuaugu

SEQ ID NO: 165669 - RNA, 22 nt, Human
agcuuucuauauaugaguugcu

SEQ ID NO: 165670 - RNA, 22 nt, Human
aaaaggaacaauaugguauuuu

SEQ ID NO: 165671 - RNA, 22 nt, Human
cagagcugucauuugccaguga

SEQ ID NO: 165672 - RNA, 22 nt, Human
uucuuuucuucccuguuuauua

SEQ ID NO: 165673 - RNA, 22 nt, Human
gcacccagggcaggaagugagg

SEQ ID NO: 165674 - RNA, 22 nt, Human
agggcugcugcuccgggcccag

SEQ ID NO: 165675 - RNA, 22 nt, Human
uggguucaaauccugguuccac

SEQ ID NO: 165676 - RNA, 22 nt, Human
cuccaugagccaggagggcuac

SEQ ID NO: 165677 - RNA, 22 nt, Human
aggggaggcugcgggcugccgu

SEQ ID NO: 165678 - RNA, 22 nt, Human
guuuuaucuauguaauuauaaa

SEQ ID NO: 165679 - RNA, 22 nt, Human
uucauuuccauuuuauagauaa

SEQ ID NO: 165680 - RNA, 22 nt, Human
guucaaucucucaugcauuuuc

SEQ ID NO: 165681 - RNA, 22 nt, Human
uaguggaaccuucuaaaugacg

SEQ ID NO: 165682 - RNA, 22 nt, Human
aagggagagggagaagguggga

SEQ ID NO: 165683 - RNA, 22 nt, Human
gcuggaaauaacuuguguagaa

SEQ ID NO: 165684 - RNA, 22 nt, Human
aauuauguugaaauaugagaac

SEQ ID NO: 165685 - RNA, 22 nt, Human
ggaggccgugcugugcugccag

SEQ ID NO: 165686 - RNA, 22 nt, Human
ucuuggucccugagcucuuuca

SEQ ID NO: 165687 - RNA, 22 nt, Human
ugugguuuguaagcaaagcaaa

SEQ ID NO: 165688 - RNA, 22 nt, Human
uuggggagaagagcuggucagg

SEQ ID NO: 165689 - RNA, 22 nt, Human
uauuuaaagucagcaacuuuuc

SEQ ID NO: 165690 - RNA, 22 nt, Human
ugcccacuucaaaaucuucauu

SEQ ID NO: 165691 - RNA, 23 nt, Human
ugggagcuauguuuggaaugggg

SEQ ID NO: 165692 - RNA, 22 nt, Human
gugaaauuguacacucaguacc

SEQ ID NO: 165693 - RNA, 22 nt, Human
ggagaggaggugagaggaagua

SEQ ID NO: 165694 - RNA, 22 nt, Human
uggaaauacaagaaguauguca

SEQ ID NO: 165695 - RNA, 22 nt, Human
agugagaguauuaaugugaacu

SEQ ID NO: 165696 - RNA, 22 nt, Human
ucggccggagggggcgggcgca

SEQ ID NO: 165697 - RNA, 22 nt, Human
uggacacugguggauauggaau

SEQ ID NO: 165698 - RNA, 23 nt, Human
gcgggcggagccgggaggcgggg

SEQ ID NO: 165699 - RNA, 17 nt, Human
auucuuauacucuguga

SEQ ID NO: 165700 - RNA, 22 nt, Human
ggaggccagagaagagccaggc

SEQ ID NO: 165701 - RNA, 22 nt, Human
uccauguauugcuaacaaauag

SEQ ID NO: 165702 - RNA, 18 nt, Human
acaaaaauagugcuuugg

SEQ ID NO: 165703 - RNA, 22 nt, Human
uucacugugauguuuaagagaa

SEQ ID NO: 165704 - RNA, 22 nt, Human
uugguuuacucuggggauaucu

SEQ ID NO: 165705 - RNA, 22 nt, Human
aguaggauguuuagcccuucuu

SEQ ID NO: 165706 - RNA, 22 nt, Human
cuguggcuaggaagcuguggga

SEQ ID NO: 165707 - RNA, 23 nt, Human
uggaaguugagagucugcuuugu

SEQ ID NO: 165708 - RNA, 22 nt, Human
uuauuucaggcauuuguaaaug

SEQ ID NO: 165709 - RNA, 22 nt, Human
gaggccagcacccagaugcaug

SEQ ID NO: 165710 - RNA, 22 nt, Human
aaggucuucgaaccuuauguua

SEQ ID NO: 165711 - RNA, 22 nt, Human
ggcucccgugggaugguggagc

SEQ ID NO: 165712 - RNA, 22 nt, Human
ggcuccagauguccccuggcaa

SEQ ID NO: 165713 - RNA, 22 nt, Human
agccgcgcuguuccugcugcug

SEQ ID NO: 165714 - RNA, 22 nt, Human
uucauaugaauuggguuuuuuu

SEQ ID NO: 165715 - RNA, 22 nt, Human
uagcauuuagaacaccuugaga

SEQ ID NO: 165716 - RNA, 22 nt, Human
ggcuagggaucuagaccaggac

SEQ ID NO: 165717 - RNA, 22 nt, Human
ccagucuuggugucuguagcac

SEQ ID NO: 165718 - RNA, 22 nt, Human
cuucuuucuuuucuucuucucu

SEQ ID NO: 165719 - RNA, 22 nt, Human
ugcagcuuuugguuucuagaug

SEQ ID NO: 165720 - RNA, 22 nt, Human
uucucugcgcuccggcccaguu

SEQ ID NO: 165721 - RNA, 22 nt, Human
gagggggaaaagggcagcagag

SEQ ID NO: 165722 - RNA, 22 nt, Human
auuagugguguauuuggcacua

SEQ ID NO: 165723 - RNA, 22 nt, Human
aggauggaaguaacuggauaau

SEQ ID NO: 165724 - RNA, 22 nt, Human
agugucugcgggcagaggagcg

SEQ ID NO: 165725 - RNA, 22 nt, Human
uccaaggacucuugucagcugu

SEQ ID NO: 165726 - RNA, 22 nt, Human
guuuauuucuuaucaucacuau

SEQ ID NO: 165727 - RNA, 22 nt, Human
cauuucaaacaguuacagcugc

SEQ ID NO: 165728 - RNA, 23 nt, Human
uccuccccaccuuuguccccucc

SEQ ID NO: 165729 - RNA, 22 nt, Human
uauauauaauguguacagguga

SEQ ID NO: 165730 - RNA, 22 nt, Human
ggcucagaggagcuggaacggu

SEQ ID NO: 165731 - RNA, 22 nt, Human
cauaaauuuuaccuuguaagug

SEQ ID NO: 165732 - RNA, 21 nt, Human
aggugaaggcgagggggacag

SEQ ID NO: 165733 - RNA, 22 nt, Human
uggagcugguucuggggaagcu

SEQ ID NO: 165734 - RNA, 22 nt, Human
uuucuugugauuuugaugaacu

SEQ ID NO: 165735 - RNA, 20 nt, Human
aauagcacagcucaaacauu

SEQ ID NO: 165736 - RNA, 22 nt, Human
augaaaacggaccagagcuauu

SEQ ID NO: 165737 - RNA, 22 nt, Human
aucguuaugauagagaaagaga

SEQ ID NO: 165738 - RNA, 22 nt, Human
gaucccagaggcggggauagga

SEQ ID NO: 165739 - RNA, 22 nt, Human
aaaguaaagccuauuuaauaau

SEQ ID NO: 165740 - RNA, 22 nt, Human
gcucagccuuuuguucuauuca

SEQ ID NO: 165741 - RNA, 22 nt, Human
uacauguggagauaacugaagc

SEQ ID NO: 165742 - RNA, 22 nt, Human
aauuuaauugguuuuuacuugu

SEQ ID NO: 165743 - RNA, 22 nt, Human
aggcaguggagcuggaauaggc

SEQ ID NO: 165744 - RNA, 22 nt, Human
ugugaagaauuaaugugaauca

SEQ ID NO: 165745 - RNA, 22 nt, Human
gaauuagguaauagaacuagua

SEQ ID NO: 165746 - RNA, 19 nt, Human
ccaguuuuuuaauauucaa

SEQ ID NO: 165747 - RNA, 17 nt, Human
auuguuuuuaauuugca

SEQ ID NO: 165748 - RNA, 22 nt, Human
agagacuguaaugagagguaca

SEQ ID NO: 165749 - RNA, 22 nt, Human
cuuuccaugucuucuuucucca

SEQ ID NO: 165750 - RNA, 22 nt, Human
ucuugugguggaucccucauuu

SEQ ID NO: 165751 - RNA, 22 nt, Human
uuacuuuuuucccccuuagaug

SEQ ID NO: 165752 - RNA, 19 nt, Human
agcaucuccacagaaaaag

SEQ ID NO: 165753 - RNA, 22 nt, Human
aggaaauaggaccagacaaagc

SEQ ID NO: 165754 - RNA, 23 nt, Human
aagaaugcuucugaagagcugcc

SEQ ID NO: 165755 - RNA, 22 nt, Human
cuguguguauaauguuugauaa

SEQ ID NO: 165756 - RNA, 22 nt, Human
gagaaaaauuucuuugcugcac

SEQ ID NO: 165757 - RNA, 22 nt, Human
cugggggacagagagaggcggu

SEQ ID NO: 165758 - RNA, 22 nt, Human
ggauggugauguacccagucau

SEQ ID NO: 165759 - RNA, 20 nt, Human
ugccagagagcucauacccu

SEQ ID NO: 165760 - RNA, 22 nt, Human
auuugcuuguucaccaguacuu

SEQ ID NO: 165761 - RNA, 22 nt, Human
uauacauauacaaaugcacaua

SEQ ID NO: 165762 - RNA, 22 nt, Human
gcaggaagauugcagaaggcug

SEQ ID NO: 165763 - RNA, 22 nt, Human
ucaguggaacacacagaguggg

SEQ ID NO: 165764 - RNA, 22 nt, Human
cuccacagccccuccaguggca

SEQ ID NO: 165765 - RNA, 22 nt, Human
gaggggacugucuggcuccgag

SEQ ID NO: 165766 - RNA, 22 nt, Human
caggaacagcaccaggagcuag

SEQ ID NO: 165767 - RNA, 22 nt, Human
agcugacagugcauggagggac

SEQ ID NO: 165768 - RNA, 22 nt, Human
cuccggggacgcagucgccgcc

SEQ ID NO: 165769 - RNA, 22 nt, Human
ucuuuuucccugguuccuuuuu

SEQ ID NO: 165770 - RNA, 22 nt, Human
aggcuccucugggggccccgga

SEQ ID NO: 165771 - RNA, 22 nt, Human
gauauauuucaaauucuuuugc

SEQ ID NO: 165772 - RNA, 22 nt, Human
uuauuguuuggguauaauuuga

SEQ ID NO: 165773 - RNA, 20 nt, Human
uggguucaguuguuucuggc

SEQ ID NO: 165774 - RNA, 22 nt, Human
agaucugucaccauccuggagc

SEQ ID NO: 165775 - RNA, 22 nt, Human
uuaaacauuuccacuugccagu

SEQ ID NO: 165776 - RNA, 22 nt, Human
auuuucauauggguuauuugua

SEQ ID NO: 165777 - RNA, 22 nt, Human
uagcauuucacugaucuucacu

SEQ ID NO: 165778 - RNA, 22 nt, Human
agcugaggccccgcagcagggu

SEQ ID NO: 165779 - RNA, 22 nt, Human
aauucuuuguuccucugccaag

SEQ ID NO: 165780 - RNA, 22 nt, Human
cagagacuuuugcuccgauucu

SEQ ID NO: 165781 - RNA, 22 nt, Human
cucggcccuggucuuacgggac

SEQ ID NO: 165782 - RNA, 22 nt, Human
ggaggcggaaguccaagcaggu

SEQ ID NO: 165783 - RNA, 22 nt, Human
guuauuuugucuuguucaugaa

SEQ ID NO: 165784 - RNA, 22 nt, Human
uucacccuucucuggcuuucag

SEQ ID NO: 165785 - RNA, 23 nt, Human
ggacuaggcaacagaugggacag

SEQ ID NO: 165786 - RNA, 19 nt, Human
aggaaggggauaaguaaca

SEQ ID NO: 165787 - RNA, 22 nt, Human
agggcgugguggugcuggagca

SEQ ID NO: 165788 - RNA, 22 nt, Human
uaguuucuucaacugucccagc

SEQ ID NO: 165789 - RNA, 21 nt, Human
gggagugaguaaugauggggg

SEQ ID NO: 165790 - RNA, 22 nt, Human
auggaguguggccaggcaguaa

SEQ ID NO: 165791 - RNA, 22 nt, Human
gaaggaaaagacgugcuaagua

SEQ ID NO: 165792 - RNA, 22 nt, Human
uaggaagagauuuucacauggc

SEQ ID NO: 165793 - RNA, 22 nt, Human
uuuuccuugagucggggcacag

SEQ ID NO: 165794 - RNA, 22 nt, Human
auagcacuuaauaugaaacagu

SEQ ID NO: 165795 - RNA, 22 nt, Human
ugucuuugaccuuaagaaguuu

SEQ ID NO: 165796 - RNA, 22 nt, Human
uacuauuuugacaugaaauuga

SEQ ID NO: 165797 - RNA, 22 nt, Human
agccugggucgagagacgagaa

SEQ ID NO: 165798 - RNA, 22 nt, Human
cguuuugaguagauagccauau

SEQ ID NO: 165799 - RNA, 22 nt, Human
uggcucacuuccguggagaggu

SEQ ID NO: 165800 - RNA, 22 nt, Human
uuuucucuuugcuucucuaaaa

SEQ ID NO: 165801 - RNA, 22 nt, Human
agauggaggaaagcaguuagaa

SEQ ID NO: 165802 - RNA, 22 nt, Human
agcagccgccgccgccgcgcac

SEQ ID NO: 165803 - RNA, 23 nt, Human
auaaugauaaugcuauuuuuugu

SEQ ID NO: 165804 - RNA, 22 nt, Human
acaugggggugggacggcagag

SEQ ID NO: 165805 - RNA, 22 nt, Human
auauucaaugaggucauauaag

SEQ ID NO: 165806 - RNA, 22 nt, Human
agcacauguuucuuuugcaauu

SEQ ID NO: 165807 - RNA, 22 nt, Human
ggagacagauggcgucucaguu

SEQ ID NO: 165808 - RNA, 22 nt, Human
ugcuuggauuuccaaaugguuu

SEQ ID NO: 165809 - RNA, 22 nt, Human
uggcagcucauuuggaaaugga

SEQ ID NO: 165810 - RNA, 22 nt, Human
gugaaaaauggccaucaggaca

SEQ ID NO: 165811 - RNA, 22 nt, Human
cacacagcuagugacaggagaa

SEQ ID NO: 165812 - RNA, 22 nt, Human
gcaguuugugauguggcaguca

SEQ ID NO: 165813 - RNA, 22 nt, Human
aggcgaagggaccagacgguag

SEQ ID NO: 165814 - RNA, 22 nt, Human
gcagguggaagcagcagacuca

SEQ ID NO: 165815 - RNA, 22 nt, Human
cuucuuuuggggaugaaaaugg

SEQ ID NO: 165816 - RNA, 22 nt, Human
acaguuuucugagaaucacagg

SEQ ID NO: 165817 - RNA, 22 nt, Human
ugagggaguguggauacaguag

SEQ ID NO: 165818 - RNA, 22 nt, Human
ucuuucugaugggaagggucaa

SEQ ID NO: 165819 - RNA, 22 nt, Human
uuuuacaaugcaaauucuugcu

SEQ ID NO: 165820 - RNA, 22 nt, Human
gagggaggugacaaggacauag

SEQ ID NO: 165821 - RNA, 22 nt, Human
uuaaaagaauccuguuauccuc

SEQ ID NO: 165822 - RNA, 22 nt, Human
acuguugagggaagcagaugaa

SEQ ID NO: 165823 - RNA, 22 nt, Human
uuggaggucucugugguggugg

SEQ ID NO: 165824 - RNA, 22 nt, Human
gcccugucagcucucauggaca

SEQ ID NO: 165825 - RNA, 22 nt, Human
gaauauuuaucucagcugcaga

SEQ ID NO: 165826 - RNA, 22 nt, Human
cagcaugguggagcugcucuuu

SEQ ID NO: 165827 - RNA, 22 nt, Human
uauauguagcucaaaaauuccc

SEQ ID NO: 165828 - RNA, 22 nt, Human
agggcaggguuggugcuggugc

SEQ ID NO: 165829 - RNA, 22 nt, Human
uggcagccugcgugaaggagcu

SEQ ID NO: 165830 - RNA, 22 nt, Human
ugguccucacccuacccagcug

SEQ ID NO: 165831 - RNA, 22 nt, Human
uucacauucauuucuuauguuu

SEQ ID NO: 165832 - RNA, 22 nt, Human
agagggagagaccuccgugccu

SEQ ID NO: 165833 - RNA, 22 nt, Human
gaggggaaggguguucaauggg

SEQ ID NO: 165834 - RNA, 22 nt, Human
guugagaaucucuagcuuagga

SEQ ID NO: 165835 - RNA, 18 nt, Human
guucaagcauuuugcucu

SEQ ID NO: 165836 - RNA, 22 nt, Human
uugcaagcccugaagggcugga

SEQ ID NO: 165837 - RNA, 22 nt, Human
aucuucaaagcacaucguuugu

SEQ ID NO: 165838 - RNA, 22 nt, Human
uucacuguucuuagagaagacc

SEQ ID NO: 165839 - RNA, 16 nt, Human
gaauuccauugcucug

SEQ ID NO: 165840 - RNA, 22 nt, Human
gggaaaauguuucugagacaaa

SEQ ID NO: 165841 - RNA, 22 nt, Human
gauuuucauuauagcuaguuuc

SEQ ID NO: 165842 - RNA, 22 nt, Human
uagcuucccagcuaaccauguc

SEQ ID NO: 165843 - RNA, 22 nt, Human
gaggagcuucagaggaaucuua

SEQ ID NO: 165844 - RNA, 22 nt, Human
augugugugcgagcgugugugu

SEQ ID NO: 165845 - RNA, 22 nt, Human
uauauauacauauagaauaugu

SEQ ID NO: 165846 - RNA, 19 nt, Human
acuggggcaggcugggcuu

SEQ ID NO: 165847 - RNA, 22 nt, Human
uucuuuuaauuucugucugcag

SEQ ID NO: 165848 - RNA, 22 nt, Human
gcuuauuagguuauuucaagga

SEQ ID NO: 165849 - RNA, 22 nt, Human
ggagaggaaguuuaaagaauug

SEQ ID NO: 165850 - RNA, 22 nt, Human
aagcgggcagcggccugcgcca

SEQ ID NO: 165851 - RNA, 22 nt, Human
ggcuggagcaggcugcacagug

SEQ ID NO: 165852 - RNA, 22 nt, Human
uaaaaauuagauauguauuuag

SEQ ID NO: 165853 - RNA, 22 nt, Human
uuuauuuuccaugucucuaggu

SEQ ID NO: 165854 - RNA, 20 nt, Human
uggagggaggaggggcccaa

SEQ ID NO: 165855 - RNA, 22 nt, Human
ccagggcuggaggaggucagga

SEQ ID NO: 165856 - RNA, 22 nt, Human
ugcaggagcaccagcucacccu

SEQ ID NO: 165857 - RNA, 22 nt, Human
gucucacuucauuuucuuagcc

SEQ ID NO: 165858 - RNA, 22 nt, Human
cagcagccuccccggccgaccu

SEQ ID NO: 165859 - RNA, 22 nt, Human
aguggagguuacagcuguacau

SEQ ID NO: 165860 - RNA, 22 nt, Human
uacuuacacugaagcaaagaua

SEQ ID NO: 165861 - RNA, 23 nt, Human
ucagaccaaccucuugcuggaac

SEQ ID NO: 165862 - RNA, 22 nt, Human
ucagccuugguuuugguguugg

SEQ ID NO: 165863 - RNA, 22 nt, Human
uggggcugguaccguaauauau

SEQ ID NO: 165864 - RNA, 22 nt, Human
auuaaacuaaauuaugaauugg

SEQ ID NO: 165865 - RNA, 22 nt, Human
aguaaaugaaagcaauuuuaga

SEQ ID NO: 165866 - RNA, 22 nt, Human
ucuucuuugugguugcccaagg

SEQ ID NO: 165867 - RNA, 22 nt, Human
aguggugccuaagcgcggaggc

SEQ ID NO: 165868 - RNA, 22 nt, Human
uuuucucaguuuuuuucaaaag

SEQ ID NO: 165869 - RNA, 22 nt, Human
gggagggaggagccccggccau

SEQ ID NO: 165870 - RNA, 22 nt, Human
gcaggggguaaggggcagggcu

SEQ ID NO: 165871 - RNA, 22 nt, Human
aaaacauuuaggguuuuuuuua

SEQ ID NO: 165872 - RNA, 22 nt, Human
uuuaaauuucugaaucuugagg

SEQ ID NO: 165873 - RNA, 22 nt, Human
cuccaggacugaggacagagcu

SEQ ID NO: 165874 - RNA, 20 nt, Human
ggcagagcuaugucuguugc

SEQ ID NO: 165875 - RNA, 22 nt, Human
cggcugcgguucaccuagggca

SEQ ID NO: 165876 - RNA, 22 nt, Human
cuccugcuuuuucuucuuccga

SEQ ID NO: 165877 - RNA, 22 nt, Human
auuuuguugaaacccuuguugu

SEQ ID NO: 165878 - RNA, 23 nt, Human
aacugcaagguugcugggaagua

SEQ ID NO: 165879 - RNA, 22 nt, Human
aggaacaguuucaaagagugaa

SEQ ID NO: 165880 - RNA, 22 nt, Human
uauuucuagggcaugaaaauaa

SEQ ID NO: 165881 - RNA, 22 nt, Human
uguccuuuauauguuuuuuagu

SEQ ID NO: 165882 - RNA, 22 nt, Human
ugaaguuuagaaaaagugccuu

SEQ ID NO: 165883 - RNA, 23 nt, Human
ugcugcgggacccgagcgcgcgc

SEQ ID NO: 165884 - RNA, 22 nt, Human
aggccccacaaacucgccuuug

SEQ ID NO: 165885 - RNA, 22 nt, Human
ccgcucuuugagacucucccga

SEQ ID NO: 165886 - RNA, 22 nt, Human
augcaccugucuuuuaaggaua

SEQ ID NO: 165887 - RNA, 22 nt, Human
uuuuucuuugcuuuccacuggc

SEQ ID NO: 165888 - RNA, 22 nt, Human
aauauuuaaauagaauuacauc

SEQ ID NO: 165889 - RNA, 22 nt, Human
ugcggagggagcagucggcugu

SEQ ID NO: 165890 - RNA, 22 nt, Human
ucacuuccuugcagcuguagaa

SEQ ID NO: 165891 - RNA, 22 nt, Human
aagagaggaaagggugugaggu

SEQ ID NO: 165892 - RNA, 22 nt, Human
gcagccugaguuuagcucgucg

SEQ ID NO: 165893 - RNA, 22 nt, Human
cggagggcccucaggacugggu

SEQ ID NO: 165894 - RNA, 22 nt, Human
ucucucugcuguccagcguuau

SEQ ID NO: 165895 - RNA, 22 nt, Human
gguagacugagcuccuugagga

SEQ ID NO: 165896 - RNA, 22 nt, Human
ugcauucugaacguaaauguga

SEQ ID NO: 165897 - RNA, 22 nt, Human
aaacuuuugaaggaggaaaaag

SEQ ID NO: 165898 - RNA, 22 nt, Human
acgugugugugcacguguguau

SEQ ID NO: 165899 - RNA, 22 nt, Human
uuuuaaaacaugucaaaaugug

SEQ ID NO: 165900 - RNA, 22 nt, Human
ugcgccccgcgggccuucgggc

SEQ ID NO: 165901 - RNA, 22 nt, Human
gugucccaaagauuagaaauca

SEQ ID NO: 165902 - RNA, 22 nt, Human
aaagcugaaacgaaaugacaac

SEQ ID NO: 165903 - RNA, 22 nt, Human
auucauucugaccucaagagaa

SEQ ID NO: 165904 - RNA, 22 nt, Human
ucgcccagguuggagugcagug

SEQ ID NO: 165905 - RNA, 22 nt, Human
uauuucaugagugaauaucuag

SEQ ID NO: 165906 - RNA, 22 nt, Human
aucacuagaguuacauugccag

SEQ ID NO: 165907 - RNA, 22 nt, Human
ugagguauuuggauuuauauuu

SEQ ID NO: 165908 - RNA, 21 nt, Human
acaaaaccuaacuuggcugcu

SEQ ID NO: 165909 - RNA, 22 nt, Human
gcuguggaaaaugggucuccaa

SEQ ID NO: 165910 - RNA, 22 nt, Human
gcuuucagggucacugucaaca

SEQ ID NO: 165911 - RNA, 22 nt, Human
guuuucuccugcuauacagugc

SEQ ID NO: 165912 - RNA, 22 nt, Human
cugcaucacagcaggaggcaca

SEQ ID NO: 165913 - RNA, 22 nt, Human
gucacuuugcuugcgaugcucc

SEQ ID NO: 165914 - RNA, 22 nt, Human
ggcuggggccuguugaagaugc

SEQ ID NO: 165915 - RNA, 22 nt, Human
agccuggacagcuacggagaac

SEQ ID NO: 165916 - RNA, 22 nt, Human
uuuuaaaagguugcuguuauaa

SEQ ID NO: 165917 - RNA, 22 nt, Human
cagggccaggccucaggggcgc

SEQ ID NO: 165918 - RNA, 22 nt, Human
uggcaaggccacaggugcaguu

SEQ ID NO: 165919 - RNA, 22 nt, Human
acuuuauacuagugauaguuug

SEQ ID NO: 165920 - RNA, 22 nt, Human
aggauggauagcaaggaagccg

SEQ ID NO: 165921 - RNA, 22 nt, Human
uaauauauuuuuuaagggaugu

SEQ ID NO: 165922 - RNA, 22 nt, Human
ugcagcagaauauggcugcagg

SEQ ID NO: 165923 - RNA, 21 nt, Human
ugccccucuuuucuuuccuuc

SEQ ID NO: 165924 - RNA, 19 nt, Human
ccucggggucugaagucag

SEQ ID NO: 165925 - RNA, 22 nt, Human
uucccggccgccccccgcucgg

SEQ ID NO: 165926 - RNA, 22 nt, Human
guuguuuucagcccagcauuag

SEQ ID NO: 165927 - RNA, 22 nt, Human
cagcgguggcaaggugacugug

SEQ ID NO: 165928 - RNA, 22 nt, Human
uagcauuuauugggcuagcaaa

SEQ ID NO: 165929 - RNA, 22 nt, Human
ggaaggggagcuggaaagggua

SEQ ID NO: 165930 - RNA, 20 nt, Human
ugcugugugucuacuguggg

SEQ ID NO: 165931 - RNA, 22 nt, Human
guuuaaaagcaaccaacaggcu

SEQ ID NO: 165932 - RNA, 22 nt, Human
ugcuuucaaaacucagaggaau

SEQ ID NO: 165933 - RNA, 22 nt, Human
uaaaacuaugcaaccuacuacc

SEQ ID NO: 165934 - RNA, 22 nt, Human
cucugcuuguaucacauuugcu

SEQ ID NO: 165935 - RNA, 22 nt, Human
uaugaauauaccacaauuuagg

SEQ ID NO: 165936 - RNA, 20 nt, Human
uuggggacaggagugugaug

SEQ ID NO: 165937 - RNA, 22 nt, Human
gaaagggggcuuggacacuggc

SEQ ID NO: 165938 - RNA, 22 nt, Human
cagguugaaaguggaggagcua

SEQ ID NO: 165939 - RNA, 22 nt, Human
aagugaggagaccucuucuuca

SEQ ID NO: 165940 - RNA, 22 nt, Human
uuguuauaggaucagugucacu

SEQ ID NO: 165941 - RNA, 22 nt, Human
ccggcugcugaggcggccccgg

SEQ ID NO: 165942 - RNA, 22 nt, Human
gugucacuuucaggagcucuaa

SEQ ID NO: 165943 - RNA, 22 nt, Human
cagcugcgcagcgccgggccug

SEQ ID NO: 165944 - RNA, 22 nt, Human
ucagucacugugaaaugaauuu

SEQ ID NO: 165945 - RNA, 22 nt, Human
uauuguuuuaagguguauuaau

SEQ ID NO: 165946 - RNA, 22 nt, Human
caaauguuugguggcauuuugu

SEQ ID NO: 165947 - RNA, 22 nt, Human
caggccagcuggaggggcagcu

SEQ ID NO: 165948 - RNA, 22 nt, Human
cugggaccugugugccugggcc

SEQ ID NO: 165949 - RNA, 22 nt, Human
aaaaacuuaccccagggcaagg

SEQ ID NO: 165950 - RNA, 22 nt, Human
gauuucuucauuuaaaaauauu

SEQ ID NO: 165951 - RNA, 22 nt, Human
auuguuuugugaaacauaguga

SEQ ID NO: 165952 - RNA, 22 nt, Human
aaauauuugaaugguguaagau

SEQ ID NO: 165953 - RNA, 22 nt, Human
auuuuagagaaacaaacguagg

SEQ ID NO: 165954 - RNA, 22 nt, Human
cggaggcugcuuucuguugcua

SEQ ID NO: 165955 - RNA, 22 nt, Human
cugccucucaugccugcuugcu

SEQ ID NO: 165956 - RNA, 22 nt, Human
cagguggauggcgagcccugca

SEQ ID NO: 165957 - RNA, 22 nt, Human
cggcccggccucgcggcgcaug

SEQ ID NO: 165958 - RNA, 22 nt, Human
uauuuuagccaacagaaugaug

SEQ ID NO: 165959 - RNA, 22 nt, Human
uguuuccuaagugucucugaag

SEQ ID NO: 165960 - RNA, 22 nt, Human
aaacuuuaggcacauggaucua

SEQ ID NO: 165961 - RNA, 22 nt, Human
ccuaggauuaaaauaauaauua

SEQ ID NO: 165962 - RNA, 20 nt, Human
cuccuccccucggccccacc

SEQ ID NO: 165963 - RNA, 22 nt, Human
gaggaggcuggagaggccagga

SEQ ID NO: 165964 - RNA, 19 nt, Human
uccuacaugagacagagag

SEQ ID NO: 165965 - RNA, 22 nt, Human
uuuuuuaaucaaguaggaaaca

SEQ ID NO: 165966 - RNA, 22 nt, Human
gaauuccaggugagagaaggua

SEQ ID NO: 165967 - RNA, 22 nt, Human
gggagccucccacugggggaag

SEQ ID NO: 165968 - RNA, 18 nt, Human
uucaggcucuugcaugaa

SEQ ID NO: 165969 - RNA, 22 nt, Human
auucaaugcacauguuuuggau

SEQ ID NO: 165970 - RNA, 22 nt, Human
auuuucuucauuuugauuguau

SEQ ID NO: 165971 - RNA, 23 nt, Human
agagggaagagcuuagaugggga

SEQ ID NO: 165972 - RNA, 22 nt, Human
gggaaauagagcuggaaccuug

SEQ ID NO: 165973 - RNA, 22 nt, Human
aggggcugagaguuugaugugg

SEQ ID NO: 165974 - RNA, 22 nt, Human
acagccaacgucuuucuuacuu

SEQ ID NO: 165975 - RNA, 22 nt, Human
gcugguggcagagcuccgcggc

SEQ ID NO: 165976 - RNA, 22 nt, Human
ccauggaaaagacgggcaggcc

SEQ ID NO: 165977 - RNA, 22 nt, Human
agcagggagacagugcagcauu

SEQ ID NO: 165978 - RNA, 22 nt, Human
aguaggaauucaaagagacaaa

SEQ ID NO: 165979 - RNA, 22 nt, Human
gagaugugguucaaggguguuu

SEQ ID NO: 165980 - RNA, 22 nt, Human
aaaucuuucacauauuuuuuau

SEQ ID NO: 165981 - RNA, 22 nt, Human
agugaggggagaaugaggugga

SEQ ID NO: 165982 - RNA, 22 nt, Human
cuccagagagaaaggaggccgc

SEQ ID NO: 165983 - RNA, 22 nt, Human
ucugagugacguccugacagga

SEQ ID NO: 165984 - RNA, 22 nt, Human
ucacuguuucaccgucugaagg

SEQ ID NO: 165985 - RNA, 22 nt, Human
uggaggcccagcugggggccgg

SEQ ID NO: 165986 - RNA, 22 nt, Human
uucuagcucauggugacagauc

SEQ ID NO: 165987 - RNA, 19 nt, Human
caggucuucuuggaggacu

SEQ ID NO: 165988 - RNA, 20 nt, Human
ucacuguaauugccuacauu

SEQ ID NO: 165989 - RNA, 22 nt, Human
gaggcuccgccggggcgggccg

SEQ ID NO: 165990 - RNA, 22 nt, Human
gccaguggucagugggagggug

SEQ ID NO: 165991 - RNA, 22 nt, Human
ucuccaggaaagacacuggacu

SEQ ID NO: 165992 - RNA, 22 nt, Human
ugggggaggaggagacagacug

SEQ ID NO: 165993 - RNA, 22 nt, Human
augcuuucucuucuauuucuca

SEQ ID NO: 165994 - RNA, 22 nt, Human
ucagcugggagaaaguuuuagg

SEQ ID NO: 165995 - RNA, 22 nt, Human
uuucuacauuuguaaccagauu

SEQ ID NO: 165996 - RNA, 22 nt, Human
auauguuaugccauuuucaagg

SEQ ID NO: 165997 - RNA, 22 nt, Human
aaaucauagccaugaacauuug

SEQ ID NO: 165998 - RNA, 22 nt, Human
ccuuucuaacagauuguggauc

SEQ ID NO: 165999 - RNA, 22 nt, Human
ugugggcguggguuggggaggg

SEQ ID NO: 166000 - RNA, 22 nt, Human
ugcacacaguucucaggaaaga

SEQ ID NO: 166001 - RNA, 22 nt, Human
uaguauuuguaauuaucaaagc

SEQ ID NO: 166002 - RNA, 22 nt, Human
gagaacagauaugaugacuuca

SEQ ID NO: 166003 - RNA, 22 nt, Human
ugcggugcgcccgggcgagugc

SEQ ID NO: 166004 - RNA, 22 nt, Human
aggaaauaguuuagucccaaaa

SEQ ID NO: 166005 - RNA, 21 nt, Human
gcgcgcucgugcucgacgcgc

SEQ ID NO: 166006 - RNA, 22 nt, Human
cagcuccaucuugcuuauacca

SEQ ID NO: 166007 - RNA, 22 nt, Human
aagugauuuucccaccaucuac

SEQ ID NO: 166008 - RNA, 22 nt, Human
uuggugaugcccaccuuuucau

SEQ ID NO: 166009 - RNA, 22 nt, Human
aggaaauaagggcacuucagau

SEQ ID NO: 166010 - RNA, 22 nt, Human
ggccgggcaugcgagcugagcg

SEQ ID NO: 166011 - RNA, 22 nt, Human
ggcuccucaggcugggguaagg

SEQ ID NO: 166012 - RNA, 22 nt, Human
acugucuuguuguaugugagcu

SEQ ID NO: 166013 - RNA, 22 nt, Human
uuuuuuuuacuccggacagcuc

SEQ ID NO: 166014 - RNA, 21 nt, Human
uaagcuaaacauucaguuaac

SEQ ID NO: 166015 - RNA, 22 nt, Human
ccuuuuaucgcgaagaacucca

SEQ ID NO: 166016 - RNA, 22 nt, Human
aaugcuaaagaagaaggaguag

SEQ ID NO: 166017 - RNA, 22 nt, Human
cccuguccugcuaggcccuggu

SEQ ID NO: 166018 - RNA, 19 nt, Human
ucaggaggucgaccuggca

SEQ ID NO: 166019 - RNA, 22 nt, Human
agagcuccaggguuuuguagug

SEQ ID NO: 166020 - RNA, 22 nt, Human
auacaucuuaacgcgcucuugg

SEQ ID NO: 166021 - RNA, 22 nt, Human
auuuucuugucucuguuguagg

SEQ ID NO: 166022 - RNA, 22 nt, Human
augggagggagcagugaguguu

SEQ ID NO: 166023 - RNA, 22 nt, Human
ugagagggagacagcucuagca

SEQ ID NO: 166024 - RNA, 22 nt, Human
cccuguccuucccuccaucuga

SEQ ID NO: 166025 - RNA, 22 nt, Human
cacauguguaccugccucucug

SEQ ID NO: 166026 - RNA, 22 nt, Human
gcacaaaagguacuucauguag

SEQ ID NO: 166027 - RNA, 22 nt, Human
uauuuuauuuagguuuaguugu

SEQ ID NO: 166028 - RNA, 22 nt, Human
uuauuuaaguauuuauugaagu

SEQ ID NO: 166029 - RNA, 22 nt, Human
uagaccugugggggcagcgggc

SEQ ID NO: 166030 - RNA, 22 nt, Human
auagaugacaguuaggaagcug

SEQ ID NO: 166031 - RNA, 22 nt, Human
acuuugccuucuuacuguguug

SEQ ID NO: 166032 - RNA, 22 nt, Human
auaaaguaaugcauauaaugug

SEQ ID NO: 166033 - RNA, 22 nt, Human
cacauuaagcccaagcauagaa

SEQ ID NO: 166034 - RNA, 18 nt, Human
ccuccccuguggaggucc

SEQ ID NO: 166035 - RNA, 22 nt, Human
aaauguuucauucuauuuuuag

SEQ ID NO: 166036 - RNA, 22 nt, Human
guggguauauauaugugugcug

SEQ ID NO: 166037 - RNA, 22 nt, Human
uuggaggccacagucaucuuua

SEQ ID NO: 166038 - RNA, 19 nt, Human
ccacacacuggucucuggg

SEQ ID NO: 166039 - RNA, 22 nt, Human
cgguggcccauuguacgcagcu

SEQ ID NO: 166040 - RNA, 22 nt, Human
cccagagggcugaggauaugaa

SEQ ID NO: 166041 - RNA, 22 nt, Human
cauaggcucuucagagaacuga

SEQ ID NO: 166042 - RNA, 22 nt, Human
gaggguggggaauagacugcua

SEQ ID NO: 166043 - RNA, 22 nt, Human
gaggugggaggcgggccugcau

SEQ ID NO: 166044 - RNA, 20 nt, Human
gaauucugaagauaauuugg

SEQ ID NO: 166045 - RNA, 22 nt, Human
gacacugccaagugccccgaga

SEQ ID NO: 166046 - RNA, 22 nt, Human
ucgcucgcuggcuccugcccgc

SEQ ID NO: 166047 - RNA, 22 nt, Human
aggcaguguguagcuggaagag

SEQ ID NO: 166048 - RNA, 22 nt, Human
uaagcgagccaguggaaaaagc

SEQ ID NO: 166049 - RNA, 22 nt, Human
gggugcuucauaggugaugcug

SEQ ID NO: 166050 - RNA, 22 nt, Human
aggccagggacaaugaggcaga

SEQ ID NO: 166051 - RNA, 22 nt, Human
agcgcggccuuacacccagggg

SEQ ID NO: 166052 - RNA, 22 nt, Human
aauguugaaccuuuuuggccug

SEQ ID NO: 166053 - RNA, 22 nt, Human
uuuccuaggaaaugauugaagu

SEQ ID NO: 166054 - RNA, 21 nt, Human
aagagcgccgggcagggcuga

SEQ ID NO: 166055 - RNA, 22 nt, Human
auuuuugguuucaccugcacgc

SEQ ID NO: 166056 - RNA, 22 nt, Human
ucauacuuuuuugacccuugug

SEQ ID NO: 166057 - RNA, 22 nt, Human
uacuuuaauugcaaaaauaaau

SEQ ID NO: 166058 - RNA, 22 nt, Human
uagcacauaguaggcacaggcu

SEQ ID NO: 166059 - RNA, 22 nt, Human
uacaagcucuuguagggggaaa

SEQ ID NO: 166060 - RNA, 22 nt, Human
uuaauguugacacacuagcaca

SEQ ID NO: 166061 - RNA, 22 nt, Human
cucugugucugauucugggaag

SEQ ID NO: 166062 - RNA, 22 nt, Human
aaaauaauauuauaccacugcu

SEQ ID NO: 166063 - RNA, 22 nt, Human
agcggcaggaagcgcgcaagcg

SEQ ID NO: 166064 - RNA, 22 nt, Human
aagcugcagacccccugucuca

SEQ ID NO: 166065 - RNA, 22 nt, Human
uuaaugauuaauguggacccaa

SEQ ID NO: 166066 - RNA, 22 nt, Human
ggagccucuaaacaguuaucaa

SEQ ID NO: 166067 - RNA, 22 nt, Human
uuuucaauuuucauuugcaaga

SEQ ID NO: 166068 - RNA, 22 nt, Human
uguguuguuggggauguuuuca

SEQ ID NO: 166069 - RNA, 22 nt, Human
uagacugagcuccuugaggaca

SEQ ID NO: 166070 - RNA, 22 nt, Human
gggcucuuaauuuuuuucucua

SEQ ID NO: 166071 - RNA, 21 nt, Human
auuauagugacuaaauugaua

SEQ ID NO: 166072 - RNA, 22 nt, Human
ugugugcuaguuuugucaguau

SEQ ID NO: 166073 - RNA, 22 nt, Human
aggagguagggugugaaacagc

SEQ ID NO: 166074 - RNA, 22 nt, Human
ggcugcuauuggucuggcuugg

SEQ ID NO: 166075 - RNA, 22 nt, Human
ccuggggcucugcacagagcag

SEQ ID NO: 166076 - RNA, 22 nt, Human
uggaagcccagaaggaagcaga

SEQ ID NO: 166077 - RNA, 20 nt, Human
gggcucugcauccaucagcc

SEQ ID NO: 166078 - RNA, 22 nt, Human
cucucugcugucuuucgggaaa

SEQ ID NO: 166079 - RNA, 22 nt, Human
cuggcaguguccagcucgugau

SEQ ID NO: 166080 - RNA, 19 nt, Human
acccaugcucuguggacuu

SEQ ID NO: 166081 - RNA, 22 nt, Human
gugaucagaagaaccugccgaa

SEQ ID NO: 166082 - RNA, 22 nt, Human
agcaaaauuccaaaaugcuaau

SEQ ID NO: 166083 - RNA, 22 nt, Human
ccagaugggggcugugggaggg

SEQ ID NO: 166084 - RNA, 22 nt, Human
aacacuaaaggucaguuagaag

SEQ ID NO: 166085 - RNA, 22 nt, Human
gggagggucugagagcugcacc

SEQ ID NO: 166086 - RNA, 22 nt, Human
uggaaguggcaggggagacgua

SEQ ID NO: 166087 - RNA, 22 nt, Human
ccacuuugagaagcugaugaaa

SEQ ID NO: 166088 - RNA, 22 nt, Human
gagcagcugagcuggaaugaga

SEQ ID NO: 166089 - RNA, 22 nt, Human
gcugcaggaggugguagggucu

SEQ ID NO: 166090 - RNA, 22 nt, Human
uaaaaucaugacagauugacau

SEQ ID NO: 166091 - RNA, 22 nt, Human
cagcagaggagguggcagcacc

SEQ ID NO: 166092 - RNA, 22 nt, Human
aucucacuucugucauguggca

SEQ ID NO: 166093 - RNA, 22 nt, Human
uauguuuugcaaauaucaaaca

SEQ ID NO: 166094 - RNA, 22 nt, Human
ugcagaggagcuggaaggcugg

SEQ ID NO: 166095 - RNA, 22 nt, Human
gggauggggagcuggaaagggg

SEQ ID NO: 166096 - RNA, 22 nt, Human
ugucccaucacagaggagacua

SEQ ID NO: 166097 - RNA, 22 nt, Human
ucauuguuuacugucuuuuuuc

SEQ ID NO: 166098 - RNA, 22 nt, Human
aaagggagauaaaguaauuuua

SEQ ID NO: 166099 - RNA, 22 nt, Human
ccaaggcuguggggcugugcag

SEQ ID NO: 166100 - RNA, 22 nt, Human
agcacagugccugacauauaug

SEQ ID NO: 166101 - RNA, 22 nt, Human
ucaaauaugggccagaggaaau

SEQ ID NO: 166102 - RNA, 22 nt, Human
acuucuuuugcaugauucuuua

SEQ ID NO: 166103 - RNA, 22 nt, Human
aagaugaguuacaaaggaguaa

SEQ ID NO: 166104 - RNA, 21 nt, Human
uguggccauuugaaaacaggg

SEQ ID NO: 166105 - RNA, 22 nt, Human
uaugggcaagagauaggugguc

SEQ ID NO: 166106 - RNA, 22 nt, Human
ugcuggagucucuugacccugg

SEQ ID NO: 166107 - RNA, 22 nt, Human
ucacaucugugugauugucauu

SEQ ID NO: 166108 - RNA, 21 nt, Human
ggccagauucucccauagcug

SEQ ID NO: 166109 - RNA, 22 nt, Human
acagacuuuuagacuuaugagu

SEQ ID NO: 166110 - RNA, 22 nt, Human
uggugccuuccgagagcuguga

SEQ ID NO: 166111 - RNA, 22 nt, Human
uuucagagaaagcccaaagacu

SEQ ID NO: 166112 - RNA, 22 nt, Human
gucuugugaagacggcagaaag

SEQ ID NO: 166113 - RNA, 22 nt, Human
gaauucuaguucuguaucucug

SEQ ID NO: 166114 - RNA, 22 nt, Human
uuggugauguagcagcaauugu

SEQ ID NO: 166115 - RNA, 22 nt, Human
cuccuugguuccggcguuggag

SEQ ID NO: 166116 - RNA, 22 nt, Human
gaaagugaauguaacauguuau

SEQ ID NO: 166117 - RNA, 22 nt, Human
caugcuaacacguugcucaccg

SEQ ID NO: 166118 - RNA, 22 nt, Human
ucuccucucugaucuugcuccg

SEQ ID NO: 166119 - RNA, 22 nt, Human
uuaucaaaaaauaguacuuuga

SEQ ID NO: 166120 - RNA, 22 nt, Human
caaaucuguuaauuucaaguug

SEQ ID NO: 166121 - RNA, 22 nt, Human
uaguuucuaauguugaaauuau

SEQ ID NO: 166122 - RNA, 22 nt, Human
uuuuguuuacauuaaauuuuga

SEQ ID NO: 166123 - RNA, 22 nt, Human
uuucacugaguaggagagcacu

SEQ ID NO: 166124 - RNA, 22 nt, Human
gggagguaaugggggugcaggg

SEQ ID NO: 166125 - RNA, 22 nt, Human
cccauggaaggguuggcccaga

SEQ ID NO: 166126 - RNA, 22 nt, Human
gcagcccucuuggucacuaggc

SEQ ID NO: 166127 - RNA, 22 nt, Human
uucauuagcacauuuccuuggu

SEQ ID NO: 166128 - RNA, 22 nt, Human
cucuuucauucuguccuuguuu

SEQ ID NO: 166129 - RNA, 22 nt, Human
gcaggccgauuuguuagaaguc

SEQ ID NO: 166130 - RNA, 22 nt, Human
cucacugucagcugcagggcuu

SEQ ID NO: 166131 - RNA, 22 nt, Human
augcggcugugggggaauggga

SEQ ID NO: 166132 - RNA, 22 nt, Human
gcauaauauugagaaauuauua

SEQ ID NO: 166133 - RNA, 22 nt, Human
caagaaaaaacaugaugagugu

SEQ ID NO: 166134 - RNA, 22 nt, Human
cauccagcuccugggggccacc

SEQ ID NO: 166135 - RNA, 22 nt, Human
aggcucagcaucugauucauau

SEQ ID NO: 166136 - RNA, 20 nt, Human
uugauucacaaaaagcuuag

SEQ ID NO: 166137 - RNA, 22 nt, Human
uuccccaccagagacagagcug

SEQ ID NO: 166138 - RNA, 22 nt, Human
ccagggaggucauagugcuggu

SEQ ID NO: 166139 - RNA, 22 nt, Human
cgcccggcugagacgcucgccc

SEQ ID NO: 166140 - RNA, 22 nt, Human
aaacaaauccaauaauaaaauu

SEQ ID NO: 166141 - RNA, 22 nt, Human
gagcaggcuggcagggccaggg

SEQ ID NO: 166142 - RNA, 22 nt, Human
gaggggaauguuccugagcugg

SEQ ID NO: 166143 - RNA, 22 nt, Human
uugauagauuuuagaggcaggc

SEQ ID NO: 166144 - RNA, 22 nt, Human
uuucaugauuaacuuagugaau

SEQ ID NO: 166145 - RNA, 22 nt, Human
aggcagagaggucuuccuggaa

SEQ ID NO: 166146 - RNA, 22 nt, Human
ggaggcccagaaggaagcccag

SEQ ID NO: 166147 - RNA, 22 nt, Human
gccggguguuccugggaagaug

SEQ ID NO: 166148 - RNA, 22 nt, Human
aacucaggagagaguaacaggg

SEQ ID NO: 166149 - RNA, 22 nt, Human
aucuucuuucaucagccccuca

SEQ ID NO: 166150 - RNA, 22 nt, Human
gaggcaggcggggcccaggugg

SEQ ID NO: 166151 - RNA, 22 nt, Human
gggaggaagaguaggaauuuga

SEQ ID NO: 166152 - RNA, 19 nt, Human
agcucaggcccaucguccc

SEQ ID NO: 166153 - RNA, 21 nt, Human
agaugaggauacugaggccua

SEQ ID NO: 166154 - RNA, 22 nt, Human
gaggugauuccucccauguaau

SEQ ID NO: 166155 - RNA, 22 nt, Human
auguuccaugacuaugcaugaa

SEQ ID NO: 166156 - RNA, 22 nt, Human
uaggggguuuuucuagagauug

SEQ ID NO: 166157 - RNA, 22 nt, Human
uuauuuuauaaagagaagacuu

SEQ ID NO: 166158 - RNA, 22 nt, Human
uggccccauuuuucuggagccu

SEQ ID NO: 166159 - RNA, 19 nt, Human
agcgccucuacugcaugga

SEQ ID NO: 166160 - RNA, 22 nt, Human
aggcgagcgcggccggugcccc

SEQ ID NO: 166161 - RNA, 19 nt, Human
agagucuccacuccacuug

SEQ ID NO: 166162 - RNA, 22 nt, Human
cuuuaaaaauguauuuuugugg

SEQ ID NO: 166163 - RNA, 22 nt, Human
cccggcucggcuucuuccccac

SEQ ID NO: 166164 - RNA, 22 nt, Human
uaauaaaaauuuaauucacauu

SEQ ID NO: 166165 - RNA, 22 nt, Human
auauaguacauguauauauaua

SEQ ID NO: 166166 - RNA, 18 nt, Human
cccagaggaaugccugga

SEQ ID NO: 166167 - RNA, 22 nt, Human
cgggagcagcucuggggcuggg

SEQ ID NO: 166168 - RNA, 22 nt, Human
ucacccagacugucugacucuu

SEQ ID NO: 166169 - RNA, 22 nt, Human
cccggagcagucgggcuccggg

SEQ ID NO: 166170 - RNA, 22 nt, Human
augcacaagguagauuauuauu

SEQ ID NO: 166171 - RNA, 22 nt, Human
ugauucacagacuucacaaggc

SEQ ID NO: 166172 - RNA, 22 nt, Human
gucuuucuuuuacauauuugug

SEQ ID NO: 166173 - RNA, 22 nt, Human
gcagccagggaccuuugacuau

SEQ ID NO: 166174 - RNA, 22 nt, Human
uucacugugauugggguggauu

SEQ ID NO: 166175 - RNA, 22 nt, Human
uggggcuccuccuggcaggagg

SEQ ID NO: 166176 - RNA, 22 nt, Human
accuccauggcccacaucuagu

SEQ ID NO: 166177 - RNA, 22 nt, Human
ggaagcugucugcccggcgcuc

SEQ ID NO: 166178 - RNA, 22 nt, Human
caggccccagggacugggcgcu

SEQ ID NO: 166179 - RNA, 22 nt, Human
cagggacugcaggaggacaggu

SEQ ID NO: 166180 - RNA, 22 nt, Human
auuuuacuaugauaguugagaa

SEQ ID NO: 166181 - RNA, 22 nt, Human
ggcugggagguggcgaggaggc

SEQ ID NO: 166182 - RNA, 22 nt, Human
gaacauauuuagcaccuaauau

SEQ ID NO: 166183 - RNA, 22 nt, Human
ggcucccccauggcugacagac

SEQ ID NO: 166184 - RNA, 22 nt, Human
ucagaaggagagacagcgugga

SEQ ID NO: 166185 - RNA, 22 nt, Human
cguggccacaguggagcugagc

SEQ ID NO: 166186 - RNA, 22 nt, Human
aauaacuuacucuaugcuuagu

SEQ ID NO: 166187 - RNA, 22 nt, Human
uucacuuuuucucugcuugaga

SEQ ID NO: 166188 - RNA, 22 nt, Human
aaagcgagccggcuuggaggga

SEQ ID NO: 166189 - RNA, 22 nt, Human
uuuuaaauggcuuuuacuuuuc

SEQ ID NO: 166190 - RNA, 22 nt, Human
uguggacaccuauuaccaguga

SEQ ID NO: 166191 - RNA, 22 nt, Human
agauaagaacauuaguaagccg

SEQ ID NO: 166192 - RNA, 23 nt, Human
caggggacaggugaccugggcuc

SEQ ID NO: 166193 - RNA, 22 nt, Human
aagcauuuuagauaaagcauca

SEQ ID NO: 166194 - RNA, 22 nt, Human
uucuugugugaauauaauuaca

SEQ ID NO: 166195 - RNA, 22 nt, Human
aaauguaaacuguauuuauaaa

SEQ ID NO: 166196 - RNA, 22 nt, Human
acagagcucccagccaucuccu

SEQ ID NO: 166197 - RNA, 22 nt, Human
uccacaaagucuaugagaguug

SEQ ID NO: 166198 - RNA, 22 nt, Human
cuagcagaagcuccuugagggu

SEQ ID NO: 166199 - RNA, 22 nt, Human
gauuuuaaaagauguauaaggu

SEQ ID NO: 166200 - RNA, 21 nt, Human
auauuguugggguuuucuuuu

SEQ ID NO: 166201 - RNA, 22 nt, Human
aaauauauauaauauauauauu

SEQ ID NO: 166202 - RNA, 22 nt, Human
uucagaauuaucauaauuuuga

SEQ ID NO: 166203 - RNA, 22 nt, Human
agcgcgcggggcugcggcaggg

SEQ ID NO: 166204 - RNA, 22 nt, Human
cggccgcgggauggcgggcagc

SEQ ID NO: 166205 - RNA, 22 nt, Human
gccagccggugaguggaagcgg

SEQ ID NO: 166206 - RNA, 22 nt, Human
gggaugaaugccuggcuccccc

SEQ ID NO: 166207 - RNA, 22 nt, Human
ucccuugacauuacuugggagg

SEQ ID NO: 166208 - RNA, 22 nt, Human
aggaggcucucagguccucccc

SEQ ID NO: 166209 - RNA, 22 nt, Human
ucauuauuuugauguauuuccu

SEQ ID NO: 166210 - RNA, 22 nt, Human
uuugcaggaaauguacugaaug

SEQ ID NO: 166211 - RNA, 22 nt, Human
gaguggccugccccagccaggc

SEQ ID NO: 166212 - RNA, 22 nt, Human
uggucuuuccuucauuguccag

SEQ ID NO: 166213 - RNA, 19 nt, Human
ggaggguguccucaguguc

SEQ ID NO: 166214 - RNA, 22 nt, Human
ccggcggguggagcaugcgcgg

SEQ ID NO: 166215 - RNA, 22 nt, Human
uacagaccaguaguucucagcg

SEQ ID NO: 166216 - RNA, 22 nt, Human
uggcucaggccuacgacgccuu

SEQ ID NO: 166217 - RNA, 22 nt, Human
gguuuucacgauccucccuuuu

SEQ ID NO: 166218 - RNA, 22 nt, Human
uuauuucauguaaaauuuaugu

SEQ ID NO: 166219 - RNA, 22 nt, Human
gagcuggacauacaggaaacca

SEQ ID NO: 166220 - RNA, 22 nt, Human
cugguuuauuucauaguuuguu

SEQ ID NO: 166221 - RNA, 22 nt, Human
uguauuuuuucccugaaauaaa

SEQ ID NO: 166222 - RNA, 22 nt, Human
auuucacucuuaauugcuuccu

SEQ ID NO: 166223 - RNA, 22 nt, Human
ggagccuuccgagucccagguu

SEQ ID NO: 166224 - RNA, 22 nt, Human
ggcagucuuucccuugagcucu

SEQ ID NO: 166225 - RNA, 22 nt, Human
uguggccaccagagcugcuauu

SEQ ID NO: 166226 - RNA, 22 nt, Human
aagaaggaaggcaagagauggg

SEQ ID NO: 166227 - RNA, 22 nt, Human
uuauuuucgugugugugugugu

SEQ ID NO: 166228 - RNA, 22 nt, Human
guuuccaggcuuugguaugguu

SEQ ID NO: 166229 - RNA, 22 nt, Human
cccagaccagagugccuggacg

SEQ ID NO: 166230 - RNA, 22 nt, Human
ugacagaggagcuggaaugauu

SEQ ID NO: 166231 - RNA, 22 nt, Human
ccagcugggucccugcuggggc

SEQ ID NO: 166232 - RNA, 22 nt, Human
cuacuucucccuagaucagaaa

SEQ ID NO: 166233 - RNA, 22 nt, Human
uuaccuuggaccggguaucaga

SEQ ID NO: 166234 - RNA, 22 nt, Human
uaaaguauucaaguagcuuucu

SEQ ID NO: 166235 - RNA, 22 nt, Human
uaauauaacugccaguuaaggu

SEQ ID NO: 166236 - RNA, 22 nt, Human
cucuucauguuggugcagaagc

SEQ ID NO: 166237 - RNA, 22 nt, Human
ugggcagggauuuggggaaacu

SEQ ID NO: 166238 - RNA, 22 nt, Human
agagauacugcaggccauaaau

SEQ ID NO: 166239 - RNA, 20 nt, Human
agucuucaggugugaggauu

SEQ ID NO: 166240 - RNA, 22 nt, Human
uuuugcuucuaguauauuuuuu

SEQ ID NO: 166241 - RNA, 22 nt, Human
uggggagacauggaguaaaaga

SEQ ID NO: 166242 - RNA, 22 nt, Human
cugguacuggaggaguucagag

SEQ ID NO: 166243 - RNA, 22 nt, Human
cuggaagcgucggaggaagggc

SEQ ID NO: 166244 - RNA, 17 nt, Human
ucuuuuacuuucucucc

SEQ ID NO: 166245 - RNA, 22 nt, Human
cacagcuggggaagcugaggcc

SEQ ID NO: 166246 - RNA, 22 nt, Human
ugguccuuuccauuggagacac

SEQ ID NO: 166247 - RNA, 22 nt, Human
gcagaggcugccgugggcagga

SEQ ID NO: 166248 - RNA, 20 nt, Human
uucacagaggacucagguca

SEQ ID NO: 166249 - RNA, 22 nt, Human
aagaaauagauagaggaauacu

SEQ ID NO: 166250 - RNA, 22 nt, Human
uguauaaaauggaaugucagaa

SEQ ID NO: 166251 - RNA, 22 nt, Human
cagaccagaaggaagccgacaa

SEQ ID NO: 166252 - RNA, 22 nt, Human
aaauguauuagccuaugugaga

SEQ ID NO: 166253 - RNA, 22 nt, Human
gaaaagcucuuuagaagagguu

SEQ ID NO: 166254 - RNA, 22 nt, Human
gcagagcugucuaagucacuuc

SEQ ID NO: 166255 - RNA, 22 nt, Human
gaccaggagauuugagcuaggc

SEQ ID NO: 166256 - RNA, 23 nt, Human
uuuuccaaaucgacucucuaguu

SEQ ID NO: 166257 - RNA, 22 nt, Human
uggagggaagcaaacacuagau

SEQ ID NO: 166258 - RNA, 22 nt, Human
agagaacaggcagcuggugccg

SEQ ID NO: 166259 - RNA, 20 nt, Human
aggggcuguaguuagaugac

SEQ ID NO: 166260 - RNA, 22 nt, Human
aauaugcaaagcguguuaucug

SEQ ID NO: 166261 - RNA, 22 nt, Human
ccuccuuuccuguuuuccugag

SEQ ID NO: 166262 - RNA, 22 nt, Human
uugucuuucguauggaacacua

SEQ ID NO: 166263 - RNA, 22 nt, Human
cacauuuuccagaagaaucaga

SEQ ID NO: 166264 - RNA, 22 nt, Human
cccgccggccacaccggccgcc

SEQ ID NO: 166265 - RNA, 22 nt, Human
ggcagguggcacugcugcuccc

SEQ ID NO: 166266 - RNA, 22 nt, Human
agcuugagauaauucaagcuga

SEQ ID NO: 166267 - RNA, 22 nt, Human
gagggugguggcggccggcacc

SEQ ID NO: 166268 - RNA, 19 nt, Human
augaaauagcauuuucuga

SEQ ID NO: 166269 - RNA, 22 nt, Human
uuuuauaauacccuugacuaau

SEQ ID NO: 166270 - RNA, 22 nt, Human
gaggcuugccacuguccauggc

SEQ ID NO: 166271 - RNA, 22 nt, Human
ucuggcaguugccgcuucaguc

SEQ ID NO: 166272 - RNA, 22 nt, Human
gcucagagaugucugcugccuu

SEQ ID NO: 166273 - RNA, 22 nt, Human
uguugaaacagcuauugacuuu

SEQ ID NO: 166274 - RNA, 19 nt, Human
cuuguggcuaugcagauac

SEQ ID NO: 166275 - RNA, 22 nt, Human
cuucucugcugccugccucuuu

SEQ ID NO: 166276 - RNA, 22 nt, Human
cagcuccagcccaggcagcucc

SEQ ID NO: 166277 - RNA, 22 nt, Human
gugccugcucauucucaauauu

SEQ ID NO: 166278 - RNA, 22 nt, Human
caucucagguuuguucugagac

SEQ ID NO: 166279 - RNA, 22 nt, Human
ugcuggagccauguuuucucua

SEQ ID NO: 166280 - RNA, 22 nt, Human
aaugcuuuuugcgaaaugugca

SEQ ID NO: 166281 - RNA, 22 nt, Human
ugcuuucagauaucuguuucaa

SEQ ID NO: 166282 - RNA, 22 nt, Human
auuaaaaaugagaguagggauu

SEQ ID NO: 166283 - RNA, 22 nt, Human
cuccagcucgcgagcucugcuc

SEQ ID NO: 166284 - RNA, 22 nt, Human
cuggggccccagcucggccccu

SEQ ID NO: 166285 - RNA, 22 nt, Human
uauauacacgcacauauacaua

SEQ ID NO: 166286 - RNA, 22 nt, Human
auggagugggaggacaugaagg

SEQ ID NO: 166287 - RNA, 22 nt, Human
cggggcucugcacaggccagga

SEQ ID NO: 166288 - RNA, 20 nt, Human
gccggggcauaggggccguc

SEQ ID NO: 166289 - RNA, 22 nt, Human
cugucucugauaagcucgaggg

SEQ ID NO: 166290 - RNA, 22 nt, Human
uuuaucaggccaucuuaugucu

SEQ ID NO: 166291 - RNA, 22 nt, Human
agggaguuccgaucugugcacc

SEQ ID NO: 166292 - RNA, 22 nt, Human
gcagggcucuggagucaggcug

SEQ ID NO: 166293 - RNA, 22 nt, Human
ccauuucacaucccugacaugu

SEQ ID NO: 166294 - RNA, 22 nt, Human
cuccccuuauuccucaacauga

SEQ ID NO: 166295 - RNA, 18 nt, Human
auucauuugcguuuggcu

SEQ ID NO: 166296 - RNA, 22 nt, Human
aaggccuaggaguugacauggg

SEQ ID NO: 166297 - RNA, 22 nt, Human
gaggcucagagggacuuucaag

SEQ ID NO: 166298 - RNA, 22 nt, Human
aagaggcuacagcccugugucu

SEQ ID NO: 166299 - RNA, 22 nt, Human
gcucagcuggagagggacgggu

SEQ ID NO: 166300 - RNA, 21 nt, Human
uccccugugccuggcauacag

SEQ ID NO: 166301 - RNA, 22 nt, Human
guucuucagcccucagguccua

SEQ ID NO: 166302 - RNA, 22 nt, Human
cagauaagcuauaaguaguacc

SEQ ID NO: 166303 - RNA, 22 nt, Human
cuucuuuccauguguuuugguu

SEQ ID NO: 166304 - RNA, 22 nt, Human
ugggcagggagcuggaaccaca

SEQ ID NO: 166305 - RNA, 22 nt, Human
agcacgcccaccuccugcggcg

SEQ ID NO: 166306 - RNA, 22 nt, Human
cggggcuccgaagagcucgguu

SEQ ID NO: 166307 - RNA, 20 nt, Human
ucugugugccaucaccuaac

SEQ ID NO: 166308 - RNA, 22 nt, Human
ccaggcuccccaggaggcccuu

SEQ ID NO: 166309 - RNA, 22 nt, Human
uuucauguuggauacuguuuca

SEQ ID NO: 166310 - RNA, 20 nt, Human
agcauucaacuuucuauguu

SEQ ID NO: 166311 - RNA, 22 nt, Human
gcaggcagauccagaagcacua

SEQ ID NO: 166312 - RNA, 23 nt, Human
cagagaaaauagaauaugcugug

SEQ ID NO: 166313 - RNA, 22 nt, Human
gggggcagguuccaggccagcu

SEQ ID NO: 166314 - RNA, 22 nt, Human
uuuuagaagcauuuaugagauu

SEQ ID NO: 166315 - RNA, 22 nt, Human
ucagucucuggggcuucuguuu

SEQ ID NO: 166316 - RNA, 22 nt, Human
ccuaggcuggcugucuucaggu

SEQ ID NO: 166317 - RNA, 21 nt, Human
acugggcuagccugacuucug

SEQ ID NO: 166318 - RNA, 22 nt, Human
agcgcucauuuuccuccugcuc

SEQ ID NO: 166319 - RNA, 22 nt, Human
aauagagacaguuuaacaauau

SEQ ID NO: 166320 - RNA, 22 nt, Human
uggaagugggcaucaccaucca

SEQ ID NO: 166321 - RNA, 22 nt, Human
ggccugagaagcaaggacacaa

SEQ ID NO: 166322 - RNA, 22 nt, Human
cucuguguguuugugugugugu

SEQ ID NO: 166323 - RNA, 19 nt, Human
uucuuuccccaccccuacc

SEQ ID NO: 166324 - RNA, 22 nt, Human
aggauagacuucagaaggcaua

SEQ ID NO: 166325 - RNA, 22 nt, Human
ggagugaguauguucugaugca

SEQ ID NO: 166326 - RNA, 22 nt, Human
uucccagggaucucuaguauuu

SEQ ID NO: 166327 - RNA, 22 nt, Human
cggcugcagcggagcaggcugg

SEQ ID NO: 166328 - RNA, 22 nt, Human
uagcuggaggggcaggaugcug

SEQ ID NO: 166329 - RNA, 22 nt, Human
cacagugugguauauuucccaa

SEQ ID NO: 166330 - RNA, 22 nt, Human
ugcuuggagaaucagucccagc

SEQ ID NO: 166331 - RNA, 22 nt, Human
uagacugugagcuccuugaggg

SEQ ID NO: 166332 - RNA, 22 nt, Human
augugccuuaauauaggcgcug

SEQ ID NO: 166333 - RNA, 22 nt, Human
guagaacucuuuccugcguggg

SEQ ID NO: 166334 - RNA, 21 nt, Human
gggagaguagcgguagggagg

SEQ ID NO: 166335 - RNA, 22 nt, Human
aggcauauaguguuuaaaaaaa

SEQ ID NO: 166336 - RNA, 22 nt, Human
uuuuauuuguauguugaaugua

SEQ ID NO: 166337 - RNA, 22 nt, Human
cagcccugagagaaccaucuau

SEQ ID NO: 166338 - RNA, 22 nt, Pseudomonas aeruginosa PA01
uucggcauguggacggugaccc

SEQ ID NO: 166339 - RNA, 22 nt, Pseudomonas aeruginosa PA01
cgacccauuggccgaccgggcg

SEQ ID NO: 166340 - RNA, 22 nt, Pseudomonas aeruginosa PA01
gaccaccgcgaacgggcugucc

SEQ ID NO: 166341 - RNA, 22 nt, Pseudomonas aeruginosa PA01
aggucgauauccgggcgcaggu

SEQ ID NO: 166342 - RNA, 22 nt, Pseudomonas aeruginosa PA01
gacguguugcagcaggcuggca

SEQ ID NO: 166343 - RNA, 22 nt, Pseudomonas aeruginosa PA01
cugcggguuguccgcggcgagc

SEQ ID NO: 166344 - RNA, 17 nt, Pseudomonas aeruginosa PA01
gucagguacggauaacu

SEQ ID NO: 166345 - RNA, 22 nt, Pseudomonas aeruginosa PA01
cgccagggcgugccgcugaacg

SEQ ID NO: 166346 - RNA, 22 nt, Pseudomonas aeruginosa PA01
agaucgacgaugcggccgaggu

SEQ ID NO: 166347 - RNA, 22 nt, Pseudomonas aeruginosa PA01
gcgcuuguuugcacgcaccuuc

SEQ ID NO: 166348 - RNA, 22 nt, Pseudomonas aeruginosa PA01
uucccgcuggcagauggcccug

SEQ ID NO: 166349 - RNA, 22 nt, Pseudomonas aeruginosa PA01
ggcgcugggcgucggcguugac

SEQ ID NO: 166350 - RNA, 22 nt, Pseudomonas aeruginosa PA01
gcgcugaucgacugguccagca

SEQ ID NO: 166351 - RNA, 22 nt, Pseudomonas aeruginosa PA01
ccuggcggcaguuggugcagcg

SEQ ID NO: 166352 - RNA, 22 nt, Pseudomonas aeruginosa PA01
cagccccaccgccagcucgucg

SEQ ID NO: 166353 - RNA, 22 nt, Pseudomonas aeruginosa PA01
gagucaacgacaugaccccgcg

SEQ ID NO: 166354 - RNA, 22 nt, Pseudomonas aeruginosa PA01
cgcgacggucaaucgggaagcg

SEQ ID NO: 166355 - RNA, 23 nt, Pseudomonas aeruginosa PA01
aucgccccguucgagcuuggcga

SEQ ID NO: 166356 - RNA, 22 nt, Pseudomonas aeruginosa PA01
gccuuggugcacgaggcgcagg

SEQ ID NO: 166357 - RNA, 22 nt, Pseudomonas aeruginosa PA01
uucggcauccagcggcuccacc

SEQ ID NO: 166358 - RNA, 22 nt, Pseudomonas aeruginosa PA01
ggugggauugcccugcaaggcu

SEQ ID NO: 166359 - RNA, 22 nt, Pseudomonas aeruginosa PA01
ucgucggcgaaaugccggucgc

SEQ ID NO: 166360 - RNA, 22 nt, Pseudomonas aeruginosa PA01
agaggaaccuuccggcugcguc

SEQ ID NO: 166361 - RNA, 22 nt, Pseudomonas aeruginosa PA01
acgcccaggccagcgauggcga

SEQ ID NO: 166362 - RNA, 22 nt, Pseudomonas aeruginosa PA01
accuggcccucuuucaccgccu

SEQ ID NO: 166363 - RNA, 20 nt, Pseudomonas aeruginosa PA01
ccgucgguacuggaacuggg

SEQ ID NO: 166364 - RNA, 22 nt, Pseudomonas aeruginosa PA01
ccgcucugcccgaccggguuga

SEQ ID NO: 166365 - RNA, 22 nt, Pseudomonas aeruginosa PA01
uucguagaucuucagcauggug

SEQ ID NO: 166366 - RNA, 22 nt, Pseudomonas aeruginosa PA01
cguucgccucgaccuggcggaa

SEQ ID NO: 166367 - RNA, 22 nt, Pseudomonas aeruginosa PA01
agcgggcaguugccggugaucg

SEQ ID NO: 166368 - RNA, 22 nt, Pseudomonas aeruginosa PA01
gcggcggucugcgcguggaauu

SEQ ID NO: 166369 - RNA, 22 nt, Pseudomonas aeruginosa PA01
ggcgccaucgucucggugcugc

SEQ ID NO: 166370 - RNA, 22 nt, Pseudomonas aeruginosa PA01
gcgccgaggcaggcguggaccu

SEQ ID NO: 166371 - RNA, 22 nt, Pseudomonas aeruginosa PA01
gcugaucgagcugaccuacgaa

SEQ ID NO: 166372 - RNA, 23 nt, Pseudomonas aeruginosa PA01
ugcucggucucguagacggucga

SEQ ID NO: 166373 - RNA, 21 nt, Pseudomonas aeruginosa PA01
gccagcucggccaggcccugg

SEQ ID NO: 166374 - RNA, 23 nt, Pseudomonas aeruginosa PA01
cgccggugcugccgggcaggacc

SEQ ID NO: 166375 - RNA, 22 nt, Pseudomonas aeruginosa PA01
gccgcgccuguacgauuaccuc

SEQ ID NO: 166376 - RNA, 21 nt, Pseudomonas aeruginosa PA01
agcguucgggcucuucgacga

SEQ ID NO: 166377 - RNA, 22 nt, Pseudomonas aeruginosa PA01
uucgaguggaccagcgguagcg

SEQ ID NO: 166378 - RNA, 22 nt, Pseudomonas aeruginosa PA01
ccuggcgccguucgucgccaac

SEQ ID NO: 166379 - RNA, 22 nt, Pseudomonas aeruginosa PA01
agcggcacuccgaccucggccg

SEQ ID NO: 166380 - RNA, 22 nt, Pseudomonas aeruginosa PA01
gcagaaguccucguggaccagg

SEQ ID NO: 166381 - RNA, 22 nt, Pseudomonas aeruginosa PA01
cgagcgucagcccgcuggucag

SEQ ID NO: 166382 - RNA, 22 nt, Pseudomonas aeruginosa PA01
ccugccugcgccuggccgaggc

SEQ ID NO: 166383 - RNA, 22 nt, Pseudomonas aeruginosa PA01
ccgucagcggccgaaaaacagc

SEQ ID NO: 166384 - RNA, 20 nt, Pseudomonas aeruginosa PA01
uggccgacucguagccggcc

SEQ ID NO: 166385 - RNA, 22 nt, Pseudomonas aeruginosa PA01
cggcaggcgcaugaaggucggg

SEQ ID NO: 166386 - RNA, 19 nt, Pseudomonas aeruginosa PA01
cgccggcgccgggcugauc

SEQ ID NO: 166387 - RNA, 19 nt, Pseudomonas aeruginosa PA01
gcgcggggugcggaugcug

SEQ ID NO: 166388 - RNA, 20 nt, Pseudomonas aeruginosa PA01
ugcuggcaccucgccuagcc

SEQ ID NO: 166389 - RNA, 22 nt, Pseudomonas aeruginosa PA01
accgccgugguagcggcgcagc

SEQ ID NO: 166390 - RNA, 23 nt, Pseudomonas aeruginosa PA01
ggaucgccggacggccgccgagu

SEQ ID NO: 166391 - RNA, 22 nt, Pseudomonas aeruginosa PA01
ccgggcgcuggucugcgcggug

SEQ ID NO: 166392 - RNA, 22 nt, Pseudomonas aeruginosa PA01
aucgccucgggcggcagcagca

SEQ ID NO: 166393 - RNA, 22 nt, Pseudomonas aeruginosa PA01
aggucggcuucgucgucuucca

SEQ ID NO: 166394 - RNA, 18 nt, Pseudomonas aeruginosa PA01
cgagcggcugacggccug

SEQ ID NO: 166395 - RNA, 22 nt, Pseudomonas aeruginosa PA01
ucgcgcgccggauagccgacca

SEQ ID NO: 166396 - RNA, 22 nt, Pseudomonas aeruginosa PA01
gcgccagggucacccguggcuc

SEQ ID NO: 166397 - RNA, 22 nt, Pseudomonas aeruginosa PA01
gagggccuccggaagcccggcc

SEQ ID NO: 166398 - RNA, 22 nt, Pseudomonas aeruginosa PA01
ccggccugucuucugccggaca

SEQ ID NO: 166399 - RNA, 22 nt, Pseudomonas aeruginosa PA01
gagcucgcucuggaugcgcguc

SEQ ID NO: 166400 - RNA, 22 nt, Pseudomonas aeruginosa PA01
accauggccgccuucgagucca

SEQ ID NO: 166401 - RNA, 22 nt, Pseudomonas aeruginosa PA01
ggccggcgacgguggccgaggu

SEQ ID NO: 166402 - RNA, 22 nt, Pseudomonas aeruginosa PA01
gcggacgcucuucggugaagcg

SEQ ID NO: 166403 - RNA, 22 nt, Pseudomonas aeruginosa PA01
cccuguucgagagccuggcgga

SEQ ID NO: 166404 - RNA, 22 nt, Pseudomonas aeruginosa PA01
gggucaggccgauggucgccag

SEQ ID NO: 166405 - RNA, 22 nt, Pseudomonas aeruginosa PA01
ugcuggcguugcucugaucagg

SEQ ID NO: 166406 - RNA, 22 nt, Pseudomonas aeruginosa PA01
cgcaggucggggugucgacgcu

SEQ ID NO: 166407 - RNA, 19 nt, Pseudomonas aeruginosa PA01
ugcuugaccagcucgggac

SEQ ID NO: 166408 - RNA, 22 nt, Pseudomonas aeruginosa PA01
uucgccauguaccagcacgucc

SEQ ID NO: 166409 - RNA, 21 nt, Pseudomonas aeruginosa PA01
ggccaugcucgacaacccguc

SEQ ID NO: 166410 - RNA, 22 nt, Pseudomonas aeruginosa PA01
ggcgggugcucggagcgcuugc

SEQ ID NO: 166411 - RNA, 22 nt, Pseudomonas aeruginosa PA01
gcaguucgaacagcgccggcag

SEQ ID NO: 166412 - RNA, 22 nt, Pseudomonas aeruginosa PA01
cagggccacauggagauggaac

SEQ ID NO: 166413 - RNA, 22 nt, Pseudomonas aeruginosa PA01
aaggccuggcgcuggcccagca

SEQ ID NO: 166414 - RNA, 22 nt, Pseudomonas aeruginosa PA01
aaggcggcaggcuauuaccuuc

SEQ ID NO: 166415 - RNA, 22 nt, Pseudomonas aeruginosa PA01
cugccuggagggcagcgugcgg

SEQ ID NO: 166416 - RNA, 22 nt, Pseudomonas aeruginosa PA01
uccguggucggccuggucuuca

SEQ ID NO: 166417 - RNA, 22 nt, Pseudomonas aeruginosa PA01
cguguucgauccacagcaggcc

SEQ ID NO: 166418 - RNA, 22 nt, Pseudomonas aeruginosa PA01
gaccuugucgaacggcaguuuc

SEQ ID NO: 166419 - RNA, 22 nt, Pseudomonas aeruginosa PA01
gccgguuuccacuccgcgcgcc

SEQ ID NO: 166420 - RNA, 22 nt, Pseudomonas aeruginosa PA01
cagggcggcgaccccguucagc

SEQ ID NO: 166421 - RNA, 22 nt, Pseudomonas aeruginosa PA01
ugacccaggcaccgauccgcgu

SEQ ID NO: 166422 - RNA, 22 nt, Pseudomonas aeruginosa PA01
cugccguuugcguaaggccugc

SEQ ID NO: 166423 - RNA, 22 nt, Pseudomonas aeruginosa PA01
cccggcgcagaugcgcgucgau

SEQ ID NO: 166424 - RNA, 22 nt, Pseudomonas aeruginosa PA01
ugagcaggaccacgucgcucgg

SEQ ID NO: 166425 - RNA, 22 nt, Pseudomonas aeruginosa PA01
gaggaugucguugaucaccagg

SEQ ID NO: 166426 - RNA, 22 nt, Pseudomonas aeruginosa PA01
gaugaugcucuuccaggucucc

SEQ ID NO: 166427 - RNA, 22 nt, Pseudomonas aeruginosa PA01
cacgcggguccaugcgcuaccc

SEQ ID NO: 166428 - RNA, 22 nt, Pseudomonas aeruginosa PA01
gcagcgggaucagcgucgacga

SEQ ID NO: 166429 - RNA, 22 nt, Pseudomonas aeruginosa PA01
ugcuggagaaugucgcggcugc

SEQ ID NO: 166430 - RNA, 22 nt, Pseudomonas aeruginosa PA01
ugagcgccugcucgcggcugau

SEQ ID NO: 166431 - RNA, 19 nt, Pseudomonas aeruginosa PA01
cguuccggcgcuguucguc

SEQ ID NO: 166432 - RNA, 19 nt, Pseudomonas aeruginosa PA01
cgccaucagcgcgggcauc

SEQ ID NO: 166433 - RNA, 22 nt, Pseudomonas aeruginosa PA01
caggcgcucugggaugaucacg

SEQ ID NO: 166434 - RNA, 22 nt, Pseudomonas aeruginosa PA01
uaccggcgaguuccgcgcguuc

SEQ ID NO: 166435 - RNA, 22 nt, Pseudomonas aeruginosa PA01
gaggcguugaccaucaccgaag

SEQ ID NO: 166436 - RNA, 22 nt, Pseudomonas aeruginosa PA01
agcaucuguuguacgucgcucg

SEQ ID NO: 166437 - RNA, 22 nt, Pseudomonas aeruginosa PA01
uuccuugagcuucagcgcgccu

SEQ ID NO: 166438 - RNA, 22 nt, Pseudomonas aeruginosa PA01
ucgugaaauuuuaaguguuauu

SEQ ID NO: 166439 - RNA, 22 nt, Pseudomonas aeruginosa PA01
gucgcgcaguugcggauuaccg

SEQ ID NO: 166440 - RNA, 22 nt, Pseudomonas aeruginosa PA01
aggugguugugcggcgccacgg

SEQ ID NO: 166441 - RNA, 22 nt, Pseudomonas aeruginosa PA01
uugcuugagcgcauggcggagg

SEQ ID NO: 166442 - RNA, 20 nt, Pseudomonas aeruginosa PA01
gcgggcgggcucuaccuggc

SEQ ID NO: 166443 - RNA, 22 nt, Pseudomonas aeruginosa PA01
ccuccuggacaucgacaucgcu

SEQ ID NO: 166444 - RNA, 22 nt, Pseudomonas aeruginosa PA01
aagcggagaacaucgucggcgg

SEQ ID NO: 166445 - RNA, 23 nt, Pseudomonas aeruginosa PA01
aucagcaacgcaaguaacacucg

SEQ ID NO: 166446 - RNA, 22 nt, Pseudomonas aeruginosa PA01
agcaccgcacgguauugcggcu

SEQ ID NO: 166447 - RNA, 22 nt, Pseudomonas aeruginosa PA01
ggcaguuucccaucggccuggc

SEQ ID NO: 166448 - RNA, 22 nt, Pseudomonas aeruginosa PA01
ucggcggugaugaaguaguccg

SEQ ID NO: 166449 - RNA, 22 nt, Pseudomonas aeruginosa PA01
cgccgugggcuccggaagggga

SEQ ID NO: 166450 - RNA, 22 nt, Pseudomonas aeruginosa PA01
cuggauuuuuugccggaaagcc

SEQ ID NO: 166451 - RNA, 22 nt, Pseudomonas aeruginosa PA01
ugggcguucgccuguuggugcu

SEQ ID NO: 166452 - RNA, 19 nt, Pseudomonas aeruginosa PA01
gcgggcauguacgaagggc

SEQ ID NO: 166453 - RNA, 22 nt, Pseudomonas aeruginosa PA01
gcugucgaucacguaacggaug

SEQ ID NO: 166454 - RNA, 22 nt, Pseudomonas aeruginosa PA01
ggcggcgacucgccgguuuccu

SEQ ID NO: 166455 - RNA, 22 nt, Pseudomonas aeruginosa PA01
agagcggcuugcuggucggcgc

SEQ ID NO: 166456 - RNA, 22 nt, Pseudomonas aeruginosa PA01
uuuaucugcaggacccggucgc

SEQ ID NO: 166457 - RNA, 20 nt, Pseudomonas aeruginosa PA01
accugcugcaacaggcucgc

SEQ ID NO: 166458 - RNA, 22 nt, Pseudomonas aeruginosa PA01
cgugaucggcgcgcugauggcg

SEQ ID NO: 166459 - RNA, 22 nt, Pseudomonas aeruginosa PA01
aacugaacaauauguugucgcc

SEQ ID NO: 166460 - RNA, 22 nt, Pseudomonas aeruginosa PA01
uccgugccaugcaguugcugcg

SEQ ID NO: 166461 - RNA, 22 nt, Pseudomonas aeruginosa PA01
ugcugcugagguagucggcuac

SEQ ID NO: 166462 - RNA, 22 nt, Pseudomonas aeruginosa PA01
gccggccuccgccuggcugugc

SEQ ID NO: 166463 - RNA, 22 nt, Pseudomonas aeruginosa PA01
ugcgugggucgcgcugggcguu

SEQ ID NO: 166464 - RNA, 22 nt, Pseudomonas aeruginosa PA01
caccgcgcggccaugaaaaaac

SEQ ID NO: 166465 - RNA, 22 nt, Pseudomonas aeruginosa PA01
uucgccgucgaacagccgcuuc

SEQ ID NO: 166466 - RNA, 22 nt, Pseudomonas aeruginosa PA01
gacgccuccuucacguugcgcg

SEQ ID NO: 166467 - RNA, 19 nt, Pseudomonas aeruginosa PA01
gcuuccaguuggcggcuuc

SEQ ID NO: 166468 - RNA, 22 nt, Pseudomonas aeruginosa PA01
ggacggccuguucgugccggug

SEQ ID NO: 166469 - RNA, 22 nt, Pseudomonas aeruginosa PA01
gugcaccgacaacugcggcaau

SEQ ID NO: 166470 - RNA, 22 nt, Pseudomonas aeruginosa PA01
gcgggacaaugacacuggccuc

SEQ ID NO: 166471 - RNA, 22 nt, Pseudomonas aeruginosa PA01
ucugcgcgacagcgucggcgaa

SEQ ID NO: 166472 - RNA, 22 nt, Pseudomonas aeruginosa PA01
uugcccggaucgaccaccagcg

SEQ ID NO: 166473 - RNA, 21 nt, Pseudomonas aeruginosa PA01
cgggucgucgcuguccggcag

SEQ ID NO: 166474 - RNA, 22 nt, Pseudomonas aeruginosa PA01
gagccgcuggcguucgucgcgg

SEQ ID NO: 166475 - RNA, 22 nt, Pseudomonas aeruginosa PA01
guugcugggugaaggcgaugau

SEQ ID NO: 166476 - RNA, 22 nt, Pseudomonas aeruginosa PA01
gcagugguucugggucucgcug

SEQ ID NO: 166477 - RNA, 22 nt, Pseudomonas aeruginosa PA01
uggccguugcgguggacccggc

SEQ ID NO: 166478 - RNA, 22 nt, Pseudomonas aeruginosa PA01
uggugaacggugugagcaugcc

SEQ ID NO: 166479 - RNA, 22 nt, Pseudomonas aeruginosa PA01
cgguaggcguggccaccagccu

SEQ ID NO: 166480 - RNA, 22 nt, Pseudomonas aeruginosa PA01
cuggacagcaggcggcgggcga

SEQ ID NO: 166481 - RNA, 21 nt, Pseudomonas aeruginosa PA01
ggccaacuggcguaucgacgg

SEQ ID NO: 166482 - RNA, 22 nt, Pseudomonas aeruginosa PA01
uugccggucggguugaugugga

SEQ ID NO: 166483 - RNA, 22 nt, Pseudomonas aeruginosa PA01
uuucuucccggccaggccgaga

SEQ ID NO: 166484 - RNA, 22 nt, Pseudomonas aeruginosa PA01
ucccgaccuucaugcgccugcc

SEQ ID NO: 166485 - RNA, 22 nt, Pseudomonas aeruginosa PA01
cgguggucggcuauccggcgcg

SEQ ID NO: 166486 - RNA, 22 nt, Pseudomonas aeruginosa PA01
gccucgcugucgauggccgggu

SEQ ID NO: 166487 - RNA, 22 nt, Pseudomonas aeruginosa PA01
cagcacgcgcagcuuggccggc

SEQ ID NO: 166488 - RNA, 22 nt, Pseudomonas aeruginosa PA01
gguuucucuggcucggcagauc

SEQ ID NO: 166489 - RNA, 22 nt, Pseudomonas aeruginosa PA01
ugguccagcggcgggucgaacu

SEQ ID NO: 166490 - RNA, 22 nt, Pseudomonas aeruginosa PA01
cagcaccucggcuucuacgacc

SEQ ID NO: 166491 - RNA, 22 nt, Pseudomonas aeruginosa PA01
cgccucggcgauguuggccagu

SEQ ID NO: 166492 - RNA, 21 nt, Pseudomonas aeruginosa PA01
uuccagcgccugcugaccuuc

SEQ ID NO: 166493 - RNA, 22 nt, Pseudomonas aeruginosa PA01
cgcuuggccacgucuuccucgg

SEQ ID NO: 166494 - RNA, 21 nt, Pseudomonas aeruginosa PA01
cuucgcgacggauggcgcagc

SEQ ID NO: 166495 - RNA, 22 nt, Pseudomonas aeruginosa PA01
ucuggucgcuggcgcugguagu

SEQ ID NO: 166496 - RNA, 20 nt, Pseudomonas aeruginosa PA01
cgcaggucggccuuggcgca

SEQ ID NO: 166497 - RNA, 22 nt, Pseudomonas aeruginosa PA01
cucgguagccgcgcucugcgug

SEQ ID NO: 166498 - RNA, 22 nt, Pseudomonas aeruginosa PA01
cuccagccuggccauccagugg

SEQ ID NO: 166499 - RNA, 22 nt, Pseudomonas aeruginosa PA01
ucgacgaagcgccgcuggccgg

SEQ ID NO: 166500 - RNA, 22 nt, Pseudomonas aeruginosa PA01
uaggcgcuggccagcagggugu

SEQ ID NO: 166501 - RNA, 22 nt, Pseudomonas aeruginosa PA01
gccaucgagaaccagaucaagc

SEQ ID NO: 166502 - RNA, 22 nt, Pseudomonas aeruginosa PA01
gccuauccgacccgucccgaac

SEQ ID NO: 166503 - RNA, 22 nt, Pseudomonas aeruginosa PA01
ggggcggcgacguucagcccgg

SEQ ID NO: 166504 - RNA, 22 nt, Pseudomonas aeruginosa PA01
cgaugcccagugccagcaggca

SEQ ID NO: 166505 - RNA, 22 nt, Pseudomonas aeruginosa PA01
ucagccaggucuggcggaugua

SEQ ID NO: 166506 - RNA, 22 nt, Pseudomonas aeruginosa PA01
cgccuggcccugcaacggcuug

SEQ ID NO: 166507 - RNA, 22 nt, Pseudomonas aeruginosa PA01
caggcgguacgcagcggucgcu

SEQ ID NO: 166508 - RNA, 22 nt, Pseudomonas aeruginosa PA01
agcuucauggagcccucggcga

SEQ ID NO: 166509 - RNA, 23 nt, Pseudomonas aeruginosa PA01
ucucgccauagcugcgcagcgcc

SEQ ID NO: 166510 - RNA, 22 nt, Pseudomonas aeruginosa PA01
uuccgaccucgaucuccccgag

SEQ ID NO: 166511 - RNA, 22 nt, Pseudomonas aeruginosa PA01
agcuggaagcccgacgccgaua

SEQ ID NO: 166512 - RNA, 22 nt, Pseudomonas aeruginosa PA01
gggcgauccgcucgcugcgcca

SEQ ID NO: 166513 - RNA, 22 nt, Pseudomonas aeruginosa PA01
gcggcgcuguucgucaugccgc

SEQ ID NO: 166514 - RNA, 22 nt, Pseudomonas aeruginosa PA01
agaggcgcugcgcaguugcgug

SEQ ID NO: 166515 - RNA, 22 nt, Pseudomonas aeruginosa PA01
cugcgcgccguaggccagcucg

SEQ ID NO: 166516 - RNA, 22 nt, Pseudomonas aeruginosa PA01
gucgccaugccauccucgcgcu

SEQ ID NO: 166517 - RNA, 22 nt, Pseudomonas aeruginosa PA01
uggccgucggggacguccacgu

SEQ ID NO: 166518 - RNA, 22 nt, Pseudomonas aeruginosa PA01
gugcuccaggcauucgucgagg

SEQ ID NO: 166519 - RNA, 22 nt, Pseudomonas aeruginosa PA01
cggucgaggagcagcccggcac

SEQ ID NO: 166520 - RNA, 22 nt, Pseudomonas aeruginosa PA01
ugguggugggaagcgaugccga

SEQ ID NO: 166521 - RNA, 22 nt, Pseudomonas aeruginosa PA01
aguucugcaugaccgguucgcg

SEQ ID NO: 166522 - RNA, 22 nt, Pseudomonas aeruginosa PA01
ggucggcgaccuggcggaccuc

SEQ ID NO: 166523 - RNA, 22 nt, Pseudomonas aeruginosa PA01
ugcgguccucggugaucagcgc

SEQ ID NO: 166524 - RNA, 22 nt, Pseudomonas aeruginosa PA01
ucagggcagccugccucgccuc

SEQ ID NO: 166525 - RNA, 19 nt, Pseudomonas aeruginosa PA01
uggcgcuggugagcccggc

SEQ ID NO: 166526 - RNA, 22 nt, Pseudomonas aeruginosa PA01
uguugcugucuucgccggugcu

SEQ ID NO: 166527 - RNA, 22 nt, Pseudomonas aeruginosa PA01
ucuugcgcuuguccuggaagau

SEQ ID NO: 166528 - RNA, 22 nt, Pseudomonas aeruginosa PA01
ucgccuggacguugggaauggu

SEQ ID NO: 166529 - RNA, 21 nt, Pseudomonas aeruginosa PA01
uccaccaguucgaacagcggc

SEQ ID NO: 166530 - RNA, 22 nt, Pseudomonas aeruginosa PA01
ugcugucucuggugcgggucug

SEQ ID NO: 166531 - RNA, 22 nt, Pseudomonas aeruginosa PA01
cggcgcuggaucggcccccucu

SEQ ID NO: 166532 - RNA, 22 nt, Pseudomonas aeruginosa PA01
cgucgcuguugcucucgugggu

SEQ ID NO: 166533 - RNA, 22 nt, Pseudomonas aeruginosa PA01
ucgcgccugcacuacuucggca

SEQ ID NO: 166534 - RNA, 22 nt, Pseudomonas aeruginosa PA01
aggauuuccggaucguuggcca

SEQ ID NO: 166535 - RNA, 22 nt, Pseudomonas aeruginosa PA01
ugcgccuggagcaggccugcga

SEQ ID NO: 166536 - RNA, 22 nt, Pseudomonas aeruginosa PA01
ucguccauguccgcgaucaggg

SEQ ID NO: 166537 - RNA, 22 nt, Pseudomonas aeruginosa PA01
caccgcggauccacugggccag

SEQ ID NO: 166538 - RNA, 22 nt, Pseudomonas aeruginosa PA01
gucgccauuccggcuuguuggu

SEQ ID NO: 166539 - RNA, 22 nt, Pseudomonas aeruginosa PA01
gcaugucgcucaugucgacgaa

SEQ ID NO: 166540 - RNA, 22 nt, Pseudomonas aeruginosa PA01
gcgugcacuuacuccgaaggcu

SEQ ID NO: 166541 - RNA, 22 nt, Pseudomonas aeruginosa PA01
aucagcgaccgauugcgauggc

SEQ ID NO: 166542 - RNA, 22 nt, Pseudomonas aeruginosa PA01
guucggcauucuccaggcgcgc

SEQ ID NO: 166543 - RNA, 22 nt, Pseudomonas aeruginosa PA01
gucguucggugaucaaccugau

SEQ ID NO: 166544 - RNA, 22 nt, Pseudomonas aeruginosa PA01
ugcgccgcgaugccagcacccu

SEQ ID NO: 166545 - RNA, 22 nt, Pseudomonas aeruginosa PA01
uucgccaagcugcugcccuggc

SEQ ID NO: 166546 - RNA, 22 nt, Pseudomonas aeruginosa PA01
gggagauggucgaggacaugau

SEQ ID NO: 166547 - RNA, 22 nt, Pseudomonas aeruginosa PA01
gccggugcagagcuucgugacc

SEQ ID NO: 166548 - RNA, 22 nt, Pseudomonas aeruginosa PA01
uguggcgcaggcgcaguugcgc

SEQ ID NO: 166549 - RNA, 22 nt, Pseudomonas aeruginosa PA01
gcaugccgaccagcauccgggc

SEQ ID NO: 166550 - RNA, 22 nt, Pseudomonas aeruginosa PA01
augcugguggaggacugguuga

SEQ ID NO: 166551 - RNA, 22 nt, Pseudomonas aeruginosa PA01
aggcaacgaugaugacggcgau

SEQ ID NO: 166552 - RNA, 22 nt, Pseudomonas aeruginosa PA01
ucggucucggccagacuaccgc

SEQ ID NO: 166553 - RNA, 22 nt, Pseudomonas aeruginosa PA01
cgugaccuacauccugaccuuc

SEQ ID NO: 166554 - RNA, 22 nt, Pseudomonas aeruginosa PA01
ggacgcacuucgcugcgggucg

SEQ ID NO: 166555 - RNA, 22 nt, Pseudomonas aeruginosa PA01
gcugguugaugucgcggcggau

SEQ ID NO: 166556 - RNA, 22 nt, Pseudomonas aeruginosa PA01
gcuuggcgcacugcgcgaauuc

SEQ ID NO: 166557 - RNA, 23 nt, Pseudomonas aeruginosa PA01
ccgccgaucaguuccguucgcgc

SEQ ID NO: 166558 - RNA, 22 nt, Pseudomonas aeruginosa PA01
cggguaggccagcgguauccau

SEQ ID NO: 166559 - RNA, 22 nt, Pseudomonas aeruginosa PA01
gcggcggagguccgcgcauguc

SEQ ID NO: 166560 - RNA, 20 nt, Pseudomonas aeruginosa PA01
ugucugcgaaaccgccccgg

SEQ ID NO: 166561 - RNA, 22 nt, Pseudomonas aeruginosa PA01
ucaccggcuacgaccugggcau

SEQ ID NO: 166562 - RNA, 22 nt, Pseudomonas aeruginosa PA01
augcuggaagagucguacgugu

SEQ ID NO: 166563 - RNA, 22 nt, Pseudomonas aeruginosa PA01
gaucagucuuccuggcgcaggu

SEQ ID NO: 166564 - RNA, 22 nt, Pseudomonas aeruginosa PA01
agcaguggucgcaggaaauccg

SEQ ID NO: 166565 - RNA, 22 nt, Pseudomonas aeruginosa PA01
ugcugccgggcaggaccagcau

SEQ ID NO: 166566 - RNA, 22 nt, Pseudomonas aeruginosa PA01
uucaagcagcgcacuucgcugg

SEQ ID NO: 166567 - RNA, 22 nt, Pseudomonas aeruginosa PA01
gcuggagcuucgccggaagcgg

SEQ ID NO: 166568 - RNA, 22 nt, Pseudomonas aeruginosa PA01
guuuucgcugcgcaggcugucc

SEQ ID NO: 166569 - RNA, 22 nt, Pseudomonas aeruginosa PA01
gccccgguaacugccauuacca

SEQ ID NO: 166570 - RNA, 22 nt, Pseudomonas aeruginosa PA01
ccggcggcgucgaugucguggc

SEQ ID NO: 166571 - RNA, 22 nt, Pseudomonas aeruginosa PA01
guugagcaggugcucguugugc

SEQ ID NO: 166572 - RNA, 22 nt, Pseudomonas aeruginosa PA01
augcgguucugcuggucggacu

SEQ ID NO: 166573 - RNA, 22 nt, Pseudomonas aeruginosa PA01
ggcgagcuuggcggcgauggcg

SEQ ID NO: 166574 - RNA, 22 nt, Pseudomonas aeruginosa PA01
cggagguaggcgcgcugcgcug

SEQ ID NO: 166575 - RNA, 22 nt, Pseudomonas aeruginosa PA01
cuaccggagccaggccgaaauc

SEQ ID NO: 166576 - RNA, 22 nt, Pseudomonas aeruginosa PA01
gaggccgagguagucgagggcg

SEQ ID NO: 166577 - RNA, 22 nt, Pseudomonas aeruginosa PA01
ucuccuggcugaccaggggcga

SEQ ID NO: 166578 - RNA, 22 nt, Pseudomonas aeruginosa PA01
uguggcaagucaccgacgaugc

SEQ ID NO: 166579 - RNA, 22 nt, Pseudomonas aeruginosa PA01
acgugcugaaucgggaaagcgg

SEQ ID NO: 166580 - RNA, 22 nt, Pseudomonas aeruginosa PA01
gcucgcugaagacgcuacgggu

SEQ ID NO: 166581 - RNA, 22 nt, Pseudomonas aeruginosa PA01
guugcgcgccguccucggugcc

SEQ ID NO: 166582 - RNA, 22 nt, Pseudomonas aeruginosa PA01
agcgccucgaccuggcguucga

SEQ ID NO: 166583 - RNA, 22 nt, Pseudomonas aeruginosa PA01
cagccgaaaagagcuggggcuu

SEQ ID NO: 166584 - RNA, 22 nt, Pseudomonas aeruginosa PA01
cgcauuaucuggaacucgcgga

SEQ ID NO: 166585 - RNA, 22 nt, Pseudomonas aeruginosa PA01
gcugaagggcuccgcgcugucc

SEQ ID NO: 166586 - RNA, 19 nt, Pseudomonas aeruginosa PA01
caacggcuccgggaagucc

SEQ ID NO: 166587 - RNA, 22 nt, Pseudomonas aeruginosa PA01
cggcgcaucgucgaaacgcugg

SEQ ID NO: 166588 - RNA, 22 nt, Pseudomonas aeruginosa PA01
uuccuggggcacugccgcgacg

SEQ ID NO: 166589 - RNA, 22 nt, Pseudomonas aeruginosa PA01
agcgcuggcacgggcucgccga

SEQ ID NO: 166590 - RNA, 22 nt, Pseudomonas aeruginosa PA01
ggcucccuuggccauuuccgcc

SEQ ID NO: 166591 - RNA, 22 nt, Pseudomonas aeruginosa PA01
gcggcggugggccagguaccgg

SEQ ID NO: 166592 - RNA, 22 nt, Pseudomonas aeruginosa PA01
gucgccgaccaggcggccgucg

SEQ ID NO: 166593 - RNA, 22 nt, Pseudomonas aeruginosa PA01
accggugggcaacuggccggcg

SEQ ID NO: 166594 - RNA, 22 nt, Pseudomonas aeruginosa PA01
ccgguugccgcgagccgagcau

SEQ ID NO: 166595 - RNA, 22 nt, Pseudomonas aeruginosa PA01
aggacgcugaaggcaugcucca

SEQ ID NO: 166596 - RNA, 22 nt, Pseudomonas aeruginosa PA01
acguggcuuugcgguggucgcc

SEQ ID NO: 166597 - RNA, 22 nt, Pseudomonas aeruginosa PA01
cauccggcggacagcccgcccc

SEQ ID NO: 166598 - RNA, 22 nt, Pseudomonas aeruginosa PA01
ccagggugccgcgcaucugcaa

SEQ ID NO: 166599 - RNA, 22 nt, Pseudomonas aeruginosa PA01
cgucuagccgcccgccggccag

SEQ ID NO: 166600 - RNA, 22 nt, Pseudomonas aeruginosa PA01
aggccggguugauggccaggau

SEQ ID NO: 166601 - RNA, 22 nt, Pseudomonas aeruginosa PA01
agcgaccugcgccugcugcagg

SEQ ID NO: 166602 - RNA, 22 nt, Pseudomonas aeruginosa PA01
ccggagauggaagcacagggcu

SEQ ID NO: 166603 - RNA, 22 nt, Pseudomonas aeruginosa PA01
accgacgaucagugcgcggcug

SEQ ID NO: 166604 - RNA, 22 nt, Pseudomonas aeruginosa PA01
guggcccguguggcugacucga

SEQ ID NO: 166605 - RNA, 22 nt, Pseudomonas aeruginosa PA01
acggcacgcuugaucgccucgg

SEQ ID NO: 166606 - RNA, 22 nt, Pseudomonas aeruginosa PA01
ucacgccguucagggucagguu

SEQ ID NO: 166607 - RNA, 22 nt, Pseudomonas aeruginosa PA01
ucgugcugaaguggcauuugcc

SEQ ID NO: 166608 - RNA, 22 nt, Pseudomonas aeruginosa PA01
ggaagcggaacagcgcgccaug

SEQ ID NO: 166609 - RNA, 22 nt, Pseudomonas aeruginosa PA01
gaccucauggaacagguucaug

SEQ ID NO: 166610 - RNA, 22 nt, Pseudomonas aeruginosa PA01
aggcgaagacguccuugagcag

SEQ ID NO: 166611 - RNA, 22 nt, Pseudomonas aeruginosa PA01
gcgaagaacaauuugcgcgccg

SEQ ID NO: 166612 - RNA, 22 nt, Pseudomonas aeruginosa PA01
cggcuguugcaguagacgccgc

SEQ ID NO: 166613 - RNA, 22 nt, Pseudomonas aeruginosa PA01
gccgggcgucggcaccgaggug

SEQ ID NO: 166614 - RNA, 22 nt, Pseudomonas aeruginosa PA01
gccgaggagaccuggcggguac

SEQ ID NO: 166615 - RNA, 22 nt, Pseudomonas aeruginosa PA01
ccuacggcgaacggcggcgaac

SEQ ID NO: 166616 - RNA, 22 nt, Pseudomonas aeruginosa PA01
gauccccugggcgucguugcgg

SEQ ID NO: 166617 - RNA, 22 nt, Pseudomonas aeruginosa PA01
gcgaccagguccagaugcucgu

SEQ ID NO: 166618 - RNA, 22 nt, Pseudomonas aeruginosa PA01
ggcugccgccgauggccuugga

SEQ ID NO: 166619 - RNA, 22 nt, Pseudomonas aeruginosa PA01
cagcgcguucuuggccugccag

SEQ ID NO: 166620 - RNA, 22 nt, Pseudomonas aeruginosa PA01
agccggugaagcugaccaucgc

SEQ ID NO: 166621 - RNA, 22 nt, Pseudomonas aeruginosa PA01
agauugucgaagcggcgcugga

SEQ ID NO: 166622 - RNA, 18 nt, Pseudomonas aeruginosa PA01
ucggcgcgcacucggugg

SEQ ID NO: 166623 - RNA, 18 nt, Pseudomonas aeruginosa PA01
ggcaggaugcacgucgcc

SEQ ID NO: 166624 - RNA, 22 nt, Pseudomonas aeruginosa PA01
augccgagcugggcggcgcugg

SEQ ID NO: 166625 - RNA, 22 nt, Pseudomonas aeruginosa PA01
gccggagcugccggccgaccug

SEQ ID NO: 166626 - RNA, 22 nt, Pseudomonas aeruginosa PA01
accgcggugacaucggugccgg

SEQ ID NO: 166627 - RNA, 22 nt, Pseudomonas aeruginosa PA01
ugccgguguugaucucgccgau

SEQ ID NO: 166628 - RNA, 22 nt, Pseudomonas aeruginosa PA01
cacgaaugcauccucgaccugc

SEQ ID NO: 166629 - RNA, 22 nt, Pseudomonas aeruginosa PA01
cgcaccucaaaggggaucacgg

SEQ ID NO: 166630 - RNA, 22 nt, Pseudomonas aeruginosa PA01
ggucgucgagcagcucgcgcag

SEQ ID NO: 166631 - RNA, 22 nt, Pseudomonas aeruginosa PA01
gcgggcugcgccaggguguugc

SEQ ID NO: 166632 - RNA, 22 nt, Pseudomonas aeruginosa PA01
gggcgcuggcguuguugauggc

SEQ ID NO: 166633 - RNA, 22 nt, Pseudomonas aeruginosa PA01
ucgacgaaggcccgggcgcucc

SEQ ID NO: 166634 - RNA, 22 nt, Pseudomonas aeruginosa PA01
auggcgucggcuaccgccuggc

SEQ ID NO: 166635 - RNA, 22 nt, Pseudomonas aeruginosa PA01
gcgcuaucgaugcgaucuucgc

SEQ ID NO: 166636 - RNA, 22 nt, Pseudomonas aeruginosa PA01
cugcuggagcgcggcgagacca

SEQ ID NO: 166637 - RNA, 21 nt, Pseudomonas aeruginosa PA01
ggcaucggccauggccggcag

SEQ ID NO: 166638 - RNA, 22 nt, Pseudomonas aeruginosa PA01
aagcaguucgacguggccgagg

SEQ ID NO: 166639 - RNA, 22 nt, Pseudomonas aeruginosa PA01
ucaggcgcggagugaucucgcc

SEQ ID NO: 166640 - RNA, 22 nt, Pseudomonas aeruginosa PA01
auuccccguuaaccuuaaguua

SEQ ID NO: 166641 - RNA, 22 nt, Pseudomonas aeruginosa PA01
ccgcucaagggcgugaccuugc

SEQ ID NO: 166642 - RNA, 22 nt, Pseudomonas aeruginosa PA01
cgaccccggccuucuugcccga

SEQ ID NO: 166643 - RNA, 22 nt, Pseudomonas aeruginosa PA01
ccgucagcgguucauuccauuu

SEQ ID NO: 166644 - RNA, 22 nt, Pseudomonas aeruginosa PA01
ucgccgaccucagcgccgggga

SEQ ID NO: 166645 - RNA, 22 nt, Pseudomonas aeruginosa PA01
agccugauggugguggacgccc

SEQ ID NO: 166646 - RNA, 22 nt, Pseudomonas aeruginosa PA01
gcacuucgaacuggccgccgac

SEQ ID NO: 166647 - RNA, 22 nt, Pseudomonas aeruginosa PA01
gccuggugaguaccggcgacag

SEQ ID NO: 166648 - RNA, 22 nt, Pseudomonas aeruginosa PA01
ggccggcaccgaugucaccgcg

SEQ ID NO: 166649 - RNA, 22 nt, Pseudomonas aeruginosa PA01
gcagcgcugcgcgagcagggug

SEQ ID NO: 166650 - RNA, 22 nt, Pseudomonas aeruginosa PA01
uggccgcgcaccagaucgccau

SEQ ID NO: 166651 - RNA, 20 nt, Pseudomonas aeruginosa PA01
aggaggccggcuuguugcgg

SEQ ID NO: 166652 - RNA, 22 nt, Pseudomonas aeruginosa PA01
ggcgccugggucugccccgccu

SEQ ID NO: 166653 - RNA, 22 nt, Pseudomonas aeruginosa PA01
uugggcaaagucugccgcacua

SEQ ID NO: 166654 - RNA, 22 nt, Pseudomonas aeruginosa PA01
uacgaccaggguggccuggccg

SEQ ID NO: 166655 - RNA, 22 nt, Pseudomonas aeruginosa PA01
cggcggaugcaguuggccgccg

SEQ ID NO: 166656 - RNA, 22 nt, Pseudomonas aeruginosa PA01
cggguucauggucuucagcgcc

SEQ ID NO: 166657 - RNA, 22 nt, Pseudomonas aeruginosa PA01
ugcggcguucugcucgggaucc

SEQ ID NO: 166658 - RNA, 22 nt, Pseudomonas aeruginosa PA01
gucggcucauggcuucagcucc

SEQ ID NO: 166659 - RNA, 22 nt, Pseudomonas aeruginosa PA01
ggcuccugguugccgggagcgg

SEQ ID NO: 166660 - RNA, 22 nt, Pseudomonas aeruginosa PA01
aaccuucugaccgggugcggcg

SEQ ID NO: 166661 - RNA, 21 nt, Pseudomonas aeruginosa PA01
ugagcgugcuggagaaccgcc

SEQ ID NO: 166662 - RNA, 22 nt, Pseudomonas aeruginosa PA01
gccuggcgggccaguucggcgc

SEQ ID NO: 166663 - RNA, 22 nt, Pseudomonas aeruginosa PA01
uugcggcgaugcucggcgaugg

SEQ ID NO: 166664 - RNA, 22 nt, Pseudomonas aeruginosa PA01
ccagcgcgccgacgucgcccau

SEQ ID NO: 166665 - RNA, 22 nt, Pseudomonas aeruginosa PA01
auugggcgugucgcgggugcug

SEQ ID NO: 166666 - RNA, 22 nt, Pseudomonas aeruginosa PA01
gcgcugauggccggcuggccgg

SEQ ID NO: 166667 - RNA, 21 nt, Pseudomonas aeruginosa PA01
cgcaggcgaccugugggucgg

SEQ ID NO: 166668 - RNA, 22 nt, Pseudomonas aeruginosa PA01
gaccaccuccuuguacugacug

SEQ ID NO: 166669 - RNA, 22 nt, Pseudomonas aeruginosa PA01
cuggaggagguaaggguaacga

SEQ ID NO: 166670 - RNA, 22 nt, Pseudomonas aeruginosa PA01
gccgcgcugcuggcgaagcuga

SEQ ID NO: 166671 - RNA, 22 nt, Pseudomonas aeruginosa PA01
gcggcccagcgguucgccggcc

SEQ ID NO: 166672 - RNA, 22 nt, Pseudomonas aeruginosa PA01
gggagcuggccgaugaucucgg

SEQ ID NO: 166673 - RNA, 22 nt, Pseudomonas aeruginosa PA01
gcaugguggcguucgacgugau

SEQ ID NO: 166674 - RNA, 22 nt, Pseudomonas aeruginosa PA01
cucgccggcgccaugcagcagc

SEQ ID NO: 166675 - RNA, 23 nt, Pseudomonas aeruginosa PA01
ccgcggccugcaauucuuccagc

SEQ ID NO: 166676 - RNA, 22 nt, Pseudomonas aeruginosa PA01
cugccggccaggcggguguuca

SEQ ID NO: 166677 - RNA, 22 nt, Pseudomonas aeruginosa PA01
gcggaguggguguuggaguagg

SEQ ID NO: 166678 - RNA, 22 nt, Pseudomonas aeruginosa PA01
uucgccauggacccggaguucg

SEQ ID NO: 166679 - RNA, 22 nt, Pseudomonas aeruginosa PA01
caggucgaggucgguguugucg

SEQ ID NO: 166680 - RNA, 22 nt, Pseudomonas aeruginosa PA01
uggauggcacccucgccgaaca

SEQ ID NO: 166681 - RNA, 22 nt, Pseudomonas aeruginosa PA01
uugcccucggcgaacgcuucuc

SEQ ID NO: 166682 - RNA, 22 nt, Pseudomonas aeruginosa PA01
cugcgcucguauucacccaugg

SEQ ID NO: 166683 - RNA, 20 nt, Pseudomonas aeruginosa PA01
cugcagcagaacgguggcgc

SEQ ID NO: 166684 - RNA, 22 nt, Pseudomonas aeruginosa PA01
aucccgagcagaacgccgcauu

SEQ ID NO: 166685 - RNA, 22 nt, Pseudomonas aeruginosa PA01
cggucgcaguagaagcaguagu

SEQ ID NO: 166686 - RNA, 22 nt, Pseudomonas aeruginosa PA01
uuggccgccagcagcaacugcu

SEQ ID NO: 166687 - RNA, 22 nt, Pseudomonas aeruginosa PA01
augcgagccuguugcagcaggu

SEQ ID NO: 166688 - RNA, 22 nt, Pseudomonas aeruginosa PA01
gcuggccaccagcgccuggcgc

SEQ ID NO: 166689 - RNA, 22 nt, Pseudomonas aeruginosa PA01
gcugcaggucggggagggcgag

SEQ ID NO: 166690 - RNA, 21 nt, Pseudomonas aeruginosa PA01
ccuuuuucguggaucgcacgg

SEQ ID NO: 166691 - RNA, 22 nt, Pseudomonas aeruginosa PA01
ucuggcagaacaggcgcccgcc

SEQ ID NO: 166692 - RNA, 22 nt, Pseudomonas aeruginosa PA01
gcgcccggugugccggcuggcg

SEQ ID NO: 166693 - RNA, 22 nt, Pseudomonas aeruginosa PA01
aucggccgacacccauugcagg

SEQ ID NO: 166694 - RNA, 22 nt, Pseudomonas aeruginosa PA01
ggcgggugcugcuggaggaccu

SEQ ID NO: 166695 - RNA, 22 nt, Pseudomonas aeruginosa PA01
acccgcgaacagccagcggcgc

SEQ ID NO: 166696 - RNA, 22 nt, Pseudomonas aeruginosa PA01
gccgccgucguggaugcgcugg

SEQ ID NO: 166697 - RNA, 22 nt, Pseudomonas aeruginosa PA01
aggugucguccggucucgagua

SEQ ID NO: 166698 - RNA, 22 nt, Pseudomonas aeruginosa PA01
ucggugguguagacgccgucga

SEQ ID NO: 166699 - RNA, 22 nt, Pseudomonas aeruginosa PA01
ccgccgaagcgcauggucaggc

SEQ ID NO: 166700 - RNA, 22 nt, Pseudomonas aeruginosa PA01
cacguggggcagcauggcgcga

SEQ ID NO: 166701 - RNA, 22 nt, Pseudomonas aeruginosa PA01
agcaccgucgagcuggagcagg

SEQ ID NO: 166702 - RNA, 22 nt, Pseudomonas aeruginosa PA01
uggcgcugagcguggcgaugaa

SEQ ID NO: 166703 - RNA, 22 nt, Pseudomonas aeruginosa PA01
gcgccacggcauucugcgacug

SEQ ID NO: 166704 - RNA, 22 nt, Pseudomonas aeruginosa PA01
ccggcagccacugcgccugcug

SEQ ID NO: 166705 - RNA, 22 nt, Pseudomonas aeruginosa PA01
cguggaguggaucagguacgcc

SEQ ID NO: 166706 - RNA, 22 nt, Pseudomonas aeruginosa PA01
ucgaggccgcgcaccacguccg

SEQ ID NO: 166707 - RNA, 22 nt, Pseudomonas aeruginosa PA01
gccucgacguacucgcggagau

SEQ ID NO: 166708 - RNA, 22 nt, Pseudomonas aeruginosa PA01
guugccgaucacgcugucaugg

SEQ ID NO: 166709 - RNA, 22 nt, Pseudomonas aeruginosa PA01
cgcgggccugcucgcuguuggu

SEQ ID NO: 166710 - RNA, 19 nt, Pseudomonas aeruginosa PA01
ggcuucugcgccucgucga

SEQ ID NO: 166711 - RNA, 22 nt, Pseudomonas aeruginosa PA01
ccgugcccgcuucagcgugcug

SEQ ID NO: 166712 - RNA, 22 nt, Pseudomonas aeruginosa PA01
gguugaacagcggcuggccggc

SEQ ID NO: 166713 - RNA, 22 nt, Pseudomonas aeruginosa PA01
ccggcgcgccagaacucgaccg

SEQ ID NO: 166714 - RNA, 22 nt, Pseudomonas aeruginosa PA01
guggcgacgagcagcgaguucu

SEQ ID NO: 166715 - RNA, 22 nt, Pseudomonas aeruginosa PA01
ugccgaucgccaccgccuggcc

SEQ ID NO: 166716 - RNA, 22 nt, Pseudomonas aeruginosa PA01
cugcgccgaggcucaggcgcca

SEQ ID NO: 166717 - RNA, 22 nt, Pseudomonas aeruginosa PA01
gcuggcugcaauaacccacugc

SEQ ID NO: 166718 - RNA, 22 nt, Pseudomonas aeruginosa PA01
cgccaucggugccucggccggc

SEQ ID NO: 166719 - RNA, 22 nt, Pseudomonas aeruginosa PA01
gggcgaggacgucgaccuugag

SEQ ID NO: 166720 - RNA, 22 nt, Pseudomonas aeruginosa PA01
aucacguccggcaggcgcucga

SEQ ID NO: 166721 - RNA, 20 nt, Pseudomonas aeruginosa PA01
cgcugcuccgcugugggguc

SEQ ID NO: 166722 - RNA, 22 nt, Pseudomonas aeruginosa PA01
gcauccgcgauguguucgaggg

SEQ ID NO: 166723 - RNA, 22 nt, Pseudomonas aeruginosa PA01
cggcaagggcggcaacaccuuc

SEQ ID NO: 166724 - RNA, 22 nt, Pseudomonas aeruginosa PA01
ccucuuccucggcgcccaggcg

SEQ ID NO: 166725 - RNA, 22 nt, Pseudomonas aeruginosa PA01
gguccucggcgaggaguucggc

SEQ ID NO: 166726 - RNA, 22 nt, Pseudomonas aeruginosa PA01
aaggacggcagcgcgcugguca

SEQ ID NO: 166727 - RNA, 22 nt, Pseudomonas aeruginosa PA01
ggcacagcuucgguggggcgag

SEQ ID NO: 166728 - RNA, 22 nt, Pseudomonas aeruginosa PA01
acuccgccggaucuuccgccgc

SEQ ID NO: 166729 - RNA, 22 nt, Pseudomonas aeruginosa PA01
gugggacagcgagccgcuggcg

SEQ ID NO: 166730 - RNA, 22 nt, Pseudomonas aeruginosa PA01
cgcaggucguagguggugcgga

SEQ ID NO: 166731 - RNA, 22 nt, Pseudomonas aeruginosa PA01
auaccggccaguucggcgccga

SEQ ID NO: 166732 - RNA, 22 nt, Pseudomonas aeruginosa PA01
ugcgccugaagacccgcgaugg

SEQ ID NO: 166733 - RNA, 22 nt, Pseudomonas aeruginosa PA01
gguuggacuggaggaacgcccc

SEQ ID NO: 166734 - RNA, 22 nt, Pseudomonas aeruginosa PA01
ucggcaagccgguggccgggau

SEQ ID NO: 166735 - RNA, 22 nt, Pseudomonas aeruginosa PA01
ccgacuugaggaugacguugau

SEQ ID NO: 166736 - RNA, 22 nt, Pseudomonas aeruginosa PA01
cagcagcgccucggcgccgaac

SEQ ID NO: 166737 - RNA, 22 nt, Pseudomonas aeruginosa PA01
agaucaugggcgucgccgccgg

SEQ ID NO: 166738 - RNA, 22 nt, Pseudomonas aeruginosa PA01
ggcgggaucgccuuggucgggu

SEQ ID NO: 166739 - RNA, 23 nt, Pseudomonas aeruginosa PA01
acgucggcugggagcguucgcgc

SEQ ID NO: 166740 - RNA, 22 nt, Pseudomonas aeruginosa PA01
gcccggauaguucugcgcgagg

SEQ ID NO: 166741 - RNA, 22 nt, Pseudomonas aeruginosa PA01
gggucgguuccucgccuucggc

SEQ ID NO: 166742 - RNA, 22 nt, Pseudomonas aeruginosa PA01
auguugcugccauucugccuga

SEQ ID NO: 166743 - RNA, 22 nt, Pseudomonas aeruginosa PA01
ggugucgcgcagggugcugagc

SEQ ID NO: 166744 - RNA, 21 nt, Pseudomonas aeruginosa PA01
aggcccguggcgucuucgucg

SEQ ID NO: 166745 - RNA, 22 nt, Pseudomonas aeruginosa PA01
acgcaugcuaccgguguucgac

SEQ ID NO: 166746 - RNA, 22 nt, Pseudomonas aeruginosa PA01
acagggcguguuccguggcagc

SEQ ID NO: 166747 - RNA, 22 nt, Pseudomonas aeruginosa PA01
gccgcugcgaugggcgucgagc

SEQ ID NO: 166748 - RNA, 22 nt, Pseudomonas aeruginosa PA01
agagcggccugcgcuucggcga

SEQ ID NO: 166749 - RNA, 19 nt, Pseudomonas aeruginosa PA01
aucaucugcgcgcuguuuc

SEQ ID NO: 166750 - RNA, 22 nt, Pseudomonas aeruginosa PA01
gugaggcgccggacagcgcccg

SEQ ID NO: 166751 - RNA, 23 nt, Pseudomonas aeruginosa PA01
cguccggacgacgacccggcguu

SEQ ID NO: 166752 - RNA, 22 nt, Pseudomonas aeruginosa PA01
cagcuuggugcgauagccguug

SEQ ID NO: 166753 - RNA, 21 nt, Pseudomonas aeruginosa PA01
aggugcucgaccaggugcgcc

SEQ ID NO: 166754 - RNA, 20 nt, Pseudomonas aeruginosa PA01
aaggcauggguuuuucgucg

SEQ ID NO: 166755 - RNA, 22 nt, Pseudomonas aeruginosa PA01
ggugcugguggcggcgauccug

SEQ ID NO: 166756 - RNA, 22 nt, Pseudomonas aeruginosa PA01
uggccggauugccgccgggcgu

SEQ ID NO: 166757 - RNA, 22 nt, Pseudomonas aeruginosa PA01
aggcgcuguucguggucagcac

SEQ ID NO: 166758 - RNA, 22 nt, Pseudomonas aeruginosa PA01
ucgguauccccuauguguucaa

SEQ ID NO: 166759 - RNA, 21 nt, Pseudomonas aeruginosa PA01
cggcaucagggucaggucggc

SEQ ID NO: 166760 - RNA, 22 nt, Pseudomonas aeruginosa PA01
gcagguugcacgccgcccuggc

SEQ ID NO: 166761 - RNA, 22 nt, Pseudomonas aeruginosa PA01
gggguaccggccaguugugcgg

SEQ ID NO: 166762 - RNA, 22 nt, Pseudomonas aeruginosa PA01
ggcggaugucgccgauuggcug

SEQ ID NO: 166763 - RNA, 22 nt, Pseudomonas aeruginosa PA01
gcaggucgaaacccuucgccag

SEQ ID NO: 166764 - RNA, 22 nt, Pseudomonas aeruginosa PA01
ugcugcaacugcgccaggcguu

SEQ ID NO: 166765 - RNA, 22 nt, Pseudomonas aeruginosa PA01
cagcggcaacuggcggaggcgg

SEQ ID NO: 166766 - RNA, 19 nt, Pseudomonas aeruginosa PA01
ccuguucagcgucgugcgc

SEQ ID NO: 166767 - RNA, 22 nt, Pseudomonas aeruginosa PA01
ggagccguugcagugguagcac

SEQ ID NO: 166768 - RNA, 22 nt, Pseudomonas aeruginosa PA01
aggagcgcgcggugaucgcccu

SEQ ID NO: 166769 - RNA, 22 nt, Pseudomonas aeruginosa PA01
cgagucgaagaucggcagcagg

SEQ ID NO: 166770 - RNA, 22 nt, Pseudomonas aeruginosa PA01
gcaggcgcagcaguucgucggc

SEQ ID NO: 166771 - RNA, 22 nt, Pseudomonas aeruginosa PA01
gagcauggucgguugaucgugc

SEQ ID NO: 166772 - RNA, 22 nt, Pseudomonas aeruginosa PA01
ggcgaggcccagcccgagcugg

SEQ ID NO: 166773 - RNA, 22 nt, Pseudomonas aeruginosa PA01
augagcgugcggaucaggcgcu

SEQ ID NO: 166774 - RNA, 21 nt, Pseudomonas aeruginosa PA01
cagguucauggugugcuggcg

SEQ ID NO: 166775 - RNA, 22 nt, Pseudomonas aeruginosa PA01
gucgacgucgagggccagcugc

SEQ ID NO: 166776 - RNA, 22 nt, Pseudomonas aeruginosa PA01
cuggugcagcacggugacaugg

SEQ ID NO: 166777 - RNA, 22 nt, Pseudomonas aeruginosa PA01
aacaggucgguuuccagguggg

SEQ ID NO: 166778 - RNA, 22 nt, Pseudomonas aeruginosa PA01
aagcgccuggagauagucgucg

SEQ ID NO: 166779 - RNA, 22 nt, Pseudomonas aeruginosa PA01
gccccgccgaacauccaggcca

SEQ ID NO: 166780 - RNA, 22 nt, Pseudomonas aeruginosa PA01
cugaggacgcugagcaggcccu

SEQ ID NO: 166781 - RNA, 20 nt, Pseudomonas aeruginosa PA01
uuccaucacguagcugccgu

SEQ ID NO: 166782 - RNA, 22 nt, Pseudomonas aeruginosa PA01
ucuccucgccggugggguuguu

SEQ ID NO: 166783 - RNA, 22 nt, Pseudomonas aeruginosa PA01
ggcgagcgguucgcgggaaagg

SEQ ID NO: 166784 - RNA, 22 nt, Pseudomonas aeruginosa PA01
gccgccagccgaucguuggauu

SEQ ID NO: 166785 - RNA, 22 nt, Pseudomonas aeruginosa PA01
cgguuguccaguugcucgcggg

SEQ ID NO: 166786 - RNA, 19 nt, Pseudomonas aeruginosa PA01
ggcuugccuucguugcgcu

SEQ ID NO: 166787 - RNA, 22 nt, Pseudomonas aeruginosa PA01
ggaaaacgcggaucgcccuugc

SEQ ID NO: 166788 - RNA, 22 nt, Pseudomonas aeruginosa PA01
gucaggaacggaugcacgcgcc

SEQ ID NO: 166789 - RNA, 22 nt, Pseudomonas aeruginosa PA01
cggugcggaugaaauuguccgg

SEQ ID NO: 166790 - RNA, 22 nt, Pseudomonas aeruginosa PA01
ggucgugcuggugggcggcaag

SEQ ID NO: 166791 - RNA, 22 nt, Pseudomonas aeruginosa PA01
gcuggccggggugcuccacgag

SEQ ID NO: 166792 - RNA, 22 nt, Pseudomonas aeruginosa PA01
ggcggucucggacaggccggca

SEQ ID NO: 166793 - RNA, 22 nt, Pseudomonas aeruginosa PA01
aggccgcggaaggugacgaugc

SEQ ID NO: 166794 - RNA, 22 nt, Pseudomonas aeruginosa PA01
agcagggugaagcgcuuggcgg

SEQ ID NO: 166795 - RNA, 22 nt, Pseudomonas aeruginosa PA01
cuugccgguaccggcgcuggcc

SEQ ID NO: 166796 - RNA, 22 nt, Pseudomonas aeruginosa PA01
acucggccugggccgagaaggc

SEQ ID NO: 166797 - RNA, 22 nt, Pseudomonas aeruginosa PA01
gggcagagcgaagacccgccgu

SEQ ID NO: 166798 - RNA, 21 nt, Pseudomonas aeruginosa PA01
uucugccuuugcucugugcuc

SEQ ID NO: 166799 - RNA, 22 nt, Pseudomonas aeruginosa PA01
ucguccaucaccaccaacccuu

SEQ ID NO: 166800 - RNA, 22 nt, Pseudomonas aeruginosa PA01
ccucgacggacggucauuuucg

SEQ ID NO: 166801 - RNA, 22 nt, Pseudomonas aeruginosa PA01
gggcgcucgucguuggcgcugu

SEQ ID NO: 166802 - RNA, 22 nt, Pseudomonas aeruginosa PA01
ccugcugcugagugccgccagc

SEQ ID NO: 166803 - RNA, 22 nt, Pseudomonas aeruginosa PA01
agcgggagaucgccaguugaug

SEQ ID NO: 166804 - RNA, 22 nt, Pseudomonas aeruginosa PA01
cuucgugguggucaccgcgcuu

SEQ ID NO: 166805 - RNA, 22 nt, Pseudomonas aeruginosa PA01
gccggcaugcugaagcgggccg

SEQ ID NO: 166806 - RNA, 22 nt, Pseudomonas aeruginosa PA01
accaccggcuugcugcuggucg

SEQ ID NO: 166807 - RNA, 22 nt, Pseudomonas aeruginosa PA01
uccgcgccuucagcucgcccug

SEQ ID NO: 166808 - RNA, 22 nt, Pseudomonas aeruginosa PA01
aagcugggucaggaccuuggug

SEQ ID NO: 166809 - RNA, 22 nt, Pseudomonas aeruginosa PA01
cugcaacggcgcgccguccugg

SEQ ID NO: 166810 - RNA, 23 nt, Pseudomonas aeruginosa PA01
auccucgcccagcucgcggcggu

SEQ ID NO: 166811 - RNA, 22 nt, Pseudomonas aeruginosa PA01
gacgcgguggucuacgucaccg

SEQ ID NO: 166812 - RNA, 22 nt, Pseudomonas aeruginosa PA01
cugcgggucagcaccgccggcu

SEQ ID NO: 166813 - RNA, 22 nt, Pseudomonas aeruginosa PA01
ggguaaggagcaucgccggcuu

SEQ ID NO: 166814 - RNA, 22 nt, Pseudomonas aeruginosa PA01
ucggcugcaugccgccgcgggu

SEQ ID NO: 166815 - RNA, 20 nt, Pseudomonas aeruginosa PA01
ccggcagacagucaggccgg

SEQ ID NO: 166816 - RNA, 20 nt, Pseudomonas aeruginosa PA01
ucaagggugagaugagcgac

SEQ ID NO: 166817 - RNA, 22 nt, Pseudomonas aeruginosa PA01
uggccuugaacgcaucgacgua

SEQ ID NO: 166818 - RNA, 22 nt, Pseudomonas aeruginosa PA01
ggggucaggucgcugagcaggg

SEQ ID NO: 166819 - RNA, 22 nt, Pseudomonas aeruginosa PA01
cgggugccauaggcugcgcaga

SEQ ID NO: 166820 - RNA, 22 nt, Pseudomonas aeruginosa PA01
cggcgauuggccggccgucgac

SEQ ID NO: 166821 - RNA, 22 nt, Pseudomonas aeruginosa PA01
augcgguuguguucgguggcgu

SEQ ID NO: 166822 - RNA, 23 nt, Pseudomonas aeruginosa PA01
cgccggaggaucgcuuugccgcg

SEQ ID NO: 166823 - RNA, 22 nt, Pseudomonas aeruginosa PA01
ccuggcgguugcgcaccaccuc

SEQ ID NO: 166824 - RNA, 19 nt, Pseudomonas aeruginosa PA01
auccgcaugggcaacugcc

SEQ ID NO: 166825 - RNA, 22 nt, Pseudomonas aeruginosa PA01
agccgugcgguggccgaccugc

SEQ ID NO: 166826 - RNA, 22 nt, Pseudomonas aeruginosa PA01
uggcacugggccgcagcgucgg

SEQ ID NO: 166827 - RNA, 22 nt, Pseudomonas aeruginosa PA01
gggcgccgacgugccggucuuc

SEQ ID NO: 166828 - RNA, 22 nt, Pseudomonas aeruginosa PA01
accugacuuuccaguagggaga

SEQ ID NO: 166829 - RNA, 22 nt, Pseudomonas aeruginosa PA01
ucgaccacgccgccgaucucgu

SEQ ID NO: 166830 - RNA, 19 nt, Pseudomonas aeruginosa PA01
ucucguccaggcuccggcg

SEQ ID NO: 166831 - RNA, 22 nt, Pseudomonas aeruginosa PA01
cgauggccaagcgcagguccgg

SEQ ID NO: 166832 - RNA, 22 nt, Pseudomonas aeruginosa PA01
cgggugaucgucgcccgccgcc

SEQ ID NO: 166833 - RNA, 22 nt, Pseudomonas aeruginosa PA01
gcgcgacgcuguugcuggcggg

SEQ ID NO: 166834 - RNA, 22 nt, Pseudomonas aeruginosa PA01
cccugcugcgcugccugauggg

SEQ ID NO: 166835 - RNA, 22 nt, Pseudomonas aeruginosa PA01
gccgauguacggguucagcgcg

SEQ ID NO: 166836 - RNA, 22 nt, Pseudomonas aeruginosa PA01
cuacgucggcuucuacgcggua

SEQ ID NO: 166837 - RNA, 22 nt, Pseudomonas aeruginosa PA01
acuggcgaagcggucggcggua

SEQ ID NO: 166838 - RNA, 20 nt, Pseudomonas aeruginosa PA01
ggaguggcuguugccguggc

SEQ ID NO: 166839 - RNA, 22 nt, Pseudomonas aeruginosa PA01
gaucaaugccguacgcuacgcc

SEQ ID NO: 166840 - RNA, 22 nt, Pseudomonas aeruginosa PA01
gguucggagugccgccggugag

SEQ ID NO: 166841 - RNA, 22 nt, Pseudomonas aeruginosa PA01
cgaugcuggucagcuuggcguu

SEQ ID NO: 166842 - RNA, 22 nt, Pseudomonas aeruginosa PA01
gagcgccaggugauccucggca

SEQ ID NO: 166843 - RNA, 22 nt, Pseudomonas aeruginosa PA01
gagagcugcucgggauagcggu

SEQ ID NO: 166844 - RNA, 22 nt, Pseudomonas aeruginosa PA01
aagcgcggugaccaccacgaag

SEQ ID NO: 166845 - RNA, 22 nt, Pseudomonas aeruginosa PA01
uucucggcuguuacccaagcgc

SEQ ID NO: 166846 - RNA, 22 nt, Pseudomonas aeruginosa PA01
cggcggcgaucagguugucgag

SEQ ID NO: 166847 - RNA, 22 nt, Pseudomonas aeruginosa PA01
ucgccgacguggucaaccaguc

SEQ ID NO: 166848 - RNA, 22 nt, Pseudomonas aeruginosa PA01
gagcggcugaaccucggucugc

SEQ ID NO: 166849 - RNA, 22 nt, Pseudomonas aeruginosa PA01
gcccucgacgggcucuucgaga

SEQ ID NO: 166850 - RNA, 22 nt, Pseudomonas aeruginosa PA01
uuuggcgaagcggcuauuggcc

SEQ ID NO: 166851 - RNA, 22 nt, Pseudomonas aeruginosa PA01
acgggcgucgagcgcccggcug

SEQ ID NO: 166852 - RNA, 22 nt, Pseudomonas aeruginosa PA01
accuucacccgccguugcgcca

SEQ ID NO: 166853 - RNA, 22 nt, Pseudomonas aeruginosa PA01
cgaagggaacagcaggcgcagg

SEQ ID NO: 166854 - RNA, 22 nt, Pseudomonas aeruginosa PA01
auggcguguccgccggccugga

SEQ ID NO: 166855 - RNA, 23 nt, Pseudomonas aeruginosa PA01
aggcgccgucgaccugcagcaga

SEQ ID NO: 166856 - RNA, 22 nt, Pseudomonas aeruginosa PA01
acgcugacgaacugugcgccgc

SEQ ID NO: 166857 - RNA, 22 nt, Pseudomonas aeruginosa PA01
gaugaucucgaccaggucuggc

SEQ ID NO: 166858 - RNA, 22 nt, Pseudomonas aeruginosa PA01
gacgacaaccaacuggugaccu

SEQ ID NO: 166859 - RNA, 22 nt, Pseudomonas aeruginosa PA01
gccggccaggccggcgccgagg

SEQ ID NO: 166860 - RNA, 23 nt, Pseudomonas aeruginosa PA01
ucugcucgccgcgaccggcgacc

SEQ ID NO: 166861 - RNA, 22 nt, Pseudomonas aeruginosa PA01
gcuggccgaguuccgccgacag

SEQ ID NO: 166862 - RNA, 22 nt, Pseudomonas aeruginosa PA01
uugucgcggcagcccuuggcga

SEQ ID NO: 166863 - RNA, 22 nt, Pseudomonas aeruginosa PA01
aggcucuggaugcugugcgccu

SEQ ID NO: 166864 - RNA, 22 nt, Pseudomonas aeruginosa PA01
aucugggacaaggcguucaucg

SEQ ID NO: 166865 - RNA, 22 nt, Pseudomonas aeruginosa PA01
guucacucuuugucuggcccug

SEQ ID NO: 166866 - RNA, 22 nt, Pseudomonas aeruginosa PA01
cgggccaagcacaugggguugu

SEQ ID NO: 166867 - RNA, 21 nt, Pseudomonas aeruginosa PA01
uuggcuacuccuggaccggcc

SEQ ID NO: 166868 - RNA, 19 nt, Pseudomonas aeruginosa PA01
augcggaugccguggcggc

SEQ ID NO: 166869 - RNA, 22 nt, Pseudomonas aeruginosa PA01
auggcgaucuccgccggcagcu

SEQ ID NO: 166870 - RNA, 22 nt, Pseudomonas aeruginosa PA01
aacgacuaucugcuggcgcugc

SEQ ID NO: 166871 - RNA, 20 nt, Pseudomonas aeruginosa PA01
gcugccguuauccguccugc

SEQ ID NO: 166872 - RNA, 22 nt, Pseudomonas aeruginosa PA01
ucgaccugguccuugagacugg

SEQ ID NO: 166873 - RNA, 22 nt, Pseudomonas aeruginosa PA01
ccugcugccggacucuuucgaa

SEQ ID NO: 166874 - RNA, 22 nt, Pseudomonas aeruginosa PA01
cggcuacagcaaccaguggcgc

SEQ ID NO: 166875 - RNA, 22 nt, Pseudomonas aeruginosa PA01
gcggugaguacuacgaaguuga

SEQ ID NO: 166876 - RNA, 22 nt, Pseudomonas aeruginosa PA01
gucgcgcuugaccucggcgcgg

SEQ ID NO: 166877 - RNA, 22 nt, Pseudomonas aeruginosa PA01
gggcgagccacucgccgaggaa

SEQ ID NO: 166878 - RNA, 22 nt, Pseudomonas aeruginosa PA01
agaggggcuggaauggcaggcc

SEQ ID NO: 166879 - RNA, 22 nt, Pseudomonas aeruginosa PA01
cgcgggaaguucuucaacgcga

SEQ ID NO: 166880 - RNA, 22 nt, Pseudomonas aeruginosa PA01
ucgccacgaaagcauggccggc

SEQ ID NO: 166881 - RNA, 22 nt, Pseudomonas aeruginosa PA01
caccuggaacucguggcgcagg

SEQ ID NO: 166882 - RNA, 22 nt, Pseudomonas aeruginosa PA01
ggggcugguggagcugcguuuc

SEQ ID NO: 166883 - RNA, 22 nt, Pseudomonas aeruginosa PA01
gcccuucguacccgcgguggcc

SEQ ID NO: 166884 - RNA, 22 nt, Pseudomonas aeruginosa PA01
auggacgaaacgauacgucccu

SEQ ID NO: 166885 - RNA, 22 nt, Pseudomonas aeruginosa PA01
gcucgggucgagggccuugaga

SEQ ID NO: 166886 - RNA, 22 nt, Pseudomonas aeruginosa PA01
cugggaaacgucgccucgaccu

SEQ ID NO: 166887 - RNA, 23 nt, Pseudomonas aeruginosa PA01
accugggcauccagcucggccug

SEQ ID NO: 166888 - RNA, 22 nt, Pseudomonas aeruginosa PA01
gcucgccgacgucgccagcgac

SEQ ID NO: 166889 - RNA, 22 nt, Pseudomonas aeruginosa PA01
gucguagguggcgaccgcgguc

SEQ ID NO: 166890 - RNA, 22 nt, Pseudomonas aeruginosa PA01
acgaucgauauauggaugcgag

SEQ ID NO: 166891 - RNA, 22 nt, Pseudomonas aeruginosa PA01
ccggcgcugcugaucgcuucgu

SEQ ID NO: 166892 - RNA, 22 nt, Pseudomonas aeruginosa PA01
gucggccagagccucggccagg

SEQ ID NO: 166893 - RNA, 19 nt, Pseudomonas aeruginosa PA01
uucgucauccaccgccucg

SEQ ID NO: 166894 - RNA, 22 nt, Pseudomonas aeruginosa PA01
ucgacccguucguacgcuaccc

SEQ ID NO: 166895 - RNA, 22 nt, Pseudomonas aeruginosa PA01
ccacuuccagacgcucggcgcg

SEQ ID NO: 166896 - RNA, 22 nt, Pseudomonas aeruginosa PA01
ggcacggcucgcagaggaucug

SEQ ID NO: 166897 - RNA, 22 nt, Pseudomonas aeruginosa PA01
cggcgcaggguauggcgguuca

SEQ ID NO: 166898 - RNA, 22 nt, Pseudomonas aeruginosa PA01
cggaccagguuucuucccucca

SEQ ID NO: 166899 - RNA, 22 nt, Pseudomonas aeruginosa PA01
uggcuguugcgcaccucgccga

SEQ ID NO: 166900 - RNA, 22 nt, Pseudomonas aeruginosa PA01
caggcccagcugggucgcgguc

SEQ ID NO: 166901 - RNA, 22 nt, Pseudomonas aeruginosa PA01
gcagucgaccagcgccgccugg

SEQ ID NO: 166902 - RNA, 22 nt, Pseudomonas aeruginosa PA01
ucagcuuccugcugaugcuggu

SEQ ID NO: 166903 - RNA, 22 nt, Pseudomonas aeruginosa PA01
cugcggcuggugcaccagcgcg

SEQ ID NO: 166904 - RNA, 22 nt, Pseudomonas aeruginosa PA01
ccagcgccuggaccuccaggcc

SEQ ID NO: 166905 - RNA, 22 nt, Pseudomonas aeruginosa PA01
aaggcgaugcucuccggcguca

SEQ ID NO: 166906 - RNA, 22 nt, Pseudomonas aeruginosa PA01
ugccuucucgcugguaucggug

SEQ ID NO: 166907 - RNA, 22 nt, Pseudomonas aeruginosa PA01
gaggcuggccugcggccugucg

SEQ ID NO: 166908 - RNA, 20 nt, Pseudomonas aeruginosa PA01
ccuucgacucggugugcauc

SEQ ID NO: 166909 - RNA, 22 nt, Pseudomonas aeruginosa PA01
guauugccgaacgagcuggcca

SEQ ID NO: 166910 - RNA, 22 nt, Pseudomonas aeruginosa PA01
gccgcgcuggccuucgaggagc

SEQ ID NO: 166911 - RNA, 22 nt, Pseudomonas aeruginosa PA01
gagcagcuggaucgggcgccgc

SEQ ID NO: 166912 - RNA, 22 nt, Pseudomonas aeruginosa PA01
agccuggucaccggccugcuga

SEQ ID NO: 166913 - RNA, 22 nt, Pseudomonas aeruginosa PA01
ggaagugaaggucggcgaccug

SEQ ID NO: 166914 - RNA, 22 nt, Pseudomonas aeruginosa PA01
agcaagcuguggcuggugaucu

SEQ ID NO: 166915 - RNA, 22 nt, Pseudomonas aeruginosa PA01
acgucagccuggcccaggccga

SEQ ID NO: 166916 - RNA, 22 nt, Pseudomonas aeruginosa PA01
augccgaucagcgcggcgaugu

SEQ ID NO: 166917 - RNA, 22 nt, Pseudomonas aeruginosa PA01
cuggaucugcuccuggucgauc

SEQ ID NO: 166918 - RNA, 22 nt, Pseudomonas aeruginosa PA01
cagcaggagauugccguccagc

SEQ ID NO: 166919 - RNA, 22 nt, Pseudomonas aeruginosa PA01
ggaucgccucgcuggucggcgc

SEQ ID NO: 166920 - RNA, 22 nt, Pseudomonas aeruginosa PA01
agcgcguugaguuccaggugcc

SEQ ID NO: 166921 - RNA, 22 nt, Pseudomonas aeruginosa PA01
cgcacgccgcggagacggccuu

SEQ ID NO: 166922 - RNA, 22 nt, Pseudomonas aeruginosa PA01
gccggccauuguugaaaacagu

SEQ ID NO: 166923 - RNA, 22 nt, Pseudomonas aeruginosa PA01
cgccauccgccaccugcuggcg

SEQ ID NO: 166924 - RNA, 22 nt, Pseudomonas aeruginosa PA01
agcacgaacuggcgcagaugaa

SEQ ID NO: 166925 - RNA, 21 nt, Pseudomonas aeruginosa PA01
cgccagcggcgugccgaccuc

SEQ ID NO: 166926 - RNA, 22 nt, Pseudomonas aeruginosa PA01
cagggcaucgauggccacuugg

SEQ ID NO: 166927 - RNA, 22 nt, Pseudomonas aeruginosa PA01
gucgcugaccuggcaaccgcag

SEQ ID NO: 166928 - RNA, 22 nt, Pseudomonas aeruginosa PA01
cucgauguacaggcugcgggug

SEQ ID NO: 166929 - RNA, 22 nt, Pseudomonas aeruginosa PA01
ucggcggccuugcgcauggcac

SEQ ID NO: 166930 - RNA, 22 nt, Pseudomonas aeruginosa PA01
ucgagaccgaacuugcucuggc

SEQ ID NO: 166931 - RNA, 22 nt, Pseudomonas aeruginosa PA01
cggcgggcauagccgagcagcg

SEQ ID NO: 166932 - RNA, 22 nt, Pseudomonas aeruginosa PA01
augaacaccuuguccaugcggc

SEQ ID NO: 166933 - RNA, 22 nt, Pseudomonas aeruginosa PA01
ugcgggccguugggaaucggcg

SEQ ID NO: 166934 - RNA, 22 nt, Pseudomonas aeruginosa PA01
gucgcgggagaauaacaucaua

SEQ ID NO: 166935 - RNA, 22 nt, Pseudomonas aeruginosa PA01
guccugguggauggucgcgagc

SEQ ID NO: 166936 - RNA, 22 nt, Pseudomonas aeruginosa PA01
cgccccacuggcgccgcucgaa

SEQ ID NO: 166937 - RNA, 18 nt, Pseudomonas aeruginosa PA01
gcggcgcucccagcccga

SEQ ID NO: 166938 - RNA, 22 nt, Pseudomonas aeruginosa PA01
gcaucgugcggcaugucuucca

SEQ ID NO: 166939 - RNA, 22 nt, Pseudomonas aeruginosa PA01
gccgguaauguagacgccaccg

SEQ ID NO: 166940 - RNA, 22 nt, Pseudomonas aeruginosa PA01
ucuucggcgggccuuuuucaug

SEQ ID NO: 166941 - RNA, 22 nt, Pseudomonas aeruginosa PA01
ucugacgcuugacggugaugcc

SEQ ID NO: 166942 - RNA, 22 nt, Pseudomonas aeruginosa PA01
ggacugcuccugccccuggccg

SEQ ID NO: 166943 - RNA, 22 nt, Pseudomonas aeruginosa PA01
agcaccccgccgaccagcauca

SEQ ID NO: 166944 - RNA, 22 nt, Pseudomonas aeruginosa PA01
uggucgaucccggcguuggucc

SEQ ID NO: 166945 - RNA, 22 nt, Pseudomonas aeruginosa PA01
accaguugauccaugccggcga

SEQ ID NO: 166946 - RNA, 22 nt, Pseudomonas aeruginosa PA01
cccgauacccugcgucccuggg

SEQ ID NO: 166947 - RNA, 22 nt, Pseudomonas aeruginosa PA01
gcggcaguucgggauggucgag

SEQ ID NO: 166948 - RNA, 22 nt, Pseudomonas aeruginosa PA01
uugguguucagcaaaggccggu

SEQ ID NO: 166949 - RNA, 22 nt, Pseudomonas aeruginosa PA01
gcgugcccucaggcaaugcuca

SEQ ID NO: 166950 - RNA, 22 nt, Pseudomonas aeruginosa PA01
ccggcgacgugcugcgccuucu

SEQ ID NO: 166951 - RNA, 22 nt, Pseudomonas aeruginosa PA01
aggggauuacacguugaagcgg

SEQ ID NO: 166952 - RNA, 22 nt, Pseudomonas aeruginosa PA01
ggcguucaucgccaggugcagc

SEQ ID NO: 166953 - RNA, 22 nt, Pseudomonas aeruginosa PA01
gagggcuuguuccggcaacugg

SEQ ID NO: 166954 - RNA, 22 nt, Pseudomonas aeruginosa PA01
ugaugccgacgucgaugacgau

SEQ ID NO: 166955 - RNA, 22 nt, Pseudomonas aeruginosa PA01
gccagguguccagguccugcca

SEQ ID NO: 166956 - RNA, 22 nt, Pseudomonas aeruginosa PA01
cgguggacuggcacuggcuggc

SEQ ID NO: 166957 - RNA, 22 nt, Pseudomonas aeruginosa PA01
cuccugcggcaugggugcguuc

SEQ ID NO: 166958 - RNA, 22 nt, Pseudomonas aeruginosa PA01
gcgaccuguugcuccagaucgc

SEQ ID NO: 166959 - RNA, 22 nt, Pseudomonas aeruginosa PA01
uggugcuggcgcaacuggcguc

SEQ ID NO: 166960 - RNA, 22 nt, Pseudomonas aeruginosa PA01
ucgccggcaaagucgagggcuu

SEQ ID NO: 166961 - RNA, 22 nt, Pseudomonas aeruginosa PA01
ccuggcuggccaacaagcuggc

SEQ ID NO: 166962 - RNA, 22 nt, Pseudomonas aeruginosa PA01
agguccaggucgaccuggucca

SEQ ID NO: 166963 - RNA, 22 nt, Pseudomonas aeruginosa PA01
ucgccgagcgucaccagcgucc

SEQ ID NO: 166964 - RNA, 22 nt, Pseudomonas aeruginosa PA01
gcccagggaguacggcggcaug

SEQ ID NO: 166965 - RNA, 22 nt, Pseudomonas aeruginosa PA01
cccggaagcgcggguccucgac

SEQ ID NO: 166966 - RNA, 22 nt, Pseudomonas aeruginosa PA01
gcggcgcgggucuggcugagca

SEQ ID NO: 166967 - RNA, 22 nt, Pseudomonas aeruginosa PA01
ucugagcguagcgacggggaau

SEQ ID NO: 166968 - RNA, 22 nt, Pseudomonas aeruginosa PA01
gaugcgauggaagcccugaucg

SEQ ID NO: 166969 - RNA, 22 nt, Pseudomonas aeruginosa PA01
acgcgagggccgccugcugguu

SEQ ID NO: 166970 - RNA, 22 nt, Pseudomonas aeruginosa PA01
cugccggugucucggcguccgu

SEQ ID NO: 166971 - RNA, 22 nt, Pseudomonas aeruginosa PA01
aguuuggcauggcaacccaguc

SEQ ID NO: 166972 - RNA, 22 nt, Pseudomonas aeruginosa PA01
gagucgcaaagccgcgcguugc

SEQ ID NO: 166973 - RNA, 22 nt, Pseudomonas aeruginosa PA01
gcucaagcugcuggccgguuuc

SEQ ID NO: 166974 - RNA, 22 nt, Pseudomonas aeruginosa PA01
ccggcgauuuccucgccggcgu

SEQ ID NO: 166975 - RNA, 22 nt, Pseudomonas aeruginosa PA01
ggcggcgcugcaggucggccug

SEQ ID NO: 166976 - RNA, 22 nt, Pseudomonas aeruginosa PA01
caccgcgaucccgcggauaucc

SEQ ID NO: 166977 - RNA, 22 nt, Pseudomonas aeruginosa PA01
cgcacgguagcuguccaccuug

SEQ ID NO: 166978 - RNA, 22 nt, Pseudomonas aeruginosa PA01
cggcauugcggcgguucagcga

SEQ ID NO: 166979 - RNA, 22 nt, Pseudomonas aeruginosa PA01
uucgucgagggcucgggcgcag

SEQ ID NO: 166980 - RNA, 22 nt, Pseudomonas aeruginosa PA01
guccagccggcgcagcgcgagu

SEQ ID NO: 166981 - RNA, 22 nt, Pseudomonas aeruginosa PA01
ucgacacgccgccgggauucgc

SEQ ID NO: 166982 - RNA, 22 nt, Pseudomonas aeruginosa PA01
ccugggcccguuccuggagggc

SEQ ID NO: 166983 - RNA, 22 nt, Pseudomonas aeruginosa PA01
agggcgagauccucuucuucaa

SEQ ID NO: 166984 - RNA, 22 nt, Pseudomonas aeruginosa PA01
ucggucucgaccagcaacuggc

SEQ ID NO: 166985 - RNA, 22 nt, Pseudomonas aeruginosa PA01
ugcggucugguacggcgcggac

SEQ ID NO: 166986 - RNA, 22 nt, Pseudomonas aeruginosa PA01
ucgagcauccggucggcuucgu

SEQ ID NO: 166987 - RNA, 22 nt, Pseudomonas aeruginosa PA01
cgcggcuucgcggugguugccg

SEQ ID NO: 166988 - RNA, 22 nt, Pseudomonas aeruginosa PA01
ugcaguugcucgccgcgguagc

SEQ ID NO: 166989 - RNA, 22 nt, Pseudomonas aeruginosa PA01
ucgucggccuucaacgccgccg

SEQ ID NO: 166990 - RNA, 22 nt, Pseudomonas aeruginosa PA01
ggauuuccugguuguagcgagc

SEQ ID NO: 166991 - RNA, 21 nt, Pseudomonas aeruginosa PA01
ccggccaguccuucaggcugg

SEQ ID NO: 166992 - RNA, 22 nt, Pseudomonas aeruginosa PA01
cuccggcgugaucagggucucg

SEQ ID NO: 166993 - RNA, 22 nt, Pseudomonas aeruginosa PA01
ccguuaucgguuuuuggcggug

SEQ ID NO: 166994 - RNA, 23 nt, Pseudomonas aeruginosa PA01
ccaugcccggcugaucgccgaga

SEQ ID NO: 166995 - RNA, 22 nt, Pseudomonas aeruginosa PA01
accaggugcuggugcucggugc

SEQ ID NO: 166996 - RNA, 22 nt, Pseudomonas aeruginosa PA01
gcccagaugcauucgcgcuuga

SEQ ID NO: 166997 - RNA, 22 nt, Pseudomonas aeruginosa PA01
gcaggaagccgaggaugguagc

SEQ ID NO: 166998 - RNA, 22 nt, Pseudomonas aeruginosa PA01
gucuggauguauucgcccaggu

SEQ ID NO: 166999 - RNA, 22 nt, Pseudomonas aeruginosa PA01
cuggaucgccuugcgcauggug

SEQ ID NO: 167000 - RNA, 22 nt, Pseudomonas aeruginosa PA01
cuucggccuuggcguccuguag

SEQ ID NO: 167001 - RNA, 22 nt, Pseudomonas aeruginosa PA01
ccuucggaccgacccucgcugc

SEQ ID NO: 167002 - RNA, 22 nt, Pseudomonas aeruginosa PA01
caccuucaaccgggucggccug

SEQ ID NO: 167003 - RNA, 23 nt, Pseudomonas aeruginosa PA01
gcagcgccggccccauggggauc

SEQ ID NO: 167004 - RNA, 22 nt, Pseudomonas aeruginosa PA01
aggguguccggcaccggcguca

SEQ ID NO: 167005 - RNA, 22 nt, Pseudomonas aeruginosa PA01
ugcugcggggccggacgcgacu

SEQ ID NO: 167006 - RNA, 22 nt, Pseudomonas aeruginosa PA01
ccguggaucagcacgaugcggc

SEQ ID NO: 167007 - RNA, 22 nt, Pseudomonas aeruginosa PA01
cgccuggagccuucgcgcgacg

SEQ ID NO: 167008 - RNA, 22 nt, Pseudomonas aeruginosa PA01
gcgucaucgcccuugccgcacc

SEQ ID NO: 167009 - RNA, 22 nt, Pseudomonas aeruginosa PA01
cgguacuguuccucggcgaggc

SEQ ID NO: 167010 - RNA, 22 nt, Pseudomonas aeruginosa PA01
gcucgcgcagggucgggaucac

SEQ ID NO: 167011 - RNA, 22 nt, Pseudomonas aeruginosa PA01
aggcguucucguaguccuggcu

SEQ ID NO: 167012 - RNA, 22 nt, Pseudomonas aeruginosa PA01
ccguaccuuccaggccgacagc

SEQ ID NO: 167013 - RNA, 22 nt, Pseudomonas aeruginosa PA01
gugcuggacaaucgcgccgaca

SEQ ID NO: 167014 - RNA, 22 nt, Pseudomonas aeruginosa PA01
cgcuucgaggaaggugccgugg

SEQ ID NO: 167015 - RNA, 22 nt, Pseudomonas aeruginosa PA01
agcuggagcgugaguucgccgc

SEQ ID NO: 167016 - RNA, 22 nt, Pseudomonas aeruginosa PA01
aaacugcaugagcggcucgacc

SEQ ID NO: 167017 - RNA, 22 nt, Pseudomonas aeruginosa PA01
gucgauauccacauccacggug

SEQ ID NO: 167018 - RNA, 22 nt, Pseudomonas aeruginosa PA01
cggcgacgaucaucuucggcuu

SEQ ID NO: 167019 - RNA, 22 nt, Pseudomonas aeruginosa PA01
gcacgccuaccgaguagaguug

SEQ ID NO: 167020 - RNA, 22 nt, Pseudomonas aeruginosa PA01
acucggcgauggcuucguggcc

SEQ ID NO: 167021 - RNA, 22 nt, Pseudomonas aeruginosa PA01
cucagcaguaccuggucgagga

SEQ ID NO: 167022 - RNA, 22 nt, Pseudomonas aeruginosa PA01
uggagcguucccgcgagguagc

SEQ ID NO: 167023 - RNA, 22 nt, Pseudomonas aeruginosa PA01
cgggccagagcggucgccuuuc

SEQ ID NO: 167024 - RNA, 22 nt, Pseudomonas aeruginosa PA01
aaagcuggaacggauagugcuc

SEQ ID NO: 167025 - RNA, 22 nt, Pseudomonas aeruginosa PA01
aggcuugcgcugggcccagccg

SEQ ID NO: 167026 - RNA, 22 nt, Pseudomonas aeruginosa PA01
ccggggugccgcugucggcgcu

SEQ ID NO: 167027 - RNA, 22 nt, Pseudomonas aeruginosa PA01
ccgcgggucaucgaguccagcg

SEQ ID NO: 167028 - RNA, 22 nt, Pseudomonas aeruginosa PA01
aucucgccgcuguccggcuggu

SEQ ID NO: 167029 - RNA, 22 nt, Pseudomonas aeruginosa PA01
cgcgcagcgccaaggauggccu

SEQ ID NO: 167030 - RNA, 22 nt, Pseudomonas aeruginosa PA01
uccgccggcgacagcaguucgg

SEQ ID NO: 167031 - RNA, 22 nt, Pseudomonas aeruginosa PA01
gcgcaucgagcggcuggcguug

SEQ ID NO: 167032 - RNA, 22 nt, Pseudomonas aeruginosa PA01
gccgccaccgccgauugaucca

SEQ ID NO: 167033 - RNA, 22 nt, Pseudomonas aeruginosa PA01
ucggccagcucaccgagcccua

SEQ ID NO: 167034 - RNA, 22 nt, Pseudomonas aeruginosa PA01
caccgucaguucgcggcgcagc

SEQ ID NO: 167035 - RNA, 22 nt, Pseudomonas aeruginosa PA01
gcgacugaguacccguugcgga

SEQ ID NO: 167036 - RNA, 22 nt, Pseudomonas aeruginosa PA01
ucgccggccuguugcucaacga

SEQ ID NO: 167037 - RNA, 22 nt, Pseudomonas aeruginosa PA01
uggggcgacagcggccccgagg

SEQ ID NO: 167038 - RNA, 22 nt, Pseudomonas aeruginosa PA01
ucgacguacuggaugccgcgcc

SEQ ID NO: 167039 - RNA, 22 nt, Pseudomonas aeruginosa PA01
ccgggcugccgcuucguuccga

SEQ ID NO: 167040 - RNA, 22 nt, Pseudomonas aeruginosa PA01
ucgggccggucugccgggcgag

SEQ ID NO: 167041 - RNA, 23 nt, Pseudomonas aeruginosa PA01
ggccgggaucgagcaacuggcgc

SEQ ID NO: 167042 - RNA, 22 nt, Pseudomonas aeruginosa PA01
cgacgauacgccccuuggaguu

SEQ ID NO: 167043 - RNA, 22 nt, Pseudomonas aeruginosa PA01
gguagcggcgggcgaacgacuc

SEQ ID NO: 167044 - RNA, 22 nt, Pseudomonas aeruginosa PA01
gcaggguggccuccuugagcuu

SEQ ID NO: 167045 - RNA, 22 nt, Pseudomonas aeruginosa PA01
ccaugucgugcuccaccaccau

SEQ ID NO: 167046 - RNA, 22 nt, Pseudomonas aeruginosa PA01
cuggugaacaucgucucggccg

SEQ ID NO: 167047 - RNA, 17 nt, Pseudomonas aeruginosa PA01
ccgagcaacagacccug

SEQ ID NO: 167048 - RNA, 22 nt, Pseudomonas aeruginosa PA01
cccugggggaaccacugcuugc

SEQ ID NO: 167049 - RNA, 22 nt, Pseudomonas aeruginosa PA01
aagcgcugggcgacgcccgucg

SEQ ID NO: 167050 - RNA, 22 nt, Pseudomonas aeruginosa PA01
cgcggcuucgccgugguggccg

SEQ ID NO: 167051 - RNA, 22 nt, Pseudomonas aeruginosa PA01
gaggcgcgcgggcugcucaacc

SEQ ID NO: 167052 - RNA, 21 nt, Pseudomonas aeruginosa PA01
uggcagguacccggccggcug

SEQ ID NO: 167053 - RNA, 22 nt, Pseudomonas aeruginosa PA01
accuuucccgcgaaccgcucgc

SEQ ID NO: 167054 - RNA, 22 nt, Pseudomonas aeruginosa PA01
ugccgcucggucugcaacgcau

SEQ ID NO: 167055 - RNA, 22 nt, Pseudomonas aeruginosa PA01
uugccgaucagcgacgagcugg

SEQ ID NO: 167056 - RNA, 22 nt, Pseudomonas aeruginosa PA01
agaccucgacgcagacggugca

SEQ ID NO: 167057 - RNA, 22 nt, Pseudomonas aeruginosa PA01
uccucgaccaccgccagcagcu

SEQ ID NO: 167058 - RNA, 22 nt, Pseudomonas aeruginosa PA01
gucgaucaccaccauccacucg

SEQ ID NO: 167059 - RNA, 21 nt, Pseudomonas aeruginosa PA01
gccgagcgauucggcgggagg

SEQ ID NO: 167060 - RNA, 22 nt, Pseudomonas aeruginosa PA01
ugucgcaaugcaccucgaccug

SEQ ID NO: 167061 - RNA, 22 nt, Pseudomonas aeruginosa PA01
cgucgcgcucgcccgauaccac

SEQ ID NO: 167062 - RNA, 22 nt, Pseudomonas aeruginosa PA01
ucgggcagcucgaucaggcuga

SEQ ID NO: 167063 - RNA, 22 nt, Pseudomonas aeruginosa PA01
aaaaacccaugccuugcgggca

SEQ ID NO: 167064 - RNA, 22 nt, Pseudomonas aeruginosa PA01
gcgaggaauucgccuugcugcg

SEQ ID NO: 167065 - RNA, 22 nt, Pseudomonas aeruginosa PA01
cacgggcugcuguucguccugg

SEQ ID NO: 167066 - RNA, 22 nt, Pseudomonas aeruginosa PA01
uucaggucgaugucgccgaugu

SEQ ID NO: 167067 - RNA, 22 nt, Pseudomonas aeruginosa PA01
aggccgaccugcagcgccgccg

SEQ ID NO: 167068 - RNA, 22 nt, Pseudomonas aeruginosa PA01
ggcgcugucggguccuggcguc

SEQ ID NO: 167069 - RNA, 20 nt, Pseudomonas aeruginosa PA01
ugcgccuggacaaguacgcc

SEQ ID NO: 167070 - RNA, 22 nt, Pseudomonas aeruginosa PA01
gccccucgcggaucucggcgau

SEQ ID NO: 167071 - RNA, 22 nt, Pseudomonas aeruginosa PA01
gugcaguuggcccgccgcgccg

SEQ ID NO: 167072 - RNA, 22 nt, Pseudomonas aeruginosa PA01
ccucggccgcaucgucgaucuc

SEQ ID NO: 167073 - RNA, 22 nt, Pseudomonas aeruginosa PA01
ccaugggcguggcccggcgcgu

SEQ ID NO: 167074 - RNA, 22 nt, Pseudomonas aeruginosa PA01
ugcuggaagaucaucccgacgc

SEQ ID NO: 167075 - RNA, 22 nt, Pseudomonas aeruginosa PA01
gacgaggacgaggaugucgagg

SEQ ID NO: 167076 - RNA, 22 nt, Pseudomonas aeruginosa PA01
gcgcgacgcggggauggacgug

SEQ ID NO: 167077 - RNA, 22 nt, Pseudomonas aeruginosa PA01
augccguucguccucagugccc

SEQ ID NO: 167078 - RNA, 22 nt, Pseudomonas aeruginosa PA01
cuuccugggucugcggcaugac

SEQ ID NO: 167079 - RNA, 22 nt, Pseudomonas aeruginosa PA01
agccgauggcgugcggaucggc

SEQ ID NO: 167080 - RNA, 22 nt, Pseudomonas aeruginosa PA01
ccgccugcugcuggcccucggc

SEQ ID NO: 167081 - RNA, 22 nt, Pseudomonas aeruginosa PA01
cgagcggccagggccugcaccg

SEQ ID NO: 167082 - RNA, 22 nt, Pseudomonas aeruginosa PA01
ucggcgauccagccuucgaggu

SEQ ID NO: 167083 - RNA, 22 nt, Pseudomonas aeruginosa PA01
guucgccuggacgucaaggacu

SEQ ID NO: 167084 - RNA, 22 nt, Pseudomonas aeruginosa PA01
ucgaggcacgcugcagggaguc

SEQ ID NO: 167085 - RNA, 22 nt, Pseudomonas aeruginosa PA01
aggggccguaggggcuuucguu

SEQ ID NO: 167086 - RNA, 22 nt, Pseudomonas aeruginosa PA01
ggacaggucauacgguuucaug

SEQ ID NO: 167087 - RNA, 22 nt, Pseudomonas aeruginosa PA01
auggcaggaaagagcgggcggu

SEQ ID NO: 167088 - RNA, 22 nt, Pseudomonas aeruginosa PA01
ccagccgcucgcggccgaucug

SEQ ID NO: 167089 - RNA, 22 nt, Pseudomonas aeruginosa PA01
ccucgccaucgaggcucugcag

SEQ ID NO: 167090 - RNA, 22 nt, Pseudomonas aeruginosa PA01
ccgccaggucgauggacaacug

SEQ ID NO: 167091 - RNA, 22 nt, Pseudomonas aeruginosa PA01
ucggccugcuugccgggggcca

SEQ ID NO: 167092 - RNA, 22 nt, Pseudomonas aeruginosa PA01
gaccuggacguacugcccggca

SEQ ID NO: 167093 - RNA, 22 nt, Pseudomonas aeruginosa PA01
acccggaccgaggucaaguaag

SEQ ID NO: 167094 - RNA, 22 nt, Pseudomonas aeruginosa PA01
gaugcggcgcugacgauacagg

SEQ ID NO: 167095 - RNA, 22 nt, Pseudomonas aeruginosa PA01
cgggccugcggaugccugagca

SEQ ID NO: 167096 - RNA, 22 nt, Pseudomonas aeruginosa PA01
cgggaagacuucgaagguugcg

SEQ ID NO: 167097 - RNA, 22 nt, Pseudomonas aeruginosa PA01
cguguucaccgauugccgcgac

SEQ ID NO: 167098 - RNA, 22 nt, Pseudomonas aeruginosa PA01
gcggcgucggcaagaccaaugu

SEQ ID NO: 167099 - RNA, 22 nt, Pseudomonas aeruginosa PA01
cuggggcaguucgaucagcgcg

SEQ ID NO: 167100 - RNA, 22 nt, Pseudomonas aeruginosa PA01
acgcggauagcuuuucuucgcu

SEQ ID NO: 167101 - RNA, 22 nt, Pseudomonas aeruginosa PA01
cggcggucucgaucuucagcuc

SEQ ID NO: 167102 - RNA, 23 nt, Pseudomonas aeruginosa PA01
caggccguugcuggcagcguggg

SEQ ID NO: 167103 - RNA, 22 nt, Pseudomonas aeruginosa PA01
aucagcagcgacuggcagaccu

SEQ ID NO: 167104 - RNA, 21 nt, Pseudomonas aeruginosa PA01
ucuggguggcggggaagcgcu

SEQ ID NO: 167105 - RNA, 22 nt, Pseudomonas aeruginosa PA01
ggucggguucgagcaccuggcu

SEQ ID NO: 167106 - RNA, 22 nt, Pseudomonas aeruginosa PA01
acggcgaaggugccgcugcccu

SEQ ID NO: 167107 - RNA, 22 nt, Pseudomonas aeruginosa PA01
ugguggcgaccuucuuccaggg

SEQ ID NO: 167108 - RNA, 22 nt, Pseudomonas aeruginosa PA01
gcuggcgucgcuccugcuggcc

SEQ ID NO: 167109 - RNA, 22 nt, Pseudomonas aeruginosa PA01
aaccgcgugcgccagccguuca

SEQ ID NO: 167110 - RNA, 22 nt, Pseudomonas aeruginosa PA01
ucgucgagggugccgaagccgc

SEQ ID NO: 167111 - RNA, 22 nt, Pseudomonas aeruginosa PA01
acgccggcggcugguugccgag

SEQ ID NO: 167112 - RNA, 22 nt, Pseudomonas aeruginosa PA01
cuggaucgcagcccgguucgcu

SEQ ID NO: 167113 - RNA, 22 nt, Pseudomonas aeruginosa PA01
gcugaucaaccgggauugcuac

SEQ ID NO: 167114 - RNA, 18 nt, Pseudomonas aeruginosa PA01
gcaucggcgugaacagcc

SEQ ID NO: 167115 - RNA, 22 nt, Pseudomonas aeruginosa PA01
cugaaagcugucccaagaccuu

SEQ ID NO: 167116 - RNA, 22 nt, Pseudomonas aeruginosa PA01
agcgccucgcgcucggcaugac

SEQ ID NO: 167117 - RNA, 21 nt, Pseudomonas aeruginosa PA01
cggugaucgacgccuaccacc

SEQ ID NO: 167118 - RNA, 22 nt, Pseudomonas aeruginosa PA01
ugugcgacacccugauccuucg

SEQ ID NO: 167119 - RNA, 22 nt, Pseudomonas aeruginosa PA01
gaucgccccgcgcugucuugca

SEQ ID NO: 167120 - RNA, 22 nt, Pseudomonas aeruginosa PA01
ccgggucgaggaagucuggcgc

SEQ ID NO: 167121 - RNA, 22 nt, Pseudomonas aeruginosa PA01
ggucgaccugcacgcggaucag

SEQ ID NO: 167122 - RNA, 22 nt, Pseudomonas aeruginosa PA01
cuggaaggcgagcaucuucaug

SEQ ID NO: 167123 - RNA, 22 nt, Pseudomonas aeruginosa PA01
uuccaguuggcggcguugcagc

SEQ ID NO: 167124 - RNA, 22 nt, Pseudomonas aeruginosa PA01
uuuacucuucgucgucgccggg

SEQ ID NO: 167125 - RNA, 22 nt, Pseudomonas aeruginosa PA01
accugcaccagcaccagccggu

SEQ ID NO: 167126 - RNA, 22 nt, Pseudomonas aeruginosa PA01
gucgccgcccagcucgcgggcc

SEQ ID NO: 167127 - RNA, 22 nt, Pseudomonas aeruginosa PA01
uauggugcaccgcgugcagccg

SEQ ID NO: 167128 - RNA, 22 nt, Pseudomonas aeruginosa PA01
aucgccuggccgcgcgggcccu

SEQ ID NO: 167129 - RNA, 22 nt, Pseudomonas aeruginosa PA01
gccugcgccgcuaccaacaggc

SEQ ID NO: 167130 - RNA, 22 nt, Pseudomonas aeruginosa PA01
uuuccaagcuggacgccggcgu

SEQ ID NO: 167131 - RNA, 22 nt, Pseudomonas aeruginosa PA01
cgccacgguguccggcagcaug

SEQ ID NO: 167132 - RNA, 22 nt, Pseudomonas aeruginosa PA01
acuucgaaguuaccgcguuggc

SEQ ID NO: 167133 - RNA, 22 nt, Pseudomonas aeruginosa PA01
agcucgaacagacgcuggccgg

SEQ ID NO: 167134 - RNA, 21 nt, Pseudomonas aeruginosa PA01
uuggccgaagucggcgcccug

SEQ ID NO: 167135 - RNA, 22 nt, Pseudomonas aeruginosa PA01
gagcugcgcgaagcgcuggacg

SEQ ID NO: 167136 - RNA, 21 nt, Pseudomonas aeruginosa PA01
gagcagcucgggcggcgcgac

SEQ ID NO: 167137 - RNA, 22 nt, Pseudomonas aeruginosa PA01
guuggccagagugucggagccg

SEQ ID NO: 167138 - RNA, 22 nt, Pseudomonas aeruginosa PA01
gcggaucggacgguugcggugc

SEQ ID NO: 167139 - RNA, 22 nt, Pseudomonas aeruginosa PA01
gucggcgauggccagcagcgcg

SEQ ID NO: 167140 - RNA, 22 nt, Pseudomonas aeruginosa PA01
ucagcgacgugaacaugccggg

SEQ ID NO: 167141 - RNA, 22 nt, Pseudomonas aeruginosa PA01
gcgacggagucaacgacguacc

SEQ ID NO: 167142 - RNA, 19 nt, Pseudomonas aeruginosa PA01
agggcgugcagguggcgga

SEQ ID NO: 167143 - RNA, 22 nt, Pseudomonas aeruginosa PA01
auggcgacugacgaagaacacc

SEQ ID NO: 167144 - RNA, 22 nt, Pseudomonas aeruginosa PA01
guugcggaucgucguagccgag

SEQ ID NO: 167145 - RNA, 22 nt, Pseudomonas aeruginosa PA01
gcgucggcugcaucgcacgacc

SEQ ID NO: 167146 - RNA, 22 nt, Pseudomonas aeruginosa PA01
gcugaaaccguugcuggagaac

SEQ ID NO: 167147 - RNA, 22 nt, Pseudomonas aeruginosa PA01
uacuacaugcucucgcccugga

SEQ ID NO: 167148 - RNA, 22 nt, Pseudomonas aeruginosa PA01
guccuugaacuccggcccggcg

SEQ ID NO: 167149 - RNA, 22 nt, Pseudomonas aeruginosa PA01
gcugaccuucgaguuguucucc

SEQ ID NO: 167150 - RNA, 22 nt, Pseudomonas aeruginosa PA01
ugagccgagcgcucagcgccga

SEQ ID NO: 167151 - RNA, 22 nt, Pseudomonas aeruginosa PA01
ucgcgccgagcaggugggugcu

SEQ ID NO: 167152 - RNA, 22 nt, Pseudomonas aeruginosa PA01
ggcgacgaucugcucgaggauc

SEQ ID NO: 167153 - RNA, 22 nt, Pseudomonas aeruginosa PA01
gaucggcggugugcucgagacc

SEQ ID NO: 167154 - RNA, 22 nt, Pseudomonas aeruginosa PA01
uacaggguggcggcgccgagga

SEQ ID NO: 167155 - RNA, 22 nt, Pseudomonas aeruginosa PA01
cgaagagcccgucgagggccug

SEQ ID NO: 167156 - RNA, 22 nt, Pseudomonas aeruginosa PA01
gagcugucgaaggucuccuggg

SEQ ID NO: 167157 - RNA, 22 nt, Pseudomonas aeruginosa PA01
ucgacgagaagcucgacgccgc

SEQ ID NO: 167158 - RNA, 22 nt, Pseudomonas aeruginosa PA01
cugcucgaccaucaugagcgug

SEQ ID NO: 167159 - RNA, 22 nt, Pseudomonas aeruginosa PA01
agcgcgcugacggugaggacuc

SEQ ID NO: 167160 - RNA, 22 nt, Pseudomonas aeruginosa PA01
aggucguugaccggcaggccga

SEQ ID NO: 167161 - RNA, 22 nt, Pseudomonas aeruginosa PA01
ugaaacugccguucgacaaggu

SEQ ID NO: 167162 - RNA, 23 nt, Pseudomonas aeruginosa PA01
cccaggcgaccaaggacaucgcc

SEQ ID NO: 167163 - RNA, 22 nt, Pseudomonas aeruginosa PA01
cggcguccuggaucagcgccug

SEQ ID NO: 167164 - RNA, 22 nt, Pseudomonas aeruginosa PA01
ccgaugugcuucaccaacggca

SEQ ID NO: 167165 - RNA, 22 nt, Pseudomonas aeruginosa PA01
caacauucgccccgcagacugc

SEQ ID NO: 167166 - RNA, 22 nt, Pseudomonas aeruginosa PA01
ugcugcuguccggugacggcga

SEQ ID NO: 167167 - RNA, 22 nt, Pseudomonas aeruginosa PA01
cgcaacgaccucgaccugucca

SEQ ID NO: 167168 - RNA, 22 nt, Pseudomonas aeruginosa PA01
gcuuggccaggucgagggcgac

SEQ ID NO: 167169 - RNA, 22 nt, Pseudomonas aeruginosa PA01
uccugcucgaucacggccuggu

SEQ ID NO: 167170 - RNA, 22 nt, Pseudomonas aeruginosa PA01
ucggcacgguaaucgccgggau

SEQ ID NO: 167171 - RNA, 22 nt, Pseudomonas aeruginosa PA01
ucagguagugaggcaccagcaa

SEQ ID NO: 167172 - RNA, 22 nt, Pseudomonas aeruginosa PA01
gggccgcccggcgggaucuugc

SEQ ID NO: 167173 - RNA, 22 nt, Pseudomonas aeruginosa PA01
cagccgggugaugccgcaggug

SEQ ID NO: 167174 - RNA, 22 nt, Pseudomonas aeruginosa PA01
guauugcggauccgccgguagg

SEQ ID NO: 167175 - RNA, 22 nt, Pseudomonas aeruginosa PA01
gcggaccugcucggccagcacc

SEQ ID NO: 167176 - RNA, 22 nt, Pseudomonas aeruginosa PA01
cgguagcagaccaggucgauga

SEQ ID NO: 167177 - RNA, 22 nt, Pseudomonas aeruginosa PA01
cagcuucaggcuggcgucgucg

SEQ ID NO: 167178 - RNA, 22 nt, Pseudomonas aeruginosa PA01
uuggccggguugagcuuggccu

SEQ ID NO: 167179 - RNA, 22 nt, Pseudomonas aeruginosa PA01
ggucguggaucagcugggcgaa

SEQ ID NO: 167180 - RNA, 22 nt, Pseudomonas aeruginosa PA01
ucgaggggaaucucguaccagg

SEQ ID NO: 167181 - RNA, 22 nt, Pseudomonas aeruginosa PA01
cggcauggacuccgcgcgcgag

SEQ ID NO: 167182 - RNA, 22 nt, Pseudomonas aeruginosa PA01
ugggcggcaagccugcgcgaca

SEQ ID NO: 167183 - RNA, 22 nt, Pseudomonas aeruginosa PA01
gcucgacguacugauaucggau

SEQ ID NO: 167184 - RNA, 22 nt, Pseudomonas aeruginosa PA01
uuggcgaucugguaguagcgau

SEQ ID NO: 167185 - RNA, 22 nt, Pseudomonas aeruginosa PA01
cgcgccagcagguggcggaugg

SEQ ID NO: 167186 - RNA, 22 nt, Pseudomonas aeruginosa PA01
ugauccugcucggcauggccau

SEQ ID NO: 167187 - RNA, 22 nt, Pseudomonas aeruginosa PA01
gcuggcggcuccugcugacgcg

SEQ ID NO: 167188 - RNA, 22 nt, Pseudomonas aeruginosa PA01
gcagcgcauacagaacuugcga

SEQ ID NO: 167189 - RNA, 22 nt, Pseudomonas aeruginosa PA01
aaccccugguaguggugcugga

SEQ ID NO: 167190 - RNA, 22 nt, Pseudomonas aeruginosa PA01
gccgcgaguaccucgaacagau

SEQ ID NO: 167191 - RNA, 22 nt, Pseudomonas aeruginosa PA01
acgcuggcgagcaacugcucgg

SEQ ID NO: 167192 - RNA, 23 nt, Pseudomonas aeruginosa PA01
ucccuccuugcagccggcggcgc

SEQ ID NO: 167193 - RNA, 22 nt, Pseudomonas aeruginosa PA01
gcugggucgcuauuuucgcugg

SEQ ID NO: 167194 - RNA, 22 nt, Pseudomonas aeruginosa PA01
guccuucgcggucgcgguagcc

SEQ ID NO: 167195 - RNA, 22 nt, Pseudomonas aeruginosa PA01
cgucggccaggaggugguacgc

SEQ ID NO: 167196 - RNA, 22 nt, Pseudomonas aeruginosa PA01
gcggccugguguuccaggccuu

SEQ ID NO: 167197 - RNA, 21 nt, Pseudomonas aeruginosa PA01
gccgcacgcugcccuccaggc

SEQ ID NO: 167198 - RNA, 22 nt, Pseudomonas aeruginosa PA01
ggccaugaggcggcggcgcugu

SEQ ID NO: 167199 - RNA, 22 nt, Pseudomonas aeruginosa PA01
acgcuuccauuccgcagcaccc

SEQ ID NO: 167200 - RNA, 22 nt, Pseudomonas aeruginosa PA01
uuccgccagcaggauguagagc

SEQ ID NO: 167201 - RNA, 22 nt, Pseudomonas aeruginosa PA01
cagcggugggccccacggcugc

SEQ ID NO: 167202 - RNA, 22 nt, Pseudomonas aeruginosa PA01
gaguugcucggugcuggcgcgg

SEQ ID NO: 167203 - RNA, 22 nt, Pseudomonas aeruginosa PA01
gcucgucggugaccggcgagac

SEQ ID NO: 167204 - RNA, 22 nt, Pseudomonas aeruginosa PA01
gagcgcgacgaguugcagcucu

SEQ ID NO: 167205 - RNA, 22 nt, Pseudomonas aeruginosa PA01
ggcgguguggagccagacggcg

SEQ ID NO: 167206 - RNA, 22 nt, Pseudomonas aeruginosa PA01
caggcucgcucguucagcuuuc

SEQ ID NO: 167207 - RNA, 22 nt, Pseudomonas aeruginosa PA01
ggcgguucaccugcaccugcug

SEQ ID NO: 167208 - RNA, 22 nt, Pseudomonas aeruginosa PA01
ucuugcggcagguagucgaaga

SEQ ID NO: 167209 - RNA, 22 nt, Pseudomonas aeruginosa PA01
ugccgcgcgggguaucgaggaa

SEQ ID NO: 167210 - RNA, 22 nt, Pseudomonas aeruginosa PA01
guggcccaucuucagggucuug

SEQ ID NO: 167211 - RNA, 22 nt, Pseudomonas aeruginosa PA01
agcagcuucugcuggcgccguu

SEQ ID NO: 167212 - RNA, 22 nt, Pseudomonas aeruginosa PA01
aaggcgaugcgccagaucagcg

SEQ ID NO: 167213 - RNA, 22 nt, Pseudomonas aeruginosa PA01
uggguucggaccgugaggugga

SEQ ID NO: 167214 - RNA, 22 nt, Pseudomonas aeruginosa PA01
gggccgggcgacgaacuggacg

SEQ ID NO: 167215 - RNA, 22 nt, Pseudomonas aeruginosa PA01
cguggcgaugucggcguggccg

SEQ ID NO: 167216 - RNA, 22 nt, Pseudomonas aeruginosa PA01
gguuggugccggucucgcgggc

SEQ ID NO: 167217 - RNA, 22 nt, Pseudomonas aeruginosa PA01
gucgaguugauguggcugaccg

SEQ ID NO: 167218 - RNA, 22 nt, Pseudomonas aeruginosa PA01
accgggaaggacauggucgggg

SEQ ID NO: 167219 - RNA, 22 nt, Pseudomonas aeruginosa PA01
cgggucgucgaacagcgugcgc

SEQ ID NO: 167220 - RNA, 22 nt, Pseudomonas aeruginosa PA01
gccucgauguaguuguucaggu

SEQ ID NO: 167221 - RNA, 20 nt, Pseudomonas aeruginosa PA01
cggcgcgcuggcuaccggcc

SEQ ID NO: 167222 - RNA, 22 nt, Pseudomonas aeruginosa PA01
guccgacgaaaccgugauggug

SEQ ID NO: 167223 - RNA, 22 nt, Pseudomonas aeruginosa PA01
gcguuggccuggccguugguca

SEQ ID NO: 167224 - RNA, 22 nt, Pseudomonas aeruginosa PA01
guuggccaggucgccggcggca

SEQ ID NO: 167225 - RNA, 22 nt, Pseudomonas aeruginosa PA01
ucgcgcauucgggucggggucu

SEQ ID NO: 167226 - RNA, 22 nt, Pseudomonas aeruginosa PA01
agccggccggugcugcugguga

SEQ ID NO: 167227 - RNA, 22 nt, Pseudomonas aeruginosa PA01
gcggaucgagcgacuggccgag

SEQ ID NO: 167228 - RNA, 22 nt, Pseudomonas aeruginosa PA01
aaccccggcgcgcuggagcgcc

SEQ ID NO: 167229 - RNA, 22 nt, Pseudomonas aeruginosa PA01
uucugggcacugcuuucggcgc

SEQ ID NO: 167230 - RNA, 22 nt, Pseudomonas aeruginosa PA01
ggcgcugcuguuccaguacgcg

SEQ ID NO: 167231 - RNA, 22 nt, Pseudomonas aeruginosa PA01
acgggggccucgcgguagcaug

SEQ ID NO: 167232 - RNA, 22 nt, Pseudomonas aeruginosa PA01
cgagagcuucgccaaccugaug

SEQ ID NO: 167233 - RNA, 22 nt, Pseudomonas aeruginosa PA01
gagcggcugaugcggcggcuga

SEQ ID NO: 167234 - RNA, 22 nt, Pseudomonas aeruginosa PA01
cugagccucggcggcagccgca

SEQ ID NO: 167235 - RNA, 22 nt, Pseudomonas aeruginosa PA01
cacgcccuucacguugcgcaac

SEQ ID NO: 167236 - RNA, 22 nt, Pseudomonas aeruginosa PA01
cgcggggucuuuccaucgcugc

SEQ ID NO: 167237 - RNA, 22 nt, Pseudomonas aeruginosa PA01
ugccgccggacggucagccgau

SEQ ID NO: 167238 - RNA, 21 nt, Pseudomonas aeruginosa PA01
ccgcucgccguggaaggcugc

SEQ ID NO: 167239 - RNA, 22 nt, Pseudomonas aeruginosa PA01
cgcugccaucgauggcgacgaa

SEQ ID NO: 167240 - RNA, 22 nt, Pseudomonas aeruginosa PA01
acccugcucggcggcgguuucg

SEQ ID NO: 167241 - RNA, 22 nt, Pseudomonas aeruginosa PA01
acgccgcuggcgaucaccgggu

SEQ ID NO: 167242 - RNA, 22 nt, Pseudomonas aeruginosa PA01
cgauguccagguggcgcugaac

SEQ ID NO: 167243 - RNA, 23 nt, Pseudomonas aeruginosa PA01
ucuugcccuucuucucgacgguc

SEQ ID NO: 167244 - RNA, 22 nt, Pseudomonas aeruginosa PA01
ucaacgaugcuugugcuugcgg

SEQ ID NO: 167245 - RNA, 22 nt, Pseudomonas aeruginosa PA01
guccagcaaguaggucgccgcg

SEQ ID NO: 167246 - RNA, 22 nt, Pseudomonas aeruginosa PA01
cgggcgacgacacuccgaucau

SEQ ID NO: 167247 - RNA, 22 nt, Pseudomonas aeruginosa PA01
gcgaaacugcugcugcaacugc

SEQ ID NO: 167248 - RNA, 22 nt, Pseudomonas aeruginosa PA01
caggugcaccgccugcgcgaua

SEQ ID NO: 167249 - RNA, 21 nt, Pseudomonas aeruginosa PA01
cccugacccgaggcuacgccg

SEQ ID NO: 167250 - RNA, 22 nt, Pseudomonas aeruginosa PA01
aggcgcacgccaacuucggugc

SEQ ID NO: 167251 - RNA, 21 nt, Pseudomonas aeruginosa PA01
uuucggcguccuggaaggguu

SEQ ID NO: 167252 - RNA, 22 nt, Pseudomonas aeruginosa PA01
cggcuuguccagcagggucagc

SEQ ID NO: 167253 - RNA, 22 nt, Pseudomonas aeruginosa PA01
gccagcaguucgcgggcacggg

SEQ ID NO: 167254 - RNA, 22 nt, Pseudomonas aeruginosa PA01
agcagcgccugaaggaagucga

SEQ ID NO: 167255 - RNA, 20 nt, Pseudomonas aeruginosa PA01
ugccccuggauaaauggagc

SEQ ID NO: 167256 - RNA, 22 nt, Pseudomonas aeruginosa PA01
cgccagucuucgccgccaggcg

SEQ ID NO: 167257 - RNA, 22 nt, Pseudomonas aeruginosa PA01
cugcuagucgcgggauccgcgc

SEQ ID NO: 167258 - RNA, 22 nt, Pseudomonas aeruginosa PA01
gguaggcgcguuccagguccug

SEQ ID NO: 167259 - RNA, 20 nt, Pseudomonas aeruginosa PA01
ucacggcccugguggucagg

SEQ ID NO: 167260 - RNA, 22 nt, Pseudomonas aeruginosa PA01
aguccuucggcaucgccggcau

SEQ ID NO: 167261 - RNA, 22 nt, Pseudomonas aeruginosa PA01
cugccgggccagcgaccgguug

SEQ ID NO: 167262 - RNA, 22 nt, Pseudomonas aeruginosa PA01
gaccgccagcagcucgucgcga

SEQ ID NO: 167263 - RNA, 22 nt, Pseudomonas aeruginosa PA01
uugucgaugugccgcgagccgc

SEQ ID NO: 167264 - RNA, 22 nt, Pseudomonas aeruginosa PA01
cgaagugcuggaacagguccgc

SEQ ID NO: 167265 - RNA, 22 nt, Pseudomonas aeruginosa PA01
cgcagggugaugugcgcggcca

SEQ ID NO: 167266 - RNA, 22 nt, Pseudomonas aeruginosa PA01
ugccagucgcggccgcucuggg

SEQ ID NO: 167267 - RNA, 21 nt, Pseudomonas aeruginosa PA01
aggccgaugggaaacugccgc

SEQ ID NO: 167268 - RNA, 22 nt, Pseudomonas aeruginosa PA01
ucgcgaauugaaggacagcguc

SEQ ID NO: 167269 - RNA, 22 nt, Pseudomonas aeruginosa PA01
ggcgugguggucaugcagguga

SEQ ID NO: 167270 - RNA, 22 nt, Pseudomonas aeruginosa PA01
gacgaggaccgcaucgccgccc

SEQ ID NO: 167271 - RNA, 22 nt, Pseudomonas aeruginosa PA01
guagcgcuugugggcgaacggc

SEQ ID NO: 167272 - RNA, 22 nt, Pseudomonas aeruginosa PA01
gcaguuccuccacgcgguuucc

SEQ ID NO: 167273 - RNA, 22 nt, Pseudomonas aeruginosa PA01
cagcagauguacggccaugguu

SEQ ID NO: 167274 - RNA, 22 nt, Pseudomonas aeruginosa PA01
aucacucguucaccgccacccu

SEQ ID NO: 167275 - RNA, 22 nt, Pseudomonas aeruginosa PA01
aaggccggccugguggcugcca

SEQ ID NO: 167276 - RNA, 22 nt, Pseudomonas aeruginosa PA01
cuccggcgaacucaggugcgcc

SEQ ID NO: 167277 - RNA, 22 nt, Pseudomonas aeruginosa PA01
ccccagguguucggcaucggcc

SEQ ID NO: 167278 - RNA, 22 nt, Pseudomonas aeruginosa PA01
aaccccagcccucgcggccgau

SEQ ID NO: 167279 - RNA, 22 nt, Pseudomonas aeruginosa PA01
guugaucagccucugcgccuuc

SEQ ID NO: 167280 - RNA, 22 nt, Pseudomonas aeruginosa PA01
gaaggucgccugcuggucagcg

SEQ ID NO: 167281 - RNA, 22 nt, Pseudomonas aeruginosa PA01
cagcuacgucgaaccggugcug

SEQ ID NO: 167282 - RNA, 22 nt, Pseudomonas aeruginosa PA01
acggcguugaccaggucgcugg

SEQ ID NO: 167283 - RNA, 22 nt, Pseudomonas aeruginosa PA01
ggugcugcuguucaugucgacg

SEQ ID NO: 167284 - RNA, 22 nt, Pseudomonas aeruginosa PA01
gucgaugaggugcuuggcgaca

SEQ ID NO: 167285 - RNA, 22 nt, Pseudomonas aeruginosa PA01
cgccgcugaauaccaccgggcc

SEQ ID NO: 167286 - RNA, 22 nt, Pseudomonas aeruginosa PA01
aggacagcucgaugaucugcgc

SEQ ID NO: 167287 - RNA, 20 nt, Pseudomonas aeruginosa PA01
ggguacgugcgcgcugggcg

SEQ ID NO: 167288 - RNA, 22 nt, Pseudomonas aeruginosa PA01
aaggcgccgagggcguuuucca

SEQ ID NO: 167289 - RNA, 22 nt, Pseudomonas aeruginosa PA01
cauggaguggguguccuuggug

SEQ ID NO: 167290 - RNA, 22 nt, Pseudomonas aeruginosa PA01
aucuggagcgggccagcgacgc

SEQ ID NO: 167291 - RNA, 22 nt, Pseudomonas aeruginosa PA01
cucugcgccugcagcgcggcau

SEQ ID NO: 167292 - RNA, 22 nt, Pseudomonas aeruginosa PA01
gccggcucaucagcacccgcug

SEQ ID NO: 167293 - RNA, 22 nt, Pseudomonas aeruginosa PA01
cgaucgauacggccuucgaggu

SEQ ID NO: 167294 - RNA, 19 nt, Pseudomonas aeruginosa PA01
cggcgggcggaucagcucg

SEQ ID NO: 167295 - RNA, 22 nt, Pseudomonas aeruginosa PA01
gcccaugucaugcucgaucagc

SEQ ID NO: 167296 - RNA, 22 nt, Pseudomonas aeruginosa PA01
gcgcggaucccgcgacuagcag

SEQ ID NO: 167297 - RNA, 22 nt, Pseudomonas aeruginosa PA01
ggugcgcaccgucgagggcgag

SEQ ID NO: 167298 - RNA, 22 nt, Pseudomonas aeruginosa PA01
aagcugggcauagaggucgucg

SEQ ID NO: 167299 - RNA, 22 nt, Pseudomonas aeruginosa PA01
ccucgaaguucggcccgaugac

SEQ ID NO: 167300 - RNA, 22 nt, Pseudomonas aeruginosa PA01
uucagcuucaaggacgcgaugg

SEQ ID NO: 167301 - RNA, 22 nt, Pseudomonas aeruginosa PA01
ugggcuaugguuucgcucucga

SEQ ID NO: 167302 - RNA, 22 nt, Pseudomonas aeruginosa PA01
ucgucggccucguucucgauga

SEQ ID NO: 167303 - RNA, 22 nt, Pseudomonas aeruginosa PA01
ugaucgucgcccugcgcggccg

SEQ ID NO: 167304 - RNA, 22 nt, Pseudomonas aeruginosa PA01
uaggcgaagaagccgcgcuccu

SEQ ID NO: 167305 - RNA, 22 nt, Pseudomonas aeruginosa PA01
gcucgaccuugaugucuuccag

SEQ ID NO: 167306 - RNA, 22 nt, Pseudomonas aeruginosa PA01
gcacuggaauggccggccgcgc

SEQ ID NO: 167307 - RNA, 22 nt, Pseudomonas aeruginosa PA01
gucuggggugaggccgagccga

SEQ ID NO: 167308 - RNA, 22 nt, Pseudomonas aeruginosa PA01
aaggccguggucgacgccgcgc

SEQ ID NO: 167309 - RNA, 22 nt, Pseudomonas aeruginosa PA01
uggucgcagcgcugggacuacg

SEQ ID NO: 167310 - RNA, 22 nt, Pseudomonas aeruginosa PA01
ggggccgaucagcaccaguucg

SEQ ID NO: 167311 - RNA, 22 nt, Pseudomonas aeruginosa PA01
gggcgagaccgagcagcgcggu

SEQ ID NO: 167312 - RNA, 22 nt, Pseudomonas aeruginosa PA01
caucgauuggugaucccgccgc

SEQ ID NO: 167313 - RNA, 22 nt, Pseudomonas aeruginosa PA01
gaugauccgcuccugcucgccg

SEQ ID NO: 167314 - RNA, 21 nt, Pseudomonas aeruginosa PA01
ucgccgagagugaccagccgc

SEQ ID NO: 167315 - RNA, 20 nt, Pseudomonas aeruginosa PA01
ccggcgcggccuuucgucgu

SEQ ID NO: 167316 - RNA, 22 nt, Pseudomonas aeruginosa PA01
ggcgaucuccagcagacgcugg

SEQ ID NO: 167317 - RNA, 20 nt, Pseudomonas aeruginosa PA01
cggcggcgaccucagccuca

SEQ ID NO: 167318 - RNA, 22 nt, Pseudomonas aeruginosa PA01
cugcugaucuggaucggagugg

SEQ ID NO: 167319 - RNA, 22 nt, Pseudomonas aeruginosa PA01
ccggcagaagacaggccgguuc

SEQ ID NO: 167320 - RNA, 21 nt, Pseudomonas aeruginosa PA01
uccacggcgguuucuaccggc

SEQ ID NO: 167321 - RNA, 22 nt, Pseudomonas aeruginosa PA01
gcugaucuacgacucgccggug

SEQ ID NO: 167322 - RNA, 22 nt, Pseudomonas aeruginosa PA01
cguggucgagggugucgacuau

SEQ ID NO: 167323 - RNA, 22 nt, Pseudomonas aeruginosa PA01
gcuaccagcaauuccacgcgac

SEQ ID NO: 167324 - RNA, 22 nt, Pseudomonas aeruginosa PA01
gcgguucagggugaugccggag

SEQ ID NO: 167325 - RNA, 22 nt, Pseudomonas aeruginosa PA01
gcggccuugaagccgucgccgg

SEQ ID NO: 167326 - RNA, 22 nt, Pseudomonas aeruginosa PA01
gccggcgagcaguuggcgaugu

SEQ ID NO: 167327 - RNA, 22 nt, Pseudomonas aeruginosa PA01
cccagcaggucgagggccugaa

SEQ ID NO: 167328 - RNA, 22 nt, Pseudomonas aeruginosa PA01
acggccagguggugcagaucga

SEQ ID NO: 167329 - RNA, 23 nt, Pseudomonas aeruginosa PA01
ucugcggcagcaggucgacgccg

SEQ ID NO: 167330 - RNA, 22 nt, Pseudomonas aeruginosa PA01
gcagcuggaaguugucaacgaa

SEQ ID NO: 167331 - RNA, 22 nt, Pseudomonas aeruginosa PA01
cuggaagaaauugucgcugacg

SEQ ID NO: 167332 - RNA, 21 nt, Pseudomonas aeruginosa PA01
ugccuuccugcucggcgagcc

SEQ ID NO: 167333 - RNA, 22 nt, Pseudomonas aeruginosa PA01
ccuggaagugcuguuccuggac

SEQ ID NO: 167334 - RNA, 22 nt, Pseudomonas aeruginosa PA01
gagggccuuuuccaagccggcc

SEQ ID NO: 167335 - RNA, 22 nt, Pseudomonas aeruginosa PA01
gacgcccagcggccucagguag

SEQ ID NO: 167336 - RNA, 22 nt, Pseudomonas aeruginosa PA01
acaccacgcgauccuuggccgc

SEQ ID NO: 167337 - RNA, 22 nt, Pseudomonas aeruginosa PA01
ccaguuggagcgcgccggcgac

SEQ ID NO: 167338 - RNA, 22 nt, Pseudomonas aeruginosa PA01
uucagcuuguuuuuccgggcug

SEQ ID NO: 167339 - RNA, 22 nt, Pseudomonas aeruginosa PA01
cugaccagguucagguagcgcg

SEQ ID NO: 167340 - RNA, 22 nt, Pseudomonas aeruginosa PA01
ccaugaucagguuguggucgcc

SEQ ID NO: 167341 - RNA, 22 nt, Pseudomonas aeruginosa PA01
acgccggccugcuggacggcau

SEQ ID NO: 167342 - RNA, 22 nt, Pseudomonas aeruginosa PA01
cgggugcugaugagccggcgga

SEQ ID NO: 167343 - RNA, 22 nt, Pseudomonas aeruginosa PA01
cagaacagcucggccuugcgcu

SEQ ID NO: 167344 - RNA, 22 nt, Pseudomonas aeruginosa PA01
ucgcgacgcgcucuggaugccg

SEQ ID NO: 167345 - RNA, 22 nt, Pseudomonas aeruginosa PA01
gccuugccgaagcgaugggcca

SEQ ID NO: 167346 - RNA, 22 nt, Pseudomonas aeruginosa PA01
gagcggugcgcuuggucuuacc

SEQ ID NO: 167347 - RNA, 22 nt, Pseudomonas aeruginosa PA01
gcagcggcaacggguggucgac

SEQ ID NO: 167348 - RNA, 22 nt, Pseudomonas aeruginosa PA01
cacggcugguggucccagcugg

SEQ ID NO: 167349 - RNA, 22 nt, Pseudomonas aeruginosa PA01
uucgguggaguuggccuccagc

SEQ ID NO: 167350 - RNA, 22 nt, Pseudomonas aeruginosa PA01
ccgagcaggccgauggagccgg

SEQ ID NO: 167351 - RNA, 22 nt, Pseudomonas aeruginosa PA01
cugcaucggcucgucauucgcc

SEQ ID NO: 167352 - RNA, 22 nt, Pseudomonas aeruginosa PA01
ccggauuugcugguagccuugg

SEQ ID NO: 167353 - RNA, 22 nt, Pseudomonas aeruginosa PA01
gucgcgcaccuccuggucgagg

SEQ ID NO: 167354 - RNA, 22 nt, Pseudomonas aeruginosa PA01
acgagcugcaacgugccgggcg

SEQ ID NO: 167355 - RNA, 22 nt, Pseudomonas aeruginosa PA01
guccucguugccgccaagccac

SEQ ID NO: 167356 - RNA, 22 nt, Pseudomonas aeruginosa PA01
caggcccugccagccggggaug

SEQ ID NO: 167357 - RNA, 22 nt, Pseudomonas aeruginosa PA01
uuggcgaaugacggcggcggcc

SEQ ID NO: 167358 - RNA, 22 nt, Pseudomonas aeruginosa PA01
ggucgccgagguacuccgccag

SEQ ID NO: 167359 - RNA, 23 nt, Pseudomonas aeruginosa PA01
cggcuacggccuggagaucgacc

SEQ ID NO: 167360 - RNA, 21 nt, Pseudomonas aeruginosa PA01
ucggcgcgauuguccagcacc

SEQ ID NO: 167361 - RNA, 22 nt, Pseudomonas aeruginosa PA01
gaggccaggaucgaggaggccg

SEQ ID NO: 167362 - RNA, 22 nt, Pseudomonas aeruginosa PA01
agcagcggguggccaugggccg

SEQ ID NO: 167363 - RNA, 22 nt, Pseudomonas aeruginosa PA01
cuugcuggacuacgccgggccu

SEQ ID NO: 167364 - RNA, 22 nt, Pseudomonas aeruginosa PA01
ccgaccugcgacagggcuaccc

SEQ ID NO: 167365 - RNA, 22 nt, Pseudomonas aeruginosa PA01
ucgcccauggccuugggcgccg

SEQ ID NO: 167366 - RNA, 23 nt, Pseudomonas aeruginosa PA01
aucgguaccgugcuguacaucgc

SEQ ID NO: 167367 - RNA, 22 nt, Pseudomonas aeruginosa PA01
auccucccgcagaucgcccgcc

SEQ ID NO: 167368 - RNA, 22 nt, Pseudomonas aeruginosa PA01
cagcggguggcuucccggcgca

SEQ ID NO: 167369 - RNA, 22 nt, Pseudomonas aeruginosa PA01
uguugcgggucucgaccgugug

SEQ ID NO: 167370 - RNA, 22 nt, Pseudomonas aeruginosa PA01
uugaucgccagcggcuucgcgg

SEQ ID NO: 167371 - RNA, 22 nt, Pseudomonas aeruginosa PA01
acggcgaagccugccucggcga

SEQ ID NO: 167372 - RNA, 22 nt, Pseudomonas aeruginosa PA01
ccuucgaggugcuggaaaucuc

SEQ ID NO: 167373 - RNA, 22 nt, Pseudomonas aeruginosa PA01
ccuagccgaaacagugcucuac

SEQ ID NO: 167374 - RNA, 23 nt, Pseudomonas aeruginosa PA01
ccugcuccgcgauugccugggcg

SEQ ID NO: 167375 - RNA, 22 nt, Pseudomonas aeruginosa PA01
gcuguuguugcugucgaaccca

SEQ ID NO: 167376 - RNA, 22 nt, Pseudomonas aeruginosa PA01
gcggccgcugaacauccgccug

SEQ ID NO: 167377 - RNA, 22 nt, Pseudomonas aeruginosa PA01
cucggucucgucgccguggcgg

SEQ ID NO: 167378 - RNA, 22 nt, Pseudomonas aeruginosa PA01
ucggccugccugaccaacugcc

SEQ ID NO: 167379 - RNA, 22 nt, Pseudomonas aeruginosa PA01
gucgaugauggcgucggacagc

SEQ ID NO: 167380 - RNA, 22 nt, Pseudomonas aeruginosa PA01
gaggcggcgcgacgggugaugg

SEQ ID NO: 167381 - RNA, 22 nt, Pseudomonas aeruginosa PA01
ucaggcuauaaggcccgaugua

SEQ ID NO: 167382 - RNA, 22 nt, Pseudomonas aeruginosa PA01
ccugugccggcgcugcguggcg

SEQ ID NO: 167383 - RNA, 22 nt, Pseudomonas aeruginosa PA01
cauugggugaugccggcggcga

SEQ ID NO: 167384 - RNA, 22 nt, Pseudomonas aeruginosa PA01
caacgggccuuccaggcugccg

SEQ ID NO: 167385 - RNA, 17 nt, Pseudomonas aeruginosa PA01
accucgcgcucgcuggc

SEQ ID NO: 167386 - RNA, 22 nt, Pseudomonas aeruginosa PA01
uggucgagcacgaugauguggu

SEQ ID NO: 167387 - RNA, 22 nt, Pseudomonas aeruginosa PA01
agccgcucguaguccgggucgg

SEQ ID NO: 167388 - RNA, 21 nt, Pseudomonas aeruginosa PA01
gcucacgccccagcgcaucgc

SEQ ID NO: 167389 - RNA, 22 nt, Pseudomonas aeruginosa PA01
ccgguggugacccgcgagcagg

SEQ ID NO: 167390 - RNA, 22 nt, Pseudomonas aeruginosa PA01
caaggccagcagcagggugguc

SEQ ID NO: 167391 - RNA, 22 nt, Pseudomonas aeruginosa PA01
aaggcggcggcggucaagccgg

SEQ ID NO: 167392 - RNA, 22 nt, Pseudomonas aeruginosa PA01
ucugggacgggugcugaagacc

SEQ ID NO: 167393 - RNA, 22 nt, Pseudomonas aeruginosa PA01
ggugauguucugccugauggac

SEQ ID NO: 167394 - RNA, 22 nt, Pseudomonas aeruginosa PA01
ggcccggcuguccaggcggccg

SEQ ID NO: 167395 - RNA, 22 nt, Pseudomonas aeruginosa PA01
gcggcugguugaucucgugggc

SEQ ID NO: 167396 - RNA, 22 nt, Pseudomonas aeruginosa PA01
auggugguggagcacgacaugg

SEQ ID NO: 167397 - RNA, 22 nt, Pseudomonas aeruginosa PA01
ccgcugugcucgccgcccauca

SEQ ID NO: 167398 - RNA, 22 nt, Pseudomonas aeruginosa PA01
ccggcgcaaccgcaucaucagc

SEQ ID NO: 167399 - RNA, 22 nt, Pseudomonas aeruginosa PA01
uggagugcagaaaggcuucgac

SEQ ID NO: 167400 - RNA, 22 nt, Pseudomonas aeruginosa PA01
ugcgguuguuguggcugccaug

SEQ ID NO: 167401 - RNA, 22 nt, Pseudomonas aeruginosa PA01
ggcggcaugaucggcaucggcg

SEQ ID NO: 167402 - RNA, 22 nt, Pseudomonas aeruginosa PA01
gcucggcgaugaccucgcuguc

SEQ ID NO: 167403 - RNA, 20 nt, Pseudomonas aeruginosa PA01
cgggucaagcaacucgacga

SEQ ID NO: 167404 - RNA, 22 nt, Pseudomonas aeruginosa PA01
gguugucaucgacgcuacucca

SEQ ID NO: 167405 - RNA, 22 nt, Pseudomonas aeruginosa PA01
gcggugaaggcguugcugcucu

SEQ ID NO: 167406 - RNA, 22 nt, Pseudomonas aeruginosa PA01
ggcgaggaacacgcagccgagc

SEQ ID NO: 167407 - RNA, 22 nt, Pseudomonas aeruginosa PA01
guuggcucgugcgagggaggug

SEQ ID NO: 167408 - RNA, 22 nt, Pseudomonas aeruginosa PA01
uaucgacgccagacuuccagcu

SEQ ID NO: 167409 - RNA, 23 nt, Pseudomonas aeruginosa PA01
aucugcucccaguacugguuggc

SEQ ID NO: 167410 - RNA, 22 nt, Pseudomonas aeruginosa PA01
uccccggucgaugcggaagcuc

SEQ ID NO: 167411 - RNA, 22 nt, Pseudomonas aeruginosa PA01
guugaucacuccgcugccgcgc

SEQ ID NO: 167412 - RNA, 22 nt, Pseudomonas aeruginosa PA01
cguggugauccaggugccgucg

SEQ ID NO: 167413 - RNA, 22 nt, Pseudomonas aeruginosa PA01
ucggcaaggcgcuugcccggca

SEQ ID NO: 167414 - RNA, 22 nt, Pseudomonas aeruginosa PA01
cugguuguaguuggcggaaccg

SEQ ID NO: 167415 - RNA, 22 nt, Pseudomonas aeruginosa PA01
acggcggacaugcggacuggaa

SEQ ID NO: 167416 - RNA, 17 nt, Pseudomonas aeruginosa PA01
ccgcuacgcccaggagu

SEQ ID NO: 167417 - RNA, 22 nt, Pseudomonas aeruginosa PA01
accgaucugaucgagccgcuuu

SEQ ID NO: 167418 - RNA, 22 nt, Pseudomonas aeruginosa PA01
gcacggagcgauacggugcgcg

SEQ ID NO: 167419 - RNA, 22 nt, Pseudomonas aeruginosa PA01
uggccaaggccggcggcgaccc

SEQ ID NO: 167420 - RNA, 22 nt, Pseudomonas aeruginosa PA01
ugggaccgccgcuguagauaua

SEQ ID NO: 167421 - RNA, 22 nt, Pseudomonas aeruginosa PA01
ugggaucacgcggccaacgaca

SEQ ID NO: 167422 - RNA, 23 nt, Pseudomonas aeruginosa PA01
gaucccggcgacgaugccggcgg

SEQ ID NO: 167423 - RNA, 22 nt, Pseudomonas aeruginosa PA01
cacaggccgagcagggcgaucg

SEQ ID NO: 167424 - RNA, 22 nt, Pseudomonas aeruginosa PA01
ggucgacucguugucggugacg

SEQ ID NO: 167425 - RNA, 22 nt, Pseudomonas aeruginosa PA01
cacuggagcagcgccuggaucg

SEQ ID NO: 167426 - RNA, 22 nt, Pseudomonas aeruginosa PA01
cguggaggagauccggggcggu

SEQ ID NO: 167427 - RNA, 19 nt, Pseudomonas aeruginosa PA01
ggcgccgaugcugaucguc

SEQ ID NO: 167428 - RNA, 22 nt, Pseudomonas aeruginosa PA01
agaugcugcgccagggcgugca

SEQ ID NO: 167429 - RNA, 20 nt, Pseudomonas aeruginosa PA01
ucggggcgaggaucagcgcg

SEQ ID NO: 167430 - RNA, 22 nt, Pseudomonas aeruginosa PA01
guaggccuggaagcuggccauc

SEQ ID NO: 167431 - RNA, 22 nt, Pseudomonas aeruginosa PA01
gcgggucagcggcggcaucagg

SEQ ID NO: 167432 - RNA, 22 nt, Pseudomonas aeruginosa PA01
cgccuaaugucuucacucucaa

SEQ ID NO: 167433 - RNA, 22 nt, Pseudomonas aeruginosa PA01
gccucgaggaucaucauccccg

SEQ ID NO: 167434 - RNA, 22 nt, Pseudomonas aeruginosa PA01
ucgcgcauggcgucgagcaggc

SEQ ID NO: 167435 - RNA, 21 nt, Pseudomonas aeruginosa PA01
acgccaugcccucggucggcc

SEQ ID NO: 167436 - RNA, 22 nt, Pseudomonas aeruginosa PA01
aagcgggucuugaguaccgaca

SEQ ID NO: 167437 - RNA, 22 nt, Pseudomonas aeruginosa PA01
gcgccgacagcggcaccccggc

SEQ ID NO: 167438 - RNA, 22 nt, Pseudomonas aeruginosa PA01
gcgcugaagccgauccgcccgg

SEQ ID NO: 167439 - RNA, 22 nt, Pseudomonas aeruginosa PA01
ugcagcgaggugaucgucgccg

SEQ ID NO: 167440 - RNA, 22 nt, Pseudomonas aeruginosa PA01
ggccgcgcuggcggaggaggaa

SEQ ID NO: 167441 - RNA, 22 nt, Pseudomonas aeruginosa PA01
ucucgucguccaugcucgcgcc

SEQ ID NO: 167442 - RNA, 22 nt, Pseudomonas aeruginosa PA01
gcgggcguuggccgaacgccuc

SEQ ID NO: 167443 - RNA, 22 nt, Pseudomonas aeruginosa PA01
agcgccuguugcaggucggccu

SEQ ID NO: 167444 - RNA, 22 nt, Pseudomonas aeruginosa PA01
cgcacgccguugccgaugcuga

SEQ ID NO: 167445 - RNA, 20 nt, Pseudomonas aeruginosa PA01
gugcucgaccaguucguggc

SEQ ID NO: 167446 - RNA, 22 nt, Pseudomonas aeruginosa PA01
ugcgccccugguucucgaugaa

SEQ ID NO: 167447 - RNA, 22 nt, Pseudomonas aeruginosa PA01
aucaggccgcaggcguggcccu

SEQ ID NO: 167448 - RNA, 22 nt, Pseudomonas aeruginosa PA01
accagcacgggcgaaccguaga

SEQ ID NO: 167449 - RNA, 22 nt, Pseudomonas aeruginosa PA01
aagcgguugaaggcauuggcca

SEQ ID NO: 167450 - RNA, 22 nt, Pseudomonas aeruginosa PA01
cgggcugacguaauggaugcug

SEQ ID NO: 167451 - RNA, 22 nt, Pseudomonas aeruginosa PA01
gaccuggccugcgaacugggua

SEQ ID NO: 167452 - RNA, 22 nt, Pseudomonas aeruginosa PA01
ggacaucgacgggcugcucagc

SEQ ID NO: 167453 - RNA, 20 nt, Pseudomonas aeruginosa PA01
cagcagaagcccgacccggc

SEQ ID NO: 167454 - RNA, 22 nt, Pseudomonas aeruginosa PA01
ccggacgcagugauggucuucg

SEQ ID NO: 167455 - RNA, 22 nt, Pseudomonas aeruginosa PA01
cuacgccauggcccucgaggag

SEQ ID NO: 167456 - RNA, 22 nt, Pseudomonas aeruginosa PA01
uggccgccaguuucgccgucag

SEQ ID NO: 167457 - RNA, 22 nt, Pseudomonas aeruginosa PA01
uccucuggcuguucgccagcgg

SEQ ID NO: 167458 - RNA, 22 nt, Pseudomonas aeruginosa PA01
ucggcguugacgaagcgcagca

SEQ ID NO: 167459 - RNA, 19 nt, Pseudomonas aeruginosa PA01
ggccuguuccgccgcuucg

SEQ ID NO: 167460 - RNA, 22 nt, Pseudomonas aeruginosa PA01
gggcagcucgaggucuucgucg

SEQ ID NO: 167461 - RNA, 22 nt, Pseudomonas aeruginosa PA01
cgcagcgacgggcgggagcugc

SEQ ID NO: 167462 - RNA, 22 nt, Pseudomonas aeruginosa PA01
uggccgcggaggagggcagcuc

SEQ ID NO: 167463 - RNA, 22 nt, Pseudomonas aeruginosa PA01
uucccgucgaugcggagcggau

SEQ ID NO: 167464 - RNA, 22 nt, Pseudomonas aeruginosa PA01
agcuggaagaucaccuguucga

SEQ ID NO: 167465 - RNA, 21 nt, Pseudomonas aeruginosa PA01
gcaucgccguggauggaaauc

SEQ ID NO: 167466 - RNA, 22 nt, Pseudomonas aeruginosa PA01
ugauucgccguucgaccuggaa

SEQ ID NO: 167467 - RNA, 22 nt, Pseudomonas aeruginosa PA01
ccggcgagaucgacaugcucag

SEQ ID NO: 167468 - RNA, 22 nt, Pseudomonas aeruginosa PA01
aucgcgguggcggugauggugg

SEQ ID NO: 167469 - RNA, 23 nt, Pseudomonas aeruginosa PA01
uuuccgcgacguugguggacagc

SEQ ID NO: 167470 - RNA, 22 nt, Pseudomonas aeruginosa PA01
gcgccuuguucgccuggcgucg

SEQ ID NO: 167471 - RNA, 22 nt, Pseudomonas aeruginosa PA01
gagggugccauccacggaccgc

SEQ ID NO: 167472 - RNA, 22 nt, Pseudomonas aeruginosa PA01
cgccagcuguagcgcaggcguu

SEQ ID NO: 167473 - RNA, 22 nt, Pseudomonas aeruginosa PA01
gaaaccgccgccgagcaggguc

SEQ ID NO: 167474 - RNA, 22 nt, Pseudomonas aeruginosa PA01
cccgcggcaauugcugcaucuc

SEQ ID NO: 167475 - RNA, 22 nt, Pseudomonas aeruginosa PA01
caggcgcgcuucgucgcacugc

SEQ ID NO: 167476 - RNA, 19 nt, Pseudomonas aeruginosa PA01
ggcgaaauccagacgcagc

SEQ ID NO: 167477 - RNA, 22 nt, Pseudomonas aeruginosa PA01
gaaccgcuuccgccggguggcc

SEQ ID NO: 167478 - RNA, 22 nt, Pseudomonas aeruginosa PA01
ugucgagggcgcuggccagguc

SEQ ID NO: 167479 - RNA, 22 nt, Pseudomonas aeruginosa PA01
uuucgcggacgaacuggcggau

SEQ ID NO: 167480 - RNA, 22 nt, Pseudomonas aeruginosa PA01
aauaccgccacaggcgguaucc

SEQ ID NO: 167481 - RNA, 22 nt, Pseudomonas aeruginosa PA01
uugcucaagcugccggauggca

SEQ ID NO: 167482 - RNA, 22 nt, Pseudomonas aeruginosa PA01
gucggugcaggcacugccuucg

SEQ ID NO: 167483 - RNA, 21 nt, Pseudomonas aeruginosa PA01
acgaucccgcgcaucgggcug

SEQ ID NO: 167484 - RNA, 22 nt, Pseudomonas aeruginosa PA01
gaccagguccagggacggagcg

SEQ ID NO: 167485 - RNA, 22 nt, Pseudomonas aeruginosa PA01
gcagggcgugcgcccggcgaau

SEQ ID NO: 167486 - RNA, 22 nt, Pseudomonas aeruginosa PA01
aaggucaucgguuucgagccca

SEQ ID NO: 167487 - RNA, 22 nt, Pseudomonas aeruginosa PA01
cggccgcuggaggagucgccac

SEQ ID NO: 167488 - RNA, 22 nt, Pseudomonas aeruginosa PA01
gcccuugagggcggcggcgaac

SEQ ID NO: 167489 - RNA, 22 nt, Pseudomonas aeruginosa PA01
cggcgcgacugucggucuggaa

SEQ ID NO: 167490 - RNA, 22 nt, Pseudomonas aeruginosa PA01
gcccggaauaaaugcaccggac

SEQ ID NO: 167491 - RNA, 22 nt, Pseudomonas aeruginosa PA01
agcaacccggcgguggucaagc

SEQ ID NO: 167492 - RNA, 22 nt, Pseudomonas aeruginosa PA01
uugaucgcauccagcacgcgga

SEQ ID NO: 167493 - RNA, 22 nt, Pseudomonas aeruginosa PA01
cuggccgauaccgucagucagu

SEQ ID NO: 167494 - RNA, 22 nt, Pseudomonas aeruginosa PA01
uggcgaccuucaagcgucggcu

SEQ ID NO: 167495 - RNA, 22 nt, Pseudomonas aeruginosa PA01
ccagcgaucagacggcuguagg

SEQ ID NO: 167496 - RNA, 22 nt, Pseudomonas aeruginosa PA01
ggcgaauacgccaccggcguua

SEQ ID NO: 167497 - RNA, 22 nt, Pseudomonas aeruginosa PA01
aggccgaguugcgccaggacga

SEQ ID NO: 167498 - RNA, 22 nt, Pseudomonas aeruginosa PA01
cggcugaggccaguuguggaag

SEQ ID NO: 167499 - RNA, 22 nt, Pseudomonas aeruginosa PA01
cgccugcucgaucagguugagc

SEQ ID NO: 167500 - RNA, 18 nt, Pseudomonas aeruginosa PA01
ugcggcucgaccaucggc

SEQ ID NO: 167501 - RNA, 22 nt, Pseudomonas aeruginosa PA01
gacgccaugcucggcgcgcuga

SEQ ID NO: 167502 - RNA, 19 nt, Pseudomonas aeruginosa PA01
guucggcagccaguuccgc

SEQ ID NO: 167503 - RNA, 22 nt, Pseudomonas aeruginosa PA01
gcggcggcaagcgguugagcau

SEQ ID NO: 167504 - RNA, 22 nt, Pseudomonas aeruginosa PA01
gccuuucgcaugcaugcgucgc

SEQ ID NO: 167505 - RNA, 22 nt, Pseudomonas aeruginosa PA01
caggcgcggaucacuuucaauu

SEQ ID NO: 167506 - RNA, 22 nt, Pseudomonas aeruginosa PA01
guggucuuccucgucguccgcg

SEQ ID NO: 167507 - RNA, 22 nt, Pseudomonas aeruginosa PA01
gauucccuggcuggcgcugagc

SEQ ID NO: 167508 - RNA, 22 nt, Pseudomonas aeruginosa PA01
cccgcugacgcugcauuuccgc

SEQ ID NO: 167509 - RNA, 22 nt, Pseudomonas aeruginosa PA01
ucuucgacuaccugccgcaaga

SEQ ID NO: 167510 - RNA, 22 nt, Pseudomonas aeruginosa PA01
gcccucgggcaguucguaggug

SEQ ID NO: 167511 - RNA, 22 nt, Pseudomonas aeruginosa PA01
cugcaucacccgcucguggucc

SEQ ID NO: 167512 - RNA, 22 nt, Pseudomonas aeruginosa PA01
aggcccagcacggugcccaugg

SEQ ID NO: 167513 - RNA, 22 nt, Pseudomonas aeruginosa PA01
gaccugaucguggacgggggcu

SEQ ID NO: 167514 - RNA, 22 nt, Pseudomonas aeruginosa PA01
cgacgacagcgccgaucagccg

SEQ ID NO: 167515 - RNA, 22 nt, Pseudomonas aeruginosa PA01
ccgccagcguauccugauguau

SEQ ID NO: 167516 - RNA, 22 nt, Pseudomonas aeruginosa PA01
ugccggccugacugucugccgg

SEQ ID NO: 167517 - RNA, 22 nt, Pseudomonas aeruginosa PA01
ccgagcggcuggcggauguagu

SEQ ID NO: 167518 - RNA, 22 nt, Pseudomonas aeruginosa PA01
aggucaguggguuugcggucug

SEQ ID NO: 167519 - RNA, 22 nt, Pseudomonas aeruginosa PA01
gugaucgaccaggggcggcugg

SEQ ID NO: 167520 - RNA, 22 nt, Pseudomonas aeruginosa PA01
ggcgccuuucuggccgucggga

SEQ ID NO: 167521 - RNA, 22 nt, Pseudomonas aeruginosa PA01
ggcuucgucaguggucagguug

SEQ ID NO: 167522 - RNA, 22 nt, Pseudomonas aeruginosa PA01
gcgggccuggagaggcaguucg

SEQ ID NO: 167523 - RNA, 22 nt, Pseudomonas aeruginosa PA01
gcucgaucuguuccggcuggua

SEQ ID NO: 167524 - RNA, 22 nt, Pseudomonas aeruginosa PA01
acggacaggcagcgcuucgcag

SEQ ID NO: 167525 - RNA, 22 nt, Pseudomonas aeruginosa PA01
aucggcagguugaggaugucgc

SEQ ID NO: 167526 - RNA, 22 nt, Pseudomonas aeruginosa PA01
gagcgauccuccaguucuuccu

SEQ ID NO: 167527 - RNA, 22 nt, Pseudomonas aeruginosa PA01
gguggcgcuggcuuccuugacc

SEQ ID NO: 167528 - RNA, 22 nt, Pseudomonas aeruginosa PA01
uccggcccggcucuggaaccgu

SEQ ID NO: 167529 - RNA, 22 nt, Pseudomonas aeruginosa PA01
aucggcgaggaucgccagcucg

SEQ ID NO: 167530 - RNA, 20 nt, Pseudomonas aeruginosa PA01
aguaccugaacuccccggag

SEQ ID NO: 167531 - RNA, 22 nt, Pseudomonas aeruginosa PA01
gcgggucagccugcgcuugcca

SEQ ID NO: 167532 - RNA, 22 nt, Pseudomonas aeruginosa PA01
ugcuggugaccuucaggcgcuu

SEQ ID NO: 167533 - RNA, 22 nt, Pseudomonas aeruginosa PA01
agggcgggcugccugccggacg

SEQ ID NO: 167534 - RNA, 22 nt, Pseudomonas aeruginosa PA01
gugcgcuggaagaucgacgacg

SEQ ID NO: 167535 - RNA, 20 nt, Pseudomonas aeruginosa PA01
aagaugucgccggccgguug

SEQ ID NO: 167536 - RNA, 20 nt, Pseudomonas aeruginosa PA01
uggagcaccucggcgaugcc

SEQ ID NO: 167537 - RNA, 22 nt, Pseudomonas aeruginosa PA01
agggcgugaugauccuuaccgg

SEQ ID NO: 167538 - RNA, 22 nt, Pseudomonas aeruginosa PA01
uggccuggaacgccuccagcgg

SEQ ID NO: 167539 - RNA, 22 nt, Pseudomonas aeruginosa PA01
ugaugcggguuccgguagggga

SEQ ID NO: 167540 - RNA, 19 nt, Pseudomonas aeruginosa PA01
uguccgagccauggaugcu

SEQ ID NO: 167541 - RNA, 23 nt, Pseudomonas aeruginosa PA01
gcgcaucgccugcugcaggucga

SEQ ID NO: 167542 - RNA, 20 nt, Pseudomonas aeruginosa PA01
gccggcuggcccgagcgggc

SEQ ID NO: 167543 - RNA, 22 nt, Pseudomonas aeruginosa PA01
uggccacgcaggcccagcggaa

SEQ ID NO: 167544 - RNA, 22 nt, Pseudomonas aeruginosa PA01
ggcaggggagaugaccgauguu

SEQ ID NO: 167545 - RNA, 22 nt, Pseudomonas aeruginosa PA01
uggcuucgaucgccagguucgg

SEQ ID NO: 167546 - RNA, 22 nt, Pseudomonas aeruginosa PA01
ccgcgcagaucccccggcuggc

SEQ ID NO: 167547 - RNA, 22 nt, Pseudomonas aeruginosa PA01
auccgcguggugacguucgacu

SEQ ID NO: 167548 - RNA, 22 nt, Pseudomonas aeruginosa PA01
gcccagggucuuuugcgggugg

SEQ ID NO: 167549 - RNA, 22 nt, Pseudomonas aeruginosa PA01
ugaugcugaucuuguucggcac

SEQ ID NO: 167550 - RNA, 22 nt, Pseudomonas aeruginosa PA01
ccugcagggcaugcaggaaacc

SEQ ID NO: 167551 - RNA, 22 nt, Pseudomonas aeruginosa PA01
ccgggcuuuuucaugucucgga

SEQ ID NO: 167552 - RNA, 23 nt, Pseudomonas aeruginosa PA01
gcgggucgcggaugucgaccacc

SEQ ID NO: 167553 - RNA, 22 nt, Pseudomonas aeruginosa PA01
cgccaccaugaucaagccuucc

SEQ ID NO: 167554 - RNA, 22 nt, Pseudomonas aeruginosa PA01
gaacuguucgucacggacauag

SEQ ID NO: 167555 - RNA, 22 nt, Pseudomonas aeruginosa PA01
gacggccgguugcugcagacgg

SEQ ID NO: 167556 - RNA, 22 nt, Pseudomonas aeruginosa PA01
cccaugacguucgagcgccugu

SEQ ID NO: 167557 - RNA, 22 nt, Pseudomonas aeruginosa PA01
gcugcgcaaguaccuggcgcgu

SEQ ID NO: 167558 - RNA, 22 nt, Pseudomonas aeruginosa PA01
acucggccuggccugcggcgac

SEQ ID NO: 167559 - RNA, 22 nt, Pseudomonas aeruginosa PA01
cguggcaucguugccgacgauc

SEQ ID NO: 167560 - RNA, 19 nt, Pseudomonas aeruginosa PA01
agccgcgccugcuguugcu

SEQ ID NO: 167561 - RNA, 22 nt, Pseudomonas aeruginosa PA01
gacgcugcuggcgccagaggaa

SEQ ID NO: 167562 - RNA, 22 nt, Pseudomonas aeruginosa PA01
agcgcgccaucaggcgguucga

SEQ ID NO: 167563 - RNA, 22 nt, Pseudomonas aeruginosa PA01
cgcgguuaccguugaaguucug

SEQ ID NO: 167564 - RNA, 22 nt, Pseudomonas aeruginosa PA01
gcuucgaacggcuugcggauca

SEQ ID NO: 167565 - RNA, 22 nt, Pseudomonas aeruginosa PA01
aucggugaugcggcggcgcugg

SEQ ID NO: 167566 - RNA, 23 nt, Pseudomonas aeruginosa PA01
ccuggccuugcaggaggucgagc

SEQ ID NO: 167567 - RNA, 22 nt, Pseudomonas aeruginosa PA01
ccgacgcuccucuccgcggccu

SEQ ID NO: 167568 - RNA, 22 nt, Pseudomonas aeruginosa PA01
ucggugaggaucuugugcggau

SEQ ID NO: 167569 - RNA, 22 nt, Pseudomonas aeruginosa PA01
ccggauuuugagucagacuggu

SEQ ID NO: 167570 - RNA, 22 nt, Pseudomonas aeruginosa PA01
cgcgaggugcgagccuucgccg

SEQ ID NO: 167571 - RNA, 22 nt, Pseudomonas aeruginosa PA01
cgacucccgcaaaacagaccgg

SEQ ID NO: 167572 - RNA, 22 nt, Pseudomonas aeruginosa PA01
aaggucgagugcgccuacgagg

SEQ ID NO: 167573 - RNA, 22 nt, Pseudomonas aeruginosa PA01
uugccagcucgauucaucgcag

SEQ ID NO: 167574 - RNA, 18 nt, Pseudomonas aeruginosa PA01
gagcagacccucgaguuc

SEQ ID NO: 167575 - RNA, 22 nt, Pseudomonas aeruginosa PA01
uccugcucggccucgcccgagg

SEQ ID NO: 167576 - RNA, 19 nt, Pseudomonas aeruginosa PA01
guguucgucgcgccccuuc

SEQ ID NO: 167577 - RNA, 22 nt, Pseudomonas aeruginosa PA01
aguucgcugaucugcaguggcg

SEQ ID NO: 167578 - RNA, 22 nt, Pseudomonas aeruginosa PA01
guucgcugccagcgcggccuga

SEQ ID NO: 167579 - RNA, 20 nt, Pseudomonas aeruginosa PA01
ugaagcugcgcaacagcgcc

SEQ ID NO: 167580 - RNA, 18 nt, Pseudomonas aeruginosa PA01
gccagccaggcagaaacc

SEQ ID NO: 167581 - RNA, 21 nt, Pseudomonas aeruginosa PA01
gguucccgagcaguugcugcg

SEQ ID NO: 167582 - RNA, 22 nt, Pseudomonas aeruginosa PA01
acgucggagacaaggcgguggc

SEQ ID NO: 167583 - RNA, 22 nt, Pseudomonas aeruginosa PA01
cgcgcugauccugcucgccgcc

SEQ ID NO: 167584 - RNA, 22 nt, Pseudomonas aeruginosa PA01
ucgaaaauagcuuagucgauug

SEQ ID NO: 167585 - RNA, 22 nt, Pseudomonas aeruginosa PA01
gacgcugcugccguccggcgcc

SEQ ID NO: 167586 - RNA, 22 nt, Pseudomonas aeruginosa PA01
ccucggcagcuucaccggcgcc

SEQ ID NO: 167587 - RNA, 22 nt, Pseudomonas aeruginosa PA01
gcgccccgccaggagccuacgg

SEQ ID NO: 167588 - RNA, 22 nt, Pseudomonas aeruginosa PA01
gaccgucggcgucgaccagggu

SEQ ID NO: 167589 - RNA, 22 nt, Pseudomonas aeruginosa PA01
agccagccggccaguugcuccg

SEQ ID NO: 167590 - RNA, 22 nt, Pseudomonas aeruginosa PA01
acgcgcgcaaccgacggcaggg

SEQ ID NO: 167591 - RNA, 22 nt, Pseudomonas aeruginosa PA01
aggccggaucggaaaagcgucg

SEQ ID NO: 167592 - RNA, 22 nt, Pseudomonas aeruginosa PA01
gugccgcucagggucgcgccgc

SEQ ID NO: 167593 - RNA, 22 nt, Pseudomonas aeruginosa PA01
cugccguuggccagcaccgccg

SEQ ID NO: 167594 - RNA, 23 nt, Pseudomonas aeruginosa PA01
ccggcgacacccucuacgugguc

SEQ ID NO: 167595 - RNA, 22 nt, Pseudomonas aeruginosa PA01
gcguccaguugcgaucggagcg

SEQ ID NO: 167596 - RNA, 22 nt, Pseudomonas aeruginosa PA01
ugccguuggcacaugcucaggc

SEQ ID NO: 167597 - RNA, 22 nt, Pseudomonas aeruginosa PA01
acgcucuccaggcuggccggcg

SEQ ID NO: 167598 - RNA, 22 nt, Pseudomonas aeruginosa PA01
auccauggcauugcugcgccug

SEQ ID NO: 167599 - RNA, 22 nt, Pseudomonas aeruginosa PA01
gcgcaagcucgacgagaacggc

SEQ ID NO: 167600 - RNA, 22 nt, Pseudomonas aeruginosa PA01
ggcacccugcuugcuacgggcu

SEQ ID NO: 167601 - RNA, 22 nt, Pseudomonas aeruginosa PA01
gcgcuggagguguuccgccgcg

SEQ ID NO: 167602 - RNA, 22 nt, Pseudomonas aeruginosa PA01
ccaucaccgccagcuggugcgc

SEQ ID NO: 167603 - RNA, 22 nt, Pseudomonas aeruginosa PA01
aaggccugguagucgaggccca

SEQ ID NO: 167604 - RNA, 22 nt, Pseudomonas aeruginosa PA01
guucuaccucgccacccggacu

SEQ ID NO: 167605 - RNA, 22 nt, Pseudomonas aeruginosa PA01
uacagcaccuguaccgcgagac

SEQ ID NO: 167606 - RNA, 22 nt, Pseudomonas aeruginosa PA01
caucgccgaaggggcgaagaag

SEQ ID NO: 167607 - RNA, 22 nt, Pseudomonas aeruginosa PA01
gccuuccacgcauauccuucag

SEQ ID NO: 167608 - RNA, 21 nt, Pseudomonas aeruginosa PA01
ucggcgacgcugaugguuauc

SEQ ID NO: 167609 - RNA, 22 nt, Pseudomonas aeruginosa PA01
uccggcucgacgccggcgaggu

SEQ ID NO: 167610 - RNA, 22 nt, Pseudomonas aeruginosa PA01
agagcuaucgagucacgcauga

SEQ ID NO: 167611 - RNA, 22 nt, Pseudomonas aeruginosa PA01
uggcacggccgcugcacgggca

SEQ ID NO: 167612 - RNA, 21 nt, Pseudomonas aeruginosa PA01
gcucggcauccuggcgcgcga

SEQ ID NO: 167613 - RNA, 22 nt, Pseudomonas aeruginosa PA01
cgccgcaggcuuggccgccggu

SEQ ID NO: 167614 - RNA, 22 nt, Pseudomonas aeruginosa PA01
uggagacguaguagucgccacu

SEQ ID NO: 167615 - RNA, 22 nt, Pseudomonas aeruginosa PA01
acagcggcuuggucagcaucca

SEQ ID NO: 167616 - RNA, 22 nt, Pseudomonas aeruginosa PA01
cacuggccgcaucgcugaagga

SEQ ID NO: 167617 - RNA, 22 nt, Pseudomonas aeruginosa PA01
gggccgauggcaucgacccgcu

SEQ ID NO: 167618 - RNA, 22 nt, Pseudomonas aeruginosa PA01
ucggccuugagccgacgucgcg

SEQ ID NO: 167619 - RNA, 22 nt, Pseudomonas aeruginosa PA01
gguggaagacucggggcagggu

SEQ ID NO: 167620 - RNA, 22 nt, Pseudomonas aeruginosa PA01
cggcagcgccucgccacgcucc

SEQ ID NO: 167621 - RNA, 22 nt, Pseudomonas aeruginosa PA01
uggcgccaugcagcaguugcga

SEQ ID NO: 167622 - RNA, 22 nt, Pseudomonas aeruginosa PA01
ucugaugggacugcguccgagc

SEQ ID NO: 167623 - RNA, 22 nt, Pseudomonas aeruginosa PA01
guuccaguucggccgcggcugg

SEQ ID NO: 167624 - RNA, 22 nt, Pseudomonas aeruginosa PA01
ucaucgcugccaguggguacgc

SEQ ID NO: 167625 - RNA, 22 nt, Pseudomonas aeruginosa PA01
ggcguucuccacuuccuggcgc

SEQ ID NO: 167626 - RNA, 22 nt, Pseudomonas aeruginosa PA01
uuccacggucagcaccgccggc

SEQ ID NO: 167627 - RNA, 22 nt, Pseudomonas aeruginosa PA01
ucgugguggucauccucggcau

SEQ ID NO: 167628 - RNA, 22 nt, Pseudomonas aeruginosa PA01
cgccaggcgacuccgggcgugc

SEQ ID NO: 167629 - RNA, 22 nt, Pseudomonas aeruginosa PA01
gcgaugcgccggaucggcugac

SEQ ID NO: 167630 - RNA, 22 nt, Pseudomonas aeruginosa PA01
cgcgcuggaacgacgucuaccu

SEQ ID NO: 167631 - RNA, 22 nt, Pseudomonas aeruginosa PA01
gcggcgcuggcccgaaccagca

SEQ ID NO: 167632 - RNA, 22 nt, Pseudomonas aeruginosa PA01
cggccggcgacagcggcuggca

SEQ ID NO: 167633 - RNA, 22 nt, Pseudomonas aeruginosa PA01
caggucgaugcgcgcauugugg

SEQ ID NO: 167634 - RNA, 22 nt, Pseudomonas aeruginosa PA01
ugccccagaggucgcgcgauuc

SEQ ID NO: 167635 - RNA, 22 nt, Pseudomonas aeruginosa PA01
cgucgcggaggauguacuggaa

SEQ ID NO: 167636 - RNA, 22 nt, Pseudomonas aeruginosa PA01
ugcagucgcgcgcugacccgca

SEQ ID NO: 167637 - RNA, 22 nt, Pseudomonas aeruginosa PA01
ggucgggccgaucugcgcgccc

SEQ ID NO: 167638 - RNA, 22 nt, Pseudomonas aeruginosa PA01
aagcgaucggcgcggcugaucg

SEQ ID NO: 167639 - RNA, 22 nt, Pseudomonas aeruginosa PA01
cgucgagaucguccuuguccca

SEQ ID NO: 167640 - RNA, 22 nt, Pseudomonas aeruginosa PA01
ccugcuguugucgcgccagggc

SEQ ID NO: 167641 - RNA, 23 nt, Pseudomonas aeruginosa PA01
cccugcgagccccuuuucgcuuc

SEQ ID NO: 167642 - RNA, 22 nt, Pseudomonas aeruginosa PA01
ugcucgguuucagucugcagcg

SEQ ID NO: 167643 - RNA, 22 nt, Pseudomonas aeruginosa PA01
gcgcuguugcugcucggcuggu

SEQ ID NO: 167644 - RNA, 22 nt, Pseudomonas aeruginosa PA01
gcguguaugauacccgagcuca

SEQ ID NO: 167645 - RNA, 22 nt, Pseudomonas aeruginosa PA01
aagcggacccgcgccagguugc

SEQ ID NO: 167646 - RNA, 22 nt, Pseudomonas aeruginosa PA01
aaggacgguuucgacgccuucc

SEQ ID NO: 167647 - RNA, 22 nt, Pseudomonas aeruginosa PA01
ccucgaucacgcuggauuggcu

SEQ ID NO: 167648 - RNA, 22 nt, Pseudomonas aeruginosa PA01
gugcccugcaucggcgcguuga

SEQ ID NO: 167649 - RNA, 22 nt, Pseudomonas aeruginosa PA01
gcguuaccaggugcgcggcuac

SEQ ID NO: 167650 - RNA, 22 nt, Pseudomonas aeruginosa PA01
gaaugccgaggagccgcugcgc

SEQ ID NO: 167651 - RNA, 22 nt, Pseudomonas aeruginosa PA01
gaucggcgaggagagcggccug

SEQ ID NO: 167652 - RNA, 22 nt, Pseudomonas aeruginosa PA01
ucgaggucagcgauccgcaauu

SEQ ID NO: 167653 - RNA, 22 nt, Pseudomonas aeruginosa PA01
augccggccaccggagccggcg

SEQ ID NO: 167654 - RNA, 22 nt, Pseudomonas aeruginosa PA01
ucagcgacaauuucuuccaggu

SEQ ID NO: 167655 - RNA, 22 nt, Pseudomonas aeruginosa PA01
gggcugugucgcaagcgcgaca

SEQ ID NO: 167656 - RNA, 22 nt, Pseudomonas aeruginosa PA01
cgggguccugcgccuggcugac

SEQ ID NO: 167657 - RNA, 22 nt, Pseudomonas aeruginosa PA01
cgccggacuugaccggauuccg

SEQ ID NO: 167658 - RNA, 22 nt, Pseudomonas aeruginosa PA01
uggcuguugcucgguguggcau

SEQ ID NO: 167659 - RNA, 22 nt, Pseudomonas aeruginosa PA01
ucgagcgcuugcgcugaugcag

SEQ ID NO: 167660 - RNA, 22 nt, Pseudomonas aeruginosa PA01
guguuggggcugucgaaggucg

SEQ ID NO: 167661 - RNA, 22 nt, Pseudomonas aeruginosa PA01
ggcugccgggccggcaagagac

SEQ ID NO: 167662 - RNA, 22 nt, Pseudomonas aeruginosa PA01
guagcguuccgggcagcggcgc

SEQ ID NO: 167663 - RNA, 22 nt, Pseudomonas aeruginosa PA01
caagcuuguccuugaagcgggc

SEQ ID NO: 167664 - RNA, 22 nt, Pseudomonas aeruginosa PA01
ucggggcgaacagcgggcauug

SEQ ID NO: 167665 - RNA, 22 nt, Pseudomonas aeruginosa PA01
aacgccaagcugaccagcaucg

SEQ ID NO: 167666 - RNA, 22 nt, Pseudomonas aeruginosa PA01
agaacuuccgccaggucgucuu

SEQ ID NO: 167667 - RNA, 22 nt, Pseudomonas aeruginosa PA01
ugggcggcgaugaguucggccu

SEQ ID NO: 167668 - RNA, 22 nt, Pseudomonas aeruginosa PA01
cuggaccgacggcccguucggc

SEQ ID NO: 167669 - RNA, 22 nt, Pseudomonas aeruginosa PA01
ugccgaggaacagccaggcgug

SEQ ID NO: 167670 - RNA, 22 nt, Pseudomonas aeruginosa PA01
cugucgcggcuacuggccgaca

SEQ ID NO: 167671 - RNA, 22 nt, Pseudomonas aeruginosa PA01
cugguggucggcgacaucgugc

SEQ ID NO: 167672 - RNA, 20 nt, Pseudomonas aeruginosa PA01
ggccuggggcgacgaugcgc

SEQ ID NO: 167673 - RNA, 22 nt, Pseudomonas aeruginosa PA01
ccgcacgcucgaucagcgccga

SEQ ID NO: 167674 - RNA, 22 nt, Pseudomonas aeruginosa PA01
aggcucagguaauagcugggca

SEQ ID NO: 167675 - RNA, 20 nt, Pseudomonas aeruginosa PA01
ccggccgaagugcucgcggu

SEQ ID NO: 167676 - RNA, 22 nt, Pseudomonas aeruginosa PA01
gccuguucuggagccgccggcg

SEQ ID NO: 167677 - RNA, 22 nt, Pseudomonas aeruginosa PA01
accugaccgccaugcgcuauuc

SEQ ID NO: 167678 - RNA, 22 nt, Pseudomonas aeruginosa PA01
cggcgugcaccaccggaucggu

SEQ ID NO: 167679 - RNA, 22 nt, Pseudomonas aeruginosa PA01
uugggcugguaguaggcuucga

SEQ ID NO: 167680 - RNA, 19 nt, Pseudomonas aeruginosa PA01
ccgguuuuccuucuggcau

SEQ ID NO: 167681 - RNA, 22 nt, Pseudomonas aeruginosa PA01
gaagggcaagguggccaagcug

SEQ ID NO: 167682 - RNA, 22 nt, Pseudomonas aeruginosa PA01
gcgcgcagcgagacgguggugc

SEQ ID NO: 167683 - RNA, 22 nt, Pseudomonas aeruginosa PA01
uugcggcggucguaguggucgg

SEQ ID NO: 167684 - RNA, 22 nt, Pseudomonas aeruginosa PA01
acggcaggcagaggucuguuac

SEQ ID NO: 167685 - RNA, 22 nt, Pseudomonas aeruginosa PA01
ugcguuucuggcacagcggcuu

SEQ ID NO: 167686 - RNA, 22 nt, Pseudomonas aeruginosa PA01
ggucggcgauguugucggcggu

SEQ ID NO: 167687 - RNA, 22 nt, Pseudomonas aeruginosa PA01
gucgaucaaggacguggcugcc

SEQ ID NO: 167688 - RNA, 21 nt, Pseudomonas aeruginosa PA01
cuggucgcacuuccucccccg

SEQ ID NO: 167689 - RNA, 22 nt, Pseudomonas aeruginosa PA01
gguccucggcaaugccgccagu

SEQ ID NO: 167690 - RNA, 22 nt, Pseudomonas aeruginosa PA01
gaccgucucguugcggucgacc

SEQ ID NO: 167691 - RNA, 22 nt, Pseudomonas aeruginosa PA01
acgcuucagcucgcccuggugc

SEQ ID NO: 167692 - RNA, 22 nt, Pseudomonas aeruginosa PA01
ucucgcgauagggcucggcgcg

SEQ ID NO: 167693 - RNA, 22 nt, Pseudomonas aeruginosa PA01
ggccacgcaacuggagguuucc

SEQ ID NO: 167694 - RNA, 22 nt, Pseudomonas aeruginosa PA01
ucuugcgcgaccuugccgcucg

SEQ ID NO: 167695 - RNA, 22 nt, Pseudomonas aeruginosa PA01
cgcggcacaagccuggaucacc

SEQ ID NO: 167696 - RNA, 22 nt, Pseudomonas aeruginosa PA01
ucuggcucgccaccggccgggu

SEQ ID NO: 167697 - RNA, 22 nt, Pseudomonas aeruginosa PA01
acggaacaguucgguggccccg

SEQ ID NO: 167698 - RNA, 22 nt, Pseudomonas aeruginosa PA01
cuggugguggacccgaugagcu

SEQ ID NO: 167699 - RNA, 21 nt, Pseudomonas aeruginosa PA01
cgggugcauguuucagcgagg

SEQ ID NO: 167700 - RNA, 22 nt, Pseudomonas aeruginosa PA01
cgcacccagccccaggcgcgac

SEQ ID NO: 167701 - RNA, 22 nt, Pseudomonas aeruginosa PA01
gucaggccgaagaucgcgccgc

SEQ ID NO: 167702 - RNA, 22 nt, Pseudomonas aeruginosa PA01
ggcgcccugcaucaggcgcgcc

SEQ ID NO: 167703 - RNA, 22 nt, Pseudomonas aeruginosa PA01
agggcgaggucagcguggacgc

SEQ ID NO: 167704 - RNA, 22 nt, Pseudomonas aeruginosa PA01
ugcugguccuggacgaggagcg

SEQ ID NO: 167705 - RNA, 22 nt, Pseudomonas aeruginosa PA01
gucagccucugguccgaggugg

SEQ ID NO: 167706 - RNA, 22 nt, Pseudomonas aeruginosa PA01
gcccggcucgaagagcgugcgc

SEQ ID NO: 167707 - RNA, 22 nt, Pseudomonas aeruginosa PA01
acgcgccugaccgguggcgcgg

SEQ ID NO: 167708 - RNA, 22 nt, Pseudomonas aeruginosa PA01
gagcuggaagcugcgcuggucg

SEQ ID NO: 167709 - RNA, 22 nt, Pseudomonas aeruginosa PA01
gugauggucgagaagcucgagc

SEQ ID NO: 167710 - RNA, 22 nt, Pseudomonas aeruginosa PA01
gccggccguagggaaucgaacg

SEQ ID NO: 167711 - RNA, 22 nt, Pseudomonas aeruginosa PA01
agggccaggucgucgccgagga

SEQ ID NO: 167712 - RNA, 22 nt, Pseudomonas aeruginosa PA01
gcggaucaccgcgauguugcag

SEQ ID NO: 167713 - RNA, 23 nt, Pseudomonas aeruginosa PA01
cgguuuccagauucccagccaua

SEQ ID NO: 167714 - RNA, 21 nt, Pseudomonas aeruginosa PA01
ggucgggccggugaaaccgac

SEQ ID NO: 167715 - RNA, 22 nt, Pseudomonas aeruginosa PA01
cagggccagcaacugauggccg

SEQ ID NO: 167716 - RNA, 22 nt, Pseudomonas aeruginosa PA01
gcuggcguugcaauugccgccg

SEQ ID NO: 167717 - RNA, 22 nt, Pseudomonas aeruginosa PA01
uggucgccggaucggcgcccag

SEQ ID NO: 167718 - RNA, 22 nt, Pseudomonas aeruginosa PA01
accuggcugcucaacucggcga

SEQ ID NO: 167719 - RNA, 22 nt, Pseudomonas aeruginosa PA01
ggcccgcuggggcuggaggaag

SEQ ID NO: 167720 - RNA, 20 nt, Pseudomonas aeruginosa PA01
ccugccgcgcaucuucgauc

SEQ ID NO: 167721 - RNA, 22 nt, Pseudomonas aeruginosa PA01
cccagcgcgaucaacuggaugu

SEQ ID NO: 167722 - RNA, 22 nt, Pseudomonas aeruginosa PA01
ccaguuccagggucagcuggcg

SEQ ID NO: 167723 - RNA, 22 nt, Pseudomonas aeruginosa PA01
gucucuuccaucaccgagcgca

SEQ ID NO: 167724 - RNA, 22 nt, Pseudomonas aeruginosa PA01
cggguacgagugcaguccgcug

SEQ ID NO: 167725 - RNA, 22 nt, Pseudomonas aeruginosa PA01
gacggcgggaugguggugaaca

SEQ ID NO: 167726 - RNA, 22 nt, Pseudomonas aeruginosa PA01
uggucggcuuccucgcuucgga

SEQ ID NO: 167727 - RNA, 22 nt, Pseudomonas aeruginosa PA01
aucgccuuccugaucuuugcuu

SEQ ID NO: 167728 - RNA, 22 nt, Pseudomonas aeruginosa PA01
ugcccgggcccuguacgaaagc

SEQ ID NO: 167729 - RNA, 22 nt, Pseudomonas aeruginosa PA01
uuccuccaguugccggcgcgaa

SEQ ID NO: 167730 - RNA, 22 nt, Pseudomonas aeruginosa PA01
ugcggccgaggucgagguugcg

SEQ ID NO: 167731 - RNA, 21 nt, Pseudomonas aeruginosa PA01
gcgucgaggaaggcgucggca

SEQ ID NO: 167732 - RNA, 22 nt, Pseudomonas aeruginosa PA01
cggcgggaaugauguugcgcuu

SEQ ID NO: 167733 - RNA, 22 nt, Pseudomonas aeruginosa PA01
ucucgcugucaucaacccgugu

SEQ ID NO: 167734 - RNA, 22 nt, Pseudomonas aeruginosa PA01
aucuggugcccuucggcuucca

SEQ ID NO: 167735 - RNA, 22 nt, Pseudomonas aeruginosa PA01
cggguggaagucgcugaccgcc

SEQ ID NO: 167736 - RNA, 22 nt, Pseudomonas aeruginosa PA01
ugccgcuggagcaguugcucgg

SEQ ID NO: 167737 - RNA, 22 nt, Pseudomonas aeruginosa PA01
uugcucggccagcucgggcugc

SEQ ID NO: 167738 - RNA, 22 nt, Pseudomonas aeruginosa PA01
ugcgcaggauccgcgacagcag

SEQ ID NO: 167739 - RNA, 22 nt, Pseudomonas aeruginosa PA01
cgccaaggagggagugagcgac

SEQ ID NO: 167740 - RNA, 22 nt, Pseudomonas aeruginosa PA01
ccgaccagcgccagcgagccag

SEQ ID NO: 167741 - RNA, 22 nt, Pseudomonas aeruginosa PA01
cucgaccgucuccagcaacggc

SEQ ID NO: 167742 - RNA, 22 nt, Pseudomonas aeruginosa PA01
gcggccuucgaccggguacgca

SEQ ID NO: 167743 - RNA, 22 nt, Pseudomonas aeruginosa PA01
cugcggagacugucaggcucau

SEQ ID NO: 167744 - RNA, 22 nt, Pseudomonas aeruginosa PA01
gacaugauccccgccgacaucc

SEQ ID NO: 167745 - RNA, 22 nt, Pseudomonas aeruginosa PA01
aggcgacgaacaucagggccag

SEQ ID NO: 167746 - RNA, 22 nt, Pseudomonas aeruginosa PA01
cgcgcuguuucugcccgccgga

SEQ ID NO: 167747 - RNA, 22 nt, Pseudomonas aeruginosa PA01
ugcgccaggcgcugguggccag

SEQ ID NO: 167748 - RNA, 22 nt, Pseudomonas aeruginosa PA01
ugcuguuccucggccaggucga

SEQ ID NO: 167749 - RNA, 22 nt, Pseudomonas aeruginosa PA01
uucgacgucggcgcccuggcgc

SEQ ID NO: 167750 - RNA, 22 nt, Pseudomonas aeruginosa PA01
cggugaagaagcugaucgcaga

SEQ ID NO: 167751 - RNA, 23 nt, Pseudomonas aeruginosa PA01
uggacgugguggguugcaccuug

SEQ ID NO: 167752 - RNA, 22 nt, Pseudomonas aeruginosa PA01
augcgugcagugggcugcuugu

SEQ ID NO: 167753 - RNA, 22 nt, Pseudomonas aeruginosa PA01
ucgcggcggacgaauggcgcca

SEQ ID NO: 167754 - RNA, 22 nt, Pseudomonas aeruginosa PA01
agcgccacgguggcgccgguga

SEQ ID NO: 167755 - RNA, 22 nt, Pseudomonas aeruginosa PA01
ucucggcgcgcuucgccugccc

SEQ ID NO: 167756 - RNA, 22 nt, Pseudomonas aeruginosa PA01
gcaucgagaugaauugcgccag

SEQ ID NO: 167757 - RNA, 22 nt, Pseudomonas aeruginosa PA01
cucggccuggucgucguagugg

SEQ ID NO: 167758 - RNA, 22 nt, Pseudomonas aeruginosa PA01
cgcugauacccgccagguggcg

SEQ ID NO: 167759 - RNA, 22 nt, Pseudomonas aeruginosa PA01
gccaggccugcucguguuccgg

SEQ ID NO: 167760 - RNA, 22 nt, Pseudomonas aeruginosa PA01
cccggccuucggcgcuucuggc

SEQ ID NO: 167761 - RNA, 22 nt, Pseudomonas aeruginosa PA01
agggccuggcgauguacggcca

SEQ ID NO: 167762 - RNA, 22 nt, Pseudomonas aeruginosa PA01
agccggauucucgccgaccgca

SEQ ID NO: 167763 - RNA, 22 nt, Pseudomonas aeruginosa PA01
ucgacgcccaggggcugcugaa

SEQ ID NO: 167764 - RNA, 22 nt, Pseudomonas aeruginosa PA01
gccagggcacgcucgaccucgc

SEQ ID NO: 167765 - RNA, 22 nt, Pseudomonas aeruginosa PA01
gucgcgcaggcggaacugggug

SEQ ID NO: 167766 - RNA, 22 nt, Pseudomonas aeruginosa PA01
gcuucuaccggaaaagcggcgc

SEQ ID NO: 167767 - RNA, 22 nt, Pseudomonas aeruginosa PA01
cagccguugacccugaucgccg

SEQ ID NO: 167768 - RNA, 22 nt, Pseudomonas aeruginosa PA01
aagcggcgguagccauggcggu

SEQ ID NO: 167769 - RNA, 22 nt, Pseudomonas aeruginosa PA01
gcgcuggccguagcccugguac

SEQ ID NO: 167770 - RNA, 22 nt, Pseudomonas aeruginosa PA01
acugguggaugccggugaucca

SEQ ID NO: 167771 - RNA, 22 nt, Pseudomonas aeruginosa PA01
cgucguggucggcaccgagcuu

SEQ ID NO: 167772 - RNA, 22 nt, Pseudomonas aeruginosa PA01
ggccuugucgucguccuggcug

SEQ ID NO: 167773 - RNA, 22 nt, Pseudomonas aeruginosa PA01
cggggugcuguuccgcaucggc

SEQ ID NO: 167774 - RNA, 23 nt, Pseudomonas aeruginosa PA01
uguggccaauugauggccuugug

SEQ ID NO: 167775 - RNA, 22 nt, Pseudomonas aeruginosa PA01
accuggucguccauggcgaagg

SEQ ID NO: 167776 - RNA, 22 nt, Pseudomonas aeruginosa PA01
ucggcgcgcuggugaucggcug

SEQ ID NO: 167777 - RNA, 22 nt, Pseudomonas aeruginosa PA01
ccgcggugaccgcugucguugu

SEQ ID NO: 167778 - RNA, 22 nt, Pseudomonas aeruginosa PA01
gggcggucggcagcgcucaugu

SEQ ID NO: 167779 - RNA, 22 nt, Pseudomonas aeruginosa PA01
acggcggcagcuugcguugggc

SEQ ID NO: 167780 - RNA, 22 nt, Pseudomonas aeruginosa PA01
ccuuguggucacugccuggagc

SEQ ID NO: 167781 - RNA, 22 nt, Pseudomonas aeruginosa PA01
cucgucggcaaagggaucggaa

SEQ ID NO: 167782 - RNA, 22 nt, Pseudomonas aeruginosa PA01
cgcuggugcgccaggcgcugug

SEQ ID NO: 167783 - RNA, 22 nt, Pseudomonas aeruginosa PA01
gggccagcucuucggcgauggu

SEQ ID NO: 167784 - RNA, 22 nt, Pseudomonas aeruginosa PA01
gacuggcgguagccgcccuccu

SEQ ID NO: 167785 - RNA, 19 nt, Pseudomonas aeruginosa PA01
ugagcagccccaggacgau

SEQ ID NO: 167786 - RNA, 21 nt, Pseudomonas aeruginosa PA01
aucggcugaccguccggcggc

SEQ ID NO: 167787 - RNA, 22 nt, Pseudomonas aeruginosa PA01
cgccgaaggauggcccgagcgc

SEQ ID NO: 167788 - RNA, 22 nt, Pseudomonas aeruginosa PA01
aaggugaugaacgucucgcuga

SEQ ID NO: 167789 - RNA, 22 nt, Pseudomonas aeruginosa PA01
ccgggcagcucgaugcacaucc

SEQ ID NO: 167790 - RNA, 22 nt, Pseudomonas aeruginosa PA01
gaguucgccgugcugcugcccg

SEQ ID NO: 167791 - RNA, 22 nt, Pseudomonas aeruginosa PA01
gcgggcgcgucccgguugcccg

SEQ ID NO: 167792 - RNA, 22 nt, Pseudomonas aeruginosa PA01
cugcguuucguaaagcaagccc

SEQ ID NO: 167793 - RNA, 22 nt, Pseudomonas aeruginosa PA01
caggcugucgggguaguccugg

SEQ ID NO: 167794 - RNA, 22 nt, Pseudomonas aeruginosa PA01
uccagggccaucaccacggcgc

SEQ ID NO: 167795 - RNA, 22 nt, Pseudomonas aeruginosa PA01
cgcgguaucgucggcccgcucg

SEQ ID NO: 167796 - RNA, 22 nt, Pseudomonas aeruginosa PA01
cgcugcggauguucggcgaaug

SEQ ID NO: 167797 - RNA, 22 nt, Pseudomonas aeruginosa PA01
gucgcugcugccgaggcugugc

SEQ ID NO: 167798 - RNA, 22 nt, Pseudomonas aeruginosa PA01
aauagcggcuuuucgaugcgca

SEQ ID NO: 167799 - RNA, 22 nt, Pseudomonas aeruginosa PA01
gagaucuggaagagcgugcuga

SEQ ID NO: 167800 - RNA, 22 nt, Pseudomonas aeruginosa PA01
cgggcgaggguaccgggagcua

SEQ ID NO: 167801 - RNA, 20 nt, Pseudomonas aeruginosa PA01
cucuacaucgccuucggcgc

SEQ ID NO: 167802 - RNA, 22 nt, Pseudomonas aeruginosa PA01
gccugguugcuggcauaguuga

SEQ ID NO: 167803 - RNA, 22 nt, Pseudomonas aeruginosa PA01
aguucgucgacgaccgcgccgg

SEQ ID NO: 167804 - RNA, 22 nt, Pseudomonas aeruginosa PA01
caugcucagcgcccugcgccgc

SEQ ID NO: 167805 - RNA, 18 nt, Pseudomonas aeruginosa PA01
uucgugcugccgccuggc

SEQ ID NO: 167806 - RNA, 22 nt, Pseudomonas aeruginosa PA01
cggcgaccacguugggguucuc

SEQ ID NO: 167807 - RNA, 22 nt, Pseudomonas aeruginosa PA01
uggucagccugacccugggcgg

SEQ ID NO: 167808 - RNA, 22 nt, Pseudomonas aeruginosa PA01
cccgccgccuucgaaggcugua

SEQ ID NO: 167809 - RNA, 22 nt, Pseudomonas aeruginosa PA01
aguugccgccggccuuccgcga

SEQ ID NO: 167810 - RNA, 18 nt, Pseudomonas aeruginosa PA01
cgaccaggcguggcugua

SEQ ID NO: 167811 - RNA, 22 nt, Pseudomonas aeruginosa PA01
ucucgauggccggcuggccgua

SEQ ID NO: 167812 - RNA, 22 nt, Pseudomonas aeruginosa PA01
uggccugauagucgaacagcuu

SEQ ID NO: 167813 - RNA, 21 nt, Pseudomonas aeruginosa PA01
ugcacggcgcugguuucggcg

SEQ ID NO: 167814 - RNA, 22 nt, Pseudomonas aeruginosa PA01
ccgccgccgaccaugaacaucg

SEQ ID NO: 167815 - RNA, 22 nt, Pseudomonas aeruginosa PA01
ggcgaugucgccgggauuggcg

SEQ ID NO: 167816 - RNA, 21 nt, Pseudomonas aeruginosa PA01
agcuucaggccgcguucggcg

SEQ ID NO: 167817 - RNA, 22 nt, Pseudomonas aeruginosa PA01
gaggcgucgcgcaggucgagca

SEQ ID NO: 167818 - RNA, 22 nt, Pseudomonas aeruginosa PA01
caggugcucggcccaguggauc

SEQ ID NO: 167819 - RNA, 22 nt, Pseudomonas aeruginosa PA01
augccgguggcgaggacgaucu

SEQ ID NO: 167820 - RNA, 23 nt, Pseudomonas aeruginosa PA01
ccucggcaccacccucggcccgc

SEQ ID NO: 167821 - RNA, 22 nt, Pseudomonas aeruginosa PA01
cguagcaaucccgguugaucag

SEQ ID NO: 167822 - RNA, 22 nt, Pseudomonas aeruginosa PA01
ugacggccagggccuggagacu

SEQ ID NO: 167823 - RNA, 22 nt, Pseudomonas aeruginosa PA01
uggccguggccggccugggccu

SEQ ID NO: 167824 - RNA, 22 nt, Pseudomonas aeruginosa PA01
guugcucggcaugcgcaucaag

SEQ ID NO: 167825 - RNA, 22 nt, Pseudomonas aeruginosa PA01
ccgcuggugaccggcaucguca

SEQ ID NO: 167826 - RNA, 22 nt, Pseudomonas aeruginosa PA01
guccagcuggaacggcucgccg

SEQ ID NO: 167827 - RNA, 22 nt, Pseudomonas aeruginosa PA01
gcugcuguugcuggugaucauc

SEQ ID NO: 167828 - RNA, 22 nt, Pseudomonas aeruginosa PA01
cugguggugcucggucgcgaca

SEQ ID NO: 167829 - RNA, 22 nt, Pseudomonas aeruginosa PA01
uacggcggcgacacccucuggg

SEQ ID NO: 167830 - RNA, 20 nt, Pseudomonas aeruginosa PA01
cggccucccgugcuugcggc

SEQ ID NO: 167831 - RNA, 22 nt, Pseudomonas aeruginosa PA01
cucgcagcgccaggcacuguug

SEQ ID NO: 167832 - RNA, 22 nt, Pseudomonas aeruginosa PA01
cacgccaggccacguuuugccg

SEQ ID NO: 167833 - RNA, 22 nt, Pseudomonas aeruginosa PA01
gcucgacgaucuccuccaccuc

SEQ ID NO: 167834 - RNA, 22 nt, Pseudomonas aeruginosa PA01
uggccgaguucgcggccgguga

SEQ ID NO: 167835 - RNA, 22 nt, Pseudomonas aeruginosa PA01
acgccuccuccaucuucggcuu

SEQ ID NO: 167836 - RNA, 22 nt, Pseudomonas aeruginosa PA01
cgcgggcacucauguuggccug

SEQ ID NO: 167837 - RNA, 19 nt, Pseudomonas aeruginosa PA01
ccucgcugccguucgagca

SEQ ID NO: 167838 - RNA, 22 nt, Pseudomonas aeruginosa PA01
gggcccgguucgucgggcuuga

SEQ ID NO: 167839 - RNA, 22 nt, Pseudomonas aeruginosa PA01
cgccagggcgccgaucagcucg

SEQ ID NO: 167840 - RNA, 22 nt, Pseudomonas aeruginosa PA01
cggcccaaggucuaccuguucg

SEQ ID NO: 167841 - RNA, 22 nt, Pseudomonas aeruginosa PA01
guuggucggcuggucgccgaag

SEQ ID NO: 167842 - RNA, 22 nt, Pseudomonas aeruginosa PA01
aggaagcccagguucacgcccu

SEQ ID NO: 167843 - RNA, 22 nt, Pseudomonas aeruginosa PA01
cugcugucgcggauccugcgca

SEQ ID NO: 167844 - RNA, 22 nt, Pseudomonas aeruginosa PA01
cuaccgccugcgccaggcaggc

SEQ ID NO: 167845 - RNA, 20 nt, Pseudomonas aeruginosa PA01
cgccggcgucuacugcaugc

SEQ ID NO: 167846 - RNA, 22 nt, Pseudomonas aeruginosa PA01
ccgaccauggagaucgccgaca

SEQ ID NO: 167847 - RNA, 22 nt, Pseudomonas aeruginosa PA01
ugucaugggugacggugaaggu

SEQ ID NO: 167848 - RNA, 22 nt, Pseudomonas aeruginosa PA01
ucguaguccugggccgguugcg

SEQ ID NO: 167849 - RNA, 22 nt, Pseudomonas aeruginosa PA01
gcgcgccuccucgccgcacauc

SEQ ID NO: 167850 - RNA, 22 nt, Pseudomonas aeruginosa PA01
agcgcgcacgcacacccagcuc

SEQ ID NO: 167851 - RNA, 22 nt, Pseudomonas aeruginosa PA01
cggccgccaguuggcuuguggg

SEQ ID NO: 167852 - RNA, 22 nt, Pseudomonas aeruginosa PA01
cgcgaucaguuggcugcuggcc

SEQ ID NO: 167853 - RNA, 22 nt, Pseudomonas aeruginosa PA01
aagcgcuuggguaacagccgag

SEQ ID NO: 167854 - RNA, 22 nt, Pseudomonas aeruginosa PA01
ggcuggucgguagccugcaggc

SEQ ID NO: 167855 - RNA, 22 nt, Pseudomonas aeruginosa PA01
ugccgugcuugaugaugccgcc

SEQ ID NO: 167856 - RNA, 22 nt, Pseudomonas aeruginosa PA01
ggggugauccagcucaccggcg

SEQ ID NO: 167857 - RNA, 22 nt, Pseudomonas aeruginosa PA01
ucggccuggcccaggccaacgu

SEQ ID NO: 167858 - RNA, 22 nt, Pseudomonas aeruginosa PA01
guccacgacgcaaagcgauggu

SEQ ID NO: 167859 - RNA, 22 nt, Pseudomonas aeruginosa PA01
cuugccgcccugagcaacagcc

SEQ ID NO: 167860 - RNA, 22 nt, Pseudomonas aeruginosa PA01
gcaguucgacccgccgcuggac

SEQ ID NO: 167861 - RNA, 22 nt, Pseudomonas aeruginosa PA01
gccucgaaggccugcaggucgg

SEQ ID NO: 167862 - RNA, 22 nt, Pseudomonas aeruginosa PA01
cgggccagaccaggacgucgcc

SEQ ID NO: 167863 - RNA, 22 nt, Pseudomonas aeruginosa PA01
ucucgaggguugaaagggaugc

SEQ ID NO: 167864 - RNA, 22 nt, Pseudomonas aeruginosa PA01
ucaagaccuggaccgcgaugga

SEQ ID NO: 167865 - RNA, 22 nt, Pseudomonas aeruginosa PA01
gcggcauucaggccggcgagcu

SEQ ID NO: 167866 - RNA, 22 nt, Pseudomonas aeruginosa PA01
acugggugaaggaguuggcgau

SEQ ID NO: 167867 - RNA, 21 nt, Pseudomonas aeruginosa PA01
cccggccgagagcgggcagga

SEQ ID NO: 167868 - RNA, 22 nt, Pseudomonas aeruginosa PA01
agcguggccuucuccucggaca

SEQ ID NO: 167869 - RNA, 22 nt, Pseudomonas aeruginosa PA01
agcugugccagcggagcgacga

SEQ ID NO: 167870 - RNA, 22 nt, Pseudomonas aeruginosa PA01
uccaccaccagcaggccggcgg

SEQ ID NO: 167871 - RNA, 22 nt, Pseudomonas aeruginosa PA01
ggcgcugguggucgauccgggc

SEQ ID NO: 167872 - RNA, 20 nt, Pseudomonas aeruginosa PA01
ucaccagauugcgggugacc

SEQ ID NO: 167873 - RNA, 22 nt, Pseudomonas aeruginosa PA01
cgaucggcaccacgaucaucuu

SEQ ID NO: 167874 - RNA, 22 nt, Pseudomonas aeruginosa PA01
gcuaccauuagaacaagggcag

SEQ ID NO: 167875 - RNA, 22 nt, Pseudomonas aeruginosa PA01
cgucgguaucgcccuggcgacc

SEQ ID NO: 167876 - RNA, 22 nt, Pseudomonas aeruginosa PA01
uucagcucguacagccgcaggc

SEQ ID NO: 167877 - RNA, 22 nt, Pseudomonas aeruginosa PA01
ucgaaggccgaggccucgaccu

SEQ ID NO: 167878 - RNA, 22 nt, Pseudomonas aeruginosa PA01
ccgagcggcccagcggauggau

SEQ ID NO: 167879 - RNA, 22 nt, Pseudomonas aeruginosa PA01
gccgaucgccaccgggaucagc

SEQ ID NO: 167880 - RNA, 22 nt, Pseudomonas aeruginosa PA01
cggugccgaaaucguuuccuuc

SEQ ID NO: 167881 - RNA, 22 nt, Pseudomonas aeruginosa PA01
cgcggacgacgaggaagaccac

SEQ ID NO: 167882 - RNA, 22 nt, Pseudomonas aeruginosa PA01
ggugcguucgcccggaagcggu

SEQ ID NO: 167883 - RNA, 22 nt, Pseudomonas aeruginosa PA01
uugccgcgcucaagcgcuggcu

SEQ ID NO: 167884 - RNA, 22 nt, Pseudomonas aeruginosa PA01
ucugccugcuuggcaugaacga

SEQ ID NO: 167885 - RNA, 22 nt, Pseudomonas aeruginosa PA01
gcggugaucgcccacaugaucg

SEQ ID NO: 167886 - RNA, 22 nt, Pseudomonas aeruginosa PA01
gucgcguagcgccaggucggcc

SEQ ID NO: 167887 - RNA, 22 nt, Pseudomonas aeruginosa PA01
ugggcguggaaaaacccagcga

SEQ ID NO: 167888 - RNA, 22 nt, Pseudomonas aeruginosa PA01
ggacugggaaggguuuugcugg

SEQ ID NO: 167889 - RNA, 22 nt, Pseudomonas aeruginosa PA01
cugaccgucgucggggucaacc

SEQ ID NO: 167890 - RNA, 22 nt, Pseudomonas aeruginosa PA01
gccaggacccgggcacuuuccu

SEQ ID NO: 167891 - RNA, 22 nt, Pseudomonas aeruginosa PA01
gccguguagcgagccgaugguu

SEQ ID NO: 167892 - RNA, 22 nt, Pseudomonas aeruginosa PA01
uuucgccagccauggucggucc

SEQ ID NO: 167893 - RNA, 22 nt, Pseudomonas aeruginosa PA01
ggaagcgcuucugguggugggc

SEQ ID NO: 167894 - RNA, 22 nt, Pseudomonas aeruginosa PA01
aucguauccguauugagagagu

SEQ ID NO: 167895 - RNA, 22 nt, Pseudomonas aeruginosa PA01
ccuugaucggauaacgcucgca

SEQ ID NO: 167896 - RNA, 22 nt, Pseudomonas aeruginosa PA01
cgcgcaggucggcgaucccgua

SEQ ID NO: 167897 - RNA, 22 nt, Pseudomonas aeruginosa PA01
aaggucgaggaguggguguacg

SEQ ID NO: 167898 - RNA, 22 nt, Pseudomonas aeruginosa PA01
ggcggucgaggagaucgucaag

SEQ ID NO: 167899 - RNA, 22 nt, Pseudomonas aeruginosa PA01
gccuaugugaagaccggccgca

SEQ ID NO: 167900 - RNA, 22 nt, Pseudomonas aeruginosa PA01
ucgucggcgaacuccgagcgca

SEQ ID NO: 167901 - RNA, 22 nt, Pseudomonas aeruginosa PA01
ggugcuggcaucgcggcgcacg

SEQ ID NO: 167902 - RNA, 22 nt, Pseudomonas aeruginosa PA01
ggcucggaagucgacuaccagg

SEQ ID NO: 167903 - RNA, 22 nt, Pseudomonas aeruginosa PA01
cgcggcuguggcaggacaggca

SEQ ID NO: 167904 - RNA, 20 nt, Pseudomonas aeruginosa PA01
cgcggcacgccguuggcguc

SEQ ID NO: 167905 - RNA, 22 nt, Pseudomonas aeruginosa PA01
uugcccguucggcgacggcagg

SEQ ID NO: 167906 - RNA, 16 nt, Pseudomonas aeruginosa PA01
accccgaggucggcga

SEQ ID NO: 167907 - RNA, 22 nt, Pseudomonas aeruginosa PA01
uugcuggcggcgguccguucgg

SEQ ID NO: 167908 - RNA, 22 nt, Pseudomonas aeruginosa PA01
uggcuuccgccuggcacggccg

SEQ ID NO: 167909 - RNA, 22 nt, Pseudomonas aeruginosa PA01
caccgcgaugccgccggugccc

SEQ ID NO: 167910 - RNA, 22 nt, Pseudomonas aeruginosa PA01
ccgacugcucgaacaugugcca

SEQ ID NO: 167911 - RNA, 22 nt, Pseudomonas aeruginosa PA01
aggucggccagggucagcuggu

SEQ ID NO: 167912 - RNA, 22 nt, Pseudomonas aeruginosa PA01
ccggcgcuucgccggccugugc

SEQ ID NO: 167913 - RNA, 22 nt, Pseudomonas aeruginosa PA01
ccgaccuguuccccgugcagca

SEQ ID NO: 167914 - RNA, 22 nt, Pseudomonas aeruginosa PA01
acgcucauuccaggagaguccc

SEQ ID NO: 167915 - RNA, 22 nt, Pseudomonas aeruginosa PA01
uagaugcaggugggcucggcgg

SEQ ID NO: 167916 - RNA, 22 nt, Pseudomonas aeruginosa PA01
uggccagcucggcgccggcaug

SEQ ID NO: 167917 - RNA, 22 nt, Pseudomonas aeruginosa PA01
gucgagcagagccuggagcagg

SEQ ID NO: 167918 - RNA, 22 nt, Pseudomonas aeruginosa PA01
aggcgcuggaccuggcgcucgg

SEQ ID NO: 167919 - RNA, 22 nt, Pseudomonas aeruginosa PA01
guguuuuccgggccggcggccg

SEQ ID NO: 167920 - RNA, 22 nt, Pseudomonas aeruginosa PA01
ugccgguguuaagaacccugcu

SEQ ID NO: 167921 - RNA, 22 nt, Pseudomonas aeruginosa PA01
ggccgccguagccgcugaucag

SEQ ID NO: 167922 - RNA, 22 nt, Pseudomonas aeruginosa PA01
gcgaccaucagcaguugcuuga

SEQ ID NO: 167923 - RNA, 22 nt, Pseudomonas aeruginosa PA01
gaacagcucgucgcggaagguc

SEQ ID NO: 167924 - RNA, 22 nt, Pseudomonas aeruginosa PA01
ugggcgaaguccuggcagaccc

SEQ ID NO: 167925 - RNA, 19 nt, Pseudomonas aeruginosa PA01
gucacgaaguugacgaugc

SEQ ID NO: 167926 - RNA, 22 nt, Pseudomonas aeruginosa PA01
auggcgccuccucuccuagugg

SEQ ID NO: 167927 - RNA, 22 nt, Pseudomonas aeruginosa PA01
cucggccugauccguacacgcu

SEQ ID NO: 167928 - RNA, 22 nt, Pseudomonas aeruginosa PA01
uggaggguuuccuugaucgccg

SEQ ID NO: 167929 - RNA, 22 nt, Pseudomonas aeruginosa PA01
guggcguucauggugccggugg

SEQ ID NO: 167930 - RNA, 22 nt, Pseudomonas aeruginosa PA01
ggagcgccugugggaucguccc

SEQ ID NO: 167931 - RNA, 22 nt, Pseudomonas aeruginosa PA01
cuggggcgggcuguccgccgga

SEQ ID NO: 167932 - RNA, 22 nt, Pseudomonas aeruginosa PA01
gcggucgccacggcgaaugucc

SEQ ID NO: 167933 - RNA, 22 nt, Pseudomonas aeruginosa PA01
ggcgaguccgcgauccugcugu

SEQ ID NO: 167934 - RNA, 22 nt, Pseudomonas aeruginosa PA01
uugcgccaggucggcggcgacc

SEQ ID NO: 167935 - RNA, 22 nt, Pseudomonas aeruginosa PA01
cggcuccaucacguucaguugc

SEQ ID NO: 167936 - RNA, 22 nt, Pseudomonas aeruginosa PA01
augccgaugcucggggugacga

SEQ ID NO: 167937 - RNA, 22 nt, Pseudomonas aeruginosa PA01
ccggugucuucccaggucuucu

SEQ ID NO: 167938 - RNA, 22 nt, Pseudomonas aeruginosa PA01
caccgcgcccuccaucaccucg

SEQ ID NO: 167939 - RNA, 22 nt, Pseudomonas aeruginosa PA01
cucugguaucgccgccugggcc

SEQ ID NO: 167940 - RNA, 22 nt, Pseudomonas aeruginosa PA01
gcggccuggccuggaucguggc

SEQ ID NO: 167941 - RNA, 22 nt, Pseudomonas aeruginosa PA01
ggcggucgagcaugccaccgug

SEQ ID NO: 167942 - RNA, 22 nt, Pseudomonas aeruginosa PA01
gaugaucaggcggucggcaucg

SEQ ID NO: 167943 - RNA, 22 nt, Pseudomonas aeruginosa PA01
aucucgaaggcguagcgggugc

SEQ ID NO: 167944 - RNA, 22 nt, Pseudomonas aeruginosa PA01
cugaggcgagaaugaaaaaggc

SEQ ID NO: 167945 - RNA, 22 nt, Pseudomonas aeruginosa PA01
ccacguggguugggaugugcca

SEQ ID NO: 167946 - RNA, 22 nt, Pseudomonas aeruginosa PA01
ggcggcgauuucuccgucgagc

SEQ ID NO: 167947 - RNA, 22 nt, Pseudomonas aeruginosa PA01
ugguagcgauccgccgggucac

SEQ ID NO: 167948 - RNA, 22 nt, Pseudomonas aeruginosa PA01
cugaucgucgcgcugaucgagg

SEQ ID NO: 167949 - RNA, 22 nt, Pseudomonas aeruginosa PA01
accaugcagccggcgaucgcgc

SEQ ID NO: 167950 - RNA, 22 nt, Pseudomonas aeruginosa PA01
acugacgcgggaguuugccugc

SEQ ID NO: 167951 - RNA, 22 nt, Pseudomonas aeruginosa PA01
agcgggaugguccgcaguaccu

SEQ ID NO: 167952 - RNA, 22 nt, Pseudomonas aeruginosa PA01
cgcgccagguacuugcgcagcc

SEQ ID NO: 167953 - RNA, 18 nt, Pseudomonas aeruginosa PA01
gcaccacggaagaugaag

SEQ ID NO: 167954 - RNA, 22 nt, Pseudomonas aeruginosa PA01
ugccggccauggccuccacguc

SEQ ID NO: 167955 - RNA, 22 nt, Pseudomonas aeruginosa PA01
ucauggagcgguacugcaugau

SEQ ID NO: 167956 - RNA, 22 nt, Pseudomonas aeruginosa PA01
gccaucgucauccucggugccg

SEQ ID NO: 167957 - RNA, 22 nt, Pseudomonas aeruginosa PA01
uuggccagcagcagcgggccca

SEQ ID NO: 167958 - RNA, 22 nt, Pseudomonas aeruginosa PA01
uuccgggcacgccggucuugac

SEQ ID NO: 167959 - RNA, 23 nt, Pseudomonas aeruginosa PA01
gcugccggcggcgucguugucgu

SEQ ID NO: 167960 - RNA, 22 nt, Pseudomonas aeruginosa PA01
ggccucccggcgcagacgacgc

SEQ ID NO: 167961 - RNA, 22 nt, Pseudomonas aeruginosa PA01
ggcgaacuccuggccuggcugc

SEQ ID NO: 167962 - RNA, 22 nt, Pseudomonas aeruginosa PA01
gccgaucaugaguucgucgggc

SEQ ID NO: 167963 - RNA, 22 nt, Pseudomonas aeruginosa PA01
ugggccugcuucaucagggcau

SEQ ID NO: 167964 - RNA, 22 nt, Pseudomonas aeruginosa PA01
uugcccgugcgcauccugccua

SEQ ID NO: 167965 - RNA, 22 nt, Pseudomonas aeruginosa PA01
ggaucggaaaagugcuggcgag

SEQ ID NO: 167966 - RNA, 22 nt, Pseudomonas aeruginosa PA01
gcucgcgauugccguccagcca

SEQ ID NO: 167967 - RNA, 22 nt, Pseudomonas aeruginosa PA01
gccucguccagggucuugcccu

SEQ ID NO: 167968 - RNA, 22 nt, Pseudomonas aeruginosa PA01
cagguugugcaggugccacuug

SEQ ID NO: 167969 - RNA, 22 nt, Pseudomonas aeruginosa PA01
cgccggagaaaucguguuauga

SEQ ID NO: 167970 - RNA, 22 nt, Pseudomonas aeruginosa PA01
ccugguccaccugggccugacc

SEQ ID NO: 167971 - RNA, 22 nt, Pseudomonas aeruginosa PA01
ucgucgaaguccagggugaucu

SEQ ID NO: 167972 - RNA, 22 nt, Pseudomonas aeruginosa PA01
uacucggcguaggcgccgccgu

SEQ ID NO: 167973 - RNA, 22 nt, Pseudomonas aeruginosa PA01
ggauuucggccuggcuccggua

SEQ ID NO: 167974 - RNA, 22 nt, Pseudomonas aeruginosa PA01
uuggccucgacgccggcgugcg

SEQ ID NO: 167975 - RNA, 22 nt, Pseudomonas aeruginosa PA01
aucgccaucgaccagccgagau

SEQ ID NO: 167976 - RNA, 22 nt, Pseudomonas aeruginosa PA01
auccgcuccacucaacggggcg

SEQ ID NO: 167977 - RNA, 22 nt, Pseudomonas aeruginosa PA01
ugcacgguagccaucgguuucu

SEQ ID NO: 167978 - RNA, 22 nt, Pseudomonas aeruginosa PA01
aucggcggcgaggaccaacugc

SEQ ID NO: 167979 - RNA, 22 nt, Pseudomonas aeruginosa PA01
guugcuggaagaacggccgcug

SEQ ID NO: 167980 - RNA, 22 nt, Pseudomonas aeruginosa PA01
cucgcugaccagcuugcuguug

SEQ ID NO: 167981 - RNA, 22 nt, Pseudomonas aeruginosa PA01
gccaaucgcccuuugcggcgug

SEQ ID NO: 167982 - RNA, 22 nt, Pseudomonas aeruginosa PA01
guguggugccgcgcgguguagc

SEQ ID NO: 167983 - RNA, 22 nt, Pseudomonas aeruginosa PA01
gacgccaucaaccuguuccgcu

SEQ ID NO: 167984 - RNA, 20 nt, Pseudomonas aeruginosa PA01
ugccgaaguggugguucaug

SEQ ID NO: 167985 - RNA, 22 nt, Pseudomonas aeruginosa PA01
ggugcugaucggcuucuacggc

SEQ ID NO: 167986 - RNA, 20 nt, Pseudomonas aeruginosa PA01
cucgccuacgaacaccgcgu

SEQ ID NO: 167987 - RNA, 22 nt, Pseudomonas aeruginosa PA01
ucugcgccagcaucgccagggc

SEQ ID NO: 167988 - RNA, 22 nt, Pseudomonas aeruginosa PA01
ugccgucguagugcucuuccac

SEQ ID NO: 167989 - RNA, 22 nt, Pseudomonas aeruginosa PA01
cgcgaccugccgcugaucgcca

SEQ ID NO: 167990 - RNA, 22 nt, Pseudomonas aeruginosa PA01
ugcacgccgaugcgcuugccgg

SEQ ID NO: 167991 - RNA, 22 nt, Pseudomonas aeruginosa PA01
accucgaucagcgcgacgauca

SEQ ID NO: 167992 - RNA, 22 nt, Pseudomonas aeruginosa PA01
acugucgcgcuggcucggcccg

SEQ ID NO: 167993 - RNA, 22 nt, Pseudomonas aeruginosa PA01
cccgcuccguuggggccgagga

SEQ ID NO: 167994 - RNA, 20 nt, Pseudomonas aeruginosa PA01
cugcauggcgcggccgacga

SEQ ID NO: 167995 - RNA, 22 nt, Pseudomonas aeruginosa PA01
cccacccuggaagcgcugaucg

SEQ ID NO: 167996 - RNA, 22 nt, Pseudomonas aeruginosa PA01
cggucgguguaggugcucuuga

SEQ ID NO: 167997 - RNA, 22 nt, Pseudomonas aeruginosa PA01
gcguucggcaaaggugccuacg

SEQ ID NO: 167998 - RNA, 22 nt, Pseudomonas aeruginosa PA01
uggggccgucgcccacgcgcuu

SEQ ID NO: 167999 - RNA, 22 nt, Pseudomonas aeruginosa PA01
ccggcagccgccugcacaucga

SEQ ID NO: 168000 - RNA, 22 nt, Pseudomonas aeruginosa PA01
gagagcgugucggacaugucuu

SEQ ID NO: 168001 - RNA, 21 nt, Pseudomonas aeruginosa PA01
agggugaagagaugucgcucg

SEQ ID NO: 168002 - RNA, 22 nt, Pseudomonas aeruginosa PA01
cgcugauccucaaguugcgcga

SEQ ID NO: 168003 - RNA, 22 nt, Pseudomonas aeruginosa PA01
gcugcugacccuggcgaucggc

SEQ ID NO: 168004 - RNA, 22 nt, Pseudomonas aeruginosa PA01
gugccgaacagcgccaggcgca

SEQ ID NO: 168005 - RNA, 21 nt, Pseudomonas aeruginosa PA01
ugucggggccgcacgcggcga

SEQ ID NO: 168006 - RNA, 22 nt, Pseudomonas aeruginosa PA01
caucacuucgauguuggucagg

SEQ ID NO: 168007 - RNA, 22 nt, Pseudomonas aeruginosa PA01
ggccgcucugcugcagggccug

SEQ ID NO: 168008 - RNA, 22 nt, Pseudomonas aeruginosa PA01
uggccagccgaaaauucuaugg

SEQ ID NO: 168009 - RNA, 22 nt, Pseudomonas aeruginosa PA01
agaccgaucuucucggcaaagg

SEQ ID NO: 168010 - RNA, 22 nt, Pseudomonas aeruginosa PA01
ugcggcaauggacaugcucggc

SEQ ID NO: 168011 - RNA, 22 nt, Pseudomonas aeruginosa PA01
cgccggaccgcugccacaccua

SEQ ID NO: 168012 - RNA, 22 nt, Pseudomonas aeruginosa PA01
acugcgcgccacggccgaggaa

SEQ ID NO: 168013 - RNA, 22 nt, Pseudomonas aeruginosa PA01
gcuacgccgagcgugccgaaga

SEQ ID NO: 168014 - RNA, 21 nt, Pseudomonas aeruginosa PA01
gcgaagucguggccggcguug

SEQ ID NO: 168015 - RNA, 22 nt, Pseudomonas aeruginosa PA01
gugcccugggccggagcggcgg

SEQ ID NO: 168016 - RNA, 22 nt, Pseudomonas aeruginosa PA01
ggugccgaggaucgacagcccg

SEQ ID NO: 168017 - RNA, 22 nt, Pseudomonas aeruginosa PA01
gggcaacuucaucgccguggau

SEQ ID NO: 168018 - RNA, 22 nt, Pseudomonas aeruginosa PA01
cugcuguugcgcgaggacgugc

SEQ ID NO: 168019 - RNA, 22 nt, Pseudomonas aeruginosa PA01
agggcguuguucggauccuuca

SEQ ID NO: 168020 - RNA, 22 nt, Pseudomonas aeruginosa PA01
gcggacgggccuucuucgccgg

SEQ ID NO: 168021 - RNA, 21 nt, Pseudomonas aeruginosa PA01
agcgccuggcgucgaugccga

SEQ ID NO: 168022 - RNA, 22 nt, Pseudomonas aeruginosa PA01
ggcagccugcccagcacuucua

SEQ ID NO: 168023 - RNA, 22 nt, Pseudomonas aeruginosa PA01
gccgccgugcugggcggcgaug

SEQ ID NO: 168024 - RNA, 22 nt, Pseudomonas aeruginosa PA01
aggcgcuggccuguggcgccca

SEQ ID NO: 168025 - RNA, 21 nt, Pseudomonas aeruginosa PA01
ugccggccgccaggugcagga

SEQ ID NO: 168026 - RNA, 22 nt, Pseudomonas aeruginosa PA01
ggcgagaggcgucgaggucggc

SEQ ID NO: 168027 - RNA, 22 nt, Pseudomonas aeruginosa PA01
ugacccugaugccggucgccgc

SEQ ID NO: 168028 - RNA, 22 nt, Pseudomonas aeruginosa PA01
aguucgucaacgccagcgcgca

SEQ ID NO: 168029 - RNA, 22 nt, Pseudomonas aeruginosa PA01
gaggugacacuucuccagcauu

SEQ ID NO: 168030 - RNA, 22 nt, Pseudomonas aeruginosa PA01
uccgauccagcaggggcgccgg

SEQ ID NO: 168031 - RNA, 22 nt, Pseudomonas aeruginosa PA01
ccgacaaucaccgccagggucg

SEQ ID NO: 168032 - RNA, 22 nt, Pseudomonas aeruginosa PA01
ucgaggagcaggcugcggugag

SEQ ID NO: 168033 - RNA, 22 nt, Pseudomonas aeruginosa PA01
ugagcuaucucgaacaacucca

SEQ ID NO: 168034 - RNA, 22 nt, Pseudomonas aeruginosa PA01
ccagcucgcccaugcgggucau

SEQ ID NO: 168035 - RNA, 22 nt, Pseudomonas aeruginosa PA01
ugguccuggcggagcugcccaa

SEQ ID NO: 168036 - RNA, 22 nt, Pseudomonas aeruginosa PA01
gcacggacucguccuuggcgcc

SEQ ID NO: 168037 - RNA, 22 nt, Pseudomonas aeruginosa PA01
ccuugccgaccacgucgacgcg

SEQ ID NO: 168038 - RNA, 22 nt, Pseudomonas aeruginosa PA01
ggggaucggcuacgaggaggug

SEQ ID NO: 168039 - RNA, 22 nt, Pseudomonas aeruginosa PA01
ccuggcggugcuggagcuggcg

SEQ ID NO: 168040 - RNA, 22 nt, Pseudomonas aeruginosa PA01
cgcccgguccuguccgugacgu

SEQ ID NO: 168041 - RNA, 22 nt, Pseudomonas aeruginosa PA01
cgccagcagcagcgggaacagc

SEQ ID NO: 168042 - RNA, 22 nt, Pseudomonas aeruginosa PA01
aacgcgaagccggaaguggggu

SEQ ID NO: 168043 - RNA, 22 nt, Pseudomonas aeruginosa PA01
uugcuguucugcccgggcugga

SEQ ID NO: 168044 - RNA, 22 nt, Pseudomonas aeruginosa PA01
augaccggagcggccgccaggg

SEQ ID NO: 168045 - RNA, 22 nt, Pseudomonas aeruginosa PA01
gcguucgcggcauguccagcga

SEQ ID NO: 168046 - RNA, 22 nt, Pseudomonas aeruginosa PA01
augccggcgccaacggugccgu

SEQ ID NO: 168047 - RNA, 22 nt, Pseudomonas aeruginosa PA01
cccauuccuugcugucgugccc

SEQ ID NO: 168048 - RNA, 22 nt, Pseudomonas aeruginosa PA01
cggcguccuggucccggugcuc

SEQ ID NO: 168049 - RNA, 22 nt, Pseudomonas aeruginosa PA01
gcaccugaaggccuccggcaac

SEQ ID NO: 168050 - RNA, 22 nt, Pseudomonas aeruginosa PA01
ucaccguucugcucgaggaggc

SEQ ID NO: 168051 - RNA, 21 nt, Pseudomonas aeruginosa PA01
aagcuucucgggcgggccggc

SEQ ID NO: 168052 - RNA, 22 nt, Pseudomonas aeruginosa PA01
cuggcgcuggcuccgucgguga

SEQ ID NO: 168053 - RNA, 22 nt, Pseudomonas aeruginosa PA01
caagcgccugcgcgccuuccug

SEQ ID NO: 168054 - RNA, 22 nt, Pseudomonas aeruginosa PA01
ggggcuggcguugcugccgucg

SEQ ID NO: 168055 - RNA, 22 nt, Pseudomonas aeruginosa PA01
cgccagagcccgguggcgaucc

SEQ ID NO: 168056 - RNA, 22 nt, Pseudomonas aeruginosa PA01
gguugucuguugcugccugaca

SEQ ID NO: 168057 - RNA, 22 nt, Pseudomonas aeruginosa PA01
cggccggccucgaucuccuugg

SEQ ID NO: 168058 - RNA, 18 nt, Pseudomonas aeruginosa PA01
cucgcccugcagucgggu

SEQ ID NO: 168059 - RNA, 22 nt, Pseudomonas aeruginosa PA01
ucgcccggcagaccggcccgac

SEQ ID NO: 168060 - RNA, 22 nt, Pseudomonas aeruginosa PA01
ugcuggucucgguguucgugcc

SEQ ID NO: 168061 - RNA, 22 nt, Pseudomonas aeruginosa PA01
cgcucgccuucgcggaguccgg

SEQ ID NO: 168062 - RNA, 22 nt, Pseudomonas aeruginosa PA01
agggcgggaacugcgcgcgcag

SEQ ID NO: 168063 - RNA, 20 nt, Pseudomonas aeruginosa PA01
aucgggccuccggcucgucc

SEQ ID NO: 168064 - RNA, 22 nt, Pseudomonas aeruginosa PA01
gcggaucgcucucgccggccaa

SEQ ID NO: 168065 - RNA, 22 nt, Pseudomonas aeruginosa PA01
cgagauggaaguucgcgaucug

SEQ ID NO: 168066 - RNA, 22 nt, Pseudomonas aeruginosa PA01
ucugcugggauaccgcgaucuc

SEQ ID NO: 168067 - RNA, 21 nt, Pseudomonas aeruginosa PA01
cgcaguggaaaucaucgaugg

SEQ ID NO: 168068 - RNA, 22 nt, Pseudomonas aeruginosa PA01
gcagccgcgcacugaucgucgg

SEQ ID NO: 168069 - RNA, 22 nt, Pseudomonas aeruginosa PA01
cgccgauuccuuggcccaggua

SEQ ID NO: 168070 - RNA, 22 nt, Pseudomonas aeruginosa PA01
ccaggccgucgacggcgcucug

SEQ ID NO: 168071 - RNA, 22 nt, Pseudomonas aeruginosa PA01
uaccuguugcaggaaggcgaug

SEQ ID NO: 168072 - RNA, 22 nt, Pseudomonas aeruginosa PA01
gcugggugugcugguggucgag

SEQ ID NO: 168073 - RNA, 22 nt, Pseudomonas aeruginosa PA01
ugguggcgaaagcgacgacagc

SEQ ID NO: 168074 - RNA, 22 nt, Pseudomonas aeruginosa PA01
accuggucgggggcgcuggccg

SEQ ID NO: 168075 - RNA, 19 nt, Pseudomonas aeruginosa PA01
gggcuguucgccguugauc

SEQ ID NO: 168076 - RNA, 22 nt, Pseudomonas aeruginosa PA01
gcgcacucaggcaaugcucagc

SEQ ID NO: 168077 - RNA, 22 nt, Pseudomonas aeruginosa PA01
caggcgcggcguuuuccccgag

SEQ ID NO: 168078 - RNA, 22 nt, Pseudomonas aeruginosa PA01
gggcgaggaagccgccggcguc

SEQ ID NO: 168079 - RNA, 22 nt, Pseudomonas aeruginosa PA01
gccgucgcggccgacgacaaag

SEQ ID NO: 168080 - RNA, 22 nt, Pseudomonas aeruginosa PA01
cugguggucggcgccgguucgu

SEQ ID NO: 168081 - RNA, 22 nt, Pseudomonas aeruginosa PA01
uggugcugguggugaaggcgaa

SEQ ID NO: 168082 - RNA, 22 nt, Pseudomonas aeruginosa PA01
aucgcccugcgccuggacgccg

SEQ ID NO: 168083 - RNA, 22 nt, Pseudomonas aeruginosa PA01
agaagugcgaaauagagcgcuu

SEQ ID NO: 168084 - RNA, 22 nt, Pseudomonas aeruginosa PA01
ugucgacccgcgucucuaugug

SEQ ID NO: 168085 - RNA, 22 nt, Pseudomonas aeruginosa PA01
acgcgcugaacgacgaagugcg

SEQ ID NO: 168086 - RNA, 19 nt, Pseudomonas aeruginosa PA01
cuguucgaucugcugaagc

SEQ ID NO: 168087 - RNA, 22 nt, Pseudomonas aeruginosa PA01
uguggcugcgcggaccgcugcc

SEQ ID NO: 168088 - RNA, 22 nt, Pseudomonas aeruginosa PA01
cuggcgcagcaguuccucgccg

SEQ ID NO: 168089 - RNA, 22 nt, Pseudomonas aeruginosa PA01
ugcuccaucagcaugcugcugg

SEQ ID NO: 168090 - RNA, 22 nt, Pseudomonas aeruginosa PA01
uccgccgccuucuccacguaga

SEQ ID NO: 168091 - RNA, 22 nt, Pseudomonas aeruginosa PA01
cugggcguagcuccgacuggcc

SEQ ID NO: 168092 - RNA, 22 nt, Pseudomonas aeruginosa PA01
cgccccgaccgaccuugcgcaa

SEQ ID NO: 168093 - RNA, 22 nt, Pseudomonas aeruginosa PA01
augccuggagcaugcucuaugg

SEQ ID NO: 168094 - RNA, 22 nt, Pseudomonas aeruginosa PA01
cuggcccaggacuaugccgcgc

SEQ ID NO: 168095 - RNA, 22 nt, Pseudomonas aeruginosa PA01
gccguccagcucaucuucucgg

SEQ ID NO: 168096 - RNA, 22 nt, Pseudomonas aeruginosa PA01
cgcggcgaggaacugcugagcg

SEQ ID NO: 168097 - RNA, 22 nt, Pseudomonas aeruginosa PA01
ucgccgcccucggccagcuuuc

SEQ ID NO: 168098 - RNA, 16 nt, Pseudomonas aeruginosa PA01
aucuccgccaccucgc

SEQ ID NO: 168099 - RNA, 22 nt, Pseudomonas aeruginosa PA01
cggugggaagccgacuucgucg

SEQ ID NO: 168100 - RNA, 22 nt, Pseudomonas aeruginosa PA01
gccggugaagcugcaauggacc

SEQ ID NO: 168101 - RNA, 22 nt, Pseudomonas aeruginosa PA01
gucgccgcggggguguagagga

SEQ ID NO: 168102 - RNA, 22 nt, Pseudomonas aeruginosa PA01
gccgaacugaugggcgacgaga

SEQ ID NO: 168103 - RNA, 22 nt, Pseudomonas aeruginosa PA01
ccggugaccgccugcggauagg

SEQ ID NO: 168104 - RNA, 22 nt, Pseudomonas aeruginosa PA01
acgccgcuggcgguauggcugc

SEQ ID NO: 168105 - RNA, 22 nt, Pseudomonas aeruginosa PA01
cucgggauaggugguccaggug

SEQ ID NO: 168106 - RNA, 17 nt, Pseudomonas aeruginosa PA01
gcaggccucgccgccgu

SEQ ID NO: 168107 - RNA, 22 nt, Pseudomonas aeruginosa PA01
ucgcccaguucggccgcggcca

SEQ ID NO: 168108 - RNA, 22 nt, Pseudomonas aeruginosa PA01
ggucggcggcaugcgcgcuucc

SEQ ID NO: 168109 - RNA, 22 nt, Pseudomonas aeruginosa PA01
caggcgaucacgaucggcaccc

SEQ ID NO: 168110 - RNA, 23 nt, Pseudomonas aeruginosa PA01
aucaccucgaccuuggccuugcc

SEQ ID NO: 168111 - RNA, 20 nt, Pseudomonas aeruginosa PA01
cgacggcaaggccggccucg

SEQ ID NO: 168112 - RNA, 22 nt, Pseudomonas aeruginosa PA01
acgcccucgcucgacgagacgg

SEQ ID NO: 168113 - RNA, 22 nt, Pseudomonas aeruginosa PA01
gcgggaggaucgaauugcaggc

SEQ ID NO: 168114 - RNA, 20 nt, Pseudomonas aeruginosa PA01
gcugcccugggacaaggccc

SEQ ID NO: 168115 - RNA, 19 nt, Pseudomonas aeruginosa PA01
ucgcugcaacacgucaagc

SEQ ID NO: 168116 - RNA, 22 nt, Pseudomonas aeruginosa PA01
cgacagagcgugcucgggccgc

SEQ ID NO: 168117 - RNA, 22 nt, Pseudomonas aeruginosa PA01
gucgcgguccaggccgaucagc

SEQ ID NO: 168118 - RNA, 22 nt, Pseudomonas aeruginosa PA01
cuucgccugaccucuucgugga

SEQ ID NO: 168119 - RNA, 22 nt, Pseudomonas aeruginosa PA01
cggggcuggucucgacccuguu

SEQ ID NO: 168120 - RNA, 22 nt, Pseudomonas aeruginosa PA01
uuccagaucaccguggcgcugg

SEQ ID NO: 168121 - RNA, 22 nt, Pseudomonas aeruginosa PA01
cgcgcucggaacccgguuuggc

SEQ ID NO: 168122 - RNA, 22 nt, Pseudomonas aeruginosa PA01
gaugccgccaugccgcagcagg

SEQ ID NO: 168123 - RNA, 22 nt, Pseudomonas aeruginosa PA01
guucuccgccacguccuucggg

SEQ ID NO: 168124 - RNA, 22 nt, Pseudomonas aeruginosa PA01
gucauccagagcgcccggguga

SEQ ID NO: 168125 - RNA, 22 nt, Pseudomonas aeruginosa PA01
ucguugugcagguucggcuggg

SEQ ID NO: 168126 - RNA, 22 nt, Pseudomonas aeruginosa PA01
ugccgccagcaggccggugacc

SEQ ID NO: 168127 - RNA, 22 nt, Pseudomonas aeruginosa PA01
ugucggucaggcuggcgucguc

SEQ ID NO: 168128 - RNA, 22 nt, Pseudomonas aeruginosa PA01
cggugcuggagaugaacuucga

SEQ ID NO: 168129 - RNA, 22 nt, Pseudomonas aeruginosa PA01
auugcggcacacgcaugcaggc

SEQ ID NO: 168130 - RNA, 22 nt, Pseudomonas aeruginosa PA01
cugcgguacgcuuuccgcuucg

SEQ ID NO: 168131 - RNA, 22 nt, Pseudomonas aeruginosa PA01
gugcccgagguccugcuggggg

SEQ ID NO: 168132 - RNA, 22 nt, Pseudomonas aeruginosa PA01
ggccucgguguuggccucgucg

SEQ ID NO: 168133 - RNA, 22 nt, Pseudomonas aeruginosa PA01
gccuggcgggcgccgacgucuu

SEQ ID NO: 168134 - RNA, 22 nt, Pseudomonas aeruginosa PA01
uggacgccagcgacccgcgccu

SEQ ID NO: 168135 - RNA, 22 nt, Pseudomonas aeruginosa PA01
gcagcagcuugccguccggguu

SEQ ID NO: 168136 - RNA, 22 nt, Pseudomonas aeruginosa PA01
cugugccuguuccagggcgugc

SEQ ID NO: 168137 - RNA, 22 nt, Pseudomonas aeruginosa PA01
agcgcgugguucagcagcacau

SEQ ID NO: 168138 - RNA, 22 nt, Pseudomonas aeruginosa PA01
auccggccguugguggugaaca

SEQ ID NO: 168139 - RNA, 22 nt, Pseudomonas aeruginosa PA01
uccgugguacaccgcaucgaag

SEQ ID NO: 168140 - RNA, 22 nt, Pseudomonas aeruginosa PA01
cgcucggcggagaagccggccg

SEQ ID NO: 168141 - RNA, 20 nt, Pseudomonas aeruginosa PA01
accucgguggccaccacggc

SEQ ID NO: 168142 - RNA, 22 nt, Pseudomonas aeruginosa PA01
ugaugcuggucggcggggugcu

SEQ ID NO: 168143 - RNA, 22 nt, Pseudomonas aeruginosa PA01
gcugguggaaaccguagccgcg

SEQ ID NO: 168144 - RNA, 22 nt, Pseudomonas aeruginosa PA01
gcacgucgagcuugguggcgaa

SEQ ID NO: 168145 - RNA, 22 nt, Pseudomonas aeruginosa PA01
gcgcgccucuuccagcagccag

SEQ ID NO: 168146 - RNA, 22 nt, Pseudomonas aeruginosa PA01
cuggccgccagggcgccuccag

SEQ ID NO: 168147 - RNA, 20 nt, Pseudomonas aeruginosa PA01
ugcgcaggucggugggcgug

SEQ ID NO: 168148 - RNA, 22 nt, Pseudomonas aeruginosa PA01
aguuugccgcaauccccggagg

SEQ ID NO: 168149 - RNA, 22 nt, Pseudomonas aeruginosa PA01
cgacuugauccuggucuggccc

SEQ ID NO: 168150 - RNA, 22 nt, Pseudomonas aeruginosa PA01
uggcgcuggaucgccaggccug

SEQ ID NO: 168151 - RNA, 22 nt, Pseudomonas aeruginosa PA01
ggccaggucggcuucaccucgg

SEQ ID NO: 168152 - RNA, 22 nt, Pseudomonas aeruginosa PA01
uucuggcgcagggugcccauca

SEQ ID NO: 168153 - RNA, 22 nt, Pseudomonas aeruginosa PA01
aucgccauucccaguuaccaga

SEQ ID NO: 168154 - RNA, 22 nt, Pseudomonas aeruginosa PA01
caggccgugcagguaggugccc

SEQ ID NO: 168155 - RNA, 22 nt, Pseudomonas aeruginosa PA01
gaguggcaguugaucaugcgcg

SEQ ID NO: 168156 - RNA, 22 nt, Pseudomonas aeruginosa PA01
gagguggagagauagccggcgu

SEQ ID NO: 168157 - RNA, 22 nt, Pseudomonas aeruginosa PA01
gguauugcggaagucgccgagg

SEQ ID NO: 168158 - RNA, 20 nt, Pseudomonas aeruginosa PA01
cuccccgggccauuuccugc

SEQ ID NO: 168159 - RNA, 22 nt, Pseudomonas aeruginosa PA01
gccuucaggcccuggcggaaua

SEQ ID NO: 168160 - RNA, 22 nt, Pseudomonas aeruginosa PA01
aucgcccugucccuggccggca

SEQ ID NO: 168161 - RNA, 19 nt, Pseudomonas aeruginosa PA01
acccgucuggccaggcguu

SEQ ID NO: 168162 - RNA, 22 nt, Pseudomonas aeruginosa PA01
gagcuggaguugcggauuggca

SEQ ID NO: 168163 - RNA, 22 nt, Pseudomonas aeruginosa PA01
gcagcgccaguugcuggacacc

SEQ ID NO: 168164 - RNA, 22 nt, Pseudomonas aeruginosa PA01
cgccguucaagccggaggcgcc

SEQ ID NO: 168165 - RNA, 22 nt, Pseudomonas aeruginosa PA01
gcgaggagccgcuggacugguc

SEQ ID NO: 168166 - RNA, 22 nt, Pseudomonas aeruginosa PA01
ucugcugcugcaacuggucgau

SEQ ID NO: 168167 - RNA, 22 nt, Pseudomonas aeruginosa PA01
gaggugaugaucaggaacagca

SEQ ID NO: 168168 - RNA, 22 nt, Pseudomonas aeruginosa PA01
gccgauccggaucgggcgccuu

SEQ ID NO: 168169 - RNA, 22 nt, Pseudomonas aeruginosa PA01
gcugcgcaucggcaccgaaggc

SEQ ID NO: 168170 - RNA, 22 nt, Pseudomonas aeruginosa PA01
cuggcgccguugcccaguacca

SEQ ID NO: 168171 - RNA, 22 nt, Pseudomonas aeruginosa PA01
gacaaguaucugguuggcgguc

SEQ ID NO: 168172 - RNA, 22 nt, Pseudomonas aeruginosa PA01
aucugccgcgcgcggagagacu

SEQ ID NO: 168173 - RNA, 22 nt, Pseudomonas aeruginosa PA01
cggacugguugagggaauugag

SEQ ID NO: 168174 - RNA, 22 nt, Pseudomonas aeruginosa PA01
uggccgccgguauugccggccg

SEQ ID NO: 168175 - RNA, 22 nt, Pseudomonas aeruginosa PA01
acaggcgcggguacuggugcag

SEQ ID NO: 168176 - RNA, 22 nt, Pseudomonas aeruginosa PA01
uggcuggggucgaccuuguugu

SEQ ID NO: 168177 - RNA, 22 nt, Pseudomonas aeruginosa PA01
gcgaggaccugccgggcgcucu

SEQ ID NO: 168178 - RNA, 22 nt, Pseudomonas aeruginosa PA01
ucgcgccagccuucggcgcugg

SEQ ID NO: 168179 - RNA, 22 nt, Pseudomonas aeruginosa PA01
cuggugcaaggcccacugcucg

SEQ ID NO: 168180 - RNA, 22 nt, Pseudomonas aeruginosa PA01
cucggcgucgagaucgccggcc

SEQ ID NO: 168181 - RNA, 22 nt, Pseudomonas aeruginosa PA01
cuggggaucuuccugaucgucg

SEQ ID NO: 168182 - RNA, 22 nt, Pseudomonas aeruginosa PA01
ucggcaggcagcugauagcucc

SEQ ID NO: 168183 - RNA, 22 nt, Pseudomonas aeruginosa PA01
ugauccaguucaguccggccac

SEQ ID NO: 168184 - RNA, 22 nt, Pseudomonas aeruginosa PA01
aaucgcgcucccagagguggcu

SEQ ID NO: 168185 - RNA, 22 nt, Pseudomonas aeruginosa PA01
ccgguguucgacaggacucgcu

SEQ ID NO: 168186 - RNA, 22 nt, Pseudomonas aeruginosa PA01
gccccgcgggaggacggcugcu

SEQ ID NO: 168187 - RNA, 22 nt, Pseudomonas aeruginosa PA01
gaccaucgacgaagaccgcugc

SEQ ID NO: 168188 - RNA, 22 nt, Pseudomonas aeruginosa PA01
ccggugcuguucgccggcggcg

SEQ ID NO: 168189 - RNA, 22 nt, Pseudomonas aeruginosa PA01
cuugggcugagccucaggccag

SEQ ID NO: 168190 - RNA, 22 nt, Pseudomonas aeruginosa PA01
ugcugacauagucgucggcgcc

SEQ ID NO: 168191 - RNA, 22 nt, Pseudomonas aeruginosa PA01
cgcgcacauaguggaagaaccc

SEQ ID NO: 168192 - RNA, 22 nt, Pseudomonas aeruginosa PA01
agguggagcguugcggcgccgg

SEQ ID NO: 168193 - RNA, 22 nt, Pseudomonas aeruginosa PA01
cgcaaggcuuuucggaaaaauu

SEQ ID NO: 168194 - RNA, 22 nt, Pseudomonas aeruginosa PA01
ccugcuugucgaugucgagggu

SEQ ID NO: 168195 - RNA, 22 nt, Pseudomonas aeruginosa PA01
uccgccacuuccugcucaugag

SEQ ID NO: 168196 - RNA, 22 nt, Pseudomonas aeruginosa PA01
cgcucagcccggugccgaaaua

SEQ ID NO: 168197 - RNA, 23 nt, Pseudomonas aeruginosa PA01
uaagccgggccgcccugcagagc

SEQ ID NO: 168198 - RNA, 22 nt, Pseudomonas aeruginosa PA01
gcuuucaucgccggcggagaaa

SEQ ID NO: 168199 - RNA, 22 nt, Pseudomonas aeruginosa PA01
ccuggugcacggucugcggcuc

SEQ ID NO: 168200 - RNA, 22 nt, Pseudomonas aeruginosa PA01
ucgacgggcauggcgagcugcg

SEQ ID NO: 168201 - RNA, 22 nt, Pseudomonas aeruginosa PA01
ucuccgaggacaucagggcgag

SEQ ID NO: 168202 - RNA, 22 nt, Pseudomonas aeruginosa PA01
ucgcuggagcugcccggcggca

SEQ ID NO: 168203 - RNA, 22 nt, Pseudomonas aeruginosa PA01
gccgggugccagcgaggucuuc

SEQ ID NO: 168204 - RNA, 22 nt, Pseudomonas aeruginosa PA01
agcugcaccauguugagcagcu

SEQ ID NO: 168205 - RNA, 22 nt, Pseudomonas aeruginosa PA01
agcgcgaggccagccagcaacu

SEQ ID NO: 168206 - RNA, 22 nt, Pseudomonas aeruginosa PA01
ggcuggugauguugccggcaag

SEQ ID NO: 168207 - RNA, 22 nt, Pseudomonas aeruginosa PA01
ggccugggccuggaagacguag

SEQ ID NO: 168208 - RNA, 19 nt, Pseudomonas aeruginosa PA01
ucugcaccaccuggccguu

SEQ ID NO: 168209 - RNA, 22 nt, Pseudomonas aeruginosa PA01
gcugaccuguugcucgacgucg

SEQ ID NO: 168210 - RNA, 22 nt, Pseudomonas aeruginosa PA01
ucgcugaggcggcaguggcuga

SEQ ID NO: 168211 - RNA, 22 nt, Pseudomonas aeruginosa PA01
accgcgauggugcccagcgcgg

SEQ ID NO: 168212 - RNA, 22 nt, Pseudomonas aeruginosa PA01
gucggcuuccugaccauggagg

SEQ ID NO: 168213 - RNA, 22 nt, Pseudomonas aeruginosa PA01
ucguccaucguccucaccggga

SEQ ID NO: 168214 - RNA, 22 nt, Pseudomonas aeruginosa PA01
gcaggcgcgccaggugcagcga

SEQ ID NO: 168215 - RNA, 22 nt, Pseudomonas aeruginosa PA01
agcgcauggccagcggguagau

SEQ ID NO: 168216 - RNA, 22 nt, Pseudomonas aeruginosa PA01
ucggcuggacccgcugcgcguc

SEQ ID NO: 168217 - RNA, 22 nt, Pseudomonas aeruginosa PA01
uguccggcgcggccuuguucaa

SEQ ID NO: 168218 - RNA, 22 nt, Pseudomonas aeruginosa PA01
auggcccgugcccaggggguca

SEQ ID NO: 168219 - RNA, 20 nt, Pseudomonas aeruginosa PA01
uuccagcgucucgccgacgc

SEQ ID NO: 168220 - RNA, 20 nt, Pseudomonas aeruginosa PA01
uuuucguagagcgcccggca

SEQ ID NO: 168221 - RNA, 22 nt, Pseudomonas aeruginosa PA01
ucgucagccagcacggcaaucg

SEQ ID NO: 168222 - RNA, 22 nt, Pseudomonas aeruginosa PA01
augggccacuccuacgacggca

SEQ ID NO: 168223 - RNA, 22 nt, Pseudomonas aeruginosa PA01
aucgccugaaggcucauccggg

SEQ ID NO: 168224 - RNA, 22 nt, Pseudomonas aeruginosa PA01
guacucacccuugguguggccc

SEQ ID NO: 168225 - RNA, 22 nt, Pseudomonas aeruginosa PA01
ggcaaguuccaggugcugcgcc

SEQ ID NO: 168226 - RNA, 22 nt, Pseudomonas aeruginosa PA01
aucagcuuggccuugaugguga

SEQ ID NO: 168227 - RNA, 22 nt, Pseudomonas aeruginosa PA01
ugcuaccaucgccgcgaaacac

SEQ ID NO: 168228 - RNA, 22 nt, Pseudomonas aeruginosa PA01
gaggugcugcugguggacggcg

SEQ ID NO: 168229 - RNA, 19 nt, Pseudomonas aeruginosa PA01
ccauccauccgagagagac

SEQ ID NO: 168230 - RNA, 22 nt, Pseudomonas aeruginosa PA01
cgcgagcgcggcugcuccaucc

SEQ ID NO: 168231 - RNA, 22 nt, Pseudomonas aeruginosa PA01
cgcagguugaggaugguggcga

SEQ ID NO: 168232 - RNA, 22 nt, Pseudomonas aeruginosa PA01
ugccgcuggaguacuuguagca

SEQ ID NO: 168233 - RNA, 22 nt, Pseudomonas aeruginosa PA01
ugcaccagcgccugcgcgagga

SEQ ID NO: 168234 - RNA, 22 nt, Pseudomonas aeruginosa PA01
gggaccuugccagcgccagccc

SEQ ID NO: 168235 - RNA, 22 nt, Pseudomonas aeruginosa PA01
aagcgcuugguugagaagaggg

SEQ ID NO: 168236 - RNA, 22 nt, Pseudomonas aeruginosa PA01
guccggcuuguacugguggugg

SEQ ID NO: 168237 - RNA, 22 nt, Pseudomonas aeruginosa PA01
cugugacagggggugaggcuua

SEQ ID NO: 168238 - RNA, 22 nt, Pseudomonas aeruginosa PA01
ggcggcgagcagccggugaucg

SEQ ID NO: 168239 - RNA, 20 nt, Pseudomonas aeruginosa PA01
gcguggacgauggcgugauc

SEQ ID NO: 168240 - RNA, 22 nt, Pseudomonas aeruginosa PA01
ucgggcucggaggcgaucaggu

SEQ ID NO: 168241 - RNA, 22 nt, Pseudomonas aeruginosa PA01
guuccggacgggcucggcgagg

SEQ ID NO: 168242 - RNA, 22 nt, Pseudomonas aeruginosa PA01
aucggccaguucgacgugguca

SEQ ID NO: 168243 - RNA, 22 nt, Pseudomonas aeruginosa PA01
uguucggccggcugcacgccau

SEQ ID NO: 168244 - RNA, 22 nt, Pseudomonas aeruginosa PA01
uccgggugcuuguugcgcaugu

SEQ ID NO: 168245 - RNA, 22 nt, Pseudomonas aeruginosa PA01
ugcagggccuguucgcuggcga

SEQ ID NO: 168246 - RNA, 22 nt, Pseudomonas aeruginosa PA01
ccgggucgaucugcacgucgua

SEQ ID NO: 168247 - RNA, 22 nt, Pseudomonas aeruginosa PA01
uccucucggcccuuggcggguu

SEQ ID NO: 168248 - RNA, 22 nt, Pseudomonas aeruginosa PA01
gccggcuucggugcaguguucc

SEQ ID NO: 168249 - RNA, 22 nt, Pseudomonas aeruginosa PA01
gucuuucguagcgaaccuggcg

SEQ ID NO: 168250 - RNA, 22 nt, Pseudomonas aeruginosa PA01
ucgccucagcaugcaucgcccg

SEQ ID NO: 168251 - RNA, 21 nt, Pseudomonas aeruginosa PA01
ccgcgccuggaccgcgccggg

SEQ ID NO: 168252 - RNA, 22 nt, Pseudomonas aeruginosa PA01
caggaaauggcccggggaggcu

SEQ ID NO: 168253 - RNA, 22 nt, Pseudomonas aeruginosa PA01
aacgccaggcgcuggcuuucgu

SEQ ID NO: 168254 - RNA, 22 nt, Pseudomonas aeruginosa PA01
caccggcggcaucaguuggcug

SEQ ID NO: 168255 - RNA, 22 nt, Pseudomonas aeruginosa PA01
guuauucgcccuacggagcugg

SEQ ID NO: 168256 - RNA, 22 nt, Pseudomonas aeruginosa PA01
ccaccuacaucggccugcgccu

SEQ ID NO: 168257 - RNA, 22 nt, Pseudomonas aeruginosa PA01
uugagcagggcgcgaucguaca

SEQ ID NO: 168258 - RNA, 23 nt, Pseudomonas aeruginosa PA01
gcuggcuggcaagggugcggauc

SEQ ID NO: 168259 - RNA, 22 nt, Pseudomonas aeruginosa PA01
ggcgaguugcguaggucuagga

SEQ ID NO: 168260 - RNA, 22 nt, Pseudomonas aeruginosa PA01
ucaguuuggucaggcuggccgg

SEQ ID NO: 168261 - RNA, 22 nt, Pseudomonas aeruginosa PA01
uccuggcgguucagcgcgauca

SEQ ID NO: 168262 - RNA, 22 nt, Pseudomonas aeruginosa PA01
aaugggcguggauaucggcaug

SEQ ID NO: 168263 - RNA, 22 nt, Pseudomonas aeruginosa PA01
uggcggaagaaggcggcauggu

SEQ ID NO: 168264 - RNA, 20 nt, Pseudomonas aeruginosa PA01
caaaccggugccuggcgugc

SEQ ID NO: 168265 - RNA, 22 nt, Pseudomonas aeruginosa PA01
gcgagaucguccugcguugugg

SEQ ID NO: 168266 - RNA, 23 nt, Pseudomonas aeruginosa PA01
gccaccccauaugccuggcgugc

SEQ ID NO: 168267 - RNA, 22 nt, Pseudomonas aeruginosa PA01
ucggcugaucggcagcaacaag

SEQ ID NO: 168268 - RNA, 22 nt, Pseudomonas aeruginosa PA01
cggccuccgucguuucgucgcc

SEQ ID NO: 168269 - RNA, 22 nt, Pseudomonas aeruginosa PA01
aucuggucgaugaauucgcgga

SEQ ID NO: 168270 - RNA, 22 nt, Pseudomonas aeruginosa PA01
guggcacucgugggcgauggcu

SEQ ID NO: 168271 - RNA, 22 nt, Pseudomonas aeruginosa PA01
gcugucgguggucgggcucggc

SEQ ID NO: 168272 - RNA, 22 nt, Pseudomonas aeruginosa PA01
uggucaccgccgacuggcuguu

SEQ ID NO: 168273 - RNA, 18 nt, Pseudomonas aeruginosa PA01
gcggcgccgggccagcag

SEQ ID NO: 168274 - RNA, 22 nt, Pseudomonas aeruginosa PA01
agccggucguaggcggcgagca

SEQ ID NO: 168275 - RNA, 22 nt, Pseudomonas aeruginosa PA01
ccuacgaggcgcugucggcgcc

SEQ ID NO: 168276 - RNA, 22 nt, Pseudomonas aeruginosa PA01
cccggcgagguccugcaaggcc

SEQ ID NO: 168277 - RNA, 22 nt, Pseudomonas aeruginosa PA01
cugcugugcguggagggggucg

SEQ ID NO: 168278 - RNA, 20 nt, Pseudomonas aeruginosa PA01
uuguucucuuccgcgauggc

SEQ ID NO: 168279 - RNA, 22 nt, Pseudomonas aeruginosa PA01
gcuuuccacauguugcggggac

SEQ ID NO: 168280 - RNA, 21 nt, Pseudomonas aeruginosa PA01
cgccaccaguuguucgugacc

SEQ ID NO: 168281 - RNA, 22 nt, Pseudomonas aeruginosa PA01
ugguggucggcgaucaccaggg

SEQ ID NO: 168282 - RNA, 20 nt, Pseudomonas aeruginosa PA01
ucgacgauguugccggcggc

SEQ ID NO: 168283 - RNA, 23 nt, Pseudomonas aeruginosa PA01
ucgagccgcgccuugacccggaa

SEQ ID NO: 168284 - RNA, 22 nt, Pseudomonas aeruginosa PA01
cggggccacgugccagcaggag

SEQ ID NO: 168285 - RNA, 22 nt, Pseudomonas aeruginosa PA01
cgccaaggaacugggcgucucg

SEQ ID NO: 168286 - RNA, 22 nt, Pseudomonas aeruginosa PA01
cagggcuucaccaucggcgggg

SEQ ID NO: 168287 - RNA, 22 nt, Pseudomonas aeruginosa PA01
gccgaugugcggguucagugcg

SEQ ID NO: 168288 - RNA, 22 nt, Pseudomonas aeruginosa PA01
ugcagucgaccugggcgggcau

SEQ ID NO: 168289 - RNA, 22 nt, Pseudomonas aeruginosa PA01
ccgaccuugccgagcgccggca

SEQ ID NO: 168290 - RNA, 22 nt, Pseudomonas aeruginosa PA01
ugcccggcgacccgcgcggagg

SEQ ID NO: 168291 - RNA, 22 nt, Pseudomonas aeruginosa PA01
guccgggagcgauggcguugac

SEQ ID NO: 168292 - RNA, 22 nt, Pseudomonas aeruginosa PA01
cccggccauguccuccagcgac

SEQ ID NO: 168293 - RNA, 22 nt, Pseudomonas aeruginosa PA01
caccugugccuggucugccucg

SEQ ID NO: 168294 - RNA, 22 nt, Pseudomonas aeruginosa PA01
uggcugccgagggugaugcucu

SEQ ID NO: 168295 - RNA, 22 nt, Pseudomonas aeruginosa PA01
cuugaucagcgccgaguggucc

SEQ ID NO: 168296 - RNA, 22 nt, Pseudomonas aeruginosa PA01
aggcgcaggcuggugucgucgc

SEQ ID NO: 168297 - RNA, 22 nt, Pseudomonas aeruginosa PA01
ggccgcggauugacccagacca

SEQ ID NO: 168298 - RNA, 22 nt, Pseudomonas aeruginosa PA01
cagggcguugucgccggccgag

SEQ ID NO: 168299 - RNA, 22 nt, Pseudomonas aeruginosa PA01
guggcaggccuggcagugcugg

SEQ ID NO: 168300 - RNA, 22 nt, Pseudomonas aeruginosa PA01
gcguggcccgucgcgcgacagg

SEQ ID NO: 168301 - RNA, 22 nt, Pseudomonas aeruginosa PA01
ucgcgcccaugaucgagcugau

SEQ ID NO: 168302 - RNA, 22 nt, Pseudomonas aeruginosa PA01
uccgggccguugcggaacaccg

SEQ ID NO: 168303 - RNA, 22 nt, Pseudomonas aeruginosa PA01
agggcggcgcgccguugcugac

SEQ ID NO: 168304 - RNA, 22 nt, Pseudomonas aeruginosa PA01
ugccgggccaugguguuguuac

SEQ ID NO: 168305 - RNA, 22 nt, Pseudomonas aeruginosa PA01
cgcggccaucgaggcggcccgu

SEQ ID NO: 168306 - RNA, 22 nt, Pseudomonas aeruginosa PA01
cagucgagucgccgccucgaac

SEQ ID NO: 168307 - RNA, 22 nt, Pseudomonas aeruginosa PA01
aacggcgagcaaugaaaaaggc

SEQ ID NO: 168308 - RNA, 22 nt, Pseudomonas aeruginosa PA01
ggccugacccgucgcgcgucga

SEQ ID NO: 168309 - RNA, 22 nt, Pseudomonas aeruginosa PA01
ugcggcuuggugucauucaugc

SEQ ID NO: 168310 - RNA, 20 nt, Pseudomonas aeruginosa PA01
uugucgcgccuguuggcgcc

SEQ ID NO: 168311 - RNA, 22 nt, Pseudomonas aeruginosa PA01
cugguggcgcggcugcaggagu

SEQ ID NO: 168312 - RNA, 22 nt, Pseudomonas aeruginosa PA01
gcgcgguggucuucaggccggc

SEQ ID NO: 168313 - RNA, 22 nt, Pseudomonas aeruginosa PA01
cgcaggaaugucguuggucuca

SEQ ID NO: 168314 - RNA, 22 nt, Pseudomonas aeruginosa PA01
gucggccgcgaccaccaggauc

SEQ ID NO: 168315 - RNA, 22 nt, Pseudomonas aeruginosa PA01
acgcaugguuaacggagaucga

SEQ ID NO: 168316 - RNA, 22 nt, Pseudomonas aeruginosa PA01
ggcugcugauggcuauccaugu

SEQ ID NO: 168317 - RNA, 22 nt, Pseudomonas aeruginosa PA01
aagcggacccgcgccaggcugc

SEQ ID NO: 168318 - RNA, 22 nt, Pseudomonas aeruginosa PA01
ucggcggcguacagguagcggc

SEQ ID NO: 168319 - RNA, 22 nt, Pseudomonas aeruginosa PA01
gguagguggcguugucgcgcug

SEQ ID NO: 168320 - RNA, 22 nt, Pseudomonas aeruginosa PA01
gcuuuuccauggacuguugcgg

SEQ ID NO: 168321 - RNA, 22 nt, Pseudomonas aeruginosa PA01
uuucgccguggauuaacaggau

SEQ ID NO: 168322 - RNA, 22 nt, Pseudomonas aeruginosa PA01
aucgcgauggugguggccgggc

SEQ ID NO: 168323 - RNA, 22 nt, Pseudomonas aeruginosa PA01
ggauaaccgcgagcgguuauuc

SEQ ID NO: 168324 - RNA, 22 nt, Pseudomonas aeruginosa PA01
cauucgcaccucgugcucgacg

SEQ ID NO: 168325 - RNA, 22 nt, Pseudomonas aeruginosa PA01
caggcggcaacuccagcuuccu

SEQ ID NO: 168326 - RNA, 22 nt, Pseudomonas aeruginosa PA01
ccauggccugggucggcgacgc

SEQ ID NO: 168327 - RNA, 22 nt, Pseudomonas aeruginosa PA01
cggcuucuucgacuacgugcuc

SEQ ID NO: 168328 - RNA, 23 nt, Pseudomonas aeruginosa PA01
ugcuggucgaauaccgcgcccgc

SEQ ID NO: 168329 - RNA, 22 nt, Pseudomonas aeruginosa PA01
cuggccuuccagcgugccgccu

SEQ ID NO: 168330 - RNA, 22 nt, Pseudomonas aeruginosa PA01
cagcgagggucgguccgaaggu

SEQ ID NO: 168331 - RNA, 22 nt, Pseudomonas aeruginosa PA01
aggcggugcgccuggcgcuguu

SEQ ID NO: 168332 - RNA, 22 nt, Pseudomonas aeruginosa PA01
cuucggcggccgggugcucggc

SEQ ID NO: 168333 - RNA, 20 nt, Pseudomonas aeruginosa PA01
ccggcgucgaaguucggcag

SEQ ID NO: 168334 - RNA, 22 nt, Pseudomonas aeruginosa PA01
ccggccagcaccugcgggucgu

SEQ ID NO: 168335 - RNA, 22 nt, Pseudomonas aeruginosa PA01
cuucggccaccgacagccucag

SEQ ID NO: 168336 - RNA, 22 nt, Pseudomonas aeruginosa PA01
ucaccggcggcuggaacgggcu

SEQ ID NO: 168337 - RNA, 22 nt, Pseudomonas aeruginosa PA01
gcuugaucaugucggggaacac

SEQ ID NO: 168338 - RNA, 22 nt, Pseudomonas aeruginosa PA01
cugggagggcucgagccuggag

SEQ ID NO: 168339 - RNA, 22 nt, Pseudomonas aeruginosa PA01
acaccgugcgccagcugcucaa

SEQ ID NO: 168340 - RNA, 22 nt, Pseudomonas aeruginosa PA01
cagcgccuggucggcccacugg

SEQ ID NO: 168341 - RNA, 22 nt, Pseudomonas aeruginosa PA01
aggaaggucucuugcggcuugc

SEQ ID NO: 168342 - RNA, 22 nt, Pseudomonas aeruginosa PA01
ucgucgacgcuccagccgagcu

SEQ ID NO: 168343 - RNA, 22 nt, Pseudomonas aeruginosa PA01
cgcccggcuccugcgcuugacc

SEQ ID NO: 168344 - RNA, 22 nt, Pseudomonas aeruginosa PA01
ggguccgaggagguguugcugg

SEQ ID NO: 168345 - RNA, 22 nt, Pseudomonas aeruginosa PA01
ggaugccacccucguucaggca

SEQ ID NO: 168346 - RNA, 22 nt, Pseudomonas aeruginosa PA01
ugcagguggugcgcuucuucga

SEQ ID NO: 168347 - RNA, 23 nt, Pseudomonas aeruginosa PA01
cagcuggcccucgacgucgaccu

SEQ ID NO: 168348 - RNA, 22 nt, Pseudomonas aeruginosa PA01
aggcgcugcgcauccagcggcc

SEQ ID NO: 168349 - RNA, 22 nt, Pseudomonas aeruginosa PA01
ugcgggccgacguggugguggu

SEQ ID NO: 168350 - RNA, 22 nt, Pseudomonas aeruginosa PA01
ggccauccaucucgacggacug

SEQ ID NO: 168351 - RNA, 22 nt, Pseudomonas aeruginosa PA01
ggcgacaucgccauuggcggug

SEQ ID NO: 168352 - RNA, 22 nt, Pseudomonas aeruginosa PA01
augggcgauaacgccguuguuc

SEQ ID NO: 168353 - RNA, 22 nt, Pseudomonas aeruginosa PA01
ccaggcggauguucagcggccg

SEQ ID NO: 168354 - RNA, 22 nt, Pseudomonas aeruginosa PA01
ugguccuguucgcccugacccu

SEQ ID NO: 168355 - RNA, 22 nt, Pseudomonas aeruginosa PA01
gcagcgaguagccgauccccgg

SEQ ID NO: 168356 - RNA, 22 nt, Pseudomonas aeruginosa PA01
gcgaaccuggaucucguccucg

SEQ ID NO: 168357 - RNA, 22 nt, Pseudomonas aeruginosa PA01
uacccggccugccuugccgucg

SEQ ID NO: 168358 - RNA, 22 nt, Pseudomonas aeruginosa PA01
agcuuggucagcaggcgcucga

SEQ ID NO: 168359 - RNA, 22 nt, Pseudomonas aeruginosa PA01
ccagccgcgaccugacccuggg

SEQ ID NO: 168360 - RNA, 22 nt, Pseudomonas aeruginosa PA01
ggucgcuccuuccaccagcgug

SEQ ID NO: 168361 - RNA, 22 nt, Pseudomonas aeruginosa PA01
uaugcuggaacugcaggguguc

SEQ ID NO: 168362 - RNA, 22 nt, Pseudomonas aeruginosa PA01
gcgaccagccuucgcgcuugcc

SEQ ID NO: 168363 - RNA, 22 nt, Pseudomonas aeruginosa PA01
agaucagcggccgcuggcugcc

SEQ ID NO: 168364 - RNA, 22 nt, Pseudomonas aeruginosa PA01
ucuggcacucgccggccuugag

SEQ ID NO: 168365 - RNA, 22 nt, Pseudomonas aeruginosa PA01
ucucgcccuucaccggcucggc

SEQ ID NO: 168366 - RNA, 22 nt, Pseudomonas aeruginosa PA01
ccugaacggacguaucaccacg

SEQ ID NO: 168367 - RNA, 23 nt, Pseudomonas aeruginosa PA01
gccgccuucgucggcgaugcccu

SEQ ID NO: 168368 - RNA, 22 nt, Pseudomonas aeruginosa PA01
ccgagcaggaagccuugcagcg

SEQ ID NO: 168369 - RNA, 22 nt, Pseudomonas aeruginosa PA01
guggcggggcggacgcgcugag

SEQ ID NO: 168370 - RNA, 22 nt, Pseudomonas aeruginosa PA01
ugccaucgaucaggcgcaucgc

SEQ ID NO: 168371 - RNA, 22 nt, Pseudomonas aeruginosa PA01
gaccgugcccagcgaggaggcg

SEQ ID NO: 168372 - RNA, 23 nt, Pseudomonas aeruginosa PA01
ccaggcagcuguucuucaggcug

SEQ ID NO: 168373 - RNA, 22 nt, Pseudomonas aeruginosa PA01
ggacggaccgucggccaggaug

SEQ ID NO: 168374 - RNA, 22 nt, Pseudomonas aeruginosa PA01
cgguguagcccucuacgaucac

SEQ ID NO: 168375 - RNA, 22 nt, Pseudomonas aeruginosa PA01
ccucgaaggccagcgcggcgcu

SEQ ID NO: 168376 - RNA, 22 nt, Pseudomonas aeruginosa PA01
gcugagcauugccugagggcac

SEQ ID NO: 168377 - RNA, 22 nt, Pseudomonas aeruginosa PA01
cgaagcgcugguucagggaggc

SEQ ID NO: 168378 - RNA, 22 nt, Pseudomonas aeruginosa PA01
uacaugaucaggccgcaaccga

SEQ ID NO: 168379 - RNA, 22 nt, Pseudomonas aeruginosa PA01
ggugaaggacgccagcaccgcc

SEQ ID NO: 168380 - RNA, 22 nt, Pseudomonas aeruginosa PA01
agccggcugugaccgagauucu

SEQ ID NO: 168381 - RNA, 22 nt, Pseudomonas aeruginosa PA01
cggucgguacgcucuggcgcug

SEQ ID NO: 168382 - RNA, 22 nt, Pseudomonas aeruginosa PA01
cgacggugaaaccggguuugcg

SEQ ID NO: 168383 - RNA, 22 nt, Pseudomonas aeruginosa PA01
gcucgcggucgcccuggccauu

SEQ ID NO: 168384 - RNA, 22 nt, Pseudomonas aeruginosa PA01
gucggcguaaagcgcuuuggcu

SEQ ID NO: 168385 - RNA, 22 nt, Pseudomonas aeruginosa PA01
aaggcagcuucuccggcucgau

SEQ ID NO: 168386 - RNA, 22 nt, Pseudomonas aeruginosa PA01
augcccgaggugaagccggaca

SEQ ID NO: 168387 - RNA, 22 nt, Pseudomonas aeruginosa PA01
ucccgccggugaccaguuacgu

SEQ ID NO: 168388 - RNA, 22 nt, Pseudomonas aeruginosa PA01
uggccgaugcgcgguucgucuu

SEQ ID NO: 168389 - RNA, 22 nt, Pseudomonas aeruginosa PA01
ggugccgacaucagcgucgcca

SEQ ID NO: 168390 - RNA, 22 nt, Pseudomonas aeruginosa PA01
uuccaccgccauugccaucgcc

SEQ ID NO: 168391 - RNA, 22 nt, Pseudomonas aeruginosa PA01
ucaggcguugcgcgauggucgc

SEQ ID NO: 168392 - RNA, 22 nt, Pseudomonas aeruginosa PA01
cgccggccgccgaggucgccaa

SEQ ID NO: 168393 - RNA, 22 nt, Pseudomonas aeruginosa PA01
ugccaucgaccuugccggcgcu

SEQ ID NO: 168394 - RNA, 22 nt, Pseudomonas aeruginosa PA01
gcuucuucgccacccuggugca

SEQ ID NO: 168395 - RNA, 22 nt, Pseudomonas aeruginosa PA01
auggccugcugcugcgccuccc

SEQ ID NO: 168396 - RNA, 22 nt, Pseudomonas aeruginosa PA01
gcggggcgcucugcaacuugca

SEQ ID NO: 168397 - RNA, 22 nt, Pseudomonas aeruginosa PA01
gcccgcccucggcgacguagcu

SEQ ID NO: 168398 - RNA, 22 nt, Pseudomonas aeruginosa PA01
gguccugagccaggcgggcgua

SEQ ID NO: 168399 - RNA, 22 nt, Pseudomonas aeruginosa PA01
accuuggcgcgacugucgagca

SEQ ID NO: 168400 - RNA, 22 nt, Pseudomonas aeruginosa PA01
gcgauucugcagcgccuuuucc

SEQ ID NO: 168401 - RNA, 22 nt, Pseudomonas aeruginosa PA01
uggcugauuugaucgaugucag

SEQ ID NO: 168402 - RNA, 22 nt, Pseudomonas aeruginosa PA01
ugacugaaggcggcauauucga

SEQ ID NO: 168403 - RNA, 23 nt, Pseudomonas aeruginosa PA01
cgcgcuccagcaggucggccaug

SEQ ID NO: 168404 - RNA, 22 nt, Pseudomonas aeruginosa PA01
cgcugcugagcaaccgcuggcc

SEQ ID NO: 168405 - RNA, 22 nt, Pseudomonas aeruginosa PA01
caguugcuugaccugggccagc

SEQ ID NO: 168406 - RNA, 22 nt, Pseudomonas aeruginosa PA01
gaggcgggaguauccggauggc

SEQ ID NO: 168407 - RNA, 22 nt, Pseudomonas aeruginosa PA01
gucgcgcugcgaggccagcgag

SEQ ID NO: 168408 - RNA, 22 nt, Pseudomonas aeruginosa PA01
ucugcaccgccuguacgcccgc

SEQ ID NO: 168409 - RNA, 22 nt, Pseudomonas aeruginosa PA01
acgccgaccucgaucaccgugg

SEQ ID NO: 168410 - RNA, 22 nt, Pseudomonas aeruginosa PA01
cgcagcaggcgguacucggcgc

SEQ ID NO: 168411 - RNA, 22 nt, Pseudomonas aeruginosa PA01
ugccgaccaucguggugguggu

SEQ ID NO: 168412 - RNA, 22 nt, Pseudomonas aeruginosa PA01
ccaggccgccagccguucggcc

SEQ ID NO: 168413 - RNA, 22 nt, Pseudomonas aeruginosa PA01
accggcagaccaucggcggcua

SEQ ID NO: 168414 - RNA, 22 nt, Pseudomonas aeruginosa PA01
ugcagcaugaucuuggcguccc

SEQ ID NO: 168415 - RNA, 18 nt, Pseudomonas aeruginosa PA01
ucagcgugaccgucuacc

SEQ ID NO: 168416 - RNA, 22 nt, Pseudomonas aeruginosa PA01
ggcgucgaguucggucagguug

SEQ ID NO: 168417 - RNA, 22 nt, Pseudomonas aeruginosa PA01
guggcuggaggacgaggagcug

SEQ ID NO: 168418 - RNA, 22 nt, Pseudomonas aeruginosa PA01
gagcgcgaguuccaggcacugg

SEQ ID NO: 168419 - RNA, 22 nt, Pseudomonas aeruginosa PA01
caagccuggggauaacgucagc

SEQ ID NO: 168420 - RNA, 22 nt, Pseudomonas aeruginosa PA01
agagccaucgucgcugccgccc

SEQ ID NO: 168421 - RNA, 22 nt, Pseudomonas aeruginosa PA01
uucucgggcuggugaccaaccu

SEQ ID NO: 168422 - RNA, 22 nt, Pseudomonas aeruginosa PA01
cuggccgaccucaacgccgccc

SEQ ID NO: 168423 - RNA, 22 nt, Pseudomonas aeruginosa PA01
gacagcagcagcaucaucugcu

SEQ ID NO: 168424 - RNA, 20 nt, Pseudomonas aeruginosa PA01
cgcgccuccagugcuccagg

SEQ ID NO: 168425 - RNA, 23 nt, Pseudomonas aeruginosa PA01
uggcguccgucuaggccuuccag

SEQ ID NO: 168426 - RNA, 22 nt, Pseudomonas aeruginosa PA01
gcgcgcuggcagaccagcuucu

SEQ ID NO: 168427 - RNA, 20 nt, Pseudomonas aeruginosa PA01
ucaggccgucgaugccgggc

SEQ ID NO: 168428 - RNA, 22 nt, Pseudomonas aeruginosa PA01
gcaggucgagcaguaccgcgcu

SEQ ID NO: 168429 - RNA, 22 nt, Pseudomonas aeruginosa PA01
acuggcccuggcuacgcgccug

SEQ ID NO: 168430 - RNA, 20 nt, Pseudomonas aeruginosa PA01
uggcggcugaucuucggcug

SEQ ID NO: 168431 - RNA, 22 nt, Pseudomonas aeruginosa PA01
cccaggucggugccgcagugcg

SEQ ID NO: 168432 - RNA, 22 nt, Pseudomonas aeruginosa PA01
gccugcaacacgugccgcugag

SEQ ID NO: 168433 - RNA, 20 nt, Pseudomonas aeruginosa PA01
cgaaggaaaaagaagggcgc

SEQ ID NO: 168434 - RNA, 22 nt, Pseudomonas aeruginosa PA01
gcagucuucagcaugccgcguc

SEQ ID NO: 168435 - RNA, 22 nt, Pseudomonas aeruginosa PA01
cgacagcgccuucgagcgcggg

SEQ ID NO: 168436 - RNA, 22 nt, Pseudomonas aeruginosa PA01
caccaucuuccucgccgggccg

SEQ ID NO: 168437 - RNA, 22 nt, Pseudomonas aeruginosa PA01
agcgaggcgucuggcacggcga

SEQ ID NO: 168438 - RNA, 22 nt, Pseudomonas aeruginosa PA01
ccaugcucuuguguugcagcga

SEQ ID NO: 168439 - RNA, 22 nt, Pseudomonas aeruginosa PA01
ugcgggugccgccgucggccug

SEQ ID NO: 168440 - RNA, 19 nt, Pseudomonas aeruginosa PA01
ggucgcgccgaacaccgcg

SEQ ID NO: 168441 - RNA, 22 nt, Pseudomonas aeruginosa PA01
gccgauccugcgcggcacccug

SEQ ID NO: 168442 - RNA, 22 nt, Pseudomonas aeruginosa PA01
uggcuggcguagugcaccaggg

SEQ ID NO: 168443 - RNA, 22 nt, Pseudomonas aeruginosa PA01
uucggccgggccuccgcggcga

SEQ ID NO: 168444 - RNA, 22 nt, Pseudomonas aeruginosa PA01
gcgccgacaucguuacccucgg

SEQ ID NO: 168445 - RNA, 20 nt, Pseudomonas aeruginosa PA01
uaucgccguugcugccgagc

SEQ ID NO: 168446 - RNA, 22 nt, Pseudomonas aeruginosa PA01
gcgcggguuccgcaaggugaug

SEQ ID NO: 168447 - RNA, 22 nt, Pseudomonas aeruginosa PA01
guggaaguggacggguacugcu

SEQ ID NO: 168448 - RNA, 22 nt, Pseudomonas aeruginosa PA01
aucggugccggaguugugcucg

SEQ ID NO: 168449 - RNA, 22 nt, Pseudomonas aeruginosa PA01
cgaagagcccgaacgcuuccgg

SEQ ID NO: 168450 - RNA, 22 nt, Pseudomonas aeruginosa PA01
acgcgcuaccuaaccugaccgg

SEQ ID NO: 168451 - RNA, 22 nt, Pseudomonas aeruginosa PA01
cucggcuggacccucuggcagc

SEQ ID NO: 168452 - RNA, 22 nt, Pseudomonas aeruginosa PA01
ugcggcgaaccugcucggccaa

SEQ ID NO: 168453 - RNA, 22 nt, Pseudomonas aeruginosa PA01
ugggcagaaugcuaucgaugcu

SEQ ID NO: 168454 - RNA, 22 nt, Pseudomonas aeruginosa PA01
gcaguugucauagcggcaguau

SEQ ID NO: 168455 - RNA, 22 nt, Pseudomonas aeruginosa PA01
cguaacgcuggaucaguugcuc

SEQ ID NO: 168456 - RNA, 22 nt, Pseudomonas aeruginosa PA01
ucgccgagcaggcgcagcuugu

SEQ ID NO: 168457 - RNA, 22 nt, Pseudomonas aeruginosa PA01
ugcgcugguggucgagcagcac

SEQ ID NO: 168458 - RNA, 20 nt, Pseudomonas aeruginosa PA01
gugaccagcauucgccugcc

SEQ ID NO: 168459 - RNA, 22 nt, Pseudomonas aeruginosa PA01
ccgauugccguaggcgaccagg

SEQ ID NO: 168460 - RNA, 22 nt, Pseudomonas aeruginosa PA01
agguguggcugccuucgccgcc

SEQ ID NO: 168461 - RNA, 22 nt, Pseudomonas aeruginosa PA01
guggccgaggugaucgcuuccg

SEQ ID NO: 168462 - RNA, 22 nt, Pseudomonas aeruginosa PA01
ugcguggucaacuggucggcgc

SEQ ID NO: 168463 - RNA, 22 nt, Pseudomonas aeruginosa PA01
cggccucuggcuggaccccagc

SEQ ID NO: 168464 - RNA, 22 nt, Pseudomonas aeruginosa PA01
gguggucaucaguacuggccgc

SEQ ID NO: 168465 - RNA, 22 nt, Pseudomonas aeruginosa PA01
cggcacccuggcgcgcagcagc

SEQ ID NO: 168466 - RNA, 22 nt, Pseudomonas aeruginosa PA01
uuggcggcgccaucucccuguu

SEQ ID NO: 168467 - RNA, 21 nt, Pseudomonas aeruginosa PA01
cugaccggccgggucggcggc

SEQ ID NO: 168468 - RNA, 22 nt, Pseudomonas aeruginosa PA01
gcggccuaccgcaaguuguggg

SEQ ID NO: 168469 - RNA, 22 nt, Pseudomonas aeruginosa PA01
ugugaacuaucgcccguacgaa

SEQ ID NO: 168470 - RNA, 22 nt, Pseudomonas aeruginosa PA01
ccucuccggcgacgaggccaag

SEQ ID NO: 168471 - RNA, 22 nt, Pseudomonas aeruginosa PA01
cugguucagccugaugcgccug

SEQ ID NO: 168472 - RNA, 22 nt, Pseudomonas aeruginosa PA01
aggcuguagcgaugggcgcgcg

SEQ ID NO: 168473 - RNA, 22 nt, Pseudomonas aeruginosa PA01
gcgcagggucuugaacagcggu

SEQ ID NO: 168474 - RNA, 22 nt, Pseudomonas aeruginosa PA01
aucccgaccagggcgccgagcg

SEQ ID NO: 168475 - RNA, 22 nt, Pseudomonas aeruginosa PA01
accggcuuccacuacgcugaaa

SEQ ID NO: 168476 - RNA, 22 nt, Pseudomonas aeruginosa PA01
gcugguggugcagcccaggcaa

SEQ ID NO: 168477 - RNA, 22 nt, Pseudomonas aeruginosa PA01
gcuggccaccgagggcauccgc

SEQ ID NO: 168478 - RNA, 22 nt, Pseudomonas aeruginosa PA01
ccggccaguucgcgggcgacgc

SEQ ID NO: 168479 - RNA, 19 nt, Pseudomonas aeruginosa PA01
agcuggcgcagcagggugc

SEQ ID NO: 168480 - RNA, 22 nt, Pseudomonas aeruginosa PA01
uuccugcucguccugguacucc

SEQ ID NO: 168481 - RNA, 22 nt, Pseudomonas aeruginosa PA01
uccaucggcgacucgaucgccg

SEQ ID NO: 168482 - RNA, 22 nt, Pseudomonas aeruginosa PA01
gcgugcugcuggucgcuccgcu

SEQ ID NO: 168483 - RNA, 22 nt, Pseudomonas aeruginosa PA01
augccggcgaugggcgacuucg

SEQ ID NO: 168484 - RNA, 22 nt, Pseudomonas aeruginosa PA01
gccgggcuccggcggacgcagg

SEQ ID NO: 168485 - RNA, 22 nt, Pseudomonas aeruginosa PA01
ucgaugaucaucaggcuggcgu

SEQ ID NO: 168486 - RNA, 22 nt, Pseudomonas aeruginosa PA01
ugcugcaggagggccagggcau

SEQ ID NO: 168487 - RNA, 22 nt, Pseudomonas aeruginosa PA01
gcggccugcucgauggccucgc

SEQ ID NO: 168488 - RNA, 22 nt, Pseudomonas aeruginosa PA01
gucgcgcaguucgaaggcggga

SEQ ID NO: 168489 - RNA, 22 nt, Pseudomonas aeruginosa PA01
uggaucgcgugagaggcauccc

SEQ ID NO: 168490 - RNA, 22 nt, Pseudomonas aeruginosa PA01
cgccggguuucgucaugucgcu

SEQ ID NO: 168491 - RNA, 22 nt, Pseudomonas aeruginosa PA01
cgggaucgagcaaauugccgca

SEQ ID NO: 168492 - RNA, 22 nt, Pseudomonas aeruginosa PA01
cggaucgcggcgaaguccuccc

SEQ ID NO: 168493 - RNA, 22 nt, Pseudomonas aeruginosa PA01
agaagcacgacgcucgccggcg

SEQ ID NO: 168494 - RNA, 22 nt, Pseudomonas aeruginosa PA01
gaccggcagaucgaggaggggc

SEQ ID NO: 168495 - RNA, 22 nt, Pseudomonas aeruginosa PA01
cgcggcaccagccagguggcgg

SEQ ID NO: 168496 - RNA, 22 nt, Pseudomonas aeruginosa PA01
uccgcgagcugucggcuuccau

SEQ ID NO: 168497 - RNA, 22 nt, Pseudomonas aeruginosa PA01
agucggcuugggucagcggguu

SEQ ID NO: 168498 - RNA, 22 nt, Pseudomonas aeruginosa PA01
cgacgccaaucccgggcuggcc

SEQ ID NO: 168499 - RNA, 22 nt, Pseudomonas aeruginosa PA01
ucgaggccgaggaucgggucgg

SEQ ID NO: 168500 - RNA, 22 nt, Pseudomonas aeruginosa PA01
agucuggcuuuugaaguucugu

SEQ ID NO: 168501 - RNA, 20 nt, Pseudomonas aeruginosa PA01
accaggcgcggaucuccgcc

SEQ ID NO: 168502 - RNA, 22 nt, Pseudomonas aeruginosa PA01
ucgcggugaaaugcucgagggc

SEQ ID NO: 168503 - RNA, 22 nt, Pseudomonas aeruginosa PA01
gcagcuugucgugcugggcgag

SEQ ID NO: 168504 - RNA, 22 nt, Pseudomonas aeruginosa PA01
cgaucugcgacauuuccugcgc

SEQ ID NO: 168505 - RNA, 22 nt, Pseudomonas aeruginosa PA01
gucaggguguugcggcugucgg

SEQ ID NO: 168506 - RNA, 22 nt, Pseudomonas aeruginosa PA01
ggcacggucuucaccgucagcg

SEQ ID NO: 168507 - RNA, 22 nt, Pseudomonas aeruginosa PA01
cugcugcaggucgacggcgccu

SEQ ID NO: 168508 - RNA, 22 nt, Pseudomonas aeruginosa PA01
aggcgccgcggcccugucagcc

SEQ ID NO: 168509 - RNA, 22 nt, Pseudomonas aeruginosa PA01
cagcggcugcuccaggcugagg

SEQ ID NO: 168510 - RNA, 22 nt, Pseudomonas aeruginosa PA01
acucgccggcauuggcacccug

SEQ ID NO: 168511 - RNA, 22 nt, Pseudomonas aeruginosa PA01
uuccaccugcgggugcgacgcg

SEQ ID NO: 168512 - RNA, 22 nt, Pseudomonas aeruginosa PA01
gccauucgccgggcgugcucgg

SEQ ID NO: 168513 - RNA, 22 nt, Pseudomonas aeruginosa PA01
ggacaguugggaagacuggugg

SEQ ID NO: 168514 - RNA, 22 nt, Pseudomonas aeruginosa PA01
ggccuugucgaugucgccgcgg

SEQ ID NO: 168515 - RNA, 22 nt, Pseudomonas aeruginosa PA01
gaggcguugcccgacgaugucc

SEQ ID NO: 168516 - RNA, 22 nt, Pseudomonas aeruginosa PA01
cgccuucgaaggccuggccgau

SEQ ID NO: 168517 - RNA, 22 nt, Pseudomonas aeruginosa PA01
gagucgcuccugcagccggugg

SEQ ID NO: 168518 - RNA, 21 nt, Pseudomonas aeruginosa PA01
cggccgccacaacgcccucga

SEQ ID NO: 168519 - RNA, 22 nt, Pseudomonas aeruginosa PA01
caggugcuguucagcggcaggu

SEQ ID NO: 168520 - RNA, 21 nt, Pseudomonas aeruginosa PA01
cgugccguucaaggaagaggc

SEQ ID NO: 168521 - RNA, 22 nt, Pseudomonas aeruginosa PA01
gccaugggugaauacgagcgca

SEQ ID NO: 168522 - RNA, 22 nt, Pseudomonas aeruginosa PA01
caggccgaccaggaacgcggug

SEQ ID NO: 168523 - RNA, 22 nt, Pseudomonas aeruginosa PA01
uuuccucgaugucgccgcccuu

SEQ ID NO: 168524 - RNA, 22 nt, Pseudomonas aeruginosa PA01
gggggcaggucacuugccccgc

SEQ ID NO: 168525 - RNA, 22 nt, Pseudomonas aeruginosa PA01
cgccgacuucgaggccuacugg

SEQ ID NO: 168526 - RNA, 22 nt, Pseudomonas aeruginosa PA01
cuucaacggcaucgaugccagc

SEQ ID NO: 168527 - RNA, 22 nt, Pseudomonas aeruginosa PA01
gguuucccgcgacagcgcgccg

SEQ ID NO: 168528 - RNA, 22 nt, Pseudomonas aeruginosa PA01
ggcccggcgauccggacaugca

SEQ ID NO: 168529 - RNA, 22 nt, Pseudomonas aeruginosa PA01
cgugcaggacuccaccgacgag

SEQ ID NO: 168530 - RNA, 22 nt, Pseudomonas aeruginosa PA01
ucccggacaccgauuuaggcga

SEQ ID NO: 168531 - RNA, 22 nt, Pseudomonas aeruginosa PA01
ccgcgggcagccccggaucggc

SEQ ID NO: 168532 - RNA, 22 nt, Pseudomonas aeruginosa PA01
acauggcguccuugccguuggc

SEQ ID NO: 168533 - RNA, 22 nt, Pseudomonas aeruginosa PA01
gaccaggcguacguauagcagg

SEQ ID NO: 168534 - RNA, 22 nt, Pseudomonas aeruginosa PA01
ucggucuggggccuggaaggcg

SEQ ID NO: 168535 - RNA, 22 nt, Pseudomonas aeruginosa PA01
agucgcugaugaaguucaccgc

SEQ ID NO: 168536 - RNA, 22 nt, Pseudomonas aeruginosa PA01
aguucgcguucgcggcucaucg

SEQ ID NO: 168537 - RNA, 22 nt, Pseudomonas aeruginosa PA01
cgugggccuggauggcgaaggg

SEQ ID NO: 168538 - RNA, 22 nt, Pseudomonas aeruginosa PA01
cgacgaagacgccacgggccuc

SEQ ID NO: 168539 - RNA, 22 nt, Pseudomonas aeruginosa PA01
cgggaugugcaggugcucggcg

SEQ ID NO: 168540 - RNA, 22 nt, Pseudomonas aeruginosa PA01
cucggccugcugccgggccggg

SEQ ID NO: 168541 - RNA, 22 nt, Pseudomonas aeruginosa PA01
ccggggcgcccuggcggucagg

SEQ ID NO: 168542 - RNA, 22 nt, Pseudomonas aeruginosa PA01
ccggcuucgaacgcaugcaacc

SEQ ID NO: 168543 - RNA, 22 nt, Pseudomonas aeruginosa PA01
agaccaugcggguuuccggggu

SEQ ID NO: 168544 - RNA, 22 nt, Pseudomonas aeruginosa PA01
gucugccuggaggccggccagg

SEQ ID NO: 168545 - RNA, 22 nt, Pseudomonas aeruginosa PA01
ugccugcucggucgcaacgggg

SEQ ID NO: 168546 - RNA, 22 nt, Pseudomonas aeruginosa PA01
ggccgaucaccaccagccgggu

SEQ ID NO: 168547 - RNA, 23 nt, Pseudomonas aeruginosa PA01
agcuggauggccgccugcuguuc

SEQ ID NO: 168548 - RNA, 22 nt, Pseudomonas aeruginosa PA01
gccgccgauggucugccggucg

SEQ ID NO: 168549 - RNA, 22 nt, Pseudomonas aeruginosa PA01
cagggcguggacucggucuacg

SEQ ID NO: 168550 - RNA, 22 nt, Pseudomonas aeruginosa PA01
ggcugguggugaaaccgaccug

SEQ ID NO: 168551 - RNA, 22 nt, Pseudomonas aeruginosa PA01
ucgaacugaagcgugucgcucu

SEQ ID NO: 168552 - RNA, 22 nt, Pseudomonas aeruginosa PA01
gugcggucgaggaagccggugu

SEQ ID NO: 168553 - RNA, 22 nt, Pseudomonas aeruginosa PA01
ucgcaucgucaccccguccagc

SEQ ID NO: 168554 - RNA, 22 nt, Pseudomonas aeruginosa PA01
gaucgacgccaggcacgccgag

SEQ ID NO: 168555 - RNA, 22 nt, Pseudomonas aeruginosa PA01
gacguugauccucggcgucucc

SEQ ID NO: 168556 - RNA, 22 nt, Pseudomonas aeruginosa PA01
gggcuucgcggaagcgccgguu

SEQ ID NO: 168557 - RNA, 22 nt, Pseudomonas aeruginosa PA01
uggaggucggcacgccgcuggc

SEQ ID NO: 168558 - RNA, 22 nt, Pseudomonas aeruginosa PA01
cgcaccaucuuucccaucagcc

SEQ ID NO: 168559 - RNA, 22 nt, Pseudomonas aeruginosa PA01
uuggcgucgaagccacuggcga

SEQ ID NO: 168560 - RNA, 22 nt, Pseudomonas aeruginosa PA01
ugcgaugccgguacgcaugagc

SEQ ID NO: 168561 - RNA, 23 nt, Pseudomonas aeruginosa PA01
gaccgccuggagcggaucagccu

SEQ ID NO: 168562 - RNA, 22 nt, Pseudomonas aeruginosa PA01
cuuccacgcguugggccugucc

SEQ ID NO: 168563 - RNA, 22 nt, Pseudomonas aeruginosa PA01
caggccccgugcgcgggauguu

SEQ ID NO: 168564 - RNA, 20 nt, Pseudomonas aeruginosa PA01
gcugcgcaccgagaccgcgc

SEQ ID NO: 168565 - RNA, 22 nt, Pseudomonas aeruginosa PA01
guggcugggugccgagccgagg

SEQ ID NO: 168566 - RNA, 20 nt, Pseudomonas aeruginosa PA01
cgagguccuugaccacgugc

SEQ ID NO: 168567 - RNA, 22 nt, Pseudomonas aeruginosa PA01
aaccugcucggccucgaccugc

SEQ ID NO: 168568 - RNA, 22 nt, Pseudomonas aeruginosa PA01
gcgacaccuuuggauuuauuag

SEQ ID NO: 168569 - RNA, 22 nt, Pseudomonas aeruginosa PA01
ggucgccugcaagucgucgugg

SEQ ID NO: 168570 - RNA, 22 nt, Pseudomonas aeruginosa PA01
gcgggcugaccaccgggcccau

SEQ ID NO: 168571 - RNA, 22 nt, Pseudomonas aeruginosa PA01
ggugaucgcguagggcaguugg

SEQ ID NO: 168572 - RNA, 18 nt, Pseudomonas aeruginosa PA01
uggaccuucuucucggca

SEQ ID NO: 168573 - RNA, 22 nt, Pseudomonas aeruginosa PA01
cgucuggaaagcgucgacgcgc

SEQ ID NO: 168574 - RNA, 22 nt, Pseudomonas aeruginosa PA01
cugggcgucguacagcuugccg

SEQ ID NO: 168575 - RNA, 22 nt, Pseudomonas aeruginosa PA01
cggcgcgccgaaggcgauaugg

SEQ ID NO: 168576 - RNA, 22 nt, Pseudomonas aeruginosa PA01
uuugcgccauucgcuggacagc

SEQ ID NO: 168577 - RNA, 20 nt, Pseudomonas aeruginosa PA01
cucacgcgggugcgccgcag

SEQ ID NO: 168578 - RNA, 22 nt, Pseudomonas aeruginosa PA01
ucgucguuguggaucgggcaga

SEQ ID NO: 168579 - RNA, 22 nt, Pseudomonas aeruginosa PA01
ggagcgcgugaccggcuacggu

SEQ ID NO: 168580 - RNA, 22 nt, Pseudomonas aeruginosa PA01
uggaacaggucaacggugcgcu

SEQ ID NO: 168581 - RNA, 22 nt, Pseudomonas aeruginosa PA01
cagccggcagcccucgacggug

SEQ ID NO: 168582 - RNA, 22 nt, Pseudomonas aeruginosa PA01
gaagagcgccaacgucgagggc

SEQ ID NO: 168583 - RNA, 22 nt, Pseudomonas aeruginosa PA01
cgccgggcuggauguguugcgg

SEQ ID NO: 168584 - RNA, 22 nt, Pseudomonas aeruginosa PA01
gacgaggcgaacugcucgaaca

SEQ ID NO: 168585 - RNA, 22 nt, Pseudomonas aeruginosa PA01
gaccggcguugaugucgccuuc

SEQ ID NO: 168586 - RNA, 22 nt, Pseudomonas aeruginosa PA01
uuaccugaagaagauccgcccg

SEQ ID NO: 168587 - RNA, 22 nt, Pseudomonas aeruginosa PA01
gccggagagauccgcaaccugc

SEQ ID NO: 168588 - RNA, 23 nt, Pseudomonas aeruginosa PA01
gaccacaccgacuucaugcuggu

SEQ ID NO: 168589 - RNA, 22 nt, Pseudomonas aeruginosa PA01
cagggugguaucggccugcgcc

SEQ ID NO: 168590 - RNA, 22 nt, Pseudomonas aeruginosa PA01
gccgacuucgccgcugagcugc

SEQ ID NO: 168591 - RNA, 22 nt, Pseudomonas aeruginosa PA01
gagcgucucaugcagguggucg

SEQ ID NO: 168592 - RNA, 22 nt, Pseudomonas aeruginosa PA01
acuggcggcauugccgaggacc

SEQ ID NO: 168593 - RNA, 22 nt, Pseudomonas aeruginosa PA01
gauggucucguuggcgcccacc

SEQ ID NO: 168594 - RNA, 22 nt, Pseudomonas aeruginosa PA01
ggccuguucgauggcguggugg

SEQ ID NO: 168595 - RNA, 22 nt, Pseudomonas aeruginosa PA01
uucgccuucgagacgcggauga

SEQ ID NO: 168596 - RNA, 22 nt, Pseudomonas aeruginosa PA01
cccguugccccagaccugggag

SEQ ID NO: 168597 - RNA, 22 nt, Pseudomonas aeruginosa PA01
ggcugaugcagcagcgccaugu

SEQ ID NO: 168598 - RNA, 22 nt, Pseudomonas aeruginosa PA01
cagucguugcaguucgccgccg

SEQ ID NO: 168599 - RNA, 22 nt, Pseudomonas aeruginosa PA01
ugggucuucucguugaggguga

SEQ ID NO: 168600 - RNA, 22 nt, Pseudomonas aeruginosa PA01
ccugcguucgggcaucuccgcc

SEQ ID NO: 168601 - RNA, 22 nt, Pseudomonas aeruginosa PA01
ugaccgccagcugguaggugcc

SEQ ID NO: 168602 - RNA, 22 nt, Pseudomonas aeruginosa PA01
gccgccaucaacuggccgacgg

SEQ ID NO: 168603 - RNA, 22 nt, Pseudomonas aeruginosa PA01
uugucgaggggauugcugaccg

SEQ ID NO: 168604 - RNA, 22 nt, Pseudomonas aeruginosa PA01
gccggcggaauacuucgggucc

SEQ ID NO: 168605 - RNA, 22 nt, Pseudomonas aeruginosa PA01
ccggccgaggcgccggaccagg

SEQ ID NO: 168606 - RNA, 20 nt, Pseudomonas aeruginosa PA01
cacggccgcgggcuguugag

SEQ ID NO: 168607 - RNA, 22 nt, Pseudomonas aeruginosa PA01
cggucaacuaccaauucuggaa

SEQ ID NO: 168608 - RNA, 22 nt, Pseudomonas aeruginosa PA01
ggcgacgacgaagaguaaaugc

SEQ ID NO: 168609 - RNA, 22 nt, Pseudomonas aeruginosa PA01
cagcagccuggccggcaguuuu

SEQ ID NO: 168610 - RNA, 22 nt, Pseudomonas aeruginosa PA01
uccgcacagugccgucgcugcc

SEQ ID NO: 168611 - RNA, 22 nt, Pseudomonas aeruginosa PA01
ucaucugcuggguguccaccag

SEQ ID NO: 168612 - RNA, 22 nt, Pseudomonas aeruginosa PA01
agccgggucugcgcgucgaggg

SEQ ID NO: 168613 - RNA, 22 nt, Pseudomonas aeruginosa PA01
agggccaucugccagcgggaac

SEQ ID NO: 168614 - RNA, 22 nt, Pseudomonas aeruginosa PA01
gccggcgccgauggcgaauucc

SEQ ID NO: 168615 - RNA, 22 nt, Pseudomonas aeruginosa PA01
gaccuugucguuguaggccuug

SEQ ID NO: 168616 - RNA, 22 nt, Pseudomonas aeruginosa PA01
agggccugggcgaucgcgacgc

SEQ ID NO: 168617 - RNA, 22 nt, Pseudomonas aeruginosa PA01
ccugggugcggcgcuuggccug

SEQ ID NO: 168618 - RNA, 22 nt, Pseudomonas aeruginosa PA01
ggcggucguggccgucgacccg

SEQ ID NO: 168619 - RNA, 22 nt, Pseudomonas aeruginosa PA01
cccggcucugcucggcgugggc

SEQ ID NO: 168620 - RNA, 22 nt, Pseudomonas aeruginosa PA01
aaucuccgcuucgucgaaaagc

SEQ ID NO: 168621 - RNA, 21 nt, Pseudomonas aeruginosa PA01
ucggugauggucaucgacgag

SEQ ID NO: 168622 - RNA, 21 nt, Pseudomonas aeruginosa PA01
agguggauggugccaccgguc

SEQ ID NO: 168623 - RNA, 22 nt, Pseudomonas aeruginosa PA01
ccgaccacaucaucgugcucga

SEQ ID NO: 168624 - RNA, 22 nt, Pseudomonas aeruginosa PA01
cggcgccgacgagcuuaucuuc

SEQ ID NO: 168625 - RNA, 22 nt, Pseudomonas aeruginosa PA01
ccgcgggcugacgcccaggcga

SEQ ID NO: 168626 - RNA, 22 nt, Pseudomonas aeruginosa PA01
gcuagccgcggucauucgcagu

SEQ ID NO: 168627 - RNA, 22 nt, Pseudomonas aeruginosa PA01
ucuggucggcacgcuggaucga

SEQ ID NO: 168628 - RNA, 22 nt, Pseudomonas aeruginosa PA01
ggcugacagggccgcggcgccu

SEQ ID NO: 168629 - RNA, 22 nt, Pseudomonas aeruginosa PA01
uugcgggugcgcucgguucagg

SEQ ID NO: 168630 - RNA, 22 nt, Pseudomonas aeruginosa PA01
cggguggucuucgagcguccgc

SEQ ID NO: 168631 - RNA, 22 nt, Pseudomonas aeruginosa PA01
aacggguagucgagcggcucgg

SEQ ID NO: 168632 - RNA, 22 nt, Pseudomonas aeruginosa PA01
gcagcggcuccucggcauucuc

SEQ ID NO: 168633 - RNA, 22 nt, Pseudomonas aeruginosa PA01
guggccaguaccguggugcugu

SEQ ID NO: 168634 - RNA, 20 nt, Pseudomonas aeruginosa PA01
agucgccgaucgccauccgu

SEQ ID NO: 168635 - RNA, 22 nt, Pseudomonas aeruginosa PA01
ucggugaggcggaucugcgucg

SEQ ID NO: 168636 - RNA, 20 nt, Pseudomonas aeruginosa PA01
cacggacgccacuacgcgau

SEQ ID NO: 168637 - RNA, 22 nt, Pseudomonas aeruginosa PA01
ggcuugcccguaggugucgugg

SEQ ID NO: 168638 - RNA, 22 nt, Pseudomonas aeruginosa PA01
cgggucgacggccacgaccgcc

SEQ ID NO: 168639 - RNA, 22 nt, Pseudomonas aeruginosa PA01
cuucggcgaggaaacgccgcgc

SEQ ID NO: 168640 - RNA, 22 nt, Pseudomonas aeruginosa PA01
acgguggugccggugagcuggc

SEQ ID NO: 168641 - RNA, 22 nt, Pseudomonas aeruginosa PA01
ccacgcauuucucgguggagga

SEQ ID NO: 168642 - RNA, 22 nt, Pseudomonas aeruginosa PA01
agcgcagcaggcaggccuggua

SEQ ID NO: 168643 - RNA, 22 nt, Pseudomonas aeruginosa PA01
ggcgcugauguugcugaucgcc

SEQ ID NO: 168644 - RNA, 22 nt, Pseudomonas aeruginosa PA01
accgccaggcgguuauccgccc

SEQ ID NO: 168645 - RNA, 22 nt, Pseudomonas aeruginosa PA01
gggaaauggcuuccggccugac

SEQ ID NO: 168646 - RNA, 22 nt, Pseudomonas aeruginosa PA01
gucgcuucaaguuccucaccgg

SEQ ID NO: 168647 - RNA, 22 nt, Pseudomonas aeruginosa PA01
ugcuguucgaggaccuuggcgu

SEQ ID NO: 168648 - RNA, 22 nt, Pseudomonas aeruginosa PA01
gggcuuguucagcgccagguag

SEQ ID NO: 168649 - RNA, 22 nt, Pseudomonas aeruginosa PA01
uuccaccggcaggcguucgcgc

SEQ ID NO: 168650 - RNA, 22 nt, Pseudomonas aeruginosa PA01
gucccuggccaccgucccgcug

SEQ ID NO: 168651 - RNA, 22 nt, Pseudomonas aeruginosa PA01
acuggccaacaucgccgaggcg

SEQ ID NO: 168652 - RNA, 20 nt, Pseudomonas aeruginosa PA01
aucagcauguugggggcggg

SEQ ID NO: 168653 - RNA, 22 nt, Pseudomonas aeruginosa PA01
gaagaccagccgaucuucgagc

SEQ ID NO: 168654 - RNA, 21 nt, Pseudomonas aeruginosa PA01
uugagcaggcgcaucgcgcug

SEQ ID NO: 168655 - RNA, 21 nt, Pseudomonas aeruginosa PA01
ccgagcaguuucucgaggcgc

SEQ ID NO: 168656 - RNA, 22 nt, Pseudomonas aeruginosa PA01
gccgccgagucccuggagcgug

SEQ ID NO: 168657 - RNA, 23 nt, Pseudomonas aeruginosa PA01
gccgaccucggagacgccgaugc

SEQ ID NO: 168658 - RNA, 22 nt, Pseudomonas aeruginosa PA01
ccaucaccaccaggaucacgaa

SEQ ID NO: 168659 - RNA, 22 nt, Pseudomonas aeruginosa PA01
guggccggcgcgauggcgucca

SEQ ID NO: 168660 - RNA, 23 nt, Pseudomonas aeruginosa PA01
uacgccaucugagugcucgccau

SEQ ID NO: 168661 - RNA, 22 nt, Pseudomonas aeruginosa PA01
ucgguggucggcgagauccaga

SEQ ID NO: 168662 - RNA, 22 nt, Pseudomonas aeruginosa PA01
uugcuauggcaucgucggcgac

SEQ ID NO: 168663 - RNA, 22 nt, Pseudomonas aeruginosa PA01
gguggugcugucggugaucgac

SEQ ID NO: 168664 - RNA, 22 nt, Pseudomonas aeruginosa PA01
cgacaaagacgucgcgcggccu

SEQ ID NO: 168665 - RNA, 22 nt, Pseudomonas aeruginosa PA01
agucggcguuccucgccggcaa

SEQ ID NO: 168666 - RNA, 22 nt, Pseudomonas aeruginosa PA01
gcgguucagcgaagcggugaug

SEQ ID NO: 168667 - RNA, 22 nt, Pseudomonas aeruginosa PA01
ggccuguggauggugccggccg

SEQ ID NO: 168668 - RNA, 22 nt, Pseudomonas aeruginosa PA01
ucgcccagcgccuggcgggucg

SEQ ID NO: 168669 - RNA, 22 nt, Pseudomonas aeruginosa PA01
cgaguugcgucucgucgucgag

SEQ ID NO: 168670 - RNA, 22 nt, Pseudomonas aeruginosa PA01
ggagaagguucgcgcgcgucug

SEQ ID NO: 168671 - RNA, 22 nt, Pseudomonas aeruginosa PA01
uggcgcggaccacgacggucgg

SEQ ID NO: 168672 - RNA, 22 nt, Pseudomonas aeruginosa PA01
ugguguucaacgccagcaccgu

SEQ ID NO: 168673 - RNA, 20 nt, Pseudomonas aeruginosa PA01
cccgacgaccugcaggcggc

SEQ ID NO: 168674 - RNA, 22 nt, Pseudomonas aeruginosa PA01
gcgaacaagcugcgccagcaug

SEQ ID NO: 168675 - RNA, 22 nt, Pseudomonas aeruginosa PA01
uggcagacgaucagcaggcugc

SEQ ID NO: 168676 - RNA, 22 nt, Pseudomonas aeruginosa PA01
ggcucagccgcgcaugccgaag

SEQ ID NO: 168677 - RNA, 22 nt, Pseudomonas aeruginosa PA01
guggaaguggucgaggccccgg

SEQ ID NO: 168678 - RNA, 22 nt, Pseudomonas aeruginosa PA01
ggcaggcaugguggaucgacug

SEQ ID NO: 168679 - RNA, 22 nt, Pseudomonas aeruginosa PA01
gguugguggcggugugcgccgg

SEQ ID NO: 168680 - RNA, 22 nt, Pseudomonas aeruginosa PA01
cgggucggcagccugcucggca

SEQ ID NO: 168681 - RNA, 22 nt, Pseudomonas aeruginosa PA01
ggcugaccgacaaggugcgcgg

SEQ ID NO: 168682 - RNA, 20 nt, Pseudomonas aeruginosa PA01
guuucagcacgcucuuccag

SEQ ID NO: 168683 - RNA, 22 nt, Pseudomonas aeruginosa PA01
cgggccgcgacggccgcccagg

SEQ ID NO: 168684 - RNA, 22 nt, Pseudomonas aeruginosa PA01
aucauccgccgaugcggcgaua

SEQ ID NO: 168685 - RNA, 22 nt, Pseudomonas aeruginosa PA01
caggcgguagucgcggccgauc

SEQ ID NO: 168686 - RNA, 22 nt, Pseudomonas aeruginosa PA01
gacauguaaugaagccucggua

SEQ ID NO: 168687 - RNA, 22 nt, Pseudomonas aeruginosa PA01
ucgaugggcgcccgaucgagcc

SEQ ID NO: 168688 - RNA, 22 nt, Pseudomonas aeruginosa PA01
ugaugccugucacauguuggca

SEQ ID NO: 168689 - RNA, 22 nt, Pseudomonas aeruginosa PA01
uggcgcugacccggcuggucau

SEQ ID NO: 168690 - RNA, 22 nt, Pseudomonas aeruginosa PA01
auguccggcagcgcggcgaagg

SEQ ID NO: 168691 - RNA, 22 nt, Pseudomonas aeruginosa PA01
gggccgggcuucagcaucgacg

SEQ ID NO: 168692 - RNA, 22 nt, Pseudomonas aeruginosa PA01
cccacgggugaucuucgccucg

SEQ ID NO: 168693 - RNA, 22 nt, Pseudomonas aeruginosa PA01
ccucgcgggcuucgagcaacgg

SEQ ID NO: 168694 - RNA, 22 nt, Pseudomonas aeruginosa PA01
uguggccguccucgugcugcag

SEQ ID NO: 168695 - RNA, 22 nt, Pseudomonas aeruginosa PA01
ugcugguagaacaguugcagcu

SEQ ID NO: 168696 - RNA, 22 nt, Pseudomonas aeruginosa PA01
cgaggccggcguggcgaaguag

SEQ ID NO: 168697 - RNA, 22 nt, Pseudomonas aeruginosa PA01
cagcgcugagagacuggcgcgc

SEQ ID NO: 168698 - RNA, 22 nt, Pseudomonas aeruginosa PA01
ggcgaacugcuugaggccgguc

SEQ ID NO: 168699 - RNA, 22 nt, Pseudomonas aeruginosa PA01
cgcuggucguaguauucgaagu

SEQ ID NO: 168700 - RNA, 22 nt, Pseudomonas aeruginosa PA01
agcgccuuguucugccagccgu

SEQ ID NO: 168701 - RNA, 22 nt, Pseudomonas aeruginosa PA01
gaccgucuugcuggcggguugu

SEQ ID NO: 168702 - RNA, 21 nt, Pseudomonas aeruginosa PA01
ggcagccgcuucgaacgccug

SEQ ID NO: 168703 - RNA, 22 nt, Pseudomonas aeruginosa PA01
guggccuggcugaagagcgccu

SEQ ID NO: 168704 - RNA, 22 nt, Pseudomonas aeruginosa PA01
cggcaccgcugaagccggcgac

SEQ ID NO: 168705 - RNA, 21 nt, Pseudomonas aeruginosa PA01
cggauaggcauugaucggguu

SEQ ID NO: 168706 - RNA, 22 nt, Pseudomonas aeruginosa PA01
ggcggugucgaagcagauccau

SEQ ID NO: 168707 - RNA, 22 nt, Pseudomonas aeruginosa PA01
agggugguccacagcggcaggc

SEQ ID NO: 168708 - RNA, 22 nt, Pseudomonas aeruginosa PA01
uagggagacgcgcccgcagccg

SEQ ID NO: 168709 - RNA, 22 nt, Pseudomonas aeruginosa PA01
ugggcguuguucgucagacggg

SEQ ID NO: 168710 - RNA, 22 nt, Pseudomonas aeruginosa PA01
cgccgaggaagaaacaccgauu

SEQ ID NO: 168711 - RNA, 22 nt, Pseudomonas aeruginosa PA01
agcgggcugagggugcccucgg

SEQ ID NO: 168712 - RNA, 22 nt, Pseudomonas aeruginosa PA01
uccggccaaccgcugccggagg

SEQ ID NO: 168713 - RNA, 22 nt, Pseudomonas aeruginosa PA01
agaccuccugcaccgagcugau

SEQ ID NO: 168714 - RNA, 22 nt, Pseudomonas aeruginosa PA01
ucucccugcccggcaucgaaca

SEQ ID NO: 168715 - RNA, 22 nt, Pseudomonas aeruginosa PA01
gccagcgaccgcaacuucaucg

SEQ ID NO: 168716 - RNA, 22 nt, Pseudomonas aeruginosa PA01
ucgagggucacgauguccuggg

SEQ ID NO: 168717 - RNA, 22 nt, Pseudomonas aeruginosa PA01
ugcgccguuucgacgaugcucg

SEQ ID NO: 168718 - RNA, 22 nt, Pseudomonas aeruginosa PA01
agccggcgaucgccuugagcgg

SEQ ID NO: 168719 - RNA, 22 nt, Pseudomonas aeruginosa PA01
augugcuggcccgcgaggcgcc

SEQ ID NO: 168720 - RNA, 19 nt, Pseudomonas aeruginosa PA01
ccauggucgccagcuugcc

SEQ ID NO: 168721 - RNA, 22 nt, Pseudomonas aeruginosa PA01
agguccgucgcaucgaccgcaa

SEQ ID NO: 168722 - RNA, 22 nt, Pseudomonas aeruginosa PA01
gcgcaaccacgugcuucucggc

SEQ ID NO: 168723 - RNA, 22 nt, Pseudomonas aeruginosa PA01
gaggcgacgaucgacuagacug

SEQ ID NO: 168724 - RNA, 22 nt, Pseudomonas aeruginosa PA01
gucggcggccaguucgaagugc

SEQ ID NO: 168725 - RNA, 22 nt, Pseudomonas aeruginosa PA01
ccugccgccgguggacgugcug

SEQ ID NO: 168726 - RNA, 22 nt, Pseudomonas aeruginosa PA01
aggaacaguucgacgcccaggu

SEQ ID NO: 168727 - RNA, 22 nt, Pseudomonas aeruginosa PA01
ggcggugaugugcguggaugau

SEQ ID NO: 168728 - RNA, 22 nt, Pseudomonas aeruginosa PA01
cccugcagccggucagggucgg

SEQ ID NO: 168729 - RNA, 22 nt, Pseudomonas aeruginosa PA01
cgcaggaaacgcucgauggcca

SEQ ID NO: 168730 - RNA, 22 nt, Pseudomonas aeruginosa PA01
agcgaucgccccguucggccag

SEQ ID NO: 168731 - RNA, 22 nt, Pseudomonas aeruginosa PA01
cagcgucugcccgccgcugacg

SEQ ID NO: 168732 - RNA, 17 nt, Pseudomonas aeruginosa PA01
uucguccagcgccagca

SEQ ID NO: 168733 - RNA, 22 nt, Pseudomonas aeruginosa PA01
ggugcugaucagccugcgccgg

SEQ ID NO: 168734 - RNA, 22 nt, Pseudomonas aeruginosa PA01
gcgcugcuccagcaccguucgu

SEQ ID NO: 168735 - RNA, 22 nt, Pseudomonas aeruginosa PA01
uucuucucgucgggcuggugca

SEQ ID NO: 168736 - RNA, 22 nt, Pseudomonas aeruginosa PA01
cguaggaaaccuggaucucgca

SEQ ID NO: 168737 - RNA, 22 nt, Pseudomonas aeruginosa PA01
ucggccagggucaggcgcaggu

SEQ ID NO: 168738 - RNA, 22 nt, Pseudomonas aeruginosa PA01
ggccgcuuccgccgaucgcagc

SEQ ID NO: 168739 - RNA, 23 nt, Pseudomonas aeruginosa PA01
uggugcggagauuuccgacucga

SEQ ID NO: 168740 - RNA, 22 nt, Pseudomonas aeruginosa PA01
cacuucgccggcgaggucuucc

SEQ ID NO: 168741 - RNA, 22 nt, Pseudomonas aeruginosa PA01
cccuucagcgccucgcccuggg

SEQ ID NO: 168742 - RNA, 22 nt, Pseudomonas aeruginosa PA01
acccugcccaaggugacccucg

SEQ ID NO: 168743 - RNA, 20 nt, Pseudomonas aeruginosa PA01
aggccagggcgcugaucggc

SEQ ID NO: 168744 - RNA, 22 nt, Pseudomonas aeruginosa PA01
gagcgacguacaacagaugcug

SEQ ID NO: 168745 - RNA, 22 nt, Pseudomonas aeruginosa PA01
cgggguguacaccacggugguc

SEQ ID NO: 168746 - RNA, 22 nt, Pseudomonas aeruginosa PA01
ucaguugggcguugccggacca

SEQ ID NO: 168747 - RNA, 22 nt, Pseudomonas aeruginosa PA01
uccaggcgcaugcgcucggcga

SEQ ID NO: 168748 - RNA, 16 nt, Pseudomonas aeruginosa PA01
aggccggaaccgcaca

SEQ ID NO: 168749 - RNA, 22 nt, Pseudomonas aeruginosa PA01
cggccagccaggcccgcaccag

SEQ ID NO: 168750 - RNA, 22 nt, Pseudomonas aeruginosa PA01
uccggcaggcagcccgcccuuc

SEQ ID NO: 168751 - RNA, 22 nt, Pseudomonas aeruginosa PA01
gaucaacgggcagaaggugugg

SEQ ID NO: 168752 - RNA, 22 nt, Pseudomonas aeruginosa PA01
aggcggagaugccguuguccuu

SEQ ID NO: 168753 - RNA, 22 nt, Pseudomonas aeruginosa PA01
uagcgccucggccaguucgucg

SEQ ID NO: 168754 - RNA, 22 nt, Pseudomonas aeruginosa PA01
gccgcgguucaggcggcgccag

SEQ ID NO: 168755 - RNA, 22 nt, Pseudomonas aeruginosa PA01
cgaagguagcggaugucggcga

SEQ ID NO: 168756 - RNA, 22 nt, Pseudomonas aeruginosa PA01
ucaggcccauuucguugcggac

SEQ ID NO: 168757 - RNA, 22 nt, Pseudomonas aeruginosa PA01
ugccuccaggcgcgaguccagc

SEQ ID NO: 168758 - RNA, 22 nt, Pseudomonas aeruginosa PA01
gcugguaguggucgagcaucau

SEQ ID NO: 168759 - RNA, 22 nt, Pseudomonas aeruginosa PA01
ccucggcagucgcgauuucggc

SEQ ID NO: 168760 - RNA, 22 nt, Pseudomonas aeruginosa PA01
uguucugcucgaucuugcgcac

SEQ ID NO: 168761 - RNA, 22 nt, Pseudomonas aeruginosa PA01
acgucuggucgcugcacauccg

SEQ ID NO: 168762 - RNA, 22 nt, Pseudomonas aeruginosa PA01
accgggaucuucgcauugcgua

SEQ ID NO: 168763 - RNA, 22 nt, Pseudomonas aeruginosa PA01
gccggucggcacaucguugacg

SEQ ID NO: 168764 - RNA, 22 nt, Pseudomonas aeruginosa PA01
gccgaucuucagcaggcugucc

SEQ ID NO: 168765 - RNA, 22 nt, Pseudomonas aeruginosa PA01
gcgguugagccuggcggcgaac

SEQ ID NO: 168766 - RNA, 22 nt, Pseudomonas aeruginosa PA01
agcgccuggucggccugguucu

SEQ ID NO: 168767 - RNA, 22 nt, Pseudomonas aeruginosa PA01
ucaccgcggaacggccgaugcg

SEQ ID NO: 168768 - RNA, 22 nt, Pseudomonas aeruginosa PA01
ucugcgccucgacgaugcgauc

SEQ ID NO: 168769 - RNA, 22 nt, Pseudomonas aeruginosa PA01
gguguggcacagggcugccgag

SEQ ID NO: 168770 - RNA, 22 nt, Pseudomonas aeruginosa PA01
ugccgauggcgccgccgagguu

SEQ ID NO: 168771 - RNA, 22 nt, Pseudomonas aeruginosa PA01
cgccgacugcgcgugcgaaacc

SEQ ID NO: 168772 - RNA, 18 nt, Pseudomonas aeruginosa PA01
ugaugcaguguccgcagu

SEQ ID NO: 168773 - RNA, 22 nt, Pseudomonas aeruginosa PA01
aggacgaugucgaccggggugc

SEQ ID NO: 168774 - RNA, 22 nt, Pseudomonas aeruginosa PA01
cgcuuucuaucgagcgaucgac

SEQ ID NO: 168775 - RNA, 17 nt, Pseudomonas aeruginosa PA01
cgaggcgcuggugaaca

SEQ ID NO: 168776 - RNA, 22 nt, Pseudomonas aeruginosa PA01
gccgugcgaggaacucaaggcg

SEQ ID NO: 168777 - RNA, 22 nt, Pseudomonas aeruginosa PA01
cgucgccggugaacugggcgac

SEQ ID NO: 168778 - RNA, 22 nt, Pseudomonas aeruginosa PA01
agcugggucagccgccaggucu

SEQ ID NO: 168779 - RNA, 22 nt, Pseudomonas aeruginosa PA01
gccgcguucguccgcgaggacg

SEQ ID NO: 168780 - RNA, 22 nt, Pseudomonas aeruginosa PA01
gaggcgccggaaugggucgccg

SEQ ID NO: 168781 - RNA, 22 nt, Pseudomonas aeruginosa PA01
ugcgcugggcguggucggcgac

SEQ ID NO: 168782 - RNA, 22 nt, Pseudomonas aeruginosa PA01
ugcgccugcacgagaccuggcg

SEQ ID NO: 168783 - RNA, 22 nt, Pseudomonas aeruginosa PA01
cauccggagugucgcuugaccg

SEQ ID NO: 168784 - RNA, 22 nt, Pseudomonas aeruginosa PA01
cguacgcacauggaauggacuc

SEQ ID NO: 168785 - RNA, 20 nt, Pseudomonas aeruginosa PA01
cgccgacgaggauccugacg

SEQ ID NO: 168786 - RNA, 22 nt, Pseudomonas aeruginosa PA01
gcaggcuuucaugcacauggug

SEQ ID NO: 168787 - RNA, 22 nt, Pseudomonas aeruginosa PA01
ggcgagcagcggcaggcugucg

SEQ ID NO: 168788 - RNA, 22 nt, Pseudomonas aeruginosa PA01
cucggugccaccgccggugcga

SEQ ID NO: 168789 - RNA, 22 nt, Pseudomonas aeruginosa PA01
aggccuugaagcaaggccaggg

SEQ ID NO: 168790 - RNA, 22 nt, Pseudomonas aeruginosa PA01
ccgcguggcgguuauucgcccu

SEQ ID NO: 168791 - RNA, 22 nt, Pseudomonas aeruginosa PA01
ugcagcggucuucgucgauggu

SEQ ID NO: 168792 - RNA, 22 nt, Pseudomonas aeruginosa PA01
agcgcggaccugcagguugcgg

SEQ ID NO: 168793 - RNA, 21 nt, Pseudomonas aeruginosa PA01
gcuucgccgugauagccgggc

SEQ ID NO: 168794 - RNA, 22 nt, Pseudomonas aeruginosa PA01
ucugcgucucggugcugucgcu

SEQ ID NO: 168795 - RNA, 22 nt, Pseudomonas aeruginosa PA01
gccgcuguuuucggcgugcgcc

SEQ ID NO: 168796 - RNA, 22 nt, Pseudomonas aeruginosa PA01
gucgacguugacgcccagcuug

SEQ ID NO: 168797 - RNA, 22 nt, Pseudomonas aeruginosa PA01
ucgccgucgucccagccgcgag

SEQ ID NO: 168798 - RNA, 22 nt, Pseudomonas aeruginosa PA01
cagggucgaucacggaagcggc

SEQ ID NO: 168799 - RNA, 22 nt, Pseudomonas aeruginosa PA01
uggccagcgcgacgggcuggcc

SEQ ID NO: 168800 - RNA, 22 nt, Pseudomonas aeruginosa PA01
uugcucggguucgacgccugcg

SEQ ID NO: 168801 - RNA, 22 nt, Pseudomonas aeruginosa PA01
ucggcccaggcugccaggugcg

SEQ ID NO: 168802 - RNA, 22 nt, Pseudomonas aeruginosa PA01
ugguggacggccagcggaucuc

SEQ ID NO: 168803 - RNA, 21 nt, Pseudomonas aeruginosa PA01
uugucgaugcgauagccgacg

SEQ ID NO: 168804 - RNA, 22 nt, Pseudomonas aeruginosa PA01
guagcugcggaucgccgccagc

SEQ ID NO: 168805 - RNA, 22 nt, Pseudomonas aeruginosa PA01
ucggcgauggccgccagggcgc

SEQ ID NO: 168806 - RNA, 22 nt, Pseudomonas aeruginosa PA01
ggcggcggcgcugcugaucguc

SEQ ID NO: 168807 - RNA, 22 nt, Pseudomonas aeruginosa PA01
gucggucgucgauggcgccggc

SEQ ID NO: 168808 - RNA, 22 nt, Pseudomonas aeruginosa PA01
aggucgaacuggcugugcaggu

SEQ ID NO: 168809 - RNA, 22 nt, Pseudomonas aeruginosa PA01
cugggcaucgagcacgucgagg

SEQ ID NO: 168810 - RNA, 22 nt, Pseudomonas aeruginosa PA01
cgcuaccugggggcugcgguag

SEQ ID NO: 168811 - RNA, 22 nt, Pseudomonas aeruginosa PA01
ugagcgccugcugcgcaccacc

SEQ ID NO: 168812 - RNA, 22 nt, Pseudomonas aeruginosa PA01
ggccaagggcgauggcggccug

SEQ ID NO: 168813 - RNA, 21 nt, Pseudomonas aeruginosa PA01
gcgcggugucgccaucgcgac

SEQ ID NO: 168814 - RNA, 22 nt, Pseudomonas aeruginosa PA01
ugccggcgaggucggccaugac

SEQ ID NO: 168815 - RNA, 22 nt, Pseudomonas aeruginosa PA01
cggcggcagguuuucucgacgc

SEQ ID NO: 168816 - RNA, 22 nt, Pseudomonas aeruginosa PA01
uucggcgagcgcggcgagguga

SEQ ID NO: 168817 - RNA, 22 nt, Pseudomonas aeruginosa PA01
ugcgucgagccuguggucuucg

SEQ ID NO: 168818 - RNA, 22 nt, Pseudomonas aeruginosa PA01
cacagggucgggugcucagccg

SEQ ID NO: 168819 - RNA, 22 nt, Pseudomonas aeruginosa PA01
ugaugugcgccuugagcugcuc

SEQ ID NO: 168820 - RNA, 22 nt, Pseudomonas aeruginosa PA01
gagcaggugauaggcgaugcgc

SEQ ID NO: 168821 - RNA, 20 nt, Pseudomonas aeruginosa PA01
cggcaacugcugaccgccuu

SEQ ID NO: 168822 - RNA, 22 nt, Pseudomonas aeruginosa PA01
acuggcucuggccgaucucggc

SEQ ID NO: 168823 - RNA, 22 nt, Pseudomonas aeruginosa PA01
gcuguugacgcgaaccacgcac

SEQ ID NO: 168824 - RNA, 22 nt, Pseudomonas aeruginosa PA01
ugcagcacggccugguuguccc

SEQ ID NO: 168825 - RNA, 23 nt, Pseudomonas aeruginosa PA01
uggugcagucgucgaugccggug

SEQ ID NO: 168826 - RNA, 22 nt, Pseudomonas aeruginosa PA01
ggcgcgaguugcugcgcgucua

SEQ ID NO: 168827 - RNA, 22 nt, Pseudomonas aeruginosa PA01
uggagauccaugucgacgccga

SEQ ID NO: 168828 - RNA, 22 nt, Pseudomonas aeruginosa PA01
cgccugccacagaucggccgcc

SEQ ID NO: 168829 - RNA, 22 nt, Pseudomonas aeruginosa PA01
gcggaugcugauggugccgucc

SEQ ID NO: 168830 - RNA, 22 nt, Pseudomonas aeruginosa PA01
gcgcuggcugagcaaugccagg

SEQ ID NO: 168831 - RNA, 22 nt, Pseudomonas aeruginosa PA01
aggccggcuaccucgaaggcgg

SEQ ID NO: 168832 - RNA, 22 nt, Pseudomonas aeruginosa PA01
cuggcccaggugauggccguca

SEQ ID NO: 168833 - RNA, 22 nt, Pseudomonas aeruginosa PA01
ccgacgacuucauggucaagcc

SEQ ID NO: 168834 - RNA, 21 nt, Pseudomonas aeruginosa PA01
uacuacugcuucuacugcgac

SEQ ID NO: 168835 - RNA, 22 nt, Pseudomonas aeruginosa PA01
ggugggguucuccggcacgcug

SEQ ID NO: 168836 - RNA, 22 nt, Pseudomonas aeruginosa PA01
accacggcgaucaugcgcuggc

SEQ ID NO: 168837 - RNA, 22 nt, Pseudomonas aeruginosa PA01
ggccccaugagguacagguaga

SEQ ID NO: 168838 - RNA, 22 nt, Pseudomonas aeruginosa PA01
ugcgguucauguagaugauguu

SEQ ID NO: 168839 - RNA, 22 nt, Pseudomonas aeruginosa PA01
cuggcgccugagacggaaagcc

SEQ ID NO: 168840 - RNA, 22 nt, Pseudomonas aeruginosa PA01
gauggacgugcauggccgggcc

SEQ ID NO: 168841 - RNA, 22 nt, Pseudomonas aeruginosa PA01
gucgagggcagccgcggcgguu

SEQ ID NO: 168842 - RNA, 22 nt, Pseudomonas aeruginosa PA01
ugccgaugaacaggucgcgcag

SEQ ID NO: 168843 - RNA, 22 nt, Pseudomonas aeruginosa PA01
acgaucggcccgggcaucggca

SEQ ID NO: 168844 - RNA, 22 nt, Pseudomonas aeruginosa PA01
aucgcgccauggucgaccagga

SEQ ID NO: 168845 - RNA, 20 nt, Pseudomonas aeruginosa PA01
ucaccgacauccuuggcguc

SEQ ID NO: 168846 - RNA, 22 nt, Pseudomonas aeruginosa PA01
uucugcgcgugcagcaccggca

SEQ ID NO: 168847 - RNA, 22 nt, Pseudomonas aeruginosa PA01
cagccgaacacggcgacggugu

SEQ ID NO: 168848 - RNA, 22 nt, Pseudomonas aeruginosa PA01
uuucggcccugcaguucgccca

SEQ ID NO: 168849 - RNA, 22 nt, Pseudomonas aeruginosa PA01
gcggugaugaugacgguggucu

SEQ ID NO: 168850 - RNA, 22 nt, Pseudomonas aeruginosa PA01
gucggcgcgcuguaucgccagg

SEQ ID NO: 168851 - RNA, 22 nt, Pseudomonas aeruginosa PA01
uccaucagcagcaggcgcggcc

SEQ ID NO: 168852 - RNA, 22 nt, Pseudomonas aeruginosa PA01
agcggguacgcugcaacagguu

SEQ ID NO: 168853 - RNA, 22 nt, Pseudomonas aeruginosa PA01
gcgguagggcgaauaaccgcuu

SEQ ID NO: 168854 - RNA, 22 nt, Pseudomonas aeruginosa PA01
gcgugccgucuuccagggugcc

SEQ ID NO: 168855 - RNA, 21 nt, Pseudomonas aeruginosa PA01
uguucgccgagugggucccgg

SEQ ID NO: 168856 - RNA, 22 nt, Pseudomonas aeruginosa PA01
gcgccauuugugcaguucgccg

SEQ ID NO: 168857 - RNA, 22 nt, Pseudomonas aeruginosa PA01
ggcggcgcuccucgaaggggaa

SEQ ID NO: 168858 - RNA, 22 nt, Pseudomonas aeruginosa PA01
cgagggaagacgcgaccggggu

SEQ ID NO: 168859 - RNA, 22 nt, Pseudomonas aeruginosa PA01
gcagggccuugucggucagggg

SEQ ID NO: 168860 - RNA, 22 nt, Pseudomonas aeruginosa PA01
cauggcgacuggccugccauug

SEQ ID NO: 168861 - RNA, 22 nt, Pseudomonas aeruginosa PA01
ucgccgaccucgaaggcggucg

SEQ ID NO: 168862 - RNA, 22 nt, Pseudomonas aeruginosa PA01
gaggcgacugcccaguugcggc

SEQ ID NO: 168863 - RNA, 22 nt, Pseudomonas aeruginosa PA01
cagucgguggccaccgccaccg

SEQ ID NO: 168864 - RNA, 22 nt, Pseudomonas aeruginosa PA01
cggaucuucuccaucgccgcuu

SEQ ID NO: 168865 - RNA, 22 nt, Pseudomonas aeruginosa PA01
ccgccgacggugaucggcuucu

SEQ ID NO: 168866 - RNA, 22 nt, Pseudomonas aeruginosa PA01
agccugaagaacagcugccugg

SEQ ID NO: 168867 - RNA, 22 nt, Pseudomonas aeruginosa PA01
gugaccgugcuggcggcgauca

SEQ ID NO: 168868 - RNA, 19 nt, Pseudomonas aeruginosa PA01
gucaggaggaucgccuggc

SEQ ID NO: 168869 - RNA, 22 nt, Pseudomonas aeruginosa PA01
cgcaucgcuccgcgcucgaccu

SEQ ID NO: 168870 - RNA, 22 nt, Pseudomonas aeruginosa PA01
uccucgucgaaaaaggcgugga

SEQ ID NO: 168871 - RNA, 22 nt, Pseudomonas aeruginosa PA01
ccgccuaucgagccggcaagcc

SEQ ID NO: 168872 - RNA, 22 nt, Pseudomonas aeruginosa PA01
cgcuucaacguguaauccccuu

SEQ ID NO: 168873 - RNA, 22 nt, Pseudomonas aeruginosa PA01
cuggcugguguuggcggcgcgc

SEQ ID NO: 168874 - RNA, 22 nt, Pseudomonas aeruginosa PA01
gggcggauaacgccccuggcgu

SEQ ID NO: 168875 - RNA, 22 nt, Pseudomonas aeruginosa PA01
ugggaacgccugcgcaagcuca

SEQ ID NO: 168876 - RNA, 19 nt, Pseudomonas aeruginosa PA01
ccugguucagcuccggccu

SEQ ID NO: 168877 - RNA, 22 nt, Pseudomonas aeruginosa PA01
gcugcuccacauagcgcgcgug

SEQ ID NO: 168878 - RNA, 23 nt, Pseudomonas aeruginosa PA01
aacugccguccuccagcuccagc

SEQ ID NO: 168879 - RNA, 22 nt, Pseudomonas aeruginosa PA01
gcguggucacccgccagcgcau

SEQ ID NO: 168880 - RNA, 22 nt, Pseudomonas aeruginosa PA01
agccagcccugggcgucgcuca

SEQ ID NO: 168881 - RNA, 22 nt, Pseudomonas aeruginosa PA01
uucuucagcuugaucacgucga

SEQ ID NO: 168882 - RNA, 22 nt, Pseudomonas aeruginosa PA01
guugcuugcccuugaucugcuu

SEQ ID NO: 168883 - RNA, 22 nt, Pseudomonas aeruginosa PA01
gggcggccucggucacaugggc

SEQ ID NO: 168884 - RNA, 22 nt, Pseudomonas aeruginosa PA01
ccgcgucggccaguugcgccau

SEQ ID NO: 168885 - RNA, 22 nt, Pseudomonas aeruginosa PA01
gcugggcuacccgcgcgacacc

SEQ ID NO: 168886 - RNA, 22 nt, Pseudomonas aeruginosa PA01
ggggcaagugaccugcccccau

SEQ ID NO: 168887 - RNA, 22 nt, Pseudomonas aeruginosa PA01
caggccacgcaguuggccuggg

SEQ ID NO: 168888 - RNA, 22 nt, Pseudomonas aeruginosa PA01
agugccaugaagaagcucggca

SEQ ID NO: 168889 - RNA, 20 nt, Pseudomonas aeruginosa PA01
cggccagcgccugcugcucg

SEQ ID NO: 168890 - RNA, 22 nt, Pseudomonas aeruginosa PA01
ucgccgccgaccucguggcgga

SEQ ID NO: 168891 - RNA, 22 nt, Pseudomonas aeruginosa PA01
ggaucguccgggguggucuugc

SEQ ID NO: 168892 - RNA, 22 nt, Pseudomonas aeruginosa PA01
ggccgucgagguagugauugau

SEQ ID NO: 168893 - RNA, 22 nt, Pseudomonas aeruginosa PA01
gcuggcggagaagugcggguug

SEQ ID NO: 168894 - RNA, 22 nt, Pseudomonas aeruginosa PA01
ggugcacguugagguuggugac

SEQ ID NO: 168895 - RNA, 22 nt, Pseudomonas aeruginosa PA01
cgccgcggccgccuugguuucc

SEQ ID NO: 168896 - RNA, 22 nt, Pseudomonas aeruginosa PA01
ugaccagguugugcccguccag

SEQ ID NO: 168897 - RNA, 22 nt, Pseudomonas aeruginosa PA01
uggcggaguucgucaccccgcu

SEQ ID NO: 168898 - RNA, 22 nt, Pseudomonas aeruginosa PA01
gcugcgcaaccaccagccagac

SEQ ID NO: 168899 - RNA, 19 nt, Pseudomonas aeruginosa PA01
gucgaugcagaccaccaac

SEQ ID NO: 168900 - RNA, 19 nt, Pseudomonas aeruginosa PA01
aggaaggccgcuucgccgc

SEQ ID NO: 168901 - RNA, 22 nt, Pseudomonas aeruginosa PA01
cagcuggaugcucgcgcucagc

SEQ ID NO: 168902 - RNA, 22 nt, Pseudomonas aeruginosa PA01
gccggucucgcggcggucgaag

SEQ ID NO: 168903 - RNA, 22 nt, Pseudomonas aeruginosa PA01
gagggcguaccgccgauggcgc

SEQ ID NO: 168904 - RNA, 22 nt, Pseudomonas aeruginosa PA01
ccaggcguucggcauucuggcu

SEQ ID NO: 168905 - RNA, 22 nt, Pseudomonas aeruginosa PA01
aucgagaucgaggucggcuggg

SEQ ID NO: 168906 - RNA, 22 nt, Pseudomonas aeruginosa PA01
ucgagcaccgcgcccugggcca

SEQ ID NO: 168907 - RNA, 22 nt, Pseudomonas aeruginosa PA01
ucggucucguaggcguagaagc

SEQ ID NO: 168908 - RNA, 22 nt, Pseudomonas aeruginosa PA01
gcgccgcggaucgccaucgagg

SEQ ID NO: 168909 - RNA, 22 nt, Pseudomonas aeruginosa PA01
ucgccggguuggucagccaggc

SEQ ID NO: 168910 - RNA, 22 nt, Pseudomonas aeruginosa PA01
gggcggcuugcaggaaggcuuc

SEQ ID NO: 168911 - RNA, 22 nt, Pseudomonas aeruginosa PA01
agggaguuuguccgcaggcugu

SEQ ID NO: 168912 - RNA, 22 nt, Pseudomonas aeruginosa PA01
aagcccuuggcgucgcgcaccg

SEQ ID NO: 168913 - RNA, 22 nt, Pseudomonas aeruginosa PA01
uggcgccgguagaggaacacgc

SEQ ID NO: 168914 - RNA, 22 nt, Pseudomonas aeruginosa PA01
gcucgguggcgccgagcaucac

SEQ ID NO: 168915 - RNA, 22 nt, Pseudomonas aeruginosa PA01
ggcccuggcgaugcgcuggcug

SEQ ID NO: 168916 - RNA, 22 nt, Pseudomonas aeruginosa PA01
uugccgcgcaggcagauaccgu

SEQ ID NO: 168917 - RNA, 22 nt, Pseudomonas aeruginosa PA01
uuguugcuggccaguuggccgg

SEQ ID NO: 168918 - RNA, 22 nt, Pseudomonas aeruginosa PA01
ugcuccaguugcgccaguucca

SEQ ID NO: 168919 - RNA, 22 nt, Pseudomonas aeruginosa PA01
gucguugcaggcgcccggcgag

SEQ ID NO: 168920 - RNA, 22 nt, Pseudomonas aeruginosa PA01
ccgacgaggccgaugcggccga

SEQ ID NO: 168921 - RNA, 22 nt, Pseudomonas aeruginosa PA01
caguugcgcggucagcgcggua

SEQ ID NO: 168922 - RNA, 21 nt, Pseudomonas aeruginosa PA01
cgcgguguagugcagguggug

SEQ ID NO: 168923 - RNA, 22 nt, Pseudomonas aeruginosa PA01
ggucuacgggaugaccgagaac

SEQ ID NO: 168924 - RNA, 22 nt, Pseudomonas aeruginosa PA01
cggcggcgaacugcaacgcgug

SEQ ID NO: 168925 - RNA, 23 nt, Pseudomonas aeruginosa PA01
ggaugcugucgacccgcucgcgc

SEQ ID NO: 168926 - RNA, 22 nt, Pseudomonas aeruginosa PA01
cuugccgccgacaucgcugaug

SEQ ID NO: 168927 - RNA, 22 nt, Pseudomonas aeruginosa PA01
cgcggcgggguauugcccaggg

SEQ ID NO: 168928 - RNA, 19 nt, Pseudomonas aeruginosa PA01
uccuccacguggcgccgcu

SEQ ID NO: 168929 - RNA, 22 nt, Pseudomonas aeruginosa PA01
ucgccgcuuugcggaugcacgc

SEQ ID NO: 168930 - RNA, 22 nt, Pseudomonas aeruginosa PA01
ugagcuugcgcaggcguuccca

SEQ ID NO: 168931 - RNA, 22 nt, Pseudomonas aeruginosa PA01
cucgcggaggaauucgggguug

SEQ ID NO: 168932 - RNA, 22 nt, Pseudomonas aeruginosa PA01
cacgcugucgacgacgaagccg

SEQ ID NO: 168933 - RNA, 20 nt, Pseudomonas aeruginosa PA01
ccauaugagugagcuggcca

SEQ ID NO: 168934 - RNA, 22 nt, Pseudomonas aeruginosa PA01
cggaucgccugcagaagccggu

SEQ ID NO: 168935 - RNA, 23 nt, Pseudomonas aeruginosa PA01
ugugcagcagcucggccggcagc

SEQ ID NO: 168936 - RNA, 22 nt, Pseudomonas aeruginosa PA01
cgaccggccacgccuuuccagc

SEQ ID NO: 168937 - RNA, 22 nt, Pseudomonas aeruginosa PA01
cagaccucugccugccguguau

SEQ ID NO: 168938 - RNA, 22 nt, Pseudomonas aeruginosa PA01
ugcgccaggcgcuggcacuggu

SEQ ID NO: 168939 - RNA, 22 nt, Pseudomonas aeruginosa PA01
acaucgagaauggcgcggcccu

SEQ ID NO: 168940 - RNA, 22 nt, Pseudomonas aeruginosa PA01
guagggcagcagcccguacagc

SEQ ID NO: 168941 - RNA, 22 nt, Pseudomonas aeruginosa PA01
ugcacgcggaacuucaggccgc

SEQ ID NO: 168942 - RNA, 17 nt, Pseudomonas aeruginosa PA01
ggccgacagcgggcgga

SEQ ID NO: 168943 - RNA, 22 nt, Pseudomonas aeruginosa PA01
uccgccggcggguugcgccaga

SEQ ID NO: 168944 - RNA, 21 nt, Pseudomonas aeruginosa PA01
uggauaccaagguccgccagc

SEQ ID NO: 168945 - RNA, 18 nt, Pseudomonas aeruginosa PA01
ucgaggguggccugcagc

SEQ ID NO: 168946 - RNA, 22 nt, Pseudomonas aeruginosa PA01
ccauggccgcgcuguucgccaa

SEQ ID NO: 168947 - RNA, 22 nt, Pseudomonas aeruginosa PA01
uugcgcgggcagacgcugggcg

SEQ ID NO: 168948 - RNA, 22 nt, Pseudomonas aeruginosa PA01
cggccugcuggcuaucggucaa

SEQ ID NO: 168949 - RNA, 21 nt, Pseudomonas aeruginosa PA01
ucgauggcgucgccgaucggc

SEQ ID NO: 168950 - RNA, 22 nt, Pseudomonas aeruginosa PA01
guggcccaggccggacagacca

SEQ ID NO: 168951 - RNA, 22 nt, Pseudomonas aeruginosa PA01
ucgcgguguagucgggguuguc

SEQ ID NO: 168952 - RNA, 22 nt, Pseudomonas aeruginosa PA01
ggcccaacgccugcggcaaguc

SEQ ID NO: 168953 - RNA, 22 nt, Pseudomonas aeruginosa PA01
ggcggcaugcucgaucgccugc

SEQ ID NO: 168954 - RNA, 22 nt, Pseudomonas aeruginosa PA01
ucggcggccagccgccgggcaa

SEQ ID NO: 168955 - RNA, 22 nt, Pseudomonas aeruginosa PA01
aggcucaggcaggccgccggca

SEQ ID NO: 168956 - RNA, 22 nt, Pseudomonas aeruginosa PA01
agcuuccagaucggcgagcgga

SEQ ID NO: 168957 - RNA, 22 nt, Pseudomonas aeruginosa PA01
ugucguugggcagaccgcgcag

SEQ ID NO: 168958 - RNA, 22 nt, Pseudomonas aeruginosa PA01
gccggcgugcucgaagcguucg

SEQ ID NO: 168959 - RNA, 22 nt, Pseudomonas aeruginosa PA01
ugugcuugucggucauggcugu

SEQ ID NO: 168960 - RNA, 22 nt, Pseudomonas aeruginosa PA01
ucgcggucgaccagcgcuggug

SEQ ID NO: 168961 - RNA, 22 nt, Pseudomonas aeruginosa PA01
ggaagguggcgaugcgcucguc

SEQ ID NO: 168962 - RNA, 22 nt, Pseudomonas aeruginosa PA01
cgguggucgauucgcugaacau

SEQ ID NO: 168963 - RNA, 22 nt, Pseudomonas aeruginosa PA01
gaucgcucggcgggguuucgcu

SEQ ID NO: 168964 - RNA, 22 nt, Pseudomonas aeruginosa PA01
uccaggugagcgcagcccgacg

SEQ ID NO: 168965 - RNA, 22 nt, Pseudomonas aeruginosa PA01
cccucgacguuggcgcucuucg

SEQ ID NO: 168966 - RNA, 22 nt, Pseudomonas aeruginosa PA01
uaaccgcaggcgguuauucgcc

SEQ ID NO: 168967 - RNA, 22 nt, Pseudomonas aeruginosa PA01
cgagcaccaucgacaggaccug

SEQ ID NO: 168968 - RNA, 22 nt, Pseudomonas aeruginosa PA01
aggucuaccgucaguucgccga

SEQ ID NO: 168969 - RNA, 22 nt, Pseudomonas aeruginosa PA01
cggccauggucucgcugaccca

SEQ ID NO: 168970 - RNA, 22 nt, Pseudomonas aeruginosa PA01
cgucggccuguggaucgccgcc

SEQ ID NO: 168971 - RNA, 22 nt, Pseudomonas aeruginosa PA01
ugauccgcggcaggcgcugcag

SEQ ID NO: 168972 - RNA, 22 nt, Pseudomonas aeruginosa PA01
auggcgaccugagccguccgcg

SEQ ID NO: 168973 - RNA, 22 nt, Pseudomonas aeruginosa PA01
cgaggaaguugaggauggcguu

SEQ ID NO: 168974 - RNA, 22 nt, Pseudomonas aeruginosa PA01
cgggcgcaucgcucucaguucc

SEQ ID NO: 168975 - RNA, 22 nt, Pseudomonas aeruginosa PA01
ggcuggcgauugcuguuaccau

SEQ ID NO: 168976 - RNA, 22 nt, Pseudomonas aeruginosa PA01
uggcgucgaggcuuucggcgac

SEQ ID NO: 168977 - RNA, 22 nt, Pseudomonas aeruginosa PA01
aaggcuaucuguucggccgccc

SEQ ID NO: 168978 - RNA, 22 nt, Pseudomonas aeruginosa PA01
cuguggauaacucugugagcaa

SEQ ID NO: 168979 - RNA, 22 nt, Pseudomonas aeruginosa PA01
gcggucguugauguacuugaag

SEQ ID NO: 168980 - RNA, 22 nt, Pseudomonas aeruginosa PA01
ggcggcuugcuggcgaucccgg

SEQ ID NO: 168981 - RNA, 20 nt, Pseudomonas aeruginosa PA01
ccggucaucuuguugcggcg

SEQ ID NO: 168982 - RNA, 22 nt, Pseudomonas aeruginosa PA01
ccuggcccaggugcugcagcca

SEQ ID NO: 168983 - RNA, 22 nt, Pseudomonas aeruginosa PA01
gucguagcuguccagcgccagg

SEQ ID NO: 168984 - RNA, 22 nt, Pseudomonas aeruginosa PA01
cgguucagaaacuggccggcgc

SEQ ID NO: 168985 - RNA, 22 nt, Pseudomonas aeruginosa PA01
acaaggccgcgaugcgcccgcc

SEQ ID NO: 168986 - RNA, 22 nt, Pseudomonas aeruginosa PA01
ggcuacguggggcuggaggucg

SEQ ID NO: 168987 - RNA, 22 nt, Pseudomonas aeruginosa PA01
uucggcauggaccaggucgaag

SEQ ID NO: 168988 - RNA, 22 nt, Pseudomonas aeruginosa PA01
cuccugggagagaauccguaaa

SEQ ID NO: 168989 - RNA, 22 nt, Pseudomonas aeruginosa PA01
aggcugauggcauccacgccau

SEQ ID NO: 168990 - RNA, 23 nt, Pseudomonas aeruginosa PA01
ggucggcggccucugguugcugc

SEQ ID NO: 168991 - RNA, 22 nt, Pseudomonas aeruginosa PA01
gguugcgcuuguccuggcgcga

SEQ ID NO: 168992 - RNA, 22 nt, Pseudomonas aeruginosa PA01
ccggagcgcccgggccuucguc

SEQ ID NO: 168993 - RNA, 22 nt, Pseudomonas aeruginosa PA01
cgucauccagcaggcaggcguc

SEQ ID NO: 168994 - RNA, 22 nt, Pseudomonas aeruginosa PA01
accuggcgcgggucgccuacca

SEQ ID NO: 168995 - RNA, 22 nt, Pseudomonas aeruginosa PA01
gccacuccucguuccaggcuga

SEQ ID NO: 168996 - RNA, 22 nt, Pseudomonas aeruginosa PA01
ccuggacuuccugcucggcgac

SEQ ID NO: 168997 - RNA, 20 nt, Pseudomonas aeruginosa PA01
gcaccgucugcgucgagguc

SEQ ID NO: 168998 - RNA, 22 nt, Pseudomonas aeruginosa PA01
ccuggugcugcuggccggcaug

SEQ ID NO: 168999 - RNA, 22 nt, Pseudomonas aeruginosa PA01
cgcugcugaucggcuucgccgg

SEQ ID NO: 169000 - RNA, 19 nt, Pseudomonas aeruginosa PA01
uccagcgccgggccggugc

SEQ ID NO: 169001 - RNA, 22 nt, Pseudomonas aeruginosa PA01
agcgcgaggagauggucgaggu

SEQ ID NO: 169002 - RNA, 22 nt, Pseudomonas aeruginosa PA01
gaggacggcgaaacgccugcca

SEQ ID NO: 169003 - RNA, 22 nt, Pseudomonas aeruginosa PA01
ucggcgccaccgcuucgagcac

SEQ ID NO: 169004 - RNA, 21 nt, Pseudomonas aeruginosa PA01
gcgggcguccaacugcgccug

SEQ ID NO: 169005 - RNA, 22 nt, Pseudomonas aeruginosa PA01
ggcagcuucgaccgcccguucg

SEQ ID NO: 169006 - RNA, 22 nt, Pseudomonas aeruginosa PA01
cugcggauuggaagaugucugg

SEQ ID NO: 169007 - RNA, 19 nt, Pseudomonas aeruginosa PA01
ucgccgguggaccugguca

SEQ ID NO: 169008 - RNA, 23 nt, Pseudomonas aeruginosa PA01
gggccaggcgcugcugcacgccg

SEQ ID NO: 169009 - RNA, 22 nt, Pseudomonas aeruginosa PA01
ugcgcgguugcgguuggcucau

SEQ ID NO: 169010 - RNA, 23 nt, Pseudomonas aeruginosa PA01
gaggccgcgcgacgucuuugucg

SEQ ID NO: 169011 - RNA, 22 nt, Pseudomonas aeruginosa PA01
ugucggcgacggucuucgagga

SEQ ID NO: 169012 - RNA, 22 nt, Pseudomonas aeruginosa PA01
ccgguccagaacgccgaacugg

SEQ ID NO: 169013 - RNA, 22 nt, Pseudomonas aeruginosa PA01
accacgagaccgaccagcaggc

SEQ ID NO: 169014 - RNA, 22 nt, Pseudomonas aeruginosa PA01
ccgaggguaacgaugucggcgc

SEQ ID NO: 169015 - RNA, 20 nt, Pseudomonas aeruginosa PA01
ggcgccggggcgguaguguc

SEQ ID NO: 169016 - RNA, 22 nt, Pseudomonas aeruginosa PA01
uggccaugauguucaccgccac

SEQ ID NO: 169017 - RNA, 22 nt, Pseudomonas aeruginosa PA01
cgacgaugcuggccggguugaa

SEQ ID NO: 169018 - RNA, 22 nt, Pseudomonas aeruginosa PA01
ugucgccuucacgcccggcgcg

SEQ ID NO: 169019 - RNA, 22 nt, Pseudomonas aeruginosa PA01
cccgcugaguccaccagaaccc

SEQ ID NO: 169020 - RNA, 22 nt, Pseudomonas aeruginosa PA01
cggcgguuguucauguagggcu

SEQ ID NO: 169021 - RNA, 22 nt, Pseudomonas aeruginosa PA01
cagaacggcgucugccagaccu

SEQ ID NO: 169022 - RNA, 22 nt, Pseudomonas aeruginosa PA01
ggcgaucgccuacucgccgagc

SEQ ID NO: 169023 - RNA, 22 nt, Pseudomonas aeruginosa PA01
gugccugguauggcaacccucu

SEQ ID NO: 169024 - RNA, 22 nt, Pseudomonas aeruginosa PA01
augaagcgcaugucgcgauccu

SEQ ID NO: 169025 - RNA, 22 nt, Pseudomonas aeruginosa PA01
aucgacggcggauuggugaagg

SEQ ID NO: 169026 - RNA, 22 nt, Pseudomonas aeruginosa PA01
gcgcgcgagaaagcggucggug

SEQ ID NO: 169027 - RNA, 22 nt, Pseudomonas aeruginosa PA01
uucgccgacaugccggcggagu

SEQ ID NO: 169028 - RNA, 22 nt, Pseudomonas aeruginosa PA01
cagggcuacggcgagcguaccg

SEQ ID NO: 169029 - RNA, 22 nt, Pseudomonas aeruginosa PA01
ccgguucuccagcaccaggcgg

SEQ ID NO: 169030 - RNA, 22 nt, Pseudomonas aeruginosa PA01
auggaucgggcgcuggucgaug

SEQ ID NO: 169031 - RNA, 23 nt, Pseudomonas aeruginosa PA01
cguccuucugcucggccagcagg

SEQ ID NO: 169032 - RNA, 22 nt, Pseudomonas aeruginosa PA01
ggcgaucaucacguuggccgag

SEQ ID NO: 169033 - RNA, 22 nt, Pseudomonas aeruginosa PA01
cugcgccugcgccgcgaacugg

SEQ ID NO: 169034 - RNA, 22 nt, Pseudomonas aeruginosa PA01
ugcguacggcauccagccccuu

SEQ ID NO: 169035 - RNA, 22 nt, Pseudomonas aeruginosa PA01
ucgaggucgcucggggcuucca

SEQ ID NO: 169036 - RNA, 22 nt, Pseudomonas aeruginosa PA01
gcccggcuucccggcggaaagu

SEQ ID NO: 169037 - RNA, 22 nt, Pseudomonas aeruginosa PA01
cgccgugguggaagaggccgau

SEQ ID NO: 169038 - RNA, 22 nt, Pseudomonas aeruginosa PA01
agcgacaaguaucgguggaguu

SEQ ID NO: 169039 - RNA, 22 nt, Pseudomonas aeruginosa PA01
ugcugcggcauggcggcauccu

SEQ ID NO: 169040 - RNA, 21 nt, Pseudomonas aeruginosa PA01
gucuucguccuucaucccggu

SEQ ID NO: 169041 - RNA, 19 nt, Pseudomonas aeruginosa PA01
ugcagcggcgggugguggc

SEQ ID NO: 169042 - RNA, 22 nt, Pseudomonas aeruginosa PA01
gucggggcgaacguagcggccg

SEQ ID NO: 169043 - RNA, 22 nt, Pseudomonas aeruginosa PA01
ggcucgcgagcgccagggcaac

SEQ ID NO: 169044 - RNA, 22 nt, Pseudomonas aeruginosa PA01
cccgaccugaagcaccgggcug

SEQ ID NO: 169045 - RNA, 22 nt, Pseudomonas aeruginosa PA01
guggaaaucgucgucgagucca

SEQ ID NO: 169046 - RNA, 22 nt, Pseudomonas aeruginosa PA01
gccuugaacuguuccucgagca

SEQ ID NO: 169047 - RNA, 22 nt, Pseudomonas aeruginosa PA01
gccggggcgcucgaccuggagg

SEQ ID NO: 169048 - RNA, 22 nt, Pseudomonas aeruginosa PA01
gcgcgugcauuggcuggccggc

SEQ ID NO: 169049 - RNA, 22 nt, Pseudomonas aeruginosa PA01
ggucgcgguucucgaucagggc

SEQ ID NO: 169050 - RNA, 22 nt, Pseudomonas aeruginosa PA01
cuggcgguggcuuucgguccau

SEQ ID NO: 169051 - RNA, 22 nt, Pseudomonas aeruginosa PA01
ccuuccaggccccagaccgagu

SEQ ID NO: 169052 - RNA, 22 nt, Pseudomonas aeruginosa PA01
gagcuguuucucguggcccugc

SEQ ID NO: 169053 - RNA, 22 nt, Pseudomonas aeruginosa PA01
cgacccgccaggcgcugggcga

SEQ ID NO: 169054 - RNA, 22 nt, Pseudomonas aeruginosa PA01
aggaucuugugcuugacgaacu

SEQ ID NO: 169055 - RNA, 22 nt, Pseudomonas aeruginosa PA01
ucggcaaaggauagccgcgugg

SEQ ID NO: 169056 - RNA, 22 nt, Pseudomonas aeruginosa PA01
agcuccaggcgcggcgaaccga

SEQ ID NO: 169057 - RNA, 20 nt, Pseudomonas aeruginosa PA01
ugccaggugauagccggcca

SEQ ID NO: 169058 - RNA, 22 nt, Pseudomonas aeruginosa PA01
cccgacauucugcgccuaaguu

SEQ ID NO: 169059 - RNA, 22 nt, Pseudomonas aeruginosa PA01
uccagggcgugcaacaggaccu

SEQ ID NO: 169060 - RNA, 22 nt, Pseudomonas aeruginosa PA01
gcacgggagugccggagguauu

SEQ ID NO: 169061 - RNA, 22 nt, Pseudomonas aeruginosa PA01
caggaguucggcggcgcgcucg

SEQ ID NO: 169062 - RNA, 22 nt, Pseudomonas aeruginosa PA01
cuuccagcgcucgcugcgcacc

SEQ ID NO: 169063 - RNA, 22 nt, Pseudomonas aeruginosa PA01
gccuguuucaguugucaugccc

SEQ ID NO: 169064 - RNA, 22 nt, Pseudomonas aeruginosa PA01
cccgccagcucaugcuggaugc

SEQ ID NO: 169065 - RNA, 22 nt, Pseudomonas aeruginosa PA01
agcccguggagaaggcccggag

SEQ ID NO: 169066 - RNA, 22 nt, Pseudomonas aeruginosa PA01
ucggcgagaucggcgauggccu

SEQ ID NO: 169067 - RNA, 22 nt, Pseudomonas aeruginosa PA01
gaucgaggcggcggccacgcuc

SEQ ID NO: 169068 - RNA, 22 nt, Pseudomonas aeruginosa PA01
cggcgaaaacaccagccuuuca

SEQ ID NO: 169069 - RNA, 22 nt, Pseudomonas aeruginosa PA01
ucggcguagccagccucguguc

SEQ ID NO: 169070 - RNA, 22 nt, Pseudomonas aeruginosa PA01
cggcguugcugguggcccaggg

SEQ ID NO: 169071 - RNA, 22 nt, Pseudomonas aeruginosa PA01
cgcgcaggcgguacaggcggcu

SEQ ID NO: 169072 - RNA, 22 nt, Pseudomonas aeruginosa PA01
cgccaugagcgugccggaggcg

SEQ ID NO: 169073 - RNA, 22 nt, Pseudomonas aeruginosa PA01
augcgcgguaggcgcaucuucg

SEQ ID NO: 169074 - RNA, 22 nt, Pseudomonas aeruginosa PA01
uggcggauccgcugcugauggu

SEQ ID NO: 169075 - RNA, 20 nt, Pseudomonas aeruginosa PA01
agccuggcgcggguccgcuu

SEQ ID NO: 169076 - RNA, 23 nt, Pseudomonas aeruginosa PA01
ugccuucucggcccaggccgagu

SEQ ID NO: 169077 - RNA, 22 nt, Pseudomonas aeruginosa PA01
augcuguucuuucacagcaucg

SEQ ID NO: 169078 - RNA, 22 nt, Pseudomonas aeruginosa PA01
uuggcggccgucgcgcaccacc

SEQ ID NO: 169079 - RNA, 22 nt, Pseudomonas aeruginosa PA01
ggcguuccgccuaccugguguu

SEQ ID NO: 169080 - RNA, 22 nt, Pseudomonas aeruginosa PA01
auccacaacauauuguuguuuu

SEQ ID NO: 169081 - RNA, 22 nt, Pseudomonas aeruginosa PA01
augucgaggaagaccaggcgau

SEQ ID NO: 169082 - RNA, 22 nt, Pseudomonas aeruginosa PA01
ccagccugaccagccuggccac

SEQ ID NO: 169083 - RNA, 22 nt, Pseudomonas aeruginosa PA01
acuaccugggugccgagccggg

SEQ ID NO: 169084 - RNA, 22 nt, Pseudomonas aeruginosa PA01
ggcaucaggccgacgcgcuuga

SEQ ID NO: 169085 - RNA, 22 nt, Pseudomonas aeruginosa PA01
cgccgcuggcgcuguucgcccu

SEQ ID NO: 169086 - RNA, 22 nt, Pseudomonas aeruginosa PA01
gccggcugggucaguugcaggc

SEQ ID NO: 169087 - RNA, 22 nt, Pseudomonas aeruginosa PA01
uggaaauggucgacgcggugcu

SEQ ID NO: 169088 - RNA, 22 nt, Pseudomonas aeruginosa PA01
gcucggugccgagguggcccug

SEQ ID NO: 169089 - RNA, 22 nt, Pseudomonas aeruginosa PA01
accagggcggcgcgguuuuccu

SEQ ID NO: 169090 - RNA, 22 nt, Pseudomonas aeruginosa PA01
gcuguucggggugaucuggcca

SEQ ID NO: 169091 - RNA, 22 nt, Pseudomonas aeruginosa PA01
cgaaggucacgucgacgcaggg

SEQ ID NO: 169092 - RNA, 22 nt, Pseudomonas aeruginosa PA01
gggcgcgggugcgguagaacga

SEQ ID NO: 169093 - RNA, 22 nt, Pseudomonas aeruginosa PA01
agcaugccguugcucaggacga

SEQ ID NO: 169094 - RNA, 22 nt, Pseudomonas aeruginosa PA01
uucgucgagggguuugacgaaa

SEQ ID NO: 169095 - RNA, 22 nt, Pseudomonas aeruginosa PA01
ggcacggcgaucaggcgggccu

SEQ ID NO: 169096 - RNA, 22 nt, Pseudomonas aeruginosa PA01
uugcugaaggauaugcguggaa

SEQ ID NO: 169097 - RNA, 22 nt, Pseudomonas aeruginosa PA01
uucuguuccaggagcgguacca

SEQ ID NO: 169098 - RNA, 22 nt, Pseudomonas aeruginosa PA01
ugccuucacuucgucgaugacg

SEQ ID NO: 169099 - RNA, 22 nt, Pseudomonas aeruginosa PA01
cgguuggccgagaugcugcugg

SEQ ID NO: 169100 - RNA, 22 nt, Pseudomonas aeruginosa PA01
cuuccucgguaucggcaucgug

SEQ ID NO: 169101 - RNA, 22 nt, Pseudomonas aeruginosa PA01
ggagggcgccagcgaggugccg

SEQ ID NO: 169102 - RNA, 22 nt, Pseudomonas aeruginosa PA01
ugcugaucaugcccaucaccgc

SEQ ID NO: 169103 - RNA, 22 nt, Pseudomonas aeruginosa PA01
gccgccgggccgccgcugacuu

SEQ ID NO: 169104 - RNA, 22 nt, Pseudomonas aeruginosa PA01
gccaucgccgcgaucuggcugu

SEQ ID NO: 169105 - RNA, 22 nt, Pseudomonas aeruginosa PA01
acgguggaacuggugguggccg

SEQ ID NO: 169106 - RNA, 21 nt, Pseudomonas aeruginosa PA01
gaugccgaucuucaggucguc

SEQ ID NO: 169107 - RNA, 22 nt, Pseudomonas aeruginosa PA01
cuuguuggugaagucgaccgaa

SEQ ID NO: 169108 - RNA, 22 nt, Pseudomonas aeruginosa PA01
ggcaugagcauucucgagcgcg

SEQ ID NO: 169109 - RNA, 22 nt, Pseudomonas aeruginosa PA01
ggccugccugcuguuucccggc

SEQ ID NO: 169110 - RNA, 22 nt, Pseudomonas aeruginosa PA01
cgcgugcgaugaccggagggau

SEQ ID NO: 169111 - RNA, 22 nt, Pseudomonas aeruginosa PA01
gcgagguugccgcacggcaggg

SEQ ID NO: 169112 - RNA, 22 nt, Pseudomonas aeruginosa PA01
gacccgcuugagccauucggcu

SEQ ID NO: 169113 - RNA, 21 nt, Pseudomonas aeruginosa PA01
cucaccugccugucggucggc

SEQ ID NO: 169114 - RNA, 22 nt, Pseudomonas aeruginosa PA01
ugcucgaagucggcgccgucuc

SEQ ID NO: 169115 - RNA, 22 nt, Pseudomonas aeruginosa PA01
acgugcggcaagggcggcgcaa

SEQ ID NO: 169116 - RNA, 22 nt, Pseudomonas aeruginosa PA01
agaggaaagugcccggguccug

SEQ ID NO: 169117 - RNA, 22 nt, Pseudomonas aeruginosa PA01
gaaggcaugaucuugaggcaca

SEQ ID NO: 169118 - RNA, 22 nt, Pseudomonas aeruginosa PA01
ggcuucgacgccgcuguagccg

SEQ ID NO: 169119 - RNA, 22 nt, Pseudomonas aeruginosa PA01
aucggcgaacaggaucgcgcag

SEQ ID NO: 169120 - RNA, 22 nt, Pseudomonas aeruginosa PA01
cuccaggcgcuggcggaggaaa

SEQ ID NO: 169121 - RNA, 22 nt, Pseudomonas aeruginosa PA01
gcugguggagguccgcgccauc

SEQ ID NO: 169122 - RNA, 22 nt, Pseudomonas aeruginosa PA01
agccgguaguagaggucagcgc

SEQ ID NO: 169123 - RNA, 22 nt, Pseudomonas aeruginosa PA01
agggcgaauaaccgcucgcggu

SEQ ID NO: 169124 - RNA, 22 nt, Pseudomonas aeruginosa PA01
aucggcgaucagcacaucggcc

SEQ ID NO: 169125 - RNA, 22 nt, Pseudomonas aeruginosa PA01
gggcgcaguccgguggccuucc

SEQ ID NO: 169126 - RNA, 22 nt, Pseudomonas aeruginosa PA01
ugucugggaaaccgccccgguc

SEQ ID NO: 169127 - RNA, 22 nt, Pseudomonas aeruginosa PA01
ugaggucgaugcguggggugcu

SEQ ID NO: 169128 - RNA, 22 nt, Pseudomonas aeruginosa PA01
ugcagcggaucgagcaggccga

SEQ ID NO: 169129 - RNA, 22 nt, Pseudomonas aeruginosa PA01
agcgccaguaccgggcggccgc

SEQ ID NO: 169130 - RNA, 22 nt, Pseudomonas aeruginosa PA01
gugccgcagguaaugagccguc

SEQ ID NO: 169131 - RNA, 22 nt, Pseudomonas aeruginosa PA01
ggugcgguuggccgccggcuug

SEQ ID NO: 169132 - RNA, 22 nt, Pseudomonas aeruginosa PA01
augccgaaggcgaucgaggcga

SEQ ID NO: 169133 - RNA, 22 nt, Pseudomonas aeruginosa PA01
cgacaagggcagcguguccguc

SEQ ID NO: 169134 - RNA, 22 nt, Pseudomonas aeruginosa PA01
gcugguguucuggcgcgugcug

SEQ ID NO: 169135 - RNA, 22 nt, Pseudomonas aeruginosa PA01
caggcgcugcaugauccacagu

SEQ ID NO: 169136 - RNA, 22 nt, Pseudomonas aeruginosa PA01
acgcugccuuccaggccgucgc

SEQ ID NO: 169137 - RNA, 21 nt, Pseudomonas aeruginosa PA01
gcugggaccccgagguggucg

SEQ ID NO: 169138 - RNA, 22 nt, Pseudomonas aeruginosa PA01
cccggcgucuacguggucgccg

SEQ ID NO: 169139 - RNA, 22 nt, Pseudomonas aeruginosa PA01
cuggcccugguggcggcgcccc

SEQ ID NO: 169140 - RNA, 22 nt, Pseudomonas aeruginosa PA01
cggccucggccccaugagcgag

SEQ ID NO: 169141 - RNA, 22 nt, Pseudomonas aeruginosa PA01
cguugcacggucuuugcggggu

SEQ ID NO: 169142 - RNA, 22 nt, Pseudomonas aeruginosa PA01
gcucggggaucuucgcccagac

SEQ ID NO: 169143 - RNA, 22 nt, Pseudomonas aeruginosa PA01
caggugauccucaacguggugg

SEQ ID NO: 169144 - RNA, 18 nt, Pseudomonas aeruginosa PA01
ucgaggucguagaaggug

SEQ ID NO: 169145 - RNA, 22 nt, Pseudomonas aeruginosa PA01
ucguuggcuucguuggccuggc

SEQ ID NO: 169146 - RNA, 22 nt, Pseudomonas aeruginosa PA01
gagcuggaagugcucgcggugc

SEQ ID NO: 169147 - RNA, 22 nt, Pseudomonas aeruginosa PA01
aucggcagcgggucgucggcgu

SEQ ID NO: 169148 - RNA, 22 nt, Pseudomonas aeruginosa PA01
agcgcggcaagauguucggcuu

SEQ ID NO: 169149 - RNA, 22 nt, Pseudomonas aeruginosa PA01
gcggaauggcugucgccccaac

SEQ ID NO: 169150 - RNA, 22 nt, Pseudomonas aeruginosa PA01
ugcggccagugcggcuucaucg

SEQ ID NO: 169151 - RNA, 22 nt, Pseudomonas aeruginosa PA01
ucaggucgacggucucggugug

SEQ ID NO: 169152 - RNA, 22 nt, Pseudomonas aeruginosa PA01
ucgcccacgcggaaggccuugc

SEQ ID NO: 169153 - RNA, 22 nt, Pseudomonas aeruginosa PA01
ggugaaugcuucgcggaugcgg

SEQ ID NO: 169154 - RNA, 22 nt, Pseudomonas aeruginosa PA01
auaaccgagcaggggcaggcug

SEQ ID NO: 169155 - RNA, 22 nt, Pseudomonas aeruginosa PA01
caccacgguggauuuccucgag

SEQ ID NO: 169156 - RNA, 22 nt, Pseudomonas aeruginosa PA01
gccguggaagcucgccacgccg

SEQ ID NO: 169157 - RNA, 22 nt, Pseudomonas aeruginosa PA01
gaggucgaucuggcccuugacc

SEQ ID NO: 169158 - RNA, 22 nt, Pseudomonas aeruginosa PA01
cgucguccaucucgcagcgguc

SEQ ID NO: 169159 - RNA, 22 nt, Pseudomonas aeruginosa PA01
uugccugcuguuccuugccugc

SEQ ID NO: 169160 - RNA, 22 nt, Pseudomonas aeruginosa PA01
cgccgagcauggcuacgaggag

SEQ ID NO: 169161 - RNA, 22 nt, Pseudomonas aeruginosa PA01
acagguugaggacgauggcgac

SEQ ID NO: 169162 - RNA, 22 nt, Pseudomonas aeruginosa PA01
cccggcgggcaccuguguggcc

SEQ ID NO: 169163 - RNA, 22 nt, Pseudomonas aeruginosa PA01
ugcuccaggucugcgugccccc

SEQ ID NO: 169164 - RNA, 22 nt, Pseudomonas aeruginosa PA01
ucggcggcgaaguguuguggcc

SEQ ID NO: 169165 - RNA, 23 nt, Pseudomonas aeruginosa PA01
cggucgaagaugaucaggcgaac

SEQ ID NO: 169166 - RNA, 22 nt, Pseudomonas aeruginosa PA01
gugcgcgaccugcugagaaagg

SEQ ID NO: 169167 - RNA, 22 nt, Pseudomonas aeruginosa PA01
cggcgaagacgaacagcgcgcc

SEQ ID NO: 169168 - RNA, 22 nt, Pseudomonas aeruginosa PA01
caggcggaaguuaucgagcccg

SEQ ID NO: 169169 - RNA, 22 nt, Pseudomonas aeruginosa PA01
ugcucgaguggcuggccgaacc

SEQ ID NO: 169170 - RNA, 22 nt, Pseudomonas aeruginosa PA01
caccugcgcgacgcccagcgcu

SEQ ID NO: 169171 - RNA, 22 nt, Pseudomonas aeruginosa PA01
gagaucaggucgaucuugcuga

SEQ ID NO: 169172 - RNA, 22 nt, Pseudomonas aeruginosa PA01
gcacgcuggcguaggucauggu

SEQ ID NO: 169173 - RNA, 22 nt, Pseudomonas aeruginosa PA01
guuggugcaugggguucucccg

SEQ ID NO: 169174 - RNA, 22 nt, Pseudomonas aeruginosa PA01
gcuuuccaggcgcuccuccucg

SEQ ID NO: 169175 - RNA, 22 nt, Pseudomonas aeruginosa PA01
guucgucacucgucgaggaagg

SEQ ID NO: 169176 - RNA, 22 nt, Pseudomonas aeruginosa PA01
cagccugaaggacuggccggcg

SEQ ID NO: 169177 - RNA, 22 nt, Pseudomonas aeruginosa PA01
agguccuuggucgcggcgauga

SEQ ID NO: 169178 - RNA, 22 nt, Pseudomonas aeruginosa PA01
ggacaguugccaaucccgcagc

SEQ ID NO: 169179 - RNA, 22 nt, Pseudomonas aeruginosa PA01
ucacgcuugaacugcaugcggu

SEQ ID NO: 169180 - RNA, 22 nt, Pseudomonas aeruginosa PA01
agccuggcccaggucaagcgcc

SEQ ID NO: 169181 - RNA, 22 nt, Pseudomonas aeruginosa PA01
uucgaggugcuugauccagucc

SEQ ID NO: 169182 - RNA, 22 nt, Pseudomonas aeruginosa PA01
ggccgccaggcaagccuugccg

SEQ ID NO: 169183 - RNA, 22 nt, Pseudomonas aeruginosa PA01
uggagugaugggcuggccuguc

SEQ ID NO: 169184 - RNA, 22 nt, Pseudomonas aeruginosa PA01
augccgguuuccagggcgagac

SEQ ID NO: 169185 - RNA, 22 nt, Pseudomonas aeruginosa PA01
cggccagggcaaugucgaagcc

SEQ ID NO: 169186 - RNA, 22 nt, Pseudomonas aeruginosa PA01
uccgccagcucaccggcaccac

SEQ ID NO: 169187 - RNA, 22 nt, Pseudomonas aeruginosa PA01
gccgcgcaacugcugcugcaac

SEQ ID NO: 169188 - RNA, 22 nt, Pseudomonas aeruginosa PA01
ccgcuucccguggccaggagug

SEQ ID NO: 169189 - RNA, 22 nt, Pseudomonas aeruginosa PA01
ccgcgaugccuuccagcaggcu

SEQ ID NO: 169190 - RNA, 22 nt, Pseudomonas aeruginosa PA01
cccucgaagauccucauggccu

SEQ ID NO: 169191 - RNA, 22 nt, Pseudomonas aeruginosa PA01
gugccuggucgcuggccucgcg

SEQ ID NO: 169192 - RNA, 22 nt, Pseudomonas aeruginosa PA01
cgccggacagccgcgaugcacu

SEQ ID NO: 169193 - RNA, 22 nt, Pseudomonas aeruginosa PA01
guacgcugcggcuuggcgccga

SEQ ID NO: 169194 - RNA, 22 nt, Pseudomonas aeruginosa PA01
gcaucagucacccugcgccucc

SEQ ID NO: 169195 - RNA, 22 nt, Pseudomonas aeruginosa PA01
acggucgagcagcacgucgagg

SEQ ID NO: 169196 - RNA, 22 nt, Pseudomonas aeruginosa PA01
cggugcgccugccguuccugau

SEQ ID NO: 169197 - RNA, 22 nt, Pseudomonas aeruginosa PA01
ggcggauggcgcucauggucgc

SEQ ID NO: 169198 - RNA, 22 nt, Pseudomonas aeruginosa PA01
ucgggcagauccagcgccugcu

SEQ ID NO: 169199 - RNA, 22 nt, Pseudomonas aeruginosa PA01
ucggcaccagggcuucgcgcag

SEQ ID NO: 169200 - RNA, 22 nt, Pseudomonas aeruginosa PA01
ccuguccuucggcggcgacgaa

SEQ ID NO: 169201 - RNA, 20 nt, Pseudomonas aeruginosa PA01
cgacgcucagcucguugggc

SEQ ID NO: 169202 - RNA, 22 nt, Pseudomonas aeruginosa PA01
aucuggagcaacaggucgcggg

SEQ ID NO: 169203 - RNA, 22 nt, Pseudomonas aeruginosa PA01
gacggguugccgccgcuggccg

SEQ ID NO: 169204 - RNA, 22 nt, Pseudomonas aeruginosa PA01
acugcgucuaccuggacaucag

SEQ ID NO: 169205 - RNA, 22 nt, Pseudomonas aeruginosa PA01
ucggucgguugcgccggguagu

SEQ ID NO: 169206 - RNA, 22 nt, Pseudomonas aeruginosa PA01
ggcggcacgccuuccggcaccc

SEQ ID NO: 169207 - RNA, 22 nt, Pseudomonas aeruginosa PA01
gcuggcuuuccagcgcggcuuu

SEQ ID NO: 169208 - RNA, 22 nt, Pseudomonas aeruginosa PA01
cugaccucgcaacugccgcccg

SEQ ID NO: 169209 - RNA, 22 nt, Pseudomonas aeruginosa PA01
ucggucagcgguuccgggccga

SEQ ID NO: 169210 - RNA, 21 nt, Pseudomonas aeruginosa PA01
cugaccaugcgcaccaucucc

SEQ ID NO: 169211 - RNA, 22 nt, Pseudomonas aeruginosa PA01
caucgccuugaucccgcgcacc

SEQ ID NO: 169212 - RNA, 22 nt, Pseudomonas aeruginosa PA01
guacccuggccuguccggccag

SEQ ID NO: 169213 - RNA, 22 nt, Pseudomonas aeruginosa PA01
uucuucgcggcgaccuugguca

SEQ ID NO: 169214 - RNA, 22 nt, Pseudomonas aeruginosa PA01
ccucuacggcgugcucgcggug

SEQ ID NO: 169215 - RNA, 22 nt, Pseudomonas aeruginosa PA01
cguugcgcgcgaccauggcgaa

SEQ ID NO: 169216 - RNA, 22 nt, Pseudomonas aeruginosa PA01
agcagguuggucuggucggcga

SEQ ID NO: 169217 - RNA, 22 nt, Pseudomonas aeruginosa PA01
ucgccggucaagaccaugcauc

SEQ ID NO: 169218 - RNA, 22 nt, Pseudomonas aeruginosa PA01
uucaccuggacuucuggggcag

SEQ ID NO: 169219 - RNA, 23 nt, Pseudomonas aeruginosa PA01
ucggccgagccgaugguguagcc

SEQ ID NO: 169220 - RNA, 22 nt, Pseudomonas aeruginosa PA01
ccgucguaccugcgcauuccau

SEQ ID NO: 169221 - RNA, 22 nt, Pseudomonas aeruginosa PA01
ccuugcuggccgcagcccggac

SEQ ID NO: 169222 - RNA, 22 nt, Pseudomonas aeruginosa PA01
cuccugggucucccuggucacc

SEQ ID NO: 169223 - RNA, 22 nt, Pseudomonas aeruginosa PA01
augggcgaagagcacggcacag

SEQ ID NO: 169224 - RNA, 22 nt, Pseudomonas aeruginosa PA01
aggcccucgggcaggugauuga

SEQ ID NO: 169225 - RNA, 22 nt, Pseudomonas aeruginosa PA01
ggcgggcgcgagaggccgaacu

SEQ ID NO: 169226 - RNA, 22 nt, Pseudomonas aeruginosa PA01
ucccgcugaccgucugcccgcu

SEQ ID NO: 169227 - RNA, 22 nt, Pseudomonas aeruginosa PA01
gaugugcagcggcuccagggcc

SEQ ID NO: 169228 - RNA, 22 nt, Pseudomonas aeruginosa PA01
aggugaucguagucgccguuga

SEQ ID NO: 169229 - RNA, 22 nt, Pseudomonas aeruginosa PA01
ugggcgaagugcgcguagcugc

SEQ ID NO: 169230 - RNA, 22 nt, Pseudomonas aeruginosa PA01
ggcgacaugaucgccaccggca

SEQ ID NO: 169231 - RNA, 22 nt, Pseudomonas aeruginosa PA01
gcagcagugcggccggaccgag

SEQ ID NO: 169232 - RNA, 22 nt, Pseudomonas aeruginosa PA01
augccgagaagcacgugguugc

SEQ ID NO: 169233 - RNA, 22 nt, Pseudomonas aeruginosa PA01
cagcagauuaucgcgggugaug

SEQ ID NO: 169234 - RNA, 22 nt, Pseudomonas aeruginosa PA01
caccgggccguugcugucgugg

SEQ ID NO: 169235 - RNA, 22 nt, Pseudomonas aeruginosa PA01
gugcuguucagcuaccgccgca

SEQ ID NO: 169236 - RNA, 22 nt, Pseudomonas aeruginosa PA01
ucggaucguucagcaccuugcg

SEQ ID NO: 169237 - RNA, 20 nt, Pseudomonas aeruginosa PA01
gaugccuuccagcagccagu

SEQ ID NO: 169238 - RNA, 22 nt, Pseudomonas aeruginosa PA01
ugcugauggucaacguggugcu

SEQ ID NO: 169239 - RNA, 22 nt, Pseudomonas aeruginosa PA01
aggucgcccuggcuggaggccu

SEQ ID NO: 169240 - RNA, 22 nt, Pseudomonas aeruginosa PA01
gcgaacuccggguccauggcga

SEQ ID NO: 169241 - RNA, 22 nt, Pseudomonas aeruginosa PA01
agcggccaguugcguuucgucg

SEQ ID NO: 169242 - RNA, 21 nt, Pseudomonas aeruginosa PA01
ugcucggcgauaucgagcuug

SEQ ID NO: 169243 - RNA, 22 nt, Pseudomonas aeruginosa PA01
ccuuccggacguccgcgucagc

SEQ ID NO: 169244 - RNA, 22 nt, Pseudomonas aeruginosa PA01
gauggcgaagauguucgcaucg

SEQ ID NO: 169245 - RNA, 22 nt, Pseudomonas aeruginosa PA01
aggacaaguccgugcuguacgc

SEQ ID NO: 169246 - RNA, 22 nt, Pseudomonas aeruginosa PA01
uguccgacgugguccccggcga

SEQ ID NO: 169247 - RNA, 23 nt, Pseudomonas aeruginosa PA01
ccagccggacguccucgaccugg

SEQ ID NO: 169248 - RNA, 22 nt, Pseudomonas aeruginosa PA01
guggcggcagaagguacgggug

SEQ ID NO: 169249 - RNA, 22 nt, Pseudomonas aeruginosa PA01
ugcgugcggcuucggccaggcg

SEQ ID NO: 169250 - RNA, 22 nt, Pseudomonas aeruginosa PA01
gccuggagguccaggcgcuggc

SEQ ID NO: 169251 - RNA, 22 nt, Pseudomonas aeruginosa PA01
acauggacgcgauccucgacca

SEQ ID NO: 169252 - RNA, 22 nt, Pseudomonas aeruginosa PA01
aagcucggugccgaccacgacg

SEQ ID NO: 169253 - RNA, 22 nt, Pseudomonas aeruginosa PA01
cguggacuggcgcggaucgcga

SEQ ID NO: 169254 - RNA, 22 nt, Pseudomonas aeruginosa PA01
caggggugccuugccaaggugu

SEQ ID NO: 169255 - RNA, 22 nt, Pseudomonas aeruginosa PA01
gcgaacagcagaugcucgccau

SEQ ID NO: 169256 - RNA, 22 nt, Pseudomonas aeruginosa PA01
caccaccucggccagccacuug

SEQ ID NO: 169257 - RNA, 22 nt, Pseudomonas aeruginosa PA01
ugccggcgcaguucgggcgcaa

SEQ ID NO: 169258 - RNA, 22 nt, Pseudomonas aeruginosa PA01
guccagcgcagcaccagcucgc

SEQ ID NO: 169259 - RNA, 22 nt, Pseudomonas aeruginosa PA01
cgacggucagccggccgaaguu

SEQ ID NO: 169260 - RNA, 22 nt, Pseudomonas aeruginosa PA01
uggccggugucgaacgggugcc

SEQ ID NO: 169261 - RNA, 22 nt, Pseudomonas aeruginosa PA01
gugugggcagagccugccgucc

SEQ ID NO: 169262 - RNA, 22 nt, Pseudomonas aeruginosa PA01
aggucguccacgccgacccggc

SEQ ID NO: 169263 - RNA, 22 nt, Pseudomonas aeruginosa PA01
aaccgcgcucgaacaccggcuu

SEQ ID NO: 169264 - RNA, 22 nt, Pseudomonas aeruginosa PA01
uuuuccgagagcagcaggucga

SEQ ID NO: 169265 - RNA, 22 nt, Pseudomonas aeruginosa PA01
aucgcgugguggacaucgacgg

SEQ ID NO: 169266 - RNA, 22 nt, Pseudomonas aeruginosa PA01
ggcgucacggcuggucagcaug

SEQ ID NO: 169267 - RNA, 23 nt, Pseudomonas aeruginosa PA01
gcggcguuucaccuccaggcuga

SEQ ID NO: 169268 - RNA, 22 nt, Pseudomonas aeruginosa PA01
ccggccuuggccagcggcgcac

SEQ ID NO: 169269 - RNA, 22 nt, Pseudomonas aeruginosa PA01
aggucggcuucggcuucgaugu

SEQ ID NO: 169270 - RNA, 22 nt, Pseudomonas aeruginosa PA01
gcucgaucagcagcuugccgcg

SEQ ID NO: 169271 - RNA, 22 nt, Pseudomonas aeruginosa PA01
gaggcgcucgguuacgaccuuu

SEQ ID NO: 169272 - RNA, 22 nt, Pseudomonas aeruginosa PA01
cgggcguggugaccaggaugug

SEQ ID NO: 169273 - RNA, 16 nt, Pseudomonas aeruginosa PA01
cgacaccucuggccgc

SEQ ID NO: 169274 - RNA, 22 nt, Pseudomonas aeruginosa PA01
ggucgggguauucgccgacguc

SEQ ID NO: 169275 - RNA, 22 nt, Pseudomonas aeruginosa PA01
agggaagacgcguaguccgggu

SEQ ID NO: 169276 - RNA, 22 nt, Pseudomonas aeruginosa PA01
accgccaagguggaagagggcg

SEQ ID NO: 169277 - RNA, 22 nt, Pseudomonas aeruginosa PA01
gccgugcggggucauggccagg

SEQ ID NO: 169278 - RNA, 22 nt, Pseudomonas aeruginosa PA01
gcuguugccgccaugcagcgcc

SEQ ID NO: 169279 - RNA, 22 nt, Pseudomonas aeruginosa PA01
aguugguccucgccgccgauca

SEQ ID NO: 169280 - RNA, 22 nt, Pseudomonas aeruginosa PA01
gccugguggaagacggccaggc

SEQ ID NO: 169281 - RNA, 22 nt, Pseudomonas aeruginosa PA01
acagaaacgcgcuuuuuucguu

SEQ ID NO: 169282 - RNA, 22 nt, Pseudomonas aeruginosa PA01
uucgcgccaggacaagcgcaac

SEQ ID NO: 169283 - RNA, 22 nt, Pseudomonas aeruginosa PA01
uugcccgguugcagcggcacca

SEQ ID NO: 169284 - RNA, 22 nt, Pseudomonas aeruginosa PA01
uccucgcugucggccaaggaca

SEQ ID NO: 169285 - RNA, 22 nt, Pseudomonas aeruginosa PA01
ugccagguccgugacucguggc

SEQ ID NO: 169286 - RNA, 23 nt, Pseudomonas aeruginosa PA01
ccugcucgcgcaucugcucgauc

SEQ ID NO: 169287 - RNA, 22 nt, Pseudomonas aeruginosa PA01
cguccaggccggccuguggcgc

SEQ ID NO: 169288 - RNA, 22 nt, Pseudomonas aeruginosa PA01
ccagcgcggcggccaccaggcg

SEQ ID NO: 169289 - RNA, 22 nt, Pseudomonas aeruginosa PA01
ugcuggucgaaggcgagcagcg

SEQ ID NO: 169290 - RNA, 22 nt, Pseudomonas aeruginosa PA01
cuucagucgccuguucggcggc

SEQ ID NO: 169291 - RNA, 20 nt, Pseudomonas aeruginosa PA01
gcggccuugcgcagcuugcc

SEQ ID NO: 169292 - RNA, 22 nt, Pseudomonas aeruginosa PA01
gcccacggcgcugccacagaag

SEQ ID NO: 169293 - RNA, 22 nt, Pseudomonas aeruginosa PA01
ugaccugccagccggugaugaa

SEQ ID NO: 169294 - RNA, 22 nt, Pseudomonas aeruginosa PA01
accgaguuggccgggaucgccg

SEQ ID NO: 169295 - RNA, 22 nt, Pseudomonas aeruginosa PA01
ugcuguugccgcugguccgcgc

SEQ ID NO: 169296 - RNA, 22 nt, Pseudomonas aeruginosa PA01
uugcgcugccgcgccaguucga

SEQ ID NO: 169297 - RNA, 22 nt, Pseudomonas aeruginosa PA01
ugcaacagcccgcagccccugg

SEQ ID NO: 169298 - RNA, 22 nt, Pseudomonas aeruginosa PA01
uacgccgaucccagccugaccg

SEQ ID NO: 169299 - RNA, 22 nt, Pseudomonas aeruginosa PA01
ugcggcucuucagcccggagag

SEQ ID NO: 169300 - RNA, 22 nt, Pseudomonas aeruginosa PA01
cagcgacuggcccaggcucagu

SEQ ID NO: 169301 - RNA, 22 nt, Pseudomonas aeruginosa PA01
ccguugaagaaccucgaucgcg

SEQ ID NO: 169302 - RNA, 22 nt, Pseudomonas aeruginosa PA01
guaacguuacgcagauagaggc

SEQ ID NO: 169303 - RNA, 22 nt, Pseudomonas aeruginosa PA01
ccgcgccuucgucgccggugaa

SEQ ID NO: 169304 - RNA, 22 nt, Pseudomonas aeruginosa PA01
cugcugggacgaaugggaguuc

SEQ ID NO: 169305 - RNA, 22 nt, Pseudomonas aeruginosa PA01
cugguguccugggucggcggcu

SEQ ID NO: 169306 - RNA, 22 nt, Pseudomonas aeruginosa PA01
gucgauccgcuugccauggggg

SEQ ID NO: 169307 - RNA, 22 nt, Pseudomonas aeruginosa PA01
gucggugaucacggugcaggug

SEQ ID NO: 169308 - RNA, 22 nt, Pseudomonas aeruginosa PA01
cugggagaacucguagacgcug

SEQ ID NO: 169309 - RNA, 22 nt, Pseudomonas aeruginosa PA01
auugaaagugauccgcgccugc

SEQ ID NO: 169310 - RNA, 22 nt, Pseudomonas aeruginosa PA01
cacggucgcgcuugaucgccga

SEQ ID NO: 169311 - RNA, 22 nt, Pseudomonas aeruginosa PA01
cgaggcgaucaagcgugccgug

SEQ ID NO: 169312 - RNA, 22 nt, Pseudomonas aeruginosa PA01
uuucucgcuggcgcggcugcuc

SEQ ID NO: 169313 - RNA, 22 nt, Pseudomonas aeruginosa PA01
aggcgggcaacgccgccgacga

SEQ ID NO: 169314 - RNA, 22 nt, Pseudomonas aeruginosa PA01
cagcgcagugcuuucaugguug

SEQ ID NO: 169315 - RNA, 22 nt, Pseudomonas aeruginosa PA01
gcggcgugcuggcggaagaaug

SEQ ID NO: 169316 - RNA, 22 nt, Pseudomonas aeruginosa PA01
gugcgcacgaagggcaccauga

SEQ ID NO: 169317 - RNA, 22 nt, Pseudomonas aeruginosa PA01
cggcgcuuucuucagcaccacc

SEQ ID NO: 169318 - RNA, 22 nt, Pseudomonas aeruginosa PA01
cuccaguucggugcggguuugg

SEQ ID NO: 169319 - RNA, 22 nt, Pseudomonas aeruginosa PA01
aggucgcgcaggggcgaguuuu

SEQ ID NO: 169320 - RNA, 22 nt, Pseudomonas aeruginosa PA01
gccggccguugcaauggcugua

SEQ ID NO: 169321 - RNA, 22 nt, Pseudomonas aeruginosa PA01
cggccaguuuggaggccucggc

SEQ ID NO: 169322 - RNA, 22 nt, Pseudomonas aeruginosa PA01
agacggauuuccaggcgaaggg

SEQ ID NO: 169323 - RNA, 18 nt, Pseudomonas aeruginosa PA01
gcccggcguaguccagca

SEQ ID NO: 169324 - RNA, 22 nt, Pseudomonas aeruginosa PA01
ucgagggcggugccgugcugcg

SEQ ID NO: 169325 - RNA, 22 nt, Pseudomonas aeruginosa PA01
caggcugaugcaugguaucggg

SEQ ID NO: 169326 - RNA, 20 nt, Pseudomonas aeruginosa PA01
gccgcgccugcucggcacug

SEQ ID NO: 169327 - RNA, 19 nt, Pseudomonas aeruginosa PA01
ggcggucaccugcuggacc

SEQ ID NO: 169328 - RNA, 22 nt, Pseudomonas aeruginosa PA01
uguucaccagcgccuugcagga

SEQ ID NO: 169329 - RNA, 22 nt, Pseudomonas aeruginosa PA01
guuggcgggccaccguggcgcu

SEQ ID NO: 169330 - RNA, 21 nt, Pseudomonas aeruginosa PA01
accacccugcccuggcgaucc

SEQ ID NO: 169331 - RNA, 22 nt, Pseudomonas aeruginosa PA01
ucguccucgcccgcaccuuccg

SEQ ID NO: 169332 - RNA, 22 nt, Pseudomonas aeruginosa PA01
gcaguugcugaagaccgggcag

SEQ ID NO: 169333 - RNA, 22 nt, Pseudomonas aeruginosa PA01
accggcuucggcggccuucugc

SEQ ID NO: 169334 - RNA, 22 nt, Pseudomonas aeruginosa PA01
uguucgaacgccaggucgaggc

SEQ ID NO: 169335 - RNA, 22 nt, Pseudomonas aeruginosa PA01
cguaucgacgcucugcagguuc

SEQ ID NO: 169336 - RNA, 22 nt, Pseudomonas aeruginosa PA01
gcucgcucaucaucacgaaauc

SEQ ID NO: 169337 - RNA, 22 nt, Pseudomonas aeruginosa PA01
cggcggcaucgcccauagcaac

SEQ ID NO: 169338 - RNA, 22 nt, Pseudomonas aeruginosa PA01
aguugcgugaaguggccuggga

SEQ ID NO: 169339 - RNA, 20 nt, Pseudomonas aeruginosa PA01
gcgcgcacaucgacgcuugc

SEQ ID NO: 169340 - RNA, 22 nt, Pseudomonas aeruginosa PA01
cggguugugcuggagcugcugu

SEQ ID NO: 169341 - RNA, 22 nt, Pseudomonas aeruginosa PA01
cccggccugccuggacgcgcug

SEQ ID NO: 169342 - RNA, 21 nt, Pseudomonas aeruginosa PA01
cggccgagcgcugguaccgcg

SEQ ID NO: 169343 - RNA, 22 nt, Pseudomonas aeruginosa PA01
cagccccaguagcgcuggcggc

SEQ ID NO: 169344 - RNA, 22 nt, Pseudomonas aeruginosa PA01
agcgacacuuauauaacgggug

SEQ ID NO: 169345 - RNA, 22 nt, Pseudomonas aeruginosa PA01
cgggagcaacgcuaugcccggc

SEQ ID NO: 169346 - RNA, 22 nt, Pseudomonas aeruginosa PA01
gaggucgagcgugcccuggcgc

SEQ ID NO: 169347 - RNA, 22 nt, Pseudomonas aeruginosa PA01
ucaggccuggccgucgcugccc

SEQ ID NO: 169348 - RNA, 22 nt, Pseudomonas aeruginosa PA01
cgccgccgauacgcagccgguu

SEQ ID NO: 169349 - RNA, 22 nt, Pseudomonas aeruginosa PA01
augcucgaagcgcuccagcggc

SEQ ID NO: 169350 - RNA, 22 nt, Pseudomonas aeruginosa PA01
gcgccccggugccgccguggaa

SEQ ID NO: 169351 - RNA, 23 nt, Pseudomonas aeruginosa PA01
ggcggccgcccuccucaugugcc

SEQ ID NO: 169352 - RNA, 22 nt, Pseudomonas aeruginosa PA01
ggcgucacgcgcuuccggcugg

SEQ ID NO: 169353 - RNA, 22 nt, Pseudomonas aeruginosa PA01
ccagcgcugccaggccuggcgc

SEQ ID NO: 169354 - RNA, 22 nt, Pseudomonas aeruginosa PA01
gcgcuccagcacuucguccagc

SEQ ID NO: 169355 - RNA, 22 nt, Pseudomonas aeruginosa PA01
gucgauccucaaggucaggcug

SEQ ID NO: 169356 - RNA, 22 nt, Pseudomonas aeruginosa PA01
cugcggguggaagugaucgaca

SEQ ID NO: 169357 - RNA, 22 nt, Pseudomonas aeruginosa PA01
gucgcguggaauugcugguagc

SEQ ID NO: 169358 - RNA, 22 nt, Pseudomonas aeruginosa PA01
gcccuucgaccuacggacggau

SEQ ID NO: 169359 - RNA, 22 nt, Pseudomonas aeruginosa PA01
guggucggugaugcuguagacg

SEQ ID NO: 169360 - RNA, 22 nt, Pseudomonas aeruginosa PA01
ggcgaagcgaucgaaaggcgac

SEQ ID NO: 169361 - RNA, 22 nt, Pseudomonas aeruginosa PA01
cggggagccucgucgacgaggc

SEQ ID NO: 169362 - RNA, 22 nt, Pseudomonas aeruginosa PA01
gagccuggccgagcgcuucugc

SEQ ID NO: 169363 - RNA, 22 nt, Pseudomonas aeruginosa PA01
cgaucacccgcggcagccgcug

SEQ ID NO: 169364 - RNA, 22 nt, Pseudomonas aeruginosa PA01
cuggccgaaaagggccucgacu

SEQ ID NO: 169365 - RNA, 22 nt, Pseudomonas aeruginosa PA01
gccaaagggcgccucgcgaugc

SEQ ID NO: 169366 - RNA, 22 nt, Pseudomonas aeruginosa PA01
ggcgaugaagaucgucggcgua

SEQ ID NO: 169367 - RNA, 22 nt, Pseudomonas aeruginosa PA01
gagcggccggacuucggcgaga

SEQ ID NO: 169368 - RNA, 22 nt, Pseudomonas aeruginosa PA01
cccugaagaaggaaaagggcga

SEQ ID NO: 169369 - RNA, 22 nt, Pseudomonas aeruginosa PA01
gccgaggaauuuccccgcgaac

SEQ ID NO: 169370 - RNA, 22 nt, Pseudomonas aeruginosa PA01
uucggcgagaaguacggcgacc

SEQ ID NO: 169371 - RNA, 22 nt, Pseudomonas aeruginosa PA01
uuggcguuaugcgcccuacggc

SEQ ID NO: 169372 - RNA, 22 nt, Pseudomonas aeruginosa PA01
cggcuucgcgcagguauucggu

SEQ ID NO: 169373 - RNA, 22 nt, Pseudomonas aeruginosa PA01
ugugccgugcucuucgcccaug

SEQ ID NO: 169374 - RNA, 22 nt, Pseudomonas aeruginosa PA01
gucgacgaacaacugcugguag

SEQ ID NO: 169375 - RNA, 22 nt, Pseudomonas aeruginosa PA01
ccgcugaugcucgccggccugc

SEQ ID NO: 169376 - RNA, 22 nt, Pseudomonas aeruginosa PA01
ccgccuccgccgguuguugccu

SEQ ID NO: 169377 - RNA, 22 nt, Pseudomonas aeruginosa PA01
uguugcgagugaucgaagacgg

SEQ ID NO: 169378 - RNA, 22 nt, Pseudomonas aeruginosa PA01
ggccaucuguugggcugcgucg

SEQ ID NO: 169379 - RNA, 22 nt, Pseudomonas aeruginosa PA01
ccagcacuccgaccugaugauc

SEQ ID NO: 169380 - RNA, 20 nt, Pseudomonas aeruginosa PA01
acucgaccacgaacgcguga

SEQ ID NO: 169381 - RNA, 22 nt, Pseudomonas aeruginosa PA01
aggcgcuuguguaccacuucca

SEQ ID NO: 169382 - RNA, 22 nt, Pseudomonas aeruginosa PA01
guccgguagugccuucggaagu

SEQ ID NO: 169383 - RNA, 22 nt, Pseudomonas aeruginosa PA01
aagucgcgcucgaccuccugga

SEQ ID NO: 169384 - RNA, 22 nt, Pseudomonas aeruginosa PA01
ggugauccaggcuugugccgcg

SEQ ID NO: 169385 - RNA, 22 nt, Pseudomonas aeruginosa PA01
ugggcgccgagaccuucgacga

SEQ ID NO: 169386 - RNA, 22 nt, Pseudomonas aeruginosa PA01
guccaggaacagcacuuccagg

SEQ ID NO: 169387 - RNA, 22 nt, Pseudomonas aeruginosa PA01
ugcugcggauguacucggugag

SEQ ID NO: 169388 - RNA, 22 nt, Pseudomonas aeruginosa PA01
cgcuuggcauuggcauccaggc

SEQ ID NO: 169389 - RNA, 20 nt, Pseudomonas aeruginosa PA01
agcgacccuugagcgccggc

SEQ ID NO: 169390 - RNA, 22 nt, Pseudomonas aeruginosa PA01
gcgucgcacccgcagguggaag

SEQ ID NO: 169391 - RNA, 22 nt, Pseudomonas aeruginosa PA01
auguccuccaggcagcgcgcgu

SEQ ID NO: 169392 - RNA, 22 nt, Pseudomonas aeruginosa PA01
ccgacgguguggaucacguggg

SEQ ID NO: 169393 - RNA, 22 nt, Pseudomonas aeruginosa PA01
gccccggcugagcugcggcagg

SEQ ID NO: 169394 - RNA, 22 nt, Pseudomonas aeruginosa PA01
caguccuggcggguuucggcgg

SEQ ID NO: 169395 - RNA, 22 nt, Pseudomonas aeruginosa PA01
gauccaguucggcgcgcagcga

SEQ ID NO: 169396 - RNA, 22 nt, Pseudomonas aeruginosa PA01
gcagcgguacgcaggccucgca

SEQ ID NO: 169397 - RNA, 22 nt, Pseudomonas aeruginosa PA01
gagcacuacacgaagcggcgcc

SEQ ID NO: 169398 - RNA, 22 nt, Pseudomonas aeruginosa PA01
gggcagcuucagcaagcgcucg

SEQ ID NO: 169399 - RNA, 22 nt, Pseudomonas aeruginosa PA01
accugcucagcgacggcgcugc

SEQ ID NO: 169400 - RNA, 22 nt, Pseudomonas aeruginosa PA01
cgacggucagcacuugccgcgc

SEQ ID NO: 169401 - RNA, 22 nt, Pseudomonas aeruginosa PA01
caggcgaucgccaucgccgcca

SEQ ID NO: 169402 - RNA, 18 nt, Pseudomonas aeruginosa PA01
ccuggcgcggguccgcuu

SEQ ID NO: 169403 - RNA, 22 nt, Pseudomonas aeruginosa PA01
ucggcgaauucgaccuggucga

SEQ ID NO: 169404 - RNA, 22 nt, Pseudomonas aeruginosa PA01
agggucaagcugcgacgugccg

SEQ ID NO: 169405 - RNA, 22 nt, Pseudomonas aeruginosa PA01
aggugcucgacgaccaggcccu

SEQ ID NO: 169406 - RNA, 22 nt, Pseudomonas aeruginosa PA01
cgcggugcagcugcucgguggc

SEQ ID NO: 169407 - RNA, 17 nt, Pseudomonas aeruginosa PA01
gccgccgaggucggcga

SEQ ID NO: 169408 - RNA, 22 nt, Pseudomonas aeruginosa PA01
gcucgccggccaguucgccgag

SEQ ID NO: 169409 - RNA, 22 nt, Pseudomonas aeruginosa PA01
ccuugcuguucagcgccacggc

SEQ ID NO: 169410 - RNA, 22 nt, Pseudomonas aeruginosa PA01
ucgucgaggucggagaccagca

SEQ ID NO: 169411 - RNA, 22 nt, Pseudomonas aeruginosa PA01
uggaaacguucucgcccuucca

SEQ ID NO: 169412 - RNA, 22 nt, Pseudomonas aeruginosa PA01
ggcggacaguggcgauccgcau

SEQ ID NO: 169413 - RNA, 22 nt, Pseudomonas aeruginosa PA01
cuggucaccgggccccugggca

SEQ ID NO: 169414 - RNA, 21 nt, Pseudomonas aeruginosa PA01
uccggcccguaguugcgcacg

SEQ ID NO: 169415 - RNA, 22 nt, Pseudomonas aeruginosa PA01
guggucaccgcccaucugcucg

SEQ ID NO: 169416 - RNA, 22 nt, Pseudomonas aeruginosa PA01
ggcuuggucagcgcggccaguu

SEQ ID NO: 169417 - RNA, 22 nt, Pseudomonas aeruginosa PA01
agccuggcgcuguucgccgcgg

SEQ ID NO: 169418 - RNA, 20 nt, Pseudomonas aeruginosa PA01
acuaccugggccaauugcug

SEQ ID NO: 169419 - RNA, 22 nt, Pseudomonas aeruginosa PA01
ucucccgcgacguucgcuccgg

SEQ ID NO: 169420 - RNA, 22 nt, Pseudomonas aeruginosa PA01
uucagcagcagcuucagguauu

SEQ ID NO: 169421 - RNA, 22 nt, Pseudomonas aeruginosa PA01
ucgcggccgggggugucguagu

SEQ ID NO: 169422 - RNA, 22 nt, Pseudomonas aeruginosa PA01
ccggauccugccccggcguaga

SEQ ID NO: 169423 - RNA, 22 nt, Pseudomonas aeruginosa PA01
gucaucacccagcaccauaucg

SEQ ID NO: 169424 - RNA, 19 nt, Pseudomonas aeruginosa PA01
cuccuccuggggcgugguc

SEQ ID NO: 169425 - RNA, 22 nt, Pseudomonas aeruginosa PA01
guccagccauucgcgguagacc

SEQ ID NO: 169426 - RNA, 19 nt, Pseudomonas aeruginosa PA01
ugcuugcagccaacugagc

SEQ ID NO: 169427 - RNA, 22 nt, Pseudomonas aeruginosa PA01
uccagcuuaucgccgggaccca

SEQ ID NO: 169428 - RNA, 21 nt, Pseudomonas aeruginosa PA01
aggcuaccguugaagaacugc

SEQ ID NO: 169429 - RNA, 22 nt, Pseudomonas aeruginosa PA01
uccgcuggucgaucuccagcga

SEQ ID NO: 169430 - RNA, 22 nt, Pseudomonas aeruginosa PA01
ggccaggcugagaaggacggcg

SEQ ID NO: 169431 - RNA, 22 nt, Pseudomonas aeruginosa PA01
cgaugcccugcacggccuggua

SEQ ID NO: 169432 - RNA, 22 nt, Pseudomonas aeruginosa PA01
ccgggacagaccgaaguggugc

SEQ ID NO: 169433 - RNA, 22 nt, Pseudomonas aeruginosa PA01
cgcuggcgcugacguuggcgau

SEQ ID NO: 169434 - RNA, 22 nt, Pseudomonas aeruginosa PA01
ccugagcguuucgugggagaua

SEQ ID NO: 169435 - RNA, 22 nt, Pseudomonas aeruginosa PA01
cggcggcuggcugaugggcaac

SEQ ID NO: 169436 - RNA, 22 nt, Pseudomonas aeruginosa PA01
ccaggcacuguuggcgugguaa

SEQ ID NO: 169437 - RNA, 22 nt, Pseudomonas aeruginosa PA01
ucgcccaggcuccagucggcgg

SEQ ID NO: 169438 - RNA, 22 nt, Pseudomonas aeruginosa PA01
ucgucgcagaacagcgccugca

SEQ ID NO: 169439 - RNA, 22 nt, Pseudomonas aeruginosa PA01
gugcugaacaugagcuggggcg

SEQ ID NO: 169440 - RNA, 22 nt, Pseudomonas aeruginosa PA01
ucgccgugaaagaggugucuga

SEQ ID NO: 169441 - RNA, 19 nt, Pseudomonas aeruginosa PA01
cgcagcggcgagaucggcc

SEQ ID NO: 169442 - RNA, 22 nt, Pseudomonas aeruginosa PA01
cggacugcugcggaugggcguc

SEQ ID NO: 169443 - RNA, 22 nt, Pseudomonas aeruginosa PA01
ggcgcccagcgucgccaggcuc

SEQ ID NO: 169444 - RNA, 19 nt, Pseudomonas aeruginosa PA01
ccgucgccggcguuggucg

SEQ ID NO: 169445 - RNA, 22 nt, Pseudomonas aeruginosa PA01
uagguggcgcuguuggcggcgc

SEQ ID NO: 169446 - RNA, 22 nt, Pseudomonas aeruginosa PA01
gcgagccgaugcaacgggcgac

SEQ ID NO: 169447 - RNA, 22 nt, Pseudomonas aeruginosa PA01
gcucggguguccugcaagcaga

SEQ ID NO: 169448 - RNA, 22 nt, Pseudomonas aeruginosa PA01
gccugggcugcaccaccagcgg

SEQ ID NO: 169449 - RNA, 22 nt, Pseudomonas aeruginosa PA01
ccggacagcgaguggaggaugc

SEQ ID NO: 169450 - RNA, 22 nt, Pseudomonas aeruginosa PA01
ugccgaccucaucagguaugcg

SEQ ID NO: 169451 - RNA, 22 nt, Pseudomonas aeruginosa PA01
ggcacgcucgccguuggcgacg

SEQ ID NO: 169452 - RNA, 22 nt, Pseudomonas aeruginosa PA01
uccuggcgggugccgcgcuggc

SEQ ID NO: 169453 - RNA, 22 nt, Pseudomonas aeruginosa PA01
ggcaagcugaagaugggcggca

SEQ ID NO: 169454 - RNA, 22 nt, Pseudomonas aeruginosa PA01
gggcggccgagguagacguugu

SEQ ID NO: 169455 - RNA, 19 nt, Pseudomonas aeruginosa PA01
gcgucggcuuccuugacga

SEQ ID NO: 169456 - RNA, 17 nt, Pseudomonas aeruginosa PA01
uccgccggacagguuga

SEQ ID NO: 169457 - RNA, 22 nt, Pseudomonas aeruginosa PA01
ccggggcgguuucccagacaca

SEQ ID NO: 169458 - RNA, 22 nt, Pseudomonas aeruginosa PA01
ugcgcggcguuuccucgccgaa

SEQ ID NO: 169459 - RNA, 19 nt, Pseudomonas aeruginosa PA01
aucagcccgcccagugcuu

SEQ ID NO: 169460 - RNA, 22 nt, Pseudomonas aeruginosa PA01
aucgagcaugacaugggcaugg

SEQ ID NO: 169461 - RNA, 22 nt, Pseudomonas aeruginosa PA01
agggcgaauaacgccccaggcg

SEQ ID NO: 169462 - RNA, 22 nt, Pseudomonas aeruginosa PA01
cucggcagcaagcuguucgaac

SEQ ID NO: 169463 - RNA, 22 nt, Pseudomonas aeruginosa PA01
aguaccggcgccagcgcccugc

SEQ ID NO: 169464 - RNA, 22 nt, Pseudomonas aeruginosa PA01
cgcgcaguuuacccggagaacc

SEQ ID NO: 169465 - RNA, 21 nt, Pseudomonas aeruginosa PA01
caccgacgccauccaucgcag

SEQ ID NO: 169466 - RNA, 22 nt, Pseudomonas aeruginosa PA01
cgauggucgcgaucagccccag

SEQ ID NO: 169467 - RNA, 22 nt, Pseudomonas aeruginosa PA01
cgcguacaucggugucggcgcg

SEQ ID NO: 169468 - RNA, 22 nt, Pseudomonas aeruginosa PA01
cgugaccaagccgcuggcgcug

SEQ ID NO: 169469 - RNA, 22 nt, Pseudomonas aeruginosa PA01
ggaagccgaacagguagcugag

SEQ ID NO: 169470 - RNA, 22 nt, Pseudomonas aeruginosa PA01
aucucgaggaugcggccggaga

SEQ ID NO: 169471 - RNA, 22 nt, Pseudomonas aeruginosa PA01
cgggcgccgcgagaacaggcug

SEQ ID NO: 169472 - RNA, 22 nt, Pseudomonas aeruginosa PA01
gcacgugcuggagcgcccgcug

SEQ ID NO: 169473 - RNA, 20 nt, Pseudomonas aeruginosa PA01
gccgacgauugagccggcga

SEQ ID NO: 169474 - RNA, 23 nt, Pseudomonas aeruginosa PA01
cgccaucgagcugccaggccagc

SEQ ID NO: 169475 - RNA, 22 nt, Pseudomonas aeruginosa PA01
cagcugguuggcaauggcggcc

SEQ ID NO: 169476 - RNA, 22 nt, Pseudomonas aeruginosa PA01
accuugacacugccgaucaggu

SEQ ID NO: 169477 - RNA, 20 nt, Pseudomonas aeruginosa PA01
ucggccaggccuucgaaggc

SEQ ID NO: 169478 - RNA, 22 nt, Pseudomonas aeruginosa PA01
uuuucgucgaccuguucguuga

SEQ ID NO: 169479 - RNA, 20 nt, Pseudomonas aeruginosa PA01
gggcgcuggcauaggcgccc

SEQ ID NO: 169480 - RNA, 22 nt, Pseudomonas aeruginosa PA01
gugccugguucaggcggcgcug

SEQ ID NO: 169481 - RNA, 23 nt, Pseudomonas aeruginosa PA01
cggugggcgccggccauggccuc

SEQ ID NO: 169482 - RNA, 22 nt, Pseudomonas aeruginosa PA01
ucgcucauggggccgaggccgu

SEQ ID NO: 169483 - RNA, 22 nt, Pseudomonas aeruginosa PA01
ggugccgccggccggcggugcc

SEQ ID NO: 169484 - RNA, 22 nt, Pseudomonas aeruginosa PA01
agcggguugcagccguuguaga

SEQ ID NO: 169485 - RNA, 22 nt, Pseudomonas aeruginosa PA01
cgugcagggcggcgauguccug

SEQ ID NO: 169486 - RNA, 22 nt, Pseudomonas aeruginosa PA01
agcucggugcuggcgacgaugg

SEQ ID NO: 169487 - RNA, 22 nt, Pseudomonas aeruginosa PA01
gugaucaagcgcgguaccgggc

SEQ ID NO: 169488 - RNA, 23 nt, Pseudomonas aeruginosa PA01
cggugagcaccgcguugccggcg

SEQ ID NO: 169489 - RNA, 22 nt, Pseudomonas aeruginosa PA01
uguguucgcccugggcgccggc

SEQ ID NO: 169490 - RNA, 22 nt, Pseudomonas aeruginosa PA01
gcggaucgccaccaggaucgcg

SEQ ID NO: 169491 - RNA, 22 nt, Pseudomonas aeruginosa PA01
ccgaacugauaccuguuggucu

SEQ ID NO: 169492 - RNA, 22 nt, Pseudomonas aeruginosa PA01
ugccgaaucgccgugcaucgcc

SEQ ID NO: 169493 - RNA, 22 nt, Pseudomonas aeruginosa PA01
ggcguugaccggguuguccacc

SEQ ID NO: 169494 - RNA, 22 nt, Pseudomonas aeruginosa PA01
cuucucgagcaucugcagaucg

SEQ ID NO: 169495 - RNA, 22 nt, Pseudomonas aeruginosa PA01
cugcuucaaggagcacuagacu

SEQ ID NO: 169496 - RNA, 22 nt, Pseudomonas aeruginosa PA01
cgacuaccccguggucgccggc

SEQ ID NO: 169497 - RNA, 22 nt, Pseudomonas aeruginosa PA01
gccggcauagggcuuggcgucg

SEQ ID NO: 169498 - RNA, 22 nt, Pseudomonas aeruginosa PA01
ucuuggcggugaugcggguguu

SEQ ID NO: 169499 - RNA, 20 nt, Pseudomonas aeruginosa PA01
ugcucgccggcuugccgccg

SEQ ID NO: 169500 - RNA, 22 nt, Pseudomonas aeruginosa PA01
caaugaccaggcaguugaccac

SEQ ID NO: 169501 - RNA, 22 nt, Pseudomonas aeruginosa PA01
cgagcgcuuccugaggcgcgua

SEQ ID NO: 169502 - RNA, 22 nt, Pseudomonas aeruginosa PA01
caggcgcugggcgucugguucg

SEQ ID NO: 169503 - RNA, 22 nt, Pseudomonas aeruginosa PA01
gucaggguggcgaugccgucuu

SEQ ID NO: 169504 - RNA, 22 nt, Pseudomonas aeruginosa PA01
cugacgcuguacagcaggcgcu

SEQ ID NO: 169505 - RNA, 22 nt, Pseudomonas aeruginosa PA01
gcaguggugcuggugcagcaug

SEQ ID NO: 169506 - RNA, 22 nt, Pseudomonas aeruginosa PA01
cacccgcucgcugggcgaguug

SEQ ID NO: 169507 - RNA, 22 nt, Pseudomonas aeruginosa PA01
gacgccugcgugcgcuuccuca

SEQ ID NO: 169508 - RNA, 22 nt, Pseudomonas aeruginosa PA01
ggcguugaucuguuccaccagc

SEQ ID NO: 169509 - RNA, 22 nt, Pseudomonas aeruginosa PA01
gaaggcggcgaaggcggcaucg

SEQ ID NO: 169510 - RNA, 22 nt, Pseudomonas aeruginosa PA01
cgucgggcugcgcucaccugga

SEQ ID NO: 169511 - RNA, 22 nt, Pseudomonas aeruginosa PA01
cugcccucggcacaggggcugc

SEQ ID NO: 169512 - RNA, 22 nt, Pseudomonas aeruginosa PA01
uuuccuacgccacgcugcgugc

SEQ ID NO: 169513 - RNA, 22 nt, Pseudomonas aeruginosa PA01
gaugucgagaaaggcaugagcc

SEQ ID NO: 169514 - RNA, 19 nt, Pseudomonas aeruginosa PA01
gcgcugcugcuggucagcu

SEQ ID NO: 169515 - RNA, 22 nt, Pseudomonas aeruginosa PA01
gcugcgcgagcguggcugggac

SEQ ID NO: 169516 - RNA, 22 nt, Pseudomonas aeruginosa PA01
gucgccauucccuaccugggcg

SEQ ID NO: 169517 - RNA, 22 nt, Pseudomonas aeruginosa PA01
ccggcuuccucgaacugcucgg

SEQ ID NO: 169518 - RNA, 22 nt, Pseudomonas aeruginosa PA01
gcugagccgcaauagccgcagc

SEQ ID NO: 169519 - RNA, 22 nt, Pseudomonas aeruginosa PA01
ugcuccagcgacucgucggggc

SEQ ID NO: 169520 - RNA, 22 nt, Pseudomonas aeruginosa PA01
caccagcuggcggugauggccg

SEQ ID NO: 169521 - RNA, 23 nt, Pseudomonas aeruginosa PA01
gcagcaccagcaguucguccugc

SEQ ID NO: 169522 - RNA, 20 nt, Pseudomonas aeruginosa PA01
ugguggcgucaucggcgcgc

SEQ ID NO: 169523 - RNA, 22 nt, Pseudomonas aeruginosa PA01
gccggccaguucaccggcgcgc

SEQ ID NO: 169524 - RNA, 22 nt, Pseudomonas aeruginosa PA01
cguucggaccucagcgucggca

SEQ ID NO: 169525 - RNA, 22 nt, Pseudomonas aeruginosa PA01
cgccaccuggcuggugccgcgc

SEQ ID NO: 169526 - RNA, 21 nt, Pseudomonas aeruginosa PA01
cgggucgaugccaucggcccg

SEQ ID NO: 169527 - RNA, 22 nt, Pseudomonas aeruginosa PA01
ggaguucgcccauggaggcucu

SEQ ID NO: 169528 - RNA, 22 nt, Pseudomonas aeruginosa PA01
gcaccgcuucgccgaucucguc

SEQ ID NO: 169529 - RNA, 19 nt, Pseudomonas aeruginosa PA01
cugguaugaugcgcgccuu

SEQ ID NO: 169530 - RNA, 20 nt, Pseudomonas aeruginosa PA01
gcgaaccugccggcugucga

SEQ ID NO: 169531 - RNA, 19 nt, Pseudomonas aeruginosa PA01
cgcggccgggauccucggc

SEQ ID NO: 169532 - RNA, 22 nt, Pseudomonas aeruginosa PA01
uggugcgcgacgaggagggagu

SEQ ID NO: 169533 - RNA, 22 nt, Pseudomonas aeruginosa PA01
gccagguugacgcuggccgacu

SEQ ID NO: 169534 - RNA, 22 nt, Pseudomonas aeruginosa PA01
augccguugccggccaggagcg

SEQ ID NO: 169535 - RNA, 22 nt, Pseudomonas aeruginosa PA01
ugggcgugcgcagggccuggag

SEQ ID NO: 169536 - RNA, 19 nt, Pseudomonas aeruginosa PA01
gcgcuugggaucguccugc

SEQ ID NO: 169537 - RNA, 22 nt, Pseudomonas aeruginosa PA01
aaucgccgugcugcccggcgca

SEQ ID NO: 169538 - RNA, 22 nt, Pseudomonas aeruginosa PA01
ugcgcccgagcaggcgugccga

SEQ ID NO: 169539 - RNA, 22 nt, Pseudomonas aeruginosa PA01
uggggcugaccucgcuguucgg

SEQ ID NO: 169540 - RNA, 22 nt, Pseudomonas aeruginosa PA01
ugagcauugccugagugcgcgu

SEQ ID NO: 169541 - RNA, 22 nt, Pseudomonas aeruginosa PA01
ccguucaccggcgagguguugg

SEQ ID NO: 169542 - RNA, 22 nt, Pseudomonas aeruginosa PA01
gaggccaagcgccccucgggca

SEQ ID NO: 169543 - RNA, 19 nt, Pseudomonas aeruginosa PA01
cgacggcaccuggaucacc

SEQ ID NO: 169544 - RNA, 22 nt, Pseudomonas aeruginosa PA01
cgcuacggccaggucaaucucg

SEQ ID NO: 169545 - RNA, 21 nt, Pseudomonas aeruginosa PA01
uucuucagccugcgcgccgug

SEQ ID NO: 169546 - RNA, 22 nt, Pseudomonas aeruginosa PA01
ccgcgccggcaaggugaucauc

SEQ ID NO: 169547 - RNA, 22 nt, Pseudomonas aeruginosa PA01
ucggcgaagguggaaggcgacg

SEQ ID NO: 169548 - RNA, 20 nt, Pseudomonas aeruginosa PA01
gaggccaucgcgcccgccga

SEQ ID NO: 169549 - RNA, 20 nt, Pseudomonas aeruginosa PA01
ucagcaggcucagcggcugc

SEQ ID NO: 169550 - RNA, 22 nt, Pseudomonas aeruginosa PA01
ccuggccgaggcgcggcggguc

SEQ ID NO: 169551 - RNA, 22 nt, Pseudomonas aeruginosa PA01
gucuucgaugcgccgcagguug

SEQ ID NO: 169552 - RNA, 22 nt, Pseudomonas aeruginosa PA01
ggccugcggcucggccuuggug

SEQ ID NO: 169553 - RNA, 22 nt, Pseudomonas aeruginosa PA01
uggccgcgcccugcggggugau

SEQ ID NO: 169554 - RNA, 22 nt, Pseudomonas aeruginosa PA01
ccggccaugucccuggguagcg

SEQ ID NO: 169555 - RNA, 22 nt, Pseudomonas aeruginosa PA01
ugggccagcuggaucucgccgg

SEQ ID NO: 169556 - RNA, 22 nt, Pseudomonas aeruginosa PA01
cgaaggucgcgcauaccgugcg

SEQ ID NO: 169557 - RNA, 22 nt, Pseudomonas aeruginosa PA01
caauugaucgaacgggcgcaca

SEQ ID NO: 169558 - RNA, 22 nt, Pseudomonas aeruginosa PA01
ugaccagcaaggcgccgauauc

SEQ ID NO: 169559 - RNA, 22 nt, Pseudomonas aeruginosa PA01
ggcccgggugauccuccagcau

SEQ ID NO: 169560 - RNA, 22 nt, Pseudomonas aeruginosa PA01
cccgcgccacgaggaacgcgug

SEQ ID NO: 169561 - RNA, 21 nt, Pseudomonas aeruginosa PA01
cccaggggcccggugaccagc

SEQ ID NO: 169562 - RNA, 22 nt, Pseudomonas aeruginosa PA01
cggguccugucgauccauggcg

SEQ ID NO: 169563 - RNA, 22 nt, Pseudomonas aeruginosa PA01
agcucggcgaugccgcaacuga

SEQ ID NO: 169564 - RNA, 22 nt, Pseudomonas aeruginosa PA01
caucgacggcuacggccaggcu

SEQ ID NO: 169565 - RNA, 22 nt, Pseudomonas aeruginosa PA01
cuugaucgguuguacgccggag

SEQ ID NO: 169566 - RNA, 21 nt, Pseudomonas aeruginosa PA01
agcgcggcgccgaauaucggg

SEQ ID NO: 169567 - RNA, 22 nt, Pseudomonas aeruginosa PA01
cagucgacgcuguccagccggc

SEQ ID NO: 169568 - RNA, 22 nt, Pseudomonas aeruginosa PA01
gcuucuucgagcagggcaaggg

SEQ ID NO: 169569 - RNA, 22 nt, Pseudomonas aeruginosa PA01
ucgcugaccgaggugcgcgcgg

SEQ ID NO: 169570 - RNA, 22 nt, Pseudomonas aeruginosa PA01
gacaggucgaggucguugcgcg

SEQ ID NO: 169571 - RNA, 22 nt, Pseudomonas aeruginosa PA01
cggucggugaccacgccgguca

SEQ ID NO: 169572 - RNA, 22 nt, Pseudomonas aeruginosa PA01
agcgccaggugucgaccaucuu

SEQ ID NO: 169573 - RNA, 22 nt, Pseudomonas aeruginosa PA01
gcgcccugcucgaccaggcgcu

SEQ ID NO: 169574 - RNA, 22 nt, Pseudomonas aeruginosa PA01
ccuggagagcaucgggcgucgc

SEQ ID NO: 169575 - RNA, 22 nt, Pseudomonas aeruginosa PA01
gcccuucguagaaugcuggcga

SEQ ID NO: 169576 - RNA, 22 nt, Pseudomonas aeruginosa PA01
ggggugcugaucggcgucgugc

SEQ ID NO: 169577 - RNA, 22 nt, Pseudomonas aeruginosa PA01
acgcggcaggucgcgggacagg

SEQ ID NO: 169578 - RNA, 22 nt, Pseudomonas aeruginosa PA01
ucuugccggcgaucagguaggc

SEQ ID NO: 169579 - RNA, 22 nt, Pseudomonas aeruginosa PA01
cccgaagacccagagcgcuggc

SEQ ID NO: 169580 - RNA, 22 nt, Pseudomonas aeruginosa PA01
ggccggucuccagccaggccag

SEQ ID NO: 169581 - RNA, 22 nt, Pseudomonas aeruginosa PA01
guugcgcucgguuucgccgaag

SEQ ID NO: 169582 - RNA, 22 nt, Pseudomonas aeruginosa PA01
ugcccgacacaccgcuggcuuu

SEQ ID NO: 169583 - RNA, 22 nt, Pseudomonas aeruginosa PA01
gcgguguugcucaagcaacugc

SEQ ID NO: 169584 - RNA, 22 nt, Pseudomonas aeruginosa PA01
ucgccgaacagccagcugcgca

SEQ ID NO: 169585 - RNA, 22 nt, Pseudomonas aeruginosa PA01
cggcggccuugccgcucugcuc

SEQ ID NO: 169586 - RNA, 22 nt, Pseudomonas aeruginosa PA01
ucggucuuggugucacggcugu

SEQ ID NO: 169587 - RNA, 22 nt, Pseudomonas aeruginosa PA01
ggcgaccugcucggccaggccu

SEQ ID NO: 169588 - RNA, 22 nt, Pseudomonas aeruginosa PA01
ucgguguagcccggcaggcgga

SEQ ID NO: 169589 - RNA, 22 nt, Pseudomonas aeruginosa PA01
ugaucgauuccagcgccucggc

SEQ ID NO: 169590 - RNA, 22 nt, Pseudomonas aeruginosa PA01
agcaccagguaggacagcgccu

SEQ ID NO: 169591 - RNA, 22 nt, Pseudomonas aeruginosa PA01
ccccugggagagaauccguaaa

SEQ ID NO: 169592 - RNA, 22 nt, Pseudomonas aeruginosa PA01
cacgccccguggcgacagggcc

SEQ ID NO: 169593 - RNA, 22 nt, Pseudomonas aeruginosa PA01
uggucagcgcgagauuguucag

SEQ ID NO: 169594 - RNA, 22 nt, Pseudomonas aeruginosa PA01
uggccgccgcacgccgugcagg

SEQ ID NO: 169595 - RNA, 22 nt, Pseudomonas aeruginosa PA01
ccgaucaccucgucaugcccgc

SEQ ID NO: 169596 - RNA, 22 nt, Pseudomonas aeruginosa PA01
agggucucgagcacaccgccga

SEQ ID NO: 169597 - RNA, 22 nt, Pseudomonas aeruginosa PA01
ggugaucaugguggcgccgaga

SEQ ID NO: 169598 - RNA, 22 nt, Pseudomonas aeruginosa PA01
aauacccggaaguggugccgcc

SEQ ID NO: 169599 - RNA, 22 nt, Pseudomonas aeruginosa PA01
agucggcgccgagccagaggcc

SEQ ID NO: 169600 - RNA, 22 nt, Pseudomonas aeruginosa PA01
ccggaugggcgccgccgcagaa

SEQ ID NO: 169601 - RNA, 22 nt, Pseudomonas aeruginosa PA01
uccucgacggcuggagcguggc

SEQ ID NO: 169602 - RNA, 22 nt, Pseudomonas aeruginosa PA01
uggcgcagcaagcagucgcugc

SEQ ID NO: 169603 - RNA, 22 nt, Pseudomonas aeruginosa PA01
gacuggcgaagccgcaggccag

SEQ ID NO: 169604 - RNA, 22 nt, Pseudomonas aeruginosa PA01
gccaccacccgggugcgcucca

SEQ ID NO: 169605 - RNA, 22 nt, Pseudomonas aeruginosa PA01
gaagugccccggggcgaccgcg

SEQ ID NO: 169606 - RNA, 22 nt, Pseudomonas aeruginosa PA01
uggcgagcuugaacagguggcg

SEQ ID NO: 169607 - RNA, 22 nt, Pseudomonas aeruginosa PA01
gugcaggucgaggugcauugcg

SEQ ID NO: 169608 - RNA, 22 nt, Pseudomonas aeruginosa PA01
ucgucgccugccaguuccaccc

SEQ ID NO: 169609 - RNA, 22 nt, Pseudomonas aeruginosa PA01
cgcaagcuguucgccgggcgcc

SEQ ID NO: 169610 - RNA, 22 nt, Pseudomonas aeruginosa PA01
ugaguucaacgcauccaccuuc

SEQ ID NO: 169611 - RNA, 22 nt, Pseudomonas aeruginosa PA01
aaggcguccuggauuucgccga

SEQ ID NO: 169612 - RNA, 22 nt, Pseudomonas aeruginosa PA01
ggauggccgccaccggcaagca

SEQ ID NO: 169613 - RNA, 22 nt, Pseudomonas aeruginosa PA01
ucaccgcguucaguugcucggc

SEQ ID NO: 169614 - RNA, 22 nt, Pseudomonas aeruginosa PA01
augaaccggcgcagcgcggcca

SEQ ID NO: 169615 - RNA, 22 nt, Pseudomonas aeruginosa PA01
ggcgugcuggcgcuggucaccg

SEQ ID NO: 169616 - RNA, 22 nt, Pseudomonas aeruginosa PA01
gccaucgggauuuccucaucag

SEQ ID NO: 169617 - RNA, 22 nt, Pseudomonas aeruginosa PA01
ccugcugagcagccuggacgcc

SEQ ID NO: 169618 - RNA, 22 nt, Pseudomonas aeruginosa PA01
gcccaggcccuggcgcgggcuc

SEQ ID NO: 169619 - RNA, 22 nt, Pseudomonas aeruginosa PA01
ggcggagaucuucgucgaaggu

SEQ ID NO: 169620 - RNA, 22 nt, Pseudomonas aeruginosa PA01
gcaccggcgacuucugcugccc

SEQ ID NO: 169621 - RNA, 22 nt, Pseudomonas aeruginosa PA01
aucaccaugcccagcgacugcg

SEQ ID NO: 169622 - RNA, 22 nt, Pseudomonas aeruginosa PA01
acggaagcgauccgugccuggu

SEQ ID NO: 169623 - RNA, 22 nt, Pseudomonas aeruginosa PA01
gggaggcgugauggcugcucaa

SEQ ID NO: 169624 - RNA, 22 nt, Pseudomonas aeruginosa PA01
ucgccgagcuggaacgccuggc

SEQ ID NO: 169625 - RNA, 22 nt, Pseudomonas aeruginosa PA01
ugcucagggggcgcugguuucg

SEQ ID NO: 169626 - RNA, 21 nt, Pseudomonas aeruginosa PA01
ucgagguccgccucggucauc

SEQ ID NO: 169627 - RNA, 22 nt, Pseudomonas aeruginosa PA01
aguugcgcgaggcguucgucga

SEQ ID NO: 169628 - RNA, 23 nt, Pseudomonas aeruginosa PA01
ugcgccgaguacgcccagcggca

SEQ ID NO: 169629 - RNA, 22 nt, Pseudomonas aeruginosa PA01
ccuggucgacgucggcaagacc

SEQ ID NO: 169630 - RNA, 22 nt, Pseudomonas aeruginosa PA01
cgccuuccuuccacuuggccgg

SEQ ID NO: 169631 - RNA, 22 nt, Pseudomonas aeruginosa PA01
caagcuggcgaugucgauccgc

SEQ ID NO: 169632 - RNA, 22 nt, Pseudomonas aeruginosa PA01
cgguuggucgaugcaggugaug

SEQ ID NO: 169633 - RNA, 22 nt, Pseudomonas aeruginosa PA01
uucucgcuguaggcgguggcgc

SEQ ID NO: 169634 - RNA, 21 nt, Pseudomonas aeruginosa PA01
ggaucugcaccgcauggcgga

SEQ ID NO: 169635 - RNA, 22 nt, Pseudomonas aeruginosa PA01
ggcuucggcuccccagccggac

SEQ ID NO: 169636 - RNA, 22 nt, Pseudomonas aeruginosa PA01
cugacgaacacgauggucuugu

SEQ ID NO: 169637 - RNA, 22 nt, Pseudomonas aeruginosa PA01
cucgaugauguucggcgagucc

SEQ ID NO: 169638 - RNA, 22 nt, Pseudomonas aeruginosa PA01
cagcaccuggcgcaucgccgug

SEQ ID NO: 169639 - RNA, 22 nt, Pseudomonas aeruginosa PA01
ccgccagcagcgaguugagcug

SEQ ID NO: 169640 - RNA, 22 nt, Pseudomonas aeruginosa PA01
aucggccgcagcauguccucca

SEQ ID NO: 169641 - RNA, 22 nt, Pseudomonas aeruginosa PA01
uugcccaggccgaucucuucca

SEQ ID NO: 169642 - RNA, 22 nt, Pseudomonas aeruginosa PA01
augaggccagugucauuguccc

SEQ ID NO: 169643 - RNA, 22 nt, Pseudomonas aeruginosa PA01
ggccuccaccgugaucagccug

SEQ ID NO: 169644 - RNA, 19 nt, Pseudomonas aeruginosa PA01
gucugcagcaaccggccgu

SEQ ID NO: 169645 - RNA, 22 nt, Pseudomonas aeruginosa PA01
uugcgcggcuccgccaguucgu

SEQ ID NO: 169646 - RNA, 19 nt, Pseudomonas aeruginosa PA01
cggcguagcgaucgucgag

SEQ ID NO: 169647 - RNA, 22 nt, Pseudomonas aeruginosa PA01
cgggcggccgaacagauagccu

SEQ ID NO: 169648 - RNA, 22 nt, Pseudomonas aeruginosa PA01
ccacgcuuccuccucgcugcca

SEQ ID NO: 169649 - RNA, 22 nt, Pseudomonas aeruginosa PA01
agguuccggaacaggcaauccu

SEQ ID NO: 169650 - RNA, 22 nt, Pseudomonas aeruginosa PA01
uggccaaggcguugcaggagca

SEQ ID NO: 169651 - RNA, 22 nt, Pseudomonas aeruginosa PA01
ugcugcuggacgucggccagcc

SEQ ID NO: 169652 - RNA, 22 nt, Pseudomonas aeruginosa PA01
ccagcgcagccucgaccucgaa

SEQ ID NO: 169653 - RNA, 22 nt, Pseudomonas aeruginosa PA01
gcgcaacggccaccagggcgag

SEQ ID NO: 169654 - RNA, 22 nt, Pseudomonas aeruginosa PA01
cgaugagcaggaagguggugcg

SEQ ID NO: 169655 - RNA, 22 nt, Pseudomonas aeruginosa PA01
cgccaggccgaccagagcacca

SEQ ID NO: 169656 - RNA, 22 nt, Pseudomonas aeruginosa PA01
uguuccagcgcgacggcgagga

SEQ ID NO: 169657 - RNA, 22 nt, Pseudomonas aeruginosa PA01
caggcgacgucgagccgaggcc

SEQ ID NO: 169658 - RNA, 22 nt, Pseudomonas aeruginosa PA01
ugaggaagcgcacgcaggcguc

SEQ ID NO: 169659 - RNA, 22 nt, Pseudomonas aeruginosa PA01
auccggggcgguuucgcagaca

SEQ ID NO: 169660 - RNA, 20 nt, Pseudomonas aeruginosa PA01
gccggguccgcaggaacgcc

SEQ ID NO: 169661 - RNA, 22 nt, Pseudomonas aeruginosa PA01
cgccgcuggucgaggccguacu

SEQ ID NO: 169662 - RNA, 22 nt, Pseudomonas aeruginosa PA01
gaugccuacuacgugucgccgg

SEQ ID NO: 169663 - RNA, 22 nt, Pseudomonas aeruginosa PA01
cgacuuccgcagccucggcgag

SEQ ID NO: 169664 - RNA, 22 nt, Pseudomonas aeruginosa PA01
ccugcuggcacguggccccggu

SEQ ID NO: 169665 - RNA, 22 nt, Pseudomonas aeruginosa PA01
cgcgaggaaaccucgcuggccg

SEQ ID NO: 169666 - RNA, 22 nt, Pseudomonas aeruginosa PA01
gucgaacaguugggcgcggaag

SEQ ID NO: 169667 - RNA, 22 nt, Pseudomonas aeruginosa PA01
accggugcaucgucuauccgcg

SEQ ID NO: 169668 - RNA, 22 nt, Pseudomonas aeruginosa PA01
caccgaccgaaucggcgagucc

SEQ ID NO: 169669 - RNA, 21 nt, Pseudomonas aeruginosa PA01
cagcgucacccgccaggugga

SEQ ID NO: 169670 - RNA, 22 nt, Pseudomonas aeruginosa PA01
ugcgggaucuucgacucgaugu

SEQ ID NO: 169671 - RNA, 22 nt, Pseudomonas aeruginosa PA01
cgcuucccgcggcugguccacu

SEQ ID NO: 169672 - RNA, 22 nt, Pseudomonas aeruginosa PA01
gggcaccauccgcgcggccauc

SEQ ID NO: 169673 - RNA, 22 nt, Pseudomonas aeruginosa PA01
gcuggccucgggccacgccuuc

SEQ ID NO: 169674 - RNA, 22 nt, Pseudomonas aeruginosa PA01
cggacgauggcguagguggcug

SEQ ID NO: 169675 - RNA, 22 nt, Pseudomonas aeruginosa PA01
cugggccaggccgguuuccugc

SEQ ID NO: 169676 - RNA, 22 nt, Pseudomonas aeruginosa PA01
gcggugacgaucuccuugauuc

SEQ ID NO: 169677 - RNA, 22 nt, Pseudomonas aeruginosa PA01
uuguccugggaugccgcggcgc

SEQ ID NO: 169678 - RNA, 22 nt, Pseudomonas aeruginosa PA01
uuucgacauggccgccggcagc

SEQ ID NO: 169679 - RNA, 22 nt, Pseudomonas aeruginosa PA01
cggccucgacguugaacuugcg

SEQ ID NO: 169680 - RNA, 22 nt, Pseudomonas aeruginosa PA01
cgcugagggccggccgauggaa

SEQ ID NO: 169681 - RNA, 22 nt, Pseudomonas aeruginosa PA01
gguccagauugcgcagcacgcc

SEQ ID NO: 169682 - RNA, 22 nt, Pseudomonas aeruginosa PA01
gguggcaggaugcgcagacugg

SEQ ID NO: 169683 - RNA, 22 nt, Pseudomonas aeruginosa PA01
ugcuccagguucgccggcgcgg

SEQ ID NO: 169684 - RNA, 22 nt, Pseudomonas aeruginosa PA01
cggcguaggugacgucguccug

SEQ ID NO: 169685 - RNA, 22 nt, Pseudomonas aeruginosa PA01
aacgggaagcccagggccucgg

SEQ ID NO: 169686 - RNA, 22 nt, Pseudomonas aeruginosa PA01
gaucaucacguaggucagccag

SEQ ID NO: 169687 - RNA, 22 nt, Pseudomonas aeruginosa PA01
ucggaggucaacccggccaugg

SEQ ID NO: 169688 - RNA, 22 nt, Pseudomonas aeruginosa PA01
ccgaguucaucaaggcgcacuu

SEQ ID NO: 169689 - RNA, 22 nt, Pseudomonas aeruginosa PA01
aaacugcaugagcggcucgacc

SEQ ID NO: 169690 - RNA, 22 nt, Pseudomonas aeruginosa PA01
aaacugaggaaagcgaaccugu

SEQ ID NO: 169691 - RNA, 22 nt, Pseudomonas aeruginosa PA01
aagcgaucggcgcggcugaucg

SEQ ID NO: 169692 - RNA, 20 nt, Pseudomonas aeruginosa PA01
aaggcauggguuuuucgucg

SEQ ID NO: 169693 - RNA, 22 nt, Pseudomonas aeruginosa PA01
aaggugaugaacgucucgcuga

SEQ ID NO: 169694 - RNA, 22 nt, Pseudomonas aeruginosa PA01
acaaggccgcgaugcgcccgcc

SEQ ID NO: 169695 - RNA, 22 nt, Pseudomonas aeruginosa PA01
acugguggaugccggugaucca

SEQ ID NO: 169696 - RNA, 22 nt, Pseudomonas aeruginosa PA01
acugcuuucgaaauauacgaau

SEQ ID NO: 169697 - RNA, 22 nt, Pseudomonas aeruginosa PA01
accacgagaccgaccagcaggc

SEQ ID NO: 169698 - RNA, 22 nt, Pseudomonas aeruginosa PA01
aggcucaggcaggccgccggca

SEQ ID NO: 169699 - RNA, 22 nt, Pseudomonas aeruginosa PA01
aggcucagguaauagcugggca

SEQ ID NO: 169700 - RNA, 23 nt, Pseudomonas aeruginosa PA01
aggguaguacgcauagcguacgu

SEQ ID NO: 169701 - RNA, 22 nt, Pseudomonas aeruginosa PA01
agggcgaggucagcguggacgc

SEQ ID NO: 169702 - RNA, 22 nt, Pseudomonas aeruginosa PA01
agggcgggaacugcgcgcgcag

SEQ ID NO: 169703 - RNA, 22 nt, Pseudomonas aeruginosa PA01
agggaguuuguccgcaggcugu

SEQ ID NO: 169704 - RNA, 22 nt, Pseudomonas aeruginosa PA01
agguggagcguugcggcgccgg

SEQ ID NO: 169705 - RNA, 22 nt, Pseudomonas aeruginosa PA01
agucgcugaugaaguucaccgc

SEQ ID NO: 169706 - RNA, 22 nt, Pseudomonas aeruginosa PA01
aguuugccgcaauccccggagg

SEQ ID NO: 169707 - RNA, 19 nt, Pseudomonas aeruginosa PA01
augcggaugccguggcggc

SEQ ID NO: 169708 - RNA, 22 nt, Pseudomonas aeruginosa PA01
augccgaaggcgaucgaggcga

SEQ ID NO: 169709 - RNA, 22 nt, Pseudomonas aeruginosa PA01
augccggccaccggagccggcg

SEQ ID NO: 169710 - RNA, 22 nt, Pseudomonas aeruginosa PA01
augccggcgaugggcgacuucg

SEQ ID NO: 169711 - RNA, 22 nt, Pseudomonas aeruginosa PA01
augccggcgccaacggugccgu

SEQ ID NO: 169712 - RNA, 22 nt, Pseudomonas aeruginosa PA01
aucuggagcaacaggucgcggg

SEQ ID NO: 169713 - RNA, 22 nt, Pseudomonas aeruginosa PA01
auaggagaaguccgaggcgauu

SEQ ID NO: 169714 - RNA, 22 nt, Pseudomonas aeruginosa PA01
auccucccgcagaucgcccgcc

SEQ ID NO: 169715 - RNA, 22 nt, Pseudomonas aeruginosa PA01
aucaggccgcaggcguggcccu

SEQ ID NO: 169716 - RNA, 22 nt, Pseudomonas aeruginosa PA01
auugaaagugauccgcgccugc

SEQ ID NO: 169717 - RNA, 22 nt, Pseudomonas aeruginosa PA01
cagaccucugccugccguguau

SEQ ID NO: 169718 - RNA, 22 nt, Pseudomonas aeruginosa PA01
cagcagccuggccggcaguuuu

SEQ ID NO: 169719 - RNA, 22 nt, Pseudomonas aeruginosa PA01
cagcagcgccucggcgccgaac

SEQ ID NO: 169720 - RNA, 22 nt, Pseudomonas aeruginosa PA01
cagcaggagauugccguccagc

SEQ ID NO: 169721 - RNA, 22 nt, Pseudomonas aeruginosa PA01
caggaguucggcggcgcgcucg

SEQ ID NO: 169722 - RNA, 22 nt, Pseudomonas aeruginosa PA01
cagcggugggccccacggcugc

SEQ ID NO: 169723 - RNA, 22 nt, Pseudomonas aeruginosa PA01
caggaaauggcccggggaggcu

SEQ ID NO: 169724 - RNA, 22 nt, Pseudomonas aeruginosa PA01
cagcuggaugcucgcgcucagc

SEQ ID NO: 169725 - RNA, 22 nt, Pseudomonas aeruginosa PA01
cagcugguuggcaauggcggcc

SEQ ID NO: 169726 - RNA, 22 nt, Pseudomonas aeruginosa PA01
cagccugaaggacuggccggcg

SEQ ID NO: 169727 - RNA, 22 nt, Pseudomonas aeruginosa PA01
cagcgccuggucggcccacugg

SEQ ID NO: 169728 - RNA, 22 nt, Pseudomonas aeruginosa PA01
cagcgcguucuuggccugccag

SEQ ID NO: 169729 - RNA, 22 nt, Pseudomonas aeruginosa PA01
cagcggcaacuggcggaggcgg

SEQ ID NO: 169730 - RNA, 22 nt, Pseudomonas aeruginosa PA01
caccagcuggcggugauggccg

SEQ ID NO: 169731 - RNA, 22 nt, Pseudomonas aeruginosa PA01
cacuggagcagcgccuggaucg

SEQ ID NO: 169732 - RNA, 22 nt, Pseudomonas aeruginosa PA01
caaggccagcagcagggugguc

SEQ ID NO: 169733 - RNA, 22 nt, Pseudomonas aeruginosa PA01
caagcgccugcgcgccuuccug

SEQ ID NO: 169734 - RNA, 22 nt, Pseudomonas aeruginosa PA01
gugccgaacagcgccaggcgca

SEQ ID NO: 169735 - RNA, 22 nt, Pseudomonas aeruginosa PA01
guggaaguggucgaggccccgg

SEQ ID NO: 169736 - RNA, 22 nt, Pseudomonas aeruginosa PA01
gugcuugugauguaagacuggu

SEQ ID NO: 169737 - RNA, 22 nt, Pseudomonas aeruginosa PA01
guggccaguaccguggugcugu

SEQ ID NO: 169738 - RNA, 22 nt, Pseudomonas aeruginosa PA01
guggccggcgcgauggcgucca

SEQ ID NO: 169739 - RNA, 22 nt, Pseudomonas aeruginosa PA01
ggcuccugguugccgggagcgg

SEQ ID NO: 169740 - RNA, 22 nt, Pseudomonas aeruginosa PA01
ggcucgcgagcgccagggcaac

SEQ ID NO: 169741 - RNA, 22 nt, Pseudomonas aeruginosa PA01
ggcugaugcagcagcgccaugu

SEQ ID NO: 169742 - RNA, 22 nt, Pseudomonas aeruginosa PA01
ggccaagggcgauggcggccug

SEQ ID NO: 169743 - RNA, 22 nt, Pseudomonas aeruginosa PA01
ggcugccgccgauggccuugga

SEQ ID NO: 169744 - RNA, 22 nt, Pseudomonas aeruginosa PA01
ggcucagccgcgcaugccgaag

SEQ ID NO: 169745 - RNA, 22 nt, Pseudomonas aeruginosa PA01
ggcgggugcucggagcgcuugc

SEQ ID NO: 169746 - RNA, 22 nt, Pseudomonas aeruginosa PA01
ggcgggugcugcuggaggaccu

SEQ ID NO: 169747 - RNA, 23 nt, Pseudomonas aeruginosa PA01
ggcggccgcccuccucaugugcc

SEQ ID NO: 169748 - RNA, 22 nt, Pseudomonas aeruginosa PA01
ggcggcgcuccucgaaggggaa

SEQ ID NO: 169749 - RNA, 22 nt, Pseudomonas aeruginosa PA01
ggcggcgcugcaggucggccug

SEQ ID NO: 169750 - RNA, 22 nt, Pseudomonas aeruginosa PA01
ggcuggugauguugccggcaag

SEQ ID NO: 169751 - RNA, 22 nt, Pseudomonas aeruginosa PA01
ggcuucggcuccccagccggac

SEQ ID NO: 169752 - RNA, 22 nt, Pseudomonas aeruginosa PA01
gggcgagccacucgccgaggaa

SEQ ID NO: 169753 - RNA, 22 nt, Pseudomonas aeruginosa PA01
gggcgaggaagccgccggcguc

SEQ ID NO: 169754 - RNA, 22 nt, Pseudomonas aeruginosa PA01
gggccagcucuucggcgauggu

SEQ ID NO: 169755 - RNA, 22 nt, Pseudomonas aeruginosa PA01
gggccgcccggcgggaucuugc

SEQ ID NO: 169756 - RNA, 22 nt, Pseudomonas aeruginosa PA01
gggccgggcgacgaacuggacg

SEQ ID NO: 169757 - RNA, 22 nt, Pseudomonas aeruginosa PA01
gggccgggcuucagcaucgacg

SEQ ID NO: 169758 - RNA, 22 nt, Pseudomonas aeruginosa PA01
gggcagcucgaggucuucgucg

SEQ ID NO: 169759 - RNA, 22 nt, Pseudomonas aeruginosa PA01
gggcagcuucagcaagcgcucg

SEQ ID NO: 169760 - RNA, 22 nt, Pseudomonas aeruginosa PA01
gggcggcuugcaggaaggcuuc

SEQ ID NO: 169761 - RNA, 20 nt, Pseudomonas aeruginosa PA01
gggcgcuggcauaggcgccc

SEQ ID NO: 169762 - RNA, 22 nt, Pseudomonas aeruginosa PA01
ggggaacagggucuucuggucg

SEQ ID NO: 169763 - RNA, 22 nt, Pseudomonas aeruginosa PA01
gggggcaggucacuugccccgc

SEQ ID NO: 169764 - RNA, 22 nt, Pseudomonas aeruginosa PA01
ggggucaggucgcugagcaggg

SEQ ID NO: 169765 - RNA, 22 nt, Pseudomonas aeruginosa PA01
uauugacacugaacgagccgga

SEQ ID NO: 169766 - RNA, 22 nt, Pseudomonas aeruginosa PA01
uaucaguuugaaguguaucugg

SEQ ID NO: 169767 - RNA, 19 nt, Pseudomonas aeruginosa PA01
uauuuccagcgcuacaucc

SEQ ID NO: 169768 - RNA, 22 nt, Pseudomonas aeruginosa PA01
ucaggcccauuucguugcggac

SEQ ID NO: 169769 - RNA, 20 nt, Pseudomonas aeruginosa PA01
ucaggccgucgaugccgggc

SEQ ID NO: 169770 - RNA, 22 nt, Pseudomonas aeruginosa PA01
ucagcuuccugcugaugcuggu

SEQ ID NO: 169771 - RNA, 22 nt, Pseudomonas aeruginosa PA01
ucuggcucgccaccggccgggu

SEQ ID NO: 169772 - RNA, 22 nt, Pseudomonas aeruginosa PA01
ucuuagcaggcgcacuaggaug

SEQ ID NO: 169773 - RNA, 22 nt, Pseudomonas aeruginosa PA01
uccugcucgaucacggccuggu

SEQ ID NO: 169774 - RNA, 22 nt, Pseudomonas aeruginosa PA01
uccucgcugucggccaaggaca

SEQ ID NO: 169775 - RNA, 22 nt, Pseudomonas aeruginosa PA01
uccucugucgguucgcauaggu

SEQ ID NO: 169776 - RNA, 22 nt, Pseudomonas aeruginosa PA01
ucucgucguccaugcucgcgcc

SEQ ID NO: 169777 - RNA, 22 nt, Pseudomonas aeruginosa PA01
ucucccugcccggcaucgaaca

SEQ ID NO: 169778 - RNA, 21 nt, Pseudomonas aeruginosa PA01
uccaccaguucgaacagcggc

SEQ ID NO: 169779 - RNA, 19 nt, Pseudomonas aeruginosa PA01
ucaucccuuccaccacguu

SEQ ID NO: 169780 - RNA, 22 nt, Pseudomonas aeruginosa PA01
ucaucugcuggguguccaccag

SEQ ID NO: 169781 - RNA, 22 nt, Pseudomonas aeruginosa PA01
uccggcucgacgccggcgaggu

SEQ ID NO: 169782 - RNA, 22 nt, Pseudomonas aeruginosa PA01
uccccggucgaugcggaagcuc

SEQ ID NO: 169783 - RNA, 22 nt, Pseudomonas aeruginosa PA01
uccgccggcgacagcaguucgg

SEQ ID NO: 169784 - RNA, 22 nt, Pseudomonas aeruginosa PA01
ucccaagggucuucuucacugg

SEQ ID NO: 169785 - RNA, 21 nt, Pseudomonas aeruginosa PA01
uggcagguacccggccggcug

SEQ ID NO: 169786 - RNA, 22 nt, Pseudomonas aeruginosa PA01
uggccagccgaaaauucuaugg

SEQ ID NO: 169787 - RNA, 22 nt, Pseudomonas aeruginosa PA01
uggccagcgcgacgggcuggcc

SEQ ID NO: 169788 - RNA, 22 nt, Pseudomonas aeruginosa PA01
uggccagcucggcgccggcaug

SEQ ID NO: 169789 - RNA, 22 nt, Pseudomonas aeruginosa PA01
uggccgccgcacgccgugcagg

SEQ ID NO: 169790 - RNA, 22 nt, Pseudomonas aeruginosa PA01
ugaugcggguuccgguagggga

SEQ ID NO: 169791 - RNA, 22 nt, Pseudomonas aeruginosa PA01
ugaugcuggucggcggggugcu

SEQ ID NO: 169792 - RNA, 23 nt, Pseudomonas aeruginosa PA01
ucuugcccuucuucucgacgguc

SEQ ID NO: 169793 - RNA, 19 nt, Pseudomonas aeruginosa PA01
ugagcagccccaggacgau

SEQ ID NO: 169794 - RNA, 22 nt, Pseudomonas aeruginosa PA01
ugagcauugccugagugcgcgu

SEQ ID NO: 169795 - RNA, 22 nt, Pseudomonas aeruginosa PA01
ugaggaagcgcacgcaggcguc

SEQ ID NO: 169796 - RNA, 22 nt, Pseudomonas aeruginosa PA01
ugagcgccugcucgcggcugau

SEQ ID NO: 169797 - RNA, 22 nt, Pseudomonas aeruginosa PA01
ugagcgccugcugcgcaccacc

SEQ ID NO: 169798 - RNA, 22 nt, Pseudomonas aeruginosa PA01
uggcgaccuucaagcgucggcu

SEQ ID NO: 169799 - RNA, 22 nt, Pseudomonas aeruginosa PA01
uggcugccgagggugaugcucu

SEQ ID NO: 169800 - RNA, 22 nt, Pseudomonas aeruginosa PA01
uggcgagcuugaacagguggcg

SEQ ID NO: 169801 - RNA, 20 nt, Pseudomonas aeruginosa PA01
uggcggcugaucuucggcug

SEQ ID NO: 169802 - RNA, 22 nt, Pseudomonas aeruginosa PA01
cuccuuggcuucgcccggaccg

SEQ ID NO: 169803 - RNA, 22 nt, Pseudomonas aeruginosa PA01
cuccuuggaacuauggguauug

SEQ ID NO: 169804 - RNA, 20 nt, Pseudomonas aeruginosa PA01
cuccccgggccauuuccugc

SEQ ID NO: 169805 - RNA, 22 nt, Pseudomonas aeruginosa PA01
cuccggcgugaucagggucucg

SEQ ID NO: 169806 - RNA, 22 nt, Pseudomonas aeruginosa PA01
cuccugcggcaugggugcguuc

SEQ ID NO: 169807 - RNA, 22 nt, Pseudomonas aeruginosa PA01
cucgccggcgccaugcagcagc

SEQ ID NO: 169808 - RNA, 22 nt, Pseudomonas aeruginosa PA01
cucagcaguaccuggucgagga

SEQ ID NO: 169809 - RNA, 20 nt, Pseudomonas aeruginosa PA01
cucuacaucgccuucggcgc

SEQ ID NO: 169810 - RNA, 22 nt, Pseudomonas aeruginosa PA01
cugccggccaggcggguguuca

SEQ ID NO: 169811 - RNA, 22 nt, Pseudomonas aeruginosa PA01
cugcugcaggucgacggcgccu

SEQ ID NO: 169812 - RNA, 23 nt, Pseudomonas aeruginosa PA01
cucugcuucggcuucuggcccgg

SEQ ID NO: 169813 - RNA, 22 nt, Pseudomonas aeruginosa PA01
cuuguguuuuuacugucgaaau

SEQ ID NO: 169814 - RNA, 22 nt, Pseudomonas aeruginosa PA01
cuugaccaccgccggguugcuc

SEQ ID NO: 169815 - RNA, 22 nt, Pseudomonas aeruginosa PA01
cuuccagcgcucgcugcgcacc

SEQ ID NO: 169816 - RNA, 22 nt, Pseudomonas aeruginosa PA01
cuucggccuuggcguccuguag

SEQ ID NO: 169817 - RNA, 22 nt, Pseudomonas aeruginosa PA01
cugcaucacccgcucguggucc

SEQ ID NO: 169818 - RNA, 22 nt, Pseudomonas aeruginosa PA01
cgagcgcuuccugaggcgcgua

SEQ ID NO: 169819 - RNA, 22 nt, Pseudomonas aeruginosa PA01
cgagcggccagggccugcaccg

SEQ ID NO: 169820 - RNA, 22 nt, Pseudomonas aeruginosa PA01
cgagcgucagcccgcuggucag

SEQ ID NO: 169821 - RNA, 18 nt, Pseudomonas aeruginosa PA01
cgaccaggcguggcugua

SEQ ID NO: 169822 - RNA, 22 nt, Pseudomonas aeruginosa PA01
cgacccgccaggcgcugggcga

SEQ ID NO: 169823 - RNA, 22 nt, Pseudomonas aeruginosa PA01
cgaggccggcguggcgaaguag

SEQ ID NO: 169824 - RNA, 22 nt, Pseudomonas aeruginosa PA01
cgaggaaguugaggauggcguu

SEQ ID NO: 169825 - RNA, 22 nt, Pseudomonas aeruginosa PA01
cgaaggucacgucgacgcaggg

SEQ ID NO: 169826 - RNA, 22 nt, Pseudomonas aeruginosa PA01
cgaagugcuggaacagguccgc

SEQ ID NO: 169827 - RNA, 22 nt, Pseudomonas aeruginosa PA01
cauccggcggacagcccgcccc

SEQ ID NO: 169828 - RNA, 22 nt, Pseudomonas aeruginosa PA01
caggccgaccaggaacgcggug

SEQ ID NO: 169829 - RNA, 23 nt, Pseudomonas aeruginosa PA01
caggccguugcuggcagcguggg

SEQ ID NO: 169830 - RNA, 22 nt, Pseudomonas aeruginosa PA01
caggcccagcugggucgcgguc

SEQ ID NO: 169831 - RNA, 22 nt, Pseudomonas aeruginosa PA01
caggccccgugcgcgggauguu

SEQ ID NO: 169832 - RNA, 22 nt, Pseudomonas aeruginosa PA01
cagggccacauggagauggaac

SEQ ID NO: 169833 - RNA, 22 nt, Pseudomonas aeruginosa PA01
cagggccagcaacugauggccg

SEQ ID NO: 169834 - RNA, 22 nt, Pseudomonas aeruginosa PA01
cagggcuacggcgagcguaccg

SEQ ID NO: 169835 - RNA, 22 nt, Pseudomonas aeruginosa PA01
cgaugcuggucagcuuggcguu

SEQ ID NO: 169836 - RNA, 22 nt, Pseudomonas aeruginosa PA01
cgauggccaagcgcagguccgg

SEQ ID NO: 169837 - RNA, 22 nt, Pseudomonas aeruginosa PA01
cgcagcaggcgguacucggcgc

SEQ ID NO: 169838 - RNA, 22 nt, Pseudomonas aeruginosa PA01
cgccccacuggcgccgcucgaa

SEQ ID NO: 169839 - RNA, 22 nt, Pseudomonas aeruginosa PA01
cggggagccucgucgacgaggc

SEQ ID NO: 169840 - RNA, 22 nt, Pseudomonas aeruginosa PA01
cggggccacgugccagcaggag

SEQ ID NO: 169841 - RNA, 22 nt, Pseudomonas aeruginosa PA01
cggggcuggucucgacccuguu

SEQ ID NO: 169842 - RNA, 22 nt, Pseudomonas aeruginosa PA01
cgccagagcccgguggcgaucc

SEQ ID NO: 169843 - RNA, 21 nt, Pseudomonas aeruginosa PA01
cgccaccaguuguucgugacc

SEQ ID NO: 169844 - RNA, 22 nt, Pseudomonas aeruginosa PA01
cgccaccaugaucaagccuucc

SEQ ID NO: 169845 - RNA, 22 nt, Pseudomonas aeruginosa PA01
cgccaccuggcuggugccgcgc

SEQ ID NO: 169846 - RNA, 22 nt, Pseudomonas aeruginosa PA01
cgccagggcgccgaucagcucg

SEQ ID NO: 169847 - RNA, 22 nt, Pseudomonas aeruginosa PA01
cggugcgccugccguuccugau

SEQ ID NO: 169848 - RNA, 23 nt, Pseudomonas aeruginosa PA01
cggugggcgccggccauggccuc

SEQ ID NO: 169849 - RNA, 22 nt, Pseudomonas aeruginosa PA01
cggguggucuucgagcguccgc

SEQ ID NO: 169850 - RNA, 22 nt, Pseudomonas aeruginosa PA01
cggguucauggucuucagcgcc

SEQ ID NO: 169851 - RNA, 23 nt, Pseudomonas aeruginosa PA01
cguccggacgacgacccggcguu

SEQ ID NO: 169852 - RNA, 22 nt, Pseudomonas aeruginosa PA01
cgucggccaggaggugguacgc

SEQ ID NO: 169853 - RNA, 22 nt, Pseudomonas aeruginosa PA01
cgucggccuguggaucgccgcc

SEQ ID NO: 169854 - RNA, 22 nt, Pseudomonas aeruginosa PA01
cguggcgaugucggcguggccg

SEQ ID NO: 169855 - RNA, 22 nt, Pseudomonas aeruginosa PA01
gcugguaguggucgagcaucau

SEQ ID NO: 169856 - RNA, 22 nt, Pseudomonas aeruginosa PA01
gcugguggugcagcccaggcaa

SEQ ID NO: 169857 - RNA, 22 nt, Pseudomonas aeruginosa PA01
gcugcgcaaguaccuggcgcgu

SEQ ID NO: 169858 - RNA, 22 nt, Pseudomonas aeruginosa PA01
gcugcgcgagcguggcugggac

SEQ ID NO: 169859 - RNA, 22 nt, Pseudomonas aeruginosa PA01
gcuggagcuucgccggaagcgg

SEQ ID NO: 169860 - RNA, 22 nt, Pseudomonas aeruginosa PA01
gcuggccgaguuccgccgacag

SEQ ID NO: 169861 - RNA, 22 nt, Pseudomonas aeruginosa PA01
gcuggcggagaagugcggguug

SEQ ID NO: 169862 - RNA, 22 nt, Pseudomonas aeruginosa PA01
gcugaagggcuccgcgcugucc

SEQ ID NO: 169863 - RNA, 23 nt, Pseudomonas aeruginosa PA01
gcugccggcggcgucguugucgu

SEQ ID NO: 169864 - RNA, 21 nt, Pseudomonas aeruginosa PA01
gccgcacgcugcccuccaggc

SEQ ID NO: 169865 - RNA, 17 nt, Pseudomonas aeruginosa PA01
gccgccgaggucggcga

SEQ ID NO: 169866 - RNA, 22 nt, Pseudomonas aeruginosa PA01
gccgccgagucccuggagcgug

SEQ ID NO: 169867 - RNA, 22 nt, Pseudomonas aeruginosa PA01
gccggagagauccgcaaccugc

SEQ ID NO: 169868 - RNA, 22 nt, Pseudomonas aeruginosa PA01
gccggagcugccggccgaccug

SEQ ID NO: 169869 - RNA, 22 nt, Pseudomonas aeruginosa PA01
gccggccaguucaccggcgcgc

SEQ ID NO: 169870 - RNA, 22 nt, Pseudomonas aeruginosa PA01
gcucgcgauugccguccagcca

SEQ ID NO: 169871 - RNA, 22 nt, Pseudomonas aeruginosa PA01
gcucgcucaucaucacgaaauc

SEQ ID NO: 169872 - RNA, 22 nt, Pseudomonas aeruginosa PA01
gcucgucggugaccggcgagac

SEQ ID NO: 169873 - RNA, 22 nt, Pseudomonas aeruginosa PA01
gccccucgcggaucucggcgau

SEQ ID NO: 169874 - RNA, 21 nt, Pseudomonas aeruginosa PA01
gccgagcgauucggcgggagg

SEQ ID NO: 169875 - RNA, 22 nt, Pseudomonas aeruginosa PA01
gccgaggaauuuccccgcgaac

SEQ ID NO: 169876 - RNA, 22 nt, Pseudomonas aeruginosa PA01
gccgaggagaccuggcggguac

SEQ ID NO: 169877 - RNA, 22 nt, Pseudomonas aeruginosa PA01
ggcaagcugaagaugggcggca

SEQ ID NO: 169878 - RNA, 22 nt, Pseudomonas aeruginosa PA01
ggcagcuucgaccgcccguucg

SEQ ID NO: 169879 - RNA, 18 nt, Pseudomonas aeruginosa PA01
ggcaggaugcacgucgcc

SEQ ID NO: 169880 - RNA, 22 nt, Pseudomonas aeruginosa PA01
ggauggccgccaccggcaagca

SEQ ID NO: 169881 - RNA, 21 nt, Pseudomonas aeruginosa PA01
gcugggaccccgagguggucg

SEQ ID NO: 169882 - RNA, 23 nt, Pseudomonas aeruginosa PA01
ggaugcugucgacccgcucgcgc

SEQ ID NO: 169883 - RNA, 22 nt, Pseudomonas aeruginosa PA01
ggcacagcuucgguggggcgag

SEQ ID NO: 169884 - RNA, 22 nt, Pseudomonas aeruginosa PA01
ggcccgggugauccuccagcau

SEQ ID NO: 169885 - RNA, 22 nt, Pseudomonas aeruginosa PA01
ggcccuggcgaugcgcuggcug

SEQ ID NO: 169886 - RNA, 17 nt, Pseudomonas aeruginosa PA01
ggccgacagcgggcgga

SEQ ID NO: 169887 - RNA, 22 nt, Pseudomonas aeruginosa PA01
ggccgccguagccgcugaucag

SEQ ID NO: 169888 - RNA, 22 nt, Pseudomonas aeruginosa PA01
ggccgcgcuggcggaggaggaa

SEQ ID NO: 169889 - RNA, 22 nt, Pseudomonas aeruginosa PA01
ggccgcucugcugcagggccug

SEQ ID NO: 169890 - RNA, 22 nt, Pseudomonas aeruginosa PA01
ggccggcaccgaugucaccgcg

SEQ ID NO: 169891 - RNA, 22 nt, Pseudomonas aeruginosa PA01
ggccggcgacgguggccgaggu

SEQ ID NO: 169892 - RNA, 23 nt, Pseudomonas aeruginosa PA01
ggccgggaucgagcaacuggcgc

SEQ ID NO: 169893 - RNA, 22 nt, Pseudomonas aeruginosa PA01
ggccaggcugagaaggacggcg

SEQ ID NO: 169894 - RNA, 22 nt, Pseudomonas aeruginosa PA01
ggccaugaggcggcggcgcugu

SEQ ID NO: 169895 - RNA, 22 nt, Pseudomonas aeruginosa PA01
ggccugccugcuguuucccggc

SEQ ID NO: 169896 - RNA, 22 nt, Pseudomonas aeruginosa PA01
ggccugggccuggaagacguag

SEQ ID NO: 169897 - RNA, 20 nt, Pseudomonas aeruginosa PA01
ggccuggggcgacgaugcgc

SEQ ID NO: 169898 - RNA, 22 nt, Pseudomonas aeruginosa PA01
ggccucccggcgcagacgacgc

SEQ ID NO: 169899 - RNA, 22 nt, Pseudomonas aeruginosa PA01
ggcgagcuuggcggcgauggcg

SEQ ID NO: 169900 - RNA, 22 nt, Pseudomonas aeruginosa PA01
ggcgaggaacacgcagccgagc

SEQ ID NO: 169901 - RNA, 22 nt, Pseudomonas aeruginosa PA01
ggcgaugaagaucgucggcgua

SEQ ID NO: 169902 - RNA, 22 nt, Pseudomonas aeruginosa PA01
ggcgcugcuguuccaguacgcg

SEQ ID NO: 169903 - RNA, 22 nt, Pseudomonas aeruginosa PA01
ggcgcugguggucgauccgggc

SEQ ID NO: 169904 - RNA, 22 nt, Pseudomonas aeruginosa PA01
ggcgcccagcgucgccaggcuc

SEQ ID NO: 169905 - RNA, 22 nt, Pseudomonas aeruginosa PA01
ggcgcgaguugcugcgcgucua

SEQ ID NO: 169906 - RNA, 22 nt, Pseudomonas aeruginosa PA01
ggcgagcagcggcaggcugucg

SEQ ID NO: 169907 - RNA, 22 nt, Pseudomonas aeruginosa PA01
ggcgagcgguucgcgggaaagg

SEQ ID NO: 169908 - RNA, 22 nt, Pseudomonas aeruginosa PA01
gacgaggacgaggaugucgagg

SEQ ID NO: 169909 - RNA, 22 nt, Pseudomonas aeruginosa PA01
gcaggcgcgccaggugcagcga

SEQ ID NO: 169910 - RNA, 22 nt, Pseudomonas aeruginosa PA01
gcagcuggaaguugucaacgaa

SEQ ID NO: 169911 - RNA, 22 nt, Pseudomonas aeruginosa PA01
gcagggcgugcgcccggcgaau

SEQ ID NO: 169912 - RNA, 22 nt, Pseudomonas aeruginosa PA01
gcagcgaguagccgauccccgg

SEQ ID NO: 169913 - RNA, 22 nt, Pseudomonas aeruginosa PA01
gcagcgccaguugcuggacacc

SEQ ID NO: 169914 - RNA, 22 nt, Pseudomonas aeruginosa PA01
gcagcgcugcgcgagcagggug

SEQ ID NO: 169915 - RNA, 22 nt, Pseudomonas aeruginosa PA01
gcaggguggccuccuugagcuu

SEQ ID NO: 169916 - RNA, 22 nt, Pseudomonas aeruginosa PA01
gaccaggcguacguauagcagg

SEQ ID NO: 169917 - RNA, 22 nt, Pseudomonas aeruginosa PA01
gaagagcgccaacgucgagggc

SEQ ID NO: 169918 - RNA, 22 nt, Pseudomonas aeruginosa PA01
gaagugccccggggcgaccgcg

SEQ ID NO: 169919 - RNA, 22 nt, Pseudomonas aeruginosa PA01
gccccgcgggaggacggcugcu

SEQ ID NO: 169920 - RNA, 22 nt, Pseudomonas aeruginosa PA01
gcccacggcgcugccacagaag

SEQ ID NO: 169921 - RNA, 22 nt, Pseudomonas aeruginosa PA01
gcccagaugcauucgcgcuuga

SEQ ID NO: 169922 - RNA, 22 nt, Pseudomonas aeruginosa PA01
gcccaggcccuggcgcgggcuc

SEQ ID NO: 169923 - RNA, 22 nt, Pseudomonas aeruginosa PA01
gcccagggaguacggcggcaug

SEQ ID NO: 169924 - RNA, 18 nt, Pseudomonas aeruginosa PA01
gcccggcguaguccagca

SEQ ID NO: 169925 - RNA, 22 nt, Pseudomonas aeruginosa PA01
gcccggcucgaagagcgugcgc

SEQ ID NO: 169926 - RNA, 22 nt, Pseudomonas aeruginosa PA01
gcccggcuucccggcggaaagu

SEQ ID NO: 169927 - RNA, 22 nt, Pseudomonas aeruginosa PA01
gccaggccugcucguguuccgg

SEQ ID NO: 169928 - RNA, 22 nt, Pseudomonas aeruginosa PA01
gcagguugcacgccgcccuggc

SEQ ID NO: 169929 - RNA, 22 nt, Pseudomonas aeruginosa PA01
gcagucuucagcaugccgcguc

SEQ ID NO: 169930 - RNA, 22 nt, Pseudomonas aeruginosa PA01
gcagggccuugucggucagggg

SEQ ID NO: 169931 - RNA, 19 nt, Pseudomonas aeruginosa PA01
gcaguucagcgacaacccg

SEQ ID NO: 169932 - RNA, 23 nt, Pseudomonas aeruginosa PA01
gccaccccauaugccuggcgugc

SEQ ID NO: 169933 - RNA, 22 nt, Pseudomonas aeruginosa PA01
gccaccacccgggugcgcucca

SEQ ID NO: 169934 - RNA, 22 nt, Pseudomonas aeruginosa PA01
gccagcaguucgcgggcacggg

SEQ ID NO: 169935 - RNA, 22 nt, Pseudomonas aeruginosa PA01
gccacuccucguuccaggcuga

SEQ ID NO: 169936 - RNA, 23 nt, Pseudomonas aeruginosa PA01
uguggccaauugauggccuugug

SEQ ID NO: 169937 - RNA, 23 nt, Pseudomonas aeruginosa PA01
ugucuccagcgucuucgggcugu

SEQ ID NO: 169938 - RNA, 22 nt, Pseudomonas aeruginosa PA01
uguucgaacgccaggucgaggc

SEQ ID NO: 169939 - RNA, 22 nt, Pseudomonas aeruginosa PA01
aacugagucucggcaaucauag

SEQ ID NO: 169940 - RNA, 22 nt, Pseudomonas aeruginosa PA01
aacgccaggcgcuggcuuucgu

SEQ ID NO: 169941 - RNA, 22 nt, Pseudomonas aeruginosa PA01
aauagcggcuuuucgaugcgca

SEQ ID NO: 169942 - RNA, 22 nt, Pseudomonas aeruginosa PA01
agcuggaagaucaccuguucga

SEQ ID NO: 169943 - RNA, 22 nt, Pseudomonas aeruginosa PA01
agcuggagcgugaguucgccgc

SEQ ID NO: 169944 - RNA, 23 nt, Pseudomonas aeruginosa PA01
agcuggauggccgccugcuguuc

SEQ ID NO: 169945 - RNA, 19 nt, Pseudomonas aeruginosa PA01
agcuggcgcagcagggugc

SEQ ID NO: 169946 - RNA, 22 nt, Pseudomonas aeruginosa PA01
agcugcaccauguugagcagcu

SEQ ID NO: 169947 - RNA, 22 nt, Pseudomonas aeruginosa PA01
agcgggagaucgccaguugaug

SEQ ID NO: 169948 - RNA, 22 nt, Pseudomonas aeruginosa PA01
agcguggccuucuccucggaca

SEQ ID NO: 169949 - RNA, 20 nt, Pseudomonas aeruginosa PA01
agcgacccuugagcgccggc

SEQ ID NO: 169950 - RNA, 22 nt, Pseudomonas aeruginosa PA01
agcgaggcgucuggcacggcga

SEQ ID NO: 169951 - RNA, 22 nt, Pseudomonas aeruginosa PA01
aggagcgcgcggugaucgcccu

SEQ ID NO: 169952 - RNA, 20 nt, Pseudomonas aeruginosa PA01
aggaggccggcuuguugcgg

SEQ ID NO: 169953 - RNA, 22 nt, Pseudomonas aeruginosa PA01
aggaacaguucgacgcccaggu

SEQ ID NO: 169954 - RNA, 22 nt, Pseudomonas aeruginosa PA01
aggccgaccugcagcgccgccg

SEQ ID NO: 169955 - RNA, 22 nt, Pseudomonas aeruginosa PA01
aggcccagcacggugcccaugg

SEQ ID NO: 169956 - RNA, 22 nt, Pseudomonas aeruginosa PA01
aggauuuccggaucguuggcca

SEQ ID NO: 169957 - RNA, 20 nt, Pseudomonas aeruginosa PA01
aggccagggcgcugaucggc

SEQ ID NO: 169958 - RNA, 22 nt, Pseudomonas aeruginosa PA01
agccagcccugggcgucgcuca

SEQ ID NO: 169959 - RNA, 22 nt, Pseudomonas aeruginosa PA01
agccagccggccaguugcuccg

SEQ ID NO: 169960 - RNA, 22 nt, Pseudomonas aeruginosa PA01
agcgcagcaggcaggccuggua

SEQ ID NO: 169961 - RNA, 22 nt, Pseudomonas aeruginosa PA01
agcgccacgguggcgccgguga

SEQ ID NO: 169962 - RNA, 22 nt, Pseudomonas aeruginosa PA01
agcgccaggugucgaccaucuu

SEQ ID NO: 169963 - RNA, 22 nt, Pseudomonas aeruginosa PA01
agcgccaguaccgggcggccgc

SEQ ID NO: 169964 - RNA, 22 nt, Pseudomonas aeruginosa PA01
agcgccucgcgcucggcaugac

SEQ ID NO: 169965 - RNA, 22 nt, Pseudomonas aeruginosa PA01
agcgcgaggccagccagcaacu

SEQ ID NO: 169966 - RNA, 22 nt, Pseudomonas aeruginosa PA01
agcgcgcacgcacacccagcuc

SEQ ID NO: 169967 - RNA, 22 nt, Pseudomonas aeruginosa PA01
agcgcgccaucaggcgguucga

SEQ ID NO: 169968 - RNA, 22 nt, Pseudomonas aeruginosa PA01
agcgcggcaagauguucggcuu

SEQ ID NO: 169969 - RNA, 21 nt, Pseudomonas aeruginosa PA01
agcgcggcgccgaauaucggg

SEQ ID NO: 169970 - RNA, 22 nt, Pseudomonas aeruginosa PA01
agcgcgugguucagcagcacau

SEQ ID NO: 169971 - RNA, 22 nt, Pseudomonas aeruginosa PA01
agcagcgccugaaggaagucga

SEQ ID NO: 169972 - RNA, 22 nt, Pseudomonas aeruginosa PA01
agcagcggguggccaugggccg

SEQ ID NO: 169973 - RNA, 22 nt, Pseudomonas aeruginosa PA01
agcaagcuguggcuggugaucu

SEQ ID NO: 169974 - RNA, 22 nt, Pseudomonas aeruginosa PA01
agcaccagguaggacagcgccu

SEQ ID NO: 169975 - RNA, 22 nt, Pseudomonas aeruginosa PA01
agcaccccgccgaccagcauca

SEQ ID NO: 169976 - RNA, 22 nt, Pseudomonas aeruginosa PA01
aaugcauuugccgcugccuggg

SEQ ID NO: 169977 - RNA, 22 nt, Pseudomonas aeruginosa PA01
accagggcggcgcgguuuuccu

SEQ ID NO: 169978 - RNA, 22 nt, Pseudomonas aeruginosa PA01
accauggccgccuucgagucca

SEQ ID NO: 169979 - RNA, 22 nt, Pseudomonas aeruginosa PA01
acgcgcgcaaccgacggcaggg

SEQ ID NO: 169980 - RNA, 22 nt, Pseudomonas aeruginosa PA01
accggcagaccaucggcggcua

SEQ ID NO: 169981 - RNA, 22 nt, Pseudomonas aeruginosa PA01
acccggaccgaggucaaguaag

SEQ ID NO: 169982 - RNA, 23 nt, Pseudomonas aeruginosa PA01
acgucggcugggagcguucgcgc

SEQ ID NO: 169983 - RNA, 22 nt, Pseudomonas aeruginosa PA01
acggaacaguucgguggccccg

SEQ ID NO: 169984 - RNA, 22 nt, Pseudomonas aeruginosa PA01
acggaagcgauccgugccuggu

SEQ ID NO: 169985 - RNA, 22 nt, Pseudomonas aeruginosa PA01
acggccagguggugcagaucga

SEQ ID NO: 169986 - RNA, 22 nt, Pseudomonas aeruginosa PA01
agagcggcuugcuggucggcgc

SEQ ID NO: 169987 - RNA, 22 nt, Pseudomonas aeruginosa PA01
agagcggccugcgcuucggcga

SEQ ID NO: 169988 - RNA, 22 nt, Pseudomonas aeruginosa PA01
uuucuucaaccagggcgagguc

SEQ ID NO: 169989 - RNA, 22 nt, Pseudomonas aeruginosa PA01
uuuccucgaugucgccgcccuu

SEQ ID NO: 169990 - RNA, 22 nt, Pseudomonas aeruginosa PA01
uuucgcggacgaacuggcggau

SEQ ID NO: 169991 - RNA, 22 nt, Pseudomonas aeruginosa PA01
uggugcuggcgcaacuggcguc

SEQ ID NO: 169992 - RNA, 22 nt, Pseudomonas aeruginosa PA01
ugguccuggcggagcugcccaa

SEQ ID NO: 169993 - RNA, 22 nt, Pseudomonas aeruginosa PA01
ugguccuguucgcccugacccu

SEQ ID NO: 169994 - RNA, 22 nt, Pseudomonas aeruginosa PA01
ugguggugggaagcgaugccga

SEQ ID NO: 169995 - RNA, 22 nt, Pseudomonas aeruginosa PA01
uggagugcagaaaggcuucgac

SEQ ID NO: 169996 - RNA, 22 nt, Pseudomonas aeruginosa PA01
uggagcguucccgcgagguagc

SEQ ID NO: 169997 - RNA, 22 nt, Pseudomonas aeruginosa PA01
ugggcggcaagccugcgcgaca

SEQ ID NO: 169998 - RNA, 22 nt, Pseudomonas aeruginosa PA01
ugggucuucucguugaggguga

SEQ ID NO: 169999 - RNA, 22 nt, Pseudomonas aeruginosa PA01
uggggcugaccucgcuguucgg

SEQ ID NO: 170000 - RNA, 22 nt, Pseudomonas aeruginosa PA01
uucaguucgagcaucgucuggc

SEQ ID NO: 170001 - RNA, 22 nt, Pseudomonas aeruginosa PA01
uucagcagcagcuucagguauu

SEQ ID NO: 170002 - RNA, 22 nt, Pseudomonas aeruginosa PA01
uuccaguuggcggcguugcagc

SEQ ID NO: 170003 - RNA, 22 nt, Pseudomonas aeruginosa PA01
uuccacggucagcaccgccggc

SEQ ID NO: 170004 - RNA, 21 nt, Pseudomonas aeruginosa PA01
uucuucagccugcgcgccgug

SEQ ID NO: 170005 - RNA, 22 nt, Pseudomonas aeruginosa PA01
uucuucagcuugaucacgucga

SEQ ID NO: 170006 - RNA, 21 nt, Pseudomonas aeruginosa PA01
uucugccuuugcucugugcuc

SEQ ID NO: 170007 - RNA, 20 nt, Pseudomonas aeruginosa PA01
uuccaucacguagcugccgu

SEQ ID NO: 170008 - RNA, 22 nt, Pseudomonas aeruginosa PA01
uucccgcuggcagauggcccug

SEQ ID NO: 170009 - RNA, 22 nt, Pseudomonas aeruginosa PA01
uucccgucgaugcggagcggau

SEQ ID NO: 170010 - RNA, 22 nt, Pseudomonas aeruginosa PA01
uuggccagcagcagcgggccca

SEQ ID NO: 170011 - RNA, 22 nt, Pseudomonas aeruginosa PA01
uuuaucugcaggacccggucgc

SEQ ID NO: 170012 - RNA, 22 nt, Pseudomonas aeruginosa PA01
uugccugcuguuccuugccugc

SEQ ID NO: 170013 - RNA, 22 nt, Pseudomonas aeruginosa PA01
uugcaugaacggcgugccguuc

SEQ ID NO: 170014 - RNA, 22 nt, Pseudomonas aeruginosa PA01
uugcccgguugcagcggcacca

SEQ ID NO: 170015 - RNA, 22 nt, Pseudomonas aeruginosa PA01
gauggacgugcauggccgggcc

SEQ ID NO: 170016 - RNA, 22 nt, Pseudomonas aeruginosa PA01
gaugugcagcggcuccagggcc

SEQ ID NO: 170017 - RNA, 22 nt, Pseudomonas aeruginosa PA01
gcagcagcuugccguccggguu

SEQ ID NO: 170018 - RNA, 22 nt, Pseudomonas aeruginosa PA01
gccggccguagggaaucgaacg

SEQ ID NO: 170019 - RNA, 22 nt, Pseudomonas aeruginosa PA01
gccggccguugcaauggcugua

SEQ ID NO: 170020 - RNA, 22 nt, Pseudomonas aeruginosa PA01
gccggcgagcaguuggcgaugu

SEQ ID NO: 170021 - RNA, 22 nt, Pseudomonas aeruginosa PA01
gccggcucaucagcacccgcug

SEQ ID NO: 170022 - RNA, 22 nt, Pseudomonas aeruginosa PA01
gccgggauggaggagcaucucg

SEQ ID NO: 170023 - RNA, 22 nt, Pseudomonas aeruginosa PA01
gccggggcgcucgaccuggagg

SEQ ID NO: 170024 - RNA, 22 nt, Pseudomonas aeruginosa PA01
gccguggaagcucgccacgccg

SEQ ID NO: 170025 - RNA, 22 nt, Pseudomonas aeruginosa PA01
gcacuggaauggccggccgcgc

SEQ ID NO: 170026 - RNA, 22 nt, Pseudomonas aeruginosa PA01
gcgcuccagcacuucguccagc

SEQ ID NO: 170027 - RNA, 22 nt, Pseudomonas aeruginosa PA01
gcgcuggagguguuccgccgcg

SEQ ID NO: 170028 - RNA, 22 nt, Pseudomonas aeruginosa PA01
gcggaauggcugucgccccaac

SEQ ID NO: 170029 - RNA, 22 nt, Pseudomonas aeruginosa PA01
gcggaccugcucggccagcacc

SEQ ID NO: 170030 - RNA, 22 nt, Pseudomonas aeruginosa PA01
gcggacgcucuucggugaagcg

SEQ ID NO: 170031 - RNA, 22 nt, Pseudomonas aeruginosa PA01
gcgccccggugccgccguggaa

SEQ ID NO: 170032 - RNA, 22 nt, Pseudomonas aeruginosa PA01
gcgcccggugugccggcuggcg

SEQ ID NO: 170033 - RNA, 22 nt, Pseudomonas aeruginosa PA01
gcgccgaggcaggcguggaccu

SEQ ID NO: 170034 - RNA, 18 nt, Pseudomonas aeruginosa PA01
gcggcgccgggccagcag

SEQ ID NO: 170035 - RNA, 22 nt, Pseudomonas aeruginosa PA01
gcggcgcgggucuggcugagca

SEQ ID NO: 170036 - RNA, 22 nt, Pseudomonas aeruginosa PA01
gcggcugguugaucucgugggc

SEQ ID NO: 170037 - RNA, 22 nt, Pseudomonas aeruginosa PA01
gcgggaggaucgaauugcaggc

SEQ ID NO: 170038 - RNA, 22 nt, Pseudomonas aeruginosa PA01
gcgucaucgcccuugccgcacc

SEQ ID NO: 170039 - RNA, 22 nt, Pseudomonas aeruginosa PA01
gcgcaagcucgacgagaacggc

SEQ ID NO: 170040 - RNA, 22 nt, Pseudomonas aeruginosa PA01
gcgcgacgcggggauggacgug

SEQ ID NO: 170041 - RNA, 22 nt, Pseudomonas aeruginosa PA01
gcgcgacgcuguugcuggcggg

SEQ ID NO: 170042 - RNA, 22 nt, Pseudomonas aeruginosa PA01
gcgcgcagcgagacgguggugc

SEQ ID NO: 170043 - RNA, 22 nt, Pseudomonas aeruginosa PA01
gcgcgccucuuccagcagccag

SEQ ID NO: 170044 - RNA, 22 nt, Pseudomonas aeruginosa PA01
gcgcgcgagaaagcggucggug

SEQ ID NO: 170045 - RNA, 19 nt, Pseudomonas aeruginosa PA01
gcgcggggugcggaugcug

SEQ ID NO: 170046 - RNA, 22 nt, Pseudomonas aeruginosa PA01
gcgcgguggucuucaggccggc

SEQ ID NO: 170047 - RNA, 21 nt, Pseudomonas aeruginosa PA01
gcgcggugucgccaucgcgac

SEQ ID NO: 170048 - RNA, 22 nt, Pseudomonas aeruginosa PA01
gcgcgugcauuggcuggccggc

SEQ ID NO: 170049 - RNA, 22 nt, Pseudomonas aeruginosa PA01
gccuggagguccaggcgcuggc

SEQ ID NO: 170050 - RNA, 22 nt, Pseudomonas aeruginosa PA01
gcgaacagcagaugcucgccau

SEQ ID NO: 170051 - RNA, 22 nt, Pseudomonas aeruginosa PA01
gccuucaggcccuggcggaaua

SEQ ID NO: 170052 - RNA, 22 nt, Pseudomonas aeruginosa PA01
gccuuggugcacgaggcgcagg

SEQ ID NO: 170053 - RNA, 22 nt, Pseudomonas aeruginosa PA01
gcgaggaauucgccuugcugcg

SEQ ID NO: 170054 - RNA, 22 nt, Pseudomonas aeruginosa PA01
gcgaggagccgcuggacugguc

SEQ ID NO: 170055 - RNA, 22 nt, Pseudomonas aeruginosa PA01
gcgaccagccuucgcgcuugcc

SEQ ID NO: 170056 - RNA, 22 nt, Pseudomonas aeruginosa PA01
gcgacggagucaacgacguacc

SEQ ID NO: 170057 - RNA, 22 nt, Pseudomonas aeruginosa PA01
gcgagccgaugcaacgggcgac

SEQ ID NO: 170058 - RNA, 22 nt, Pseudomonas aeruginosa PA01
cuggcccaggacuaugccgcgc

SEQ ID NO: 170059 - RNA, 22 nt, Pseudomonas aeruginosa PA01
cuggcccaggugauggccguca

SEQ ID NO: 170060 - RNA, 22 nt, Pseudomonas aeruginosa PA01
cuggauuuuuugccggaaagcc

SEQ ID NO: 170061 - RNA, 22 nt, Pseudomonas aeruginosa PA01
cgggcgaggguaccgggagcua

SEQ ID NO: 170062 - RNA, 22 nt, Pseudomonas aeruginosa PA01
cuggaaggcgagcaucuucaug

SEQ ID NO: 170063 - RNA, 22 nt, Pseudomonas aeruginosa PA01
cugguggcgcggcugcaggagu

SEQ ID NO: 170064 - RNA, 22 nt, Pseudomonas aeruginosa PA01
gagcggccggacuucggcgaga

SEQ ID NO: 170065 - RNA, 22 nt, Pseudomonas aeruginosa PA01
gagcgccaggugauccucggca

SEQ ID NO: 170066 - RNA, 22 nt, Pseudomonas aeruginosa PA01
gagagcgugucggacaugucuu

SEQ ID NO: 170067 - RNA, 22 nt, Pseudomonas aeruginosa PA01
gaggcgccggaaugggucgccg

SEQ ID NO: 170068 - RNA, 22 nt, Pseudomonas aeruginosa PA01
gaggcgcgcgggcugcucaacc

SEQ ID NO: 170069 - RNA, 22 nt, Pseudomonas aeruginosa PA01
gaggccaggaucgaggaggccg

SEQ ID NO: 170070 - RNA, 22 nt, Pseudomonas aeruginosa PA01
gaggccgagguagucgagggcg

SEQ ID NO: 170071 - RNA, 22 nt, Pseudomonas aeruginosa PA01
gagcugucgaaggucuccuggg

SEQ ID NO: 170072 - RNA, 22 nt, Pseudomonas aeruginosa PA01
cugucuaucugcguaacguuac

SEQ ID NO: 170073 - RNA, 22 nt, Pseudomonas aeruginosa PA01
gagcuggaguugcggauuggca

SEQ ID NO: 170074 - RNA, 22 nt, Pseudomonas aeruginosa PA01
gagcugcgcgaagcgcuggacg

SEQ ID NO: 170075 - RNA, 22 nt, Pseudomonas aeruginosa PA01
gagcuggaagcugcgcuggucg

SEQ ID NO: 170076 - RNA, 22 nt, Pseudomonas aeruginosa PA01
gagcuggaagugcucgcggugc

SEQ ID NO: 170077 - RNA, 22 nt, Pseudomonas aeruginosa PA01
gagcacuacacgaagcggcgcc

SEQ ID NO: 170078 - RNA, 21 nt, Pseudomonas aeruginosa PA01
gagcagcucgggcggcgcgac

SEQ ID NO: 170079 - RNA, 22 nt, Pseudomonas aeruginosa PA01
gagcagcuggaucgggcgccgc

SEQ ID NO: 170080 - RNA, 22 nt, Pseudomonas aeruginosa PA01
gagcucgcucuggaugcgcguc

SEQ ID NO: 170081 - RNA, 22 nt, Pseudomonas aeruginosa PA01
gaggugacacuucuccagcauu

SEQ ID NO: 170082 - RNA, 22 nt, Pseudomonas aeruginosa PA01
gaggugcugcugguggacggcg

SEQ ID NO: 170083 - RNA, 22 nt, Pseudomonas aeruginosa PA01
gaggguaagugucgcuaaaggu

SEQ ID NO: 170084 - RNA, 22 nt, Pseudomonas aeruginosa PA01
gaguggcaguugaucaugcgcg

SEQ ID NO: 170085 - RNA, 22 nt, Pseudomonas aeruginosa PA01
gagugccucgcgcugaaaagga

SEQ ID NO: 170086 - RNA, 22 nt, Pseudomonas aeruginosa PA01
gaucgaggcggcggccacgcuc

SEQ ID NO: 170087 - RNA, 22 nt, Pseudomonas aeruginosa PA01
caugcuugccgguuuguugcag

SEQ ID NO: 170088 - RNA, 22 nt, Pseudomonas aeruginosa PA01
aggccgaguugcgccaggacga

SEQ ID NO: 170089 - RNA, 22 nt, Pseudomonas aeruginosa PA01
cauccuuacguggcaccagugu

SEQ ID NO: 170090 - RNA, 22 nt, Pseudomonas aeruginosa PA01
aggcgcaggcuggugucgucgc

SEQ ID NO: 170091 - RNA, 22 nt, Pseudomonas aeruginosa PA01
aggccggaucggaaaagcgucg

SEQ ID NO: 170092 - RNA, 22 nt, Pseudomonas aeruginosa PA01
aggccggcuaccucgaaggcgg

SEQ ID NO: 170093 - RNA, 22 nt, Pseudomonas aeruginosa PA01
aggccggguugauggccaggau

SEQ ID NO: 170094 - RNA, 22 nt, Pseudomonas aeruginosa PA01
cauggcgacuggccugccauug

SEQ ID NO: 170095 - RNA, 22 nt, Pseudomonas aeruginosa PA01
caucuucaauacugaaaccagc

SEQ ID NO: 170096 - RNA, 22 nt, Pseudomonas aeruginosa PA01
ccaggccgccagccguucggcc

SEQ ID NO: 170097 - RNA, 22 nt, Pseudomonas aeruginosa PA01
ccaggccgucgacggcgcucug

SEQ ID NO: 170098 - RNA, 22 nt, Pseudomonas aeruginosa PA01
ccagggugccgcgcaucugcaa

SEQ ID NO: 170099 - RNA, 22 nt, Pseudomonas aeruginosa PA01
ccagcacuccgaccugaugauc

SEQ ID NO: 170100 - RNA, 22 nt, Pseudomonas aeruginosa PA01
ccagaacugcuuggagaucucg

SEQ ID NO: 170101 - RNA, 22 nt, Pseudomonas aeruginosa PA01
ccacguggguugggaugugcca

SEQ ID NO: 170102 - RNA, 22 nt, Pseudomonas aeruginosa PA01
ccagccugaccagccuggccac

SEQ ID NO: 170103 - RNA, 22 nt, Pseudomonas aeruginosa PA01
ccagcgccuggaccuccaggcc

SEQ ID NO: 170104 - RNA, 22 nt, Pseudomonas aeruginosa PA01
ccagcgcggcggccaccaggcg

SEQ ID NO: 170105 - RNA, 22 nt, Pseudomonas aeruginosa PA01
ccaguuccagggucagcuggcg

SEQ ID NO: 170106 - RNA, 22 nt, Pseudomonas aeruginosa PA01
ccaguuggagcgcgccggcgac

SEQ ID NO: 170107 - RNA, 22 nt, Pseudomonas aeruginosa PA01
cccagcaggucgagggccugaa

SEQ ID NO: 170108 - RNA, 22 nt, Pseudomonas aeruginosa PA01
cccgccagcucaugcuggaugc

SEQ ID NO: 170109 - RNA, 22 nt, Pseudomonas aeruginosa PA01
cccgcgccacgaggaacgcgug

SEQ ID NO: 170110 - RNA, 22 nt, Pseudomonas aeruginosa PA01
cccgcuccguuggggccgagga

SEQ ID NO: 170111 - RNA, 21 nt, Pseudomonas aeruginosa PA01
cccggccgagagcgggcagga

SEQ ID NO: 170112 - RNA, 22 nt, Pseudomonas aeruginosa PA01
cccggccugccuggacgcgcug

SEQ ID NO: 170113 - RNA, 22 nt, Pseudomonas aeruginosa PA01
cccggcgcagaugcgcgucgau

SEQ ID NO: 170114 - RNA, 22 nt, Pseudomonas aeruginosa PA01
cccggcgggcaccuguguggcc

SEQ ID NO: 170115 - RNA, 22 nt, Pseudomonas aeruginosa PA01
cccggcucugcucggcgugggc

SEQ ID NO: 170116 - RNA, 22 nt, Pseudomonas aeruginosa PA01
cugcugugcguggagggggucg

SEQ ID NO: 170117 - RNA, 22 nt, Pseudomonas aeruginosa PA01
cugcuucaaggagcacuagacu

SEQ ID NO: 170118 - RNA, 22 nt, Pseudomonas aeruginosa PA01
cgggagcaacgcuaugcccggc

SEQ ID NO: 170119 - RNA, 21 nt, Pseudomonas aeruginosa PA01
cggccgagcgcugguaccgcg

SEQ ID NO: 170120 - RNA, 22 nt, Pseudomonas aeruginosa PA01
cggcagcgccucgccacgcucc

SEQ ID NO: 170121 - RNA, 22 nt, Pseudomonas aeruginosa PA01
cggccagccaggcccgcaccag

SEQ ID NO: 170122 - RNA, 20 nt, Pseudomonas aeruginosa PA01
cggccagcgccugcugcucg

SEQ ID NO: 170123 - RNA, 22 nt, Pseudomonas aeruginosa PA01
cggccagggcaaugucgaagcc

SEQ ID NO: 170124 - RNA, 22 nt, Pseudomonas aeruginosa PA01
cggcaccgcugaagccggcgac

SEQ ID NO: 170125 - RNA, 22 nt, Pseudomonas aeruginosa PA01
cggacugguugagggaauugag

SEQ ID NO: 170126 - RNA, 22 nt, Pseudomonas aeruginosa PA01
cggaucuucuccaucgccgcuu

SEQ ID NO: 170127 - RNA, 22 nt, Pseudomonas aeruginosa PA01
cggcgaccacguugggguucuc

SEQ ID NO: 170128 - RNA, 22 nt, Pseudomonas aeruginosa PA01
cggcgacgaucaucuucggcuu

SEQ ID NO: 170129 - RNA, 22 nt, Pseudomonas aeruginosa PA01
cggcgcaggguauggcgguuca

SEQ ID NO: 170130 - RNA, 22 nt, Pseudomonas aeruginosa PA01
cggcgcgccgaaggcgauaugg

SEQ ID NO: 170131 - RNA, 20 nt, Pseudomonas aeruginosa PA01
cggcgcgcuggcuaccggcc

SEQ ID NO: 170132 - RNA, 22 nt, Pseudomonas aeruginosa PA01
cggcggcagguuuucucgacgc

SEQ ID NO: 170133 - RNA, 22 nt, Pseudomonas aeruginosa PA01
cggcggccuugccgcucugcuc

SEQ ID NO: 170134 - RNA, 22 nt, Pseudomonas aeruginosa PA01
cggcgggcauagccgagcagcg

SEQ ID NO: 170135 - RNA, 22 nt, Pseudomonas aeruginosa PA01
cggcguccuggaucagcgccug

SEQ ID NO: 170136 - RNA, 22 nt, Pseudomonas aeruginosa PA01
cggcguccuggucccggugcuc

SEQ ID NO: 170137 - RNA, 22 nt, Pseudomonas aeruginosa PA01
cgcuuucuaucgagcgaucgac

SEQ ID NO: 170138 - RNA, 22 nt, Pseudomonas aeruginosa PA01
cgccgaaggauggcccgagcgc

SEQ ID NO: 170139 - RNA, 22 nt, Pseudomonas aeruginosa PA01
cgccgccgauacgcagccgguu

SEQ ID NO: 170140 - RNA, 22 nt, Pseudomonas aeruginosa PA01
cgccggccgccgaggucgccaa

SEQ ID NO: 170141 - RNA, 19 nt, Pseudomonas aeruginosa PA01
cgccggcgccgggcugauc

SEQ ID NO: 170142 - RNA, 22 nt, Pseudomonas aeruginosa PA01
cgccugccacagaucggccgcc

SEQ ID NO: 170143 - RNA, 22 nt, Pseudomonas aeruginosa PA01
cgcgagcgcggcugcuccaucc

SEQ ID NO: 170144 - RNA, 22 nt, Pseudomonas aeruginosa PA01
cgcgaggaaaccucgcuggccg

SEQ ID NO: 170145 - RNA, 22 nt, Pseudomonas aeruginosa PA01
cgcgcagcgccaaggauggccu

SEQ ID NO: 170146 - RNA, 22 nt, Pseudomonas aeruginosa PA01
cgcgcaggcgguacaggcggcu

SEQ ID NO: 170147 - RNA, 22 nt, Pseudomonas aeruginosa PA01
cgcgcaguuuacccggagaacc

SEQ ID NO: 170148 - RNA, 22 nt, Pseudomonas aeruginosa PA01
cgcgccagcagguggcggaugg

SEQ ID NO: 170149 - RNA, 23 nt, Pseudomonas aeruginosa PA01
cgcgcuccagcaggucggccaug

SEQ ID NO: 170150 - RNA, 22 nt, Pseudomonas aeruginosa PA01
cgcgcucggaacccgguuuggc

SEQ ID NO: 170151 - RNA, 22 nt, Pseudomonas aeruginosa PA01
cgcgcuggaacgacgucuaccu

SEQ ID NO: 170152 - RNA, 19 nt, Pseudomonas aeruginosa PA01
cgcggccgggauccucggc

SEQ ID NO: 170153 - RNA, 22 nt, Pseudomonas aeruginosa PA01
cgcggugcagcugcucgguggc

SEQ ID NO: 170154 - RNA, 22 nt, Pseudomonas aeruginosa PA01
cgcguacaucggugucggcgcg

SEQ ID NO: 170155 - RNA, 22 nt, Pseudomonas aeruginosa PA01
ccugguccaccugggccugacc

SEQ ID NO: 170156 - RNA, 22 nt, Pseudomonas aeruginosa PA01
ccuuguggucacugccuggagc

SEQ ID NO: 170157 - RNA, 20 nt, Pseudomonas aeruginosa PA01
ccuucgacucggugugcauc

SEQ ID NO: 170158 - RNA, 22 nt, Pseudomonas aeruginosa PA01
cgaagagcccgaacgcuuccgg

SEQ ID NO: 170159 - RNA, 22 nt, Pseudomonas aeruginosa PA01
cgaagagcccgucgagggccug

SEQ ID NO: 170160 - RNA, 22 nt, Pseudomonas aeruginosa PA01
cgaagcgcugguucagggaggc

SEQ ID NO: 170161 - RNA, 22 nt, Pseudomonas aeruginosa PA01
cccuguucgagagccuggcgga

SEQ ID NO: 170162 - RNA, 22 nt, Pseudomonas aeruginosa PA01
ccgaccagcgccagcgagccag

SEQ ID NO: 170163 - RNA, 22 nt, Pseudomonas aeruginosa PA01
ccgccgccgaccaugaacaucg

SEQ ID NO: 170164 - RNA, 22 nt, Pseudomonas aeruginosa PA01
ccgcgcagaucccccggcuggc

SEQ ID NO: 170165 - RNA, 21 nt, Pseudomonas aeruginosa PA01
ccgcgccuggaccgcgccggg

SEQ ID NO: 170166 - RNA, 23 nt, Pseudomonas aeruginosa PA01
ccgcggccugcaauucuuccagc

SEQ ID NO: 170167 - RNA, 22 nt, Pseudomonas aeruginosa PA01
ccggccugucuucugccggaca

SEQ ID NO: 170168 - RNA, 22 nt, Pseudomonas aeruginosa PA01
ccggccuuggccagcggcgcac

SEQ ID NO: 170169 - RNA, 23 nt, Pseudomonas aeruginosa PA01
ccggcgacacccucuacgugguc

SEQ ID NO: 170170 - RNA, 22 nt, Pseudomonas aeruginosa PA01
ccggcgacgugcugcgccuucu

SEQ ID NO: 170171 - RNA, 22 nt, Pseudomonas aeruginosa PA01
ccggcgauuuccucgccggcgu

SEQ ID NO: 170172 - RNA, 22 nt, Pseudomonas aeruginosa PA01
ccggcgcgccagaacucgaccg

SEQ ID NO: 170173 - RNA, 22 nt, Pseudomonas aeruginosa PA01
ccggcgcugcugaucgcuucgu

SEQ ID NO: 170174 - RNA, 20 nt, Pseudomonas aeruginosa PA01
ccggcgucgaaguucggcag

SEQ ID NO: 170175 - RNA, 22 nt, Pseudomonas aeruginosa PA01
ccggcuuccucgaacugcucgg

SEQ ID NO: 170176 - RNA, 22 nt, Pseudomonas aeruginosa PA01
ccgggcgcuggucugcgcggug

SEQ ID NO: 170177 - RNA, 22 nt, Pseudomonas aeruginosa PA01
ccgagcaggaagccuugcagcg

SEQ ID NO: 170178 - RNA, 21 nt, Pseudomonas aeruginosa PA01
ccgagcaguuucucgaggcgc

SEQ ID NO: 170179 - RNA, 22 nt, Pseudomonas aeruginosa PA01
ccggagcgcccgggccuucguc

SEQ ID NO: 170180 - RNA, 22 nt, Pseudomonas aeruginosa PA01
ccggaugggcgccgccgcagaa

SEQ ID NO: 170181 - RNA, 22 nt, Pseudomonas aeruginosa PA01
ccggcagccacugcgccugcug

SEQ ID NO: 170182 - RNA, 20 nt, Pseudomonas aeruginosa PA01
ccggccgaagugcucgcggu

SEQ ID NO: 170183 - RNA, 22 nt, Pseudomonas aeruginosa PA01
ccggccgaggcgccggaccagg

SEQ ID NO: 170184 - RNA, 22 nt, Pseudomonas aeruginosa PA01
ccgguucuccagcaccaggcgg

SEQ ID NO: 170185 - RNA, 19 nt, Pseudomonas aeruginosa PA01
ccgucgccggcguuggucg

SEQ ID NO: 170186 - RNA, 22 nt, Pseudomonas aeruginosa PA01
ccucuccggcgacgaggccaag

SEQ ID NO: 170187 - RNA, 22 nt, Pseudomonas aeruginosa PA01
ccugccugcgccuggccgaggc

SEQ ID NO: 170188 - RNA, 23 nt, Pseudomonas aeruginosa PA01
ccugcuccgcgauugccugggcg

SEQ ID NO: 170189 - RNA, 22 nt, Pseudomonas aeruginosa PA01
ccuggaagugcuguuccuggac

SEQ ID NO: 170190 - RNA, 22 nt, Pseudomonas aeruginosa PA01
ggagggcgccagcgaggugccg

SEQ ID NO: 170191 - RNA, 22 nt, Pseudomonas aeruginosa PA01
ggaucggaaaagugcuggcgag

SEQ ID NO: 170192 - RNA, 22 nt, Pseudomonas aeruginosa PA01
gguggcaggaugcgcagacugg

SEQ ID NO: 170193 - RNA, 22 nt, Pseudomonas aeruginosa PA01
ggugggauugcccugcaaggcu

SEQ ID NO: 170194 - RNA, 22 nt, Pseudomonas aeruginosa PA01
ggugcgcaccgucgagggcgag

SEQ ID NO: 170195 - RNA, 22 nt, Pseudomonas aeruginosa PA01
gguuuccaugaccacgcccugc

SEQ ID NO: 170196 - RNA, 22 nt, Pseudomonas aeruginosa PA01
guagcccuggccgagguccggg

SEQ ID NO: 170197 - RNA, 22 nt, Pseudomonas aeruginosa PA01
gucagccucugguccgaggugg

SEQ ID NO: 170198 - RNA, 22 nt, Pseudomonas aeruginosa PA01
ggacggccuguucgugccggug

SEQ ID NO: 170199 - RNA, 22 nt, Pseudomonas aeruginosa PA01
ggagcgccugugggaucguccc

SEQ ID NO: 170200 - RNA, 22 nt, Pseudomonas aeruginosa PA01
ggagcgcgugaccggcuacggu

SEQ ID NO: 170201 - RNA, 22 nt, Pseudomonas aeruginosa PA01
ggagccguugcagugguagcac

SEQ ID NO: 170202 - RNA, 22 nt, Pseudomonas aeruginosa PA01
ggaagugaaggucggcgaccug

SEQ ID NO: 170203 - RNA, 22 nt, Pseudomonas aeruginosa PA01
ggaagccgaacagguagcugag

SEQ ID NO: 170204 - RNA, 22 nt, Pseudomonas aeruginosa PA01
ggaagcggaacagcgcgccaug

SEQ ID NO: 170205 - RNA, 22 nt, Pseudomonas aeruginosa PA01
gcuuuccaggcgcuccuccucg

SEQ ID NO: 170206 - RNA, 22 nt, Pseudomonas aeruginosa PA01
gcucgccgacgucgccagcgac

SEQ ID NO: 170207 - RNA, 22 nt, Pseudomonas aeruginosa PA01
gcuucuucgagcagggcaaggg

SEQ ID NO: 170208 - RNA, 22 nt, Pseudomonas aeruginosa PA01
gcuucuucgccacccuggugca

SEQ ID NO: 170209 - RNA, 22 nt, Pseudomonas aeruginosa PA01
gcuccauuuauccaggggcaga

SEQ ID NO: 170210 - RNA, 22 nt, Pseudomonas aeruginosa PA01
gcgugccgucuuccagggugcc

SEQ ID NO: 170211 - RNA, 22 nt, Pseudomonas aeruginosa PA01
gcgucggcugcaucgcacgacc

SEQ ID NO: 170212 - RNA, 19 nt, Pseudomonas aeruginosa PA01
gcgucggcuuccuugacga

SEQ ID NO: 170213 - RNA, 22 nt, Pseudomonas aeruginosa PA01
guugaugucguagcucaccagc

SEQ ID NO: 170214 - RNA, 22 nt, Pseudomonas aeruginosa PA01
guugcggaucgucguagccgag

SEQ ID NO: 170215 - RNA, 22 nt, Pseudomonas aeruginosa PA01
gugaggcgccggacagcgcccg

SEQ ID NO: 170216 - RNA, 22 nt, Pseudomonas aeruginosa PA01
gucuuucccggauggauggaga

SEQ ID NO: 170217 - RNA, 22 nt, Pseudomonas aeruginosa PA01
guccggcuuguacugguggugg

SEQ ID NO: 170218 - RNA, 22 nt, Pseudomonas aeruginosa PA01
guccgggagcgauggcguugac

SEQ ID NO: 170219 - RNA, 22 nt, Pseudomonas aeruginosa PA01
guccagcgcagcaccagcucgc

SEQ ID NO: 170220 - RNA, 22 nt, Pseudomonas aeruginosa PA01
gucaggguggcgaugccgucuu

SEQ ID NO: 170221 - RNA, 22 nt, Pseudomonas aeruginosa PA01
gucaggguguugcggcugucgg

SEQ ID NO: 170222 - RNA, 19 nt, Pseudomonas aeruginosa PA01
guccuuggccagguucugc

SEQ ID NO: 170223 - RNA, 22 nt, Pseudomonas aeruginosa PA01
gucaggccgaagaucgcgccgc

SEQ ID NO: 170224 - RNA, 22 nt, Pseudomonas aeruginosa PA01
gucggcgauggccagcagcgcg

SEQ ID NO: 170225 - RNA, 22 nt, Pseudomonas aeruginosa PA01
gucuccuggaggcuucgcucgg

SEQ ID NO: 170226 - RNA, 22 nt, Pseudomonas aeruginosa PA01
gucugccuggaggccggccagg

SEQ ID NO: 170227 - RNA, 22 nt, Pseudomonas aeruginosa PA01
gucucuuccaucaccgagcgca

SEQ ID NO: 170228 - RNA, 19 nt, Pseudomonas aeruginosa PA01
gucugcagcaaccggccgu

SEQ ID NO: 170229 - RNA, 22 nt, Pseudomonas aeruginosa PA01
uacugaccacgucuuccaggcu

SEQ ID NO: 170230 - RNA, 22 nt, Pseudomonas aeruginosa PA01
uacccggccugccuugccgucg

SEQ ID NO: 170231 - RNA, 22 nt, Pseudomonas aeruginosa PA01
ugcagcggaucgagcaggccga

SEQ ID NO: 170232 - RNA, 22 nt, Pseudomonas aeruginosa PA01
ugccggccauggccuccacguc

SEQ ID NO: 170233 - RNA, 21 nt, Pseudomonas aeruginosa PA01
ugccggccgccaggugcagga

SEQ ID NO: 170234 - RNA, 22 nt, Pseudomonas aeruginosa PA01
ugccggccugacugucugccgg

SEQ ID NO: 170235 - RNA, 22 nt, Pseudomonas aeruginosa PA01
ugccggcgaggucggccaugac

SEQ ID NO: 170236 - RNA, 22 nt, Pseudomonas aeruginosa PA01
ugccggcgcaguucgggcgcaa

SEQ ID NO: 170237 - RNA, 20 nt, Pseudomonas aeruginosa PA01
ugccgaaguggugguucaug

SEQ ID NO: 170238 - RNA, 22 nt, Pseudomonas aeruginosa PA01
ugccgaggaacagccaggcgug

SEQ ID NO: 170239 - RNA, 22 nt, Pseudomonas aeruginosa PA01
ugcccggcgacccgcgcggagg

SEQ ID NO: 170240 - RNA, 22 nt, Pseudomonas aeruginosa PA01
ugccauagccguugcagggcuu

SEQ ID NO: 170241 - RNA, 20 nt, Pseudomonas aeruginosa PA01
ugaagcugcgcaacagcgcc

SEQ ID NO: 170242 - RNA, 22 nt, Pseudomonas aeruginosa PA01
ugcgccccugguucucgaugaa

SEQ ID NO: 170243 - RNA, 22 nt, Pseudomonas aeruginosa PA01
ugcgcggcguuuccucgccgaa

SEQ ID NO: 170244 - RNA, 22 nt, Pseudomonas aeruginosa PA01
ugcgcugggcguggucggcgac

SEQ ID NO: 170245 - RNA, 22 nt, Pseudomonas aeruginosa PA01
ugcgcugguggucgagcagcac

SEQ ID NO: 170246 - RNA, 22 nt, Pseudomonas aeruginosa PA01
ugcggcucuucagcccggagag

SEQ ID NO: 170247 - RNA, 22 nt, Pseudomonas aeruginosa PA01
ugcucagggggcgcugguuucg

SEQ ID NO: 170248 - RNA, 22 nt, Pseudomonas aeruginosa PA01
ugcuccaguugcgccaguucca

SEQ ID NO: 170249 - RNA, 22 nt, Pseudomonas aeruginosa PA01
ugcucuugaagugauggaagau

SEQ ID NO: 170250 - RNA, 20 nt, Pseudomonas aeruginosa PA01
uggagcaccucggcgaugcc

SEQ ID NO: 170251 - RNA, 19 nt, Pseudomonas aeruginosa PA01
ugcuugcagccaacugagc

SEQ ID NO: 170252 - RNA, 22 nt, Pseudomonas aeruginosa PA01
uggaacaggucaacggugcgcu

SEQ ID NO: 170253 - RNA, 22 nt, Pseudomonas aeruginosa PA01
ugcugcaggagggccagggcau

SEQ ID NO: 170254 - RNA, 22 nt, Pseudomonas aeruginosa PA01
ugcuggagaaugucgcggcugc

SEQ ID NO: 170255 - RNA, 20 nt, Pseudomonas aeruginosa PA01
ugcuggcaccucgccuagcc

SEQ ID NO: 170256 - RNA, 22 nt, Pseudomonas aeruginosa PA01
ugcugucucuggugcgggucug

SEQ ID NO: 170257 - RNA, 19 nt, Pseudomonas aeruginosa PA01
ucgcugcaacacgucaagc

SEQ ID NO: 170258 - RNA, 22 nt, Pseudomonas aeruginosa PA01
ucguccucgcccgcaccuuccg

SEQ ID NO: 170259 - RNA, 22 nt, Pseudomonas aeruginosa PA01
ucgucggccucguucucgauga

SEQ ID NO: 170260 - RNA, 22 nt, Pseudomonas aeruginosa PA01
ucgucggccuucaacgccgccg

SEQ ID NO: 170261 - RNA, 22 nt, Pseudomonas aeruginosa PA01
ucgucggcgaaaugccggucgc

SEQ ID NO: 170262 - RNA, 22 nt, Pseudomonas aeruginosa PA01
ucgucggcgaacuccgagcgca

SEQ ID NO: 170263 - RNA, 18 nt, Pseudomonas aeruginosa PA01
ucggcgcgcacucggugg

SEQ ID NO: 170264 - RNA, 22 nt, Pseudomonas aeruginosa PA01
ucggucgguugcgccggguagu

SEQ ID NO: 170265 - RNA, 22 nt, Pseudomonas aeruginosa PA01
ucggucucgaccagcaacuggc

SEQ ID NO: 170266 - RNA, 22 nt, Pseudomonas aeruginosa PA01
ucggucucguaggcguagaagc

SEQ ID NO: 170267 - RNA, 22 nt, Pseudomonas aeruginosa PA01
ucgccggcaaagucgagggcuu

SEQ ID NO: 170268 - RNA, 22 nt, Pseudomonas aeruginosa PA01
ucgccggguuggucagccaggc

SEQ ID NO: 170269 - RNA, 22 nt, Pseudomonas aeruginosa PA01
ucgagcgcuugcgcugaugcag

SEQ ID NO: 170270 - RNA, 22 nt, Pseudomonas aeruginosa PA01
ucgaaggccgaggccucgaccu

SEQ ID NO: 170271 - RNA, 22 nt, Pseudomonas aeruginosa PA01
ucagagcuuuuccagacagccg

SEQ ID NO: 170272 - RNA, 22 nt, Pseudomonas aeruginosa PA01
ucaccggcggcuggaacgggcu

SEQ ID NO: 170273 - RNA, 22 nt, Pseudomonas aeruginosa PA01
ucaccggcuacgaccugggcau

SEQ ID NO: 170274 - RNA, 22 nt, Pseudomonas aeruginosa PA01
uccuugagguugaucguccagu

SEQ ID NO: 170275 - RNA, 22 nt, Human
aaaaaaacuaauuuuaaaugug

SEQ ID NO: 170276 - RNA, 22 nt, Human
aaaaaguaccacuuggacacuu

SEQ ID NO: 170277 - RNA, 22 nt, Human
aaagaccaagagccccaaguuu

SEQ ID NO: 170278 - RNA, 22 nt, Human
aaagaagugucuuacucccucu

SEQ ID NO: 170279 - RNA, 22 nt, Human
aaagagccaacuaccgcaaauu

SEQ ID NO: 170280 - RNA, 21 nt, Human
aaagaagagcucagagguaga

SEQ ID NO: 170281 - RNA, 22 nt, Human
aaacugacugaugugaucuuau

SEQ ID NO: 170282 - RNA, 22 nt, Human
aaacucaugccagagaacuuaa

SEQ ID NO: 170283 - RNA, 22 nt, Human
aaacucaucaguuuagaaaccu

SEQ ID NO: 170284 - RNA, 22 nt, Human
aaaaggaacaauaugguauuuu

SEQ ID NO: 170285 - RNA, 22 nt, Human
aaaauauguugagauacugaaa

SEQ ID NO: 170286 - RNA, 22 nt, Human
aaacaagagcuuacauggcugc

SEQ ID NO: 170287 - RNA, 21 nt, Human
aaacaugcagccugccaauuc

SEQ ID NO: 170288 - RNA, 18 nt, Human
aaacccacguauucaggc

SEQ ID NO: 170289 - RNA, 22 nt, Human
aauggugaggagugcauugaga

SEQ ID NO: 170290 - RNA, 22 nt, Human
aaugguggaugucuguucugac

SEQ ID NO: 170291 - RNA, 22 nt, Human
aauggcuagcauguaaaauauc

SEQ ID NO: 170292 - RNA, 22 nt, Human
aauggagugguucuugcccucu

SEQ ID NO: 170293 - RNA, 22 nt, Human
aauggacuucucugagccuguu

SEQ ID NO: 170294 - RNA, 22 nt, Human
aaugccuucauuggcgaagugc

SEQ ID NO: 170295 - RNA, 22 nt, Human
aauggaaaggagccugacuaua

SEQ ID NO: 170296 - RNA, 22 nt, Human
aauggaccuuaaauugcuucag

SEQ ID NO: 170297 - RNA, 22 nt, Human
aaugcgcagaguggugugugca

SEQ ID NO: 170298 - RNA, 22 nt, Human
aaugagaauguaagugaagaga

SEQ ID NO: 170299 - RNA, 23 nt, Human
aaugaguugggcagcauacaggc

SEQ ID NO: 170300 - RNA, 22 nt, Human
aaugaguucaucugaauucugg

SEQ ID NO: 170301 - RNA, 22 nt, Human
aaugagacgagagaacccauuu

SEQ ID NO: 170302 - RNA, 22 nt, Human
aaugaguccuuuagugccauug

SEQ ID NO: 170303 - RNA, 22 nt, Human
aaugauuuucugcaaacaguga

SEQ ID NO: 170304 - RNA, 22 nt, Human
aaugaguuuguucuauuauuug

SEQ ID NO: 170305 - RNA, 22 nt, Human
aaugcauacguguuuguggcaa

SEQ ID NO: 170306 - RNA, 22 nt, Human
aaugcagaugugucuuuaauuu

SEQ ID NO: 170307 - RNA, 22 nt, Human
aaugaacuuugaagauggugaa

SEQ ID NO: 170308 - RNA, 22 nt, Human
aaugaaaaucugucaguucaag

SEQ ID NO: 170309 - RNA, 22 nt, Human
aaugaaacuaguagaaucuuug

SEQ ID NO: 170310 - RNA, 22 nt, Human
aaugaacuuucaguucagagag

SEQ ID NO: 170311 - RNA, 22 nt, Human
aagucauuaucucuucuaaucu

SEQ ID NO: 170312 - RNA, 22 nt, Human
aaguggcccuaauugggccaaa

SEQ ID NO: 170313 - RNA, 17 nt, Human
aagugggcaaagugaga

SEQ ID NO: 170314 - RNA, 23 nt, Human
aaguggugacugugcuacugaga

SEQ ID NO: 170315 - RNA, 22 nt, Human
aaguggcaggggaaggguugga

SEQ ID NO: 170316 - RNA, 22 nt, Human
aaguggugagacccugcugaaa

SEQ ID NO: 170317 - RNA, 22 nt, Human
aauacagcacucacaccucccu

SEQ ID NO: 170318 - RNA, 22 nt, Human
aauaugaugccaaauugcuaca

SEQ ID NO: 170319 - RNA, 22 nt, Human
aaguaacuggguggccccaguu

SEQ ID NO: 170320 - RNA, 22 nt, Human
aagguguaaguagcugguucau

SEQ ID NO: 170321 - RNA, 22 nt, Human
aaggugggacugagaggggaca

SEQ ID NO: 170322 - RNA, 22 nt, Human
aagguccuguagccacagagcc

SEQ ID NO: 170323 - RNA, 22 nt, Human
aaggucucucgggcuuugcuga

SEQ ID NO: 170324 - RNA, 22 nt, Human
aaggggggcaccugcaugcccg

SEQ ID NO: 170325 - RNA, 22 nt, Human
aagggccuccuggggagccugg

SEQ ID NO: 170326 - RNA, 22 nt, Human
aaggcugugaacuuuucgggaa

SEQ ID NO: 170327 - RNA, 22 nt, Human
aagggagaguauccagaaacag

SEQ ID NO: 170328 - RNA, 22 nt, Human
aaggcaggagaguaggaggugg

SEQ ID NO: 170329 - RNA, 22 nt, Human
aaggccacacuugcuggccagc

SEQ ID NO: 170330 - RNA, 22 nt, Human
aaggcggcggcggcggcugcgg

SEQ ID NO: 170331 - RNA, 22 nt, Human
aaggcgguuccgguucgcggcg

SEQ ID NO: 170332 - RNA, 22 nt, Human
aaggcgauuuaaagauguuagg

SEQ ID NO: 170333 - RNA, 22 nt, Human
aaggcgccacagugauugcaaa

SEQ ID NO: 170334 - RNA, 19 nt, Human
aaggcuuucugagugaaaa

SEQ ID NO: 170335 - RNA, 22 nt, Human
aaggaguggugaagucagaugu

SEQ ID NO: 170336 - RNA, 22 nt, Human
aagcaugaaauaauguccuugu

SEQ ID NO: 170337 - RNA, 22 nt, Human
aagcgcaaggugucagcagguu

SEQ ID NO: 170338 - RNA, 22 nt, Human
aagccugguuauuugaggaugu

SEQ ID NO: 170339 - RNA, 22 nt, Human
aacugcauaagcuucgggaccu

SEQ ID NO: 170340 - RNA, 22 nt, Human
aacgggguugauuauuggaaga

SEQ ID NO: 170341 - RNA, 22 nt, Human
aacuacucugggguggcagguu

SEQ ID NO: 170342 - RNA, 22 nt, Human
aacuaaggccacaagaggcaaa

SEQ ID NO: 170343 - RNA, 22 nt, Human
aacgcagagaguaaugcugaac

SEQ ID NO: 170344 - RNA, 22 nt, Human
aacgcugugcacuggguccagg

SEQ ID NO: 170345 - RNA, 22 nt, Human
aacucgaugcaauucacuuugu

SEQ ID NO: 170346 - RNA, 22 nt, Human
aacuggguuuaucuaaugugua

SEQ ID NO: 170347 - RNA, 22 nt, Human
aacucugcaaugaaaucauguu

SEQ ID NO: 170348 - RNA, 22 nt, Human
aacuuuacagacuagagcuuuc

SEQ ID NO: 170349 - RNA, 22 nt, Human
aacuugaagacaccccacauuc

SEQ ID NO: 170350 - RNA, 20 nt, Human
aacuuugagugcaugacuuu

SEQ ID NO: 170351 - RNA, 22 nt, Human
aacugggugauucaggcuguuu

SEQ ID NO: 170352 - RNA, 22 nt, Human
aacuguugucacgaauguggcu

SEQ ID NO: 170353 - RNA, 22 nt, Human
aagaaaagaaacauggguaugc

SEQ ID NO: 170354 - RNA, 22 nt, Human
aagaaaagguaaccgcuuaucu

SEQ ID NO: 170355 - RNA, 23 nt, Human
aacugcaagguugcugggaagua

SEQ ID NO: 170356 - RNA, 22 nt, Human
aagccgagggaggugauggaga

SEQ ID NO: 170357 - RNA, 22 nt, Human
aagccagccaguuccagcagcu

SEQ ID NO: 170358 - RNA, 22 nt, Human
aagcauuuuagauaaagcauca

SEQ ID NO: 170359 - RNA, 22 nt, Human
aagaggauuuuaguuugccaga

SEQ ID NO: 170360 - RNA, 22 nt, Human
aagaggacagucaaauggccgg

SEQ ID NO: 170361 - RNA, 22 nt, Human
aagagcuuguuaugcugcucuu

SEQ ID NO: 170362 - RNA, 21 nt, Human
aagagcgccgggcagggcuga

SEQ ID NO: 170363 - RNA, 22 nt, Human
aagcagaaaaacugagcuccaa

SEQ ID NO: 170364 - RNA, 22 nt, Human
aagaugcuucaugagaguuggg

SEQ ID NO: 170365 - RNA, 22 nt, Human
aagaguggagcuggaaaguggg

SEQ ID NO: 170366 - RNA, 22 nt, Human
aagagugaguagcuugguuggu

SEQ ID NO: 170367 - RNA, 22 nt, Human
aagagggguggucugugaggau

SEQ ID NO: 170368 - RNA, 22 nt, Human
aagaggcuacagcccugugucu

SEQ ID NO: 170369 - RNA, 22 nt, Human
aagagaggcccaaguggcuggc

SEQ ID NO: 170370 - RNA, 23 nt, Human
aagaaugcuucugaagagcugcc

SEQ ID NO: 170371 - RNA, 22 nt, Human
aagacacuuucuaaauagaagu

SEQ ID NO: 170372 - RNA, 22 nt, Human
aagaagcuacugucacuaucag

SEQ ID NO: 170373 - RNA, 22 nt, Human
aagaaggcggaccagaagggag

SEQ ID NO: 170374 - RNA, 22 nt, Human
aagaagguugaaugacuacuuu

SEQ ID NO: 170375 - RNA, 22 nt, Human
aaccucuuugugaaugucauga

SEQ ID NO: 170376 - RNA, 22 nt, Human
aaccaggcgagagagcggucag

SEQ ID NO: 170377 - RNA, 22 nt, Human
aaccucgggcugcacuuggcac

SEQ ID NO: 170378 - RNA, 22 nt, Human
aaccauggauuucaguucaccu

SEQ ID NO: 170379 - RNA, 22 nt, Human
aaccggauugauccuucuuuga

SEQ ID NO: 170380 - RNA, 22 nt, Human
aaccagaagucaucagagcuga

SEQ ID NO: 170381 - RNA, 22 nt, Human
aacaguuaagaggaggcagaga

SEQ ID NO: 170382 - RNA, 22 nt, Human
aacagggcaguuccuuauagug

SEQ ID NO: 170383 - RNA, 22 nt, Human
aacgcaacaacuggagcuguag

SEQ ID NO: 170384 - RNA, 22 nt, Human
aacgccgggacucgcagggagc

SEQ ID NO: 170385 - RNA, 22 nt, Human
aacccugaacuuaguucuagga

SEQ ID NO: 170386 - RNA, 22 nt, Human
aaccugagggcaggaccccaua

SEQ ID NO: 170387 - RNA, 22 nt, Human
aacccaagacaagcacuggcca

SEQ ID NO: 170388 - RNA, 22 nt, Human
aacgucugagaccccuccucuc

SEQ ID NO: 170389 - RNA, 22 nt, Human
aacgugcuuuacaaaugaccuu

SEQ ID NO: 170390 - RNA, 22 nt, Human
aaccugaggguagacaaguuca

SEQ ID NO: 170391 - RNA, 22 nt, Human
aaccuggguguacauuaugguc

SEQ ID NO: 170392 - RNA, 22 nt, Human
aaccuggaggaccuuaugcuaa

SEQ ID NO: 170393 - RNA, 22 nt, Human
aacgagcugggggggccggggg

SEQ ID NO: 170394 - RNA, 22 nt, Human
aacgaugauaaauuguucucug

SEQ ID NO: 170395 - RNA, 23 nt, Human
aaagacuagaagccguggcugca

SEQ ID NO: 170396 - RNA, 22 nt, Human
aaagaccuucacuuucuggcug

SEQ ID NO: 170397 - RNA, 22 nt, Human
aaagaucaguuaacgccaucaa

SEQ ID NO: 170398 - RNA, 17 nt, Human
aaaugguccuagggauu

SEQ ID NO: 170399 - RNA, 22 nt, Human
aaauucagauggcuuucuuuuc

SEQ ID NO: 170400 - RNA, 22 nt, Human
aaauguuugguggauaaaagga

SEQ ID NO: 170401 - RNA, 22 nt, Human
aacaucaaaggaagaaugauau

SEQ ID NO: 170402 - RNA, 22 nt, Human
aacaucugagagcccuugugca

SEQ ID NO: 170403 - RNA, 21 nt, Human
aacaaaagggaagaacagcug

SEQ ID NO: 170404 - RNA, 22 nt, Human
aaauuugggagaaaugggucau

SEQ ID NO: 170405 - RNA, 22 nt, Human
aacagguucaucuuggaagcag

SEQ ID NO: 170406 - RNA, 22 nt, Human
aacaggcuaaauuguccauuuc

SEQ ID NO: 170407 - RNA, 22 nt, Human
aacacuguaucagucuucaaua

SEQ ID NO: 170408 - RNA, 22 nt, Human
aaauuuuguugaaaaauauuuu

SEQ ID NO: 170409 - RNA, 22 nt, Human
aaauucggggaguuuugaggau

SEQ ID NO: 170410 - RNA, 21 nt, Human
aaauuucauauggccaaccua

SEQ ID NO: 170411 - RNA, 22 nt, Human
agucccugauggacuggaugag

SEQ ID NO: 170412 - RNA, 22 nt, Human
agucggguugcagacacauccu

SEQ ID NO: 170413 - RNA, 21 nt, Human
agugaagagugggcuugauca

SEQ ID NO: 170414 - RNA, 22 nt, Human
agucggggagcgugaccagaga

SEQ ID NO: 170415 - RNA, 22 nt, Human
agucggauuucccagguuauug

SEQ ID NO: 170416 - RNA, 22 nt, Human
agucaguguagaaagcccaggc

SEQ ID NO: 170417 - RNA, 22 nt, Human
agucaagguggaccagaaaaau

SEQ ID NO: 170418 - RNA, 20 nt, Human
agucacagacccucagguag

SEQ ID NO: 170419 - RNA, 22 nt, Human
agucaccuacagcucaugcuuc

SEQ ID NO: 170420 - RNA, 22 nt, Human
agucaggggaucuagacuugaa

SEQ ID NO: 170421 - RNA, 21 nt, Human
agucaagcugccugcuuggca

SEQ ID NO: 170422 - RNA, 22 nt, Human
aguauggaauuuuuaaugacag

SEQ ID NO: 170423 - RNA, 22 nt, Human
aguagcaguuccauuugaugug

SEQ ID NO: 170424 - RNA, 22 nt, Human
aguagggugaggaggggaguga

SEQ ID NO: 170425 - RNA, 22 nt, Human
aguaggaauucaaagagacaaa

SEQ ID NO: 170426 - RNA, 21 nt, Human
aggugcccaggauuauuuuuu

SEQ ID NO: 170427 - RNA, 22 nt, Human
aggugcccucucuggcuccucc

SEQ ID NO: 170428 - RNA, 22 nt, Human
aggugcuugcauacugcuugac

SEQ ID NO: 170429 - RNA, 22 nt, Human
aggucuugguaggccagagucu

SEQ ID NO: 170430 - RNA, 22 nt, Human
agguggucuuguggaugccgca

SEQ ID NO: 170431 - RNA, 22 nt, Human
agguggucccaauggcugggca

SEQ ID NO: 170432 - RNA, 22 nt, Human
agguggggacuccaccgaugcu

SEQ ID NO: 170433 - RNA, 22 nt, Human
aggugggcuuagaaaucuguau

SEQ ID NO: 170434 - RNA, 22 nt, Human
aggugugcacccggucgcuucc

SEQ ID NO: 170435 - RNA, 22 nt, Human
aggugucauuauagaccagaua

SEQ ID NO: 170436 - RNA, 22 nt, Human
agguuagcuguaugucuguaaa

SEQ ID NO: 170437 - RNA, 22 nt, Human
aggcccugcugaggccucccuc

SEQ ID NO: 170438 - RNA, 22 nt, Human
aggcccagcaccagcggucuuc

SEQ ID NO: 170439 - RNA, 22 nt, Human
aggccccacaaacucgccuuug

SEQ ID NO: 170440 - RNA, 22 nt, Human
aggccauuucacagguuuugga

SEQ ID NO: 170441 - RNA, 22 nt, Human
aggaggaggacucgccaggcca

SEQ ID NO: 170442 - RNA, 22 nt, Human
aggaggcguuugcuaaacgggc

SEQ ID NO: 170443 - RNA, 22 nt, Human
aggccagugcagcuggaacaga

SEQ ID NO: 170444 - RNA, 16 nt, Human
aggagcagaaagcagu

SEQ ID NO: 170445 - RNA, 22 nt, Human
aggagcccaaagcacuuggcug

SEQ ID NO: 170446 - RNA, 22 nt, Human
aggacccacccugugaaaguuc

SEQ ID NO: 170447 - RNA, 22 nt, Human
aggauauguccuuuuuuucccc

SEQ ID NO: 170448 - RNA, 22 nt, Human
aggaugagugaagagguaaauu

SEQ ID NO: 170449 - RNA, 22 nt, Human
aggcgguuggcuuugucugggu

SEQ ID NO: 170450 - RNA, 22 nt, Human
aggcucagcaucugauucauau

SEQ ID NO: 170451 - RNA, 23 nt, Human
aggcugccacucagggugaggcu

SEQ ID NO: 170452 - RNA, 22 nt, Human
aggccgcuggggcagcgcccga

SEQ ID NO: 170453 - RNA, 22 nt, Human
aggccgcgguggcgaaggcguu

SEQ ID NO: 170454 - RNA, 22 nt, Human
aggccugcccuuggggagccuu

SEQ ID NO: 170455 - RNA, 22 nt, Human
aggcgagcgcggccggugcccc

SEQ ID NO: 170456 - RNA, 19 nt, Human
agggaggcaagagaaaugu

SEQ ID NO: 170457 - RNA, 22 nt, Human
agggagcugcucugcuuccgug

SEQ ID NO: 170458 - RNA, 22 nt, Human
agggaggcccagcagacuggcg

SEQ ID NO: 170459 - RNA, 22 nt, Human
agggaugcaguaaaaacuguag

SEQ ID NO: 170460 - RNA, 22 nt, Human
agggaguuccgaucugugcacc

SEQ ID NO: 170461 - RNA, 19 nt, Human
agggagagucccaagagaa

SEQ ID NO: 170462 - RNA, 22 nt, Human
agggaccgugagcuccuugggg

SEQ ID NO: 170463 - RNA, 22 nt, Human
aggcuuuugcucuggcuccucu

SEQ ID NO: 170464 - RNA, 22 nt, Human
aggcuucaaggacagcagccac

SEQ ID NO: 170465 - RNA, 21 nt, Human
aggcuuggaucuagacaggcc

SEQ ID NO: 170466 - RNA, 22 nt, Human
aggcugucucaccucaggaggg

SEQ ID NO: 170467 - RNA, 18 nt, Human
aggcuggggaucacaggg

SEQ ID NO: 170468 - RNA, 22 nt, Human
aggccugcuccucuucucaucc

SEQ ID NO: 170469 - RNA, 22 nt, Human
agggaaauuaaugugagcaaug

SEQ ID NO: 170470 - RNA, 22 nt, Human
aggcgaagggaccagacgguag

SEQ ID NO: 170471 - RNA, 22 nt, Human
aggccugaggaccagauaaaug

SEQ ID NO: 170472 - RNA, 22 nt, Human
aggccgguggaggagguggagg

SEQ ID NO: 170473 - RNA, 22 nt, Human
agggaagaggaccagagucucu

SEQ ID NO: 170474 - RNA, 22 nt, Human
aggcggguuuaggacaaugcuu

SEQ ID NO: 170475 - RNA, 22 nt, Human
aggcugaagcacacucaugcag

SEQ ID NO: 170476 - RNA, 22 nt, Human
aggcugccuaugaaggcagaag

SEQ ID NO: 170477 - RNA, 23 nt, Human
aggcugcagaagaauagggucau

SEQ ID NO: 170478 - RNA, 19 nt, Human
aggcugccucacccucccu

SEQ ID NO: 170479 - RNA, 22 nt, Human
aggcugcuggcaggcguggacg

SEQ ID NO: 170480 - RNA, 22 nt, Human
agggcccaccuuggugcugagg

SEQ ID NO: 170481 - RNA, 22 nt, Human
agggcucagccuccuccucagc

SEQ ID NO: 170482 - RNA, 22 nt, Human
agggcucacuacaacccuggga

SEQ ID NO: 170483 - RNA, 22 nt, Human
agggcggucccugagacucucc

SEQ ID NO: 170484 - RNA, 22 nt, Human
agggcgugguggugcuggagca

SEQ ID NO: 170485 - RNA, 22 nt, Human
agggccggggagggcugugggg

SEQ ID NO: 170486 - RNA, 22 nt, Human
agggcccauagaucgucagcuu

SEQ ID NO: 170487 - RNA, 22 nt, Human
agggaccacauccccucugugg

SEQ ID NO: 170488 - RNA, 22 nt, Human
agggcuugggggccuugaaggc

SEQ ID NO: 170489 - RNA, 22 nt, Human
agggcuuacaucccacaguuag

SEQ ID NO: 170490 - RNA, 22 nt, Human
agggcugcugcuccgggcccag

SEQ ID NO: 170491 - RNA, 22 nt, Human
aggggauggagcuggaaggcag

SEQ ID NO: 170492 - RNA, 22 nt, Human
aggggaggcugcgggcugccgu

SEQ ID NO: 170493 - RNA, 22 nt, Human
aggggaggcugggcuggggggc

SEQ ID NO: 170494 - RNA, 22 nt, Human
agggcuucugcugcagagaccu

SEQ ID NO: 170495 - RNA, 20 nt, Human
agggccuauauaaacugcug

SEQ ID NO: 170496 - RNA, 22 nt, Human
aggggcugugucauuuguccua

SEQ ID NO: 170497 - RNA, 22 nt, Human
aggggcuuguggaguugcuggu

SEQ ID NO: 170498 - RNA, 19 nt, Human
aggggccugcuuggccuug

SEQ ID NO: 170499 - RNA, 22 nt, Human
aggggcagccucacaauccucu

SEQ ID NO: 170500 - RNA, 22 nt, Human
agguagggaggguagaugcucu

SEQ ID NO: 170501 - RNA, 22 nt, Human
aggguggcacucugggggcucc

SEQ ID NO: 170502 - RNA, 22 nt, Human
aggguggcuggaguggucuggu

SEQ ID NO: 170503 - RNA, 22 nt, Human
aggguuugaauccucuuucuua

SEQ ID NO: 170504 - RNA, 22 nt, Human
aggguuuucauauauuauuagu

SEQ ID NO: 170505 - RNA, 22 nt, Human
aggggcaagucuggccauuucu

SEQ ID NO: 170506 - RNA, 22 nt, Human
aggggagggcuggccuuuggau

SEQ ID NO: 170507 - RNA, 22 nt, Human
aggggaggggaguaucaggauu

SEQ ID NO: 170508 - RNA, 22 nt, Human
agggggcuccugcaggccccca

SEQ ID NO: 170509 - RNA, 22 nt, Human
aggguuugugaagacuuggcca

SEQ ID NO: 170510 - RNA, 22 nt, Human
aggguuccugaaaaguauguca

SEQ ID NO: 170511 - RNA, 22 nt, Human
aggguuucucuccaguguggac

SEQ ID NO: 170512 - RNA, 22 nt, Human
agguagcuggugcugggcuccu

SEQ ID NO: 170513 - RNA, 22 nt, Human
aggguugaagucugguccucau

SEQ ID NO: 170514 - RNA, 22 nt, Human
agguccugucuuaucucuguaa

SEQ ID NO: 170515 - RNA, 22 nt, Human
aggucggcuuuuuuccuuucac

SEQ ID NO: 170516 - RNA, 22 nt, Human
aggucguauaguuaccuccuug

SEQ ID NO: 170517 - RNA, 22 nt, Human
agguauuuuaugucgugugaug

SEQ ID NO: 170518 - RNA, 22 nt, Human
aggugcagcugguggagucugg

SEQ ID NO: 170519 - RNA, 22 nt, Human
agguaugucccccgagugcagc

SEQ ID NO: 170520 - RNA, 22 nt, Human
agcugugaccuucaagagcuac

SEQ ID NO: 170521 - RNA, 22 nt, Human
agcuguugaccuucccuuucag

SEQ ID NO: 170522 - RNA, 22 nt, Human
aggaacaguuucaaagagugaa

SEQ ID NO: 170523 - RNA, 22 nt, Human
agcuggauuaaucacagugacu

SEQ ID NO: 170524 - RNA, 22 nt, Human
aggaaaguugagcugucuguag

SEQ ID NO: 170525 - RNA, 22 nt, Human
agcuuugcccaaugaguuaugu

SEQ ID NO: 170526 - RNA, 22 nt, Human
agcuuugcugcuggagaagggu

SEQ ID NO: 170527 - RNA, 20 nt, Human
aggaacuggaagggaggaaa

SEQ ID NO: 170528 - RNA, 22 nt, Human
aggaagagcuggaccagaggac

SEQ ID NO: 170529 - RNA, 22 nt, Human
aggaagccuggaguccugccca

SEQ ID NO: 170530 - RNA, 22 nt, Human
aggaaaggcucugugguuccua

SEQ ID NO: 170531 - RNA, 22 nt, Human
aggaaaguugcuuguagugcug

SEQ ID NO: 170532 - RNA, 22 nt, Human
aggacucagcgucugucucccg

SEQ ID NO: 170533 - RNA, 22 nt, Human
aggacguaacccaggacagccu

SEQ ID NO: 170534 - RNA, 22 nt, Human
aggagaccugguugugugugug

SEQ ID NO: 170535 - RNA, 23 nt, Human
aggaagucugacacuacagcguu

SEQ ID NO: 170536 - RNA, 22 nt, Human
aggagacaguuuggacguguag

SEQ ID NO: 170537 - RNA, 22 nt, Human
aggagaaagaccagccugccga

SEQ ID NO: 170538 - RNA, 20 nt, Human
agcuuucaccaguacuucca

SEQ ID NO: 170539 - RNA, 22 nt, Human
agcuuggcaagcacuguuugag

SEQ ID NO: 170540 - RNA, 22 nt, Human
agcuuugucccaagugcucugg

SEQ ID NO: 170541 - RNA, 22 nt, Human
agcugcauguauauucuuaaca

SEQ ID NO: 170542 - RNA, 22 nt, Human
agcugcuggcggauguuggacu

SEQ ID NO: 170543 - RNA, 22 nt, Human
agcugcuuuacuggucggcugg

SEQ ID NO: 170544 - RNA, 20 nt, Human
agcuggcccccgguggccug

SEQ ID NO: 170545 - RNA, 22 nt, Human
agcuggaaucucggcaaagcgu

SEQ ID NO: 170546 - RNA, 20 nt, Human
agcugucccugacacuagga

SEQ ID NO: 170547 - RNA, 22 nt, Human
agcugugccuauucguggcaag

SEQ ID NO: 170548 - RNA, 22 nt, Human
agcuugcccuuguaccagccag

SEQ ID NO: 170549 - RNA, 22 nt, Human
agcuugauggauugcugaggca

SEQ ID NO: 170550 - RNA, 22 nt, Human
agcuugaugaaagugggugcuc

SEQ ID NO: 170551 - RNA, 22 nt, Human
agcuugagauaauucaagcuga

SEQ ID NO: 170552 - RNA, 22 nt, Human
agcuucccaggagaucuccgcc

SEQ ID NO: 170553 - RNA, 22 nt, Human
agcuuccaaagaccaggauuga

SEQ ID NO: 170554 - RNA, 22 nt, Human
agcuucuucugccuugucccug

SEQ ID NO: 170555 - RNA, 22 nt, Human
agcugaugucucaccuguuaga

SEQ ID NO: 170556 - RNA, 22 nt, Human
agcugauugucuuuuuaaaagu

SEQ ID NO: 170557 - RNA, 22 nt, Human
agcugaggccccgcagcagggu

SEQ ID NO: 170558 - RNA, 22 nt, Human
agcugacagugcauggagggac

SEQ ID NO: 170559 - RNA, 22 nt, Human
agcugcauucguaucauauugu

SEQ ID NO: 170560 - RNA, 22 nt, Human
agcugagccagacagguaagca

SEQ ID NO: 170561 - RNA, 19 nt, Human
agcugcugauugguggagg

SEQ ID NO: 170562 - RNA, 22 nt, Human
agcugcugcaaguggugcuaac

SEQ ID NO: 170563 - RNA, 22 nt, Human
agcucggcuguccugugccccu

SEQ ID NO: 170564 - RNA, 22 nt, Human
agcuccugcgcacggugcacac

SEQ ID NO: 170565 - RNA, 22 nt, Human
agcucugugcaggcagaggcau

SEQ ID NO: 170566 - RNA, 22 nt, Human
agcucugcuucuugggaagaug

SEQ ID NO: 170567 - RNA, 22 nt, Human
agcuccucagauuuggguggcg

SEQ ID NO: 170568 - RNA, 22 nt, Human
agcugaccugauugcuuuucag

SEQ ID NO: 170569 - RNA, 22 nt, Human
agcucuucugacucuaggcuca

SEQ ID NO: 170570 - RNA, 22 nt, Human
agcucagugugucuaugaggua

SEQ ID NO: 170571 - RNA, 22 nt, Human
agcucccaauugacuugaacua

SEQ ID NO: 170572 - RNA, 19 nt, Human
agcucaggcccaucguccc

SEQ ID NO: 170573 - RNA, 22 nt, Human
agcguaugaauauuugaagaga

SEQ ID NO: 170574 - RNA, 22 nt, Human
agcgucaugugaccagcgcgcc

SEQ ID NO: 170575 - RNA, 22 nt, Human
agcuagugcaguucucaaaugg

SEQ ID NO: 170576 - RNA, 22 nt, Human
agcgggucaugucggccgccca

SEQ ID NO: 170577 - RNA, 22 nt, Human
agcggcgcgucuccgagcugga

SEQ ID NO: 170578 - RNA, 22 nt, Human
agcgcucauuuuccuccugcuc

SEQ ID NO: 170579 - RNA, 22 nt, Human
agcgcuguguucccgugggcau

SEQ ID NO: 170580 - RNA, 22 nt, Human
agcgcaguuaccgcgcggggcu

SEQ ID NO: 170581 - RNA, 19 nt, Human
agcggccgccgcgggcgcc

SEQ ID NO: 170582 - RNA, 22 nt, Human
agcggcaagguguauguggcag

SEQ ID NO: 170583 - RNA, 22 nt, Human
agcggcaggaagcgcgcaagcg

SEQ ID NO: 170584 - RNA, 22 nt, Human
agcggugacauccuucugugcu

SEQ ID NO: 170585 - RNA, 22 nt, Human
agcggcucaggccccgugggcu

SEQ ID NO: 170586 - RNA, 22 nt, Human
agcgagccugugcacuucuaac

SEQ ID NO: 170587 - RNA, 22 nt, Human
agcgaaaagaauggaguggagu

SEQ ID NO: 170588 - RNA, 22 nt, Human
agccuucccuuucaacaauuug

SEQ ID NO: 170589 - RNA, 22 nt, Human
agccuugcaugauuucauucau

SEQ ID NO: 170590 - RNA, 22 nt, Human
agccuguuacuguccugugcca

SEQ ID NO: 170591 - RNA, 22 nt, Human
agccugugacucugugaaacca

SEQ ID NO: 170592 - RNA, 22 nt, Human
agccuguacuuagagggauuaa

SEQ ID NO: 170593 - RNA, 22 nt, Human
agccgcgcuguuccugcugcug

SEQ ID NO: 170594 - RNA, 22 nt, Human
agcccuucccuuucacuggugc

SEQ ID NO: 170595 - RNA, 23 nt, Human
agcccagcagagaaccuaggucc

SEQ ID NO: 170596 - RNA, 20 nt, Human
agcauucaacuuucuauguu

SEQ ID NO: 170597 - RNA, 22 nt, Human
agcauucccuuugcagugucau

SEQ ID NO: 170598 - RNA, 22 nt, Human
agcccgggagggcugucuggga

SEQ ID NO: 170599 - RNA, 22 nt, Human
agccccuucuuuggggagcuga

SEQ ID NO: 170600 - RNA, 22 nt, Human
agccugggucgagagacgagaa

SEQ ID NO: 170601 - RNA, 22 nt, Human
agcauugguggcauuugcagcu

SEQ ID NO: 170602 - RNA, 22 nt, Human
agccacggcaaugauaggcugc

SEQ ID NO: 170603 - RNA, 22 nt, Human
agcagucagaucguggggaaaa

SEQ ID NO: 170604 - RNA, 22 nt, Human
agcaguugcuuuguauauuaaa

SEQ ID NO: 170605 - RNA, 22 nt, Human
agccagcauauauauaguugaa

SEQ ID NO: 170606 - RNA, 18 nt, Human
agcaguugucucucucca

SEQ ID NO: 170607 - RNA, 22 nt, Human
agcauucagacaucugauggau

SEQ ID NO: 170608 - RNA, 22 nt, Human
agcauuugcuguucuagaaagu

SEQ ID NO: 170609 - RNA, 22 nt, Human
agcaggaggagagccuggcggu

SEQ ID NO: 170610 - RNA, 22 nt, Human
agcaucggacggagcaccugcu

SEQ ID NO: 170611 - RNA, 21 nt, Human
agcaucugaggcaguuuccua

SEQ ID NO: 170612 - RNA, 22 nt, Human
agcaugaauugccauuuauuaa

SEQ ID NO: 170613 - RNA, 22 nt, Human
agcagcaggugaccucgaugcc

SEQ ID NO: 170614 - RNA, 22 nt, Human
agauagccagauauaaauaguc

SEQ ID NO: 170615 - RNA, 16 nt, Human
agcagcgugggggugg

SEQ ID NO: 170616 - RNA, 17 nt, Human
agcagcuggguugaucu

SEQ ID NO: 170617 - RNA, 22 nt, Human
agcacggugguuaagagagugg

SEQ ID NO: 170618 - RNA, 22 nt, Human
agcaggaaggcuagaagcagga

SEQ ID NO: 170619 - RNA, 22 nt, Human
agcaggguggcaagucuuucug

SEQ ID NO: 170620 - RNA, 22 nt, Human
agcagggugugggugugagugu

SEQ ID NO: 170621 - RNA, 22 nt, Human
agcaggggcaggguuuugugcu

SEQ ID NO: 170622 - RNA, 22 nt, Human
agcagguucaagggcaaagcug

SEQ ID NO: 170623 - RNA, 22 nt, Human
agcagggagacagugcagcauu

SEQ ID NO: 170624 - RNA, 22 nt, Human
agcaggccuuucaccucugucc

SEQ ID NO: 170625 - RNA, 22 nt, Human
agcagauuguacagugcauuag

SEQ ID NO: 170626 - RNA, 22 nt, Human
agcaggaggguuuuguagaguc

SEQ ID NO: 170627 - RNA, 22 nt, Human
agcaggucagugguaaucaaaa

SEQ ID NO: 170628 - RNA, 19 nt, Human
agcaguggagccaugccug

SEQ ID NO: 170629 - RNA, 18 nt, Human
agcagugcggaucauuuu

SEQ ID NO: 170630 - RNA, 19 nt, Human
agcagugaaaucuggugag

SEQ ID NO: 170631 - RNA, 22 nt, Human
agcaguucucugucuagcuaga

SEQ ID NO: 170632 - RNA, 22 nt, Human
accccagcucugagccacacca

SEQ ID NO: 170633 - RNA, 22 nt, Human
accgucagguuagaaugagcac

SEQ ID NO: 170634 - RNA, 22 nt, Human
accgguucccaucuggagaguu

SEQ ID NO: 170635 - RNA, 22 nt, Human
acccggccuacucagugcccag

SEQ ID NO: 170636 - RNA, 22 nt, Human
acccgguuuucccagcaccucc

SEQ ID NO: 170637 - RNA, 22 nt, Human
accccuuaaauuuguuguuuaa

SEQ ID NO: 170638 - RNA, 21 nt, Human
accgucaguacuaguauugac

SEQ ID NO: 170639 - RNA, 20 nt, Human
acccaaagcucagcgugucc

SEQ ID NO: 170640 - RNA, 22 nt, Human
acccugacggugggcagcuuga

SEQ ID NO: 170641 - RNA, 22 nt, Human
acccugcacagagggcuuuaua

SEQ ID NO: 170642 - RNA, 22 nt, Human
accaggguacuucuaggugggg

SEQ ID NO: 170643 - RNA, 22 nt, Human
accauccaaaagcuuuucauca

SEQ ID NO: 170644 - RNA, 22 nt, Human
acccagauauccaggccucugc

SEQ ID NO: 170645 - RNA, 19 nt, Human
acccaugcucuguggacuu

SEQ ID NO: 170646 - RNA, 21 nt, Human
acccagaauggagccaagccu

SEQ ID NO: 170647 - RNA, 23 nt, Human
accgccgcugccgccgcccccgc

SEQ ID NO: 170648 - RNA, 22 nt, Human
accgauuucaaauggugcuaga

SEQ ID NO: 170649 - RNA, 22 nt, Human
accucaguacugcaguuugguu

SEQ ID NO: 170650 - RNA, 22 nt, Human
accuauuuauacaacugcacca

SEQ ID NO: 170651 - RNA, 22 nt, Human
accuagcacggugagguaggcc

SEQ ID NO: 170652 - RNA, 22 nt, Human
accuggacucugaucacuuuug

SEQ ID NO: 170653 - RNA, 22 nt, Human
accuggaccugccaccuaugag

SEQ ID NO: 170654 - RNA, 22 nt, Human
accugaucugagaaguggaggg

SEQ ID NO: 170655 - RNA, 22 nt, Human
accugaccagguggcuucccaa

SEQ ID NO: 170656 - RNA, 22 nt, Human
accugauuuuauggauuuugag

SEQ ID NO: 170657 - RNA, 22 nt, Human
accugguaaccugccugacuaa

SEQ ID NO: 170658 - RNA, 21 nt, Human
accugguuuacugaucccagg

SEQ ID NO: 170659 - RNA, 22 nt, Human
accgcuggcacuggggacgggg

SEQ ID NO: 170660 - RNA, 22 nt, Human
accgggcagcucugccccugcc

SEQ ID NO: 170661 - RNA, 22 nt, Human
accggucucaccaaacgcccca

SEQ ID NO: 170662 - RNA, 22 nt, Human
accugcagguguuuccacacuu

SEQ ID NO: 170663 - RNA, 22 nt, Human
accugagauuuuuacucaguaa

SEQ ID NO: 170664 - RNA, 22 nt, Human
accugcucucccucucgcaguc

SEQ ID NO: 170665 - RNA, 22 nt, Human
accgagcaggguguuugcgcac

SEQ ID NO: 170666 - RNA, 22 nt, Human
acgggugcuuguucccgcugcu

SEQ ID NO: 170667 - RNA, 22 nt, Human
acgggugugauuccuuuugugu

SEQ ID NO: 170668 - RNA, 22 nt, Human
acggugagacuggcgaaggaaa

SEQ ID NO: 170669 - RNA, 22 nt, Human
acggguuccuugagggcaggau

SEQ ID NO: 170670 - RNA, 22 nt, Human
acggggagcgucggccucuccc

SEQ ID NO: 170671 - RNA, 22 nt, Human
acgguuuugugagguaguacuu

SEQ ID NO: 170672 - RNA, 22 nt, Human
acgugaccuuauuugaaaaaug

SEQ ID NO: 170673 - RNA, 22 nt, Human
accuuggauauucuuacucggu

SEQ ID NO: 170674 - RNA, 23 nt, Human
acgaccuugcccucauuccaaag

SEQ ID NO: 170675 - RNA, 22 nt, Human
acgaagggggcauggugagagu

SEQ ID NO: 170676 - RNA, 22 nt, Human
acgaggauuuccuuagaugaaa

SEQ ID NO: 170677 - RNA, 23 nt, Human
acgcagacacauguaugggccuc

SEQ ID NO: 170678 - RNA, 22 nt, Human
acgcuucacaggugcgcauugu

SEQ ID NO: 170679 - RNA, 22 nt, Human
acgcugagcucauggagaugca

SEQ ID NO: 170680 - RNA, 22 nt, Human
acggccgaugacuccagcaugg

SEQ ID NO: 170681 - RNA, 22 nt, Human
acggcggguuccgggccagccc

SEQ ID NO: 170682 - RNA, 22 nt, Human
acggcuugaacgcgccuguggg

SEQ ID NO: 170683 - RNA, 22 nt, Human
accuguagcccaaucauggcag

SEQ ID NO: 170684 - RNA, 23 nt, Human
accuggucccaugggugggccug

SEQ ID NO: 170685 - RNA, 21 nt, Human
accuggugaugaaugggaggc

SEQ ID NO: 170686 - RNA, 22 nt, Human
accuggcccugggucuccugac

SEQ ID NO: 170687 - RNA, 22 nt, Human
accuggauauuuucaguugcau

SEQ ID NO: 170688 - RNA, 22 nt, Human
acgauuugguucagugaagaca

SEQ ID NO: 170689 - RNA, 22 nt, Human
accuugauggagugaugaauga

SEQ ID NO: 170690 - RNA, 22 nt, Human
accuucugaccucucggacuuc

SEQ ID NO: 170691 - RNA, 22 nt, Human
accugguuucuuacccaagaga

SEQ ID NO: 170692 - RNA, 19 nt, Human
accuguucaaccucgugcu

SEQ ID NO: 170693 - RNA, 22 nt, Human
accuucguuuaguacucauuuu

SEQ ID NO: 170694 - RNA, 22 nt, Human
accuugggcccagaccggcacg

SEQ ID NO: 170695 - RNA, 22 nt, Human
accuuuggaggacuagggucau

SEQ ID NO: 170696 - RNA, 22 nt, Human
acauggacugguccauuaugac

SEQ ID NO: 170697 - RNA, 22 nt, Human
acauaaacaugcagccugccaa

SEQ ID NO: 170698 - RNA, 22 nt, Human
acaugggggugggacggcagag

SEQ ID NO: 170699 - RNA, 22 nt, Human
acauggggaaaaaggccugcuc

SEQ ID NO: 170700 - RNA, 22 nt, Human
acaugggcaaucgcuuuauuca

SEQ ID NO: 170701 - RNA, 22 nt, Human
aauucugaggccauuuauuucc

SEQ ID NO: 170702 - RNA, 22 nt, Human
acagugugcaagaaauggggga

SEQ ID NO: 170703 - RNA, 22 nt, Human
acauggaccucagauccuggcc

SEQ ID NO: 170704 - RNA, 22 nt, Human
acauggaauuucagaagagcau

SEQ ID NO: 170705 - RNA, 20 nt, Human
acauggagaagcgagguagg

SEQ ID NO: 170706 - RNA, 22 nt, Human
acauccaguaucagaagcauca

SEQ ID NO: 170707 - RNA, 21 nt, Human
acauccaggguccucacugcc

SEQ ID NO: 170708 - RNA, 22 nt, Human
acaugaguuacuuccgauuccc

SEQ ID NO: 170709 - RNA, 22 nt, Human
acaugcacagcaagggugagag

SEQ ID NO: 170710 - RNA, 22 nt, Human
acaucuucuauggagguucgga

SEQ ID NO: 170711 - RNA, 22 nt, Human
accagccacacacauuagucac

SEQ ID NO: 170712 - RNA, 22 nt, Human
accaggaguuuugaccaggggc

SEQ ID NO: 170713 - RNA, 22 nt, Human
accaccacugacaccagcucgg

SEQ ID NO: 170714 - RNA, 22 nt, Human
acauuguuauuccucaggaguu

SEQ ID NO: 170715 - RNA, 22 nt, Human
acauguggaggaggcgagggua

SEQ ID NO: 170716 - RNA, 21 nt, Human
acauguacacauguaugcaca

SEQ ID NO: 170717 - RNA, 22 nt, Human
acaugguguggcacuaggggcu

SEQ ID NO: 170718 - RNA, 22 nt, Human
acauucucuuuuagaaagcugu

SEQ ID NO: 170719 - RNA, 23 nt, Human
acauuacacgcaguaauugcccc

SEQ ID NO: 170720 - RNA, 20 nt, Human
acccagaguccuccccgcgc

SEQ ID NO: 170721 - RNA, 22 nt, Human
accaugacugucacauuauuau

SEQ ID NO: 170722 - RNA, 22 nt, Human
accacguccugguggcuguugg

SEQ ID NO: 170723 - RNA, 22 nt, Human
accagccacccugccgcguccg

SEQ ID NO: 170724 - RNA, 22 nt, Human
accaggcagcaccaaagccggu

SEQ ID NO: 170725 - RNA, 17 nt, Human
accaggggcagcacugc

SEQ ID NO: 170726 - RNA, 22 nt, Human
accagcgcguuuucaguuucau

SEQ ID NO: 170727 - RNA, 22 nt, Human
accagguugagacuucggcuuu

SEQ ID NO: 170728 - RNA, 22 nt, Human
acccccacuccgcaguagaacu

SEQ ID NO: 170729 - RNA, 22 nt, Human
acccccaggacacugccucuga

SEQ ID NO: 170730 - RNA, 22 nt, Human
accccgugucccugaggguccu

SEQ ID NO: 170731 - RNA, 22 nt, Human
accaccacauaguaggcacuua

SEQ ID NO: 170732 - RNA, 22 nt, Human
agagcagcaaucuuugaaauua

SEQ ID NO: 170733 - RNA, 22 nt, Human
agagauugagcucagaagaccu

SEQ ID NO: 170734 - RNA, 22 nt, Human
agagcugggacuuggacucaau

SEQ ID NO: 170735 - RNA, 22 nt, Human
agagcuauuucuuaaaagcugu

SEQ ID NO: 170736 - RNA, 22 nt, Human
agaguucaccccacugaugagu

SEQ ID NO: 170737 - RNA, 22 nt, Human
agaggaauuauugaguuagauu

SEQ ID NO: 170738 - RNA, 22 nt, Human
agaggugcuuaugcucaugguu

SEQ ID NO: 170739 - RNA, 22 nt, Human
agaguacagaagcauuucagau

SEQ ID NO: 170740 - RNA, 22 nt, Human
agagccggagucuucuuguuug

SEQ ID NO: 170741 - RNA, 22 nt, Human
agagcuagaaggaagcauuucu

SEQ ID NO: 170742 - RNA, 22 nt, Human
agagcagauggagcuggaagag

SEQ ID NO: 170743 - RNA, 22 nt, Human
agagcaucgguggaguccccac

SEQ ID NO: 170744 - RNA, 22 nt, Human
agagaaccauggcauccaggua

SEQ ID NO: 170745 - RNA, 22 nt, Human
agagacaagggaccucuggaga

SEQ ID NO: 170746 - RNA, 22 nt, Human
agagacuguaaugagagguaca

SEQ ID NO: 170747 - RNA, 22 nt, Human
agagacugauggaucaccaaau

SEQ ID NO: 170748 - RNA, 22 nt, Human
agacuuuggcagggccaguggu

SEQ ID NO: 170749 - RNA, 19 nt, Human
agacugaagggcccgaguc

SEQ ID NO: 170750 - RNA, 22 nt, Human
agagaagaauccccugguggag

SEQ ID NO: 170751 - RNA, 22 nt, Human
agacccuugcagucugguuguc

SEQ ID NO: 170752 - RNA, 22 nt, Human
agaccccuguggugaugguggu

SEQ ID NO: 170753 - RNA, 22 nt, Human
agaccauuuuguagccagcaua

SEQ ID NO: 170754 - RNA, 22 nt, Human
agaccccugcuggggcugcugu

SEQ ID NO: 170755 - RNA, 22 nt, Human
agacuuugaaugaugacagcgu

SEQ ID NO: 170756 - RNA, 22 nt, Human
agacgacucuuaaggcagaauu

SEQ ID NO: 170757 - RNA, 22 nt, Human
agacagcggugcaauaaauggu

SEQ ID NO: 170758 - RNA, 22 nt, Human
agacauuuggugugaagggagg

SEQ ID NO: 170759 - RNA, 22 nt, Human
agacuggagucuccuuuggagc

SEQ ID NO: 170760 - RNA, 22 nt, Human
agaccagugaguaggccuuaga

SEQ ID NO: 170761 - RNA, 20 nt, Human
agacauugaggagagagcau

SEQ ID NO: 170762 - RNA, 22 nt, Human
agaaucucuagaaaugggucuc

SEQ ID NO: 170763 - RNA, 22 nt, Human
agacacugacaggguccaugga

SEQ ID NO: 170764 - RNA, 22 nt, Human
agaacaggaggaagccagcucc

SEQ ID NO: 170765 - RNA, 20 nt, Human
agaaggagagaugaggcaaa

SEQ ID NO: 170766 - RNA, 22 nt, Human
agaacaagaaacccgaaaagug

SEQ ID NO: 170767 - RNA, 22 nt, Human
agaaauuguaauaaaucugguc

SEQ ID NO: 170768 - RNA, 22 nt, Human
acuuugccagcucccugcuggc

SEQ ID NO: 170769 - RNA, 22 nt, Human
agaagcauaagggcuuugccag

SEQ ID NO: 170770 - RNA, 22 nt, Human
agaagcagaaggaagcagggcc

SEQ ID NO: 170771 - RNA, 22 nt, Human
agaaauggggugaagcaaaugg

SEQ ID NO: 170772 - RNA, 22 nt, Human
agaagaagacccuaaggaaagg

SEQ ID NO: 170773 - RNA, 22 nt, Human
agaaagcacccugcacuuucug

SEQ ID NO: 170774 - RNA, 20 nt, Human
agaaaggaguaaagaagaga

SEQ ID NO: 170775 - RNA, 22 nt, Human
acuugcauuguguaguguuuuu

SEQ ID NO: 170776 - RNA, 22 nt, Human
acuuuuuugccaucccuccagc

SEQ ID NO: 170777 - RNA, 22 nt, Human
acuuugugaauagaacuggaug

SEQ ID NO: 170778 - RNA, 19 nt, Human
acuugcuuucauuuaagau

SEQ ID NO: 170779 - RNA, 22 nt, Human
acuuugucuugaucaaaggugu

SEQ ID NO: 170780 - RNA, 22 nt, Human
acuguggcugcuacccuggcuc

SEQ ID NO: 170781 - RNA, 22 nt, Human
acuguugcuuguuuggaauguu

SEQ ID NO: 170782 - RNA, 22 nt, Human
acugugcaugaaccgaaacaaa

SEQ ID NO: 170783 - RNA, 19 nt, Human
acuggggcaggcugggcuu

SEQ ID NO: 170784 - RNA, 22 nt, Human
acuggugcucuggccaccgcug

SEQ ID NO: 170785 - RNA, 22 nt, Human
acuggcgucugucuccccugcc

SEQ ID NO: 170786 - RNA, 22 nt, Human
acuggcuuauuguuguggagcu

SEQ ID NO: 170787 - RNA, 22 nt, Human
acuggcauuccuaggggagggg

SEQ ID NO: 170788 - RNA, 22 nt, Human
acuggggcaggaaaguaugcug

SEQ ID NO: 170789 - RNA, 22 nt, Human
acugggcaaggauaugaugggu

SEQ ID NO: 170790 - RNA, 22 nt, Human
acuggcuuggaaauggguauuu

SEQ ID NO: 170791 - RNA, 22 nt, Human
acuguccucgaaguaccugugc

SEQ ID NO: 170792 - RNA, 22 nt, Human
acuggggaggucuggauggauc

SEQ ID NO: 170793 - RNA, 22 nt, Human
acuguugagggaagcagaugaa

SEQ ID NO: 170794 - RNA, 22 nt, Human
acugugcccccucuacugcuga

SEQ ID NO: 170795 - RNA, 22 nt, Human
acugcuguugugauggguauuu

SEQ ID NO: 170796 - RNA, 22 nt, Human
acugcagauccucugagaaacc

SEQ ID NO: 170797 - RNA, 22 nt, Human
acugcguuucuaaaguagcaua

SEQ ID NO: 170798 - RNA, 20 nt, Human
acugcaagagacagaugaaa

SEQ ID NO: 170799 - RNA, 22 nt, Human
acuggagcccguggaggcgcag

SEQ ID NO: 170800 - RNA, 22 nt, Human
acugcaggucccaucaccugcg

SEQ ID NO: 170801 - RNA, 22 nt, Human
acugggacuguaugugcuggac

SEQ ID NO: 170802 - RNA, 22 nt, Human
acuggggauugguucuucaaca

SEQ ID NO: 170803 - RNA, 19 nt, Human
acugggaugggcagugcca

SEQ ID NO: 170804 - RNA, 22 nt, Human
acuggcaugauagaccauaaca

SEQ ID NO: 170805 - RNA, 22 nt, Human
acugcacuccagcccgagcaac

SEQ ID NO: 170806 - RNA, 18 nt, Human
acugagcccaggacacac

SEQ ID NO: 170807 - RNA, 22 nt, Human
acugagcaaaacugauccuguu

SEQ ID NO: 170808 - RNA, 22 nt, Human
acugccuugcaccauggcuuuu

SEQ ID NO: 170809 - RNA, 21 nt, Human
acugccaugcaggagccucca

SEQ ID NO: 170810 - RNA, 22 nt, Human
acugccauauuaggagcuucag

SEQ ID NO: 170811 - RNA, 22 nt, Human
ccucgugcgauaguuaugucag

SEQ ID NO: 170812 - RNA, 22 nt, Human
cgacgacaggcgcccgaggagg

SEQ ID NO: 170813 - RNA, 19 nt, Human
ccucggggucugaagucag

SEQ ID NO: 170814 - RNA, 22 nt, Human
cgcacaggcacagacacuggga

SEQ ID NO: 170815 - RNA, 23 nt, Human
cgagagccugcaggaccuucgga

SEQ ID NO: 170816 - RNA, 22 nt, Human
cgcaucggguagaggagcugga

SEQ ID NO: 170817 - RNA, 22 nt, Human
cgcauugcaauucaggggauaa

SEQ ID NO: 170818 - RNA, 22 nt, Human
ccugcugcugaugcuguuucac

SEQ ID NO: 170819 - RNA, 22 nt, Human
ccgcagggcccggcgggcucag

SEQ ID NO: 170820 - RNA, 22 nt, Human
ccgcagucugcaaucucccugg

SEQ ID NO: 170821 - RNA, 22 nt, Human
cgacaagagaaaugcuuuguuu

SEQ ID NO: 170822 - RNA, 22 nt, Human
ccucaggaauuuauucuucugu

SEQ ID NO: 170823 - RNA, 22 nt, Human
ccugcugagccuggugggcagc

SEQ ID NO: 170824 - RNA, 19 nt, Human
ccugcugaagugaugcagc

SEQ ID NO: 170825 - RNA, 22 nt, Human
ccugcuggagucuaguuggucu

SEQ ID NO: 170826 - RNA, 18 nt, Human
ccugcguggauguccucu

SEQ ID NO: 170827 - RNA, 22 nt, Human
ccuggaccgacacaggaaggga

SEQ ID NO: 170828 - RNA, 22 nt, Human
cggcggcgaaccgaccugggug

SEQ ID NO: 170829 - RNA, 22 nt, Human
ccugccagccugccaucccaca

SEQ ID NO: 170830 - RNA, 22 nt, Human
ccugcaugacuuugucagaccu

SEQ ID NO: 170831 - RNA, 22 nt, Human
ccugcucuaauucauucaugcu

SEQ ID NO: 170832 - RNA, 22 nt, Human
ccugcucccccugcaagccuug

SEQ ID NO: 170833 - RNA, 22 nt, Human
ccugacagcgugucccuggccc

SEQ ID NO: 170834 - RNA, 22 nt, Human
ccugaauuuaucugaauggugg

SEQ ID NO: 170835 - RNA, 22 nt, Human
ccugaaaugaguucugcucacu

SEQ ID NO: 170836 - RNA, 22 nt, Human
ccucuggacuugggacagugag

SEQ ID NO: 170837 - RNA, 22 nt, Human
cgcgcuuugggcaguguggcug

SEQ ID NO: 170838 - RNA, 22 nt, Human
cgcucggcuuucccuccgccgg

SEQ ID NO: 170839 - RNA, 22 nt, Human
cgcucugccugcccuaacuucc

SEQ ID NO: 170840 - RNA, 22 nt, Human
ccugcaguagagguugguaggg

SEQ ID NO: 170841 - RNA, 19 nt, Human
cgacauggguaaugggaga

SEQ ID NO: 170842 - RNA, 22 nt, Human
cgaaggaaucacuuaacacuuu

SEQ ID NO: 170843 - RNA, 20 nt, Human
cguugccagcccggcccggg

SEQ ID NO: 170844 - RNA, 20 nt, Human
ccuuuuguugcuguuuggau

SEQ ID NO: 170845 - RNA, 22 nt, Human
ccuuuuguuucccuuuauguuc

SEQ ID NO: 170846 - RNA, 22 nt, Human
cgugccugguggagagcgaggg

SEQ ID NO: 170847 - RNA, 22 nt, Human
cgugcaggagcuggagguccga

SEQ ID NO: 170848 - RNA, 22 nt, Human
cgucagccacagcugccccggg

SEQ ID NO: 170849 - RNA, 22 nt, Human
cgggucgagugcuguaguucga

SEQ ID NO: 170850 - RNA, 22 nt, Human
cggucggagagaaugaccugga

SEQ ID NO: 170851 - RNA, 22 nt, Human
cggugccccuagcgcgccgccc

SEQ ID NO: 170852 - RNA, 22 nt, Human
cgguccugcucuuccucccguu

SEQ ID NO: 170853 - RNA, 19 nt, Human
cggugcugauuggugcagu

SEQ ID NO: 170854 - RNA, 22 nt, Human
cgguggcccauuguacgcagcu

SEQ ID NO: 170855 - RNA, 22 nt, Human
cgguugcaggaugugcgggcag

SEQ ID NO: 170856 - RNA, 18 nt, Human
ccuucaucucugcuucuu

SEQ ID NO: 170857 - RNA, 22 nt, Human
cggggugugacggugcgggccu

SEQ ID NO: 170858 - RNA, 22 nt, Human
cggggcuccgaagagcucgguu

SEQ ID NO: 170859 - RNA, 19 nt, Human
cggggcuugguggguucuc

SEQ ID NO: 170860 - RNA, 22 nt, Human
cggggcuggcguuagggaggca

SEQ ID NO: 170861 - RNA, 22 nt, Human
ccuguuccaacccucccuggcu

SEQ ID NO: 170862 - RNA, 23 nt, Human
ccuggcugaccugaagguguagu

SEQ ID NO: 170863 - RNA, 22 nt, Human
ccugggcauuuguuucacaggu

SEQ ID NO: 170864 - RNA, 20 nt, Human
ccugggcuccaggagccccg

SEQ ID NO: 170865 - RNA, 22 nt, Human
ccugggugaugugcugcccucg

SEQ ID NO: 170866 - RNA, 22 nt, Human
ccuggggcucugcacagagcag

SEQ ID NO: 170867 - RNA, 22 nt, Human
ccugggcucgcgcacuucaccc

SEQ ID NO: 170868 - RNA, 22 nt, Human
ccugugucaucagcuguggcua

SEQ ID NO: 170869 - RNA, 22 nt, Human
ccugugcuucacucaacaagcc

SEQ ID NO: 170870 - RNA, 22 nt, Human
cggggaggagccagcggaggau

SEQ ID NO: 170871 - RNA, 22 nt, Human
ccugugcaugccaggguacacc

SEQ ID NO: 170872 - RNA, 22 nt, Human
ccugugacucugucugaugguc

SEQ ID NO: 170873 - RNA, 22 nt, Human
cucgccugacucggaugggcug

SEQ ID NO: 170874 - RNA, 22 nt, Human
cucggcccuggucuuacgggac

SEQ ID NO: 170875 - RNA, 22 nt, Human
cucggggcguggcaguagcaug

SEQ ID NO: 170876 - RNA, 22 nt, Human
cucuaaauguggucugcagaua

SEQ ID NO: 170877 - RNA, 22 nt, Human
cggccuuuggcuucuccugugu

SEQ ID NO: 170878 - RNA, 22 nt, Human
cggccuuugcccgucauucugg

SEQ ID NO: 170879 - RNA, 22 nt, Human
cgcuuugguaauagggcagccu

SEQ ID NO: 170880 - RNA, 22 nt, Human
cgcuucauugugggggccccca

SEQ ID NO: 170881 - RNA, 22 nt, Human
cuccuggagcagcaggcgcagg

SEQ ID NO: 170882 - RNA, 22 nt, Human
cuccccucccuuuaacccccuu

SEQ ID NO: 170883 - RNA, 22 nt, Human
cuccaugagccaggagggcuac

SEQ ID NO: 170884 - RNA, 22 nt, Human
cucagcgggagucuggccgaac

SEQ ID NO: 170885 - RNA, 22 nt, Human
cucagcugcuuuguuuugcuuu

SEQ ID NO: 170886 - RNA, 22 nt, Human
cgcucggugagccaguggcgga

SEQ ID NO: 170887 - RNA, 22 nt, Human
cgcugcagcggcugagucccgc

SEQ ID NO: 170888 - RNA, 22 nt, Human
cucagaugcacacaggugaggg

SEQ ID NO: 170889 - RNA, 22 nt, Human
cucaccugccuccccgcccucc

SEQ ID NO: 170890 - RNA, 22 nt, Human
cucacugugggcuaugaauggg

SEQ ID NO: 170891 - RNA, 22 nt, Human
cucagaagaacaaaggcucuac

SEQ ID NO: 170892 - RNA, 22 nt, Human
cgccuggccccgcagcgcuugu

SEQ ID NO: 170893 - RNA, 22 nt, Human
cgagaccaggcuuuuuuuagga

SEQ ID NO: 170894 - RNA, 22 nt, Human
cgagcccaacccucccguccuc

SEQ ID NO: 170895 - RNA, 22 nt, Human
cgaccccugaaaauggcagcca

SEQ ID NO: 170896 - RNA, 22 nt, Human
cuacaaggucuuuaucugcuuu

SEQ ID NO: 170897 - RNA, 22 nt, Human
cuaauugcuggcugcuggcaga

SEQ ID NO: 170898 - RNA, 22 nt, Human
cuauaagguguuucuauugguc

SEQ ID NO: 170899 - RNA, 22 nt, Human
cgggucgcacaggagaaaggcg

SEQ ID NO: 170900 - RNA, 19 nt, Human
cggugaagagaguuuagau

SEQ ID NO: 170901 - RNA, 22 nt, Human
cgggguguggggcgguagugug

SEQ ID NO: 170902 - RNA, 19 nt, Human
cugacccaacauuaguuca

SEQ ID NO: 170903 - RNA, 22 nt, Human
cugaaggcuuugaauggaauga

SEQ ID NO: 170904 - RNA, 20 nt, Human
cugaauaccacagagccauc

SEQ ID NO: 170905 - RNA, 20 nt, Human
cugaccagcagccugucucc

SEQ ID NO: 170906 - RNA, 22 nt, Human
cugaacuaagcccaaagacacu

SEQ ID NO: 170907 - RNA, 22 nt, Human
cggggcucugcacaggccagga

SEQ ID NO: 170908 - RNA, 22 nt, Human
cggggcggcgagcgggccgggc

SEQ ID NO: 170909 - RNA, 22 nt, Human
cggggcgggcgugggaggugga

SEQ ID NO: 170910 - RNA, 22 nt, Human
cggcuucucgggucggauuccg

SEQ ID NO: 170911 - RNA, 22 nt, Human
cgggacaauagcagugcugaug

SEQ ID NO: 170912 - RNA, 22 nt, Human
cgggagagacagaggaggcgcc

SEQ ID NO: 170913 - RNA, 20 nt, Human
cgggacacucaagcucuggg

SEQ ID NO: 170914 - RNA, 22 nt, Human
cggggcaaggggggcuggugga

SEQ ID NO: 170915 - RNA, 22 nt, Human
cgggcuccaagcuuucacccca

SEQ ID NO: 170916 - RNA, 22 nt, Human
cgggcacucagggucgaggugg

SEQ ID NO: 170917 - RNA, 22 nt, Human
cgggcacagguugagguagaug

SEQ ID NO: 170918 - RNA, 22 nt, Human
cggcgcugguacaguggaagag

SEQ ID NO: 170919 - RNA, 22 nt, Human
cugaaacucaagauaggaggaa

SEQ ID NO: 170920 - RNA, 22 nt, Human
cggcgccccgcgcgggcggcuc

SEQ ID NO: 170921 - RNA, 22 nt, Human
cggcuacccaugucauauucgu

SEQ ID NO: 170922 - RNA, 22 nt, Human
cggcugcagcggagcaggcugg

SEQ ID NO: 170923 - RNA, 22 nt, Human
cugaaacuauggggaggggagc

SEQ ID NO: 170924 - RNA, 20 nt, Human
cucuuucugcuuuaugccuc

SEQ ID NO: 170925 - RNA, 22 nt, Human
cucuucugugggugcuauguca

SEQ ID NO: 170926 - RNA, 22 nt, Human
cucugucuggggaggggagagg

SEQ ID NO: 170927 - RNA, 22 nt, Human
cucuguugucaguggaagcagc

SEQ ID NO: 170928 - RNA, 22 nt, Human
cucuggggaagugcacucgcug

SEQ ID NO: 170929 - RNA, 17 nt, Human
cucugggucuccugcuu

SEQ ID NO: 170930 - RNA, 22 nt, Human
cucugcuuguaucacauuugcu

SEQ ID NO: 170931 - RNA, 18 nt, Human
cucuggacagcaggcauc

SEQ ID NO: 170932 - RNA, 22 nt, Human
cucuggacaucugcggugcuuc

SEQ ID NO: 170933 - RNA, 22 nt, Human
cccuuuuuuauggaguuggcca

SEQ ID NO: 170934 - RNA, 22 nt, Human
cccuuuuuugccauuccuuccu

SEQ ID NO: 170935 - RNA, 22 nt, Human
cccuugagccuggaggagcucu

SEQ ID NO: 170936 - RNA, 22 nt, Human
ccugcacuaccuggggcugcug

SEQ ID NO: 170937 - RNA, 22 nt, Human
cccuuuucuaauuuagccuguu

SEQ ID NO: 170938 - RNA, 22 nt, Human
ccugcaguuuuuccaugauaca

SEQ ID NO: 170939 - RNA, 22 nt, Human
ccugccagaaaagagggaguuc

SEQ ID NO: 170940 - RNA, 22 nt, Human
cccugcacuguguggacucugg

SEQ ID NO: 170941 - RNA, 17 nt, Human
cccugcauugauccuca

SEQ ID NO: 170942 - RNA, 22 nt, Human
cccugggccccgaacugcugag

SEQ ID NO: 170943 - RNA, 22 nt, Human
ccugacgcugauauauaguuaa

SEQ ID NO: 170944 - RNA, 22 nt, Human
ccugaggcccuggcugugcuga

SEQ ID NO: 170945 - RNA, 21 nt, Human
ccugagccuguuuauccagaa

SEQ ID NO: 170946 - RNA, 22 nt, Human
ccugagacucuccugugcagcc

SEQ ID NO: 170947 - RNA, 22 nt, Human
cccuguccugcuaggcccuggu

SEQ ID NO: 170948 - RNA, 22 nt, Human
cccuucauguagcugugugucc

SEQ ID NO: 170949 - RNA, 22 nt, Human
cccuguccuucccuccaucuga

SEQ ID NO: 170950 - RNA, 22 nt, Human
cccuggucucugacuugauccu

SEQ ID NO: 170951 - RNA, 22 nt, Human
ccugaagaugguugauccccuu

SEQ ID NO: 170952 - RNA, 22 nt, Human
ccucucugcgaaugcugauagu

SEQ ID NO: 170953 - RNA, 22 nt, Human
cccugauaaaucagcaccucag

SEQ ID NO: 170954 - RNA, 22 nt, Human
cccucucaaucuuuaaaauaca

SEQ ID NO: 170955 - RNA, 22 nt, Human
ccugaccauuugccacaugggu

SEQ ID NO: 170956 - RNA, 22 nt, Human
ccucggacuugggugggcuccu

SEQ ID NO: 170957 - RNA, 22 nt, Human
cccgggccgagucuuccagcga

SEQ ID NO: 170958 - RNA, 22 nt, Human
cccgguugggguuccagggcgc

SEQ ID NO: 170959 - RNA, 22 nt, Human
cccguggugggaugacaccaug

SEQ ID NO: 170960 - RNA, 22 nt, Human
ccucuccucugugcagacugcc

SEQ ID NO: 170961 - RNA, 21 nt, Human
ccuccagccagagggucugga

SEQ ID NO: 170962 - RNA, 22 nt, Human
ccccuuucucccgcgucuggcc

SEQ ID NO: 170963 - RNA, 18 nt, Human
ccuccccuguggaggucc

SEQ ID NO: 170964 - RNA, 22 nt, Human
cccgacuccuccugguaccuaa

SEQ ID NO: 170965 - RNA, 22 nt, Human
ccuccugggccuugcucuguga

SEQ ID NO: 170966 - RNA, 22 nt, Human
ccuccuuuccuguuuuccugag

SEQ ID NO: 170967 - RNA, 19 nt, Human
ccuccguguuaccuguccu

SEQ ID NO: 170968 - RNA, 22 nt, Human
cccggcgccucguuuccuaguc

SEQ ID NO: 170969 - RNA, 22 nt, Human
cccggagcagucgggcuccggg

SEQ ID NO: 170970 - RNA, 22 nt, Human
cccagcuuugcggacccgggag

SEQ ID NO: 170971 - RNA, 22 nt, Human
cccaggaaugagcaggcagggg

SEQ ID NO: 170972 - RNA, 22 nt, Human
ccggguucuuguucuaggaugu

SEQ ID NO: 170973 - RNA, 22 nt, Human
ccggguccagugggcacugggc

SEQ ID NO: 170974 - RNA, 22 nt, Human
cccaggccguguaaucagcagc

SEQ ID NO: 170975 - RNA, 22 nt, Human
ccgggcggcauccagccguucc

SEQ ID NO: 170976 - RNA, 22 nt, Human
cccagcucuggaagguggggga

SEQ ID NO: 170977 - RNA, 22 nt, Human
cccagccgcuguggucuagggu

SEQ ID NO: 170978 - RNA, 22 nt, Human
ccggcggaaacauggcggcgcc

SEQ ID NO: 170979 - RNA, 22 nt, Human
ccgcgcccccggcugugccccc

SEQ ID NO: 170980 - RNA, 22 nt, Human
ccgcggcagaggcgggggcgcc

SEQ ID NO: 170981 - RNA, 22 nt, Human
ccgcgggcagggcuucaccuuu

SEQ ID NO: 170982 - RNA, 22 nt, Human
ccgcucuuugagacucucccga

SEQ ID NO: 170983 - RNA, 22 nt, Human
cccagaagaguauguguuugcu

SEQ ID NO: 170984 - RNA, 22 nt, Human
ccggaggaaauugcauugguug

SEQ ID NO: 170985 - RNA, 22 nt, Human
ccgcuggccgacuuccgagagc

SEQ ID NO: 170986 - RNA, 22 nt, Human
cccagcaccauaacucaggccu

SEQ ID NO: 170987 - RNA, 22 nt, Human
ccgcuggaagcgaguggugggc

SEQ ID NO: 170988 - RNA, 22 nt, Human
cccagaggcugaguugggagca

SEQ ID NO: 170989 - RNA, 23 nt, Human
ccccugcauggcaccacauuccc

SEQ ID NO: 170990 - RNA, 22 nt, Human
ccuacccucaagggccuggggg

SEQ ID NO: 170991 - RNA, 20 nt, Human
ccucauucucgcguguguuu

SEQ ID NO: 170992 - RNA, 22 nt, Human
ccccaggcagcccuccaggagc

SEQ ID NO: 170993 - RNA, 22 nt, Human
ccccaaauuugugcuuucauag

SEQ ID NO: 170994 - RNA, 22 nt, Human
cccauggacuagcuaugagcag

SEQ ID NO: 170995 - RNA, 22 nt, Human
cccaucugugaaauggggcugc

SEQ ID NO: 170996 - RNA, 22 nt, Human
cccaugacucucauucacaguc

SEQ ID NO: 170997 - RNA, 22 nt, Human
cccaguuguuccuauucuucuu

SEQ ID NO: 170998 - RNA, 22 nt, Human
ccguccgcuccuccagccgcug

SEQ ID NO: 170999 - RNA, 22 nt, Human
ccgguguggguuucucgguagu

SEQ ID NO: 171000 - RNA, 22 nt, Human
cccaggucgucagcaguguggu

SEQ ID NO: 171001 - RNA, 22 nt, Human
cccugggucagagcgacuucuc

SEQ ID NO: 171002 - RNA, 22 nt, Human
ccagugcuuccaggaauacggu

SEQ ID NO: 171003 - RNA, 22 nt, Human
ccaguguguuuuucucugacuc

SEQ ID NO: 171004 - RNA, 22 nt, Human
ccaguggugcauguuugagcaa

SEQ ID NO: 171005 - RNA, 22 nt, Human
cccugcuuccucuucuguuugu

SEQ ID NO: 171006 - RNA, 22 nt, Human
ccagucugccggcccggccccu

SEQ ID NO: 171007 - RNA, 20 nt, Human
cccuggcuggcaucuggacu

SEQ ID NO: 171008 - RNA, 22 nt, Human
cccuggcucaggcagcuuuguu

SEQ ID NO: 171009 - RNA, 22 nt, Human
cccuggacuccauuuucccgua

SEQ ID NO: 171010 - RNA, 20 nt, Human
cccuggaaugagaugcauau

SEQ ID NO: 171011 - RNA, 22 nt, Human
cccgguggagaugugggacagg

SEQ ID NO: 171012 - RNA, 22 nt, Human
cccgggcucuggcagaggcggu

SEQ ID NO: 171013 - RNA, 22 nt, Human
ccagggcuggaggaggucagga

SEQ ID NO: 171014 - RNA, 22 nt, Human
ccagggcuggaccagugcuugg

SEQ ID NO: 171015 - RNA, 22 nt, Human
ccagggcugcugccugggcugg

SEQ ID NO: 171016 - RNA, 22 nt, Human
ccagggucggcaucagcguggg

SEQ ID NO: 171017 - RNA, 23 nt, Human
ccagucgagucccaaccuucacc

SEQ ID NO: 171018 - RNA, 22 nt, Human
ccagguuggccaccuucacggg

SEQ ID NO: 171019 - RNA, 22 nt, Human
ccaggggagagucugagucguu

SEQ ID NO: 171020 - RNA, 17 nt, Human
cccugcacccuacucuc

SEQ ID NO: 171021 - RNA, 19 nt, Human
cccucggcuucugguuacu

SEQ ID NO: 171022 - RNA, 23 nt, Human
cccucgcuccucgguuccccugu

SEQ ID NO: 171023 - RNA, 21 nt, Human
cccuugccugcacuccucggc

SEQ ID NO: 171024 - RNA, 22 nt, Human
ccaugauguugccuacacugcu

SEQ ID NO: 171025 - RNA, 22 nt, Human
ccauggaaaagacgggcaggcc

SEQ ID NO: 171026 - RNA, 22 nt, Human
ccauggauacuaagguauguga

SEQ ID NO: 171027 - RNA, 22 nt, Human
ccaucucaucugguugggggug

SEQ ID NO: 171028 - RNA, 22 nt, Human
ccgagguccugaagcaagggcc

SEQ ID NO: 171029 - RNA, 22 nt, Human
ccgaggaguagggugucuacgg

SEQ ID NO: 171030 - RNA, 22 nt, Human
ccgagcagggcgcccugcccca

SEQ ID NO: 171031 - RNA, 19 nt, Human
ccgagcagauugauguuuc

SEQ ID NO: 171032 - RNA, 22 nt, Human
ccgccccaggcccugagccaag

SEQ ID NO: 171033 - RNA, 18 nt, Human
cccaccugcccagguuca

SEQ ID NO: 171034 - RNA, 23 nt, Human
ccaugugcaggguucagcacuua

SEQ ID NO: 171035 - RNA, 22 nt, Human
ccauuuggccauucaguuguuc

SEQ ID NO: 171036 - RNA, 22 nt, Human
ccgccacggggcaugggaggca

SEQ ID NO: 171037 - RNA, 22 nt, Human
ccaugggugucuggagcacccu

SEQ ID NO: 171038 - RNA, 22 nt, Human
ccccugggcccugagccgcgau

SEQ ID NO: 171039 - RNA, 23 nt, Human
ccagcugugccuggcccaggagc

SEQ ID NO: 171040 - RNA, 22 nt, Human
ccagcugcugcaccgugcaugg

SEQ ID NO: 171041 - RNA, 22 nt, Human
ccagcugggucccugcuggggc

SEQ ID NO: 171042 - RNA, 22 nt, Human
ccccguggcugggggacagagc

SEQ ID NO: 171043 - RNA, 22 nt, Human
cccccauccccugaaggagcug

SEQ ID NO: 171044 - RNA, 22 nt, Human
ccagccugagcuugcugcccuc

SEQ ID NO: 171045 - RNA, 22 nt, Human
ccccagugguugcaacagcaga

SEQ ID NO: 171046 - RNA, 22 nt, Human
cccgaaaauuguuguacugcag

SEQ ID NO: 171047 - RNA, 22 nt, Human
ccaggcagaggggucuggagca

SEQ ID NO: 171048 - RNA, 22 nt, Human
ccaggaguccgugggucuugag

SEQ ID NO: 171049 - RNA, 22 nt, Human
cccgccggccacaccggccgcc

SEQ ID NO: 171050 - RNA, 22 nt, Human
cccgcucaccccacuccaccag

SEQ ID NO: 171051 - RNA, 19 nt, Human
cccgauggagacuuagcag

SEQ ID NO: 171052 - RNA, 23 nt, Human
cccgggaagugcugcuuaucugg

SEQ ID NO: 171053 - RNA, 22 nt, Human
ccaggcccugcuccucacacca

SEQ ID NO: 171054 - RNA, 22 nt, Human
cccggcucggcuucuuccccac

SEQ ID NO: 171055 - RNA, 22 nt, Human
cccgaggagagguccaggcccu

SEQ ID NO: 171056 - RNA, 22 nt, Human
ccaggcucaccuggagccccug

SEQ ID NO: 171057 - RNA, 22 nt, Human
ccagggcggacaaggucuuuga

SEQ ID NO: 171058 - RNA, 22 nt, Human
ccagggagggccacagggccau

SEQ ID NO: 171059 - RNA, 20 nt, Human
caucaacaccuugucagccu

SEQ ID NO: 171060 - RNA, 22 nt, Human
cccagccugaucucggccagcu

SEQ ID NO: 171061 - RNA, 22 nt, Human
cccagccgaaugcucccuuccc

SEQ ID NO: 171062 - RNA, 16 nt, Human
ccagaugaaugggagu

SEQ ID NO: 171063 - RNA, 22 nt, Human
ccagcaagacucgcagugggau

SEQ ID NO: 171064 - RNA, 22 nt, Human
cccauggaaggguuggcccaga

SEQ ID NO: 171065 - RNA, 20 nt, Human
ccccagcauccuuuucaucu

SEQ ID NO: 171066 - RNA, 22 nt, Human
ccagccacagcuuccagcuccu

SEQ ID NO: 171067 - RNA, 22 nt, Human
cccagccuuugcuuccugguuc

SEQ ID NO: 171068 - RNA, 22 nt, Human
cccagcgccugcccuccgccgc

SEQ ID NO: 171069 - RNA, 22 nt, Human
cccagcugaacuugcauuccaa

SEQ ID NO: 171070 - RNA, 22 nt, Human
cccagcuggcaaaggcguccuu

SEQ ID NO: 171071 - RNA, 22 nt, Human
cccaggcuggggcuccuccagc

SEQ ID NO: 171072 - RNA, 22 nt, Human
cccagggguugaggccguaggg

SEQ ID NO: 171073 - RNA, 22 nt, Human
gaacugggguagggguagcuuu

SEQ ID NO: 171074 - RNA, 22 nt, Human
cuguuuuugccugugacaaaaa

SEQ ID NO: 171075 - RNA, 22 nt, Human
gaacaaaagauagcccaaacau

SEQ ID NO: 171076 - RNA, 22 nt, Human
gaagcagguucuucaggaugaa

SEQ ID NO: 171077 - RNA, 22 nt, Human
gaagcaccuggacggugccugg

SEQ ID NO: 171078 - RNA, 22 nt, Human
cuuaggcgugugcgggugaggc

SEQ ID NO: 171079 - RNA, 22 nt, Human
cuucacuccuggagugaguuuc

SEQ ID NO: 171080 - RNA, 23 nt, Human
cuucagaccucagaaggucuguu

SEQ ID NO: 171081 - RNA, 22 nt, Human
cuucaacuucuguuuuaaggaa

SEQ ID NO: 171082 - RNA, 22 nt, Human
cuguguggccuaaguggagaca

SEQ ID NO: 171083 - RNA, 22 nt, Human
gaaagggggcuuggacacuggc

SEQ ID NO: 171084 - RNA, 22 nt, Human
cugugcuucgagggcuccccgc

SEQ ID NO: 171085 - RNA, 22 nt, Human
cugugccagucagggggcaagu

SEQ ID NO: 171086 - RNA, 22 nt, Human
cuguggaaugcaguugcgagca

SEQ ID NO: 171087 - RNA, 22 nt, Human
cugugcuguuagcgauuuuuaa

SEQ ID NO: 171088 - RNA, 22 nt, Human
cuguggaguccuggggaaugga

SEQ ID NO: 171089 - RNA, 22 nt, Human
cuguggcuaggaagcuguggga

SEQ ID NO: 171090 - RNA, 22 nt, Human
gaaagcuuggaaacgacuuuau

SEQ ID NO: 171091 - RNA, 22 nt, Human
cugugcauguucucuagcugau

SEQ ID NO: 171092 - RNA, 22 nt, Human
cuggccagccucccagguaccc

SEQ ID NO: 171093 - RNA, 22 nt, Human
cuggcaguguccagcucgugau

SEQ ID NO: 171094 - RNA, 22 nt, Human
cuggcagcucugagucccuucu

SEQ ID NO: 171095 - RNA, 22 nt, Human
cuggaugucugggaggcuuccc

SEQ ID NO: 171096 - RNA, 21 nt, Human
cuuugccuccagcagccgcag

SEQ ID NO: 171097 - RNA, 22 nt, Human
cuuugcaaagagagaaaguggg

SEQ ID NO: 171098 - RNA, 22 nt, Human
cuuggugagcuccuggcgcagc

SEQ ID NO: 171099 - RNA, 22 nt, Human
cuuggugcgaagagucagggga

SEQ ID NO: 171100 - RNA, 22 nt, Human
gaauggagaacccuggacacug

SEQ ID NO: 171101 - RNA, 22 nt, Human
cuugcugggagagcuuuagaga

SEQ ID NO: 171102 - RNA, 22 nt, Human
cuuggagauacagaggacauuu

SEQ ID NO: 171103 - RNA, 22 nt, Human
cuuggcacauuuuguucuucug

SEQ ID NO: 171104 - RNA, 22 nt, Human
cuuggcacccaucuuuccaccu

SEQ ID NO: 171105 - RNA, 22 nt, Human
cuucuuugacucacugguacgc

SEQ ID NO: 171106 - RNA, 22 nt, Human
gaauagauuagaaagaguaugu

SEQ ID NO: 171107 - RNA, 21 nt, Human
gaagcugcuaugaagggggac

SEQ ID NO: 171108 - RNA, 22 nt, Human
cuucaggaccugaagcccaucu

SEQ ID NO: 171109 - RNA, 22 nt, Human
gaagcuccaggaugccugcacu

SEQ ID NO: 171110 - RNA, 22 nt, Human
gaagcuucgaaagagugauuuc

SEQ ID NO: 171111 - RNA, 22 nt, Human
cuucagcgucgucaguguugcu

SEQ ID NO: 171112 - RNA, 22 nt, Human
cuucaugucacugucuuaggua

SEQ ID NO: 171113 - RNA, 22 nt, Human
gaaggaagcugucuggaugugu

SEQ ID NO: 171114 - RNA, 22 nt, Human
gaaggauaauuuugcuggaugu

SEQ ID NO: 171115 - RNA, 22 nt, Human
cuuccagugcauagguagauca

SEQ ID NO: 171116 - RNA, 22 nt, Human
cuucuguguggauacagucccu

SEQ ID NO: 171117 - RNA, 22 nt, Human
gacggggcagccagcugguggc

SEQ ID NO: 171118 - RNA, 20 nt, Human
gacgaacuagaacaguggua

SEQ ID NO: 171119 - RNA, 22 nt, Human
cuuuuaccuuaauuucgacaca

SEQ ID NO: 171120 - RNA, 19 nt, Human
cuuugugguuuucagaacu

SEQ ID NO: 171121 - RNA, 22 nt, Human
gacccggauguuguacucgagg

SEQ ID NO: 171122 - RNA, 22 nt, Human
gacccgacaaguaaucagguga

SEQ ID NO: 171123 - RNA, 22 nt, Human
gacaucuguccauggcacugga

SEQ ID NO: 171124 - RNA, 22 nt, Human
gacauugaauugaauccagauu

SEQ ID NO: 171125 - RNA, 22 nt, Human
cuuguuuuaaacuguuguggcu

SEQ ID NO: 171126 - RNA, 22 nt, Human
gagaaugagucagagcuggcug

SEQ ID NO: 171127 - RNA, 22 nt, Human
gagaagguggaccugaaggagc

SEQ ID NO: 171128 - RNA, 22 nt, Human
gagaauuauacaugagcuauuu

SEQ ID NO: 171129 - RNA, 22 nt, Human
gaaaagcucuuuagaagagguu

SEQ ID NO: 171130 - RNA, 22 nt, Human
gacuucaucagagcguacuguu

SEQ ID NO: 171131 - RNA, 20 nt, Human
gacuucaauuucuaucuuuu

SEQ ID NO: 171132 - RNA, 22 nt, Human
gaaaaaccacaauugguauuuu

SEQ ID NO: 171133 - RNA, 22 nt, Human
gacugucaaauaaaucguuuac

SEQ ID NO: 171134 - RNA, 22 nt, Human
gacuggucuuuugugauggaug

SEQ ID NO: 171135 - RNA, 22 nt, Human
gacuggggcauuagaguagcuu

SEQ ID NO: 171136 - RNA, 22 nt, Human
gacuggcucuaucaggauaaau

SEQ ID NO: 171137 - RNA, 16 nt, Human
gaauuccauugcucug

SEQ ID NO: 171138 - RNA, 22 nt, Human
gagcaggucucaguucugccuc

SEQ ID NO: 171139 - RNA, 22 nt, Human
gagcaggcuggcagggccaggg

SEQ ID NO: 171140 - RNA, 22 nt, Human
gagcagcugagcuggaaugaga

SEQ ID NO: 171141 - RNA, 22 nt, Human
gaagaugacaucggaucugucu

SEQ ID NO: 171142 - RNA, 22 nt, Human
gaagaggaagaggagccagagc

SEQ ID NO: 171143 - RNA, 22 nt, Human
gagcaguuagggaccgcaggcu

SEQ ID NO: 171144 - RNA, 22 nt, Human
gagcagucuuugaaaggcacca

SEQ ID NO: 171145 - RNA, 22 nt, Human
gaacauuucugcagaugucuga

SEQ ID NO: 171146 - RNA, 22 nt, Human
gagcacugagcuggaauuggag

SEQ ID NO: 171147 - RNA, 22 nt, Human
gagcacuucagcauaaaucaca

SEQ ID NO: 171148 - RNA, 22 nt, Human
gagcagccugaggauucugcuc

SEQ ID NO: 171149 - RNA, 22 nt, Human
gagcagcaggccagguugcagg

SEQ ID NO: 171150 - RNA, 22 nt, Human
gaacugaauguguaauguuggc

SEQ ID NO: 171151 - RNA, 22 nt, Human
gagauuguggcagcagcuguuu

SEQ ID NO: 171152 - RNA, 22 nt, Human
gagauuugaguuccuacugagu

SEQ ID NO: 171153 - RNA, 22 nt, Human
gaacaguuucccuguagaaaau

SEQ ID NO: 171154 - RNA, 22 nt, Human
gaacaaggauucccaaagaaga

SEQ ID NO: 171155 - RNA, 22 nt, Human
gaacagauucaucuaguggcua

SEQ ID NO: 171156 - RNA, 22 nt, Human
gagagcugucagcguagcaccg

SEQ ID NO: 171157 - RNA, 22 nt, Human
gagagaguaucugcugguucac

SEQ ID NO: 171158 - RNA, 22 nt, Human
cuugauucauuuaagguuggag

SEQ ID NO: 171159 - RNA, 22 nt, Human
cuugccaguguugcagaagcuc

SEQ ID NO: 171160 - RNA, 22 nt, Human
cuugccucucccucuagggggu

SEQ ID NO: 171161 - RNA, 22 nt, Human
cugcccugcagcuccacggacu

SEQ ID NO: 171162 - RNA, 22 nt, Human
cugccgaugcgcaguggcgccu

SEQ ID NO: 171163 - RNA, 22 nt, Human
cugcccgcaugcaggaaugcug

SEQ ID NO: 171164 - RNA, 22 nt, Human
cugccuggggaaugugaggauu

SEQ ID NO: 171165 - RNA, 22 nt, Human
cugccugugcgccaagugcacg

SEQ ID NO: 171166 - RNA, 22 nt, Human
cugccucucaugccugcuugcu

SEQ ID NO: 171167 - RNA, 22 nt, Human
cuucuugggaggggcggagcuc

SEQ ID NO: 171168 - RNA, 22 nt, Human
cuucuuuucuacuggccuagaa

SEQ ID NO: 171169 - RNA, 22 nt, Human
cuucuucaucuuuuggaggaac

SEQ ID NO: 171170 - RNA, 22 nt, Human
cugcagauguagcugcuuuccu

SEQ ID NO: 171171 - RNA, 22 nt, Human
cugcagauaaguguuuugaaaa

SEQ ID NO: 171172 - RNA, 22 nt, Human
cuuccugcaacaccuguguugc

SEQ ID NO: 171173 - RNA, 22 nt, Human
cugauggagagugugauuuggg

SEQ ID NO: 171174 - RNA, 21 nt, Human
cugauguaccucaagccuagu

SEQ ID NO: 171175 - RNA, 22 nt, Human
cuucauccguaccacggccaca

SEQ ID NO: 171176 - RNA, 22 nt, Human
cugaugugcauguggggggaug

SEQ ID NO: 171177 - RNA, 22 nt, Human
cuuccauucugauggcuaauua

SEQ ID NO: 171178 - RNA, 22 nt, Human
cuucccugucuacaacccugcc

SEQ ID NO: 171179 - RNA, 22 nt, Human
cuugugggaucuggagacaccg

SEQ ID NO: 171180 - RNA, 19 nt, Human
cuuguggcuaugcagauac

SEQ ID NO: 171181 - RNA, 22 nt, Human
cuggaaauggcagaguugcauu

SEQ ID NO: 171182 - RNA, 22 nt, Human
cugcuuuggaucucucucugcc

SEQ ID NO: 171183 - RNA, 22 nt, Human
cuuucauuuuugggcaucugag

SEQ ID NO: 171184 - RNA, 22 nt, Human
cuuuacauuaauuucuacugau

SEQ ID NO: 171185 - RNA, 22 nt, Human
cuggagaagagguaguauguag

SEQ ID NO: 171186 - RNA, 22 nt, Human
cuuggcauguucaucugcuugg

SEQ ID NO: 171187 - RNA, 22 nt, Human
cuugcuguccgaugggucugua

SEQ ID NO: 171188 - RNA, 21 nt, Human
cuuggagacucuuggccacau

SEQ ID NO: 171189 - RNA, 22 nt, Human
cugcuacgguguccgguggggc

SEQ ID NO: 171190 - RNA, 22 nt, Human
cugcucugagaggcucuuccua

SEQ ID NO: 171191 - RNA, 22 nt, Human
cugcguugaccagacuccuggg

SEQ ID NO: 171192 - RNA, 22 nt, Human
cugcuugguuuggagggcccac

SEQ ID NO: 171193 - RNA, 22 nt, Human
cuuggggucuuacuuguacccu

SEQ ID NO: 171194 - RNA, 22 nt, Human
cuugggguuugggggcuugacc

SEQ ID NO: 171195 - RNA, 22 nt, Human
cugcugccagcuuaauacucac

SEQ ID NO: 171196 - RNA, 22 nt, Human
cuccaggcccagggccaagagc

SEQ ID NO: 171197 - RNA, 22 nt, Human
cuccagcucgcgagcucugcuc

SEQ ID NO: 171198 - RNA, 22 nt, Human
cuggcuuucauggcgcaguuga

SEQ ID NO: 171199 - RNA, 22 nt, Human
cucccgagccuuacucuguucc

SEQ ID NO: 171200 - RNA, 22 nt, Human
cuccggggacgcagucgccgcc

SEQ ID NO: 171201 - RNA, 19 nt, Human
cugggacaaugaaagcauc

SEQ ID NO: 171202 - RNA, 22 nt, Human
cuggggccccagcucggccccu

SEQ ID NO: 171203 - RNA, 22 nt, Human
cucuccagucauauucucaguc

SEQ ID NO: 171204 - RNA, 22 nt, Human
cucuauucuaauggauucuggg

SEQ ID NO: 171205 - RNA, 22 nt, Human
cugggaccugugugccugggcc

SEQ ID NO: 171206 - RNA, 22 nt, Human
cuccucguccucuucauccucu

SEQ ID NO: 171207 - RNA, 22 nt, Human
cuccugcuuuuucuucuuccga

SEQ ID NO: 171208 - RNA, 22 nt, Human
cuggccugugggcugucuccgg

SEQ ID NO: 171209 - RNA, 22 nt, Human
cuggccaggugggggguagugg

SEQ ID NO: 171210 - RNA, 22 nt, Human
cucaugcugcaaauggcuguuu

SEQ ID NO: 171211 - RNA, 22 nt, Human
cuggauagaccccuuauugcau

SEQ ID NO: 171212 - RNA, 22 nt, Human
cuggaugagcuucgugcgcacg

SEQ ID NO: 171213 - RNA, 22 nt, Human
cuggaucgccccgaugugcccc

SEQ ID NO: 171214 - RNA, 22 nt, Human
cuggauagaggaugguaggcac

SEQ ID NO: 171215 - RNA, 20 nt, Human
cuggaguguagcaguggcug

SEQ ID NO: 171216 - RNA, 22 nt, Human
cuggagucagcaaggacgaggc

SEQ ID NO: 171217 - RNA, 22 nt, Human
cuggagcucugggcaucucagg

SEQ ID NO: 171218 - RNA, 22 nt, Human
cuggagaucaguuggacaacag

SEQ ID NO: 171219 - RNA, 22 nt, Human
cuggaagcgucggaggaagggc

SEQ ID NO: 171220 - RNA, 22 nt, Human
cuggaauugcuugagcuaggaa

SEQ ID NO: 171221 - RNA, 23 nt, Human
cuggacauucgcaaaguucaucu

SEQ ID NO: 171222 - RNA, 22 nt, Human
cugacugauuuugcuuuuuaau

SEQ ID NO: 171223 - RNA, 22 nt, Human
cugaccucuaaguaacagagaa

SEQ ID NO: 171224 - RNA, 22 nt, Human
cuggaaagauuuacacggggaa

SEQ ID NO: 171225 - RNA, 22 nt, Human
cuggaaaaauggauccugucuu

SEQ ID NO: 171226 - RNA, 19 nt, Human
cugagcagggaaaaacccu

SEQ ID NO: 171227 - RNA, 22 nt, Human
cugagaggcacaaggcauuucg

SEQ ID NO: 171228 - RNA, 22 nt, Human
cugagcuuuucucugcuucuua

SEQ ID NO: 171229 - RNA, 22 nt, Human
cugaguuuuucaaaucugaauu

SEQ ID NO: 171230 - RNA, 20 nt, Human
cuuaugcaaaauguuaggga

SEQ ID NO: 171231 - RNA, 22 nt, Human
cugagcuauauauuaugcauag

SEQ ID NO: 171232 - RNA, 22 nt, Human
cugacugaggaucaguucauca

SEQ ID NO: 171233 - RNA, 22 nt, Human
cuguuuggaugccauggucaag

SEQ ID NO: 171234 - RNA, 22 nt, Human
cugacagaucuggaucugaacu

SEQ ID NO: 171235 - RNA, 22 nt, Human
cugaccugugagcuaugccggc

SEQ ID NO: 171236 - RNA, 22 nt, Human
cugaccgugccgcgguacugcu

SEQ ID NO: 171237 - RNA, 22 nt, Human
cuguguugggauggugcgcgca

SEQ ID NO: 171238 - RNA, 22 nt, Human
cugaagcugggcacuuccuuuu

SEQ ID NO: 171239 - RNA, 22 nt, Human
cugaaggacacgugaggagcca

SEQ ID NO: 171240 - RNA, 22 nt, Human
cugugugcagggcacaauggaa

SEQ ID NO: 171241 - RNA, 22 nt, Human
cugugugugcacacguguaugg

SEQ ID NO: 171242 - RNA, 22 nt, Human
cucuucauuauucacgcccugu

SEQ ID NO: 171243 - RNA, 22 nt, Human
cugugaaugguggccacgcguu

SEQ ID NO: 171244 - RNA, 22 nt, Human
cuguggcugcgcccugggggag

SEQ ID NO: 171245 - RNA, 22 nt, Human
cugugcuugcugugcuggggcc

SEQ ID NO: 171246 - RNA, 22 nt, Human
cugugguuucuaugggccuuga

SEQ ID NO: 171247 - RNA, 22 nt, Human
cucugcccacaguccccgagga

SEQ ID NO: 171248 - RNA, 22 nt, Human
cucugcguggcugggcccaggg

SEQ ID NO: 171249 - RNA, 20 nt, Human
cuggugccuucugcgauuua

SEQ ID NO: 171250 - RNA, 19 nt, Human
cucuggcuccugggcugcc

SEQ ID NO: 171251 - RNA, 22 nt, Human
cuguauggaggaggugcuagcc

SEQ ID NO: 171252 - RNA, 22 nt, Human
cucuggcaacgauggugcuuau

SEQ ID NO: 171253 - RNA, 22 nt, Human
cagggugaagaugcgccuccug

SEQ ID NO: 171254 - RNA, 22 nt, Human
caggguugaugaauugucugua

SEQ ID NO: 171255 - RNA, 22 nt, Human
caggaaaauaauggugauggga

SEQ ID NO: 171256 - RNA, 22 nt, Human
caggggucccccggcucccugg

SEQ ID NO: 171257 - RNA, 22 nt, Human
cagggguaccuggguuaccugu

SEQ ID NO: 171258 - RNA, 19 nt, Human
caggggcuuaugcgaccuc

SEQ ID NO: 171259 - RNA, 22 nt, Human
caggggcuccaggugagccugg

SEQ ID NO: 171260 - RNA, 22 nt, Human
cagggccaggccucaggggcgc

SEQ ID NO: 171261 - RNA, 22 nt, Human
cagggcacaguuauggaggugg

SEQ ID NO: 171262 - RNA, 22 nt, Human
cagcucuccacccuccugguuc

SEQ ID NO: 171263 - RNA, 22 nt, Human
caggacacagacacuaaauaua

SEQ ID NO: 171264 - RNA, 22 nt, Human
caggcagggcugccuucugcuu

SEQ ID NO: 171265 - RNA, 21 nt, Human
caggccaaaagguucaacauu

SEQ ID NO: 171266 - RNA, 22 nt, Human
caggccagcuggaggggcagcu

SEQ ID NO: 171267 - RNA, 22 nt, Human
cagggagguuggauuggggccu

SEQ ID NO: 171268 - RNA, 22 nt, Human
caggcagggagcuggaaaggau

SEQ ID NO: 171269 - RNA, 22 nt, Human
caggcagagagggcagugugga

SEQ ID NO: 171270 - RNA, 22 nt, Human
caggcacagcuaagacuggcca

SEQ ID NO: 171271 - RNA, 22 nt, Human
cagcuuaccucccacagcucuc

SEQ ID NO: 171272 - RNA, 22 nt, Human
cagcccuguugcgcuuccggcg

SEQ ID NO: 171273 - RNA, 22 nt, Human
caggaagagaacugcucagccu

SEQ ID NO: 171274 - RNA, 22 nt, Human
caggaacucuucugggugcuug

SEQ ID NO: 171275 - RNA, 22 nt, Human
cagaucacucugggcggcggga

SEQ ID NO: 171276 - RNA, 22 nt, Human
cagauguuugaaugcuuaccac

SEQ ID NO: 171277 - RNA, 22 nt, Human
cagcacaggugugaggccugau

SEQ ID NO: 171278 - RNA, 22 nt, Human
cagcuggggagagacauggcag

SEQ ID NO: 171279 - RNA, 22 nt, Human
cagcuguauuucucugguuaga

SEQ ID NO: 171280 - RNA, 22 nt, Human
cagcagccuccccggccgaccu

SEQ ID NO: 171281 - RNA, 22 nt, Human
cagcacuuccuccgugagcccc

SEQ ID NO: 171282 - RNA, 22 nt, Human
cagcagaggagguggcagcacc

SEQ ID NO: 171283 - RNA, 22 nt, Human
cagcaugcaaguccagaugugg

SEQ ID NO: 171284 - RNA, 22 nt, Human
cagcauggagacaaagugggca

SEQ ID NO: 171285 - RNA, 22 nt, Human
cagacagagcucacaagucuuu

SEQ ID NO: 171286 - RNA, 22 nt, Human
cagcccaggcucagauguuggg

SEQ ID NO: 171287 - RNA, 20 nt, Human
cagagacaagagggaaggga

SEQ ID NO: 171288 - RNA, 22 nt, Human
cagacugagaaagugccacagg

SEQ ID NO: 171289 - RNA, 22 nt, Human
cagacuccugcuccucuggggc

SEQ ID NO: 171290 - RNA, 23 nt, Human
cagagaaaauagaauaugcugug

SEQ ID NO: 171291 - RNA, 22 nt, Human
cagcucugcugggaggaugcag

SEQ ID NO: 171292 - RNA, 22 nt, Human
cagcuccagcccaggcagcucc

SEQ ID NO: 171293 - RNA, 22 nt, Human
cagcucgaauaauggagaacug

SEQ ID NO: 171294 - RNA, 22 nt, Human
cagcugcugguguaucgggucc

SEQ ID NO: 171295 - RNA, 22 nt, Human
cagcugcgcagcgccgggccug

SEQ ID NO: 171296 - RNA, 22 nt, Human
cagcugacaagaguccuuggag

SEQ ID NO: 171297 - RNA, 22 nt, Human
cagaggcugggugggguggggg

SEQ ID NO: 171298 - RNA, 22 nt, Human
cagaggaugucuacaccuugag

SEQ ID NO: 171299 - RNA, 22 nt, Human
cagaggcugagcugcgggauga

SEQ ID NO: 171300 - RNA, 22 nt, Human
cagcccaucaaggggauccuga

SEQ ID NO: 171301 - RNA, 21 nt, Human
cagagcuuuggagacggagga

SEQ ID NO: 171302 - RNA, 19 nt, Human
cagcaaacacuguaaaugg

SEQ ID NO: 171303 - RNA, 22 nt, Human
cagaaaaaaaugcagacuagca

SEQ ID NO: 171304 - RNA, 20 nt, Human
cagaucuuauguuuuucugu

SEQ ID NO: 171305 - RNA, 22 nt, Human
cagaugccauagguauaguaua

SEQ ID NO: 171306 - RNA, 22 nt, Human
cagauggagaaagagugaaugg

SEQ ID NO: 171307 - RNA, 22 nt, Human
cagauggaguuaguuucuaaca

SEQ ID NO: 171308 - RNA, 22 nt, Human
cacaaggagaaauagauauuga

SEQ ID NO: 171309 - RNA, 22 nt, Human
caaucuucucuagaguauucua

SEQ ID NO: 171310 - RNA, 22 nt, Human
cagagccagcuguccuuggcau

SEQ ID NO: 171311 - RNA, 22 nt, Human
cagagcagaaaccugggugauu

SEQ ID NO: 171312 - RNA, 22 nt, Human
cacacaccagaaagccugggac

SEQ ID NO: 171313 - RNA, 20 nt, Human
cagagccaggguuuuguuuu

SEQ ID NO: 171314 - RNA, 19 nt, Human
caggucuucuuggaggacu

SEQ ID NO: 171315 - RNA, 22 nt, Human
caggccacagcuaaagaggauu

SEQ ID NO: 171316 - RNA, 22 nt, Human
caggcaggagaaaaggcgcggg

SEQ ID NO: 171317 - RNA, 22 nt, Human
cagggccagggcuauggugaag

SEQ ID NO: 171318 - RNA, 22 nt, Human
cagggcuugaaucaaggaaguc

SEQ ID NO: 171319 - RNA, 22 nt, Human
caguuuuggaagaaacaaggaa

SEQ ID NO: 171320 - RNA, 22 nt, Human
cagggcaucucugaaucuucac

SEQ ID NO: 171321 - RNA, 22 nt, Human
cagggcagaguuaagaugcugg

SEQ ID NO: 171322 - RNA, 22 nt, Human
caggcgcauggugagcagauga

SEQ ID NO: 171323 - RNA, 22 nt, Human
cagggacugcaggaggacaggu

SEQ ID NO: 171324 - RNA, 22 nt, Human
cagggacgugagccaugucagu

SEQ ID NO: 171325 - RNA, 22 nt, Human
cagggagcggggagaucucggg

SEQ ID NO: 171326 - RNA, 22 nt, Human
caggccgcccucuccuguuagc

SEQ ID NO: 171327 - RNA, 22 nt, Human
cauccagggguacccuggagcc

SEQ ID NO: 171328 - RNA, 22 nt, Human
caucgagaauuggcagcuaaag

SEQ ID NO: 171329 - RNA, 22 nt, Human
caguacugucuuccugauggca

SEQ ID NO: 171330 - RNA, 22 nt, Human
caguagcuuuuugcagacaaga

SEQ ID NO: 171331 - RNA, 22 nt, Human
cagguuuggaagucacgaagcu

SEQ ID NO: 171332 - RNA, 22 nt, Human
caggggcuuuccuguuuaugga

SEQ ID NO: 171333 - RNA, 22 nt, Human
caggggacacuccugcuugggc

SEQ ID NO: 171334 - RNA, 22 nt, Human
cagggggcagcguagaaaauga

SEQ ID NO: 171335 - RNA, 22 nt, Human
cagguaguuagaaugaccagga

SEQ ID NO: 171336 - RNA, 22 nt, Human
cagguauuugaaggcaguggga

SEQ ID NO: 171337 - RNA, 22 nt, Human
caggucagcacuuggaggugca

SEQ ID NO: 171338 - RNA, 22 nt, Human
cagguugaagagguuaacgaua

SEQ ID NO: 171339 - RNA, 22 nt, Human
cagguugucuaauuccaagggg

SEQ ID NO: 171340 - RNA, 22 nt, Human
cauguauguuaguggcugcuuu

SEQ ID NO: 171341 - RNA, 22 nt, Human
caugguaccuagccucauggau

SEQ ID NO: 171342 - RNA, 19 nt, Human
cauggcgguaaagaggcug

SEQ ID NO: 171343 - RNA, 22 nt, Human
caugggcucuucuggacugcac

SEQ ID NO: 171344 - RNA, 22 nt, Human
cauggcaggugcagauucugug

SEQ ID NO: 171345 - RNA, 22 nt, Human
caugcuggcacugaccagccua

SEQ ID NO: 171346 - RNA, 22 nt, Human
cauggcacuuuugugucuaaau

SEQ ID NO: 171347 - RNA, 22 nt, Human
caugccaguagccggcuugacu

SEQ ID NO: 171348 - RNA, 22 nt, Human
caugccucuguuuuaguuguug

SEQ ID NO: 171349 - RNA, 22 nt, Human
caugcagcagaauaaugacuau

SEQ ID NO: 171350 - RNA, 22 nt, Human
caguuuuauacacugcagcucc

SEQ ID NO: 171351 - RNA, 22 nt, Human
caguugcuauugagagaacaca

SEQ ID NO: 171352 - RNA, 20 nt, Human
caugaguccgugaguggccc

SEQ ID NO: 171353 - RNA, 22 nt, Human
caguggggaggccaggauagaa

SEQ ID NO: 171354 - RNA, 22 nt, Human
caguucaagauuguugcuuucu

SEQ ID NO: 171355 - RNA, 21 nt, Human
caguucuaagugucaucuuuu

SEQ ID NO: 171356 - RNA, 22 nt, Human
caugaugaacugugcuguuagg

SEQ ID NO: 171357 - RNA, 20 nt, Human
caugaugcaaacaguaacgu

SEQ ID NO: 171358 - RNA, 22 nt, Human
caugaugagaguaauaacacag

SEQ ID NO: 171359 - RNA, 22 nt, Human
caugauucccacauugcgauca

SEQ ID NO: 171360 - RNA, 22 nt, Human
caugauguuaucaagcacaaag

SEQ ID NO: 171361 - RNA, 22 nt, Human
cagugcuccugccccugcccuu

SEQ ID NO: 171362 - RNA, 22 nt, Human
cagugcucauagcuguuccucc

SEQ ID NO: 171363 - RNA, 22 nt, Human
caucugcagccucugcauuccc

SEQ ID NO: 171364 - RNA, 23 nt, Human
cagucgacugugcccucccgagc

SEQ ID NO: 171365 - RNA, 22 nt, Human
caucucagguuuguucugagac

SEQ ID NO: 171366 - RNA, 22 nt, Human
cagugccggccaggaccuccug

SEQ ID NO: 171367 - RNA, 20 nt, Human
cagugcccguggaaaagaug

SEQ ID NO: 171368 - RNA, 22 nt, Human
cagucucuugcuucauuaguug

SEQ ID NO: 171369 - RNA, 22 nt, Human
cagucucuggugaguugacagu

SEQ ID NO: 171370 - RNA, 22 nt, Human
auuguuuugugaaacauaguga

SEQ ID NO: 171371 - RNA, 22 nt, Human
auuucccugcagugcuuaggaa

SEQ ID NO: 171372 - RNA, 22 nt, Human
auuggcugucagcccggauggg

SEQ ID NO: 171373 - RNA, 22 nt, Human
auuucaacagaguuugaaggca

SEQ ID NO: 171374 - RNA, 22 nt, Human
auuucagcagcccauguuugga

SEQ ID NO: 171375 - RNA, 22 nt, Human
auuucagaaugaaaggaaaaau

SEQ ID NO: 171376 - RNA, 22 nt, Human
auugacagagguguaguugaga

SEQ ID NO: 171377 - RNA, 17 nt, Human
auuguuuuuaauuugca

SEQ ID NO: 171378 - RNA, 22 nt, Human
auuguagucuggacuuuuggga

SEQ ID NO: 171379 - RNA, 22 nt, Human
auuagugguguauuuggcacua

SEQ ID NO: 171380 - RNA, 22 nt, Human
auuacagaagauaugcucaaca

SEQ ID NO: 171381 - RNA, 22 nt, Human
auuuuaccauuaguuuguaaua

SEQ ID NO: 171382 - RNA, 21 nt, Human
auuuguggugcaauuguggua

SEQ ID NO: 171383 - RNA, 23 nt, Human
auuugcugaucguagaugacuag

SEQ ID NO: 171384 - RNA, 22 nt, Human
auuugccaguuacucacaccac

SEQ ID NO: 171385 - RNA, 22 nt, Human
auuugaaguauaaguaauugcu

SEQ ID NO: 171386 - RNA, 22 nt, Human
auuuuugguuauaaaauaguuu

SEQ ID NO: 171387 - RNA, 22 nt, Human
auuuuugugucacaucuaggaa

SEQ ID NO: 171388 - RNA, 22 nt, Human
auuuucgcaccucgcgaguugc

SEQ ID NO: 171389 - RNA, 22 nt, Human
auuuuucucucaugugcaacua

SEQ ID NO: 171390 - RNA, 21 nt, Human
auuuggucaaugucugcguga

SEQ ID NO: 171391 - RNA, 22 nt, Human
auuuggggacagagugggggua

SEQ ID NO: 171392 - RNA, 22 nt, Human
caaagaagagauuuacagagcu

SEQ ID NO: 171393 - RNA, 22 nt, Human
caaaacccaagugcuauugcaa

SEQ ID NO: 171394 - RNA, 22 nt, Human
caaaagcaaagaucuuugauug

SEQ ID NO: 171395 - RNA, 22 nt, Human
auuuuuuuuccugucucuuuca

SEQ ID NO: 171396 - RNA, 17 nt, Human
caaccaggaaaggaggg

SEQ ID NO: 171397 - RNA, 22 nt, Human
caacuucuauucagucugcagu

SEQ ID NO: 171398 - RNA, 22 nt, Human
auuuuuuuaggcugucagccgc

SEQ ID NO: 171399 - RNA, 22 nt, Human
caacauuucaaggucuuuagga

SEQ ID NO: 171400 - RNA, 22 nt, Human
caacaagcgcucagagcaaagc

SEQ ID NO: 171401 - RNA, 22 nt, Human
auuuuuauuugccuaugauaua

SEQ ID NO: 171402 - RNA, 22 nt, Human
cacaagacuaaguggcagagca

SEQ ID NO: 171403 - RNA, 22 nt, Human
caacacaucaguucagucuuga

SEQ ID NO: 171404 - RNA, 22 nt, Human
caacaaguugauuucacgcugc

SEQ ID NO: 171405 - RNA, 22 nt, Human
caaaugcaguggucgugcugga

SEQ ID NO: 171406 - RNA, 22 nt, Human
caaaucagaucagagacaggcu

SEQ ID NO: 171407 - RNA, 22 nt, Human
caaauacaaauacgggcagcuu

SEQ ID NO: 171408 - RNA, 22 nt, Human
caauccccaggucccagaacag

SEQ ID NO: 171409 - RNA, 22 nt, Human
caaagcuucaucuguuguuuug

SEQ ID NO: 171410 - RNA, 22 nt, Human
caaaggaaagagaaaaagucuu

SEQ ID NO: 171411 - RNA, 22 nt, Human
caaguugcaugugcuugaaaua

SEQ ID NO: 171412 - RNA, 22 nt, Human
caauaccucuuggugauugggc

SEQ ID NO: 171413 - RNA, 22 nt, Human
caaagccuggggagaguaagga

SEQ ID NO: 171414 - RNA, 22 nt, Human
caaggguguacagauaugagag

SEQ ID NO: 171415 - RNA, 22 nt, Human
caagggcagaggcagggccccg

SEQ ID NO: 171416 - RNA, 22 nt, Human
caaggggagcugguauggaugg

SEQ ID NO: 171417 - RNA, 22 nt, Human
caaggaagguugguugaaggua

SEQ ID NO: 171418 - RNA, 22 nt, Human
caagaaguugacagccagguga

SEQ ID NO: 171419 - RNA, 22 nt, Human
caagagcucccagaccugggca

SEQ ID NO: 171420 - RNA, 22 nt, Human
caagaaccuagcgaucagguaa

SEQ ID NO: 171421 - RNA, 22 nt, Human
caaaacauucagagagcucacu

SEQ ID NO: 171422 - RNA, 22 nt, Human
caagaugcaagaccagucaggc

SEQ ID NO: 171423 - RNA, 22 nt, Human
caagagguaugagccgggauga

SEQ ID NO: 171424 - RNA, 22 nt, Human
caagcgcgccgcuuccuuccgc

SEQ ID NO: 171425 - RNA, 20 nt, Human
caccggguugcugguuucuu

SEQ ID NO: 171426 - RNA, 22 nt, Human
caccuggaggcagcaccgggcu

SEQ ID NO: 171427 - RNA, 22 nt, Human
cacccgacugaggacgccgccc

SEQ ID NO: 171428 - RNA, 22 nt, Human
caaggucagacagccaggacag

SEQ ID NO: 171429 - RNA, 22 nt, Human
caagguuucgaguucccaacca

SEQ ID NO: 171430 - RNA, 22 nt, Human
caccaccaguaccaucacacgc

SEQ ID NO: 171431 - RNA, 22 nt, Human
caccagcgacugugaccagcaa

SEQ ID NO: 171432 - RNA, 22 nt, Human
caaggaaaugucagaaaggcaa

SEQ ID NO: 171433 - RNA, 22 nt, Human
cacaugugugugccuacaugca

SEQ ID NO: 171434 - RNA, 22 nt, Human
cacauugguagaauuuagaaga

SEQ ID NO: 171435 - RNA, 22 nt, Human
cacauuucagcacucagggcau

SEQ ID NO: 171436 - RNA, 22 nt, Human
cacagcuggggaagcugaggcc

SEQ ID NO: 171437 - RNA, 22 nt, Human
cacaguccugcauuuacugccu

SEQ ID NO: 171438 - RNA, 22 nt, Human
caagcacaauuucuacauguua

SEQ ID NO: 171439 - RNA, 22 nt, Human
caagcagauauuuuagucaaga

SEQ ID NO: 171440 - RNA, 22 nt, Human
cacaugugggcacagggcugca

SEQ ID NO: 171441 - RNA, 22 nt, Human
caaggaaaacagaugaucaaca

SEQ ID NO: 171442 - RNA, 22 nt, Human
cacagccaagacuuggccccau

SEQ ID NO: 171443 - RNA, 22 nt, Human
cacagcaggcagaacgugggca

SEQ ID NO: 171444 - RNA, 22 nt, Human
caagaaaaaacaugaugagugu

SEQ ID NO: 171445 - RNA, 19 nt, Human
caagagcaaagucuuauga

SEQ ID NO: 171446 - RNA, 22 nt, Human
caagagcgugugcagggcaagu

SEQ ID NO: 171447 - RNA, 22 nt, Human
augcagauguagauucugaaau

SEQ ID NO: 171448 - RNA, 22 nt, Human
augcacuugacucuauuccaca

SEQ ID NO: 171449 - RNA, 22 nt, Human
augcagcggucagaggaacuca

SEQ ID NO: 171450 - RNA, 22 nt, Human
augaucaagaauuuuguauucc

SEQ ID NO: 171451 - RNA, 22 nt, Human
augaucacagugucagucauua

SEQ ID NO: 171452 - RNA, 22 nt, Human
augcaccugucuuuuaaggaua

SEQ ID NO: 171453 - RNA, 17 nt, Human
augcccagggcucccug

SEQ ID NO: 171454 - RNA, 23 nt, Human
augcaacauugccaguaugggca

SEQ ID NO: 171455 - RNA, 22 nt, Human
augcccugggagugcuguacca

SEQ ID NO: 171456 - RNA, 22 nt, Human
augccgggguggcuccagcacc

SEQ ID NO: 171457 - RNA, 22 nt, Human
augccugcugucaggaacucuu

SEQ ID NO: 171458 - RNA, 22 nt, Human
augccucuugagagccagugcu

SEQ ID NO: 171459 - RNA, 18 nt, Human
augcugacacaaugugga

SEQ ID NO: 171460 - RNA, 22 nt, Human
augcugacaacaaagaaggaag

SEQ ID NO: 171461 - RNA, 22 nt, Human
augcucuuaauugcuagauaag

SEQ ID NO: 171462 - RNA, 22 nt, Human
auggccuuucucaguggugcuu

SEQ ID NO: 171463 - RNA, 22 nt, Human
augcugcuuguccauuuauuug

SEQ ID NO: 171464 - RNA, 22 nt, Human
augcugcuccuuuucaggcauu

SEQ ID NO: 171465 - RNA, 22 nt, Human
augcugugccuggaaagcggcu

SEQ ID NO: 171466 - RNA, 22 nt, Human
augcuugaaaguuauuucauuu

SEQ ID NO: 171467 - RNA, 22 nt, Human
augccugggcuuuaggguucuc

SEQ ID NO: 171468 - RNA, 21 nt, Human
augcgcgguggagugagcgaa

SEQ ID NO: 171469 - RNA, 22 nt, Human
augcggcugugggggaauggga

SEQ ID NO: 171470 - RNA, 22 nt, Human
augcgcugugcacacucuuaac

SEQ ID NO: 171471 - RNA, 22 nt, Human
augaggagucaaggagucggag

SEQ ID NO: 171472 - RNA, 22 nt, Human
augaggauuagcaucugcaaau

SEQ ID NO: 171473 - RNA, 22 nt, Human
augaugaugguuuaacuucagg

SEQ ID NO: 171474 - RNA, 22 nt, Human
augaugauuauucauuuucugu

SEQ ID NO: 171475 - RNA, 22 nt, Human
augaagugcccugggggccaga

SEQ ID NO: 171476 - RNA, 22 nt, Human
augauggagaacaaagaaaauc

SEQ ID NO: 171477 - RNA, 22 nt, Human
augacagcuaaggaauguguag

SEQ ID NO: 171478 - RNA, 22 nt, Human
augaauuaucugguguuggaaa

SEQ ID NO: 171479 - RNA, 22 nt, Human
augcacuacuagaugcaaaagu

SEQ ID NO: 171480 - RNA, 22 nt, Human
augcagaaucucuuuccugagg

SEQ ID NO: 171481 - RNA, 22 nt, Human
augagaaauaauuguguacuga

SEQ ID NO: 171482 - RNA, 20 nt, Human
aucugugaugagaacgguuu

SEQ ID NO: 171483 - RNA, 22 nt, Human
aucuucaaagcacaucguuugu

SEQ ID NO: 171484 - RNA, 19 nt, Human
augagccccaguucguucc

SEQ ID NO: 171485 - RNA, 22 nt, Human
augagcucuaaguacaugccca

SEQ ID NO: 171486 - RNA, 22 nt, Human
augagcuaagcagaaagcacac

SEQ ID NO: 171487 - RNA, 22 nt, Human
aucuacuaagugccaagcacag

SEQ ID NO: 171488 - RNA, 23 nt, Human
augaaaugauacuuuauucacug

SEQ ID NO: 171489 - RNA, 22 nt, Human
augaaacuggagcgccuggagg

SEQ ID NO: 171490 - RNA, 22 nt, Human
augaaaacgugugugugugugu

SEQ ID NO: 171491 - RNA, 22 nt, Human
aucugcuguaguuggugccagu

SEQ ID NO: 171492 - RNA, 22 nt, Human
aucugcugcuccuucuucuugc

SEQ ID NO: 171493 - RNA, 22 nt, Human
aucugcugccuaggguuugucu

SEQ ID NO: 171494 - RNA, 22 nt, Human
auucccagucccucccaccccu

SEQ ID NO: 171495 - RNA, 17 nt, Human
auucaugaacauguccu

SEQ ID NO: 171496 - RNA, 22 nt, Human
auucauuuuuacaucaccaaua

SEQ ID NO: 171497 - RNA, 22 nt, Human
auucaggacucuuccuugaaga

SEQ ID NO: 171498 - RNA, 22 nt, Human
auucaagauaagggucugggag

SEQ ID NO: 171499 - RNA, 21 nt, Human
auucaaagaagaggaaggccc

SEQ ID NO: 171500 - RNA, 22 nt, Human
auucaagauagaaggauuuuca

SEQ ID NO: 171501 - RNA, 22 nt, Human
auguuuuuugaaaauguauuuu

SEQ ID NO: 171502 - RNA, 18 nt, Human
auguuccugcaguuauuu

SEQ ID NO: 171503 - RNA, 22 nt, Human
auguuccuuaaugugcuuguag

SEQ ID NO: 171504 - RNA, 22 nt, Human
augugaaagagguguucagugg

SEQ ID NO: 171505 - RNA, 20 nt, Human
augucaggaagggagucagg

SEQ ID NO: 171506 - RNA, 22 nt, Human
augugccuuaauauaggcgcug

SEQ ID NO: 171507 - RNA, 22 nt, Human
augugcacuggugugugcguuc

SEQ ID NO: 171508 - RNA, 22 nt, Human
augugccugagggcuccuugug

SEQ ID NO: 171509 - RNA, 22 nt, Human
augugcauguauguaucauauu

SEQ ID NO: 171510 - RNA, 19 nt, Human
auguucugaauuacuguaa

SEQ ID NO: 171511 - RNA, 22 nt, Human
augugaaauuugggcucuggga

SEQ ID NO: 171512 - RNA, 22 nt, Human
auguugaguggaugaacaaaca

SEQ ID NO: 171513 - RNA, 22 nt, Human
augugaacuccagcugccaacc

SEQ ID NO: 171514 - RNA, 22 nt, Human
auguguuuugaccccugcuaaa

SEQ ID NO: 171515 - RNA, 22 nt, Human
auguguuuccaacagagaggga

SEQ ID NO: 171516 - RNA, 22 nt, Human
augugugugcgagcgugugugu

SEQ ID NO: 171517 - RNA, 22 nt, Human
auggcuucugucuuggaaauuu

SEQ ID NO: 171518 - RNA, 18 nt, Human
auggcuccagugucuucc

SEQ ID NO: 171519 - RNA, 22 nt, Human
auggccuguuuccucugaaaga

SEQ ID NO: 171520 - RNA, 22 nt, Human
auggccugaagcuaaccccccu

SEQ ID NO: 171521 - RNA, 19 nt, Human
augggaagcggccagcgga

SEQ ID NO: 171522 - RNA, 22 nt, Human
auggcucugcugggcaaagcaa

SEQ ID NO: 171523 - RNA, 22 nt, Human
auggccguggccagggucaggg

SEQ ID NO: 171524 - RNA, 22 nt, Human
auggcuguguuguuccucugaa

SEQ ID NO: 171525 - RNA, 20 nt, Human
auggcgagucagcacaaaac

SEQ ID NO: 171526 - RNA, 22 nt, Human
augguugccugagauaagacug

SEQ ID NO: 171527 - RNA, 22 nt, Human
augguugugaaagagcaaagac

SEQ ID NO: 171528 - RNA, 22 nt, Human
augguugggggaugucagcagg

SEQ ID NO: 171529 - RNA, 22 nt, Human
augugaaccuggguccugggcc

SEQ ID NO: 171530 - RNA, 21 nt, Human
auauuguugggguuuucuuuu

SEQ ID NO: 171531 - RNA, 22 nt, Human
auauuuguuuggcagaguucag

SEQ ID NO: 171532 - RNA, 22 nt, Human
aucacaaauggaaucaccuccc

SEQ ID NO: 171533 - RNA, 21 nt, Human
aucagaggacaucucagggcc

SEQ ID NO: 171534 - RNA, 20 nt, Human
aucaggagucgcggggagag

SEQ ID NO: 171535 - RNA, 22 nt, Human
aucagcucuugaugccuuucuu

SEQ ID NO: 171536 - RNA, 22 nt, Human
aucaagacaaaggaaaggcuaa

SEQ ID NO: 171537 - RNA, 22 nt, Human
aucaacucacagugugcuggca

SEQ ID NO: 171538 - RNA, 20 nt, Human
aucaagugucuugccaggca

SEQ ID NO: 171539 - RNA, 19 nt, Human
aucagcaguuuugccugga

SEQ ID NO: 171540 - RNA, 22 nt, Human
aucagagcuaguacuugcaggu

SEQ ID NO: 171541 - RNA, 20 nt, Human
aucaugugcacugcugacag

SEQ ID NO: 171542 - RNA, 22 nt, Human
aucgaguggugagaacacaaca

SEQ ID NO: 171543 - RNA, 22 nt, Human
aucccacaccccuacaacauau

SEQ ID NO: 171544 - RNA, 22 nt, Human
auccacccugcaggccaacucu

SEQ ID NO: 171545 - RNA, 22 nt, Human
auccuccuggggcagucuuccc

SEQ ID NO: 171546 - RNA, 22 nt, Human
auccuggcuuuccugauuuacu

SEQ ID NO: 171547 - RNA, 18 nt, Human
auccuuugaucaucuguc

SEQ ID NO: 171548 - RNA, 22 nt, Human
auccgugagcgagcgagcaccc

SEQ ID NO: 171549 - RNA, 22 nt, Human
auccugauggaaacugguauga

SEQ ID NO: 171550 - RNA, 22 nt, Human
auccucucuuaugaacaacugu

SEQ ID NO: 171551 - RNA, 22 nt, Human
aucccuggccacgaagcugccc

SEQ ID NO: 171552 - RNA, 22 nt, Human
aucaugggauagugggacgagc

SEQ ID NO: 171553 - RNA, 22 nt, Human
auccaggggucugaauggauau

SEQ ID NO: 171554 - RNA, 22 nt, Human
aucaugcgguuaaggagugugu

SEQ ID NO: 171555 - RNA, 22 nt, Human
aucaucccuuucucccagugaa

SEQ ID NO: 171556 - RNA, 23 nt, Human
auccacauucuaguccuuuaugc

SEQ ID NO: 171557 - RNA, 22 nt, Human
aucauuugaacagaauuuguuu

SEQ ID NO: 171558 - RNA, 22 nt, Human
aucagugcacgcgaugggcaga

SEQ ID NO: 171559 - RNA, 22 nt, Human
auccuccuuugcccugagauca

SEQ ID NO: 171560 - RNA, 22 nt, Human
aucauguauauuuuugcuauua

SEQ ID NO: 171561 - RNA, 22 nt, Human
aucauguauaugcagcguuugu

SEQ ID NO: 171562 - RNA, 22 nt, Human
auccucugcucaugagaaaugu

SEQ ID NO: 171563 - RNA, 22 nt, Human
aucaugugacuagguuuggcca

SEQ ID NO: 171564 - RNA, 22 nt, Human
aucauugcuaguaaggaucuug

SEQ ID NO: 171565 - RNA, 22 nt, Human
auauggugauuuuaugcaggaa

SEQ ID NO: 171566 - RNA, 22 nt, Human
auaugcacauguacauguauau

SEQ ID NO: 171567 - RNA, 22 nt, Human
auaggacuguacagaauacaag

SEQ ID NO: 171568 - RNA, 22 nt, Human
auaggcauaacacugauguccu

SEQ ID NO: 171569 - RNA, 22 nt, Human
auaggcggagccauaucaucca

SEQ ID NO: 171570 - RNA, 22 nt, Human
auaguugcugucauuauuugag

SEQ ID NO: 171571 - RNA, 22 nt, Human
auauaacccaaggcaggcugug

SEQ ID NO: 171572 - RNA, 22 nt, Human
auagggaggcggagggagcugg

SEQ ID NO: 171573 - RNA, 22 nt, Human
auaggagcaagauuauagcagg

SEQ ID NO: 171574 - RNA, 22 nt, Human
auagcaguauuaugagauaacu

SEQ ID NO: 171575 - RNA, 22 nt, Human
auagaaauagacaaugcaaaga

SEQ ID NO: 171576 - RNA, 22 nt, Human
auagaugacaguuaggaagcug

SEQ ID NO: 171577 - RNA, 22 nt, Human
agugaggggagaaugaggugga

SEQ ID NO: 171578 - RNA, 23 nt, Human
agugaagcugguuagugaugacc

SEQ ID NO: 171579 - RNA, 22 nt, Human
uugccccugcccucuguggucc

SEQ ID NO: 171580 - RNA, 22 nt, Human
uuuuuuuuacuccggacagcuc

SEQ ID NO: 171581 - RNA, 22 nt, Human
uuuuuuuguagguguaugaaaa

SEQ ID NO: 171582 - RNA, 22 nt, Human
uuuuuuguuccuugguuuuugu

SEQ ID NO: 171583 - RNA, 18 nt, Human
uuuuuuguucuguuuugu

SEQ ID NO: 171584 - RNA, 22 nt, Human
uuuuugcuuuuuugucaucuaa

SEQ ID NO: 171585 - RNA, 22 nt, Human
uuuuuaccugguguccagcuuc

SEQ ID NO: 171586 - RNA, 22 nt, Human
uuuuucacacuccuuuccaguu

SEQ ID NO: 171587 - RNA, 18 nt, Human
uuuuguguuuauucugca

SEQ ID NO: 171588 - RNA, 22 nt, Human
uuuuggaaaaaccaguauggaa

SEQ ID NO: 171589 - RNA, 22 nt, Human
uuuuccaaaaguggagaggaau

SEQ ID NO: 171590 - RNA, 22 nt, Human
uuuucauuguuaguuucuccuu

SEQ ID NO: 171591 - RNA, 22 nt, Human
uuuuccgaccuuaggaaggaac

SEQ ID NO: 171592 - RNA, 22 nt, Human
uuuucuacaaucacucuggaag

SEQ ID NO: 171593 - RNA, 22 nt, Human
uuuucugauccuucuaacuuga

SEQ ID NO: 171594 - RNA, 22 nt, Human
uuuucuugagucacuccaguga

SEQ ID NO: 171595 - RNA, 22 nt, Human
uuuugcaaauuacuaaauuucu

SEQ ID NO: 171596 - RNA, 22 nt, Human
uuuugccuauuguaucaucgua

SEQ ID NO: 171597 - RNA, 22 nt, Human
uuuucaguuccaucucugcucu

SEQ ID NO: 171598 - RNA, 22 nt, Human
uuuuaaaagguugcuguuauaa

SEQ ID NO: 171599 - RNA, 19 nt, Human
uuuaaugugugcugcaauc

SEQ ID NO: 171600 - RNA, 22 nt, Human
uuuguuugcugagugaauucaa

SEQ ID NO: 171601 - RNA, 23 nt, Human
uuuguugguuuaagaguagcaga

SEQ ID NO: 171602 - RNA, 19 nt, Human
uuuguuguaucagagcuuu

SEQ ID NO: 171603 - RNA, 22 nt, Human
uuuguugguugcacuggugggu

SEQ ID NO: 171604 - RNA, 22 nt, Human
uuuguucuucucaugcacacaa

SEQ ID NO: 171605 - RNA, 22 nt, Human
uuuguucaccuagcaaacuuuu

SEQ ID NO: 171606 - RNA, 19 nt, Human
uucuguggucccaggccuu

SEQ ID NO: 171607 - RNA, 22 nt, Human
uucugugcugagaaauagagag

SEQ ID NO: 171608 - RNA, 22 nt, Human
uuuuuuuagaaagaucauaguu

SEQ ID NO: 171609 - RNA, 22 nt, Human
uuuuuuuaaguuuugauuuuag

SEQ ID NO: 171610 - RNA, 22 nt, Human
uugaggcugaucacuccuauaa

SEQ ID NO: 171611 - RNA, 22 nt, Human
uugaggguggauugucagggga

SEQ ID NO: 171612 - RNA, 22 nt, Human
uugaggaagggaggcaaaacug

SEQ ID NO: 171613 - RNA, 22 nt, Human
uugaggucuguguaggcagcaa

SEQ ID NO: 171614 - RNA, 22 nt, Human
uuuuuguggggggcggugugaa

SEQ ID NO: 171615 - RNA, 22 nt, Human
uuuuuguuauuuagguguagag

SEQ ID NO: 171616 - RNA, 22 nt, Human
uuuuuucuggaguuugggguuu

SEQ ID NO: 171617 - RNA, 22 nt, Human
uugaaggugggaggauuuauau

SEQ ID NO: 171618 - RNA, 22 nt, Human
uuccgcuuucaauggcuuggcu

SEQ ID NO: 171619 - RNA, 22 nt, Human
uuuguucuagauaacugguaau

SEQ ID NO: 171620 - RNA, 18 nt, Human
uucuaaauucuguuuuua

SEQ ID NO: 171621 - RNA, 22 nt, Human
uucguucagcgcuugcgcaugc

SEQ ID NO: 171622 - RNA, 22 nt, Human
uucucuauuugcugcaccucuc

SEQ ID NO: 171623 - RNA, 22 nt, Human
uucucaagccuuccuuucccaa

SEQ ID NO: 171624 - RNA, 19 nt, Human
uuuucaacguccgguucau

SEQ ID NO: 171625 - RNA, 22 nt, Human
uuuuauuuguauguugaaugua

SEQ ID NO: 171626 - RNA, 22 nt, Human
uuuugaugaccauucuucuuuu

SEQ ID NO: 171627 - RNA, 22 nt, Human
uucuggacuuccaaauggcuuc

SEQ ID NO: 171628 - RNA, 22 nt, Human
uucugucaguguugguggaaau

SEQ ID NO: 171629 - RNA, 22 nt, Human
uuuucacugacuuggucuggaa

SEQ ID NO: 171630 - RNA, 22 nt, Human
uucugaaccauugagcacugcc

SEQ ID NO: 171631 - RNA, 22 nt, Human
uucugcccuugccagacaagua

SEQ ID NO: 171632 - RNA, 18 nt, Human
uucugcggugacagauau

SEQ ID NO: 171633 - RNA, 20 nt, Human
uucugcagcagguguugaag

SEQ ID NO: 171634 - RNA, 22 nt, Human
uuggggggucagacuugauaca

SEQ ID NO: 171635 - RNA, 22 nt, Human
uugggggccuccuguuccccca

SEQ ID NO: 171636 - RNA, 22 nt, Human
uuggggcugcguauuuccaugu

SEQ ID NO: 171637 - RNA, 22 nt, Human
uuggggcugcguguuuccaugu

SEQ ID NO: 171638 - RNA, 22 nt, Human
uuggguguugguuccugggagg

SEQ ID NO: 171639 - RNA, 22 nt, Human
uuggucaagacugauaucaaga

SEQ ID NO: 171640 - RNA, 22 nt, Human
uuggcaaagagaugcauaagga

SEQ ID NO: 171641 - RNA, 22 nt, Human
uugcccccuguccuucccugua

SEQ ID NO: 171642 - RNA, 22 nt, Human
uuggccaaaaaagucauuagaa

SEQ ID NO: 171643 - RNA, 22 nt, Human
uuggugaugaaagugcugcgcu

SEQ ID NO: 171644 - RNA, 22 nt, Human
uuggugaugcuaggaauguagu

SEQ ID NO: 171645 - RNA, 22 nt, Human
uuggugauguagcagcaauugu

SEQ ID NO: 171646 - RNA, 22 nt, Human
uuguccacuaagaaagugcccu

SEQ ID NO: 171647 - RNA, 22 nt, Human
uuguagaucagauggccaguag

SEQ ID NO: 171648 - RNA, 22 nt, Human
uuguaugcugggaagcgggagg

SEQ ID NO: 171649 - RNA, 21 nt, Human
uuguccacacacaccaacugc

SEQ ID NO: 171650 - RNA, 22 nt, Human
uuguuuuucucuagggaaggcu

SEQ ID NO: 171651 - RNA, 22 nt, Human
uuguuugcacuuuagagacugu

SEQ ID NO: 171652 - RNA, 22 nt, Human
uuuaaugaugucuaugccuguu

SEQ ID NO: 171653 - RNA, 22 nt, Human
uugcuuugcuucuuuaugguca

SEQ ID NO: 171654 - RNA, 22 nt, Human
uuggaaaagaaauacucauaua

SEQ ID NO: 171655 - RNA, 22 nt, Human
uuggaagacagccgucuuuauu

SEQ ID NO: 171656 - RNA, 22 nt, Human
uuggacugggauggccgaggcu

SEQ ID NO: 171657 - RNA, 22 nt, Human
uuggaagugucuaauacaggua

SEQ ID NO: 171658 - RNA, 22 nt, Human
uuggaauuugagaccaagaaaa

SEQ ID NO: 171659 - RNA, 22 nt, Human
uuggaagagagauggggagaga

SEQ ID NO: 171660 - RNA, 22 nt, Human
uuggaaguggcaaaggcuaaag

SEQ ID NO: 171661 - RNA, 22 nt, Human
uugcuugaacccaggaagugga

SEQ ID NO: 171662 - RNA, 22 nt, Human
uugcugagcugaaccagccacc

SEQ ID NO: 171663 - RNA, 22 nt, Human
uugcucuuaccauuauguguga

SEQ ID NO: 171664 - RNA, 21 nt, Human
uugcuggagcaauguaaauca

SEQ ID NO: 171665 - RNA, 22 nt, Human
uugcaagcccugaagggcugga

SEQ ID NO: 171666 - RNA, 20 nt, Human
uugcaaagugaauagcaauu

SEQ ID NO: 171667 - RNA, 22 nt, Human
uugcagauuucuuguccccauu

SEQ ID NO: 171668 - RNA, 22 nt, Human
uugcauauguccagccaugcau

SEQ ID NO: 171669 - RNA, 22 nt, Human
uugcagugucaucuagacgugg

SEQ ID NO: 171670 - RNA, 22 nt, Human
uugcguaucuacauugccugua

SEQ ID NO: 171671 - RNA, 22 nt, Human
uugccgacuggccaaggaguaa

SEQ ID NO: 171672 - RNA, 22 nt, Human
uugccaggggacaucuggagcc

SEQ ID NO: 171673 - RNA, 22 nt, Human
uugccuacaaacgaaucuaucu

SEQ ID NO: 171674 - RNA, 22 nt, Human
uugccuguuugagagcuguguu

SEQ ID NO: 171675 - RNA, 22 nt, Human
uuucugggggucgugcuggcug

SEQ ID NO: 171676 - RNA, 19 nt, Human
uuucuggguucaccucuug

SEQ ID NO: 171677 - RNA, 22 nt, Human
uuauuugcccauguuuagcaga

SEQ ID NO: 171678 - RNA, 22 nt, Human
uuugagugccucgaguguggga

SEQ ID NO: 171679 - RNA, 22 nt, Human
uuugaugagaaaugacuuaagu

SEQ ID NO: 171680 - RNA, 20 nt, Human
uuugauugccccucugacuu

SEQ ID NO: 171681 - RNA, 22 nt, Human
uuugagguuuagcucacuauuu

SEQ ID NO: 171682 - RNA, 22 nt, Human
uucacuguucuuagagaagacc

SEQ ID NO: 171683 - RNA, 22 nt, Human
uuugagugcccauguuucccag

SEQ ID NO: 171684 - RNA, 22 nt, Human
uucaacacaaguugugcaguaa

SEQ ID NO: 171685 - RNA, 22 nt, Human
uucaaacacugugcaauugggu

SEQ ID NO: 171686 - RNA, 22 nt, Human
uuugaagauaaauauggagaaa

SEQ ID NO: 171687 - RNA, 22 nt, Human
uuugaagaaacagucuuaagag

SEQ ID NO: 171688 - RNA, 22 nt, Human
uuauuuuuaggaauguagaggu

SEQ ID NO: 171689 - RNA, 22 nt, Human
uuuggcaccuccaaggacucgc

SEQ ID NO: 171690 - RNA, 22 nt, Human
uuuggggcucauuugcuuuugu

SEQ ID NO: 171691 - RNA, 22 nt, Human
uuugggcauuuuuaaggaucuu

SEQ ID NO: 171692 - RNA, 22 nt, Human
uuugggguuuuuuggugaaauc

SEQ ID NO: 171693 - RNA, 19 nt, Human
uuugguaggcuugagggaa

SEQ ID NO: 171694 - RNA, 22 nt, Human
uucaggggcaaauacauuuuga

SEQ ID NO: 171695 - RNA, 22 nt, Human
uuuguuaugguuggaagcagga

SEQ ID NO: 171696 - RNA, 22 nt, Human
uuccagguggcuuuccuggggg

SEQ ID NO: 171697 - RNA, 22 nt, Human
uuuguggaaaagagcccaggag

SEQ ID NO: 171698 - RNA, 22 nt, Human
uuccaaaugacaaugggcugua

SEQ ID NO: 171699 - RNA, 22 nt, Human
uuccaacaugugcuuguguuga

SEQ ID NO: 171700 - RNA, 22 nt, Human
uucauugcuacuuaaaauacca

SEQ ID NO: 171701 - RNA, 22 nt, Human
uucauugcagaauuuggccuca

SEQ ID NO: 171702 - RNA, 22 nt, Human
uuugguguuuucaggaauauac

SEQ ID NO: 171703 - RNA, 21 nt, Human
uuuccagaggcagccggacuc

SEQ ID NO: 171704 - RNA, 22 nt, Human
uuaugccuguuaggcagcaucu

SEQ ID NO: 171705 - RNA, 22 nt, Human
uuucaugauuaacuuagugaau

SEQ ID NO: 171706 - RNA, 22 nt, Human
uuucagcaugacuguuaucuuu

SEQ ID NO: 171707 - RNA, 22 nt, Human
uuucuauuuacagugcuaggua

SEQ ID NO: 171708 - RNA, 22 nt, Human
uuucgcuuguucggagugcuuu

SEQ ID NO: 171709 - RNA, 22 nt, Human
uuauuguagcacuuuggcagug

SEQ ID NO: 171710 - RNA, 22 nt, Human
uuauuguuuggguauaauuuga

SEQ ID NO: 171711 - RNA, 22 nt, Human
uuuccuuuguuuugguauaugu

SEQ ID NO: 171712 - RNA, 22 nt, Human
uuuccugcagacaguuuaagca

SEQ ID NO: 171713 - RNA, 22 nt, Human
uuaugugcuuuuugagcucuaa

SEQ ID NO: 171714 - RNA, 22 nt, Human
uuaccugcagagacguggaggc

SEQ ID NO: 171715 - RNA, 22 nt, Human
uuaccugagcggauuuguugca

SEQ ID NO: 171716 - RNA, 21 nt, Human
uguuugcuuuuggagcaacug

SEQ ID NO: 171717 - RNA, 22 nt, Human
uguuugaugugcacgugugugu

SEQ ID NO: 171718 - RNA, 22 nt, Human
uuucaagccucacugcguuuug

SEQ ID NO: 171719 - RNA, 22 nt, Human
ugggcagagggugaggaaggcg

SEQ ID NO: 171720 - RNA, 22 nt, Human
ugggauggacuuuagagaaucg

SEQ ID NO: 171721 - RNA, 22 nt, Human
ugggcagggagcuggaaccaca

SEQ ID NO: 171722 - RNA, 22 nt, Human
ugggccacguggagucuguagg

SEQ ID NO: 171723 - RNA, 22 nt, Human
ugggcccaucauugcugugggc

SEQ ID NO: 171724 - RNA, 21 nt, Human
uggggaugcauugcagaggca

SEQ ID NO: 171725 - RNA, 22 nt, Human
uggggagucccaacgguggaag

SEQ ID NO: 171726 - RNA, 22 nt, Human
uggcuugagcugggcccaccug

SEQ ID NO: 171727 - RNA, 22 nt, Human
ugggagagauaggcuucuggac

SEQ ID NO: 171728 - RNA, 22 nt, Human
uggcuuuugaaaaggugaugua

SEQ ID NO: 171729 - RNA, 22 nt, Human
uggcuuuucaccugcuccucug

SEQ ID NO: 171730 - RNA, 20 nt, Human
ugggauggaaucaccugcac

SEQ ID NO: 171731 - RNA, 22 nt, Human
ugggaugagcuauauagaaagu

SEQ ID NO: 171732 - RNA, 22 nt, Human
ugggauauagaauuggcagagu

SEQ ID NO: 171733 - RNA, 20 nt, Human
uuccccauaaaaauguucca

SEQ ID NO: 171734 - RNA, 22 nt, Human
uuccccgagccuggggaagcug

SEQ ID NO: 171735 - RNA, 22 nt, Human
ugggucacuggccaagcucgac

SEQ ID NO: 171736 - RNA, 22 nt, Human
ugggucagauacaguguuuggu

SEQ ID NO: 171737 - RNA, 22 nt, Human
ugggucagauugagccccuggu

SEQ ID NO: 171738 - RNA, 22 nt, Human
uggggugccccccucgguuugc

SEQ ID NO: 171739 - RNA, 22 nt, Human
uucuagccauagaaauuagauu

SEQ ID NO: 171740 - RNA, 20 nt, Human
uucucugcagcaggcggccc

SEQ ID NO: 171741 - RNA, 22 nt, Human
uucucagagaaagcuccucaug

SEQ ID NO: 171742 - RNA, 22 nt, Human
ugggggcacccagccgaugagg

SEQ ID NO: 171743 - RNA, 22 nt, Human
ugggggauucaucucagagcgu

SEQ ID NO: 171744 - RNA, 22 nt, Human
ugggggagggagaguugauggg

SEQ ID NO: 171745 - RNA, 21 nt, Human
uggccaaggaauagaagcucu

SEQ ID NO: 171746 - RNA, 22 nt, Human
uucagguacuaagugcugauuc

SEQ ID NO: 171747 - RNA, 22 nt, Human
uggcauuuuguagcuguguauc

SEQ ID NO: 171748 - RNA, 22 nt, Human
uucagguuuuuaaguucugccu

SEQ ID NO: 171749 - RNA, 22 nt, Human
uggcccaagggaggcuuggccu

SEQ ID NO: 171750 - RNA, 22 nt, Human
uggccaaucagcugugaccugc

SEQ ID NO: 171751 - RNA, 22 nt, Human
uucauacucuucccugggcaaa

SEQ ID NO: 171752 - RNA, 22 nt, Human
uggccccauuuuucuggagccu

SEQ ID NO: 171753 - RNA, 21 nt, Human
uggcccgagccgggguuggcu

SEQ ID NO: 171754 - RNA, 20 nt, Human
uggccgacccugaggaguug

SEQ ID NO: 171755 - RNA, 22 nt, Human
uggcccugaaucaaggccagca

SEQ ID NO: 171756 - RNA, 22 nt, Human
uggccgaugagcaugcgcugau

SEQ ID NO: 171757 - RNA, 23 nt, Human
uggccguccccugacucucuggc

SEQ ID NO: 171758 - RNA, 22 nt, Human
uucaugcgcuuuucaggagugu

SEQ ID NO: 171759 - RNA, 20 nt, Human
uggcccgcgcuccuccugcu

SEQ ID NO: 171760 - RNA, 22 nt, Human
uucaucauuuuccauuccucuu

SEQ ID NO: 171761 - RNA, 22 nt, Human
uggcuucugguuuauccuuaua

SEQ ID NO: 171762 - RNA, 22 nt, Human
uuccagauguuuaaguucugcu

SEQ ID NO: 171763 - RNA, 22 nt, Human
uuccagcaaagguaguguguua

SEQ ID NO: 171764 - RNA, 18 nt, Human
uggcuagaagagcucuca

SEQ ID NO: 171765 - RNA, 22 nt, Human
uggcucacaggaggcagaggug

SEQ ID NO: 171766 - RNA, 22 nt, Human
uggcucagcgcggccuggucuu

SEQ ID NO: 171767 - RNA, 22 nt, Human
uggcucaggccuacgacgccuu

SEQ ID NO: 171768 - RNA, 22 nt, Human
uggcucaguaaucgagucuccu

SEQ ID NO: 171769 - RNA, 22 nt, Human
uggcgcucacccugcggcccug

SEQ ID NO: 171770 - RNA, 22 nt, Human
uggcggcuggacuggggggcca

SEQ ID NO: 171771 - RNA, 22 nt, Human
uggcgcgcagccugcuggugcu

SEQ ID NO: 171772 - RNA, 22 nt, Human
uggcgcgcucgcucucgcugag

SEQ ID NO: 171773 - RNA, 22 nt, Human
uggcaguugcaguaacuuguau

SEQ ID NO: 171774 - RNA, 22 nt, Human
uggcaucucggugcugguucuu

SEQ ID NO: 171775 - RNA, 22 nt, Human
uucagacugcccauguuugcca

SEQ ID NO: 171776 - RNA, 21 nt, Human
uggcaggcagcuggaagcuug

SEQ ID NO: 171777 - RNA, 22 nt, Human
uggcagcucauuuggaaaugga

SEQ ID NO: 171778 - RNA, 22 nt, Human
uucagaccucaaauccacaugc

SEQ ID NO: 171779 - RNA, 22 nt, Human
uucagaauuaucauaauuuuga

SEQ ID NO: 171780 - RNA, 22 nt, Human
uucagaagguaggaaugucccu

SEQ ID NO: 171781 - RNA, 18 nt, Human
uggcaugcuuugauacau

SEQ ID NO: 171782 - RNA, 22 nt, Human
uggcaugugaauuguuacauug

SEQ ID NO: 171783 - RNA, 20 nt, Human
uggcaugaaauuuuccaagc

SEQ ID NO: 171784 - RNA, 20 nt, Human
uggcaugcucucuuuuuagg

SEQ ID NO: 171785 - RNA, 22 nt, Human
uucagcacuggacagcgagucu

SEQ ID NO: 171786 - RNA, 23 nt, Human
uucagcucuccugaagcaucugu

SEQ ID NO: 171787 - RNA, 22 nt, Human
uucaggaaacaaauuugcaguu

SEQ ID NO: 171788 - RNA, 22 nt, Human
uucaccucuuuuuggggacauc

SEQ ID NO: 171789 - RNA, 22 nt, Human
uucacucagagcaggacagccc

SEQ ID NO: 171790 - RNA, 22 nt, Human
uucacugacaguauugaggagg

SEQ ID NO: 171791 - RNA, 22 nt, Human
uucacugugauguuuaagagaa

SEQ ID NO: 171792 - RNA, 22 nt, Human
uggcacaggcagaaggugccgc

SEQ ID NO: 171793 - RNA, 22 nt, Human
uucacugugauugggguggauu

SEQ ID NO: 171794 - RNA, 22 nt, Human
uggcacugaagcuggaaagccu

SEQ ID NO: 171795 - RNA, 22 nt, Human
uggcacugcccugucucggugg

SEQ ID NO: 171796 - RNA, 22 nt, Human
uggcagccucugguccuuaguu

SEQ ID NO: 171797 - RNA, 22 nt, Human
uggcagcauuuuuuccagaaca

SEQ ID NO: 171798 - RNA, 22 nt, Human
uggcagccugcgugaaggagcu

SEQ ID NO: 171799 - RNA, 18 nt, Human
uggcaaugccaaaggcuu

SEQ ID NO: 171800 - RNA, 22 nt, Human
uggcaaggccacaggugcaguu

SEQ ID NO: 171801 - RNA, 22 nt, Human
uggaugccauuugauuaaggcu

SEQ ID NO: 171802 - RNA, 22 nt, Human
uggauuguauugauugguuggc

SEQ ID NO: 171803 - RNA, 22 nt, Human
uggaugacaaccauuggaagag

SEQ ID NO: 171804 - RNA, 20 nt, Human
uggaucgaccucacuuccau

SEQ ID NO: 171805 - RNA, 21 nt, Human
uggauauugaguaguuucuga

SEQ ID NO: 171806 - RNA, 23 nt, Human
uucaccaaugcuguccaaguacc

SEQ ID NO: 171807 - RNA, 22 nt, Human
uggaugagugaauggauaaauc

SEQ ID NO: 171808 - RNA, 22 nt, Human
uucaaaaugcagaauaguuugg

SEQ ID NO: 171809 - RNA, 22 nt, Human
uucaaacaguguagaauauaug

SEQ ID NO: 171810 - RNA, 22 nt, Human
uggagucuugcuuugggagugc

SEQ ID NO: 171811 - RNA, 22 nt, Human
uuauuuuuguaacacuguauag

SEQ ID NO: 171812 - RNA, 19 nt, Human
uggaggcggguggcccaga

SEQ ID NO: 171813 - RNA, 22 nt, Human
uggaggcccagcugggggccgg

SEQ ID NO: 171814 - RNA, 22 nt, Human
uggaggauaacacaagaaguga

SEQ ID NO: 171815 - RNA, 22 nt, Human
uuauuuuguagcucugaucuuu

SEQ ID NO: 171816 - RNA, 22 nt, Human
uggagcugguucuggggaagcu

SEQ ID NO: 171817 - RNA, 22 nt, Human
uggaggagaacugauuuggcuu

SEQ ID NO: 171818 - RNA, 22 nt, Human
uuauuggcagcuccugcacaug

SEQ ID NO: 171819 - RNA, 22 nt, Human
uuauuccauagaagucaaggaa

SEQ ID NO: 171820 - RNA, 22 nt, Human
ugcuauucuuggagcugaugga

SEQ ID NO: 171821 - RNA, 22 nt, Human
uuauguugauaggaaucugauu

SEQ ID NO: 171822 - RNA, 22 nt, Human
uggugcaggauuuauuuaacua

SEQ ID NO: 171823 - RNA, 23 nt, Human
uucugaggucacgguggaccugg

SEQ ID NO: 171824 - RNA, 22 nt, Human
ugguggagucugggggaggcuu

SEQ ID NO: 171825 - RNA, 22 nt, Human
uucuuggcacagaugagauucu

SEQ ID NO: 171826 - RNA, 22 nt, Human
uucuucauucccuuacuuccga

SEQ ID NO: 171827 - RNA, 22 nt, Human
uucuuuuuagcugguuguaaga

SEQ ID NO: 171828 - RNA, 21 nt, Human
ugguuuuaucuugguggcugc

SEQ ID NO: 171829 - RNA, 22 nt, Human
ugguuuguauauguuugugaga

SEQ ID NO: 171830 - RNA, 22 nt, Human
ugguugugcucuguuugaaagu

SEQ ID NO: 171831 - RNA, 22 nt, Human
ugguugugcuucuuugccucag

SEQ ID NO: 171832 - RNA, 22 nt, Human
uugaaaacugucaccuuuauuc

SEQ ID NO: 171833 - RNA, 22 nt, Human
uugaacaguuuugucagguuca

SEQ ID NO: 171834 - RNA, 22 nt, Human
uguaauucuaauccagagcugg

SEQ ID NO: 171835 - RNA, 22 nt, Human
ugugagccuuuauuaaccucau

SEQ ID NO: 171836 - RNA, 22 nt, Human
ugugacugaaaaugauugagug

SEQ ID NO: 171837 - RNA, 22 nt, Human
ugucuucuuuucccuuagcccu

SEQ ID NO: 171838 - RNA, 22 nt, Human
ugugaaugacuguguucuuugc

SEQ ID NO: 171839 - RNA, 22 nt, Human
ugugcagaaggagguucuccgg

SEQ ID NO: 171840 - RNA, 22 nt, Human
ugugagcugccacuucuaaucu

SEQ ID NO: 171841 - RNA, 19 nt, Human
ugugaagaccucagugcgg

SEQ ID NO: 171842 - RNA, 22 nt, Human
ugugaagaauuaaugugaauca

SEQ ID NO: 171843 - RNA, 22 nt, Human
uugcacagaugcacaugguugc

SEQ ID NO: 171844 - RNA, 22 nt, Human
uugcagagaacuaaagggagua

SEQ ID NO: 171845 - RNA, 23 nt, Human
ugucugccuaucaugugaaggac

SEQ ID NO: 171846 - RNA, 22 nt, Human
ugucaccucauacaguaccuca

SEQ ID NO: 171847 - RNA, 22 nt, Human
uugauaacuuagcugggcugcu

SEQ ID NO: 171848 - RNA, 19 nt, Human
uugaauguuugauagucuc

SEQ ID NO: 171849 - RNA, 22 nt, Human
uugauuuccauuguccagcauu

SEQ ID NO: 171850 - RNA, 23 nt, Human
ugucacugcggaguggccugcag

SEQ ID NO: 171851 - RNA, 22 nt, Human
ugucacguaaaaacuagauuuc

SEQ ID NO: 171852 - RNA, 22 nt, Human
uuggugauugggaauggauggg

SEQ ID NO: 171853 - RNA, 21 nt, Human
uguuggccuucauucucuguc

SEQ ID NO: 171854 - RNA, 22 nt, Human
uuggugaugcccaccuuuucau

SEQ ID NO: 171855 - RNA, 22 nt, Human
uguugcauguggcuguuugcca

SEQ ID NO: 171856 - RNA, 22 nt, Human
uguuggaauaagugcuugaagg

SEQ ID NO: 171857 - RNA, 19 nt, Human
uuggugaagguucacugac

SEQ ID NO: 171858 - RNA, 22 nt, Human
uugguugaaauguguucaugcu

SEQ ID NO: 171859 - RNA, 22 nt, Human
uguuguagacaguucacucgug

SEQ ID NO: 171860 - RNA, 22 nt, Human
uguugucaugcagucaguggua

SEQ ID NO: 171861 - RNA, 22 nt, Human
uugguguuucacuuccuugucg

SEQ ID NO: 171862 - RNA, 22 nt, Human
uguugguuucaagcaggagccu

SEQ ID NO: 171863 - RNA, 22 nt, Human
uguugaaacagcuauugacuuu

SEQ ID NO: 171864 - RNA, 22 nt, Human
uguugaagcaccucugucuuuc

SEQ ID NO: 171865 - RNA, 22 nt, Human
uuggggaaaaagaccuaaugac

SEQ ID NO: 171866 - RNA, 22 nt, Human
uguuaacugccaggacagaucg

SEQ ID NO: 171867 - RNA, 22 nt, Human
uuggccauuacugagccuggag

SEQ ID NO: 171868 - RNA, 22 nt, Human
uuggccguuucacugggcaguu

SEQ ID NO: 171869 - RNA, 22 nt, Human
uguuccggucuaucgugucaau

SEQ ID NO: 171870 - RNA, 22 nt, Human
uuggcuguguugaaaacgugga

SEQ ID NO: 171871 - RNA, 22 nt, Human
uugcuugcggccuuugugccuu

SEQ ID NO: 171872 - RNA, 22 nt, Human
ugugggcugcuguuuccuugua

SEQ ID NO: 171873 - RNA, 22 nt, Human
uuggagagggugggcuuugaag

SEQ ID NO: 171874 - RNA, 22 nt, Human
uuggaguucuucaugcucugua

SEQ ID NO: 171875 - RNA, 22 nt, Human
uguguggaggugggugaugucu

SEQ ID NO: 171876 - RNA, 22 nt, Human
uuggaaauguagaaaagcagau

SEQ ID NO: 171877 - RNA, 22 nt, Human
ugugcugcagcgagagcuacga

SEQ ID NO: 171878 - RNA, 22 nt, Human
ugugcgucuguguacagaugug

SEQ ID NO: 171879 - RNA, 22 nt, Human
ugugcuugucguggagccaggc

SEQ ID NO: 171880 - RNA, 22 nt, Human
ugugccuuucacuaugucauuc

SEQ ID NO: 171881 - RNA, 22 nt, Human
ugugcagugcguggguguugaa

SEQ ID NO: 171882 - RNA, 22 nt, Human
uugcugguggcucugauuucau

SEQ ID NO: 171883 - RNA, 22 nt, Human
uugcugugucauuuguuuaauc

SEQ ID NO: 171884 - RNA, 22 nt, Human
uguggccaccagagcugcuauu

SEQ ID NO: 171885 - RNA, 22 nt, Human
uugcugccagcgcccugcaggg

SEQ ID NO: 171886 - RNA, 22 nt, Human
uugcugcgcugaccuccaguga

SEQ ID NO: 171887 - RNA, 22 nt, Human
uugcuggaguagaaaacuuaac

SEQ ID NO: 171888 - RNA, 22 nt, Human
uugcugggauucauugaagggu

SEQ ID NO: 171889 - RNA, 16 nt, Human
ugccaagggguuaaug

SEQ ID NO: 171890 - RNA, 22 nt, Human
ugugggaggaugggccccuaga

SEQ ID NO: 171891 - RNA, 22 nt, Human
ugcauuugcaauggguacacaa

SEQ ID NO: 171892 - RNA, 22 nt, Human
ugcccagagccucuuaccucca

SEQ ID NO: 171893 - RNA, 22 nt, Human
ugugggcguggguuggggaggg

SEQ ID NO: 171894 - RNA, 22 nt, Human
ugugggaucauggaucagggcc

SEQ ID NO: 171895 - RNA, 22 nt, Human
ugccaucaugucagauuuggga

SEQ ID NO: 171896 - RNA, 22 nt, Human
ugccaugguuguacaguagcag

SEQ ID NO: 171897 - RNA, 22 nt, Human
ugcccaaucaauuguagcuauu

SEQ ID NO: 171898 - RNA, 22 nt, Human
ugccauuggucuuaaggcuagc

SEQ ID NO: 171899 - RNA, 22 nt, Human
uguggguggucagcgugugaug

SEQ ID NO: 171900 - RNA, 22 nt, Human
ugugguagagcuuaaaugaggu

SEQ ID NO: 171901 - RNA, 22 nt, Human
uguggugacuugagcuuccuaa

SEQ ID NO: 171902 - RNA, 22 nt, Human
uguggucuccucucugucuucc

SEQ ID NO: 171903 - RNA, 22 nt, Human
uguggugcucagggaggauggg

SEQ ID NO: 171904 - RNA, 22 nt, Human
ugugguuggggucagauaggga

SEQ ID NO: 171905 - RNA, 21 nt, Human
uguguaccuucuuccgagcuc

SEQ ID NO: 171906 - RNA, 22 nt, Human
ugugugguaaugagagauccaa

SEQ ID NO: 171907 - RNA, 22 nt, Human
ugugcaguauugaaauauaugu

SEQ ID NO: 171908 - RNA, 22 nt, Human
ugucuucagguuccucaccacu

SEQ ID NO: 171909 - RNA, 22 nt, Human
ugcaggagcaccagcucacccu

SEQ ID NO: 171910 - RNA, 22 nt, Human
ugcaggagcccaggaauacuau

SEQ ID NO: 171911 - RNA, 22 nt, Human
ugugcgcgugugcuuugugugu

SEQ ID NO: 171912 - RNA, 22 nt, Human
ugugcaucuggaggcaauguuu

SEQ ID NO: 171913 - RNA, 22 nt, Human
ugcaggguuucaauacacagga

SEQ ID NO: 171914 - RNA, 22 nt, Human
ugcagguggcagcggggcacca

SEQ ID NO: 171915 - RNA, 22 nt, Human
ugugccuagauuccaugcacuc

SEQ ID NO: 171916 - RNA, 22 nt, Human
ugcagguuuucagauguguguu

SEQ ID NO: 171917 - RNA, 21 nt, Human
uguggccauuugaaaacaggg

SEQ ID NO: 171918 - RNA, 22 nt, Human
ugugggaggauuuaggugaauc

SEQ ID NO: 171919 - RNA, 22 nt, Human
uguggcuuaggugagcauguga

SEQ ID NO: 171920 - RNA, 22 nt, Human
ugcauucugggucgcagagugg

SEQ ID NO: 171921 - RNA, 22 nt, Human
ugcauugccucuauucauuaua

SEQ ID NO: 171922 - RNA, 22 nt, Human
ugcauaugcauguaccuguguu

SEQ ID NO: 171923 - RNA, 22 nt, Human
ugcgccuccugcugccugcccu

SEQ ID NO: 171924 - RNA, 22 nt, Human
ugcgccucugucacucagcauc

SEQ ID NO: 171925 - RNA, 22 nt, Human
uguuccuggggaccugccuucc

SEQ ID NO: 171926 - RNA, 23 nt, Human
uguuccugaugccucguccuguc

SEQ ID NO: 171927 - RNA, 22 nt, Human
ugcggcucaaagggaaggccuu

SEQ ID NO: 171928 - RNA, 19 nt, Human
ugcgggcugcggucagggc

SEQ ID NO: 171929 - RNA, 22 nt, Human
ugcggaaggcagcgcagggugg

SEQ ID NO: 171930 - RNA, 22 nt, Human
ugcgcgccgacggcuccgugac

SEQ ID NO: 171931 - RNA, 19 nt, Human
uguucuacuugcuaguauu

SEQ ID NO: 171932 - RNA, 22 nt, Human
uguuacaucucugcccagccua

SEQ ID NO: 171933 - RNA, 22 nt, Human
uguucggaaaagggcaagcuau

SEQ ID NO: 171934 - RNA, 22 nt, Human
ugcggagggagcagucggcugu

SEQ ID NO: 171935 - RNA, 22 nt, Human
ugcggugcagcccugcccucuc

SEQ ID NO: 171936 - RNA, 22 nt, Human
uguucuucaaacucaguuccac

SEQ ID NO: 171937 - RNA, 22 nt, Human
ugcuaaugaauggaggaucuga

SEQ ID NO: 171938 - RNA, 22 nt, Human
ugcguugaggaccgcgagggcg

SEQ ID NO: 171939 - RNA, 22 nt, Human
uguucuuacuaaguaccugaaa

SEQ ID NO: 171940 - RNA, 19 nt, Human
uguugcagcuugaucggua

SEQ ID NO: 171941 - RNA, 22 nt, Human
uguugccaucuaaaauguuacu

SEQ ID NO: 171942 - RNA, 22 nt, Human
uguugagaacaucucggggaca

SEQ ID NO: 171943 - RNA, 22 nt, Human
uguugauuaauuuucccaaaca

SEQ ID NO: 171944 - RNA, 22 nt, Human
ugccuguguuugggguggggaa

SEQ ID NO: 171945 - RNA, 22 nt, Human
uguguucagaagaggcugccgg

SEQ ID NO: 171946 - RNA, 22 nt, Human
uguguguuguuuugccagaaua

SEQ ID NO: 171947 - RNA, 19 nt, Human
ugccuggcaccagcuccac

SEQ ID NO: 171948 - RNA, 20 nt, Human
ugccugagcgcagcuccagg

SEQ ID NO: 171949 - RNA, 22 nt, Human
ugccugaagccugccccugggu

SEQ ID NO: 171950 - RNA, 22 nt, Human
uguguguguguguguguuugug

SEQ ID NO: 171951 - RNA, 22 nt, Human
ugcgccccgcgggccuucgggc

SEQ ID NO: 171952 - RNA, 22 nt, Human
ugccuuuggcuguucugugacc

SEQ ID NO: 171953 - RNA, 22 nt, Human
ugccuuguagccaccgggucac

SEQ ID NO: 171954 - RNA, 22 nt, Human
uguucccgaugacaggaccagg

SEQ ID NO: 171955 - RNA, 22 nt, Human
uguuacugaaugucucugcuuu

SEQ ID NO: 171956 - RNA, 23 nt, Human
uggugcagcgcaggccggguggc

SEQ ID NO: 171957 - RNA, 22 nt, Human
uggugcagacaggagccccgcu

SEQ ID NO: 171958 - RNA, 21 nt, Human
ugaggccugccagucucagaa

SEQ ID NO: 171959 - RNA, 22 nt, Human
ugguggaggugggggguauuuu

SEQ ID NO: 171960 - RNA, 22 nt, Human
ugaggcuuucacuuggcaaaga

SEQ ID NO: 171961 - RNA, 19 nt, Human
ugguggaggugcaccugac

SEQ ID NO: 171962 - RNA, 22 nt, Human
uggggggacagauggagaggac

SEQ ID NO: 171963 - RNA, 22 nt, Human
ugacaucagacugugagaagag

SEQ ID NO: 171964 - RNA, 22 nt, Human
ugggggguuuagaaucugcccu

SEQ ID NO: 171965 - RNA, 20 nt, Human
ugggggugcccaucuccccu

SEQ ID NO: 171966 - RNA, 22 nt, Human
uggggucuggcauaugguagau

SEQ ID NO: 171967 - RNA, 22 nt, Human
uggggccaggcuguuggcuucc

SEQ ID NO: 171968 - RNA, 22 nt, Human
ugggguuuuagagcaggcagag

SEQ ID NO: 171969 - RNA, 20 nt, Human
ugggguucccuuuagggcuu

SEQ ID NO: 171970 - RNA, 22 nt, Human
ugacauccuacaccccuggguc

SEQ ID NO: 171971 - RNA, 22 nt, Human
ugagccugaguguguauugaac

SEQ ID NO: 171972 - RNA, 22 nt, Human
uggugacaucuaccuagguaaa

SEQ ID NO: 171973 - RNA, 22 nt, Human
ugaugaugaagaaauauuauca

SEQ ID NO: 171974 - RNA, 22 nt, Human
uguacagauaucaggagugagg

SEQ ID NO: 171975 - RNA, 22 nt, Human
ugaguuucuuacucaggagcug

SEQ ID NO: 171976 - RNA, 22 nt, Human
ugagugugugucuuggguaccg

SEQ ID NO: 171977 - RNA, 22 nt, Human
ugaguuagcucuauucuuuugg

SEQ ID NO: 171978 - RNA, 18 nt, Human
ugguuggugggggugaag

SEQ ID NO: 171979 - RNA, 22 nt, Human
ugguugauuaauuuugccaagc

SEQ ID NO: 171980 - RNA, 22 nt, Human
uggugugggauccugggaagga

SEQ ID NO: 171981 - RNA, 22 nt, Human
ugaggucaggcagggguuuggc

SEQ ID NO: 171982 - RNA, 22 nt, Human
ugcacccacuuagcugaaguuc

SEQ ID NO: 171983 - RNA, 16 nt, Human
ugcaccgggaacacug

SEQ ID NO: 171984 - RNA, 22 nt, Human
ugucugcauucgaguucaugga

SEQ ID NO: 171985 - RNA, 22 nt, Human
uguccccugcccagggauggga

SEQ ID NO: 171986 - RNA, 23 nt, Human
ugcaaaauuugcagaguucgaug

SEQ ID NO: 171987 - RNA, 22 nt, Human
ugauugcucagcuagccucuuu

SEQ ID NO: 171988 - RNA, 22 nt, Human
ugauugcucgacacucugcuug

SEQ ID NO: 171989 - RNA, 22 nt, Human
ugcaaaaguuuuauacacagau

SEQ ID NO: 171990 - RNA, 22 nt, Human
ugucagacagggcugcagucag

SEQ ID NO: 171991 - RNA, 22 nt, Human
uguauuugaagaaagagcuucu

SEQ ID NO: 171992 - RNA, 22 nt, Human
ugucaaguuguuaaguucuggg

SEQ ID NO: 171993 - RNA, 22 nt, Human
ugauguggaucuauaacuguaa

SEQ ID NO: 171994 - RNA, 22 nt, Human
uguaucuguguguauguguuua

SEQ ID NO: 171995 - RNA, 18 nt, Human
ugauggcuaagagccggg

SEQ ID NO: 171996 - RNA, 22 nt, Human
uguacauuuacaaaagcuuuau

SEQ ID NO: 171997 - RNA, 22 nt, Human
uguagggaggaaggguuggaaa

SEQ ID NO: 171998 - RNA, 22 nt, Human
uguaguuuuaggagggguaaau

SEQ ID NO: 171999 - RNA, 22 nt, Human
ugggaacuggaaaaaaugaagu

SEQ ID NO: 172000 - RNA, 22 nt, Human
ugaaccgcuucauggugccugu

SEQ ID NO: 172001 - RNA, 22 nt, Human
ugaacuggauuugugagcuccu

SEQ ID NO: 172002 - RNA, 22 nt, Human
ugaagacuucuuuuggucacca

SEQ ID NO: 172003 - RNA, 21 nt, Human
ugaagcccugugaggugcuua

SEQ ID NO: 172004 - RNA, 23 nt, Human
ugggagcuauguuuggaaugggg

SEQ ID NO: 172005 - RNA, 22 nt, Human
ugaacuucccauguacagacug

SEQ ID NO: 172006 - RNA, 22 nt, Human
ugggagagaagcugaggcaggg

SEQ ID NO: 172007 - RNA, 22 nt, Human
uggccugauuuugcuaagagaa

SEQ ID NO: 172008 - RNA, 22 nt, Human
ucuuuuaucuguuguguaacaa

SEQ ID NO: 172009 - RNA, 23 nt, Human
uggcucugagcuuccugguggcc

SEQ ID NO: 172010 - RNA, 22 nt, Human
ugaaagcuggcucugcagagug

SEQ ID NO: 172011 - RNA, 22 nt, Human
uggcugagcugcagcguggcuu

SEQ ID NO: 172012 - RNA, 22 nt, Human
uggcucuucucaagcauuggcu

SEQ ID NO: 172013 - RNA, 22 nt, Human
uggcugaugucuguucuguuau

SEQ ID NO: 172014 - RNA, 22 nt, Human
uggcugagugaacauguccauu

SEQ ID NO: 172015 - RNA, 22 nt, Human
uggcugaggcuuuucuuaaaga

SEQ ID NO: 172016 - RNA, 22 nt, Human
uggcugggagcuggaacugggc

SEQ ID NO: 172017 - RNA, 22 nt, Human
uggcuucuggccaggcacagga

SEQ ID NO: 172018 - RNA, 22 nt, Human
uggcuucagacuucugcuacgu

SEQ ID NO: 172019 - RNA, 22 nt, Human
uggcuugacaucaauacuuauu

SEQ ID NO: 172020 - RNA, 22 nt, Human
ugaaaugccucuuugguucuaa

SEQ ID NO: 172021 - RNA, 21 nt, Human
ugaacaccaggagaaaucggu

SEQ ID NO: 172022 - RNA, 22 nt, Human
ugaaggaggugaauccaugcau

SEQ ID NO: 172023 - RNA, 22 nt, Human
ugaaggccagggauuugcagcc

SEQ ID NO: 172024 - RNA, 22 nt, Human
ugggaggcugugggaauggguc

SEQ ID NO: 172025 - RNA, 22 nt, Human
ugggcagggauuuggggaaacu

SEQ ID NO: 172026 - RNA, 21 nt, Human
ugaagggugagauauaaguga

SEQ ID NO: 172027 - RNA, 22 nt, Human
ugaaggggaaagucuugcuaua

SEQ ID NO: 172028 - RNA, 22 nt, Human
ugggcacacugaaucugcuauu

SEQ ID NO: 172029 - RNA, 22 nt, Human
ugggccgugagacgucucuggg

SEQ ID NO: 172030 - RNA, 22 nt, Human
ugggccaaaugucugcauaagu

SEQ ID NO: 172031 - RNA, 22 nt, Human
uggggaguaggaggggaacaga

SEQ ID NO: 172032 - RNA, 22 nt, Human
ugaaucagaccuucauugggua

SEQ ID NO: 172033 - RNA, 22 nt, Human
ugggcuguuucuuaaggauaug

SEQ ID NO: 172034 - RNA, 22 nt, Human
uggggaagaacuugccauuuca

SEQ ID NO: 172035 - RNA, 22 nt, Human
ugacaguuugacugcaaccuuu

SEQ ID NO: 172036 - RNA, 22 nt, Human
ugacagugugcccggagguuag

SEQ ID NO: 172037 - RNA, 22 nt, Human
ugaauuuuggcaauuuucugug

SEQ ID NO: 172038 - RNA, 22 nt, Human
ugacagaggagcuggaaugauu

SEQ ID NO: 172039 - RNA, 22 nt, Human
ugacacagaccaaguggugcug

SEQ ID NO: 172040 - RNA, 22 nt, Human
ugaauucaaacuuuuuaacaag

SEQ ID NO: 172041 - RNA, 22 nt, Human
ugaauuacacugggaucagggc

SEQ ID NO: 172042 - RNA, 22 nt, Human
ugggggaggaggagacagacug

SEQ ID NO: 172043 - RNA, 22 nt, Human
uggggcuuucgcggagcgucgg

SEQ ID NO: 172044 - RNA, 22 nt, Human
uggggcuggccaggaggagucu

SEQ ID NO: 172045 - RNA, 22 nt, Human
uggggcugguaccguaauauau

SEQ ID NO: 172046 - RNA, 22 nt, Human
uggggcuccaguagagaaggca

SEQ ID NO: 172047 - RNA, 22 nt, Human
uggggcgccuggcugaggcugc

SEQ ID NO: 172048 - RNA, 22 nt, Human
uggaacugauuaaaagggcaga

SEQ ID NO: 172049 - RNA, 17 nt, Human
ucugccaguuuuagaau

SEQ ID NO: 172050 - RNA, 22 nt, Human
ucugcccaggaggucccauggg

SEQ ID NO: 172051 - RNA, 22 nt, Human
ucugcaugccucaggaggccug

SEQ ID NO: 172052 - RNA, 23 nt, Human
ucugccuccuaauuguugguguc

SEQ ID NO: 172053 - RNA, 22 nt, Human
ucugcccguucaaauccuuguu

SEQ ID NO: 172054 - RNA, 22 nt, Human
ucuggaaauggaaguaacuaug

SEQ ID NO: 172055 - RNA, 22 nt, Human
uggaacugguuugcuucagacu

SEQ ID NO: 172056 - RNA, 22 nt, Human
uggaacuagugucugagauggg

SEQ ID NO: 172057 - RNA, 21 nt, Human
ucugccaguuucucuuacuuu

SEQ ID NO: 172058 - RNA, 22 nt, Human
ucugcagggcccuuggcuccug

SEQ ID NO: 172059 - RNA, 19 nt, Human
ugcugcaggaauucucaag

SEQ ID NO: 172060 - RNA, 22 nt, Human
uggaggaggagaacuuggcacu

SEQ ID NO: 172061 - RNA, 22 nt, Human
uggagcuuuguguauuuuuaau

SEQ ID NO: 172062 - RNA, 22 nt, Human
uggagcuggcuuguggaaguug

SEQ ID NO: 172063 - RNA, 19 nt, Human
uggaggcacuaacaaacuc

SEQ ID NO: 172064 - RNA, 22 nt, Human
uggaggauggaaggaaagcugg

SEQ ID NO: 172065 - RNA, 22 nt, Human
uggagaugcacgagcaggugga

SEQ ID NO: 172066 - RNA, 22 nt, Human
uggagccuugugagaccacaau

SEQ ID NO: 172067 - RNA, 22 nt, Human
uggagccagcaggacucagagg

SEQ ID NO: 172068 - RNA, 22 nt, Human
uggagccugauggauaggaacg

SEQ ID NO: 172069 - RNA, 21 nt, Human
ucuggggacaagguccaggaa

SEQ ID NO: 172070 - RNA, 22 nt, Human
ucugggccaacccuuccauggg

SEQ ID NO: 172071 - RNA, 22 nt, Human
ucuggggaugagugaugucgua

SEQ ID NO: 172072 - RNA, 22 nt, Human
uggaaggggccaggcgcggagu

SEQ ID NO: 172073 - RNA, 22 nt, Human
uggaagggagcuggaauuugga

SEQ ID NO: 172074 - RNA, 22 nt, Human
uggacagguacuucacauuauu

SEQ ID NO: 172075 - RNA, 22 nt, Human
uggacccaccccagggccugcu

SEQ ID NO: 172076 - RNA, 22 nt, Human
uggacuguaauguguguggacc

SEQ ID NO: 172077 - RNA, 22 nt, Human
uggcccagaucucugaccuuga

SEQ ID NO: 172078 - RNA, 22 nt, Human
ucuuggucccugagcucuuuca

SEQ ID NO: 172079 - RNA, 22 nt, Human
ucuuggggagacuaguguuugg

SEQ ID NO: 172080 - RNA, 22 nt, Human
uggcccauccggcuccuccuug

SEQ ID NO: 172081 - RNA, 20 nt, Human
uggcccagcacgacgaggac

SEQ ID NO: 172082 - RNA, 22 nt, Human
uggcccaucagggcaccugaga

SEQ ID NO: 172083 - RNA, 22 nt, Human
uggccucauggccuuaucuggg

SEQ ID NO: 172084 - RNA, 19 nt, Human
ucuuucauuucuagcucug

SEQ ID NO: 172085 - RNA, 22 nt, Human
uggccagucuuagcugugccug

SEQ ID NO: 172086 - RNA, 22 nt, Human
uggccaugagaaucuuugcugu

SEQ ID NO: 172087 - RNA, 22 nt, Human
uggccauuuacucuguaagagu

SEQ ID NO: 172088 - RNA, 22 nt, Human
uggcaggggaaaagggguggga

SEQ ID NO: 172089 - RNA, 21 nt, Human
uggaggcguaaucacuguuga

SEQ ID NO: 172090 - RNA, 22 nt, Human
uggagguagcugacuccagccc

SEQ ID NO: 172091 - RNA, 20 nt, Human
uggagggaggaggggcccaa

SEQ ID NO: 172092 - RNA, 22 nt, Human
ucuguucaugucuuuuuaagug

SEQ ID NO: 172093 - RNA, 22 nt, Human
uggaugccuugggggaggagga

SEQ ID NO: 172094 - RNA, 22 nt, Human
uggaugcuccaaguagaccuua

SEQ ID NO: 172095 - RNA, 22 nt, Human
uggauauagcugaggugucuug

SEQ ID NO: 172096 - RNA, 20 nt, Human
uggaugacuucaggcagccu

SEQ ID NO: 172097 - RNA, 22 nt, Human
uggcacagcuugucauaaacuc

SEQ ID NO: 172098 - RNA, 22 nt, Human
uggcacguuggauugggaguuc

SEQ ID NO: 172099 - RNA, 22 nt, Human
uggcacaguuaaaguuguagaa

SEQ ID NO: 172100 - RNA, 22 nt, Human
uggcagaaugaagacuggggcc

SEQ ID NO: 172101 - RNA, 22 nt, Human
ucuuacuguccucuguuuuucu

SEQ ID NO: 172102 - RNA, 22 nt, Human
ucuuaaucauucuucacuuccu

SEQ ID NO: 172103 - RNA, 22 nt, Human
ugccuggugcggagugaguggc

SEQ ID NO: 172104 - RNA, 22 nt, Human
uccuuuggaaacuggaugucuu

SEQ ID NO: 172105 - RNA, 22 nt, Human
ugccauagccacugaggugagu

SEQ ID NO: 172106 - RNA, 22 nt, Human
uccuuagccagggcagcucaaa

SEQ ID NO: 172107 - RNA, 23 nt, Human
ugccggaucuacuuuggguucuc

SEQ ID NO: 172108 - RNA, 22 nt, Human
ugccgccccggggcccccagcc

SEQ ID NO: 172109 - RNA, 21 nt, Human
uccugcagggcagcagagugg

SEQ ID NO: 172110 - RNA, 22 nt, Human
ugcccugaagcugucaauuuug

SEQ ID NO: 172111 - RNA, 22 nt, Human
uccugggcuugcucuuuccauu

SEQ ID NO: 172112 - RNA, 22 nt, Human
ugcccugcagacccugcagugu

SEQ ID NO: 172113 - RNA, 22 nt, Human
ugccauauuuugaggauguaca

SEQ ID NO: 172114 - RNA, 20 nt, Human
uccugaaauuacgugauuca

SEQ ID NO: 172115 - RNA, 22 nt, Human
uccucuucaaaauagcucugaa

SEQ ID NO: 172116 - RNA, 23 nt, Human
ugccaggaagaaugaccucugcu

SEQ ID NO: 172117 - RNA, 22 nt, Human
ugccagauuaugucuccagggc

SEQ ID NO: 172118 - RNA, 20 nt, Human
ugccagagagcucauacccu

SEQ ID NO: 172119 - RNA, 22 nt, Human
ugccaguaauuguccuguagcu

SEQ ID NO: 172120 - RNA, 22 nt, Human
ugccagugugccuuccgcucac

SEQ ID NO: 172121 - RNA, 22 nt, Human
ugcauucugaacguaaauguga

SEQ ID NO: 172122 - RNA, 22 nt, Human
ugccaaugauuccacaauggaa

SEQ ID NO: 172123 - RNA, 22 nt, Human
ugcauugccauagcagggggau

SEQ ID NO: 172124 - RNA, 22 nt, Human
ucccuuuggagguguccagcac

SEQ ID NO: 172125 - RNA, 23 nt, Human
ugcaugagcaucuccaccucagu

SEQ ID NO: 172126 - RNA, 22 nt, Human
ugcaugacugaucuguuuguca

SEQ ID NO: 172127 - RNA, 22 nt, Human
ugcaugacaauugccgucaagu

SEQ ID NO: 172128 - RNA, 17 nt, Human
uccuacaggugugcuga

SEQ ID NO: 172129 - RNA, 22 nt, Human
uccguugaggcugccaggcgag

SEQ ID NO: 172130 - RNA, 22 nt, Human
ugcguggauuuaggagugaggg

SEQ ID NO: 172131 - RNA, 22 nt, Human
ugcgucccagcauguagggcag

SEQ ID NO: 172132 - RNA, 22 nt, Human
ugcggugcgcccgggcgagugc

SEQ ID NO: 172133 - RNA, 22 nt, Human
ucgauccaggaaggcugguuua

SEQ ID NO: 172134 - RNA, 22 nt, Human
ucgaugcuggcgcagguuucac

SEQ ID NO: 172135 - RNA, 22 nt, Human
ucgagcucagcagggaggugcg

SEQ ID NO: 172136 - RNA, 22 nt, Human
ugcgccaggacacccguggcgg

SEQ ID NO: 172137 - RNA, 22 nt, Human
ucgcccagguuggagugcagug

SEQ ID NO: 172138 - RNA, 22 nt, Human
ugcucagaagacuuacugguua

SEQ ID NO: 172139 - RNA, 20 nt, Human
ugcuccaggaacacuggccg

SEQ ID NO: 172140 - RNA, 22 nt, Human
ucggccggagggggcgggcgca

SEQ ID NO: 172141 - RNA, 22 nt, Human
ucggauuggggaugggugggag

SEQ ID NO: 172142 - RNA, 22 nt, Human
ugcuauccagacacauaugauc

SEQ ID NO: 172143 - RNA, 22 nt, Human
ugcugcacccuucauuuuccca

SEQ ID NO: 172144 - RNA, 22 nt, Human
ugcugacuauacauuuagcauu

SEQ ID NO: 172145 - RNA, 22 nt, Human
ugcugcacucacaggaagaguu

SEQ ID NO: 172146 - RNA, 22 nt, Human
ucgugaagaaauguggacuuca

SEQ ID NO: 172147 - RNA, 22 nt, Human
ucgugagugcugucaccugcug

SEQ ID NO: 172148 - RNA, 22 nt, Human
ucguggaugaagaauagaggcc

SEQ ID NO: 172149 - RNA, 22 nt, Human
ugcucuuuguagcugcuuugcu

SEQ ID NO: 172150 - RNA, 22 nt, Human
ucgucaaaguaaugucauagca

SEQ ID NO: 172151 - RNA, 22 nt, Human
ugcugaccggccuccccccagc

SEQ ID NO: 172152 - RNA, 22 nt, Human
ucgggccacauccacacaucca

SEQ ID NO: 172153 - RNA, 22 nt, Human
ugcuagccacuauuguaaguau

SEQ ID NO: 172154 - RNA, 21 nt, Human
ucgggcggcggcugaggcggc

SEQ ID NO: 172155 - RNA, 23 nt, Human
ugcucgccuucaggacuugggcu

SEQ ID NO: 172156 - RNA, 22 nt, Human
ugcucugcuaggagaagaauga

SEQ ID NO: 172157 - RNA, 22 nt, Human
ugcacgcgcccuucgauggccc

SEQ ID NO: 172158 - RNA, 22 nt, Human
ugcacgcacuugcucuccagcg

SEQ ID NO: 172159 - RNA, 18 nt, Human
ugcacccuaagggcccca

SEQ ID NO: 172160 - RNA, 22 nt, Human
ugcacugccuuucuuggcauga

SEQ ID NO: 172161 - RNA, 20 nt, Human
ugcagcucccccgcaguuuc

SEQ ID NO: 172162 - RNA, 22 nt, Human
ugcagcaucuccuugugccaug

SEQ ID NO: 172163 - RNA, 22 nt, Human
ugcagcagaauauggcugcagg

SEQ ID NO: 172164 - RNA, 22 nt, Human
uccaugcaguagaggcgcuggg

SEQ ID NO: 172165 - RNA, 22 nt, Human
uccauggucgauggcugcuggg

SEQ ID NO: 172166 - RNA, 22 nt, Human
ugcaaggcacccacucugcuuu

SEQ ID NO: 172167 - RNA, 21 nt, Human
ugcaacugaaaggaauauggu

SEQ ID NO: 172168 - RNA, 22 nt, Human
ugcaagauccagucuugagaag

SEQ ID NO: 172169 - RNA, 21 nt, Human
ugcaaugcauugacagcagca

SEQ ID NO: 172170 - RNA, 22 nt, Human
ugcacagagggaggcauaaaau

SEQ ID NO: 172171 - RNA, 22 nt, Human
uccagggaggggcggcaggggu

SEQ ID NO: 172172 - RNA, 22 nt, Human
ugauuuggcaucaguguauccu

SEQ ID NO: 172173 - RNA, 22 nt, Human
uccagaaagccguugacuuauu

SEQ ID NO: 172174 - RNA, 22 nt, Human
uccagaaaucucuguugauugu

SEQ ID NO: 172175 - RNA, 22 nt, Human
uccacagggaugccugcggcuu

SEQ ID NO: 172176 - RNA, 22 nt, Human
uccaccugucccugcuuccugc

SEQ ID NO: 172177 - RNA, 20 nt, Human
uccacugagcgucacggcag

SEQ ID NO: 172178 - RNA, 22 nt, Human
ugcaaaaagagcgaggagcccu

SEQ ID NO: 172179 - RNA, 22 nt, Human
uccagugguggcucccggaccu

SEQ ID NO: 172180 - RNA, 22 nt, Human
uccaguggcaccuuggcccuca

SEQ ID NO: 172181 - RNA, 22 nt, Human
uccaggucgggggugggccggc

SEQ ID NO: 172182 - RNA, 22 nt, Human
uccacaaagucuaugagaguug

SEQ ID NO: 172183 - RNA, 22 nt, Human
ugaucuuugcuuuuggcuuagu

SEQ ID NO: 172184 - RNA, 20 nt, Human
ugauccacucucauugcucu

SEQ ID NO: 172185 - RNA, 20 nt, Human
ugauaggcauugacauaagg

SEQ ID NO: 172186 - RNA, 22 nt, Human
ucauugugugugcuucuugggc

SEQ ID NO: 172187 - RNA, 22 nt, Human
ucauaucauuuugaaagcugag

SEQ ID NO: 172188 - RNA, 22 nt, Human
ugagugggaggugggaagggua

SEQ ID NO: 172189 - RNA, 22 nt, Human
ugagugugugcugcuuacauuc

SEQ ID NO: 172190 - RNA, 22 nt, Human
ugagugcuuuucgguguaccgu

SEQ ID NO: 172191 - RNA, 22 nt, Human
ugaguugcagucaauauugcaa

SEQ ID NO: 172192 - RNA, 22 nt, Human
ugagucaccucucagaagccac

SEQ ID NO: 172193 - RNA, 20 nt, Human
ugagucagcugcaugggugg

SEQ ID NO: 172194 - RNA, 22 nt, Human
ugagguugggaggacugccuaa

SEQ ID NO: 172195 - RNA, 19 nt, Human
ugaguacuaaugagauuga

SEQ ID NO: 172196 - RNA, 22 nt, Human
ugagguguuugugcaccaucug

SEQ ID NO: 172197 - RNA, 22 nt, Human
ugagguauuuggauuuauauuu

SEQ ID NO: 172198 - RNA, 22 nt, Human
ucaggcgcucuucguggcugcc

SEQ ID NO: 172199 - RNA, 22 nt, Human
ucuacgugacagaacagacuga

SEQ ID NO: 172200 - RNA, 22 nt, Human
ucuacugagugcugagauuuug

SEQ ID NO: 172201 - RNA, 22 nt, Human
ucuaaugcuuccucucauccca

SEQ ID NO: 172202 - RNA, 22 nt, Human
ucuuccagauacuuccugacuu

SEQ ID NO: 172203 - RNA, 22 nt, Human
ucuuccucuccuggggcauuug

SEQ ID NO: 172204 - RNA, 22 nt, Human
uauuggcucagucagaaguuuu

SEQ ID NO: 172205 - RNA, 22 nt, Human
ucuugcuggagucaaggcuaca

SEQ ID NO: 172206 - RNA, 22 nt, Human
ucuugcuguagcuguuucuucu

SEQ ID NO: 172207 - RNA, 22 nt, Human
ucuugccuuuucuagcuucuag

SEQ ID NO: 172208 - RNA, 22 nt, Human
ucuugggcaguccucuacuggu

SEQ ID NO: 172209 - RNA, 22 nt, Human
ucuugcuguggcagaucuggag

SEQ ID NO: 172210 - RNA, 22 nt, Human
ucuugucacagcuugacuccua

SEQ ID NO: 172211 - RNA, 23 nt, Human
ucuuuccuuucauacagucagcu

SEQ ID NO: 172212 - RNA, 22 nt, Human
ucuuuauuucccuaacuugcua

SEQ ID NO: 172213 - RNA, 20 nt, Human
uauuucaaugugccaaguuu

SEQ ID NO: 172214 - RNA, 22 nt, Human
ucuuugcauggacauguguuuu

SEQ ID NO: 172215 - RNA, 22 nt, Human
ugaacuuacauugaggaauucu

SEQ ID NO: 172216 - RNA, 22 nt, Human
ugaaccaugaauuacaggagca

SEQ ID NO: 172217 - RNA, 22 nt, Human
ugaaccugagggcaaagggaca

SEQ ID NO: 172218 - RNA, 22 nt, Human
ugaacauuuuugcuugcagcuu

SEQ ID NO: 172219 - RNA, 22 nt, Human
ugaacagacuauucucccaugu

SEQ ID NO: 172220 - RNA, 22 nt, Human
ugaacagugugagggugugacc

SEQ ID NO: 172221 - RNA, 22 nt, Human
ucaaccagcuuaucugcaggau

SEQ ID NO: 172222 - RNA, 22 nt, Human
ugaagacaguuuuacucaugag

SEQ ID NO: 172223 - RNA, 22 nt, Human
ugaagccaugcuaaauguuaca

SEQ ID NO: 172224 - RNA, 21 nt, Human
ugaagccuagagaauugggga

SEQ ID NO: 172225 - RNA, 22 nt, Human
ugaagccacacuagcuuguccu

SEQ ID NO: 172226 - RNA, 22 nt, Human
uauuuuuuuaacauuuauugua

SEQ ID NO: 172227 - RNA, 22 nt, Human
uauuuuuguuuaccaguuaaca

SEQ ID NO: 172228 - RNA, 22 nt, Human
ucaaaucuuuuuuccuucccug

SEQ ID NO: 172229 - RNA, 22 nt, Human
ucaaaggcuugugguucuggga

SEQ ID NO: 172230 - RNA, 22 nt, Human
ugaaaaauauuuuuagaaauaa

SEQ ID NO: 172231 - RNA, 22 nt, Human
ugaaaggaauuuaaauguuguu

SEQ ID NO: 172232 - RNA, 22 nt, Human
uauuuucucugccacacuucca

SEQ ID NO: 172233 - RNA, 22 nt, Human
uauuugauggaacucuugcuuu

SEQ ID NO: 172234 - RNA, 21 nt, Human
ucagccuguccaguguuaacc

SEQ ID NO: 172235 - RNA, 22 nt, Human
ucagcaggugcuuuguuuacuc

SEQ ID NO: 172236 - RNA, 22 nt, Human
ugacgcauggccagcucugucu

SEQ ID NO: 172237 - RNA, 22 nt, Human
ugaccuacauuuauagcuguca

SEQ ID NO: 172238 - RNA, 19 nt, Human
ucagcagauuuugcaaaca

SEQ ID NO: 172239 - RNA, 22 nt, Human
ucagcugggagaaaguuuuagg

SEQ ID NO: 172240 - RNA, 22 nt, Human
ucagccuugguuuugguguugg

SEQ ID NO: 172241 - RNA, 19 nt, Human
ugacuggguucuaggcagg

SEQ ID NO: 172242 - RNA, 22 nt, Human
ugacucugaugcaguguguuua

SEQ ID NO: 172243 - RNA, 22 nt, Human
ucaggcaggaucccagggaagg

SEQ ID NO: 172244 - RNA, 19 nt, Human
ucaggaggucgaccuggca

SEQ ID NO: 172245 - RNA, 22 nt, Human
ugacacacagggggauggaguu

SEQ ID NO: 172246 - RNA, 22 nt, Human
ugaauuucuuuuuaaaauauua

SEQ ID NO: 172247 - RNA, 22 nt, Human
ugaauuuguaggaauucuccau

SEQ ID NO: 172248 - RNA, 22 nt, Human
ugacaagagaccccuccgcagg

SEQ ID NO: 172249 - RNA, 22 nt, Human
ucagagacaucagguuguagca

SEQ ID NO: 172250 - RNA, 22 nt, Human
ucagagugagcuggggcugcuu

SEQ ID NO: 172251 - RNA, 17 nt, Human
ugacagcuaaggggcuu

SEQ ID NO: 172252 - RNA, 22 nt, Human
ucaccuggagagcuugcuaaua

SEQ ID NO: 172253 - RNA, 22 nt, Human
ucaccuuuugaauugcuguugu

SEQ ID NO: 172254 - RNA, 22 nt, Human
ucaccgucucaguacggaggga

SEQ ID NO: 172255 - RNA, 22 nt, Human
ugaauuauaugguauugaacau

SEQ ID NO: 172256 - RNA, 22 nt, Human
ucacugccuagggcuacugugc

SEQ ID NO: 172257 - RNA, 22 nt, Human
ucaccaggauugggcuguaggc

SEQ ID NO: 172258 - RNA, 22 nt, Human
ugaaugcuacccugcuggcucu

SEQ ID NO: 172259 - RNA, 22 nt, Human
ugaaugaguucaccgcucaguu

SEQ ID NO: 172260 - RNA, 22 nt, Human
ucacccuguggcuauaaggcaa

SEQ ID NO: 172261 - RNA, 22 nt, Human
ucacccagacugucugacucuu

SEQ ID NO: 172262 - RNA, 21 nt, Human
ucaagugcccaagguuuguuu

SEQ ID NO: 172263 - RNA, 21 nt, Human
ucaaguccuggcuuugcucuu

SEQ ID NO: 172264 - RNA, 22 nt, Human
ucacacaucucagguguuuaau

SEQ ID NO: 172265 - RNA, 22 nt, Human
ugaaucaaugaauugcacuuca

SEQ ID NO: 172266 - RNA, 22 nt, Human
ugaaucugagccugcgcaaagu

SEQ ID NO: 172267 - RNA, 22 nt, Human
ugaagguggcuugcagcuaguc

SEQ ID NO: 172268 - RNA, 22 nt, Human
ucaaggaagggguaggaauaau

SEQ ID NO: 172269 - RNA, 22 nt, Human
ucaagcuggaaaugaagaaucu

SEQ ID NO: 172270 - RNA, 22 nt, Human
ucaagcacugugcaaugagcuu

SEQ ID NO: 172271 - RNA, 22 nt, Human
ucaagagauauaugcugguuua

SEQ ID NO: 172272 - RNA, 22 nt, Human
ucaagcaaggaauccuuuugua

SEQ ID NO: 172273 - RNA, 22 nt, Human
ucaagaagauaaugucuagggu

SEQ ID NO: 172274 - RNA, 22 nt, Human
ugaaggagucgaggugggugag

SEQ ID NO: 172275 - RNA, 22 nt, Human
ugaagcuaguauuaacucagau

SEQ ID NO: 172276 - RNA, 22 nt, Human
guuccgcggccucgcgcugagc

SEQ ID NO: 172277 - RNA, 22 nt, Human
guucaccaguagcugggcuguu

SEQ ID NO: 172278 - RNA, 21 nt, Human
uauucgcauuucugucuuuac

SEQ ID NO: 172279 - RNA, 22 nt, Human
guuauuuugucuuguucaugaa

SEQ ID NO: 172280 - RNA, 23 nt, Human
guuauugcuggugcuggccagcc

SEQ ID NO: 172281 - RNA, 22 nt, Human
uaugggcaagagauaggugguc

SEQ ID NO: 172282 - RNA, 22 nt, Human
uauuguuuuaagguguauuaau

SEQ ID NO: 172283 - RNA, 22 nt, Human
guugaacagucacccugggagu

SEQ ID NO: 172284 - RNA, 22 nt, Human
uauuuguuucuaguggcagcaa

SEQ ID NO: 172285 - RNA, 19 nt, Human
uaucccccauagcagugcg

SEQ ID NO: 172286 - RNA, 22 nt, Human
uaugcacacguguccaugugca

SEQ ID NO: 172287 - RNA, 22 nt, Human
gugugaguggcuaagugugccu

SEQ ID NO: 172288 - RNA, 22 nt, Human
uaugacccccugcacaugugac

SEQ ID NO: 172289 - RNA, 22 nt, Human
uaugacugcucagugaauggaa

SEQ ID NO: 172290 - RNA, 22 nt, Human
uagcauuuagaacaccuugaga

SEQ ID NO: 172291 - RNA, 22 nt, Human
uagcauuuauugggcuagcaaa

SEQ ID NO: 172292 - RNA, 22 nt, Human
uagcauuucacugaucuucacu

SEQ ID NO: 172293 - RNA, 22 nt, Human
uauaagggaaaagcagguuggu

SEQ ID NO: 172294 - RNA, 22 nt, Human
uaguuccucuucucagggccau

SEQ ID NO: 172295 - RNA, 22 nt, Human
guugucuggcucugaccauucu

SEQ ID NO: 172296 - RNA, 22 nt, Human
guuuaagcagauugcuguggug

SEQ ID NO: 172297 - RNA, 22 nt, Human
ucacauugcauuuucucauuug

SEQ ID NO: 172298 - RNA, 22 nt, Human
ucacaagaagaaauuaaacugu

SEQ ID NO: 172299 - RNA, 22 nt, Human
ucaauuggcuacaaauaaugua

SEQ ID NO: 172300 - RNA, 22 nt, Human
ucacagguuuaguccagcaguc

SEQ ID NO: 172301 - RNA, 22 nt, Human
ucacaggagucaaggaauagua

SEQ ID NO: 172302 - RNA, 22 nt, Human
ucaccccagccuuaugacucag

SEQ ID NO: 172303 - RNA, 22 nt, Human
ucaccauguuuucauaggaaca

SEQ ID NO: 172304 - RNA, 22 nt, Human
ucaccauguacaugaagggcgg

SEQ ID NO: 172305 - RNA, 22 nt, Human
guuuccaagucucucaacaccc

SEQ ID NO: 172306 - RNA, 22 nt, Human
ucaccugccuggguggucaccu

SEQ ID NO: 172307 - RNA, 22 nt, Human
guuucuguggacucugcuuagg

SEQ ID NO: 172308 - RNA, 22 nt, Human
ucacuuccuugcagcuguagaa

SEQ ID NO: 172309 - RNA, 22 nt, Human
ucacuguuucaccgucugaagg

SEQ ID NO: 172310 - RNA, 23 nt, Human
ucacugccaagaaaaguuacaga

SEQ ID NO: 172311 - RNA, 22 nt, Human
ucacucagucugagcaauugcu

SEQ ID NO: 172312 - RNA, 22 nt, Human
ucacugaauuucaagcuagugg

SEQ ID NO: 172313 - RNA, 22 nt, Human
ucagcuucaucuugagcccaca

SEQ ID NO: 172314 - RNA, 22 nt, Human
ucagcucucucuuggugaucuc

SEQ ID NO: 172315 - RNA, 21 nt, Human
ucaggaagagccaguucaugc

SEQ ID NO: 172316 - RNA, 22 nt, Human
ucagcguuggccuccuccaggg

SEQ ID NO: 172317 - RNA, 22 nt, Human
ucagcguuaguuuuucaucuaa

SEQ ID NO: 172318 - RNA, 22 nt, Human
ucagcucacaauguugagaaag

SEQ ID NO: 172319 - RNA, 22 nt, Human
ucagcuauccauucuccuauga

SEQ ID NO: 172320 - RNA, 22 nt, Human
guuuuucuuugauuuagaacca

SEQ ID NO: 172321 - RNA, 22 nt, Human
ucagcgucuccaaaagagcccg

SEQ ID NO: 172322 - RNA, 23 nt, Human
guuuuugcugcagcugaagaagg

SEQ ID NO: 172323 - RNA, 22 nt, Human
ucagcaaugggauucaggcuuu

SEQ ID NO: 172324 - RNA, 23 nt, Human
ucagccgcuggcgaguccacugg

SEQ ID NO: 172325 - RNA, 22 nt, Human
ucagcaguuaagcuucccugcc

SEQ ID NO: 172326 - RNA, 23 nt, Human
ucagaccaaccucuugcuggaac

SEQ ID NO: 172327 - RNA, 22 nt, Human
ucagaaggagagacagcgugga

SEQ ID NO: 172328 - RNA, 22 nt, Human
ucagagccagacacacagcaga

SEQ ID NO: 172329 - RNA, 22 nt, Human
guuuuuacuuccaaugcuauga

SEQ ID NO: 172330 - RNA, 22 nt, Human
ucccagccugacagugcaucaa

SEQ ID NO: 172331 - RNA, 22 nt, Human
ucccagcaggcaccgcuucugc

SEQ ID NO: 172332 - RNA, 22 nt, Human
uagaagaugccuuaaaguugaa

SEQ ID NO: 172333 - RNA, 22 nt, Human
uagaagagcuuccaccuggggc

SEQ ID NO: 172334 - RNA, 22 nt, Human
uccuacccccuucuccagcucc

SEQ ID NO: 172335 - RNA, 22 nt, Human
uagcauccugugugaauguauu

SEQ ID NO: 172336 - RNA, 22 nt, Human
uagcaggagagaaguuuuaagu

SEQ ID NO: 172337 - RNA, 22 nt, Human
uagcaggaggcaguuccucgcu

SEQ ID NO: 172338 - RNA, 22 nt, Human
uagccaaguguuuuucaugacc

SEQ ID NO: 172339 - RNA, 23 nt, Human
uccugcagauaagcugguugaca

SEQ ID NO: 172340 - RNA, 22 nt, Human
uccugaaugguguaauagguuu

SEQ ID NO: 172341 - RNA, 22 nt, Human
uccucuucucuagagccggaau

SEQ ID NO: 172342 - RNA, 22 nt, Human
uagauuguaagcuccuugaggg

SEQ ID NO: 172343 - RNA, 22 nt, Human
uagcgggucacccugcugugaa

SEQ ID NO: 172344 - RNA, 22 nt, Human
uagccucauuauuuacucauga

SEQ ID NO: 172345 - RNA, 22 nt, Human
uagccucaagagauucagggac

SEQ ID NO: 172346 - RNA, 22 nt, Human
uagccacuccgcagcaccgggu

SEQ ID NO: 172347 - RNA, 19 nt, Human
uccuugacuguauucagag

SEQ ID NO: 172348 - RNA, 22 nt, Human
ucgggacccccgcccgggcccg

SEQ ID NO: 172349 - RNA, 22 nt, Human
ucgggcgaauguuguuuuucuc

SEQ ID NO: 172350 - RNA, 22 nt, Human
ucgggcccggcucccgacgccc

SEQ ID NO: 172351 - RNA, 22 nt, Human
ucgggggucgggcggcggucca

SEQ ID NO: 172352 - RNA, 22 nt, Human
ucggguguguguguuggguaug

SEQ ID NO: 172353 - RNA, 22 nt, Human
ucgggaggaggcggagcucguu

SEQ ID NO: 172354 - RNA, 23 nt, Human
ucgucgucagccacuaccucccc

SEQ ID NO: 172355 - RNA, 22 nt, Human
ucguccaauaaccugccagcgc

SEQ ID NO: 172356 - RNA, 22 nt, Human
ucgcuugaacccaggaagugga

SEQ ID NO: 172357 - RNA, 22 nt, Human
ucggcgaccugucauggaccaa

SEQ ID NO: 172358 - RNA, 22 nt, Human
ucggccuuuucuuauacccaca

SEQ ID NO: 172359 - RNA, 22 nt, Human
uaggccugcugaagagcaagcu

SEQ ID NO: 172360 - RNA, 20 nt, Human
ucgcugcaagggaaauggag

SEQ ID NO: 172361 - RNA, 22 nt, Human
uaggcauguaaaagugaguucg

SEQ ID NO: 172362 - RNA, 22 nt, Human
ucgagcacaccagacuugcaga

SEQ ID NO: 172363 - RNA, 22 nt, Human
ucgagcgcucccugugcucucg

SEQ ID NO: 172364 - RNA, 22 nt, Human
ucgccauguacaugaagggcgg

SEQ ID NO: 172365 - RNA, 22 nt, Human
ucgcucgcuggcuccugcccgc

SEQ ID NO: 172366 - RNA, 22 nt, Human
ucgccccccgccucacccucgg

SEQ ID NO: 172367 - RNA, 22 nt, Human
ucgcggccgcuccacaugcaca

SEQ ID NO: 172368 - RNA, 22 nt, Human
uccagguucaguucaucaucua

SEQ ID NO: 172369 - RNA, 22 nt, Human
uaccgaagcugcuuuugcaugu

SEQ ID NO: 172370 - RNA, 22 nt, Human
uaccgcagagucauugugagga

SEQ ID NO: 172371 - RNA, 20 nt, Human
uaccagggguuugggacagc

SEQ ID NO: 172372 - RNA, 23 nt, Human
uaccauugauuuuaugguuuucu

SEQ ID NO: 172373 - RNA, 19 nt, Human
uacccggauagccagguag

SEQ ID NO: 172374 - RNA, 22 nt, Human
uaccaugggucaguuggguuug

SEQ ID NO: 172375 - RNA, 22 nt, Human
uccagguggcuuuccuggggga

SEQ ID NO: 172376 - RNA, 22 nt, Human
uacugccauuauccugcugaaa

SEQ ID NO: 172377 - RNA, 22 nt, Human
uacucgaaaucagagagaauaa

SEQ ID NO: 172378 - RNA, 16 nt, Human
uccaguguuccuggau

SEQ ID NO: 172379 - RNA, 22 nt, Human
uacuggguguucugagaaaaua

SEQ ID NO: 172380 - RNA, 19 nt, Human
uaccagguuggagaggccc

SEQ ID NO: 172381 - RNA, 22 nt, Human
uccagcacacagguggcucuca

SEQ ID NO: 172382 - RNA, 22 nt, Human
uccagacucaaaaaccagaugg

SEQ ID NO: 172383 - RNA, 21 nt, Human
uaccacugaaauugaucguuc

SEQ ID NO: 172384 - RNA, 22 nt, Human
uacauggauguuauccuuacug

SEQ ID NO: 172385 - RNA, 22 nt, Human
uccaccacgaaacugcagcugc

SEQ ID NO: 172386 - RNA, 22 nt, Human
uccacuaucagaccuguagucu

SEQ ID NO: 172387 - RNA, 22 nt, Human
uccacagcagagcacgguaccu

SEQ ID NO: 172388 - RNA, 22 nt, Human
uacaccuuaagccgcggcuccc

SEQ ID NO: 172389 - RNA, 22 nt, Human
uacaccaugcuccagcaggaca

SEQ ID NO: 172390 - RNA, 21 nt, Human
uaagccaccaugugaaaccag

SEQ ID NO: 172391 - RNA, 22 nt, Human
ucaucagccaaagaguccuuca

SEQ ID NO: 172392 - RNA, 22 nt, Human
uaagaggucugaaacgguggga

SEQ ID NO: 172393 - RNA, 22 nt, Human
uacaagcucuuguagggggaaa

SEQ ID NO: 172394 - RNA, 21 nt, Human
uacaagaccggauucgggccc

SEQ ID NO: 172395 - RNA, 20 nt, Human
ucauucagaaucaguaugca

SEQ ID NO: 172396 - RNA, 22 nt, Human
uaauccaaaccaggaauucccu

SEQ ID NO: 172397 - RNA, 22 nt, Human
uacuuacacugaagcaaagaua

SEQ ID NO: 172398 - RNA, 20 nt, Human
uacccgcagcugggucuggc

SEQ ID NO: 172399 - RNA, 20 nt, Human
uaccaucauuggcaaaccuc

SEQ ID NO: 172400 - RNA, 22 nt, Human
uacuaccugcaggaacaauuag

SEQ ID NO: 172401 - RNA, 22 nt, Human
gucuaccuucuuucucaacugg

SEQ ID NO: 172402 - RNA, 23 nt, Human
gucagcuugaccaguggagaguc

SEQ ID NO: 172403 - RNA, 20 nt, Human
gucagaggacccuagagcga

SEQ ID NO: 172404 - RNA, 23 nt, Human
gucucacaaccaccugagaaaau

SEQ ID NO: 172405 - RNA, 20 nt, Human
uacaaggauguucaucagag

SEQ ID NO: 172406 - RNA, 22 nt, Human
gucugccagauucugcuggauc

SEQ ID NO: 172407 - RNA, 22 nt, Human
uacaaucacccaaagagccaga

SEQ ID NO: 172408 - RNA, 22 nt, Human
uacaauguucgcauucucucug

SEQ ID NO: 172409 - RNA, 22 nt, Human
gugcgaaagaagcgacuccagu

SEQ ID NO: 172410 - RNA, 20 nt, Human
gugcggcucuaccacucggu

SEQ ID NO: 172411 - RNA, 22 nt, Human
uagcagcacuauuuguuguagu

SEQ ID NO: 172412 - RNA, 22 nt, Human
gugccgggcugcggcaaggugu

SEQ ID NO: 172413 - RNA, 22 nt, Human
gugcccaguugaggccaggacu

SEQ ID NO: 172414 - RNA, 22 nt, Human
uagaugguguccagaaagagaa

SEQ ID NO: 172415 - RNA, 22 nt, Human
gugcagcugguggagucugggg

SEQ ID NO: 172416 - RNA, 22 nt, Human
gugcacagaaacauacaaugug

SEQ ID NO: 172417 - RNA, 22 nt, Human
gugcaaugaguguggcaaagcc

SEQ ID NO: 172418 - RNA, 22 nt, Human
uagaggccguagguggcugguu

SEQ ID NO: 172419 - RNA, 22 nt, Human
uagaccugugggggcagcgggc

SEQ ID NO: 172420 - RNA, 22 nt, Human
gugaggugauugcugguguuug

SEQ ID NO: 172421 - RNA, 22 nt, Human
gugaugugugaaggucugcagg

SEQ ID NO: 172422 - RNA, 19 nt, Human
gugaugaugccacuccaac

SEQ ID NO: 172423 - RNA, 19 nt, Human
uagagcagcuucagauucc

SEQ ID NO: 172424 - RNA, 22 nt, Human
uagaggaccacagggugcagag

SEQ ID NO: 172425 - RNA, 22 nt, Human
uagaggccagggugucuugagu

SEQ ID NO: 172426 - RNA, 22 nt, Human
gguguuccgguucugcucuggg

SEQ ID NO: 172427 - RNA, 22 nt, Human
gguugccuuugcaguuggauca

SEQ ID NO: 172428 - RNA, 22 nt, Human
gguugcggaccagcugggcugc

SEQ ID NO: 172429 - RNA, 22 nt, Human
gguucaaagccugaugggguug

SEQ ID NO: 172430 - RNA, 23 nt, Human
gguuggcuguacccaggcucccu

SEQ ID NO: 172431 - RNA, 22 nt, Human
uaaaugauaguauugaagguag

SEQ ID NO: 172432 - RNA, 22 nt, Human
uaaauguugcuugugcugcuca

SEQ ID NO: 172433 - RNA, 22 nt, Human
ggugcuuuucacaagcauggga

SEQ ID NO: 172434 - RNA, 22 nt, Human
gguggcauguaccucacagacu

SEQ ID NO: 172435 - RNA, 22 nt, Human
guuuucuaaaacacauauaagu

SEQ ID NO: 172436 - RNA, 22 nt, Human
gguggcuucuguuugcaagagg

SEQ ID NO: 172437 - RNA, 22 nt, Human
ggugggaauccaggccuucauc

SEQ ID NO: 172438 - RNA, 22 nt, Human
gguggcuugcugguaggugugc

SEQ ID NO: 172439 - RNA, 22 nt, Human
gguaugaggaugaggguggcau

SEQ ID NO: 172440 - RNA, 22 nt, Human
ggucauacaaggcacuggugau

SEQ ID NO: 172441 - RNA, 22 nt, Human
ggucaaauaugaguaauuuccu

SEQ ID NO: 172442 - RNA, 22 nt, Human
gguauccaaauaaagcagguaa

SEQ ID NO: 172443 - RNA, 23 nt, Human
gguagguggggagauuaaagucu

SEQ ID NO: 172444 - RNA, 22 nt, Human
ggugcuucgauagguguccaua

SEQ ID NO: 172445 - RNA, 22 nt, Human
guagguggaggcaacacagcca

SEQ ID NO: 172446 - RNA, 22 nt, Human
guaggugggcuuccaagguccu

SEQ ID NO: 172447 - RNA, 22 nt, Human
guaguucuuucucaauguucaa

SEQ ID NO: 172448 - RNA, 18 nt, Human
uaacugguuucuucccau

SEQ ID NO: 172449 - RNA, 22 nt, Human
uaacagugcuacaguuacuuuc

SEQ ID NO: 172450 - RNA, 22 nt, Human
uaaccuugaagacugagcugac

SEQ ID NO: 172451 - RNA, 22 nt, Human
gucagacucuggggccccaggc

SEQ ID NO: 172452 - RNA, 22 nt, Human
gucacuguuucacuguucauua

SEQ ID NO: 172453 - RNA, 22 nt, Human
gucaaaguuaacuagcaggugc

SEQ ID NO: 172454 - RNA, 22 nt, Human
guaucugaaaaagaauucugac

SEQ ID NO: 172455 - RNA, 21 nt, Human
guaucuuucuuuuaaaauauc

SEQ ID NO: 172456 - RNA, 23 nt, Human
uaagccugugccugcuaccugcu

SEQ ID NO: 172457 - RNA, 22 nt, Human
guaugugugcauacauguacga

SEQ ID NO: 172458 - RNA, 22 nt, Human
guaugugucuuagaacuuggga

SEQ ID NO: 172459 - RNA, 22 nt, Human
uaagagauuuauugaggacuuc

SEQ ID NO: 172460 - RNA, 22 nt, Human
guggagaucuggugcccccugg

SEQ ID NO: 172461 - RNA, 22 nt, Human
gggcaugugauggacgugugcc

SEQ ID NO: 172462 - RNA, 20 nt, Human
gggccagguggaccaggggc

SEQ ID NO: 172463 - RNA, 22 nt, Human
gggccaaggggagcuggaaggg

SEQ ID NO: 172464 - RNA, 22 nt, Human
gggcccaacuguuggcagccuc

SEQ ID NO: 172465 - RNA, 22 nt, Human
gggccccgggcgcggcugcggg

SEQ ID NO: 172466 - RNA, 22 nt, Human
gggccggcuggggcggggcggg

SEQ ID NO: 172467 - RNA, 22 nt, Human
gggccggagaagguagcugaag

SEQ ID NO: 172468 - RNA, 22 nt, Human
guggaggguuugcaaugugcag

SEQ ID NO: 172469 - RNA, 22 nt, Human
gggccucccggagcugcuccca

SEQ ID NO: 172470 - RNA, 22 nt, Human
ggccuugguggcuuugcugaug

SEQ ID NO: 172471 - RNA, 22 nt, Human
guggaaggaauuaacagacuag

SEQ ID NO: 172472 - RNA, 22 nt, Human
guggaaauuuuaggaucaucuu

SEQ ID NO: 172473 - RNA, 22 nt, Human
gggcaggggcagugguggcauu

SEQ ID NO: 172474 - RNA, 22 nt, Human
gggcaguuucaugugguucaac

SEQ ID NO: 172475 - RNA, 22 nt, Human
gggcaggacccguuagaguggc

SEQ ID NO: 172476 - RNA, 22 nt, Human
guggaagggaaaccgcacuggc

SEQ ID NO: 172477 - RNA, 22 nt, Human
gggcagaaaggaaggcuggggg

SEQ ID NO: 172478 - RNA, 22 nt, Human
gggcagagagcuggaacuccuu

SEQ ID NO: 172479 - RNA, 22 nt, Human
gggcagagggcgagcugggaga

SEQ ID NO: 172480 - RNA, 22 nt, Human
guggcgucgaugauggugucau

SEQ ID NO: 172481 - RNA, 22 nt, Human
guggccaaggcagagaaagagc

SEQ ID NO: 172482 - RNA, 18 nt, Human
guggccauugaccagcuu

SEQ ID NO: 172483 - RNA, 22 nt, Human
guggcuuauguccagcagauau

SEQ ID NO: 172484 - RNA, 22 nt, Human
guggauggagcuggaagccauu

SEQ ID NO: 172485 - RNA, 22 nt, Human
guggcaaguuuucugacaagga

SEQ ID NO: 172486 - RNA, 22 nt, Human
guggauaaguuguuugaccuac

SEQ ID NO: 172487 - RNA, 22 nt, Human
guggcagagccuugcggcuuug

SEQ ID NO: 172488 - RNA, 20 nt, Human
guggcagugguggcagcagu

SEQ ID NO: 172489 - RNA, 22 nt, Human
gugggcuuuuuugaaaccugaa

SEQ ID NO: 172490 - RNA, 22 nt, Human
gugggcacguccuacugucacu

SEQ ID NO: 172491 - RNA, 22 nt, Human
gugggggauggcgugugggucu

SEQ ID NO: 172492 - RNA, 22 nt, Human
guggcuuuguuuccaaaugaaa

SEQ ID NO: 172493 - RNA, 22 nt, Human
gugggugaguggggccgccuga

SEQ ID NO: 172494 - RNA, 21 nt, Human
gggccugggccagggccgggu

SEQ ID NO: 172495 - RNA, 22 nt, Human
gggccuuggaggagaaggacuu

SEQ ID NO: 172496 - RNA, 22 nt, Human
guggggguaggggguuuccugg

SEQ ID NO: 172497 - RNA, 22 nt, Human
gugggggcuaaauugaggggug

SEQ ID NO: 172498 - RNA, 22 nt, Human
gugguggggaguuggauggaag

SEQ ID NO: 172499 - RNA, 22 nt, Human
guggugggcgugguguaugccu

SEQ ID NO: 172500 - RNA, 22 nt, Human
gggcggcguccucagucgggug

SEQ ID NO: 172501 - RNA, 22 nt, Human
gggcuacugagcuggaacuggg

SEQ ID NO: 172502 - RNA, 22 nt, Human
gggcggccugcucuguggggag

SEQ ID NO: 172503 - RNA, 22 nt, Human
gggcggggcucacggugcggca

SEQ ID NO: 172504 - RNA, 22 nt, Human
gggcggggggagcuggaaugaa

SEQ ID NO: 172505 - RNA, 22 nt, Human
gggcggggcuuccguccuccac

SEQ ID NO: 172506 - RNA, 22 nt, Human
guggugaacauuugcaucugcu

SEQ ID NO: 172507 - RNA, 22 nt, Human
gugguaaagugugccugugguc

SEQ ID NO: 172508 - RNA, 22 nt, Human
gggcgagcgucucagccgggcg

SEQ ID NO: 172509 - RNA, 22 nt, Human
gugguaccaguaggucagccau

SEQ ID NO: 172510 - RNA, 22 nt, Human
gggcgcuuucugggucagggcu

SEQ ID NO: 172511 - RNA, 22 nt, Human
guggguuggguuuuugaaggga

SEQ ID NO: 172512 - RNA, 22 nt, Human
gggcgcuguguuaggugcugua

SEQ ID NO: 172513 - RNA, 22 nt, Human
gugggugauacugccgugggag

SEQ ID NO: 172514 - RNA, 22 nt, Human
ggggaaauauuucugaccugug

SEQ ID NO: 172515 - RNA, 22 nt, Human
gggcuuuuccaacacucuggag

SEQ ID NO: 172516 - RNA, 20 nt, Human
gggcuuugagcucagggcuu

SEQ ID NO: 172517 - RNA, 19 nt, Human
gggcuuguuggcaaaugac

SEQ ID NO: 172518 - RNA, 22 nt, Human
guguuagcauggaacagaacgc

SEQ ID NO: 172519 - RNA, 22 nt, Human
guguguggacgucugagcccag

SEQ ID NO: 172520 - RNA, 22 nt, Human
guguggcgacucagagcugccu

SEQ ID NO: 172521 - RNA, 22 nt, Human
gugugcacaaucuggcaugugc

SEQ ID NO: 172522 - RNA, 22 nt, Human
gugugguguuaagcaaauuaau

SEQ ID NO: 172523 - RNA, 23 nt, Human
gugugccuuuaucuucuguacuc

SEQ ID NO: 172524 - RNA, 22 nt, Human
gggcuguggggccugcagaagg

SEQ ID NO: 172525 - RNA, 22 nt, Human
gggcuguuugcauauguuuaua

SEQ ID NO: 172526 - RNA, 22 nt, Human
gggcuguaggagcuggaauggg

SEQ ID NO: 172527 - RNA, 22 nt, Human
gggcuggggcucuggggcuagg

SEQ ID NO: 172528 - RNA, 22 nt, Human
gggcugaugcuuauacauacug

SEQ ID NO: 172529 - RNA, 22 nt, Human
gggcugagagcuggaaucugag

SEQ ID NO: 172530 - RNA, 22 nt, Human
gggcuggcaguuuucugaguuc

SEQ ID NO: 172531 - RNA, 20 nt, Human
gggcucugcauccaucagcc

SEQ ID NO: 172532 - RNA, 22 nt, Human
guucuucagcccucagguccua

SEQ ID NO: 172533 - RNA, 22 nt, Human
guugagacugaaguucugaaag

SEQ ID NO: 172534 - RNA, 22 nt, Human
ggguuuuaccagauguguggug

SEQ ID NO: 172535 - RNA, 22 nt, Human
ggguuuuggggaggaagugagc

SEQ ID NO: 172536 - RNA, 22 nt, Human
ggguuguuuguauuucucugaa

SEQ ID NO: 172537 - RNA, 22 nt, Human
ggguuguagagcuggaagggga

SEQ ID NO: 172538 - RNA, 20 nt, Human
ggguugagcguggccccucu

SEQ ID NO: 172539 - RNA, 22 nt, Human
gguacgagcccugccuaguguc

SEQ ID NO: 172540 - RNA, 22 nt, Human
gguagaggaugaggagguugga

SEQ ID NO: 172541 - RNA, 22 nt, Human
gguagagagugaggaggggcuc

SEQ ID NO: 172542 - RNA, 22 nt, Human
gguaagcauuaagugagggaau

SEQ ID NO: 172543 - RNA, 22 nt, Human
guugcaaaugggaagaugguua

SEQ ID NO: 172544 - RNA, 23 nt, Human
guugccuuugcaucuucauccau

SEQ ID NO: 172545 - RNA, 22 nt, Human
guugcggaguguagcgaugcuu

SEQ ID NO: 172546 - RNA, 22 nt, Human
guugccugguuucaaaaggaau

SEQ ID NO: 172547 - RNA, 22 nt, Human
gggguguuagucuuacccagag

SEQ ID NO: 172548 - RNA, 21 nt, Human
guucucacagcugaggugguu

SEQ ID NO: 172549 - RNA, 21 nt, Human
gggugcacagcaaauuugaga

SEQ ID NO: 172550 - RNA, 22 nt, Human
gggucggcacucuggcagcacc

SEQ ID NO: 172551 - RNA, 22 nt, Human
guuccgcugcaaggccaggaaa

SEQ ID NO: 172552 - RNA, 22 nt, Human
guuccugagcaguuccuggcca

SEQ ID NO: 172553 - RNA, 22 nt, Human
guucggcuuccuaugucaugag

SEQ ID NO: 172554 - RNA, 22 nt, Human
guucuccaggggcuguucaucu

SEQ ID NO: 172555 - RNA, 22 nt, Human
gggugcucauggauaaggcgaa

SEQ ID NO: 172556 - RNA, 22 nt, Human
ggguggcaagucuuucugcaac

SEQ ID NO: 172557 - RNA, 22 nt, Human
guucuggaggagagccuggugu

SEQ ID NO: 172558 - RNA, 22 nt, Human
guucucuuaauccuaguuggua

SEQ ID NO: 172559 - RNA, 22 nt, Human
guucugcccaggccuccccaac

SEQ ID NO: 172560 - RNA, 22 nt, Human
ggguggugagagaacuuugcag

SEQ ID NO: 172561 - RNA, 22 nt, Human
ggggcuccuguggcuauaugua

SEQ ID NO: 172562 - RNA, 22 nt, Human
ggggcuuggguagagcagaaac

SEQ ID NO: 172563 - RNA, 22 nt, Human
ggggcuggguuugcgcaggcuc

SEQ ID NO: 172564 - RNA, 22 nt, Human
ggggcuuccagcgcccgccggu

SEQ ID NO: 172565 - RNA, 22 nt, Human
guuacuacccacccuucucccc

SEQ ID NO: 172566 - RNA, 22 nt, Human
gggggcgccgccgcucaucuca

SEQ ID NO: 172567 - RNA, 22 nt, Human
gggggcgcguggagggccgugg

SEQ ID NO: 172568 - RNA, 22 nt, Human
gggggcagguuccaggccagcu

SEQ ID NO: 172569 - RNA, 22 nt, Human
gggggggcagguuggaugucag

SEQ ID NO: 172570 - RNA, 22 nt, Human
gggguacgaugguggggggcga

SEQ ID NO: 172571 - RNA, 22 nt, Human
ggguacaccaauggaugccagg

SEQ ID NO: 172572 - RNA, 22 nt, Human
gggucagggaggccccaccaug

SEQ ID NO: 172573 - RNA, 22 nt, Human
ggggucugaucccuucuggcuu

SEQ ID NO: 172574 - RNA, 22 nt, Human
guuauuguuauugcguugucga

SEQ ID NO: 172575 - RNA, 22 nt, Human
gggguguuuugaagagguucag

SEQ ID NO: 172576 - RNA, 22 nt, Human
ggggugugcugggagaagggau

SEQ ID NO: 172577 - RNA, 22 nt, Human
guuauugggagagggaauggga

SEQ ID NO: 172578 - RNA, 22 nt, Human
ggggcggggagcaugagcuggg

SEQ ID NO: 172579 - RNA, 17 nt, Human
ggggcguguauuugaug

SEQ ID NO: 172580 - RNA, 23 nt, Human
guuaccgaccugauucggcagcc

SEQ ID NO: 172581 - RNA, 22 nt, Human
ggggcggcgugggcgcggugau

SEQ ID NO: 172582 - RNA, 22 nt, Human
ggggccuuugaguugggucccu

SEQ ID NO: 172583 - RNA, 22 nt, Human
ggggccccuguggcuugaugcc

SEQ ID NO: 172584 - RNA, 22 nt, Human
ggggccgggccggcagacuggg

SEQ ID NO: 172585 - RNA, 22 nt, Human
ggggccaaggcaaacuugaggg

SEQ ID NO: 172586 - RNA, 22 nt, Human
ggggauuucccaaugcgaagca

SEQ ID NO: 172587 - RNA, 22 nt, Human
ggggagaugauaagugcauuug

SEQ ID NO: 172588 - RNA, 22 nt, Human
ggggaagagagaagaaugaucu

SEQ ID NO: 172589 - RNA, 22 nt, Human
guguugaugugucuguauucua

SEQ ID NO: 172590 - RNA, 22 nt, Human
ggggaaggaaggggagggcacg

SEQ ID NO: 172591 - RNA, 22 nt, Human
ggggagggcugagcacgguuga

SEQ ID NO: 172592 - RNA, 22 nt, Human
ggggaggugugcaggacaccuc

SEQ ID NO: 172593 - RNA, 22 nt, Human
guguuguaguguguguuucuuu

SEQ ID NO: 172594 - RNA, 23 nt, Human
guguuguugauuuucgaaucuuu

SEQ ID NO: 172595 - RNA, 22 nt, Human
gcccauggagaccucaggcugg

SEQ ID NO: 172596 - RNA, 22 nt, Human
gcccagcuuuuugaggcaggca

SEQ ID NO: 172597 - RNA, 22 nt, Human
ggaagcugucugcccggcgcuc

SEQ ID NO: 172598 - RNA, 22 nt, Human
ggaagccugggcgcaggcaggg

SEQ ID NO: 172599 - RNA, 22 nt, Human
gcugggagaggcagcuuucgga

SEQ ID NO: 172600 - RNA, 22 nt, Human
gccaucuucggcagccgccugg

SEQ ID NO: 172601 - RNA, 22 nt, Human
gcuggggaucgaaggcagagcc

SEQ ID NO: 172602 - RNA, 22 nt, Human
gcugggucucucccugguccug

SEQ ID NO: 172603 - RNA, 22 nt, Human
gccuggcagggagauuguaaga

SEQ ID NO: 172604 - RNA, 22 nt, Human
gccuggccaaucgccgucuagg

SEQ ID NO: 172605 - RNA, 22 nt, Human
gccugcuugaaagcacuuucug

SEQ ID NO: 172606 - RNA, 21 nt, Human
gccugcuguucacccugccac

SEQ ID NO: 172607 - RNA, 22 nt, Human
gccugcugggcucuuccugcug

SEQ ID NO: 172608 - RNA, 22 nt, Human
ggaauaaaaggagguggcgaga

SEQ ID NO: 172609 - RNA, 22 nt, Human
ggaaggggagcuggaaagggua

SEQ ID NO: 172610 - RNA, 22 nt, Human
ggaagucuacucuuccgaaaac

SEQ ID NO: 172611 - RNA, 22 nt, Human
ggacugggagaauggaggcaag

SEQ ID NO: 172612 - RNA, 22 nt, Human
gcgauugguuuggggccagagu

SEQ ID NO: 172613 - RNA, 22 nt, Human
ggacggggagcuggaaagggga

SEQ ID NO: 172614 - RNA, 22 nt, Human
ggaccucagccaucccucggag

SEQ ID NO: 172615 - RNA, 22 nt, Human
gccuucgauaugaggguuugcc

SEQ ID NO: 172616 - RNA, 22 nt, Human
gccuucccuccucugcucucag

SEQ ID NO: 172617 - RNA, 22 nt, Human
gccuugagcucaugucccagcu

SEQ ID NO: 172618 - RNA, 22 nt, Human
ggagaucuuggacuggccggcc

SEQ ID NO: 172619 - RNA, 22 nt, Human
gcgccuugccuguccucuaacc

SEQ ID NO: 172620 - RNA, 22 nt, Human
ggagaucugggcuguuucuggc

SEQ ID NO: 172621 - RNA, 19 nt, Human
ggagcagauaaacauacuu

SEQ ID NO: 172622 - RNA, 22 nt, Human
ggagcaguggaggggccagggu

SEQ ID NO: 172623 - RNA, 22 nt, Human
ggagcagaggaaagaguagcau

SEQ ID NO: 172624 - RNA, 22 nt, Human
ggagcaagagugagcaagcaga

SEQ ID NO: 172625 - RNA, 20 nt, Human
ggagagggaaaggcuguacu

SEQ ID NO: 172626 - RNA, 22 nt, Human
gcgcgccugccucccgcggugc

SEQ ID NO: 172627 - RNA, 22 nt, Human
ggaugggcuuggggaggucuag

SEQ ID NO: 172628 - RNA, 22 nt, Human
ggauugaagggaaccucagaau

SEQ ID NO: 172629 - RNA, 22 nt, Human
gcggcggcggaggcgggggcag

SEQ ID NO: 172630 - RNA, 22 nt, Human
ggcaaggaagaaagcagaaguu

SEQ ID NO: 172631 - RNA, 22 nt, Human
ggcagaaaacaauaaccauuuc

SEQ ID NO: 172632 - RNA, 22 nt, Human
ggcaagcacugggugucuuagc

SEQ ID NO: 172633 - RNA, 22 nt, Human
gcgggcgcuguggccccggccu

SEQ ID NO: 172634 - RNA, 22 nt, Human
gcggcgucccagcuccgacggc

SEQ ID NO: 172635 - RNA, 22 nt, Human
ggaucaccagguuuguuguugg

SEQ ID NO: 172636 - RNA, 22 nt, Human
ggagccuuccgagucccagguu

SEQ ID NO: 172637 - RNA, 22 nt, Human
ggaucagcgagaagggcugaaa

SEQ ID NO: 172638 - RNA, 22 nt, Human
ggaucgauuccaaauguagauc

SEQ ID NO: 172639 - RNA, 22 nt, Human
ggagccaguuuagaccucaguu

SEQ ID NO: 172640 - RNA, 22 nt, Human
ggagcauggcuucuuggggcug

SEQ ID NO: 172641 - RNA, 20 nt, Human
ggagcgggcauuuguguucc

SEQ ID NO: 172642 - RNA, 22 nt, Human
ggaugcugcuccacaucccaca

SEQ ID NO: 172643 - RNA, 22 nt, Human
gcucccagcuuuuguccacggc

SEQ ID NO: 172644 - RNA, 22 nt, Human
ggcagggaauucagagggaagg

SEQ ID NO: 172645 - RNA, 22 nt, Human
gcuccagcuccauaaacauaag

SEQ ID NO: 172646 - RNA, 22 nt, Human
ggcagggacugggauauggaga

SEQ ID NO: 172647 - RNA, 22 nt, Human
gcucaacucaacgucauuugaa

SEQ ID NO: 172648 - RNA, 22 nt, Human
gcuacaacugugucuguggggc

SEQ ID NO: 172649 - RNA, 22 nt, Human
gcuacaaauaaaaugggugacu

SEQ ID NO: 172650 - RNA, 20 nt, Human
ggcagagcuaugucuguugc

SEQ ID NO: 172651 - RNA, 21 nt, Human
ggcagagaagcuggaaguugg

SEQ ID NO: 172652 - RNA, 22 nt, Human
ggcagagcugugcgcccaccca

SEQ ID NO: 172653 - RNA, 22 nt, Human
ggcagaggaagcuggaaguggg

SEQ ID NO: 172654 - RNA, 22 nt, Human
gcgggcuuggcuccagggccca

SEQ ID NO: 172655 - RNA, 22 nt, Human
ggcagagguagcuggaaccagg

SEQ ID NO: 172656 - RNA, 22 nt, Human
gcggggcucuacuuggccugga

SEQ ID NO: 172657 - RNA, 22 nt, Human
gcgugugugauaugccucugca

SEQ ID NO: 172658 - RNA, 22 nt, Human
gcuacaaaaccagggcaaagga

SEQ ID NO: 172659 - RNA, 22 nt, Human
gcgggugagauucgagagaugg

SEQ ID NO: 172660 - RNA, 22 nt, Human
gcucuggcuacuguggcuaccg

SEQ ID NO: 172661 - RNA, 22 nt, Human
gcucuggcugccuuaguuuugu

SEQ ID NO: 172662 - RNA, 22 nt, Human
ggccagcgugggggaguagcgg

SEQ ID NO: 172663 - RNA, 22 nt, Human
gcugcaggaggugguagggucu

SEQ ID NO: 172664 - RNA, 22 nt, Human
gcugcacgguccuggcaccacg

SEQ ID NO: 172665 - RNA, 22 nt, Human
gcugcagggagcuggaaggcuc

SEQ ID NO: 172666 - RNA, 23 nt, Human
gcugcagugaauguuguuguugu

SEQ ID NO: 172667 - RNA, 22 nt, Human
ggcccuggggcaggagcagagg

SEQ ID NO: 172668 - RNA, 22 nt, Human
ggccgccacacagauucccccg

SEQ ID NO: 172669 - RNA, 22 nt, Human
ggccgccgcuuagcugagcccc

SEQ ID NO: 172670 - RNA, 22 nt, Human
ggccccggaggccguuagcuua

SEQ ID NO: 172671 - RNA, 22 nt, Human
ggcccgcgcugcuggcgcgcca

SEQ ID NO: 172672 - RNA, 18 nt, Human
ggccucagccuggccgga

SEQ ID NO: 172673 - RNA, 22 nt, Human
ggccgggugggaggcagcggag

SEQ ID NO: 172674 - RNA, 20 nt, Human
ggccugagcauggcuggcag

SEQ ID NO: 172675 - RNA, 22 nt, Human
ggccucucuccuuggcuugcag

SEQ ID NO: 172676 - RNA, 22 nt, Human
ggccugcucuggcuguggucag

SEQ ID NO: 172677 - RNA, 22 nt, Human
ggccugcuaccagcugugaccu

SEQ ID NO: 172678 - RNA, 22 nt, Human
ggccuggccuccugcuuuucca

SEQ ID NO: 172679 - RNA, 22 nt, Human
ggccuggcacauaguaggcagu

SEQ ID NO: 172680 - RNA, 22 nt, Human
ggcggcccaggugcuccaggcg

SEQ ID NO: 172681 - RNA, 22 nt, Human
ggcggcugcuccuugcccucgg

SEQ ID NO: 172682 - RNA, 22 nt, Human
ggcggugcgaggaugcagggcu

SEQ ID NO: 172683 - RNA, 22 nt, Human
ggcuaagcaguaaaugggguua

SEQ ID NO: 172684 - RNA, 22 nt, Human
ggcggcaagggaauggagaaga

SEQ ID NO: 172685 - RNA, 22 nt, Human
ggcggaggucacgcacccgcca

SEQ ID NO: 172686 - RNA, 22 nt, Human
ggcgcccucccuguccgucuuc

SEQ ID NO: 172687 - RNA, 22 nt, Human
ggcggagggcuguguccccggc

SEQ ID NO: 172688 - RNA, 22 nt, Human
ggcgccugguauucuuccucuc

SEQ ID NO: 172689 - RNA, 22 nt, Human
ggcgaguacagacggggccugg

SEQ ID NO: 172690 - RNA, 22 nt, Human
ggcgccauuuuugccuucggag

SEQ ID NO: 172691 - RNA, 23 nt, Human
ggccuuuuuaaccgcgagcgaca

SEQ ID NO: 172692 - RNA, 22 nt, Human
ggccuugggauguggcugcagc

SEQ ID NO: 172693 - RNA, 22 nt, Human
ggcgacuacugaaugcuugaaa

SEQ ID NO: 172694 - RNA, 22 nt, Human
ggcgaggcgggccgcggggucu

SEQ ID NO: 172695 - RNA, 22 nt, Human
ggccuugauuccggucauugaa

SEQ ID NO: 172696 - RNA, 22 nt, Human
ggcgaugaggucuuagaaucua

SEQ ID NO: 172697 - RNA, 22 nt, Human
gcugcgcgcagccggcgccgag

SEQ ID NO: 172698 - RNA, 22 nt, Human
gcugcgccgggagccggggccg

SEQ ID NO: 172699 - RNA, 18 nt, Human
ggcugggcugugccccuu

SEQ ID NO: 172700 - RNA, 22 nt, Human
ggcugguggcgggcagcacaga

SEQ ID NO: 172701 - RNA, 22 nt, Human
ggcugugaaguacguugaaggu

SEQ ID NO: 172702 - RNA, 22 nt, Human
ggcugggagguggcgaggaggc

SEQ ID NO: 172703 - RNA, 22 nt, Human
ggcuggacuuucugcugggcuc

SEQ ID NO: 172704 - RNA, 22 nt, Human
gcuggguuguucuccuggucca

SEQ ID NO: 172705 - RNA, 22 nt, Human
gcuggucuggcaauccucaugg

SEQ ID NO: 172706 - RNA, 22 nt, Human
gcuggugugagauucucgaggg

SEQ ID NO: 172707 - RNA, 19 nt, Human
gcugggauaggauguauuu

SEQ ID NO: 172708 - RNA, 22 nt, Human
gcugggccucuuacuucuuacg

SEQ ID NO: 172709 - RNA, 22 nt, Human
gcuggguaguucuuguuuggga

SEQ ID NO: 172710 - RNA, 22 nt, Human
ggcuucaaaacacaugucaaga

SEQ ID NO: 172711 - RNA, 20 nt, Human
gcugugccaugacccucgag

SEQ ID NO: 172712 - RNA, 22 nt, Human
ggcugugguggacgcgggaaac

SEQ ID NO: 172713 - RNA, 22 nt, Human
ggcugugggguccuguggugug

SEQ ID NO: 172714 - RNA, 22 nt, Human
gcugucaggaacaugccuuggu

SEQ ID NO: 172715 - RNA, 22 nt, Human
gcuguaacuuuuucauuuucaa

SEQ ID NO: 172716 - RNA, 22 nt, Human
gcuguccugggaacaggcacua

SEQ ID NO: 172717 - RNA, 22 nt, Human
gcuguauaucuuuugaagugau

SEQ ID NO: 172718 - RNA, 22 nt, Human
ggcucccccauggcugacagac

SEQ ID NO: 172719 - RNA, 22 nt, Human
ggcuccagauguccccuggcaa

SEQ ID NO: 172720 - RNA, 22 nt, Human
gcugcuggcuuccugcuguuuu

SEQ ID NO: 172721 - RNA, 22 nt, Human
gcuggaaauaacuuguguagaa

SEQ ID NO: 172722 - RNA, 22 nt, Human
gcuggauuuaggguucccuccu

SEQ ID NO: 172723 - RNA, 22 nt, Human
ggcucguaaaggccucacaggu

SEQ ID NO: 172724 - RNA, 22 nt, Human
ggcugaggccucuggggaggga

SEQ ID NO: 172725 - RNA, 22 nt, Human
ggcugcuugauagauaugagua

SEQ ID NO: 172726 - RNA, 22 nt, Human
ggcugcagggaacaggaugggu

SEQ ID NO: 172727 - RNA, 22 nt, Human
gcuggcgauggccgagucuccg

SEQ ID NO: 172728 - RNA, 22 nt, Human
ggcuggaacuucuucuggcauu

SEQ ID NO: 172729 - RNA, 22 nt, Human
gcuggccugcgagggcaggcug

SEQ ID NO: 172730 - RNA, 22 nt, Human
gcugggagucgcgucuguggcc

SEQ ID NO: 172731 - RNA, 22 nt, Human
gcugggacacacagucuucuuu

SEQ ID NO: 172732 - RNA, 22 nt, Human
ggcagugguaggagcccaggag

SEQ ID NO: 172733 - RNA, 22 nt, Human
ggcagguggcacugcugcuccc

SEQ ID NO: 172734 - RNA, 22 nt, Human
gguguaaggaagauggaagaug

SEQ ID NO: 172735 - RNA, 20 nt, Human
ggcauuuuuuaguugagcuu

SEQ ID NO: 172736 - RNA, 22 nt, Human
gguggucaggagcgcccguugg

SEQ ID NO: 172737 - RNA, 22 nt, Human
gguggggugagggggcgaggcc

SEQ ID NO: 172738 - RNA, 22 nt, Human
ggugggccaaauuaaacauaua

SEQ ID NO: 172739 - RNA, 22 nt, Human
ggcaggauggagcagggcuaaa

SEQ ID NO: 172740 - RNA, 22 nt, Human
ggcagcgcuuggcugcucgaca

SEQ ID NO: 172741 - RNA, 22 nt, Human
ggcaggaaguaaggaugcuaca

SEQ ID NO: 172742 - RNA, 22 nt, Human
ggcagggagagcgccgccaugc

SEQ ID NO: 172743 - RNA, 22 nt, Human
ggcagggagagcaugcugauaa

SEQ ID NO: 172744 - RNA, 18 nt, Human
ggcagggcucagcugcuc

SEQ ID NO: 172745 - RNA, 22 nt, Human
ggcagcagaacuggcccuguau

SEQ ID NO: 172746 - RNA, 22 nt, Human
ggcagcccuggacccuggagaa

SEQ ID NO: 172747 - RNA, 21 nt, Human
ggcagccuggcaggggcacug

SEQ ID NO: 172748 - RNA, 22 nt, Human
ggugcaaagauggcaguugcaa

SEQ ID NO: 172749 - RNA, 22 nt, Human
ggugacucacauuaggacuucg

SEQ ID NO: 172750 - RNA, 19 nt, Human
ggucugcggggugaccgug

SEQ ID NO: 172751 - RNA, 18 nt, Human
gguacguuuugaucaaug

SEQ ID NO: 172752 - RNA, 22 nt, Human
gguaccuggcccuggggcugcu

SEQ ID NO: 172753 - RNA, 22 nt, Human
gguaauugaaaguuuguugaug

SEQ ID NO: 172754 - RNA, 22 nt, Human
ggguguuaugccucugagucag

SEQ ID NO: 172755 - RNA, 22 nt, Human
ggguguuuuuggugacagggag

SEQ ID NO: 172756 - RNA, 22 nt, Human
ggguguggaggugacacauuug

SEQ ID NO: 172757 - RNA, 22 nt, Human
gggugugcuaaaccuacgcaca

SEQ ID NO: 172758 - RNA, 22 nt, Human
ggcaaagaguacaucguccugg

SEQ ID NO: 172759 - RNA, 22 nt, Human
ggcaccuuucaucccaucuaga

SEQ ID NO: 172760 - RNA, 22 nt, Human
ggcaagauccagcacaaacaca

SEQ ID NO: 172761 - RNA, 22 nt, Human
ggcacuggguugcagagagaga

SEQ ID NO: 172762 - RNA, 22 nt, Human
ggucgucuguccugucgccgcu

SEQ ID NO: 172763 - RNA, 22 nt, Human
ggucggggcuggccggcguggu

SEQ ID NO: 172764 - RNA, 22 nt, Human
ggucuuccuugggggacuugaa

SEQ ID NO: 172765 - RNA, 22 nt, Human
ggucuucauucuaccagacuuu

SEQ ID NO: 172766 - RNA, 22 nt, Human
ggucuucauaugccacagaguc

SEQ ID NO: 172767 - RNA, 22 nt, Human
ggucugauaccugcagguuguc

SEQ ID NO: 172768 - RNA, 22 nt, Human
ggucugcgauggcaagggucuu

SEQ ID NO: 172769 - RNA, 20 nt, Human
ggucuguuucuucuuuucau

SEQ ID NO: 172770 - RNA, 21 nt, Human
ggccagauucucccauagcug

SEQ ID NO: 172771 - RNA, 22 nt, Human
gguguagggaaacuugacuaau

SEQ ID NO: 172772 - RNA, 22 nt, Human
gguucuggaaaagaaagcaaag

SEQ ID NO: 172773 - RNA, 22 nt, Human
gguguacuucacucuuaccuag

SEQ ID NO: 172774 - RNA, 22 nt, Human
gguuuuccaguagaucagaaga

SEQ ID NO: 172775 - RNA, 22 nt, Human
ggcccugcuuccccaguguaca

SEQ ID NO: 172776 - RNA, 22 nt, Human
guaauugcucauauggcaccug

SEQ ID NO: 172777 - RNA, 22 nt, Human
guaccuguacauaacuacauau

SEQ ID NO: 172778 - RNA, 22 nt, Human
guaaacugaauuggauacugug

SEQ ID NO: 172779 - RNA, 22 nt, Human
guaggaaaugaauaagguaccu

SEQ ID NO: 172780 - RNA, 22 nt, Human
guagucauugggucugugguca

SEQ ID NO: 172781 - RNA, 22 nt, Human
guagugauuguuccucaggggu

SEQ ID NO: 172782 - RNA, 22 nt, Human
guacugggaauggagccugggc

SEQ ID NO: 172783 - RNA, 22 nt, Human
guagagcagaaacauggagaaa

SEQ ID NO: 172784 - RNA, 22 nt, Human
guagaacucuuuccugcguggg

SEQ ID NO: 172785 - RNA, 22 nt, Human
ggccgccacuuuccagugcugc

SEQ ID NO: 172786 - RNA, 22 nt, Human
ggccgggcaugcgagcugagcg

SEQ ID NO: 172787 - RNA, 22 nt, Human
ggccgcuuucuggggagugagg

SEQ ID NO: 172788 - RNA, 22 nt, Human
guaguuuuugagcuguaaucuu

SEQ ID NO: 172789 - RNA, 22 nt, Human
ggccugagaagcaaggacacaa

SEQ ID NO: 172790 - RNA, 22 nt, Human
ggccuucuuuucaugucuuucg

SEQ ID NO: 172791 - RNA, 22 nt, Human
gggagguaaugggggugcaggg

SEQ ID NO: 172792 - RNA, 22 nt, Human
gggagggcuuggacccagaugu

SEQ ID NO: 172793 - RNA, 22 nt, Human
gggauguauguuuguguggaga

SEQ ID NO: 172794 - RNA, 22 nt, Human
ggaaaagccauauuauaggcaa

SEQ ID NO: 172795 - RNA, 22 nt, Human
gcuuuggcuucuccuggcagga

SEQ ID NO: 172796 - RNA, 22 nt, Human
gcuguggcuccaauggugagcc

SEQ ID NO: 172797 - RNA, 22 nt, Human
gcuguggaaaaugggucuccaa

SEQ ID NO: 172798 - RNA, 22 nt, Human
gggaggcagacgcuggagccca

SEQ ID NO: 172799 - RNA, 22 nt, Human
gcuguggguuccuccccugucc

SEQ ID NO: 172800 - RNA, 22 nt, Human
gggagcuggagcuggaagacuc

SEQ ID NO: 172801 - RNA, 22 nt, Human
gcuuuuaaauuaucugacaaug

SEQ ID NO: 172802 - RNA, 22 nt, Human
gcuuuucaaguuacaauuagcu

SEQ ID NO: 172803 - RNA, 22 nt, Human
ggacaauuguacucgauuucaa

SEQ ID NO: 172804 - RNA, 22 nt, Human
ggacagagcaacccuacgcagc

SEQ ID NO: 172805 - RNA, 22 nt, Human
gggcuagggucagggggccacu

SEQ ID NO: 172806 - RNA, 22 nt, Human
gggcuacagaugggagggauga

SEQ ID NO: 172807 - RNA, 22 nt, Human
gggcucaaccauagcacaaaga

SEQ ID NO: 172808 - RNA, 22 nt, Human
gggcgcgcggagccucgccggg

SEQ ID NO: 172809 - RNA, 22 nt, Human
ggaaguggauucagggcugcua

SEQ ID NO: 172810 - RNA, 22 nt, Human
gggcggugccugucuccgaagc

SEQ ID NO: 172811 - RNA, 22 nt, Human
ggaagcuguugugagugcagca

SEQ ID NO: 172812 - RNA, 19 nt, Human
ggaacgcugggcuccccuc

SEQ ID NO: 172813 - RNA, 22 nt, Human
ggaacaguacucggaggccaga

SEQ ID NO: 172814 - RNA, 22 nt, Human
gggccaggaugugguucauuuu

SEQ ID NO: 172815 - RNA, 22 nt, Human
gggcagucagauucgggggccu

SEQ ID NO: 172816 - RNA, 22 nt, Human
gggcaugcagcaauucuguggu

SEQ ID NO: 172817 - RNA, 22 nt, Human
ggaaggugagugcugugugauu

SEQ ID NO: 172818 - RNA, 18 nt, Human
ggaaggugcuggagugca

SEQ ID NO: 172819 - RNA, 22 nt, Human
gggcgcaagcaugugucugggu

SEQ ID NO: 172820 - RNA, 22 nt, Human
gggcgcgccaggagcugcgcgg

SEQ ID NO: 172821 - RNA, 22 nt, Human
gggcgccgggagugagagugag

SEQ ID NO: 172822 - RNA, 22 nt, Human
ggagagcuagugagcuggaggu

SEQ ID NO: 172823 - RNA, 22 nt, Human
ggggcaucguugauugcauggu

SEQ ID NO: 172824 - RNA, 22 nt, Human
ggagaccagaaggaagcuucga

SEQ ID NO: 172825 - RNA, 22 nt, Human
ggagaagaggagcuggaagccu

SEQ ID NO: 172826 - RNA, 22 nt, Human
ggggacggcuggccggggcccc

SEQ ID NO: 172827 - RNA, 22 nt, Human
ggggacugccgacagucucaaa

SEQ ID NO: 172828 - RNA, 22 nt, Human
ggacauggaaagugugugauuu

SEQ ID NO: 172829 - RNA, 22 nt, Human
ggacauugaagcuggaaaggga

SEQ ID NO: 172830 - RNA, 22 nt, Human
gggcugcuccgcccgcugcgcc

SEQ ID NO: 172831 - RNA, 18 nt, Human
ggagaagaacagaugugg

SEQ ID NO: 172832 - RNA, 22 nt, Human
ggggcugggaggccggcgcgca

SEQ ID NO: 172833 - RNA, 22 nt, Human
ggagaugaaugugguaaaacug

SEQ ID NO: 172834 - RNA, 22 nt, Human
gggggcugugugcccgcucccc

SEQ ID NO: 172835 - RNA, 22 nt, Human
ggaggaagagaccagggggcuu

SEQ ID NO: 172836 - RNA, 22 nt, Human
ggggugggcuggguguccaagg

SEQ ID NO: 172837 - RNA, 22 nt, Human
ggggugaggcagggcagggguc

SEQ ID NO: 172838 - RNA, 22 nt, Human
ggggugagaguguuuuaaagca

SEQ ID NO: 172839 - RNA, 21 nt, Human
ggggcccccacacaugccucc

SEQ ID NO: 172840 - RNA, 22 nt, Human
ggggccaugauggacgagguga

SEQ ID NO: 172841 - RNA, 22 nt, Human
ggggcgaguguggaccgcagcc

SEQ ID NO: 172842 - RNA, 22 nt, Human
ggggcguugccacggggacggg

SEQ ID NO: 172843 - RNA, 22 nt, Human
gggugguggagguuugacagac

SEQ ID NO: 172844 - RNA, 22 nt, Human
gggucauugcgugacgcgagca

SEQ ID NO: 172845 - RNA, 22 nt, Human
gggugguuccuggaucugacug

SEQ ID NO: 172846 - RNA, 19 nt, Human
ggaguugccaggagaagga

SEQ ID NO: 172847 - RNA, 22 nt, Human
ggagggagugcaggcaggcaga

SEQ ID NO: 172848 - RNA, 22 nt, Human
gggguugauaauuagagaaaug

SEQ ID NO: 172849 - RNA, 22 nt, Human
ggagggaggggugggagaugga

SEQ ID NO: 172850 - RNA, 22 nt, Human
ggguggugauacugcuucugcc

SEQ ID NO: 172851 - RNA, 20 nt, Human
gggucuggcaucucucucug

SEQ ID NO: 172852 - RNA, 22 nt, Human
gggucuggagauccgggugaag

SEQ ID NO: 172853 - RNA, 22 nt, Human
gcugccuugaacuuggccuggg

SEQ ID NO: 172854 - RNA, 23 nt, Human
gcugccguuucccaucgugguga

SEQ ID NO: 172855 - RNA, 22 nt, Human
gccagccggugaguggaagcgg

SEQ ID NO: 172856 - RNA, 20 nt, Human
gccaaggaggagaaacaggc

SEQ ID NO: 172857 - RNA, 22 nt, Human
gccaaccagucgguccaggaag

SEQ ID NO: 172858 - RNA, 22 nt, Human
gccaaucaggaggcuguacauc

SEQ ID NO: 172859 - RNA, 22 nt, Human
gcugcccauugcucucccacuc

SEQ ID NO: 172860 - RNA, 22 nt, Human
gcugccgcugcggggcgcgggc

SEQ ID NO: 172861 - RNA, 22 nt, Human
gcugcccucccagggcaagcuu

SEQ ID NO: 172862 - RNA, 22 nt, Human
gcugagcagaacaauuagaaau

SEQ ID NO: 172863 - RNA, 23 nt, Human
gcugagcaccagccauaucuuuu

SEQ ID NO: 172864 - RNA, 22 nt, Human
gcugagcagcgaaggcacaugc

SEQ ID NO: 172865 - RNA, 22 nt, Human
gcugauucuucugcuuuuucuc

SEQ ID NO: 172866 - RNA, 23 nt, Human
gcauuugcaggaaacuggaaaag

SEQ ID NO: 172867 - RNA, 22 nt, Human
gcauuucauaaccagccaugcu

SEQ ID NO: 172868 - RNA, 22 nt, Human
gcucugcuccaucuguuuccuc

SEQ ID NO: 172869 - RNA, 22 nt, Human
gcucucuggccugggaggagga

SEQ ID NO: 172870 - RNA, 22 nt, Human
gcucucucuucugcaggccuua

SEQ ID NO: 172871 - RNA, 22 nt, Human
gcugagaguguaggauguuuac

SEQ ID NO: 172872 - RNA, 22 nt, Human
gccauguucuugaaucuggguc

SEQ ID NO: 172873 - RNA, 22 nt, Human
gccaugguggggccucccugac

SEQ ID NO: 172874 - RNA, 22 nt, Human
gcuggcggguuggggaggcgga

SEQ ID NO: 172875 - RNA, 21 nt, Human
gcuggcugucucuuacacggu

SEQ ID NO: 172876 - RNA, 22 nt, Human
gccauguuuugguaaauaccau

SEQ ID NO: 172877 - RNA, 20 nt, Human
gcccacccgcacucccgccg

SEQ ID NO: 172878 - RNA, 22 nt, Human
gcccagacaucuguugggaccu

SEQ ID NO: 172879 - RNA, 22 nt, Human
gcuggaugucugugccaggcac

SEQ ID NO: 172880 - RNA, 22 nt, Human
gcuggauaaggaucaguuucuu

SEQ ID NO: 172881 - RNA, 22 nt, Human
gcuggaagggccagcuuucagg

SEQ ID NO: 172882 - RNA, 22 nt, Human
gcugcuggcggagcuggcgcug

SEQ ID NO: 172883 - RNA, 22 nt, Human
gcugcucaaaaaaacacuagcu

SEQ ID NO: 172884 - RNA, 22 nt, Human
gcugcuacagagcuggaggggg

SEQ ID NO: 172885 - RNA, 22 nt, Human
gccaggccuggguggagcgcuc

SEQ ID NO: 172886 - RNA, 22 nt, Human
gcugcgcugggacgccaccaac

SEQ ID NO: 172887 - RNA, 22 nt, Human
gccagggcucgagcaggccagc

SEQ ID NO: 172888 - RNA, 22 nt, Human
gcugcuucgcugcacacccgag

SEQ ID NO: 172889 - RNA, 22 nt, Human
gccagucgucuuuauuacagcu

SEQ ID NO: 172890 - RNA, 22 nt, Human
gccaguuuguuuacugaugguu

SEQ ID NO: 172891 - RNA, 21 nt, Human
gcucccgaagugcucggcguu

SEQ ID NO: 172892 - RNA, 22 nt, Human
gcuccggggguuccagaucauc

SEQ ID NO: 172893 - RNA, 19 nt, Human
gcuccugcagcuagagugc

SEQ ID NO: 172894 - RNA, 22 nt, Human
gcucaaggucacacagggguga

SEQ ID NO: 172895 - RNA, 22 nt, Human
gcaucuccugagucagauuuug

SEQ ID NO: 172896 - RNA, 22 nt, Human
gcuauuggcuaauuguugcaac

SEQ ID NO: 172897 - RNA, 22 nt, Human
gcucaagaccaagggagcgggg

SEQ ID NO: 172898 - RNA, 22 nt, Human
gcuacaggggucaguccuuugc

SEQ ID NO: 172899 - RNA, 22 nt, Human
gcguggccugcugaaggacuuc

SEQ ID NO: 172900 - RNA, 22 nt, Human
gcaggggguaaggggcagggcu

SEQ ID NO: 172901 - RNA, 21 nt, Human
gcaggggugugugagcugggg

SEQ ID NO: 172902 - RNA, 22 nt, Human
gcgucucugggcugacccaggu

SEQ ID NO: 172903 - RNA, 22 nt, Human
gcguggaugauuuugagucggu

SEQ ID NO: 172904 - RNA, 19 nt, Human
gcggcggugccggcuggga

SEQ ID NO: 172905 - RNA, 22 nt, Human
gcggcuggcuguccaaacuggg

SEQ ID NO: 172906 - RNA, 22 nt, Human
gcgggccggcaggggaggaguu

SEQ ID NO: 172907 - RNA, 22 nt, Human
gcagcucagcacgcacagguaa

SEQ ID NO: 172908 - RNA, 22 nt, Human
gcagcguguggcuaauggcucu

SEQ ID NO: 172909 - RNA, 22 nt, Human
gcagcgcugagaugauuuguug

SEQ ID NO: 172910 - RNA, 22 nt, Human
gcggguggaggagggacgggca

SEQ ID NO: 172911 - RNA, 22 nt, Human
gcggggggcucgggcagcucgg

SEQ ID NO: 172912 - RNA, 22 nt, Human
gcgguguuuuaacacucccucg

SEQ ID NO: 172913 - RNA, 22 nt, Human
gcgguggcuacuaaaguucgaa

SEQ ID NO: 172914 - RNA, 22 nt, Human
gcaggaaugguacauaccuguu

SEQ ID NO: 172915 - RNA, 22 nt, Human
gccuuggacuaccacucccaca

SEQ ID NO: 172916 - RNA, 22 nt, Human
gccuuucuugguuugucaggca

SEQ ID NO: 172917 - RNA, 22 nt, Human
gcggagcuaaagauuggcuccu

SEQ ID NO: 172918 - RNA, 22 nt, Human
gcagccaauggcgagccccaca

SEQ ID NO: 172919 - RNA, 22 nt, Human
gcagccugaguuuagcucgucg

SEQ ID NO: 172920 - RNA, 22 nt, Human
gcagcccucuuggucacuaggc

SEQ ID NO: 172921 - RNA, 22 nt, Human
gcagccauggcuggccgggcau

SEQ ID NO: 172922 - RNA, 22 nt, Human
gcggcaguccuuccaguacagg

SEQ ID NO: 172923 - RNA, 22 nt, Human
gcggcccggguccccagcagca

SEQ ID NO: 172924 - RNA, 22 nt, Human
gcggccucuuugcugccucagg

SEQ ID NO: 172925 - RNA, 23 nt, Human
gaugauggcaacuacauccggug

SEQ ID NO: 172926 - RNA, 22 nt, Human
gaugauuccuuuguucauugug

SEQ ID NO: 172927 - RNA, 22 nt, Human
gaucacuuugauuagauguccu

SEQ ID NO: 172928 - RNA, 22 nt, Human
gauggacgguuuuaccagacag

SEQ ID NO: 172929 - RNA, 22 nt, Human
gaugccuccaggaaagaggacg

SEQ ID NO: 172930 - RNA, 22 nt, Human
gccauggugagccaccuggugg

SEQ ID NO: 172931 - RNA, 22 nt, Human
gcccgaccgcgccggcccgcac

SEQ ID NO: 172932 - RNA, 22 nt, Human
gcccgccaacuugccagcggug

SEQ ID NO: 172933 - RNA, 23 nt, Human
gcccagaggccccuggccugagc

SEQ ID NO: 172934 - RNA, 22 nt, Human
gcccagccucagggcaucagcu

SEQ ID NO: 172935 - RNA, 22 nt, Human
gcccagaagguagcgaguaguc

SEQ ID NO: 172936 - RNA, 22 nt, Human
gaugccggggucguagccgugg

SEQ ID NO: 172937 - RNA, 22 nt, Human
gauacaugucacaaguugugca

SEQ ID NO: 172938 - RNA, 22 nt, Human
gcaugguuuccugcaacguucu

SEQ ID NO: 172939 - RNA, 22 nt, Human
gcauguagucaguguugagaac

SEQ ID NO: 172940 - RNA, 22 nt, Human
gcauugcuauuucuguuagugu

SEQ ID NO: 172941 - RNA, 20 nt, Human
gcauggcuggcugcugucug

SEQ ID NO: 172942 - RNA, 22 nt, Human
gcauggaaaagggaugcuaacu

SEQ ID NO: 172943 - RNA, 22 nt, Human
gcaugcgugcgugcgugcaugu

SEQ ID NO: 172944 - RNA, 22 nt, Human
gagguuggagggcugcccugca

SEQ ID NO: 172945 - RNA, 22 nt, Human
gagguuggggugucucucccca

SEQ ID NO: 172946 - RNA, 22 nt, Human
gcaacguauauggguaaggaua

SEQ ID NO: 172947 - RNA, 22 nt, Human
gcaaaugacuuagucacuccag

SEQ ID NO: 172948 - RNA, 22 nt, Human
gcaacccugggucaugguugac

SEQ ID NO: 172949 - RNA, 22 nt, Human
gccuagaagaaugagcgcaggg

SEQ ID NO: 172950 - RNA, 22 nt, Human
gccuccgccuuccugucucccc

SEQ ID NO: 172951 - RNA, 22 nt, Human
gccucaaaaguguuguagaggg

SEQ ID NO: 172952 - RNA, 22 nt, Human
gccuggaaugcaaugugacgaa

SEQ ID NO: 172953 - RNA, 22 nt, Human
gccugaaaugaaccagaggacu

SEQ ID NO: 172954 - RNA, 22 nt, Human
gcacagauaaucugccuuacca

SEQ ID NO: 172955 - RNA, 22 nt, Human
gccugggcuuccgggacccggg

SEQ ID NO: 172956 - RNA, 20 nt, Human
gccugggagaagaucaggga

SEQ ID NO: 172957 - RNA, 22 nt, Human
gccuuuauauuacauuuggaag

SEQ ID NO: 172958 - RNA, 22 nt, Human
gcccuagaguugagagcaccca

SEQ ID NO: 172959 - RNA, 22 nt, Human
gcccugaagagguagagaauuu

SEQ ID NO: 172960 - RNA, 22 nt, Human
gaugguggggggcagcugggag

SEQ ID NO: 172961 - RNA, 22 nt, Human
gcccuuuuaucaacuccuagaa

SEQ ID NO: 172962 - RNA, 18 nt, Human
gccgccuugcucgugaac

SEQ ID NO: 172963 - RNA, 22 nt, Human
gccgccgccgccuuuguugcgg

SEQ ID NO: 172964 - RNA, 22 nt, Human
gccgccgcucaccugggcgccg

SEQ ID NO: 172965 - RNA, 22 nt, Human
gauucugaaauuaacagacugg

SEQ ID NO: 172966 - RNA, 22 nt, Human
gccggagagccaacaccacgga

SEQ ID NO: 172967 - RNA, 22 nt, Human
gccgcguggcagucuuggugac

SEQ ID NO: 172968 - RNA, 20 nt, Human
gccggggcauaggggccguc

SEQ ID NO: 172969 - RNA, 22 nt, Human
gauugcugccagcguguccgug

SEQ ID NO: 172970 - RNA, 22 nt, Human
gccguuccuacucucucugugu

SEQ ID NO: 172971 - RNA, 21 nt, Human
gccgugcgccuccaggcgcgc

SEQ ID NO: 172972 - RNA, 22 nt, Human
gccggguguuccugggaagaug

SEQ ID NO: 172973 - RNA, 22 nt, Human
gauuucauaaaacgagaaacuc

SEQ ID NO: 172974 - RNA, 20 nt, Human
gagaggguuaggauauuugc

SEQ ID NO: 172975 - RNA, 22 nt, Human
gaugcucuugauuggaccaggg

SEQ ID NO: 172976 - RNA, 22 nt, Human
gagacuguaagcuccuugagga

SEQ ID NO: 172977 - RNA, 22 nt, Human
gagaggguugggaggcagcaga

SEQ ID NO: 172978 - RNA, 22 nt, Human
gagaggcugagcaguccggguu

SEQ ID NO: 172979 - RNA, 22 nt, Human
gagaggcagcucaggaggucag

SEQ ID NO: 172980 - RNA, 22 nt, Human
gagaggaagugccugcucccag

SEQ ID NO: 172981 - RNA, 22 nt, Human
gagacucagccccugcucucaa

SEQ ID NO: 172982 - RNA, 22 nt, Human
gagagaaggaagugaauuuccc

SEQ ID NO: 172983 - RNA, 22 nt, Human
gagccaugagauaagagcaccu

SEQ ID NO: 172984 - RNA, 22 nt, Human
gagcaugacgcaacaccaagug

SEQ ID NO: 172985 - RNA, 22 nt, Human
gagccauggaggaugugcagca

SEQ ID NO: 172986 - RNA, 22 nt, Human
gagcccuguagcaagucauguc

SEQ ID NO: 172987 - RNA, 22 nt, Human
gaugugugugcccugggccugc

SEQ ID NO: 172988 - RNA, 22 nt, Human
gagcagcucgagaaggaagcag

SEQ ID NO: 172989 - RNA, 22 nt, Human
gagcagcacagaccaaacagaa

SEQ ID NO: 172990 - RNA, 22 nt, Human
gagcacauguggagagucuggg

SEQ ID NO: 172991 - RNA, 22 nt, Human
gagcaacacauugaaugaggau

SEQ ID NO: 172992 - RNA, 22 nt, Human
gauggguuugagauguuugggu

SEQ ID NO: 172993 - RNA, 22 nt, Human
gaugguagauauagaaagggga

SEQ ID NO: 172994 - RNA, 22 nt, Human
gauggugauggcccuaagcuga

SEQ ID NO: 172995 - RNA, 22 nt, Human
gaugguaucugcuggcuuucag

SEQ ID NO: 172996 - RNA, 22 nt, Human
gagagucuuaaguuacagaacu

SEQ ID NO: 172997 - RNA, 22 nt, Human
gagaucuguguuugcugaagcu

SEQ ID NO: 172998 - RNA, 22 nt, Human
gagagugggagauuuccagcag

SEQ ID NO: 172999 - RNA, 22 nt, Human
gagaugugguucaaggguguuu

SEQ ID NO: 173000 - RNA, 22 nt, Human
gagauggauuuuuuugccaguc

SEQ ID NO: 173001 - RNA, 22 nt, Human
gagcggcggugagaaguguggg

SEQ ID NO: 173002 - RNA, 22 nt, Human
gagcgugaggcagcuuucuaag

SEQ ID NO: 173003 - RNA, 22 nt, Human
gagcuggacauacaggaaacca

SEQ ID NO: 173004 - RNA, 22 nt, Human
gagcuggagaaacacauaagaa

SEQ ID NO: 173005 - RNA, 21 nt, Human
gcaaccagaccacagggcagu

SEQ ID NO: 173006 - RNA, 22 nt, Human
gagcuuuguuccgugguggcac

SEQ ID NO: 173007 - RNA, 19 nt, Human
gagccgcucccgcagccgg

SEQ ID NO: 173008 - RNA, 22 nt, Human
gagcgcgcaaucucuccagcug

SEQ ID NO: 173009 - RNA, 22 nt, Human
gauugcaucaauauuuagagua

SEQ ID NO: 173010 - RNA, 22 nt, Human
gauugcauaugcauucugauac

SEQ ID NO: 173011 - RNA, 20 nt, Human
gauuuaacgcugcgucuguc

SEQ ID NO: 173012 - RNA, 22 nt, Human
gauugggagugugacauuguau

SEQ ID NO: 173013 - RNA, 22 nt, Human
gauuggucacacaauaguauau

SEQ ID NO: 173014 - RNA, 22 nt, Human
gauuccugcuauucacagggcu

SEQ ID NO: 173015 - RNA, 22 nt, Human
gagccgcagcugcguagggucc

SEQ ID NO: 173016 - RNA, 22 nt, Human
gauucagagcugcaacaaagaa

SEQ ID NO: 173017 - RNA, 19 nt, Human
gagcaugacuggccuugca

SEQ ID NO: 173018 - RNA, 22 nt, Human
gauuaucaccaaauggccuccu

SEQ ID NO: 173019 - RNA, 22 nt, Human
gauuaagaaagauagaugugga

SEQ ID NO: 173020 - RNA, 22 nt, Human
gagcagggagaggcagagaggc

SEQ ID NO: 173021 - RNA, 22 nt, Human
gagcagguuauuagaaauggaa

SEQ ID NO: 173022 - RNA, 22 nt, Human
gagcaggucuuugguaaugcuu

SEQ ID NO: 173023 - RNA, 22 nt, Human
gaggacccuuaggucagacaga

SEQ ID NO: 173024 - RNA, 22 nt, Human
gaggacuucaggccuggccagg

SEQ ID NO: 173025 - RNA, 22 nt, Human
gaggacugguugggaaugugaa

SEQ ID NO: 173026 - RNA, 22 nt, Human
gcaaggaagcagaguugcuauc

SEQ ID NO: 173027 - RNA, 22 nt, Human
gcaaggacagaagcccacacag

SEQ ID NO: 173028 - RNA, 22 nt, Human
gaggagcaggcaggaucugguc

SEQ ID NO: 173029 - RNA, 22 nt, Human
gcaauuguauugucaagacaug

SEQ ID NO: 173030 - RNA, 22 nt, Human
gcaauagccuacaugcgucaga

SEQ ID NO: 173031 - RNA, 22 nt, Human
gcacaaguccuccgacagcacg

SEQ ID NO: 173032 - RNA, 22 nt, Human
gaggagggagcuggaagcucuu

SEQ ID NO: 173033 - RNA, 22 nt, Human
gcacagcuaugagcugaauugu

SEQ ID NO: 173034 - RNA, 22 nt, Human
gcacacuguaugcugguauuug

SEQ ID NO: 173035 - RNA, 22 nt, Human
gcacagaguguaaaaguuucau

SEQ ID NO: 173036 - RNA, 23 nt, Human
gcacuguuugaggagcacugugc

SEQ ID NO: 173037 - RNA, 21 nt, Human
gcagaacuaggacuugaacau

SEQ ID NO: 173038 - RNA, 22 nt, Human
gaggcuugccacuguccauggc

SEQ ID NO: 173039 - RNA, 22 nt, Human
gcacucugggucaucugcugcc

SEQ ID NO: 173040 - RNA, 21 nt, Human
gcacucagucacuacucaaga

SEQ ID NO: 173041 - RNA, 22 nt, Human
gaggcagaggaaacagcucauu

SEQ ID NO: 173042 - RNA, 22 nt, Human
gaggcagaggaugggacuguau

SEQ ID NO: 173043 - RNA, 22 nt, Human
gcaccacccaaaggcggggcuc

SEQ ID NO: 173044 - RNA, 22 nt, Human
gcacagucaacacuuauucacc

SEQ ID NO: 173045 - RNA, 22 nt, Human
gcacgugugugagagauaugaa

SEQ ID NO: 173046 - RNA, 22 nt, Human
gcacccagggcaggaagugagg

SEQ ID NO: 173047 - RNA, 22 nt, Human
gaggcccugagauugcugcccu

SEQ ID NO: 173048 - RNA, 22 nt, Human
gcagccucugcaguucaggagg

SEQ ID NO: 173049 - RNA, 22 nt, Human
gcagcguuaacauuuuuccugu

SEQ ID NO: 173050 - RNA, 22 nt, Human
gcagccuccggccuggcccccu

SEQ ID NO: 173051 - RNA, 22 nt, Human
gcaggaagauugcagaaggcug

SEQ ID NO: 173052 - RNA, 22 nt, Human
gcaggacuucuguuuaaccagu

SEQ ID NO: 173053 - RNA, 22 nt, Human
gcaggagggggccuggagccca

SEQ ID NO: 173054 - RNA, 22 nt, Human
gcaggcagauccagaagcacua

SEQ ID NO: 173055 - RNA, 22 nt, Human
gcaggcaggauucagagauaca

SEQ ID NO: 173056 - RNA, 22 nt, Human
gaggugauuccucccauguaau

SEQ ID NO: 173057 - RNA, 22 nt, Human
gaggugaacccaggugcuucac

SEQ ID NO: 173058 - RNA, 22 nt, Human
gaggucaugcagcucugaguuc

SEQ ID NO: 173059 - RNA, 22 nt, Human
gaggucggaagugaggguaacu

SEQ ID NO: 173060 - RNA, 22 nt, Human
gaggucagugugggggcaaggg

SEQ ID NO: 173061 - RNA, 22 nt, Human
gcagcauuaccaagacauggca

SEQ ID NO: 173062 - RNA, 22 nt, Human
gcagccagggaccuuugacuau

SEQ ID NO: 173063 - RNA, 22 nt, Human
gaggggaauguuccugagcugg

SEQ ID NO: 173064 - RNA, 22 nt, Human
gaggggacugucuggcuccgag

SEQ ID NO: 173065 - RNA, 22 nt, Human
gaggggcaagaaguuggccucu

SEQ ID NO: 173066 - RNA, 22 nt, Human
gaggggcacaguggggccuggg

SEQ ID NO: 173067 - RNA, 22 nt, Human
gcagaaguauuguacgguggga

SEQ ID NO: 173068 - RNA, 22 nt, Human
gagggggcggccccugugggca

SEQ ID NO: 173069 - RNA, 22 nt, Human
gagggggaaaagggcagcagag

SEQ ID NO: 173070 - RNA, 22 nt, Human
gaggggcucuugggcaugaagg

SEQ ID NO: 173071 - RNA, 21 nt, Human
gcagcaugagaaagccccaaa

SEQ ID NO: 173072 - RNA, 22 nt, Human
gaggguggggaauagacugcua

SEQ ID NO: 173073 - RNA, 22 nt, Human
gaggguggagccuccuggaagu

SEQ ID NO: 173074 - RNA, 22 nt, Human
gagggugugguauggauguguu

SEQ ID NO: 173075 - RNA, 22 nt, Human
gagggguuguuaacaaagaaua

SEQ ID NO: 173076 - RNA, 22 nt, Human
gaggggggcacuuguuuugacu

SEQ ID NO: 173077 - RNA, 22 nt, Human
gaggguaagcugggacuccucg

SEQ ID NO: 173078 - RNA, 22 nt, Human
gcagcagugugggcugaaccua

SEQ ID NO: 173079 - RNA, 22 nt, Human
gcagcaaucuucacagugucau

SEQ ID NO: 173080 - RNA, 22 nt, Human
gaggggcgaggacgcugaagua

SEQ ID NO: 173081 - RNA, 22 nt, Human
gaggggcggggcgggaggagag

SEQ ID NO: 173082 - RNA, 22 nt, Human
aaaaccugcaagaugaaaucag

SEQ ID NO: 173083 - RNA, 22 nt, Human
aaaaggauauuuggugcaaagc

SEQ ID NO: 173084 - RNA, 22 nt, Human
aaaaguuguaauauuuccuuua

SEQ ID NO: 173085 - RNA, 22 nt, Human
aaaagcgaagagaacugaaguu

SEQ ID NO: 173086 - RNA, 22 nt, Human
aaaagcauuauuagucugggug

SEQ ID NO: 173087 - RNA, 22 nt, Human
aaaaggacaguagccuugaggu

SEQ ID NO: 173088 - RNA, 23 nt, Human
aaacuacauuuauaguuuuucuc

SEQ ID NO: 173089 - RNA, 22 nt, Human
aaacgcaauuucuugcauguca

SEQ ID NO: 173090 - RNA, 22 nt, Human
aaaaucucagaaaaguuuaggu

SEQ ID NO: 173091 - RNA, 22 nt, Human
aaaauauucuauaucaaagaua

SEQ ID NO: 173092 - RNA, 22 nt, Human
aaacagcugcaguacacggccu

SEQ ID NO: 173093 - RNA, 22 nt, Human
aaacaccaagagcuagcuauua

SEQ ID NO: 173094 - RNA, 22 nt, Human
aaagaugaaguucagcgaagaa

SEQ ID NO: 173095 - RNA, 22 nt, Human
aaagccaagucugauuuuguug

SEQ ID NO: 173096 - RNA, 22 nt, Human
aaagcauuuguuucuccuggaa

SEQ ID NO: 173097 - RNA, 22 nt, Human
aaagccagggacagugugcaug

SEQ ID NO: 173098 - RNA, 22 nt, Human
aaagcccuccaggguauacauu

SEQ ID NO: 173099 - RNA, 22 nt, Human
aaagcugaaacgaaaugacaac

SEQ ID NO: 173100 - RNA, 22 nt, Human
aaagccaagguccauguacuuu

SEQ ID NO: 173101 - RNA, 22 nt, Human
aaagcagucuguuuuaaccuga

SEQ ID NO: 173102 - RNA, 22 nt, Human
aaaggggugguauuucuuuugg

SEQ ID NO: 173103 - RNA, 22 nt, Human
aaaggucagaugugucgaggag

SEQ ID NO: 173104 - RNA, 22 nt, Human
aaagggcugaaguagucucugu

SEQ ID NO: 173105 - RNA, 22 nt, Human
aaagaacguuucugggaaucag

SEQ ID NO: 173106 - RNA, 22 nt, Human
aaagacaauaauucucucuagc

SEQ ID NO: 173107 - RNA, 22 nt, Human
aaacgcauucuuacaugcuucc

SEQ ID NO: 173108 - RNA, 22 nt, Human
aaagcaaagaucuguagcccaa

SEQ ID NO: 173109 - RNA, 22 nt, Human
aaagacagccuguuggcuuucu

SEQ ID NO: 173110 - RNA, 23 nt, Human
aaagaggugaauccaggacaagc

SEQ ID NO: 173111 - RNA, 22 nt, Human
aaagagggaaggaaggagugaa

SEQ ID NO: 173112 - RNA, 22 nt, Human
aaagcauucuaaccgaucgacg

SEQ ID NO: 173113 - RNA, 20 nt, Human
aaauccuugggaguggugca

SEQ ID NO: 173114 - RNA, 22 nt, Human
aaaucuuucacauauuuuuuau

SEQ ID NO: 173115 - RNA, 22 nt, Human
aaaugcacaauaaaguaaaggc

SEQ ID NO: 173116 - RNA, 22 nt, Human
aaauaugguaucugccaaacua

SEQ ID NO: 173117 - RNA, 22 nt, Human
aaaucauguuaaagagggaguu

SEQ ID NO: 173118 - RNA, 22 nt, Human
aaauugcauuuuaaagguagau

SEQ ID NO: 173119 - RNA, 22 nt, Human
aacaaaacauuuuacgaauaua

SEQ ID NO: 173120 - RNA, 19 nt, Human
aacaaaauaguucuaguua

SEQ ID NO: 173121 - RNA, 22 nt, Human
aacaaagaaaagcuugagguuu

SEQ ID NO: 173122 - RNA, 22 nt, Human
aacagguucaagccuugcagca

SEQ ID NO: 173123 - RNA, 22 nt, Human
aaagucugaaaaaguuuguggg

SEQ ID NO: 173124 - RNA, 22 nt, Human
aaagguggugguuagggaauau

SEQ ID NO: 173125 - RNA, 22 nt, Human
aaaggugccucuuacaaggcuu

SEQ ID NO: 173126 - RNA, 22 nt, Human
aaagggaugauuucugaagaua

SEQ ID NO: 173127 - RNA, 23 nt, Human
aaaguacuuaaucugcaaaccac

SEQ ID NO: 173128 - RNA, 21 nt, Human
aauugccuaauauaugggaag

SEQ ID NO: 173129 - RNA, 22 nt, Human
aauuauucaugucugggcagcc

SEQ ID NO: 173130 - RNA, 22 nt, Human
aauuauugucuuuuuuaaaagc

SEQ ID NO: 173131 - RNA, 22 nt, Human
aauuucagaccaacgagucagg

SEQ ID NO: 173132 - RNA, 21 nt, Human
acaaaaccuaacuuggcugcu

SEQ ID NO: 173133 - RNA, 22 nt, Human
aauuugcuccaaugucaguucu

SEQ ID NO: 173134 - RNA, 22 nt, Human
acaaagugaaaagcaucgaauu

SEQ ID NO: 173135 - RNA, 22 nt, Human
acaaaucccuguaaacacagcu

SEQ ID NO: 173136 - RNA, 20 nt, Human
acaaccacugcucacaguuu

SEQ ID NO: 173137 - RNA, 22 nt, Human
acaacccacacguuccgggugg

SEQ ID NO: 173138 - RNA, 22 nt, Human
aaugugugggagaacagucuuu

SEQ ID NO: 173139 - RNA, 23 nt, Human
aaugggcggaaguguuaaguugc

SEQ ID NO: 173140 - RNA, 22 nt, Human
aauggcagauaauuuuccagau

SEQ ID NO: 173141 - RNA, 22 nt, Human
aaucccaguugacagaacuguu

SEQ ID NO: 173142 - RNA, 22 nt, Human
aaucauguguaaugggcagacc

SEQ ID NO: 173143 - RNA, 22 nt, Human
aaucacuuagaacccaggaagu

SEQ ID NO: 173144 - RNA, 22 nt, Human
aaugcugugauuuauuaaguau

SEQ ID NO: 173145 - RNA, 22 nt, Human
aaucgacuguagagacuuggcg

SEQ ID NO: 173146 - RNA, 22 nt, Human
aaucuacaaugaaaaaauguuu

SEQ ID NO: 173147 - RNA, 22 nt, Human
aauggaugauuaaauggaugaa

SEQ ID NO: 173148 - RNA, 22 nt, Human
aaugcugugggauagggcuccu

SEQ ID NO: 173149 - RNA, 22 nt, Human
aaugcuuuuugcgaaaugugca

SEQ ID NO: 173150 - RNA, 22 nt, Human
aauggaaaaagaacuguuuaaa

SEQ ID NO: 173151 - RNA, 22 nt, Human
aauggaaaaauccacagggaac

SEQ ID NO: 173152 - RNA, 22 nt, Human
acaguguuacuugauaguguau

SEQ ID NO: 173153 - RNA, 22 nt, Human
acauccagcagauuguccagag

SEQ ID NO: 173154 - RNA, 22 nt, Human
acagguuggagguguggaguca

SEQ ID NO: 173155 - RNA, 22 nt, Human
acagguuucuccccugguuauu

SEQ ID NO: 173156 - RNA, 19 nt, Human
acaggaaggaaaauuucaa

SEQ ID NO: 173157 - RNA, 22 nt, Human
acaggguauauaggcaaagcua

SEQ ID NO: 173158 - RNA, 22 nt, Human
acaggauuuucagggaagguga

SEQ ID NO: 173159 - RNA, 22 nt, Human
acaggcugcccgcuccccaccu

SEQ ID NO: 173160 - RNA, 22 nt, Human
acaggcgucgccugcucuugcc

SEQ ID NO: 173161 - RNA, 22 nt, Human
acagcugagaugcuacuugugg

SEQ ID NO: 173162 - RNA, 22 nt, Human
acagcuggaggucugugagcac

SEQ ID NO: 173163 - RNA, 22 nt, Human
acaggacgugugugcgcaugug

SEQ ID NO: 173164 - RNA, 22 nt, Human
acagagguuaggauggguugua

SEQ ID NO: 173165 - RNA, 19 nt, Human
acagccuguugguggggcu

SEQ ID NO: 173166 - RNA, 22 nt, Human
acagccacuaugacagauuuag

SEQ ID NO: 173167 - RNA, 20 nt, Human
acagccguaaugguccuugg

SEQ ID NO: 173168 - RNA, 22 nt, Human
acagccaacgucuuucuuacuu

SEQ ID NO: 173169 - RNA, 22 nt, Human
acagcucaggcccaucaacccc

SEQ ID NO: 173170 - RNA, 22 nt, Human
acagcugguugaaggggaccaa

SEQ ID NO: 173171 - RNA, 22 nt, Human
acaggaaaugaaaugguaucua

SEQ ID NO: 173172 - RNA, 22 nt, Human
acaggacaaaaaucuggauggc

SEQ ID NO: 173173 - RNA, 22 nt, Human
acagcaauccuggcagaggguu

SEQ ID NO: 173174 - RNA, 22 nt, Human
acagaugccagcuacaccaccg

SEQ ID NO: 173175 - RNA, 22 nt, Human
acagccacccuggaacgguugu

SEQ ID NO: 173176 - RNA, 22 nt, Human
acagcagguuauuguuauggca

SEQ ID NO: 173177 - RNA, 23 nt, Human
acagaggcaucagagcagcaggc

SEQ ID NO: 173178 - RNA, 23 nt, Human
acagcaagaggaccagaugugag

SEQ ID NO: 173179 - RNA, 22 nt, Human
acagacuugaccuuggagaggc

SEQ ID NO: 173180 - RNA, 22 nt, Human
acagacuuaguauccugcugcu

SEQ ID NO: 173181 - RNA, 22 nt, Human
acacgguggccagcaguaggug

SEQ ID NO: 173182 - RNA, 22 nt, Human
acacgugcaggagaauguagug

SEQ ID NO: 173183 - RNA, 22 nt, Human
acacucagaaaggcagagguuc

SEQ ID NO: 173184 - RNA, 22 nt, Human
acagacaucaucaacaucuucc

SEQ ID NO: 173185 - RNA, 22 nt, Human
acacgcacaccugugcacucgu

SEQ ID NO: 173186 - RNA, 20 nt, Human
acacaccugcucagacugag

SEQ ID NO: 173187 - RNA, 22 nt, Human
acacccuugcagacgguuccuu

SEQ ID NO: 173188 - RNA, 19 nt, Human
acacaccagugccugugac

SEQ ID NO: 173189 - RNA, 22 nt, Human
acacacaugccuuuccuaagua

SEQ ID NO: 173190 - RNA, 22 nt, Human
acacaagaaugugcacucagcc

SEQ ID NO: 173191 - RNA, 22 nt, Human
acacacagaaggaagccccacu

SEQ ID NO: 173192 - RNA, 22 nt, Human
acaaugugcuuaugaaggcagu

SEQ ID NO: 173193 - RNA, 22 nt, Human
acaaggccugagggugacagca

SEQ ID NO: 173194 - RNA, 22 nt, Human
acaaguuucauuguuuagaacc

SEQ ID NO: 173195 - RNA, 22 nt, Human
acaaucauuuuuccccuucagu

SEQ ID NO: 173196 - RNA, 21 nt, Human
acaaugaguuugaggcaucag

SEQ ID NO: 173197 - RNA, 22 nt, Human
acaaggccaagcauucuagcaa

SEQ ID NO: 173198 - RNA, 22 nt, Human
acaagaccagcagggagggugc

SEQ ID NO: 173199 - RNA, 22 nt, Human
acaaggaagaaaacauuacuuu

SEQ ID NO: 173200 - RNA, 22 nt, Human
aaguuccacuagugacccagaa

SEQ ID NO: 173201 - RNA, 20 nt, Human
aagugcuguuagcugccuga

SEQ ID NO: 173202 - RNA, 22 nt, Human
aagugcuggccuacucaaucga

SEQ ID NO: 173203 - RNA, 23 nt, Human
aagugcucaguggacagcauugc

SEQ ID NO: 173204 - RNA, 22 nt, Human
aagugauuuuccuacuugcuaa

SEQ ID NO: 173205 - RNA, 21 nt, Human
aaguacccuuuugcuacucag

SEQ ID NO: 173206 - RNA, 22 nt, Human
aauaaagcuugaaagcagggaa

SEQ ID NO: 173207 - RNA, 22 nt, Human
aaucacuggcuccucacggcaa

SEQ ID NO: 173208 - RNA, 22 nt, Human
aauaucuagccuuuagcagcuu

SEQ ID NO: 173209 - RNA, 22 nt, Human
aagugauuuucccaccaucuac

SEQ ID NO: 173210 - RNA, 22 nt, Human
aagugauuuagagagcucuuag

SEQ ID NO: 173211 - RNA, 22 nt, Human
aagugaaaaaagucaguacuga

SEQ ID NO: 173212 - RNA, 22 nt, Human
aagugaagccaauuuuuuuagg

SEQ ID NO: 173213 - RNA, 20 nt, Human
aagucuauuuagaguugcuu

SEQ ID NO: 173214 - RNA, 22 nt, Human
aaggugcugaggguccuggcuu

SEQ ID NO: 173215 - RNA, 22 nt, Human
aaggugccacuucccucagacu

SEQ ID NO: 173216 - RNA, 22 nt, Human
aagguggugaucaucuugaagg

SEQ ID NO: 173217 - RNA, 22 nt, Human
aaguagaaaaccgcacuggacu

SEQ ID NO: 173218 - RNA, 22 nt, Human
aagucccaucugccuccaugua

SEQ ID NO: 173219 - RNA, 18 nt, Human
aaguaguuugagauuguu

SEQ ID NO: 173220 - RNA, 23 nt, Human
aagggcgauuaacauucgcucga

SEQ ID NO: 173221 - RNA, 22 nt, Human
aaggggaauaguaggaccuggg

SEQ ID NO: 173222 - RNA, 22 nt, Human
aaggggauuuaagguaagaaga

SEQ ID NO: 173223 - RNA, 22 nt, Human
aaggugcauuaguuuggagggg

SEQ ID NO: 173224 - RNA, 23 nt, Human
aaggugaagccaccaggugagga

SEQ ID NO: 173225 - RNA, 22 nt, Human
aaggggaggccugcgcuuucgg

SEQ ID NO: 173226 - RNA, 22 nt, Human
aaggucuuggcucuggccgcac

SEQ ID NO: 173227 - RNA, 22 nt, Human
aagggcuucucgccugugugca

SEQ ID NO: 173228 - RNA, 22 nt, Human
aaggacaccaaacuaauuggga

SEQ ID NO: 173229 - RNA, 22 nt, Human
aaggcuuguugucacgcucuug

SEQ ID NO: 173230 - RNA, 22 nt, Human
aaggcugaccaguuuacacuuu

SEQ ID NO: 173231 - RNA, 22 nt, Human
aaggcuguuugagcacuggagc

SEQ ID NO: 173232 - RNA, 22 nt, Human
aaggaaaaccugacugaagaac

SEQ ID NO: 173233 - RNA, 22 nt, Human
aagauuugaaaguggugcauuu

SEQ ID NO: 173234 - RNA, 22 nt, Human
aagaucugaccgugauggcggc

SEQ ID NO: 173235 - RNA, 22 nt, Human
aagcagcauaugacagcaucca

SEQ ID NO: 173236 - RNA, 22 nt, Human
aagcagacugggccauaaggaa

SEQ ID NO: 173237 - RNA, 22 nt, Human
aagaugcaagcauuuugaacug

SEQ ID NO: 173238 - RNA, 22 nt, Human
aagaugaguuacaaaggaguaa

SEQ ID NO: 173239 - RNA, 22 nt, Human
aagaaguccuugaggcgcaccc

SEQ ID NO: 173240 - RNA, 22 nt, Human
aagaggaggcuggaauccuaaa

SEQ ID NO: 173241 - RNA, 22 nt, Human
aagaaggaaggcaagagauggg

SEQ ID NO: 173242 - RNA, 22 nt, Human
aaccaagcucaauggucugagu

SEQ ID NO: 173243 - RNA, 22 nt, Human
aagaaaagcaucuuuguaguag

SEQ ID NO: 173244 - RNA, 19 nt, Human
aagaacaguucuaauuuca

SEQ ID NO: 173245 - RNA, 22 nt, Human
aagaacaugggugugggcauuc

SEQ ID NO: 173246 - RNA, 22 nt, Human
aagaacaacugcuuuaaaagca

SEQ ID NO: 173247 - RNA, 22 nt, Human
aagaaaggcacaagaaagaaaa

SEQ ID NO: 173248 - RNA, 22 nt, Human
aagaaauacagaaauggcagua

SEQ ID NO: 173249 - RNA, 22 nt, Human
aaggccuaggaguugacauggg

SEQ ID NO: 173250 - RNA, 22 nt, Human
aaggcgaggggcacagcugaga

SEQ ID NO: 173251 - RNA, 22 nt, Human
aaggcaguuaauuuggcuagaa

SEQ ID NO: 173252 - RNA, 22 nt, Human
aaggauuuccaggccugcgccu

SEQ ID NO: 173253 - RNA, 22 nt, Human
aaggcacuugcccagagcugca

SEQ ID NO: 173254 - RNA, 22 nt, Human
aaggagcuuucauuacagccuu

SEQ ID NO: 173255 - RNA, 22 nt, Human
aaggacaaaacagcuguucuaa

SEQ ID NO: 173256 - RNA, 22 nt, Human
aagcuuugggcagaagaggauu

SEQ ID NO: 173257 - RNA, 22 nt, Human
aagcuguuagggagugguaggu

SEQ ID NO: 173258 - RNA, 22 nt, Human
aagcuguuauuucacagguuca

SEQ ID NO: 173259 - RNA, 22 nt, Human
aagcuuugaauauuagaccuug

SEQ ID NO: 173260 - RNA, 22 nt, Human
aagcugccugggaggaagggcu

SEQ ID NO: 173261 - RNA, 22 nt, Human
aagcugaguaggaaugguaggu

SEQ ID NO: 173262 - RNA, 22 nt, Human
aagcucuauaggagauacagua

SEQ ID NO: 173263 - RNA, 22 nt, Human
aagcucagcugguggugauugc

SEQ ID NO: 173264 - RNA, 18 nt, Human
aagcugcauuauuuuggc

SEQ ID NO: 173265 - RNA, 20 nt, Human
aagcuguguucaagauggga

SEQ ID NO: 173266 - RNA, 22 nt, Human
aagcucugggacugaggcuccu

SEQ ID NO: 173267 - RNA, 22 nt, Human
aagccuguugacagcugucagu

SEQ ID NO: 173268 - RNA, 22 nt, Human
aagcugcagacccccugucuca

SEQ ID NO: 173269 - RNA, 22 nt, Human
aagcgggcagcggccugcgcca

SEQ ID NO: 173270 - RNA, 22 nt, Human
aagcaugagguggugagugaca

SEQ ID NO: 173271 - RNA, 22 nt, Human
aagccucaugccagauccaggu

SEQ ID NO: 173272 - RNA, 22 nt, Human
aagcaggaaaugaaaugcuugc

SEQ ID NO: 173273 - RNA, 22 nt, Human
aagcagugacucucagaggcag

SEQ ID NO: 173274 - RNA, 22 nt, Human
aagcaaagucaucuagaguagu

SEQ ID NO: 173275 - RNA, 22 nt, Human
aagcgcggccgccgcggucgcu

SEQ ID NO: 173276 - RNA, 22 nt, Human
aagcacagggacucaggaccgg

SEQ ID NO: 173277 - RNA, 23 nt, Human
aagcaacagacuucaucagauau

SEQ ID NO: 173278 - RNA, 22 nt, Human
auaaauuugacagcucuucaug

SEQ ID NO: 173279 - RNA, 22 nt, Human
auaaaagcacaauagaguuaug

SEQ ID NO: 173280 - RNA, 22 nt, Human
auaaaaucugaagcaagaauaa

SEQ ID NO: 173281 - RNA, 22 nt, Human
auaaucuuuccagucaguuucc

SEQ ID NO: 173282 - RNA, 22 nt, Human
auaagccugccuuaucuccaga

SEQ ID NO: 173283 - RNA, 22 nt, Human
auacaugugugugcauacaugu

SEQ ID NO: 173284 - RNA, 22 nt, Human
auacaggcaguaagauucucag

SEQ ID NO: 173285 - RNA, 22 nt, Human
auacagccuaguuugaguccca

SEQ ID NO: 173286 - RNA, 22 nt, Human
aguuuuugccucgaauucugcg

SEQ ID NO: 173287 - RNA, 22 nt, Human
aguuuuguuuguuuguuuguua

SEQ ID NO: 173288 - RNA, 22 nt, Human
aguuuuuaacgccauguuugaa

SEQ ID NO: 173289 - RNA, 22 nt, Human
aguuuacccacuguugaaauua

SEQ ID NO: 173290 - RNA, 22 nt, Human
aguuucuugaagacugauguuu

SEQ ID NO: 173291 - RNA, 22 nt, Human
aguugguucgucucgccuugag

SEQ ID NO: 173292 - RNA, 21 nt, Human
aguuguacuguauagcagaug

SEQ ID NO: 173293 - RNA, 22 nt, Human
aguuguucucagcagaagaacu

SEQ ID NO: 173294 - RNA, 22 nt, Human
aguugguguuagaguuuuucag

SEQ ID NO: 173295 - RNA, 22 nt, Human
aguugggaaaugcugcaguagu

SEQ ID NO: 173296 - RNA, 22 nt, Human
aguugguauuuacugcaguugg

SEQ ID NO: 173297 - RNA, 22 nt, Human
aguugguggaagcuaagcuucu

SEQ ID NO: 173298 - RNA, 22 nt, Human
aguuguuuuucuuagauuuuag

SEQ ID NO: 173299 - RNA, 22 nt, Human
aguugcuucccuauucuuagca

SEQ ID NO: 173300 - RNA, 22 nt, Human
aguugcagguucacguaucuug

SEQ ID NO: 173301 - RNA, 22 nt, Human
aguugcugccagguccugggag

SEQ ID NO: 173302 - RNA, 22 nt, Human
aguucugggaggugcacgucca

SEQ ID NO: 173303 - RNA, 22 nt, Human
aguucuuugcucccugcuuuuu

SEQ ID NO: 173304 - RNA, 22 nt, Human
aguucccgcgggagggcgcagg

SEQ ID NO: 173305 - RNA, 22 nt, Human
aguuccucagaagggccuggga

SEQ ID NO: 173306 - RNA, 22 nt, Human
aguucuggcccugaaacaggga

SEQ ID NO: 173307 - RNA, 22 nt, Human
agugccuuaaaggucuugcagc

SEQ ID NO: 173308 - RNA, 22 nt, Human
agugcuuuauguuguugugcaa

SEQ ID NO: 173309 - RNA, 22 nt, Human
agugcucagggaaugccacuga

SEQ ID NO: 173310 - RNA, 23 nt, Human
aguggaggucgggguggggagac

SEQ ID NO: 173311 - RNA, 22 nt, Human
aguggagguuacagcuguacau

SEQ ID NO: 173312 - RNA, 23 nt, Human
aguggccgaucaucucgggcuug

SEQ ID NO: 173313 - RNA, 22 nt, Human
aguggugccuaagcgcggaggc

SEQ ID NO: 173314 - RNA, 19 nt, Human
agugggcaaggaagaugac

SEQ ID NO: 173315 - RNA, 22 nt, Human
aguggcuguuccaggugaggac

SEQ ID NO: 173316 - RNA, 22 nt, Human
agugcccuugggcgguucacag

SEQ ID NO: 173317 - RNA, 22 nt, Human
agugcgagaugaggacagaagc

SEQ ID NO: 173318 - RNA, 22 nt, Human
agugccuucuagaaucucuuaa

SEQ ID NO: 173319 - RNA, 22 nt, Human
agugccuggcugauggguccug

SEQ ID NO: 173320 - RNA, 22 nt, Human
agugccauggcugcuagauggc

SEQ ID NO: 173321 - RNA, 22 nt, Human
aguggcuagaucaugagugagc

SEQ ID NO: 173322 - RNA, 22 nt, Human
agugccaucuuuaacuguccca

SEQ ID NO: 173323 - RNA, 23 nt, Human
agugaucuguguuugaagaaugc

SEQ ID NO: 173324 - RNA, 19 nt, Human
agugaacuccauaucaggu

SEQ ID NO: 173325 - RNA, 22 nt, Human
agucugaguaucucugagccag

SEQ ID NO: 173326 - RNA, 22 nt, Human
aguaggagcucaauuaaauguu

SEQ ID NO: 173327 - RNA, 22 nt, Human
aguaggagugacaagcagguca

SEQ ID NO: 173328 - RNA, 22 nt, Human
agugaagauagagccaggucug

SEQ ID NO: 173329 - RNA, 22 nt, Human
agugagcuuuuaaaauuuacca

SEQ ID NO: 173330 - RNA, 22 nt, Human
agugaugcuuuggagaagaucc

SEQ ID NO: 173331 - RNA, 23 nt, Human
agugaugcaguaucugggucugu

SEQ ID NO: 173332 - RNA, 22 nt, Human
agugauguaauggugaauguga

SEQ ID NO: 173333 - RNA, 20 nt, Human
agugaguuaucagcuacagu

SEQ ID NO: 173334 - RNA, 22 nt, Human
agugaucugcugcagugcucug

SEQ ID NO: 173335 - RNA, 22 nt, Human
agugaugauccaaaugaauuga

SEQ ID NO: 173336 - RNA, 22 nt, Human
aguucaugcuuagaucucauuu

SEQ ID NO: 173337 - RNA, 22 nt, Human
aguucaugugguuuaacuuaau

SEQ ID NO: 173338 - RNA, 22 nt, Human
aguucaauuguuuuguaaaagu

SEQ ID NO: 173339 - RNA, 17 nt, Human
aguuacugcacuugcca

SEQ ID NO: 173340 - RNA, 22 nt, Human
aguguucaauuugagcucaaag

SEQ ID NO: 173341 - RNA, 23 nt, Human
aguguucagcauguaguaaauac

SEQ ID NO: 173342 - RNA, 22 nt, Human
aguguucaucacaggcuagaga

SEQ ID NO: 173343 - RNA, 22 nt, Human
aguguuugggagagggugugag

SEQ ID NO: 173344 - RNA, 22 nt, Human
agugugaguuacaaagugugaa

SEQ ID NO: 173345 - RNA, 22 nt, Human
agugucugcgggcagaggagcg

SEQ ID NO: 173346 - RNA, 22 nt, Human
aguggcuggcaggggagggucc

SEQ ID NO: 173347 - RNA, 22 nt, Human
aguggcugugaaauacauggga

SEQ ID NO: 173348 - RNA, 22 nt, Human
aguggggcccaagaaucugcau

SEQ ID NO: 173349 - RNA, 22 nt, Human
agugucuuuagucgcugagcaa

SEQ ID NO: 173350 - RNA, 22 nt, Human
aguguggccaaugaggaugggc

SEQ ID NO: 173351 - RNA, 22 nt, Human
agggggccucucccgcggcgcc

SEQ ID NO: 173352 - RNA, 22 nt, Human
agggggccuauucuuggacugc

SEQ ID NO: 173353 - RNA, 22 nt, Human
agggguuugggaaggguuaggg

SEQ ID NO: 173354 - RNA, 22 nt, Human
agggucgucuggguccgugggg

SEQ ID NO: 173355 - RNA, 22 nt, Human
aggucugcccaggaugcugcuu

SEQ ID NO: 173356 - RNA, 22 nt, Human
aggucgugggugagagagagac

SEQ ID NO: 173357 - RNA, 22 nt, Human
aggggcagaggaugauggaaga

SEQ ID NO: 173358 - RNA, 20 nt, Human
aggggcuguaguuagaugac

SEQ ID NO: 173359 - RNA, 22 nt, Human
aggggcugagaguuugaugugg

SEQ ID NO: 173360 - RNA, 22 nt, Human
aggguguacauuuguuggugaa

SEQ ID NO: 173361 - RNA, 22 nt, Human
aggguguuugggagcagaggau

SEQ ID NO: 173362 - RNA, 22 nt, Human
aggguggaggacaggccaguga

SEQ ID NO: 173363 - RNA, 22 nt, Human
aggcuguagaucuagacaugua

SEQ ID NO: 173364 - RNA, 22 nt, Human
aggcugucucagccugcuugca

SEQ ID NO: 173365 - RNA, 20 nt, Human
aggcuccuccaggaugugug

SEQ ID NO: 173366 - RNA, 22 nt, Human
agggcacuuccucugggucccu

SEQ ID NO: 173367 - RNA, 22 nt, Human
agggcaguuaugaaugucucca

SEQ ID NO: 173368 - RNA, 21 nt, Human
agggccagaucaccaaggagc

SEQ ID NO: 173369 - RNA, 22 nt, Human
agggccaagaaagaguggcuuu

SEQ ID NO: 173370 - RNA, 22 nt, Human
agggcaggguuggugcuggugc

SEQ ID NO: 173371 - RNA, 22 nt, Human
agggaguagggagccaugggug

SEQ ID NO: 173372 - RNA, 22 nt, Human
agggcaguguggugggacugac

SEQ ID NO: 173373 - RNA, 22 nt, Human
agggaugugcagggcuugccau

SEQ ID NO: 173374 - RNA, 22 nt, Human
agggcuguuggugcccucgagg

SEQ ID NO: 173375 - RNA, 22 nt, Human
agggcugggcuuggcaggcugg

SEQ ID NO: 173376 - RNA, 22 nt, Human
agggcaugugaaguaaccuagg

SEQ ID NO: 173377 - RNA, 23 nt, Human
agggcacugaagcuggaauuggg

SEQ ID NO: 173378 - RNA, 22 nt, Human
agggccagcagcuuggccaacc

SEQ ID NO: 173379 - RNA, 21 nt, Human
aguaccugugugccugugugu

SEQ ID NO: 173380 - RNA, 22 nt, Human
agguuuuugucauuuucuggua

SEQ ID NO: 173381 - RNA, 22 nt, Human
agguuuggaaguggcgauccau

SEQ ID NO: 173382 - RNA, 22 nt, Human
agguuuuacuuuuuuuggaggu

SEQ ID NO: 173383 - RNA, 22 nt, Human
agguuguaucauaugaaacugu

SEQ ID NO: 173384 - RNA, 18 nt, Human
agguugcaucugugcaga

SEQ ID NO: 173385 - RNA, 22 nt, Human
agguggcuaugaggaugcaguc

SEQ ID NO: 173386 - RNA, 22 nt, Human
agguuuggccuuggggggaguu

SEQ ID NO: 173387 - RNA, 20 nt, Human
agguuugcuguauaucaugg

SEQ ID NO: 173388 - RNA, 22 nt, Human
agguuguugagaucaucuggcu

SEQ ID NO: 173389 - RNA, 22 nt, Human
aggugagaacguggaggggcgg

SEQ ID NO: 173390 - RNA, 22 nt, Human
agguggcguauguguucguguu

SEQ ID NO: 173391 - RNA, 19 nt, Human
aggugaugugacucuagaa

SEQ ID NO: 173392 - RNA, 22 nt, Human
aggugcucaguaauugauuguu

SEQ ID NO: 173393 - RNA, 22 nt, Human
aggugcccaaaucuucuguuuu

SEQ ID NO: 173394 - RNA, 22 nt, Human
aggugcacugguacaggcuuca

SEQ ID NO: 173395 - RNA, 22 nt, Human
aggugcauuuacuuggggcccu

SEQ ID NO: 173396 - RNA, 22 nt, Human
aggugcuuaaagaauguguggu

SEQ ID NO: 173397 - RNA, 22 nt, Human
aggugggucgcaggcaucagug

SEQ ID NO: 173398 - RNA, 22 nt, Human
agguguaauuacucuugcaguu

SEQ ID NO: 173399 - RNA, 22 nt, Human
agguggugacgaugcuccguac

SEQ ID NO: 173400 - RNA, 21 nt, Human
aggugguuccaauaaguaggu

SEQ ID NO: 173401 - RNA, 20 nt, Human
aggauuauguacauggaugc

SEQ ID NO: 173402 - RNA, 22 nt, Human
aggacaaaggaccagaucugga

SEQ ID NO: 173403 - RNA, 22 nt, Human
aggagguagggugugaaacagc

SEQ ID NO: 173404 - RNA, 22 nt, Human
aggauugucuccugugaugugc

SEQ ID NO: 173405 - RNA, 22 nt, Human
aggcaacagacaggcuugguuc

SEQ ID NO: 173406 - RNA, 22 nt, Human
aggauggauagcaaggaagccg

SEQ ID NO: 173407 - RNA, 22 nt, Human
aggcaagauuaggaccagaaga

SEQ ID NO: 173408 - RNA, 22 nt, Human
aggcacagaauccagucugcug

SEQ ID NO: 173409 - RNA, 22 nt, Human
aggaggcaaaugagagggcuca

SEQ ID NO: 173410 - RNA, 22 nt, Human
aggagcugccggauggggcaug

SEQ ID NO: 173411 - RNA, 22 nt, Human
aggaauuuuaauaugcuugucu

SEQ ID NO: 173412 - RNA, 22 nt, Human
aggagcacugggcaugucaccc

SEQ ID NO: 173413 - RNA, 22 nt, Human
aggacacagaguauggaagugu

SEQ ID NO: 173414 - RNA, 22 nt, Human
aggacaagacaaggaccagaga

SEQ ID NO: 173415 - RNA, 22 nt, Human
aggaauugucgucauguauaau

SEQ ID NO: 173416 - RNA, 22 nt, Human
aggaaauaggaccagacaaagc

SEQ ID NO: 173417 - RNA, 22 nt, Human
aggaauuugggguuacaugaug

SEQ ID NO: 173418 - RNA, 22 nt, Human
agcggcaggacgucuucuucga

SEQ ID NO: 173419 - RNA, 22 nt, Human
agcggccucgcugccugcucag

SEQ ID NO: 173420 - RNA, 22 nt, Human
agcgcugugaaggcugggccac

SEQ ID NO: 173421 - RNA, 21 nt, Human
aggcauuuucuuggagauucu

SEQ ID NO: 173422 - RNA, 22 nt, Human
aggccaggcgccggcgcgagac

SEQ ID NO: 173423 - RNA, 22 nt, Human
aggcagugccuggaccccagcu

SEQ ID NO: 173424 - RNA, 21 nt, Human
aggccaaguuggauuucuuca

SEQ ID NO: 173425 - RNA, 22 nt, Human
aggcaguguggagggcuguugc

SEQ ID NO: 173426 - RNA, 22 nt, Human
aggcagugguguuugcuggugg

SEQ ID NO: 173427 - RNA, 22 nt, Human
aggcauguugcuucgggcuuug

SEQ ID NO: 173428 - RNA, 22 nt, Human
aggccagggacaaugaggcaga

SEQ ID NO: 173429 - RNA, 22 nt, Human
aggccacucagggggccaagau

SEQ ID NO: 173430 - RNA, 22 nt, Human
aggcugcucucgccggcggugu

SEQ ID NO: 173431 - RNA, 22 nt, Human
aggcguggcuucugcuggguug

SEQ ID NO: 173432 - RNA, 22 nt, Human
aggcugggaaguguguccugag

SEQ ID NO: 173433 - RNA, 22 nt, Human
aggccgagaugacagagccacu

SEQ ID NO: 173434 - RNA, 20 nt, Human
aggccgcccgcugccgcuuc

SEQ ID NO: 173435 - RNA, 22 nt, Human
aggcagaugggagcuggaaguu

SEQ ID NO: 173436 - RNA, 23 nt, Human
aggcaagaacggguuguucaccc

SEQ ID NO: 173437 - RNA, 19 nt, Human
aggcagccccaacuugcau

SEQ ID NO: 173438 - RNA, 20 nt, Human
aggcagacaaggagucuguu

SEQ ID NO: 173439 - RNA, 22 nt, Human
aggcagagauggcugcagggcc

SEQ ID NO: 173440 - RNA, 22 nt, Human
aggcagagaggucuuccuggaa

SEQ ID NO: 173441 - RNA, 21 nt, Human
aggcagcgauuuucauauugc

SEQ ID NO: 173442 - RNA, 23 nt, Human
aggcagcaugcaacaggccauuu

SEQ ID NO: 173443 - RNA, 22 nt, Human
aggcaggcucaaugcccagucu

SEQ ID NO: 173444 - RNA, 22 nt, Human
aggcagcagggagggagaaaug

SEQ ID NO: 173445 - RNA, 22 nt, Human
aggcaggggagcuggaagggua

SEQ ID NO: 173446 - RNA, 22 nt, Human
aggcaggauuugcgaugugguu

SEQ ID NO: 173447 - RNA, 22 nt, Human
aggcaggagcugugguggugag

SEQ ID NO: 173448 - RNA, 22 nt, Human
aggcaguguguagcuggaagag

SEQ ID NO: 173449 - RNA, 22 nt, Human
aggcaucguguuuuucugcuuu

SEQ ID NO: 173450 - RNA, 22 nt, Human
aggcaguggcuuuuguuguguu

SEQ ID NO: 173451 - RNA, 22 nt, Human
aggcaguggagcuggaauaggc

SEQ ID NO: 173452 - RNA, 23 nt, Human
aggcagaguccuggggcacagcc

SEQ ID NO: 173453 - RNA, 22 nt, Human
acgcgcuccagcaggugcuuca

SEQ ID NO: 173454 - RNA, 22 nt, Human
acgccugccuguacuugugggg

SEQ ID NO: 173455 - RNA, 22 nt, Human
acgccaggagcuucuccguuca

SEQ ID NO: 173456 - RNA, 22 nt, Human
acgcauguacuuguaugcaaug

SEQ ID NO: 173457 - RNA, 22 nt, Human
acgucaucguugucaucgucau

SEQ ID NO: 173458 - RNA, 22 nt, Human
acaucccccuacuuguguccug

SEQ ID NO: 173459 - RNA, 22 nt, Human
acaucucacuucuuugaaggcu

SEQ ID NO: 173460 - RNA, 22 nt, Human
acagugguggagggcuguccug

SEQ ID NO: 173461 - RNA, 22 nt, Human
acagucuuggauuccaggaguc

SEQ ID NO: 173462 - RNA, 20 nt, Human
acgccgcgaggugagcuggu

SEQ ID NO: 173463 - RNA, 22 nt, Human
acgccggguaaggucauucugc

SEQ ID NO: 173464 - RNA, 22 nt, Human
acgccuugagccuugccugaau

SEQ ID NO: 173465 - RNA, 22 nt, Human
acgugcauuacucaaaucucaa

SEQ ID NO: 173466 - RNA, 22 nt, Human
acuaggugggugucacugacuc

SEQ ID NO: 173467 - RNA, 22 nt, Human
acuaggaaguaaauaugucauc

SEQ ID NO: 173468 - RNA, 22 nt, Human
acgguuuggggaggaggauccc

SEQ ID NO: 173469 - RNA, 22 nt, Human
acguccgcugauucuuuggaag

SEQ ID NO: 173470 - RNA, 22 nt, Human
acgguguuucucguucaggguu

SEQ ID NO: 173471 - RNA, 20 nt, Human
acuaccaugcaauuccgcuu

SEQ ID NO: 173472 - RNA, 22 nt, Human
acuauggaguucagaucuugag

SEQ ID NO: 173473 - RNA, 22 nt, Human
acugaucuguguaauauguuac

SEQ ID NO: 173474 - RNA, 22 nt, Human
acugauuccaagcuuguggagg

SEQ ID NO: 173475 - RNA, 22 nt, Human
acugaugacaaugugaguguuc

SEQ ID NO: 173476 - RNA, 22 nt, Human
acugcugauuauugaaguagag

SEQ ID NO: 173477 - RNA, 22 nt, Human
acugagaacuuggggacagagg

SEQ ID NO: 173478 - RNA, 22 nt, Human
acugacuacauguccugucauu

SEQ ID NO: 173479 - RNA, 22 nt, Human
acugaaggcuggaccaugcauc

SEQ ID NO: 173480 - RNA, 22 nt, Human
acugaauguucucaaaggggag

SEQ ID NO: 173481 - RNA, 22 nt, Human
acugaacuaaagaaaugggcaa

SEQ ID NO: 173482 - RNA, 22 nt, Human
acugaaauuuauauuuugggca

SEQ ID NO: 173483 - RNA, 22 nt, Human
acugaaauggggacaguccuua

SEQ ID NO: 173484 - RNA, 22 nt, Human
acucugagguuuuccaaguaca

SEQ ID NO: 173485 - RNA, 22 nt, Human
acugaaaguugaugagucacug

SEQ ID NO: 173486 - RNA, 22 nt, Human
acucagcaccuagaaagugugc

SEQ ID NO: 173487 - RNA, 22 nt, Human
acucaaacuuuuuguggacauu

SEQ ID NO: 173488 - RNA, 22 nt, Human
acucagaguuugcguuccauac

SEQ ID NO: 173489 - RNA, 22 nt, Human
acucaguaacuguuugcugaau

SEQ ID NO: 173490 - RNA, 22 nt, Human
acucaucauuuuacggagcagc

SEQ ID NO: 173491 - RNA, 21 nt, Human
acuccagccacugacugucuc

SEQ ID NO: 173492 - RNA, 21 nt, Human
acucaucuuuuuggagaccag

SEQ ID NO: 173493 - RNA, 22 nt, Human
acucucugcugcugagcuuggg

SEQ ID NO: 173494 - RNA, 22 nt, Human
acucggaggccaaggccaacgg

SEQ ID NO: 173495 - RNA, 22 nt, Human
acucgggggccgcugcagggag

SEQ ID NO: 173496 - RNA, 22 nt, Human
acucggcggccucgagugcugg

SEQ ID NO: 173497 - RNA, 22 nt, Human
acucugagaugugucuugauuc

SEQ ID NO: 173498 - RNA, 22 nt, Human
acucugcaguaaggaauuguuu

SEQ ID NO: 173499 - RNA, 22 nt, Human
acucuguaauucugaagcaccu

SEQ ID NO: 173500 - RNA, 22 nt, Human
acucucaauuaucuggacugaa

SEQ ID NO: 173501 - RNA, 22 nt, Human
acucugaaaggcuacaaaugcu

SEQ ID NO: 173502 - RNA, 21 nt, Human
acuuccacaucacugaguaga

SEQ ID NO: 173503 - RNA, 22 nt, Human
acuuccuuuuuuggggauagca

SEQ ID NO: 173504 - RNA, 22 nt, Human
acuucugcccuggcgagggcgu

SEQ ID NO: 173505 - RNA, 23 nt, Human
acuggauuguucuugggcgcuga

SEQ ID NO: 173506 - RNA, 22 nt, Human
acuggauuuugugguguaucuu

SEQ ID NO: 173507 - RNA, 22 nt, Human
acuucaggacggcaguggaggg

SEQ ID NO: 173508 - RNA, 16 nt, Human
acuuguuguuuugguu

SEQ ID NO: 173509 - RNA, 22 nt, Human
acuugauggaguuucacuguau

SEQ ID NO: 173510 - RNA, 22 nt, Human
acuugaugcauauggaagagca

SEQ ID NO: 173511 - RNA, 17 nt, Human
acuuaagacaguggaaa

SEQ ID NO: 173512 - RNA, 22 nt, Human
acuugagcuugaaagguaugcu

SEQ ID NO: 173513 - RNA, 22 nt, Human
acuguucacccagcacuagcag

SEQ ID NO: 173514 - RNA, 22 nt, Human
acuuugccuucuuacuguguug

SEQ ID NO: 173515 - RNA, 22 nt, Human
agaaauggccagacuugccccu

SEQ ID NO: 173516 - RNA, 22 nt, Human
agaaacaagcccuagaaguccu

SEQ ID NO: 173517 - RNA, 22 nt, Human
agaaaauagguaguagacgggc

SEQ ID NO: 173518 - RNA, 22 nt, Human
acuuuggugcgaagucacuuua

SEQ ID NO: 173519 - RNA, 22 nt, Human
agacaaggggauuuuugauggu

SEQ ID NO: 173520 - RNA, 22 nt, Human
agacaauuccauccuacguggg

SEQ ID NO: 173521 - RNA, 22 nt, Human
agacccugauucugcuggcggu

SEQ ID NO: 173522 - RNA, 22 nt, Human
agaauuuguaucuacggugugc

SEQ ID NO: 173523 - RNA, 22 nt, Human
agacaagagcugaggacauauu

SEQ ID NO: 173524 - RNA, 22 nt, Human
agacacauuuucagcucugcca

SEQ ID NO: 173525 - RNA, 22 nt, Human
agaccccuggggaggauuauag

SEQ ID NO: 173526 - RNA, 22 nt, Human
agaagguggaguagaacaagcu

SEQ ID NO: 173527 - RNA, 22 nt, Human
agaauguaagaaugcaaagauu

SEQ ID NO: 173528 - RNA, 22 nt, Human
agaaucaggaagacagccuggc

SEQ ID NO: 173529 - RNA, 22 nt, Human
agaaucagagcagaaucuucau

SEQ ID NO: 173530 - RNA, 16 nt, Human
agaaggcuaguaacag

SEQ ID NO: 173531 - RNA, 21 nt, Human
agaagcggucgaaucgcagac

SEQ ID NO: 173532 - RNA, 22 nt, Human
agaauacuaauaagggauuugc

SEQ ID NO: 173533 - RNA, 22 nt, Human
agaauacaauuguucaguaaua

SEQ ID NO: 173534 - RNA, 22 nt, Human
agaaggcaucugcucgcuucca

SEQ ID NO: 173535 - RNA, 22 nt, Human
agaaggcagaaaagcuuuacaa

SEQ ID NO: 173536 - RNA, 22 nt, Human
agaacccaaggcccagggaugu

SEQ ID NO: 173537 - RNA, 22 nt, Human
agaaccaauacuacagcaagua

SEQ ID NO: 173538 - RNA, 22 nt, Human
agaaaaggaagcuuagacugua

SEQ ID NO: 173539 - RNA, 22 nt, Human
agaagggcugcuuagaauauac

SEQ ID NO: 173540 - RNA, 19 nt, Human
agaacccccuuccucugcu

SEQ ID NO: 173541 - RNA, 22 nt, Human
agaagauucagcaguagggugg

SEQ ID NO: 173542 - RNA, 22 nt, Human
agaagaucccugugguuacgac

SEQ ID NO: 173543 - RNA, 22 nt, Human
agaguggcaccuuaccugagac

SEQ ID NO: 173544 - RNA, 22 nt, Human
agaguguguggggcugagguca

SEQ ID NO: 173545 - RNA, 21 nt, Human
agagugugugcaucauauuug

SEQ ID NO: 173546 - RNA, 22 nt, Human
agauauguuaggcuuguucccu

SEQ ID NO: 173547 - RNA, 22 nt, Human
agagcagcuuuucggaaccacu

SEQ ID NO: 173548 - RNA, 22 nt, Human
agagcccagaucccacccugga

SEQ ID NO: 173549 - RNA, 22 nt, Human
agagcucguggcucauugagga

SEQ ID NO: 173550 - RNA, 22 nt, Human
agagcacaggguuuugugccgg

SEQ ID NO: 173551 - RNA, 23 nt, Human
agaggccaacuucuugccccucc

SEQ ID NO: 173552 - RNA, 22 nt, Human
agaggcaugaacucccguagcc

SEQ ID NO: 173553 - RNA, 22 nt, Human
agaggcaggcagcagagaagau

SEQ ID NO: 173554 - RNA, 22 nt, Human
agagggcaggcugguugggguc

SEQ ID NO: 173555 - RNA, 22 nt, Human
agagggagccugcacagcuuuc

SEQ ID NO: 173556 - RNA, 22 nt, Human
agacgcgcagaaggaagcggcc

SEQ ID NO: 173557 - RNA, 22 nt, Human
agaccguguguggguugcggug

SEQ ID NO: 173558 - RNA, 22 nt, Human
agagcagaggcauggccguggg

SEQ ID NO: 173559 - RNA, 21 nt, Human
agauguucaguguccuaaccc

SEQ ID NO: 173560 - RNA, 22 nt, Human
agcaagggucucucauggcuug

SEQ ID NO: 173561 - RNA, 22 nt, Human
agauguugucucuuacguuuga

SEQ ID NO: 173562 - RNA, 22 nt, Human
agauucgucuuuaauucaccau

SEQ ID NO: 173563 - RNA, 22 nt, Human
agauugaugugaccauuggaag

SEQ ID NO: 173564 - RNA, 22 nt, Human
agcaaaguacugagcucaaagg

SEQ ID NO: 173565 - RNA, 19 nt, Human
agauggcaaaaugcaaaga

SEQ ID NO: 173566 - RNA, 22 nt, Human
agauggcuccaguguccagagg

SEQ ID NO: 173567 - RNA, 20 nt, Human
agaugcccaacucuguuuug

SEQ ID NO: 173568 - RNA, 21 nt, Human
agaugcaguuugcaggugggu

SEQ ID NO: 173569 - RNA, 22 nt, Human
agauucucccuccuggcgcugu

SEQ ID NO: 173570 - RNA, 22 nt, Human
agaugaccaguaagugguugaa

SEQ ID NO: 173571 - RNA, 23 nt, Human
agaugaugaauaaagagugagga

SEQ ID NO: 173572 - RNA, 22 nt, Human
agaugaugugugucuucagcua

SEQ ID NO: 173573 - RNA, 22 nt, Human
agauuauuuaagacaggaacca

SEQ ID NO: 173574 - RNA, 21 nt, Human
agaugaggauacugaggccua

SEQ ID NO: 173575 - RNA, 22 nt, Human
agauggaguccugaagccagaa

SEQ ID NO: 173576 - RNA, 22 nt, Human
agccauggagaacagacuugaa

SEQ ID NO: 173577 - RNA, 22 nt, Human
agccauggaggaugugcagcau

SEQ ID NO: 173578 - RNA, 22 nt, Human
agcccccaaaauguuugccugc

SEQ ID NO: 173579 - RNA, 22 nt, Human
agcccugugugcuuguguuccu

SEQ ID NO: 173580 - RNA, 22 nt, Human
agccccaauuacagcugugcug

SEQ ID NO: 173581 - RNA, 22 nt, Human
agccacagucuguagccagcuu

SEQ ID NO: 173582 - RNA, 22 nt, Human
agccacacuuagucacaaagau

SEQ ID NO: 173583 - RNA, 22 nt, Human
agccagauuuuuugagaggcga

SEQ ID NO: 173584 - RNA, 22 nt, Human
agccaugcuguuuugccuggga

SEQ ID NO: 173585 - RNA, 22 nt, Human
agccagugucgugugacaugag

SEQ ID NO: 173586 - RNA, 21 nt, Human
agccagguuuccuuugaagag

SEQ ID NO: 173587 - RNA, 22 nt, Human
agccagugcagcuggaaauuca

SEQ ID NO: 173588 - RNA, 22 nt, Human
agccauggagauguggguuggg

SEQ ID NO: 173589 - RNA, 22 nt, Human
agcccugaccuguccuguucug

SEQ ID NO: 173590 - RNA, 22 nt, Human
agcccagguggagugugugggg

SEQ ID NO: 173591 - RNA, 22 nt, Human
agccccggugagggaguccugu

SEQ ID NO: 173592 - RNA, 22 nt, Human
agccuggacagcuacggagaac

SEQ ID NO: 173593 - RNA, 22 nt, Human
agccugaaccaauauagcagcc

SEQ ID NO: 173594 - RNA, 22 nt, Human
agccucucugaugugacagcua

SEQ ID NO: 173595 - RNA, 22 nt, Human
agcgacuugacagacauguccu

SEQ ID NO: 173596 - RNA, 22 nt, Human
agccgcugaauuugaaacaagc

SEQ ID NO: 173597 - RNA, 22 nt, Human
agccggccucggacagagggag

SEQ ID NO: 173598 - RNA, 22 nt, Human
agccgcgcagccucauuaagga

SEQ ID NO: 173599 - RNA, 22 nt, Human
agcccuuucuuguuuaacugca

SEQ ID NO: 173600 - RNA, 21 nt, Human
agccgggacaacguggacccc

SEQ ID NO: 173601 - RNA, 22 nt, Human
agccuacauuugacuauagucu

SEQ ID NO: 173602 - RNA, 22 nt, Human
agccuggagcaggcucugcucu

SEQ ID NO: 173603 - RNA, 22 nt, Human
agccugagucugcacauagaac

SEQ ID NO: 173604 - RNA, 22 nt, Human
agccugugcuguguuugcucca

SEQ ID NO: 173605 - RNA, 22 nt, Human
agcgcggccuuacacccagggg

SEQ ID NO: 173606 - RNA, 21 nt, Human
agcgcugcauccaccauggcu

SEQ ID NO: 173607 - RNA, 22 nt, Human
agcgcgcggggcugcggcaggg

SEQ ID NO: 173608 - RNA, 19 nt, Human
agcgccucuacugcaugga

SEQ ID NO: 173609 - RNA, 22 nt, Human
agcgccgcugugauuggugagg

SEQ ID NO: 173610 - RNA, 22 nt, Human
agcgcccguugagucgcgcggu

SEQ ID NO: 173611 - RNA, 22 nt, Human
agcacuugggugauaguacuuu

SEQ ID NO: 173612 - RNA, 22 nt, Human
agcaaggagcugaaaccgggcu

SEQ ID NO: 173613 - RNA, 22 nt, Human
agcaacauggaguuugugcgca

SEQ ID NO: 173614 - RNA, 22 nt, Human
agcacauguuucuuuugcaauu

SEQ ID NO: 173615 - RNA, 22 nt, Human
agcaaggguugguuuucugaca

SEQ ID NO: 173616 - RNA, 22 nt, Human
agcaaagccucuuugaaaaaaa

SEQ ID NO: 173617 - RNA, 22 nt, Human
agauuuggaauggggguucaua

SEQ ID NO: 173618 - RNA, 22 nt, Human
agcagcaaugacaauucaacca

SEQ ID NO: 173619 - RNA, 22 nt, Human
agcacgcccaccuccugcggcg

SEQ ID NO: 173620 - RNA, 22 nt, Human
agcaccuuguucagaucuuaca

SEQ ID NO: 173621 - RNA, 20 nt, Human
agcacaggcagucauucagu

SEQ ID NO: 173622 - RNA, 22 nt, Human
agcaauucagagcauggacuuu

SEQ ID NO: 173623 - RNA, 22 nt, Human
agcagagaacauucauucaugu

SEQ ID NO: 173624 - RNA, 22 nt, Human
agcacuaccggucacggccaug

SEQ ID NO: 173625 - RNA, 22 nt, Human
agcagagggucaguuuuuuagu

SEQ ID NO: 173626 - RNA, 22 nt, Human
agcaggagaaagaguaugggcu

SEQ ID NO: 173627 - RNA, 22 nt, Human
agcaggagagacuggcccaaaa

SEQ ID NO: 173628 - RNA, 22 nt, Human
agcaggacuugcugagcccucc

SEQ ID NO: 173629 - RNA, 22 nt, Human
agcaggauggaguaacgugaaa

SEQ ID NO: 173630 - RNA, 22 nt, Human
agcagcugagccccagcuguga

SEQ ID NO: 173631 - RNA, 22 nt, Human
agcaguuuauccucauaaugga

SEQ ID NO: 173632 - RNA, 22 nt, Human
agcagccgccgccgccgcgcac

SEQ ID NO: 173633 - RNA, 19 nt, Human
agcagccaucgaccaugga

SEQ ID NO: 173634 - RNA, 22 nt, Human
agcagcaggcugggaugagucu

SEQ ID NO: 173635 - RNA, 22 nt, Human
agcagcaccuguccucgcugcu

SEQ ID NO: 173636 - RNA, 22 nt, Human
gaggggaaggagcgaaggcggg

SEQ ID NO: 173637 - RNA, 22 nt, Human
gaggggaaggauuucuucagaa

SEQ ID NO: 173638 - RNA, 22 nt, Human
gagggcugccacguugggcgag

SEQ ID NO: 173639 - RNA, 22 nt, Human
gagggagugggcccgugggcac

SEQ ID NO: 173640 - RNA, 22 nt, Human
gagggauuuuagugcagcaacu

SEQ ID NO: 173641 - RNA, 22 nt, Human
gaaugggaauuauggugggacu

SEQ ID NO: 173642 - RNA, 22 nt, Human
gagggcauugucuucuuaguuu

SEQ ID NO: 173643 - RNA, 22 nt, Human
gaggggcugggguugacuccaa

SEQ ID NO: 173644 - RNA, 22 nt, Human
gaggggcuccagguguugagga

SEQ ID NO: 173645 - RNA, 19 nt, Human
gaauugcacgagcagaggc

SEQ ID NO: 173646 - RNA, 22 nt, Human
gaauuccaggugagagaaggua

SEQ ID NO: 173647 - RNA, 22 nt, Human
gaggaugacaaagaaggcagac

SEQ ID NO: 173648 - RNA, 22 nt, Human
gaaguggggaggagaagacuga

SEQ ID NO: 173649 - RNA, 22 nt, Human
gaggauuugagggucacuccac

SEQ ID NO: 173650 - RNA, 22 nt, Human
gaauccccugucggaacagugg

SEQ ID NO: 173651 - RNA, 22 nt, Human
gaggcugguucccuugaucuuu

SEQ ID NO: 173652 - RNA, 22 nt, Human
gaaugacuugcucauucugugu

SEQ ID NO: 173653 - RNA, 22 nt, Human
gaaugccugggguucuucgauc

SEQ ID NO: 173654 - RNA, 22 nt, Human
gaggcggugguggcgagaguca

SEQ ID NO: 173655 - RNA, 22 nt, Human
gaggcggcgacgcgggcccggg

SEQ ID NO: 173656 - RNA, 22 nt, Human
gaaugcacacgugugugcaugc

SEQ ID NO: 173657 - RNA, 22 nt, Human
gaggccagcacccagaugcaug

SEQ ID NO: 173658 - RNA, 22 nt, Human
gaggccauguggcccgggcugc

SEQ ID NO: 173659 - RNA, 22 nt, Human
gaggccuucauuucuccgucug

SEQ ID NO: 173660 - RNA, 22 nt, Human
gaggcgcgcugcgagggcgcgg

SEQ ID NO: 173661 - RNA, 22 nt, Human
gaggcaggcggggcccaggugg

SEQ ID NO: 173662 - RNA, 22 nt, Human
gaggcaggaagggaggguugug

SEQ ID NO: 173663 - RNA, 22 nt, Human
gaggaggucaccuggugagcaa

SEQ ID NO: 173664 - RNA, 22 nt, Human
gaggaggcuggagaggccagga

SEQ ID NO: 173665 - RNA, 22 nt, Human
gaggaggagacggaggccuggg

SEQ ID NO: 173666 - RNA, 22 nt, Human
gaggaggagaagcggcggcgga

SEQ ID NO: 173667 - RNA, 22 nt, Human
gaggagcuucagaggaaucuua

SEQ ID NO: 173668 - RNA, 22 nt, Human
gaggagcggugcaugugggggc

SEQ ID NO: 173669 - RNA, 22 nt, Human
gaaggcuguggcuggucucagu

SEQ ID NO: 173670 - RNA, 22 nt, Human
gaagggccaggggcaggcugga

SEQ ID NO: 173671 - RNA, 22 nt, Human
gaaggggccuggggcaaggcua

SEQ ID NO: 173672 - RNA, 22 nt, Human
gaagguuuuguuugcaaaucau

SEQ ID NO: 173673 - RNA, 22 nt, Human
gaggagacaguggagccgcuac

SEQ ID NO: 173674 - RNA, 22 nt, Human
gaggaagucuuaucuggaugca

SEQ ID NO: 173675 - RNA, 22 nt, Human
gaaggcagucuggggagcagcc

SEQ ID NO: 173676 - RNA, 22 nt, Human
gaaggcugaauuauuuguuccu

SEQ ID NO: 173677 - RNA, 22 nt, Human
gaagcuucucaacugguggaau

SEQ ID NO: 173678 - RNA, 22 nt, Human
gaaggcaguaaauggcuguuuu

SEQ ID NO: 173679 - RNA, 22 nt, Human
gaagcgugcagguccguauacu

SEQ ID NO: 173680 - RNA, 22 nt, Human
gagcgcacagaaggaagcagcc

SEQ ID NO: 173681 - RNA, 22 nt, Human
gagccuguuaggcaccuguguu

SEQ ID NO: 173682 - RNA, 22 nt, Human
gaagcgucaugaaagaaaggcu

SEQ ID NO: 173683 - RNA, 22 nt, Human
gaagcccuggaggggcuggagg

SEQ ID NO: 173684 - RNA, 22 nt, Human
gaagcggguucacuggauggcu

SEQ ID NO: 173685 - RNA, 22 nt, Human
gagcggcucaguggccauguga

SEQ ID NO: 173686 - RNA, 22 nt, Human
gaagccaugauaaccagugugg

SEQ ID NO: 173687 - RNA, 22 nt, Human
gagccggggcucccugaggucc

SEQ ID NO: 173688 - RNA, 22 nt, Human
gagccuaccugcugcucuuuca

SEQ ID NO: 173689 - RNA, 22 nt, Human
gagccuggagcuggaacgaagc

SEQ ID NO: 173690 - RNA, 22 nt, Human
gagccucaggguuuuguugaca

SEQ ID NO: 173691 - RNA, 22 nt, Human
gaagccaacacgugggagggag

SEQ ID NO: 173692 - RNA, 18 nt, Human
gaagcaacaguucugagu

SEQ ID NO: 173693 - RNA, 22 nt, Human
gagagaggggaagagaagcucu

SEQ ID NO: 173694 - RNA, 22 nt, Human
gaaaaugcacacauacacaccc

SEQ ID NO: 173695 - RNA, 22 nt, Human
gaucauauccagucaccacuau

SEQ ID NO: 173696 - RNA, 22 nt, Human
gauauuuugugaaaaaacaacu

SEQ ID NO: 173697 - RNA, 22 nt, Human
gagaaggagcagaaaaucuccu

SEQ ID NO: 173698 - RNA, 22 nt, Human
gaucccccaucuacuaucccca

SEQ ID NO: 173699 - RNA, 22 nt, Human
gagaagugggggucugggauga

SEQ ID NO: 173700 - RNA, 22 nt, Human
gagaagugaauaacgaagcagg

SEQ ID NO: 173701 - RNA, 22 nt, Human
gagaaauagauucaugguagau

SEQ ID NO: 173702 - RNA, 22 nt, Human
gagaacaaggaagagucggcag

SEQ ID NO: 173703 - RNA, 22 nt, Human
gagaaaaauuucuuugcugcac

SEQ ID NO: 173704 - RNA, 22 nt, Human
gacuuguguagcuucagaauuu

SEQ ID NO: 173705 - RNA, 22 nt, Human
gauauggaaacuugauguugug

SEQ ID NO: 173706 - RNA, 22 nt, Human
gauaggaggaugggaccuguga

SEQ ID NO: 173707 - RNA, 22 nt, Human
gauaccugccaagcugcacuca

SEQ ID NO: 173708 - RNA, 22 nt, Human
gauaaugcuuuggucagacaug

SEQ ID NO: 173709 - RNA, 22 nt, Human
gaguuucacguagaucaggguc

SEQ ID NO: 173710 - RNA, 22 nt, Human
gacuggguaaagcuuauccaaa

SEQ ID NO: 173711 - RNA, 22 nt, Human
gacuccuuaauguggcugaugu

SEQ ID NO: 173712 - RNA, 22 nt, Human
gacuacauuugguauugacgag

SEQ ID NO: 173713 - RNA, 22 nt, Human
gacugggacucaacccaccauu

SEQ ID NO: 173714 - RNA, 22 nt, Human
gacuggaaucucugcuuguuaa

SEQ ID NO: 173715 - RNA, 22 nt, Human
gaguugauggccauugaguuga

SEQ ID NO: 173716 - RNA, 22 nt, Human
gaguuggggcugcguguuucca

SEQ ID NO: 173717 - RNA, 22 nt, Human
gacucuucucucccaaaugccc

SEQ ID NO: 173718 - RNA, 22 nt, Human
gaccaggagauuugagcuaggc

SEQ ID NO: 173719 - RNA, 22 nt, Human
gaguacagaagauaaaggcaca

SEQ ID NO: 173720 - RNA, 22 nt, Human
gaccagaacuucuagucuaagu

SEQ ID NO: 173721 - RNA, 22 nt, Human
gacccucucagacuuccaggca

SEQ ID NO: 173722 - RNA, 22 nt, Human
gacccugaggauucccugcuga

SEQ ID NO: 173723 - RNA, 22 nt, Human
gaguagaacagauagucaagaa

SEQ ID NO: 173724 - RNA, 22 nt, Human
gagugaucuguaggcagcaugg

SEQ ID NO: 173725 - RNA, 22 nt, Human
gaguggccugccccagccaggc

SEQ ID NO: 173726 - RNA, 22 nt, Human
gacggaggacaucagcaguguc

SEQ ID NO: 173727 - RNA, 22 nt, Human
gacgacgggccccguggccacc

SEQ ID NO: 173728 - RNA, 22 nt, Human
gaccugcucagcccuguguguu

SEQ ID NO: 173729 - RNA, 22 nt, Human
gaccugguggccauugucccag

SEQ ID NO: 173730 - RNA, 22 nt, Human
gaccuccauucugucaugacug

SEQ ID NO: 173731 - RNA, 22 nt, Human
gaccuuguucuggcauucucag

SEQ ID NO: 173732 - RNA, 22 nt, Human
gacagcaggaugugaggggaug

SEQ ID NO: 173733 - RNA, 22 nt, Human
gacagcguguuuugcaugaaca

SEQ ID NO: 173734 - RNA, 22 nt, Human
gacagcguaucaauugaacaua

SEQ ID NO: 173735 - RNA, 22 nt, Human
gaggugcaggggcccgggcugg

SEQ ID NO: 173736 - RNA, 22 nt, Human
gaggugggaggcgggccugcau

SEQ ID NO: 173737 - RNA, 20 nt, Human
gagguugcucagaguggggu

SEQ ID NO: 173738 - RNA, 22 nt, Human
gagguuggagggcuggccugca

SEQ ID NO: 173739 - RNA, 22 nt, Human
gacaguggagccacguugggag

SEQ ID NO: 173740 - RNA, 22 nt, Human
gagggugguggcggccggcacc

SEQ ID NO: 173741 - RNA, 22 nt, Human
gacaagaugacaucauggcuuc

SEQ ID NO: 173742 - RNA, 20 nt, Human
gacaagccacagcucccaga

SEQ ID NO: 173743 - RNA, 22 nt, Human
gaggguuucagugggacggguu

SEQ ID NO: 173744 - RNA, 22 nt, Human
gacacucauauuaagccuauuu

SEQ ID NO: 173745 - RNA, 22 nt, Human
gacaccuucuacugacuaugga

SEQ ID NO: 173746 - RNA, 22 nt, Human
gaggucagcaagccaugcuugu

SEQ ID NO: 173747 - RNA, 22 nt, Human
gagguagcgugcagggcccgaa

SEQ ID NO: 173748 - RNA, 22 nt, Human
cuugagcugaguuugcagcucu

SEQ ID NO: 173749 - RNA, 22 nt, Human
cuugcagccuggagcucagccu

SEQ ID NO: 173750 - RNA, 22 nt, Human
gaagucaggaaggagauugaag

SEQ ID NO: 173751 - RNA, 22 nt, Human
gaagucugacucuuuguaagcu

SEQ ID NO: 173752 - RNA, 21 nt, Human
cuucgcuguuccagcucuugg

SEQ ID NO: 173753 - RNA, 23 nt, Human
cuucggcgcucgcugggcggagg

SEQ ID NO: 173754 - RNA, 22 nt, Human
gaaggggacuccauggaaugau

SEQ ID NO: 173755 - RNA, 22 nt, Human
gaagguuuacugaagauuuaaa

SEQ ID NO: 173756 - RNA, 22 nt, Human
gaaggugcugaaacagaaauuu

SEQ ID NO: 173757 - RNA, 22 nt, Human
gaagaugcugcuuguucacggg

SEQ ID NO: 173758 - RNA, 22 nt, Human
gaacuuuaauuagcuuuugucu

SEQ ID NO: 173759 - RNA, 22 nt, Human
gaagcaagagggaucaggaucu

SEQ ID NO: 173760 - RNA, 22 nt, Human
gacacccgccggcgccugccuc

SEQ ID NO: 173761 - RNA, 22 nt, Human
gacacaacuauccaguauggga

SEQ ID NO: 173762 - RNA, 22 nt, Human
gacacaacuucccucccacauu

SEQ ID NO: 173763 - RNA, 22 nt, Human
cuuggcuccuucacagggagau

SEQ ID NO: 173764 - RNA, 22 nt, Human
cuuggggcuugcuguuguagcc

SEQ ID NO: 173765 - RNA, 22 nt, Human
gaauggcagaaugaagcagugu

SEQ ID NO: 173766 - RNA, 22 nt, Human
gagaccuuaagagaugucagcu

SEQ ID NO: 173767 - RNA, 22 nt, Human
gagaacuauagaaaccuggucu

SEQ ID NO: 173768 - RNA, 22 nt, Human
gaaaacccuguauguagcguuu

SEQ ID NO: 173769 - RNA, 22 nt, Human
gagaaaacauacuuaguguccu

SEQ ID NO: 173770 - RNA, 22 nt, Human
gagaaagauuguccuucagggg

SEQ ID NO: 173771 - RNA, 22 nt, Human
gagaacagauaugaugacuuca

SEQ ID NO: 173772 - RNA, 22 nt, Human
gacuugcucaaaucagauuuua

SEQ ID NO: 173773 - RNA, 22 nt, Human
gacuugauugguuugucaaguu

SEQ ID NO: 173774 - RNA, 22 nt, Human
gacuucaagaugaaucuuuggg

SEQ ID NO: 173775 - RNA, 22 nt, Human
cuuuuuuucuccauauuucugg

SEQ ID NO: 173776 - RNA, 22 nt, Human
gacugacagugguacuguaauu

SEQ ID NO: 173777 - RNA, 22 nt, Human
cuuuuucaugggugaugagugg

SEQ ID NO: 173778 - RNA, 22 nt, Human
cuuuggauuuuuugcuuuugua

SEQ ID NO: 173779 - RNA, 22 nt, Human
cuuuggggcugaggaggagguu

SEQ ID NO: 173780 - RNA, 22 nt, Human
gaccgggcucugcugacggucu

SEQ ID NO: 173781 - RNA, 22 nt, Human
gaccugaccucauuagcaaguu

SEQ ID NO: 173782 - RNA, 22 nt, Human
gacacugccaagugccccgaga

SEQ ID NO: 173783 - RNA, 22 nt, Human
cuuuccaugucuucuuucucca

SEQ ID NO: 173784 - RNA, 22 nt, Human
cuuucuccagagugaagauccu

SEQ ID NO: 173785 - RNA, 22 nt, Human
cuuucuuucaaguucugcuuua

SEQ ID NO: 173786 - RNA, 22 nt, Human
cuuucugauguaaggaacuagg

SEQ ID NO: 173787 - RNA, 22 nt, Human
gacagggacacagccagugagg

SEQ ID NO: 173788 - RNA, 22 nt, Human
gacagguagacaugaauauuaa

SEQ ID NO: 173789 - RNA, 22 nt, Human
gacaggaauuaucuaaaguaga

SEQ ID NO: 173790 - RNA, 22 nt, Human
gacaggcagagaggaagagaga

SEQ ID NO: 173791 - RNA, 22 nt, Human
cugaucccuuuucauuugcagg

SEQ ID NO: 173792 - RNA, 22 nt, Human
cuucacugcagucauggcucug

SEQ ID NO: 173793 - RNA, 22 nt, Human
cuucagagugacucagcaucuu

SEQ ID NO: 173794 - RNA, 22 nt, Human
cuggagcuucaggguucucggg

SEQ ID NO: 173795 - RNA, 22 nt, Human
cuggcggcccgaggcagaggag

SEQ ID NO: 173796 - RNA, 22 nt, Human
cuggcggugaucccgauggugu

SEQ ID NO: 173797 - RNA, 22 nt, Human
cuggcuguguguuugugcaucu

SEQ ID NO: 173798 - RNA, 21 nt, Human
cuggcucgccaugguucuuuu

SEQ ID NO: 173799 - RNA, 21 nt, Human
cugggaacccgaccaaggccu

SEQ ID NO: 173800 - RNA, 22 nt, Human
cuggcgauugcgagagucgccu

SEQ ID NO: 173801 - RNA, 22 nt, Human
cuggcgagcugggccuggggga

SEQ ID NO: 173802 - RNA, 21 nt, Human
cuuuucuagucccagccccgc

SEQ ID NO: 173803 - RNA, 22 nt, Human
cuuuuccuccaggaagccaagc

SEQ ID NO: 173804 - RNA, 22 nt, Human
cuuuucaaacaggacagguccu

SEQ ID NO: 173805 - RNA, 22 nt, Human
cuggguguggugggugcugccg

SEQ ID NO: 173806 - RNA, 22 nt, Human
cuggguaaauauguauuccuga

SEQ ID NO: 173807 - RNA, 22 nt, Human
cugggaguugacgaggcuugua

SEQ ID NO: 173808 - RNA, 22 nt, Human
cugggguaucugccacaacucu

SEQ ID NO: 173809 - RNA, 22 nt, Human
cugggagaggaaccucgagggu

SEQ ID NO: 173810 - RNA, 22 nt, Human
cugggagaugacucagagcagg

SEQ ID NO: 173811 - RNA, 22 nt, Human
cugggaggagacaggggauggg

SEQ ID NO: 173812 - RNA, 22 nt, Human
cuuuugcaauagugacacugau

SEQ ID NO: 173813 - RNA, 22 nt, Human
cuguguuguuugaguagcuuga

SEQ ID NO: 173814 - RNA, 22 nt, Human
gaaccuggcagcccuauaucug

SEQ ID NO: 173815 - RNA, 22 nt, Human
gaacggccucguuccucggugu

SEQ ID NO: 173816 - RNA, 22 nt, Human
gaagaaggaagaucaugcuuga

SEQ ID NO: 173817 - RNA, 22 nt, Human
gaagaagagauaauggggagca

SEQ ID NO: 173818 - RNA, 22 nt, Human
cuguuguucacuuugcugguga

SEQ ID NO: 173819 - RNA, 22 nt, Human
cuguggguggcugugccccagg

SEQ ID NO: 173820 - RNA, 22 nt, Human
gaaaugggggcaugcguuacau

SEQ ID NO: 173821 - RNA, 22 nt, Human
gaaaucuggugauuuucuguug

SEQ ID NO: 173822 - RNA, 22 nt, Human
cuguccugauggugccacuggu

SEQ ID NO: 173823 - RNA, 22 nt, Human
gaaaccauggcaaccagguccu

SEQ ID NO: 173824 - RNA, 19 nt, Human
cuguccacacacucgcuuc

SEQ ID NO: 173825 - RNA, 22 nt, Human
cuguccccauugcugucccugg

SEQ ID NO: 173826 - RNA, 22 nt, Human
gaaaaucaggauggaugugagg

SEQ ID NO: 173827 - RNA, 22 nt, Human
cuggguguuccuuucauuuuaa

SEQ ID NO: 173828 - RNA, 22 nt, Human
cuggugaagccuucggagaccc

SEQ ID NO: 173829 - RNA, 22 nt, Human
gaaaagaaggcaggagcccaag

SEQ ID NO: 173830 - RNA, 22 nt, Human
gaaaaggaggggaggcagaugg

SEQ ID NO: 173831 - RNA, 22 nt, Human
cuggugggucacgugugggugg

SEQ ID NO: 173832 - RNA, 22 nt, Human
cugcgcgagcacugccggcggg

SEQ ID NO: 173833 - RNA, 22 nt, Human
cugcggcaccaaccccuucaug

SEQ ID NO: 173834 - RNA, 22 nt, Human
cugcgcagaucugcuguucucu

SEQ ID NO: 173835 - RNA, 22 nt, Human
cugccuuggcccuaguucaugg

SEQ ID NO: 173836 - RNA, 22 nt, Human
cuagcacagugcuuggcacaca

SEQ ID NO: 173837 - RNA, 22 nt, Human
cugccuucaaaguaauauuuua

SEQ ID NO: 173838 - RNA, 22 nt, Human
cuacugaugccccgcugugccu

SEQ ID NO: 173839 - RNA, 22 nt, Human
cugccggcugcugcagagaggu

SEQ ID NO: 173840 - RNA, 22 nt, Human
cugcccauggcuccuggcugug

SEQ ID NO: 173841 - RNA, 22 nt, Human
cugccccucgcucaccagcucu

SEQ ID NO: 173842 - RNA, 22 nt, Human
cugccaggagaggccagggccc

SEQ ID NO: 173843 - RNA, 22 nt, Human
cugcuguugagguuccaggcca

SEQ ID NO: 173844 - RNA, 22 nt, Human
cugcuguuuuccccaccaucuc

SEQ ID NO: 173845 - RNA, 22 nt, Human
cugcuguuuucugggcuucuua

SEQ ID NO: 173846 - RNA, 22 nt, Human
cugcugugcagacagacucucu

SEQ ID NO: 173847 - RNA, 22 nt, Human
cugcugucuuuauuucacugcu

SEQ ID NO: 173848 - RNA, 22 nt, Human
cugcuggugcugcccacacggu

SEQ ID NO: 173849 - RNA, 22 nt, Human
cugcugcuugauugcaggaagu

SEQ ID NO: 173850 - RNA, 22 nt, Human
cuaggucagaggacacagcuua

SEQ ID NO: 173851 - RNA, 22 nt, Human
cugcgguucuguuuaguggcga

SEQ ID NO: 173852 - RNA, 22 nt, Human
cuagcaggacucagcagauauu

SEQ ID NO: 173853 - RNA, 22 nt, Human
cuaggaugcuguaauggugucu

SEQ ID NO: 173854 - RNA, 21 nt, Human
cugcugaaggaaccccaugga

SEQ ID NO: 173855 - RNA, 22 nt, Human
cugagcugcucccgcugcagcg

SEQ ID NO: 173856 - RNA, 21 nt, Human
cgucccggcgugagagagcug

SEQ ID NO: 173857 - RNA, 22 nt, Human
cugagcggugagggcauacagc

SEQ ID NO: 173858 - RNA, 22 nt, Human
cggugcuuuccauaucagcagc

SEQ ID NO: 173859 - RNA, 22 nt, Human
cugagcaucaaaugggcaauua

SEQ ID NO: 173860 - RNA, 17 nt, Human
cgugaggaccaggcagc

SEQ ID NO: 173861 - RNA, 22 nt, Human
cgugaucuguuauauagugagc

SEQ ID NO: 173862 - RNA, 22 nt, Human
cgugaaaugcagaaaguugugg

SEQ ID NO: 173863 - RNA, 22 nt, Human
cugaugcucuggauguagucaa

SEQ ID NO: 173864 - RNA, 22 nt, Human
cugauccuauauugguaugagg

SEQ ID NO: 173865 - RNA, 22 nt, Human
cugccacuaccaugcuggauga

SEQ ID NO: 173866 - RNA, 22 nt, Human
cugcaucacagcaggaggcaca

SEQ ID NO: 173867 - RNA, 22 nt, Human
cugcaguguccgcuugcucagc

SEQ ID NO: 173868 - RNA, 22 nt, Human
cugauuucaaauggugcuagau

SEQ ID NO: 173869 - RNA, 22 nt, Human
cugcacagucauuuccucucaa

SEQ ID NO: 173870 - RNA, 22 nt, Human
cugcacuggguacauagaaaca

SEQ ID NO: 173871 - RNA, 22 nt, Human
cugcagagaccuaggucagguu

SEQ ID NO: 173872 - RNA, 20 nt, Human
cugauguucgugcuuccugg

SEQ ID NO: 173873 - RNA, 22 nt, Human
cugauguuuaucucaagaguuc

SEQ ID NO: 173874 - RNA, 22 nt, Human
cguugguggguguguggucgga

SEQ ID NO: 173875 - RNA, 17 nt, Human
cguuccagaacaaauga

SEQ ID NO: 173876 - RNA, 22 nt, Human
cgugugugugcgugugcgugug

SEQ ID NO: 173877 - RNA, 22 nt, Human
cguuauagagcacucgaacuuu

SEQ ID NO: 173878 - RNA, 22 nt, Human
cgugcuaccugagcugacagcu

SEQ ID NO: 173879 - RNA, 22 nt, Human
cgugggggcaacgaccccuccc

SEQ ID NO: 173880 - RNA, 22 nt, Human
cgugucauggcggcgcaggugg

SEQ ID NO: 173881 - RNA, 20 nt, Human
cuguuugcuaucaugagcug

SEQ ID NO: 173882 - RNA, 22 nt, Human
cuguuuggcuuccacugcuucu

SEQ ID NO: 173883 - RNA, 23 nt, Human
cugagggcuggucugaagucugc

SEQ ID NO: 173884 - RNA, 22 nt, Human
cuuaggaaauccuguacucccc

SEQ ID NO: 173885 - RNA, 22 nt, Human
cugagggagcugcuggccuugg

SEQ ID NO: 173886 - RNA, 22 nt, Human
cugagggagacagugcggacua

SEQ ID NO: 173887 - RNA, 22 nt, Human
cuguuucucugccugcacacau

SEQ ID NO: 173888 - RNA, 20 nt, Human
cuguucucuugccacaugag

SEQ ID NO: 173889 - RNA, 22 nt, Human
cuguuguguuauuugcagugca

SEQ ID NO: 173890 - RNA, 22 nt, Human
cugaagaaagaaaauggccauc

SEQ ID NO: 173891 - RNA, 22 nt, Human
cuguuccuccaccucaacaaac

SEQ ID NO: 173892 - RNA, 22 nt, Human
cuguucagugcauauguauuga

SEQ ID NO: 173893 - RNA, 22 nt, Human
cugaaagacagccaggcaaagc

SEQ ID NO: 173894 - RNA, 22 nt, Human
cugaaagacgaggggaagucgg

SEQ ID NO: 173895 - RNA, 20 nt, Human
cucuuuaugagaccacuguc

SEQ ID NO: 173896 - RNA, 21 nt, Human
cugugggaaggccugaggucu

SEQ ID NO: 173897 - RNA, 19 nt, Human
cugaaacacagagagggcu

SEQ ID NO: 173898 - RNA, 22 nt, Human
cugugggcucucaugggaccug

SEQ ID NO: 173899 - RNA, 22 nt, Human
cuggugcuguagccugauugag

SEQ ID NO: 173900 - RNA, 22 nt, Human
cuggugagaccgacuuccacuu

SEQ ID NO: 173901 - RNA, 22 nt, Human
cuguccuguggccugcuccggu

SEQ ID NO: 173902 - RNA, 22 nt, Human
cugucacuguuuuaaccaacaa

SEQ ID NO: 173903 - RNA, 22 nt, Human
cuggcuaaugugcugauagcca

SEQ ID NO: 173904 - RNA, 22 nt, Human
cucccugagaugcaggagagag

SEQ ID NO: 173905 - RNA, 22 nt, Human
cuccgaaaugcaucccagggca

SEQ ID NO: 173906 - RNA, 22 nt, Human
cuccgcagcugggguuggcgcu

SEQ ID NO: 173907 - RNA, 22 nt, Human
cugggagggguagccaauccua

SEQ ID NO: 173908 - RNA, 22 nt, Human
cuccagcagaaagggcgagugg

SEQ ID NO: 173909 - RNA, 22 nt, Human
cugggugugugugaacagagau

SEQ ID NO: 173910 - RNA, 22 nt, Human
cugggugagcuggccagagggu

SEQ ID NO: 173911 - RNA, 22 nt, Human
cugggugggcacccagccuggg

SEQ ID NO: 173912 - RNA, 22 nt, Human
cuggguuuggcugugcuugaau

SEQ ID NO: 173913 - RNA, 22 nt, Human
cuggucaauaaucauguaguac

SEQ ID NO: 173914 - RNA, 22 nt, Human
cugggcucccucucccgccucg

SEQ ID NO: 173915 - RNA, 22 nt, Human
cugggaugagcuguuuccuggu

SEQ ID NO: 173916 - RNA, 22 nt, Human
cugggcuuucaggcccuaaggc

SEQ ID NO: 173917 - RNA, 22 nt, Human
cugggcaugggaacuucaaggc

SEQ ID NO: 173918 - RNA, 22 nt, Human
cugggggacagagagaggcggu

SEQ ID NO: 173919 - RNA, 22 nt, Human
cugggguuggccagggcccuag

SEQ ID NO: 173920 - RNA, 22 nt, Human
cugggguggugcaggccucaug

SEQ ID NO: 173921 - RNA, 22 nt, Human
cucacgguuugcaucaagagug

SEQ ID NO: 173922 - RNA, 22 nt, Human
cucacugucagcugcagggcuu

SEQ ID NO: 173923 - RNA, 22 nt, Human
cugcuucacccugccugagaac

SEQ ID NO: 173924 - RNA, 22 nt, Human
cucaagacacccuggccucuac

SEQ ID NO: 173925 - RNA, 22 nt, Human
cucaggugagcgagcuaaauua

SEQ ID NO: 173926 - RNA, 22 nt, Human
cucagcaacccacacacggucu

SEQ ID NO: 173927 - RNA, 22 nt, Human
cucagaugaugucuucagggaa

SEQ ID NO: 173928 - RNA, 22 nt, Human
cuggacucuuuguuuaguucug

SEQ ID NO: 173929 - RNA, 22 nt, Human
cucagcgagggaaagaggccgc

SEQ ID NO: 173930 - RNA, 22 nt, Human
cucagcugauuaauuucauguu

SEQ ID NO: 173931 - RNA, 22 nt, Human
cucaagagaaaucggaaucaga

SEQ ID NO: 173932 - RNA, 22 nt, Human
cuaggggucccaagggugcucu

SEQ ID NO: 173933 - RNA, 22 nt, Human
cucaagugacucagccugguug

SEQ ID NO: 173934 - RNA, 22 nt, Human
cuauuuucccauaugguugaca

SEQ ID NO: 173935 - RNA, 22 nt, Human
cucaaagcagacuuuucccuuu

SEQ ID NO: 173936 - RNA, 22 nt, Human
cucagcaauuaccugugucucu

SEQ ID NO: 173937 - RNA, 22 nt, Human
cgccugucugcauggccacugg

SEQ ID NO: 173938 - RNA, 22 nt, Human
cgcuagggagcacuuggcagug

SEQ ID NO: 173939 - RNA, 22 nt, Human
cgcgggcuugggcaccugcgga

SEQ ID NO: 173940 - RNA, 22 nt, Human
cgcgcgguguuccgcauucugc

SEQ ID NO: 173941 - RNA, 22 nt, Human
cuagguggcagcacuccgaggu

SEQ ID NO: 173942 - RNA, 22 nt, Human
cuagcagaagcuccuugagggu

SEQ ID NO: 173943 - RNA, 22 nt, Human
cgccaaccaggcuguccuccca

SEQ ID NO: 173944 - RNA, 22 nt, Human
cgcagcuucagggccaggaggg

SEQ ID NO: 173945 - RNA, 22 nt, Human
cgccaguggcagcuggaacagg

SEQ ID NO: 173946 - RNA, 22 nt, Human
cgcccggcugagacgcucgccc

SEQ ID NO: 173947 - RNA, 22 nt, Human
cgcccccgaucggggccgccgc

SEQ ID NO: 173948 - RNA, 21 nt, Human
cgcccggccggaaaccccuuc

SEQ ID NO: 173949 - RNA, 22 nt, Human
cgccgccgccugcccgcgcccc

SEQ ID NO: 173950 - RNA, 22 nt, Human
cggccgcgggauggcgggcagc

SEQ ID NO: 173951 - RNA, 22 nt, Human
cggagggcccucaggacugggu

SEQ ID NO: 173952 - RNA, 22 nt, Human
cggcccggccucgcggcgcaug

SEQ ID NO: 173953 - RNA, 22 nt, Human
cucugagcucgugcaguacuuc

SEQ ID NO: 173954 - RNA, 22 nt, Human
cggagcauacugccuggagaug

SEQ ID NO: 173955 - RNA, 22 nt, Human
cucuaccugcacaugccugacu

SEQ ID NO: 173956 - RNA, 22 nt, Human
cggagcgagaaggggaaagccc

SEQ ID NO: 173957 - RNA, 22 nt, Human
cuccugauuucuaggccuuauc

SEQ ID NO: 173958 - RNA, 22 nt, Human
cuccgccuguccugggcccacg

SEQ ID NO: 173959 - RNA, 22 nt, Human
cuccggccuucugacuccccug

SEQ ID NO: 173960 - RNA, 22 nt, Human
cuccaccucagugucaucuucu

SEQ ID NO: 173961 - RNA, 22 nt, Human
cuccacccuagagggcccaugc

SEQ ID NO: 173962 - RNA, 22 nt, Human
cucaugagucugucagagucau

SEQ ID NO: 173963 - RNA, 22 nt, Human
cuccacagccccuccaguggca

SEQ ID NO: 173964 - RNA, 22 nt, Human
cgcugcugucaucgucuacggu

SEQ ID NO: 173965 - RNA, 22 nt, Human
cgcuggagagcaagugcgugca

SEQ ID NO: 173966 - RNA, 22 nt, Human
cucaugaauggcucuuugugcu

SEQ ID NO: 173967 - RNA, 22 nt, Human
cucagugacuuccugcucaauu

SEQ ID NO: 173968 - RNA, 22 nt, Human
cguggcaguagagcuggaacuu

SEQ ID NO: 173969 - RNA, 22 nt, Human
cguggaggucgcauauuccucu

SEQ ID NO: 173970 - RNA, 22 nt, Human
cgugaagaaguaauagguggug

SEQ ID NO: 173971 - RNA, 21 nt, Human
ccuuugaguguguuugaagua

SEQ ID NO: 173972 - RNA, 22 nt, Human
ccugccuuccagcucuggggag

SEQ ID NO: 173973 - RNA, 21 nt, Human
ccuggagacaaagacagggug

SEQ ID NO: 173974 - RNA, 19 nt, Human
ccuggccaacgucaacauu

SEQ ID NO: 173975 - RNA, 22 nt, Human
ccuggcauuagaaauuccguca

SEQ ID NO: 173976 - RNA, 22 nt, Human
ccuggcccagcuggaagcggga

SEQ ID NO: 173977 - RNA, 22 nt, Human
cgggaggcggagcuccgcgggg

SEQ ID NO: 173978 - RNA, 22 nt, Human
cgggagcagcucuggggcuggg

SEQ ID NO: 173979 - RNA, 21 nt, Human
ccuugcacucaucccaugccc

SEQ ID NO: 173980 - RNA, 22 nt, Human
ccuugggagcgcccuguccggg

SEQ ID NO: 173981 - RNA, 22 nt, Human
cgcacuggagcuggaacgaguc

SEQ ID NO: 173982 - RNA, 22 nt, Human
cgcacuugugagcgacagggcu

SEQ ID NO: 173983 - RNA, 22 nt, Human
cgcacacaaaugcauacgccag

SEQ ID NO: 173984 - RNA, 22 nt, Human
cgagguacuuacccuggucugu

SEQ ID NO: 173985 - RNA, 22 nt, Human
cgagggcuggaggggagacaga

SEQ ID NO: 173986 - RNA, 22 nt, Human
cgagugauuauucuggcugaga

SEQ ID NO: 173987 - RNA, 18 nt, Human
cgauguguaugugauuug

SEQ ID NO: 173988 - RNA, 22 nt, Human
cguggccacaguggagcugagc

SEQ ID NO: 173989 - RNA, 22 nt, Human
cuaaagacagcaagacaucauc

SEQ ID NO: 173990 - RNA, 22 nt, Human
cgaggccgcuucauggcuggca

SEQ ID NO: 173991 - RNA, 22 nt, Human
cgaggcuugcaaggacgaggag

SEQ ID NO: 173992 - RNA, 22 nt, Human
cgagcccacacuccuguccucu

SEQ ID NO: 173993 - RNA, 22 nt, Human
cgaggagguccaggagcaguag

SEQ ID NO: 173994 - RNA, 22 nt, Human
cuaccccaggccccucgaugcc

SEQ ID NO: 173995 - RNA, 22 nt, Human
cuaccagcacgccuuccucuac

SEQ ID NO: 173996 - RNA, 22 nt, Human
cuacacgauaaauuuuaguggu

SEQ ID NO: 173997 - RNA, 22 nt, Human
ccucccaccguaucucaguggc

SEQ ID NO: 173998 - RNA, 22 nt, Human
cgaagcuuuuguuggcgugucg

SEQ ID NO: 173999 - RNA, 22 nt, Human
ccucgcucauggauucugccug

SEQ ID NO: 174000 - RNA, 22 nt, Human
ccuccgguucucagggcuccac

SEQ ID NO: 174001 - RNA, 19 nt, Human
ccuccgcauccucaucugu

SEQ ID NO: 174002 - RNA, 22 nt, Human
ccuagcauagcuuuugccuccc

SEQ ID NO: 174003 - RNA, 22 nt, Human
cgaacggcagagagcccguccc

SEQ ID NO: 174004 - RNA, 22 nt, Human
ccgugggugggguacgggcugg

SEQ ID NO: 174005 - RNA, 22 nt, Human
ccgugccuuuaguuucuucugu

SEQ ID NO: 174006 - RNA, 22 nt, Human
ccgugcaguuucucacacacau

SEQ ID NO: 174007 - RNA, 19 nt, Human
ccggucaugcauuccuuug

SEQ ID NO: 174008 - RNA, 22 nt, Human
cggacugaccugcucggggaga

SEQ ID NO: 174009 - RNA, 22 nt, Human
ccugccugggcucacuugccag

SEQ ID NO: 174010 - RNA, 22 nt, Human
cggaagcacuagacacugacac

SEQ ID NO: 174011 - RNA, 22 nt, Human
cggaggagcugcgcggaggggg

SEQ ID NO: 174012 - RNA, 22 nt, Human
cgcuuugacuuuagaaggccaa

SEQ ID NO: 174013 - RNA, 22 nt, Human
cggcugcgguucaccuagggca

SEQ ID NO: 174014 - RNA, 22 nt, Human
cggaggcugcuuucuguugcua

SEQ ID NO: 174015 - RNA, 22 nt, Human
ccugagccgagcgcucuuucuc

SEQ ID NO: 174016 - RNA, 22 nt, Human
cgcugggugguugauguacagc

SEQ ID NO: 174017 - RNA, 19 nt, Human
cgcugcucccgcuguggcu

SEQ ID NO: 174018 - RNA, 22 nt, Human
cgccgugucuggucuguacguc

SEQ ID NO: 174019 - RNA, 22 nt, Human
cgccgugcagucagcccagaag

SEQ ID NO: 174020 - RNA, 22 nt, Human
cgcccguacuuugccggcauga

SEQ ID NO: 174021 - RNA, 20 nt, Human
ccucucugcaugcucccuga

SEQ ID NO: 174022 - RNA, 22 nt, Human
ccugacucugauuucgcugcau

SEQ ID NO: 174023 - RNA, 22 nt, Human
ccuucuguaccaaggccucaug

SEQ ID NO: 174024 - RNA, 22 nt, Human
ccuugcgaggaugcugugagcu

SEQ ID NO: 174025 - RNA, 22 nt, Human
ccgcggcuguaguggaggugga

SEQ ID NO: 174026 - RNA, 23 nt, Human
ccuuguguaucuccagccacucc

SEQ ID NO: 174027 - RNA, 22 nt, Human
ccuuggcuuaccuucugugugg

SEQ ID NO: 174028 - RNA, 22 nt, Human
ccgcucgggugcagagggcaga

SEQ ID NO: 174029 - RNA, 22 nt, Human
ccuuugcccugagaaauguucc

SEQ ID NO: 174030 - RNA, 22 nt, Human
ccggcggguggagcaugcgcgg

SEQ ID NO: 174031 - RNA, 22 nt, Human
ccggcugagccucgccgcggcc

SEQ ID NO: 174032 - RNA, 22 nt, Human
ccgggcuuccuuagagcaagau

SEQ ID NO: 174033 - RNA, 22 nt, Human
ccggcugcugaggcggccccgg

SEQ ID NO: 174034 - RNA, 22 nt, Human
ccuuugcugggccucuccaucu

SEQ ID NO: 174035 - RNA, 22 nt, Human
ccagagaugcagugggugcagu

SEQ ID NO: 174036 - RNA, 19 nt, Human
cccagaggaaugccuggaa

SEQ ID NO: 174037 - RNA, 22 nt, Human
ccagacuggggauuuugccagg

SEQ ID NO: 174038 - RNA, 18 nt, Human
cccagaggaaugccugga

SEQ ID NO: 174039 - RNA, 22 nt, Human
ccagagcaccgaaacgagcuuu

SEQ ID NO: 174040 - RNA, 22 nt, Human
ccgaaccacacgacagugcuca

SEQ ID NO: 174041 - RNA, 22 nt, Human
ccgagaucagaguaggauuugg

SEQ ID NO: 174042 - RNA, 21 nt, Human
ccgacggcgcagaugccggcc

SEQ ID NO: 174043 - RNA, 22 nt, Human
ccuggccacagggcucugcauu

SEQ ID NO: 174044 - RNA, 22 nt, Human
ccgcggcugcgcggugccccuc

SEQ ID NO: 174045 - RNA, 22 nt, Human
ccugggcauaaaucacuccaag

SEQ ID NO: 174046 - RNA, 22 nt, Human
ccuggcccugcugcuugccagc

SEQ ID NO: 174047 - RNA, 22 nt, Human
ccugggccuaaacaaacaagag

SEQ ID NO: 174048 - RNA, 22 nt, Human
ccuggguccucacaaucccagg

SEQ ID NO: 174049 - RNA, 22 nt, Human
ccugucugaaggcagggggaug

SEQ ID NO: 174050 - RNA, 21 nt, Human
ccugucagcccaacuuuugga

SEQ ID NO: 174051 - RNA, 20 nt, Human
ccuguucacugcgcaguuuc

SEQ ID NO: 174052 - RNA, 22 nt, Human
ccugucuuuucugaucauacua

SEQ ID NO: 174053 - RNA, 19 nt, Human
ccugugaguuaagcuaugu

SEQ ID NO: 174054 - RNA, 22 nt, Human
ccaccacauuugccuagacuuu

SEQ ID NO: 174055 - RNA, 22 nt, Human
ccacccugguuacugugccagg

SEQ ID NO: 174056 - RNA, 22 nt, Human
ccaccccagaaagggaaggcca

SEQ ID NO: 174057 - RNA, 22 nt, Human
cauuaccuggggagaggauacc

SEQ ID NO: 174058 - RNA, 22 nt, Human
ccacuacauugagugcuuucuc

SEQ ID NO: 174059 - RNA, 22 nt, Human
ccacagcauugaaaucuauaau

SEQ ID NO: 174060 - RNA, 22 nt, Human
ccaaggcuguggggcugugcag

SEQ ID NO: 174061 - RNA, 22 nt, Human
ccaaggugcagcccauggugaa

SEQ ID NO: 174062 - RNA, 22 nt, Human
ccaaggcuggagggcuuaugua

SEQ ID NO: 174063 - RNA, 22 nt, Human
ccaaccaguuucuuggcuuuag

SEQ ID NO: 174064 - RNA, 22 nt, Human
ccaagcguguuuaggaaaugcu

SEQ ID NO: 174065 - RNA, 22 nt, Human
ccaaccaguuaucuccuaaggu

SEQ ID NO: 174066 - RNA, 22 nt, Human
caugcgucugcauuggguggug

SEQ ID NO: 174067 - RNA, 22 nt, Human
cauggcggcgcucucccugccu

SEQ ID NO: 174068 - RNA, 22 nt, Human
ccaagagcuucccauagcuucu

SEQ ID NO: 174069 - RNA, 22 nt, Human
cauggcacagaagaugucguuu

SEQ ID NO: 174070 - RNA, 22 nt, Human
caugcagauugccaggcucccu

SEQ ID NO: 174071 - RNA, 22 nt, Human
caugccugaucagcggccagca

SEQ ID NO: 174072 - RNA, 22 nt, Human
caugaacucucggguuuggaau

SEQ ID NO: 174073 - RNA, 22 nt, Human
cauuucuggccuggggagcggg

SEQ ID NO: 174074 - RNA, 22 nt, Human
cauuuucugcaagucugcucaa

SEQ ID NO: 174075 - RNA, 22 nt, Human
cauccagcuccugggggccacc

SEQ ID NO: 174076 - RNA, 22 nt, Human
caucagucugaaagccagggag

SEQ ID NO: 174077 - RNA, 21 nt, Human
caucaagaucaauggagggcu

SEQ ID NO: 174078 - RNA, 22 nt, Human
caucaacagucuacuuuuugcc

SEQ ID NO: 174079 - RNA, 22 nt, Human
cauguguuucuuaagccaggcc

SEQ ID NO: 174080 - RNA, 22 nt, Human
cauaucuccagguucugcugga

SEQ ID NO: 174081 - RNA, 22 nt, Human
cauuauucaggcuuuggaauuu

SEQ ID NO: 174082 - RNA, 22 nt, Human
caugugcaucagccaauuggag

SEQ ID NO: 174083 - RNA, 22 nt, Human
caugugguauugugagauccac

SEQ ID NO: 174084 - RNA, 22 nt, Human
cagguugaaaguggaggagcua

SEQ ID NO: 174085 - RNA, 22 nt, Human
caucaggcugggaacacagauc

SEQ ID NO: 174086 - RNA, 22 nt, Human
ccaccuggcagcaggcucggca

SEQ ID NO: 174087 - RNA, 22 nt, Human
ccaccucuaccuggccggccuu

SEQ ID NO: 174088 - RNA, 22 nt, Human
ccacccacuucucugcccucca

SEQ ID NO: 174089 - RNA, 22 nt, Human
ccaccacugaggcacaggagcc

SEQ ID NO: 174090 - RNA, 22 nt, Human
ccacguguugcucagacagggu

SEQ ID NO: 174091 - RNA, 23 nt, Human
ccacaugugagcccaccgugccc

SEQ ID NO: 174092 - RNA, 22 nt, Human
ccauuuuccuguauggacucga

SEQ ID NO: 174093 - RNA, 22 nt, Human
ccagaacgacgggcagaggcgc

SEQ ID NO: 174094 - RNA, 20 nt, Human
ccagaagagaagaaaaggaa

SEQ ID NO: 174095 - RNA, 22 nt, Human
cccacgccuucuuucuucaaau

SEQ ID NO: 174096 - RNA, 22 nt, Human
cccagaccagagugccuggacg

SEQ ID NO: 174097 - RNA, 22 nt, Human
cccaagcuccacauuuuagcuu

SEQ ID NO: 174098 - RNA, 22 nt, Human
ccauggccaauugcaccuugcu

SEQ ID NO: 174099 - RNA, 22 nt, Human
ccaugugaccugugucaguugc

SEQ ID NO: 174100 - RNA, 23 nt, Human
ccacuccucccaggccacccugc

SEQ ID NO: 174101 - RNA, 20 nt, Human
ccacuucucugcucugccca

SEQ ID NO: 174102 - RNA, 22 nt, Human
ccacuuucuaaauuggcgauuu

SEQ ID NO: 174103 - RNA, 22 nt, Human
ccaggcuccccaggaggcccuu

SEQ ID NO: 174104 - RNA, 22 nt, Human
ccagggaggucauagugcuggu

SEQ ID NO: 174105 - RNA, 22 nt, Human
ccagggcuggguuugucggugu

SEQ ID NO: 174106 - RNA, 22 nt, Human
ccagguggacggcgaguacagg

SEQ ID NO: 174107 - RNA, 19 nt, Human
ccaacaguacugaagcacu

SEQ ID NO: 174108 - RNA, 22 nt, Human
ccaaauuguuguuguuguuguu

SEQ ID NO: 174109 - RNA, 22 nt, Human
ccaaucaacuguguggcuuucu

SEQ ID NO: 174110 - RNA, 21 nt, Human
ccacaauucuaguuacauaug

SEQ ID NO: 174111 - RNA, 22 nt, Human
ccagugcagacgcggaacuggc

SEQ ID NO: 174112 - RNA, 22 nt, Human
ccagugacaaagucggaagucc

SEQ ID NO: 174113 - RNA, 22 nt, Human
ccaaggcugcagccgugacgcg

SEQ ID NO: 174114 - RNA, 22 nt, Human
ccagugcaguacaaaccuuagu

SEQ ID NO: 174115 - RNA, 22 nt, Human
ccagugagauagugguauaugc

SEQ ID NO: 174116 - RNA, 22 nt, Human
ccagccuucugaugggacccuc

SEQ ID NO: 174117 - RNA, 17 nt, Human
ccagcugcucccucaga

SEQ ID NO: 174118 - RNA, 22 nt, Human
ccaggcccugccugugguuccu

SEQ ID NO: 174119 - RNA, 22 nt, Human
ccagcuuuucagaaucugccug

SEQ ID NO: 174120 - RNA, 22 nt, Human
ccaaaauauuagugcuuaagua

SEQ ID NO: 174121 - RNA, 22 nt, Human
cauuuuuuuuccccuccuggua

SEQ ID NO: 174122 - RNA, 22 nt, Human
ccagcaggagacuagcaacaua

SEQ ID NO: 174123 - RNA, 22 nt, Human
ccagcagaagcucccgcugggu

SEQ ID NO: 174124 - RNA, 22 nt, Human
ccagcaaguaagucagugucag

SEQ ID NO: 174125 - RNA, 22 nt, Human
ccagccugccaagcccagcccu

SEQ ID NO: 174126 - RNA, 22 nt, Human
ccagcaucagcucuuggcuggc

SEQ ID NO: 174127 - RNA, 22 nt, Human
ccagccacugacugauuuaaaa

SEQ ID NO: 174128 - RNA, 22 nt, Human
ccagcaugcucagucuaaauug

SEQ ID NO: 174129 - RNA, 22 nt, Human
ccagcucgaggcaggggcugca

SEQ ID NO: 174130 - RNA, 22 nt, Human
cauuuuccucugcugguguuca

SEQ ID NO: 174131 - RNA, 22 nt, Human
cauuucaaacaguuacagcugc

SEQ ID NO: 174132 - RNA, 22 nt, Human
cauugggcggggaccucggcug

SEQ ID NO: 174133 - RNA, 22 nt, Human
ccagaggcuuaugcagcugcug

SEQ ID NO: 174134 - RNA, 22 nt, Human
ccagauaaacauuccuuggccu

SEQ ID NO: 174135 - RNA, 22 nt, Human
ccagaugggggcugugggaggg

SEQ ID NO: 174136 - RNA, 22 nt, Human
cauuggcacauguauucugggc

SEQ ID NO: 174137 - RNA, 22 nt, Human
cauugcaucuuuuauggguaag

SEQ ID NO: 174138 - RNA, 22 nt, Human
ccagagcacaccguuugccuuc

SEQ ID NO: 174139 - RNA, 22 nt, Human
ccagacuggggcuccuugaggg

SEQ ID NO: 174140 - RNA, 20 nt, Human
cauuccugaggaauucaugu

SEQ ID NO: 174141 - RNA, 22 nt, Human
ccacuuugagaagcugaugaaa

SEQ ID NO: 174142 - RNA, 22 nt, Human
ccagaacguuugugcgaggcag

SEQ ID NO: 174143 - RNA, 22 nt, Human
ccacuguuggcccgaagggguc

SEQ ID NO: 174144 - RNA, 19 nt, Human
ccagaagggcaagcaaagg

SEQ ID NO: 174145 - RNA, 22 nt, Human
cauugcugccaaggugagcugg

SEQ ID NO: 174146 - RNA, 22 nt, Human
cauugcuguuaauugucucuag

SEQ ID NO: 174147 - RNA, 22 nt, Human
cauugcugugggcauuugcugc

SEQ ID NO: 174148 - RNA, 21 nt, Human
cagcagaugccagggucucug

SEQ ID NO: 174149 - RNA, 22 nt, Human
cagcagaugacuauuggagcug

SEQ ID NO: 174150 - RNA, 21 nt, Human
cagcagaaaugagaggagaaa

SEQ ID NO: 174151 - RNA, 22 nt, Human
cagcacugcccuaccccuccac

SEQ ID NO: 174152 - RNA, 22 nt, Human
cacuguugagcaauguacagug

SEQ ID NO: 174153 - RNA, 22 nt, Human
cagccccgcuggccucgccucc

SEQ ID NO: 174154 - RNA, 22 nt, Human
cagccccucuucucuccucgga

SEQ ID NO: 174155 - RNA, 22 nt, Human
cagaccuggaaaacaggcuugc

SEQ ID NO: 174156 - RNA, 22 nt, Human
cagcccuggccucuucgcuuuc

SEQ ID NO: 174157 - RNA, 22 nt, Human
cagcauugagcacagaaggaaa

SEQ ID NO: 174158 - RNA, 22 nt, Human
cagccagaucgccuuccgccuc

SEQ ID NO: 174159 - RNA, 22 nt, Human
cagaccucucaggcuguucuug

SEQ ID NO: 174160 - RNA, 22 nt, Human
cagaccagaaggaagccgacaa

SEQ ID NO: 174161 - RNA, 22 nt, Human
caccaucagacuucugggcagg

SEQ ID NO: 174162 - RNA, 20 nt, Human
cacccgguccucagcgacuc

SEQ ID NO: 174163 - RNA, 22 nt, Human
cacccugacuggcccugcagga

SEQ ID NO: 174164 - RNA, 23 nt, Human
caccaugacaugccuauagggga

SEQ ID NO: 174165 - RNA, 22 nt, Human
caccgaacuuugcaaaugcaau

SEQ ID NO: 174166 - RNA, 22 nt, Human
caccgagagccacuuccggaac

SEQ ID NO: 174167 - RNA, 22 nt, Human
caccugcaaauuccagauuucu

SEQ ID NO: 174168 - RNA, 22 nt, Human
cagagagcguccauccggugcc

SEQ ID NO: 174169 - RNA, 22 nt, Human
cagagacuuuugcuccgauucu

SEQ ID NO: 174170 - RNA, 22 nt, Human
cagagaggagcacaaagugaag

SEQ ID NO: 174171 - RNA, 22 nt, Human
cacugcacuccagccugggcaa

SEQ ID NO: 174172 - RNA, 22 nt, Human
cacugcaaccuccaccucccgg

SEQ ID NO: 174173 - RNA, 19 nt, Human
cacuguccuagucgaggcc

SEQ ID NO: 174174 - RNA, 22 nt, Human
caaugccaggaaccugggggaa

SEQ ID NO: 174175 - RNA, 22 nt, Human
caaugcacauggacaucaggcu

SEQ ID NO: 174176 - RNA, 22 nt, Human
caagccacugggagcugcacac

SEQ ID NO: 174177 - RNA, 23 nt, Human
cacucgcaggcccagcucucagg

SEQ ID NO: 174178 - RNA, 22 nt, Human
cacgggcgacgugaucuaggac

SEQ ID NO: 174179 - RNA, 22 nt, Human
caauuaccaguaauugagguuu

SEQ ID NO: 174180 - RNA, 22 nt, Human
caaugaaaauuuaaguugcagc

SEQ ID NO: 174181 - RNA, 22 nt, Human
cacagcagcaucauuuaucugg

SEQ ID NO: 174182 - RNA, 22 nt, Human
cacuguugaagauacuuccucu

SEQ ID NO: 174183 - RNA, 22 nt, Human
cacacgagcccuggagccagca

SEQ ID NO: 174184 - RNA, 22 nt, Human
cacacguuucuacugcugccaa

SEQ ID NO: 174185 - RNA, 22 nt, Human
cacagaggaugcccaagcgauc

SEQ ID NO: 174186 - RNA, 22 nt, Human
cacugcguaguggcccgaagcu

SEQ ID NO: 174187 - RNA, 22 nt, Human
cacugcugaggcccguguuacu

SEQ ID NO: 174188 - RNA, 22 nt, Human
cacacagcuagugacaggagaa

SEQ ID NO: 174189 - RNA, 17 nt, Human
cacauggagcuuguugc

SEQ ID NO: 174190 - RNA, 22 nt, Human
cagaacugaauaaagccaggau

SEQ ID NO: 174191 - RNA, 22 nt, Human
cagaaagugauuugcuauucca

SEQ ID NO: 174192 - RNA, 22 nt, Human
cagacagaguuguuucuucucc

SEQ ID NO: 174193 - RNA, 22 nt, Human
cagacacgucccuguugaccug

SEQ ID NO: 174194 - RNA, 23 nt, Human
cacaggcagaaaucaagacggua

SEQ ID NO: 174195 - RNA, 22 nt, Human
cacuaaccauguucccaacagc

SEQ ID NO: 174196 - RNA, 20 nt, Human
cacagcugacgaguauccaa

SEQ ID NO: 174197 - RNA, 22 nt, Human
cagaaaacauuguguguauaag

SEQ ID NO: 174198 - RNA, 22 nt, Human
caggaguggugagguuagcaga

SEQ ID NO: 174199 - RNA, 22 nt, Human
caggaggugugucccaccgggu

SEQ ID NO: 174200 - RNA, 22 nt, Human
caggauauguucaagguuuucu

SEQ ID NO: 174201 - RNA, 23 nt, Human
caggggacaggugaccugggcuc

SEQ ID NO: 174202 - RNA, 20 nt, Human
caggccuucaggauggcugg

SEQ ID NO: 174203 - RNA, 22 nt, Human
caggcgcugacgggaccgggcu

SEQ ID NO: 174204 - RNA, 22 nt, Human
caggacccaaccucccugcucu

SEQ ID NO: 174205 - RNA, 22 nt, Human
caggccgccacugcagcagcug

SEQ ID NO: 174206 - RNA, 22 nt, Human
caggccccagggacugggcgcu

SEQ ID NO: 174207 - RNA, 22 nt, Human
caggugauuuuguuuucaaaug

SEQ ID NO: 174208 - RNA, 22 nt, Human
cagcuugcccugauguggaaga

SEQ ID NO: 174209 - RNA, 22 nt, Human
cagcuuguucugaccugugauu

SEQ ID NO: 174210 - RNA, 22 nt, Human
cagcuucaugacaaacaguuuu

SEQ ID NO: 174211 - RNA, 22 nt, Human
cagcuucacuuaaaacaugcaa

SEQ ID NO: 174212 - RNA, 22 nt, Human
cagcuguggagauggggugcau

SEQ ID NO: 174213 - RNA, 22 nt, Human
cagcucuggcuauugaggacca

SEQ ID NO: 174214 - RNA, 22 nt, Human
cagcuggaggagcagcuuccag

SEQ ID NO: 174215 - RNA, 22 nt, Human
cagcgguggcaaggugacugug

SEQ ID NO: 174216 - RNA, 22 nt, Human
cagccuacaucagaauaccaau

SEQ ID NO: 174217 - RNA, 22 nt, Human
cagccuuuucuuaaaaugcaag

SEQ ID NO: 174218 - RNA, 22 nt, Human
cagcuauggaauuggcccagau

SEQ ID NO: 174219 - RNA, 22 nt, Human
cagcuucaaaggcccugauggu

SEQ ID NO: 174220 - RNA, 22 nt, Human
cagagcugucauuugccaguga

SEQ ID NO: 174221 - RNA, 22 nt, Human
cagagcugagucuucaagguug

SEQ ID NO: 174222 - RNA, 22 nt, Human
cagcccuugcgacacccuggcu

SEQ ID NO: 174223 - RNA, 22 nt, Human
cagaggagcgaguuggacgcca

SEQ ID NO: 174224 - RNA, 22 nt, Human
cagccuggccucuggauauuug

SEQ ID NO: 174225 - RNA, 22 nt, Human
cagccgcucaugggcccggagc

SEQ ID NO: 174226 - RNA, 22 nt, Human
cagcccugagagaaccaucuau

SEQ ID NO: 174227 - RNA, 19 nt, Human
caggacaguuugccaagaa

SEQ ID NO: 174228 - RNA, 22 nt, Human
caggacagaaauaaggaauaua

SEQ ID NO: 174229 - RNA, 22 nt, Human
caggacccaacggugcaauguc

SEQ ID NO: 174230 - RNA, 22 nt, Human
caggacuuccucuaugguggcg

SEQ ID NO: 174231 - RNA, 22 nt, Human
cagcaugguggagcugcucuuu

SEQ ID NO: 174232 - RNA, 22 nt, Human
caggaacucggagcccaucucu

SEQ ID NO: 174233 - RNA, 22 nt, Human
cagccccagcacuuagcugagu

SEQ ID NO: 174234 - RNA, 22 nt, Human
cagccccaguuuucauaagacu

SEQ ID NO: 174235 - RNA, 22 nt, Human
cagguggccggguaggaggugg

SEQ ID NO: 174236 - RNA, 22 nt, Human
caggugcucugauauggggcug

SEQ ID NO: 174237 - RNA, 22 nt, Human
cauaaauuuuaccuuguaagug

SEQ ID NO: 174238 - RNA, 22 nt, Human
cauaggugguagaauggggaga

SEQ ID NO: 174239 - RNA, 22 nt, Human
caggugccucugccccacgcgg

SEQ ID NO: 174240 - RNA, 22 nt, Human
caguguugcuaaugaauucauu

SEQ ID NO: 174241 - RNA, 22 nt, Human
caguggagaccugccugcugga

SEQ ID NO: 174242 - RNA, 22 nt, Human
caguggaugucucauaguguga

SEQ ID NO: 174243 - RNA, 22 nt, Human
caggguuuuaguugcagguuau

SEQ ID NO: 174244 - RNA, 22 nt, Human
caguugcagagugauguguuug

SEQ ID NO: 174245 - RNA, 22 nt, Human
caggauuuaauaagauaguguu

SEQ ID NO: 174246 - RNA, 22 nt, Human
caggcacaagaucggcuagaua

SEQ ID NO: 174247 - RNA, 19 nt, Human
caggauuguuuaaagcuuu

SEQ ID NO: 174248 - RNA, 22 nt, Human
cagguuuuccuuuuaaaaggaa

SEQ ID NO: 174249 - RNA, 22 nt, Human
caggcacaaugagcgccaucuu

SEQ ID NO: 174250 - RNA, 22 nt, Human
cagugcuggaggggugcuugca

SEQ ID NO: 174251 - RNA, 22 nt, Human
caggaagucugaauucugagag

SEQ ID NO: 174252 - RNA, 22 nt, Human
caggacacaaaagguggagaag

SEQ ID NO: 174253 - RNA, 22 nt, Human
cagguggauggcgagcccugca

SEQ ID NO: 174254 - RNA, 22 nt, Human
cagguuguucugggcauggagg

SEQ ID NO: 174255 - RNA, 20 nt, Human
cagguugcugcccccgccuc

SEQ ID NO: 174256 - RNA, 22 nt, Human
caggugggauuuugcugcuuga

SEQ ID NO: 174257 - RNA, 22 nt, Human
cagguguugcaguugaagacug

SEQ ID NO: 174258 - RNA, 22 nt, Human
auggaagagacaaugcuaucug

SEQ ID NO: 174259 - RNA, 22 nt, Human
auggaacauuaaucuucaaaug

SEQ ID NO: 174260 - RNA, 22 nt, Human
augggcauacaaaugcuacccu

SEQ ID NO: 174261 - RNA, 22 nt, Human
auggaaggggagguagggagga

SEQ ID NO: 174262 - RNA, 22 nt, Human
auggaauuuaaauuuugguguc

SEQ ID NO: 174263 - RNA, 22 nt, Human
auggauggaagcagccugaacu

SEQ ID NO: 174264 - RNA, 22 nt, Human
auggaggaugugcagcaugggc

SEQ ID NO: 174265 - RNA, 22 nt, Human
auggagggcagccccacuaaag

SEQ ID NO: 174266 - RNA, 22 nt, Human
auggaggugagccccccauccu

SEQ ID NO: 174267 - RNA, 22 nt, Human
auggagggguuguugcuugagu

SEQ ID NO: 174268 - RNA, 18 nt, Human
augggggaggaggaaagg

SEQ ID NO: 174269 - RNA, 22 nt, Human
auggggucagagaauggugggu

SEQ ID NO: 174270 - RNA, 22 nt, Human
augggcuuuacccucagagcuu

SEQ ID NO: 174271 - RNA, 22 nt, Human
augcugccuaaagcuacuuaca

SEQ ID NO: 174272 - RNA, 22 nt, Human
auggagcgggaggauggaggag

SEQ ID NO: 174273 - RNA, 22 nt, Human
auggagcagagcugaugggccu

SEQ ID NO: 174274 - RNA, 22 nt, Human
auggaggagcagaggguuucca

SEQ ID NO: 174275 - RNA, 22 nt, Human
augcccagaacccccuggaugg

SEQ ID NO: 174276 - RNA, 22 nt, Human
augcaugaucccgguaugugaa

SEQ ID NO: 174277 - RNA, 22 nt, Human
augccaccucuucugauuccag

SEQ ID NO: 174278 - RNA, 22 nt, Human
augcugccuccucuucagccgc

SEQ ID NO: 174279 - RNA, 22 nt, Human
augauucuaccaaugccaucuu

SEQ ID NO: 174280 - RNA, 22 nt, Human
auguugcugauccuguggcugu

SEQ ID NO: 174281 - RNA, 22 nt, Human
augugggguaggaggggggaau

SEQ ID NO: 174282 - RNA, 23 nt, Human
auguagcugcucccgaugcccuc

SEQ ID NO: 174283 - RNA, 21 nt, Human
auguguucugauagugcuugc

SEQ ID NO: 174284 - RNA, 22 nt, Human
augggcauggauggccgagucu

SEQ ID NO: 174285 - RNA, 22 nt, Human
augggcggugcauuugcacagu

SEQ ID NO: 174286 - RNA, 22 nt, Human
augggagggugaggaggcagcu

SEQ ID NO: 174287 - RNA, 22 nt, Human
augggagugacagggccacugg

SEQ ID NO: 174288 - RNA, 22 nt, Human
auggggaggcggauggagugcu

SEQ ID NO: 174289 - RNA, 22 nt, Human
augguguaggugaagagaacau

SEQ ID NO: 174290 - RNA, 22 nt, Human
auggucugcucagucucuugac

SEQ ID NO: 174291 - RNA, 22 nt, Human
auggugaaaugauuugauguca

SEQ ID NO: 174292 - RNA, 22 nt, Human
auggcagcggagcuggaaauga

SEQ ID NO: 174293 - RNA, 22 nt, Human
auguccugguccacagaaggga

SEQ ID NO: 174294 - RNA, 22 nt, Human
auggugaugaugaugaugauaa

SEQ ID NO: 174295 - RNA, 22 nt, Human
augggggccagggacccuggca

SEQ ID NO: 174296 - RNA, 22 nt, Human
augguaaguuuuuaaaaagcgu

SEQ ID NO: 174297 - RNA, 22 nt, Human
augggugggagugaaggggcuc

SEQ ID NO: 174298 - RNA, 19 nt, Human
augguauugcuggguuuuu

SEQ ID NO: 174299 - RNA, 22 nt, Human
auguaaugucaaucuucagugg

SEQ ID NO: 174300 - RNA, 22 nt, Human
auguggaaagcuugucuuagag

SEQ ID NO: 174301 - RNA, 22 nt, Human
auggugugugugugugugugug

SEQ ID NO: 174302 - RNA, 22 nt, Human
augaggguggggaaugggccau

SEQ ID NO: 174303 - RNA, 22 nt, Human
augcaggcuaagaguaaagacg

SEQ ID NO: 174304 - RNA, 22 nt, Human
augauuaagguacgucauuucu

SEQ ID NO: 174305 - RNA, 21 nt, Human
augagguggcuacuaaagagu

SEQ ID NO: 174306 - RNA, 22 nt, Human
augcacaagguagauuauuauu

SEQ ID NO: 174307 - RNA, 19 nt, Human
augcacgugaaaugcauuu

SEQ ID NO: 174308 - RNA, 22 nt, Human
augaaacucuagcuuucagcac

SEQ ID NO: 174309 - RNA, 23 nt, Human
augaacgcacugagaucauaauu

SEQ ID NO: 174310 - RNA, 22 nt, Human
aucuuuguaaguaaucaaagcu

SEQ ID NO: 174311 - RNA, 22 nt, Human
augcaaaaucuuauuuuuucua

SEQ ID NO: 174312 - RNA, 22 nt, Human
augauaccacucaauagggcau

SEQ ID NO: 174313 - RNA, 22 nt, Human
augaacuaagagucauuagugu

SEQ ID NO: 174314 - RNA, 22 nt, Human
aucugugauuuuggcaagauuu

SEQ ID NO: 174315 - RNA, 22 nt, Human
aucugugguacaugacggcugc

SEQ ID NO: 174316 - RNA, 22 nt, Human
augaaaacggaccagagcuauu

SEQ ID NO: 174317 - RNA, 22 nt, Human
augaacugcaguauaaacuugg

SEQ ID NO: 174318 - RNA, 22 nt, Human
augaagguggacagauuuuuuu

SEQ ID NO: 174319 - RNA, 22 nt, Human
augacugaugcugacucauggg

SEQ ID NO: 174320 - RNA, 22 nt, Human
augaccuucuuuccuuaaauuu

SEQ ID NO: 174321 - RNA, 22 nt, Human
augacagcucuagcacacagua

SEQ ID NO: 174322 - RNA, 22 nt, Human
augaccauccagaaguccagcu

SEQ ID NO: 174323 - RNA, 23 nt, Human
aucgcccggguccagucccggcu

SEQ ID NO: 174324 - RNA, 22 nt, Human
aucuguucuucaaaauauuaca

SEQ ID NO: 174325 - RNA, 22 nt, Human
aucguggcacgucgccgcagcg

SEQ ID NO: 174326 - RNA, 22 nt, Human
aucuucaaggacgccaagaucc

SEQ ID NO: 174327 - RNA, 22 nt, Human
aucucaagcucugagggaggcc

SEQ ID NO: 174328 - RNA, 22 nt, Human
aucucagacucuccggguuccg

SEQ ID NO: 174329 - RNA, 22 nt, Human
aucucaaagauaugcugguaaa

SEQ ID NO: 174330 - RNA, 23 nt, Human
aucugagccuggucccacccgcu

SEQ ID NO: 174331 - RNA, 22 nt, Human
aucuuugccuuuaugccucuag

SEQ ID NO: 174332 - RNA, 22 nt, Human
aucuuggccuucuccuggagug

SEQ ID NO: 174333 - RNA, 18 nt, Human
auccuucggccuagugga

SEQ ID NO: 174334 - RNA, 19 nt, Human
auccuugcucacucacuga

SEQ ID NO: 174335 - RNA, 20 nt, Human
auccuggucuuuggaagcuu

SEQ ID NO: 174336 - RNA, 22 nt, Human
aucuccaguuagcaguacugau

SEQ ID NO: 174337 - RNA, 22 nt, Human
auacuucaccuaacccaguuuc

SEQ ID NO: 174338 - RNA, 22 nt, Human
auuuuuaucuaaaauccacuuu

SEQ ID NO: 174339 - RNA, 22 nt, Human
auuuuuuuggucauaugagaua

SEQ ID NO: 174340 - RNA, 22 nt, Human
caaaaaauccauagaaagaggu

SEQ ID NO: 174341 - RNA, 22 nt, Human
caaauggggaauagaugauggg

SEQ ID NO: 174342 - RNA, 22 nt, Human
auuuuugguuucaccugcacgc

SEQ ID NO: 174343 - RNA, 22 nt, Human
auuuuugugcuuuauuggggua

SEQ ID NO: 174344 - RNA, 22 nt, Human
auuuuauuuugggaucuuuuua

SEQ ID NO: 174345 - RNA, 22 nt, Human
auuucuguaauucugaggagug

SEQ ID NO: 174346 - RNA, 22 nt, Human
auuuuguugaaacccuuguugu

SEQ ID NO: 174347 - RNA, 22 nt, Human
auugaugaaaauaguuauuuua

SEQ ID NO: 174348 - RNA, 22 nt, Human
auugaguucaccucuuucagaa

SEQ ID NO: 174349 - RNA, 18 nt, Human
auugagcaugacagaccu

SEQ ID NO: 174350 - RNA, 22 nt, Human
auuguucuagaauuuuuuuucc

SEQ ID NO: 174351 - RNA, 22 nt, Human
auuggccaguggacagcgccgu

SEQ ID NO: 174352 - RNA, 22 nt, Human
auuuagagaaguagcaaggucc

SEQ ID NO: 174353 - RNA, 22 nt, Human
auuugcuuguucaccaguacuu

SEQ ID NO: 174354 - RNA, 22 nt, Human
auuuccagcagcauauuugucu

SEQ ID NO: 174355 - RNA, 22 nt, Human
auuuggucuguaauuacaugga

SEQ ID NO: 174356 - RNA, 22 nt, Human
auuucauuuuagaaauaagugu

SEQ ID NO: 174357 - RNA, 20 nt, Human
auucucaccaugugacaugg

SEQ ID NO: 174358 - RNA, 22 nt, Human
auuaucugacugaguagucugu

SEQ ID NO: 174359 - RNA, 22 nt, Human
auucgaucacugccgaggaccu

SEQ ID NO: 174360 - RNA, 22 nt, Human
auucgcggcuugaucugcuugc

SEQ ID NO: 174361 - RNA, 22 nt, Human
auuccguuuuaaaaccuuaagc

SEQ ID NO: 174362 - RNA, 22 nt, Human
auguuguugaacucuuugcaug

SEQ ID NO: 174363 - RNA, 22 nt, Human
auguuguuuauggguuaucaag

SEQ ID NO: 174364 - RNA, 22 nt, Human
auucaagagcccauguuuccug

SEQ ID NO: 174365 - RNA, 22 nt, Human
auucugcauuucuaaccagguc

SEQ ID NO: 174366 - RNA, 22 nt, Human
auucuguuuuaccauuuucuuu

SEQ ID NO: 174367 - RNA, 20 nt, Human
auucuguguaaauguccugu

SEQ ID NO: 174368 - RNA, 22 nt, Human
auugacagaaaauuggauggca

SEQ ID NO: 174369 - RNA, 22 nt, Human
auugaaguguacguuugaucua

SEQ ID NO: 174370 - RNA, 22 nt, Human
auugaagcauggagaugaggca

SEQ ID NO: 174371 - RNA, 17 nt, Human
auucuaguuggcuuuuu

SEQ ID NO: 174372 - RNA, 22 nt, Human
auucccuuugacgaucccuagg

SEQ ID NO: 174373 - RNA, 22 nt, Human
auuccagggaaauggggaugga

SEQ ID NO: 174374 - RNA, 22 nt, Human
auuccaccccauccucccaggu

SEQ ID NO: 174375 - RNA, 22 nt, Human
auucuugauauagauaguuaau

SEQ ID NO: 174376 - RNA, 23 nt, Human
auugccuguagaucuucacuuuc

SEQ ID NO: 174377 - RNA, 22 nt, Human
auugccauaauagagccaugua

SEQ ID NO: 174378 - RNA, 21 nt, Human
auuggcagaucucuggauugu

SEQ ID NO: 174379 - RNA, 22 nt, Human
auucuucauguugaagcuguca

SEQ ID NO: 174380 - RNA, 22 nt, Human
auugcaggucguguggaaguga

SEQ ID NO: 174381 - RNA, 22 nt, Human
auugaugccugaaaaauaugua

SEQ ID NO: 174382 - RNA, 22 nt, Human
auucuguugguuuaauagucaa

SEQ ID NO: 174383 - RNA, 22 nt, Human
auugagcuguugaagucccaca

SEQ ID NO: 174384 - RNA, 22 nt, Human
uuuguguuacaguccuagaacu

SEQ ID NO: 174385 - RNA, 22 nt, Human
uuucuuuuucuacaccuuagcu

SEQ ID NO: 174386 - RNA, 22 nt, Human
uuucuuugcugguuggcucucc

SEQ ID NO: 174387 - RNA, 22 nt, Human
uuucuugugauuuugaugaacu

SEQ ID NO: 174388 - RNA, 22 nt, Human
uuucuugggaaaugucagaagu

SEQ ID NO: 174389 - RNA, 22 nt, Human
uuucuggacuaaagggagagau

SEQ ID NO: 174390 - RNA, 22 nt, Human
uuucuggauaagcagggucucu

SEQ ID NO: 174391 - RNA, 22 nt, Human
uuucugcauuuguauuggaaaa

SEQ ID NO: 174392 - RNA, 19 nt, Human
uuucucacugagucguuug

SEQ ID NO: 174393 - RNA, 22 nt, Human
uuucucugggugaugagguggc

SEQ ID NO: 174394 - RNA, 22 nt, Human
uuucguugcacucauaugguug

SEQ ID NO: 174395 - RNA, 22 nt, Human
uuuccccugggaacauugauuc

SEQ ID NO: 174396 - RNA, 21 nt, Human
uuucauaggguuaaaggguua

SEQ ID NO: 174397 - RNA, 22 nt, Human
uuuccacacucacugcacucau

SEQ ID NO: 174398 - RNA, 22 nt, Human
uuucaucccugucagugaaggc

SEQ ID NO: 174399 - RNA, 22 nt, Human
uuuggaugcugucauaugcugc

SEQ ID NO: 174400 - RNA, 22 nt, Human
uuuggcaagcagaugaagguag

SEQ ID NO: 174401 - RNA, 22 nt, Human
uuuggcgucucucaggagcuca

SEQ ID NO: 174402 - RNA, 22 nt, Human
uuuggccauuuguaugcaugau

SEQ ID NO: 174403 - RNA, 22 nt, Human
uuugggccugucugccugcuuu

SEQ ID NO: 174404 - RNA, 20 nt, Human
uuugguuggcuaggggaagc

SEQ ID NO: 174405 - RNA, 22 nt, Human
uuuggucuggaaucuucagggu

SEQ ID NO: 174406 - RNA, 22 nt, Human
uuugcaaaguccauugaaguua

SEQ ID NO: 174407 - RNA, 23 nt, Human
uuugcaaauuggacacaaccaca

SEQ ID NO: 174408 - RNA, 22 nt, Human
uuugcauuugagagaggaaaca

SEQ ID NO: 174409 - RNA, 22 nt, Human
uuugccaucagaugugguaggu

SEQ ID NO: 174410 - RNA, 22 nt, Human
uuugcugaaaaaccacuugagu

SEQ ID NO: 174411 - RNA, 22 nt, Human
uuugcugggaagccuucacucu

SEQ ID NO: 174412 - RNA, 21 nt, Human
uuugacagaccagguauaguu

SEQ ID NO: 174413 - RNA, 22 nt, Human
uuugaagaccuuaucucuaaau

SEQ ID NO: 174414 - RNA, 22 nt, Human
uuugaugauuuucuagagugua

SEQ ID NO: 174415 - RNA, 22 nt, Human
uuguugcuguugaacccugcug

SEQ ID NO: 174416 - RNA, 22 nt, Human
uuguugcaagccuggaaucugg

SEQ ID NO: 174417 - RNA, 22 nt, Human
uuguuauuauuauuuucguucu

SEQ ID NO: 174418 - RNA, 22 nt, Human
uuguguuuaaucuguuccacua

SEQ ID NO: 174419 - RNA, 22 nt, Human
uuguggcaggauggacagcaga

SEQ ID NO: 174420 - RNA, 22 nt, Human
uuguguugaagugguuagggcg

SEQ ID NO: 174421 - RNA, 22 nt, Human
uuuaggaauuugcugggcauga

SEQ ID NO: 174422 - RNA, 22 nt, Human
uuuauugaccugaguaucagca

SEQ ID NO: 174423 - RNA, 22 nt, Human
uuucacugaguaggagagcacu

SEQ ID NO: 174424 - RNA, 22 nt, Human
uuucagaaauggcacugaaauc

SEQ ID NO: 174425 - RNA, 22 nt, Human
uugugcucaguuguggucuauu

SEQ ID NO: 174426 - RNA, 22 nt, Human
uuguggacgcaauucaaggaua

SEQ ID NO: 174427 - RNA, 22 nt, Human
uugugccuuaauauaggcgcug

SEQ ID NO: 174428 - RNA, 18 nt, Human
uugugccugagaaggugg

SEQ ID NO: 174429 - RNA, 22 nt, Human
uugugcacauuucauugaccug

SEQ ID NO: 174430 - RNA, 22 nt, Human
uugguguaauacaagcaauuug

SEQ ID NO: 174431 - RNA, 22 nt, Human
uuggggauugggugcaagggac

SEQ ID NO: 174432 - RNA, 19 nt, Human
uugguuuguugcuuaggug

SEQ ID NO: 174433 - RNA, 22 nt, Human
uugggcauuucuuauguauuuu

SEQ ID NO: 174434 - RNA, 22 nt, Human
uugggcuagaaacaacgugggu

SEQ ID NO: 174435 - RNA, 22 nt, Human
uuggcuucuugcuaggaagcug

SEQ ID NO: 174436 - RNA, 22 nt, Human
uuggccuaggcacaggcaggug

SEQ ID NO: 174437 - RNA, 22 nt, Human
uuggccuuacgcauggucggca

SEQ ID NO: 174438 - RNA, 22 nt, Human
uuggccugcuccagaacaaggg

SEQ ID NO: 174439 - RNA, 22 nt, Human
uuggcgcuauuauuaccacauu

SEQ ID NO: 174440 - RNA, 22 nt, Human
uuggcguuuccuguucugggug

SEQ ID NO: 174441 - RNA, 21 nt, Human
uuggcuacugcuucagaggga

SEQ ID NO: 174442 - RNA, 22 nt, Human
uuggcuuuucaguuuuaaguua

SEQ ID NO: 174443 - RNA, 22 nt, Human
uuggauguggggauggaguggg

SEQ ID NO: 174444 - RNA, 22 nt, Human
uuggauguccucuguggaguau

SEQ ID NO: 174445 - RNA, 22 nt, Human
uuggaggccacagucaucuuua

SEQ ID NO: 174446 - RNA, 22 nt, Human
uuggaggcagagucuugcugag

SEQ ID NO: 174447 - RNA, 19 nt, Human
uuggagcaucccaaaggcu

SEQ ID NO: 174448 - RNA, 22 nt, Human
uugauuugcagaagguguagag

SEQ ID NO: 174449 - RNA, 22 nt, Human
uugauuggguauaaugacagga

SEQ ID NO: 174450 - RNA, 22 nt, Human
uuuuuuguggcuggaagaaaaa

SEQ ID NO: 174451 - RNA, 22 nt, Human
uuuuuugucuugaagaaauggu

SEQ ID NO: 174452 - RNA, 22 nt, Human
uugauagauuuuagaggcaggc

SEQ ID NO: 174453 - RNA, 22 nt, Human
uugaugacauuuagcauaauug

SEQ ID NO: 174454 - RNA, 22 nt, Human
uugaugacuaaagaaagcugcu

SEQ ID NO: 174455 - RNA, 22 nt, Human
uuuuugggccaaauauauuuac

SEQ ID NO: 174456 - RNA, 22 nt, Human
uugaaaaaaucugaggaggacc

SEQ ID NO: 174457 - RNA, 22 nt, Human
uucuuccagugaaacgugcauc

SEQ ID NO: 174458 - RNA, 20 nt, Human
uuuuguccaccugcaggaag

SEQ ID NO: 174459 - RNA, 21 nt, Human
uucuuugaagacccauuugag

SEQ ID NO: 174460 - RNA, 23 nt, Human
uucuuuccuuaucccauuuacuu

SEQ ID NO: 174461 - RNA, 22 nt, Human
uuuucucacugagagccuugau

SEQ ID NO: 174462 - RNA, 22 nt, Human
uuuugcuagaaaucaccaauac

SEQ ID NO: 174463 - RNA, 22 nt, Human
uuuucuuggaguggcuguccuu

SEQ ID NO: 174464 - RNA, 18 nt, Human
uucgucauggggaucgua

SEQ ID NO: 174465 - RNA, 22 nt, Human
uucgucauuaugcagccuguga

SEQ ID NO: 174466 - RNA, 22 nt, Human
uuuuagccagcaucugggucga

SEQ ID NO: 174467 - RNA, 22 nt, Human
uuuguuuuggugucaugcguga

SEQ ID NO: 174468 - RNA, 22 nt, Human
uuuguugucuucauaauacuuu

SEQ ID NO: 174469 - RNA, 22 nt, Human
uuccucuugaaucugucugacu

SEQ ID NO: 174470 - RNA, 22 nt, Human
uuccugacacuggcaggcuucu

SEQ ID NO: 174471 - RNA, 21 nt, Human
uuccuccucuggagaagaaga

SEQ ID NO: 174472 - RNA, 22 nt, Human
uuugugguuuugagagaguugc

SEQ ID NO: 174473 - RNA, 22 nt, Human
uuuguccuguuggcaugaaaau

SEQ ID NO: 174474 - RNA, 22 nt, Human
uuccaaggagagcucgaccuca

SEQ ID NO: 174475 - RNA, 22 nt, Human
uuccaaggcugcuauuuguuuc

SEQ ID NO: 174476 - RNA, 22 nt, Human
uucaugcaagagugugaggucc

SEQ ID NO: 174477 - RNA, 21 nt, Human
uuuguucaggggcaaaguuaa

SEQ ID NO: 174478 - RNA, 22 nt, Human
uucccaggugugagugagguga

SEQ ID NO: 174479 - RNA, 22 nt, Human
uucccagggaucucuaguauuu

SEQ ID NO: 174480 - RNA, 22 nt, Human
uuuguuguauuaacccagggua

SEQ ID NO: 174481 - RNA, 22 nt, Human
uucaggugguuuaagaauugga

SEQ ID NO: 174482 - RNA, 20 nt, Human
uucaggaccuuccaguccau

SEQ ID NO: 174483 - RNA, 22 nt, Human
uucaggacuauccaguggucuc

SEQ ID NO: 174484 - RNA, 22 nt, Human
uuuggcuaccugggagggaaag

SEQ ID NO: 174485 - RNA, 22 nt, Human
uuuggcuccccaggaucugaaa

SEQ ID NO: 174486 - RNA, 19 nt, Human
uuugccugugguucagaag

SEQ ID NO: 174487 - RNA, 22 nt, Human
uuugccggaucugucuccagcu

SEQ ID NO: 174488 - RNA, 22 nt, Human
uucagcugcuugccugaaguca

SEQ ID NO: 174489 - RNA, 22 nt, Human
uuugcuguccaauauucagggu

SEQ ID NO: 174490 - RNA, 22 nt, Human
uuugcuguaaugcaugucagag

SEQ ID NO: 174491 - RNA, 22 nt, Human
uucagcaagugucucuacuguc

SEQ ID NO: 174492 - RNA, 22 nt, Human
uuugccccacaggcagcuuugg

SEQ ID NO: 174493 - RNA, 21 nt, Human
uucaaccagcaauuggcagaa

SEQ ID NO: 174494 - RNA, 20 nt, Human
uucacagaucucuaacugag

SEQ ID NO: 174495 - RNA, 20 nt, Human
uucacagaggacucagguca

SEQ ID NO: 174496 - RNA, 20 nt, Human
uucacggaggccgcgccccc

SEQ ID NO: 174497 - RNA, 22 nt, Human
uucacccuucucuggcuuucag

SEQ ID NO: 174498 - RNA, 22 nt, Human
uucacccaaaucaagcuggccu

SEQ ID NO: 174499 - RNA, 22 nt, Human
uugggugcugcacccuucaaca

SEQ ID NO: 174500 - RNA, 22 nt, Human
uuggggaugccccuacgggcua

SEQ ID NO: 174501 - RNA, 22 nt, Human
uuggggccggcgcggaggaggg

SEQ ID NO: 174502 - RNA, 22 nt, Human
uugguugcugaugagcuuugag

SEQ ID NO: 174503 - RNA, 22 nt, Human
uugguauucaguuggauuugga

SEQ ID NO: 174504 - RNA, 22 nt, Human
uugguauuuguuuaaauuacac

SEQ ID NO: 174505 - RNA, 22 nt, Human
uugucaggaacuaugauuaugc

SEQ ID NO: 174506 - RNA, 22 nt, Human
uugucagcuagugaugcuguuc

SEQ ID NO: 174507 - RNA, 22 nt, Human
uguuuagcucugacuaugugau

SEQ ID NO: 174508 - RNA, 22 nt, Human
uguuguucuuuuucuucuuguu

SEQ ID NO: 174509 - RNA, 22 nt, Human
uuguggagaggaagcaaggagg

SEQ ID NO: 174510 - RNA, 22 nt, Human
uugugcagugccuggacccagg

SEQ ID NO: 174511 - RNA, 23 nt, Human
uugugcggugcuuuggguuuaca

SEQ ID NO: 174512 - RNA, 22 nt, Human
uguuuuuagcuguuuuuuggau

SEQ ID NO: 174513 - RNA, 22 nt, Human
uguuuuguuuagguuuguuuuu

SEQ ID NO: 174514 - RNA, 21 nt, Human
uguuuuguaauagauacuaug

SEQ ID NO: 174515 - RNA, 21 nt, Human
uugugaaaguccaggaacaac

SEQ ID NO: 174516 - RNA, 22 nt, Human
uugucuuggcauaccguuauau

SEQ ID NO: 174517 - RNA, 22 nt, Human
uugucuguacuggcugcaucga

SEQ ID NO: 174518 - RNA, 22 nt, Human
uuggcaggcugcauguuuaugu

SEQ ID NO: 174519 - RNA, 22 nt, Human
uuggcagagaacagaaugauuu

SEQ ID NO: 174520 - RNA, 22 nt, Human
uuggcacagagcugcagccugg

SEQ ID NO: 174521 - RNA, 22 nt, Human
uuggggagaagagcuggucagg

SEQ ID NO: 174522 - RNA, 22 nt, Human
uuggggaggaagauagggugaa

SEQ ID NO: 174523 - RNA, 22 nt, Human
uguuccuuuuguuguuuuguuu

SEQ ID NO: 174524 - RNA, 22 nt, Human
uuggccaaggaccuuuuuggag

SEQ ID NO: 174525 - RNA, 20 nt, Human
uugcggccuaacagccccuu

SEQ ID NO: 174526 - RNA, 22 nt, Human
uugcggaucuucauggccucag

SEQ ID NO: 174527 - RNA, 22 nt, Human
uguguguguguguaugugcgug

SEQ ID NO: 174528 - RNA, 22 nt, Human
uuaauauuuauugguaaucacu

SEQ ID NO: 174529 - RNA, 22 nt, Human
uuaaucagacauucucaaguuu

SEQ ID NO: 174530 - RNA, 22 nt, Human
uuguuuguaaggcucuuagaau

SEQ ID NO: 174531 - RNA, 23 nt, Human
uuuaaacaauguggucguggugg

SEQ ID NO: 174532 - RNA, 22 nt, Human
uuuaaauaguugguuuuuuugc

SEQ ID NO: 174533 - RNA, 22 nt, Human
uuguuguuguuguuauuuaguu

SEQ ID NO: 174534 - RNA, 22 nt, Human
uuguuccuaguuguccaucaca

SEQ ID NO: 174535 - RNA, 22 nt, Human
uuaacauuguccuuagcagauu

SEQ ID NO: 174536 - RNA, 22 nt, Human
uuuaccugucuguagaacauaa

SEQ ID NO: 174537 - RNA, 22 nt, Human
uuaccuuggaccggguaucaga

SEQ ID NO: 174538 - RNA, 22 nt, Human
uuuaaguuaguauggguuaggu

SEQ ID NO: 174539 - RNA, 22 nt, Human
uuacacaugaagguccaauguu

SEQ ID NO: 174540 - RNA, 22 nt, Human
uuuauaaacacaagaugggcuc

SEQ ID NO: 174541 - RNA, 22 nt, Human
uguagggaucugccucuuccuc

SEQ ID NO: 174542 - RNA, 22 nt, Human
uugaagccaccacuguaaguca

SEQ ID NO: 174543 - RNA, 22 nt, Human
uugaagaagucaaaagcugcag

SEQ ID NO: 174544 - RNA, 22 nt, Human
uguagugaaauuaaaccaaagc

SEQ ID NO: 174545 - RNA, 22 nt, Human
uugaaaaaugcccagcagacaa

SEQ ID NO: 174546 - RNA, 22 nt, Human
uguaccucagauuauugaucuc

SEQ ID NO: 174547 - RNA, 20 nt, Human
uugaaagucagggcuccagu

SEQ ID NO: 174548 - RNA, 22 nt, Human
uguacuuguaauaucagugaaa

SEQ ID NO: 174549 - RNA, 22 nt, Human
ugguucugucugugcugggggg

SEQ ID NO: 174550 - RNA, 22 nt, Human
ugguugcaguggugcuuauaca

SEQ ID NO: 174551 - RNA, 22 nt, Human
ugguugagguugacucuauaua

SEQ ID NO: 174552 - RNA, 21 nt, Human
uucuuugcugcuguuuuugua

SEQ ID NO: 174553 - RNA, 22 nt, Human
uugaaaaaauguguuuaaggag

SEQ ID NO: 174554 - RNA, 22 nt, Human
uucuuuuaauagagauccugug

SEQ ID NO: 174555 - RNA, 22 nt, Human
uucuugcgaaagaaugagcuga

SEQ ID NO: 174556 - RNA, 22 nt, Human
uucuucuguuggcagagcauac

SEQ ID NO: 174557 - RNA, 20 nt, Human
ugguguccuaugcuugugcu

SEQ ID NO: 174558 - RNA, 22 nt, Human
uucuugcuucucugucugccuc

SEQ ID NO: 174559 - RNA, 23 nt, Human
uggugugaggaaggaagacuuua

SEQ ID NO: 174560 - RNA, 22 nt, Human
uucuuugcucaccugccgcucc

SEQ ID NO: 174561 - RNA, 22 nt, Human
uggucuuuccuucauuguccag

SEQ ID NO: 174562 - RNA, 22 nt, Human
uggugcacgugggcagucggcc

SEQ ID NO: 174563 - RNA, 22 nt, Human
uggugaggacccagauuuuccu

SEQ ID NO: 174564 - RNA, 22 nt, Human
uucugugacgcaaagcugggaa

SEQ ID NO: 174565 - RNA, 22 nt, Human
ugucuucauuccccaugaaguc

SEQ ID NO: 174566 - RNA, 22 nt, Human
uugcagcuguugcaaagucucu

SEQ ID NO: 174567 - RNA, 20 nt, Human
uugcaugcagccggaugcug

SEQ ID NO: 174568 - RNA, 22 nt, Human
uugcaucagcaggcauaauugg

SEQ ID NO: 174569 - RNA, 22 nt, Human
ugugccuguugguguagacaua

SEQ ID NO: 174570 - RNA, 22 nt, Human
ugugccuucuucauuuaauuua

SEQ ID NO: 174571 - RNA, 22 nt, Human
uugcccuaccccaggccuuuuu

SEQ ID NO: 174572 - RNA, 22 nt, Human
uugccaggagacaucuggagcc

SEQ ID NO: 174573 - RNA, 22 nt, Human
uugcaugugugaaaugcacaga

SEQ ID NO: 174574 - RNA, 22 nt, Human
ugucugggauguuggcagccac

SEQ ID NO: 174575 - RNA, 20 nt, Human
ugucugguaagacgcccauc

SEQ ID NO: 174576 - RNA, 21 nt, Human
ugucugcaauuccagggaacc

SEQ ID NO: 174577 - RNA, 22 nt, Human
uugagacucgagucucucagac

SEQ ID NO: 174578 - RNA, 21 nt, Human
ugucagcaacaauacuuucuc

SEQ ID NO: 174579 - RNA, 22 nt, Human
uugaugagucacuuucuguaaa

SEQ ID NO: 174580 - RNA, 23 nt, Human
uugaucuggaaaauacuuguuug

SEQ ID NO: 174581 - RNA, 22 nt, Human
ugucauuggugaucugaugccu

SEQ ID NO: 174582 - RNA, 22 nt, Human
uguccagcuauauguguaugug

SEQ ID NO: 174583 - RNA, 22 nt, Human
ugucccuggacuccaggagcca

SEQ ID NO: 174584 - RNA, 22 nt, Human
uugaccagaaaaguuaguaauu

SEQ ID NO: 174585 - RNA, 22 nt, Human
uugaccauguggcccaggccaa

SEQ ID NO: 174586 - RNA, 22 nt, Human
uugagcagccauuagcuggggu

SEQ ID NO: 174587 - RNA, 20 nt, Human
uugagccucauggauugucu

SEQ ID NO: 174588 - RNA, 22 nt, Human
uugaauaguuuuggauagcaua

SEQ ID NO: 174589 - RNA, 21 nt, Human
uugaaguggguagcuggcggg

SEQ ID NO: 174590 - RNA, 22 nt, Human
uugaauuuagguuuaugugaaa

SEQ ID NO: 174591 - RNA, 22 nt, Human
uuccugcuggucaaaguugccu

SEQ ID NO: 174592 - RNA, 22 nt, Human
uuccugaucuuuucccagaguu

SEQ ID NO: 174593 - RNA, 19 nt, Human
uuccucaggugugaguuag

SEQ ID NO: 174594 - RNA, 22 nt, Human
uucccggccgccccccgcucgg

SEQ ID NO: 174595 - RNA, 21 nt, Human
uuccuggaggcagaaacguga

SEQ ID NO: 174596 - RNA, 22 nt, Human
uuccuguggggugucaucauag

SEQ ID NO: 174597 - RNA, 21 nt, Human
uucgaaugggucguugcugcc

SEQ ID NO: 174598 - RNA, 22 nt, Human
uggggcgcaggcccagcgggcu

SEQ ID NO: 174599 - RNA, 22 nt, Human
uucgcggccaggcggggaggcc

SEQ ID NO: 174600 - RNA, 22 nt, Human
uucgucaauaugcagccuguga

SEQ ID NO: 174601 - RNA, 22 nt, Human
uucggugagcugcgggcgagga

SEQ ID NO: 174602 - RNA, 22 nt, Human
uucggcagaaagucauuugucu

SEQ ID NO: 174603 - RNA, 22 nt, Human
uucgcucuucacacagugcuga

SEQ ID NO: 174604 - RNA, 21 nt, Human
uuccauggacccugucagugu

SEQ ID NO: 174605 - RNA, 22 nt, Human
uuccauggggcuguugcgcaga

SEQ ID NO: 174606 - RNA, 22 nt, Human
uggcuuuuuauuccuaugugau

SEQ ID NO: 174607 - RNA, 22 nt, Human
uggcuuuuuucuccccuuggau

SEQ ID NO: 174608 - RNA, 22 nt, Human
uggcuguuggagcuggaagaug

SEQ ID NO: 174609 - RNA, 22 nt, Human
ugggaagcugagccucgaugug

SEQ ID NO: 174610 - RNA, 22 nt, Human
ugggaagaguuagagacagcug

SEQ ID NO: 174611 - RNA, 22 nt, Human
uuccaagcaccaugaaggccuc

SEQ ID NO: 174612 - RNA, 22 nt, Human
uggagcugaaguacucucacua

SEQ ID NO: 174613 - RNA, 22 nt, Human
uucuggggccgugacgaggggc

SEQ ID NO: 174614 - RNA, 22 nt, Human
uucugggguaagcacugaggau

SEQ ID NO: 174615 - RNA, 22 nt, Human
uucuggaguuugaagaucaggu

SEQ ID NO: 174616 - RNA, 22 nt, Human
uucuggucucucugaccuagga

SEQ ID NO: 174617 - RNA, 22 nt, Human
ugguccgagaacuguccugguu

SEQ ID NO: 174618 - RNA, 22 nt, Human
ugguaacgguuuccuugccauu

SEQ ID NO: 174619 - RNA, 21 nt, Human
ugguaaggggauccuguuacu

SEQ ID NO: 174620 - RNA, 22 nt, Human
ugguaauuuaacaaaauuguca

SEQ ID NO: 174621 - RNA, 22 nt, Human
uucugcuagugguauauguuga

SEQ ID NO: 174622 - RNA, 20 nt, Human
uucugcucuagagucuagaa

SEQ ID NO: 174623 - RNA, 19 nt, Human
uucugcucaguaacacccu

SEQ ID NO: 174624 - RNA, 21 nt, Human
uucugcuguucaccaccaccc

SEQ ID NO: 174625 - RNA, 23 nt, Human
uucugcuucccauagcacuuugu

SEQ ID NO: 174626 - RNA, 22 nt, Human
uucugcuuuaaagcucauguuu

SEQ ID NO: 174627 - RNA, 23 nt, Human
uggguuucagugccaaugcugcc

SEQ ID NO: 174628 - RNA, 22 nt, Human
uggguuugcuuguucagguucu

SEQ ID NO: 174629 - RNA, 22 nt, Human
uggguguguccauauuuugacu

SEQ ID NO: 174630 - RNA, 22 nt, Human
uggguguggaagcagcgugggg

SEQ ID NO: 174631 - RNA, 22 nt, Human
ugggugugcaccuacgaucucu

SEQ ID NO: 174632 - RNA, 22 nt, Human
uggggcuccuccuggcaggagg

SEQ ID NO: 174633 - RNA, 22 nt, Human
uggggcggaaggaggagaggug

SEQ ID NO: 174634 - RNA, 22 nt, Human
uggacagugguggggaggagga

SEQ ID NO: 174635 - RNA, 22 nt, Human
uggaagugucagcaggcugguu

SEQ ID NO: 174636 - RNA, 22 nt, Human
uggaagugggcaucaccaucca

SEQ ID NO: 174637 - RNA, 22 nt, Human
uggaaugccgggccaggcuccg

SEQ ID NO: 174638 - RNA, 21 nt, Human
uggaauuggaaaccauucuau

SEQ ID NO: 174639 - RNA, 22 nt, Human
uggagaaauaacauuuggauuc

SEQ ID NO: 174640 - RNA, 22 nt, Human
uggacuguucauugauacugga

SEQ ID NO: 174641 - RNA, 22 nt, Human
uggagagcaaugaggggcaggc

SEQ ID NO: 174642 - RNA, 22 nt, Human
uggagcaagaagggaggcagaa

SEQ ID NO: 174643 - RNA, 21 nt, Human
uggagcagggaggauuugggg

SEQ ID NO: 174644 - RNA, 22 nt, Human
uggagagcaggugaaggaaaga

SEQ ID NO: 174645 - RNA, 22 nt, Human
uggaaggaaauguguaucauaa

SEQ ID NO: 174646 - RNA, 22 nt, Human
uggaagcuggcugaucugacuu

SEQ ID NO: 174647 - RNA, 22 nt, Human
uggaagucuucucucccaugga

SEQ ID NO: 174648 - RNA, 22 nt, Human
uggaagggguuacgcagcagga

SEQ ID NO: 174649 - RNA, 22 nt, Human
uggaaguggcaggggagacgua

SEQ ID NO: 174650 - RNA, 22 nt, Human
uggaagaaaugguugagccaug

SEQ ID NO: 174651 - RNA, 22 nt, Human
uggaagaucugguguagcuccu

SEQ ID NO: 174652 - RNA, 22 nt, Human
uggaagcccagaaggaagcaga

SEQ ID NO: 174653 - RNA, 22 nt, Human
uggaagaagcuacaagcgguga

SEQ ID NO: 174654 - RNA, 22 nt, Human
uuagguuuaugaggucugcauu

SEQ ID NO: 174655 - RNA, 22 nt, Human
uggaaaugcuuagaggugaucu

SEQ ID NO: 174656 - RNA, 22 nt, Human
uggaaagcagcccugcucccca

SEQ ID NO: 174657 - RNA, 22 nt, Human
uggaaagaagacugugguugag

SEQ ID NO: 174658 - RNA, 22 nt, Human
uuaccgagaacaugacuggaau

SEQ ID NO: 174659 - RNA, 22 nt, Human
ugcuuguuuuguggcuucagcu

SEQ ID NO: 174660 - RNA, 22 nt, Human
ugcuuucagauaucuguuucaa

SEQ ID NO: 174661 - RNA, 22 nt, Human
ugcuuuuguaucagaguauuca

SEQ ID NO: 174662 - RNA, 21 nt, Human
ugcuuuuguugucagcugcug

SEQ ID NO: 174663 - RNA, 22 nt, Human
uuaccugccucaaacacgaaug

SEQ ID NO: 174664 - RNA, 20 nt, Human
ugcuguggguaagcuuuaua

SEQ ID NO: 174665 - RNA, 22 nt, Human
ugcuucuuuccuuggugacuuc

SEQ ID NO: 174666 - RNA, 22 nt, Human
ugcuugggucuguuuugcaaag

SEQ ID NO: 174667 - RNA, 22 nt, Human
ugcuugcuaucuaaguguuuca

SEQ ID NO: 174668 - RNA, 20 nt, Human
ugcugggccaucuugcaugc

SEQ ID NO: 174669 - RNA, 22 nt, Human
ugcugugagaccauuuguugag

SEQ ID NO: 174670 - RNA, 22 nt, Human
ugcugguuucugaguaaccaca

SEQ ID NO: 174671 - RNA, 22 nt, Human
ugcuggaguggcacuguguggc

SEQ ID NO: 174672 - RNA, 22 nt, Human
ugcuggagucucuugacccugg

SEQ ID NO: 174673 - RNA, 22 nt, Human
ugcugggagcugggccucgaca

SEQ ID NO: 174674 - RNA, 22 nt, Human
ugcuggagccauguuuucucua

SEQ ID NO: 174675 - RNA, 23 nt, Human
ugcugcuggaguaucuacaaugc

SEQ ID NO: 174676 - RNA, 22 nt, Human
uguuuuuucccccccuucuaaa

SEQ ID NO: 174677 - RNA, 22 nt, Human
ugcugcucaagcugcagcaaaa

SEQ ID NO: 174678 - RNA, 22 nt, Human
ugcugcucuucaccauggccuc

SEQ ID NO: 174679 - RNA, 22 nt, Human
ugcuggaaggguaguauuaacu

SEQ ID NO: 174680 - RNA, 22 nt, Human
ugcugccucccaucccucccga

SEQ ID NO: 174681 - RNA, 22 nt, Human
ugcugccucugaauggagcagu

SEQ ID NO: 174682 - RNA, 22 nt, Human
ugcugcggauauacaggaucug

SEQ ID NO: 174683 - RNA, 22 nt, Human
uguuuucaucucucacccagaa

SEQ ID NO: 174684 - RNA, 22 nt, Human
uguuugaggugacucuggaaug

SEQ ID NO: 174685 - RNA, 22 nt, Human
uguuuccuguaccacagguuuu

SEQ ID NO: 174686 - RNA, 22 nt, Human
uguuuaguuuugcaccaauaaa

SEQ ID NO: 174687 - RNA, 22 nt, Human
ugcugcacuuauggcucugagg

SEQ ID NO: 174688 - RNA, 22 nt, Human
ugcugccgccgccaccgccgcc

SEQ ID NO: 174689 - RNA, 21 nt, Human
ugccuggccuuugcuuuuccu

SEQ ID NO: 174690 - RNA, 22 nt, Human
ugccuguguauuuccggccugc

SEQ ID NO: 174691 - RNA, 22 nt, Human
uguguguguccucauuugcaga

SEQ ID NO: 174692 - RNA, 22 nt, Human
uguuggcagugcuacagucagu

SEQ ID NO: 174693 - RNA, 22 nt, Human
uguuggugcacugaaaggcagg

SEQ ID NO: 174694 - RNA, 18 nt, Human
uguugguguucacucacu

SEQ ID NO: 174695 - RNA, 22 nt, Human
uguuguuguuguuguuguuguu

SEQ ID NO: 174696 - RNA, 22 nt, Human
ugcuccugaacacagcccuaug

SEQ ID NO: 174697 - RNA, 22 nt, Human
ugcucgggcuccuuugagugag

SEQ ID NO: 174698 - RNA, 22 nt, Human
ugcucugguccucccucggcgc

SEQ ID NO: 174699 - RNA, 22 nt, Human
ugagaaauauacaccagacaca

SEQ ID NO: 174700 - RNA, 22 nt, Human
uggguucaaauccugguuccac

SEQ ID NO: 174701 - RNA, 20 nt, Human
uggguucaguuguuucuggc

SEQ ID NO: 174702 - RNA, 22 nt, Human
ugguaaaguguacugaauauga

SEQ ID NO: 174703 - RNA, 21 nt, Human
ugguccaaggacucauaccug

SEQ ID NO: 174704 - RNA, 22 nt, Human
ugguccaaaccagugcuguggu

SEQ ID NO: 174705 - RNA, 22 nt, Human
uggucacgucgggguauugcca

SEQ ID NO: 174706 - RNA, 22 nt, Human
uggucacacugcauaacacgca

SEQ ID NO: 174707 - RNA, 22 nt, Human
ugguaugaaggaggccggcagc

SEQ ID NO: 174708 - RNA, 22 nt, Human
uggucaaauccuagauccuuug

SEQ ID NO: 174709 - RNA, 22 nt, Human
uggucaagcaaugaauuuauuu

SEQ ID NO: 174710 - RNA, 22 nt, Human
ugagagggagacagcucuagca

SEQ ID NO: 174711 - RNA, 22 nt, Human
ugagagguagaacuuguagugu

SEQ ID NO: 174712 - RNA, 22 nt, Human
ugagacuuggggggcugagggc

SEQ ID NO: 174713 - RNA, 22 nt, Human
ugagacugaguuugguuuuguu

SEQ ID NO: 174714 - RNA, 22 nt, Human
ugguagacaacagcagugggac

SEQ ID NO: 174715 - RNA, 22 nt, Human
ugggugaugagguccccagccc

SEQ ID NO: 174716 - RNA, 22 nt, Human
ugggugccgcaucuugcuguuc

SEQ ID NO: 174717 - RNA, 22 nt, Human
ugggugggcagagucuaagaua

SEQ ID NO: 174718 - RNA, 22 nt, Human
uggguggauucgggaacuuguu

SEQ ID NO: 174719 - RNA, 22 nt, Human
ugacguuugcgccgcgcacgac

SEQ ID NO: 174720 - RNA, 22 nt, Human
uggguggugaaauggaugggaa

SEQ ID NO: 174721 - RNA, 22 nt, Human
uggguguuccuggggugcaagg

SEQ ID NO: 174722 - RNA, 22 nt, Human
ugggugugggguaggguaagag

SEQ ID NO: 174723 - RNA, 22 nt, Human
ugagaaaacaguuuguaauaau

SEQ ID NO: 174724 - RNA, 22 nt, Human
uggguccaggauucuguguuuc

SEQ ID NO: 174725 - RNA, 22 nt, Human
ugggucaguagccuugcagaac

SEQ ID NO: 174726 - RNA, 22 nt, Human
uggguagcucaauagagccaca

SEQ ID NO: 174727 - RNA, 22 nt, Human
ugaaagccuacagcucacuguu

SEQ ID NO: 174728 - RNA, 22 nt, Human
ucuuuuuaugucaaaaucgaug

SEQ ID NO: 174729 - RNA, 20 nt, Human
ugauaugcgguacagagagg

SEQ ID NO: 174730 - RNA, 22 nt, Human
ugaucauugaacaucgaguuaa

SEQ ID NO: 174731 - RNA, 23 nt, Human
uguacugucuuucagguucuuau

SEQ ID NO: 174732 - RNA, 19 nt, Human
ugaucuccaguacagacau

SEQ ID NO: 174733 - RNA, 22 nt, Human
ugaugaucaugcagguugguuu

SEQ ID NO: 174734 - RNA, 22 nt, Human
ugaguccagaugggccagcagg

SEQ ID NO: 174735 - RNA, 22 nt, Human
ugagucugaagagagaauaagg

SEQ ID NO: 174736 - RNA, 22 nt, Human
ugagugcacaggccacucuuca

SEQ ID NO: 174737 - RNA, 22 nt, Human
ugguuucagacagacucgaacu

SEQ ID NO: 174738 - RNA, 22 nt, Human
ugguuuccugauggacacuugg

SEQ ID NO: 174739 - RNA, 22 nt, Human
ugguuuucuuaauuagcaguca

SEQ ID NO: 174740 - RNA, 22 nt, Human
ugguuuuuuguaggauaaacau

SEQ ID NO: 174741 - RNA, 22 nt, Human
ugguccuuuccauuggagacac

SEQ ID NO: 174742 - RNA, 22 nt, Human
uggucggugguguggggaggca

SEQ ID NO: 174743 - RNA, 22 nt, Human
uggucucaaagcaaggaaggaa

SEQ ID NO: 174744 - RNA, 22 nt, Human
uggucugauggucccaccaccg

SEQ ID NO: 174745 - RNA, 22 nt, Human
uggugccuuccgagagcuguga

SEQ ID NO: 174746 - RNA, 19 nt, Human
uggugcgcuguuccugagc

SEQ ID NO: 174747 - RNA, 22 nt, Human
uggugcuuuuguggaugcuaac

SEQ ID NO: 174748 - RNA, 19 nt, Human
ugagauuguaugaggagau

SEQ ID NO: 174749 - RNA, 22 nt, Human
ugguucacaagaauccagguag

SEQ ID NO: 174750 - RNA, 22 nt, Human
ugagggagggggagccguucua

SEQ ID NO: 174751 - RNA, 22 nt, Human
ugagggaggggaaugugugcag

SEQ ID NO: 174752 - RNA, 22 nt, Human
ugguggccucaguggcuucugu

SEQ ID NO: 174753 - RNA, 20 nt, Human
ugguguacauuuccauaguu

SEQ ID NO: 174754 - RNA, 21 nt, Human
ugguguacauuuccauaguuu

SEQ ID NO: 174755 - RNA, 22 nt, Human
ugguggcuuuucguagguucac

SEQ ID NO: 174756 - RNA, 22 nt, Human
ugaggaugagaaggaagagaag

SEQ ID NO: 174757 - RNA, 22 nt, Human
ugguggcaauuuuuggggucaa

SEQ ID NO: 174758 - RNA, 22 nt, Human
uggucugggaagaucacaauua

SEQ ID NO: 174759 - RNA, 22 nt, Human
ugaggaugaggaagaagaagaa

SEQ ID NO: 174760 - RNA, 22 nt, Human
ugucugauccuucaggagcccc

SEQ ID NO: 174761 - RNA, 22 nt, Human
ugucugaauuguaauguugcgu

SEQ ID NO: 174762 - RNA, 23 nt, Human
ugcaaugcagcuagauguaaaau

SEQ ID NO: 174763 - RNA, 22 nt, Human
ugcagacuguuucuugacugaa

SEQ ID NO: 174764 - RNA, 22 nt, Human
ugcagaacacaguagacagaac

SEQ ID NO: 174765 - RNA, 22 nt, Human
ugcagccucacgcauccgcauu

SEQ ID NO: 174766 - RNA, 19 nt, Human
ugcagcacuaaaaacuuuc

SEQ ID NO: 174767 - RNA, 22 nt, Human
ugugagauuuuauuugauaugc

SEQ ID NO: 174768 - RNA, 22 nt, Human
ugugagucuugcaggucgcuca

SEQ ID NO: 174769 - RNA, 22 nt, Human
ugugaagugaugggugaccgag

SEQ ID NO: 174770 - RNA, 22 nt, Human
ugugaagcgugugcaggggaca

SEQ ID NO: 174771 - RNA, 23 nt, Human
ugugaauggccuucuuuagaggu

SEQ ID NO: 174772 - RNA, 22 nt, Human
ugugaaugacuuuguucuuugc

SEQ ID NO: 174773 - RNA, 22 nt, Human
ugucacagagcgugcaacagaa

SEQ ID NO: 174774 - RNA, 22 nt, Human
ugucacggccggguggcaccga

SEQ ID NO: 174775 - RNA, 22 nt, Human
ugaugaugccaaaauuuggcau

SEQ ID NO: 174776 - RNA, 22 nt, Human
ugauuguauuuauccucuguuc

SEQ ID NO: 174777 - RNA, 22 nt, Human
ugauugggacauuuuguuuucu

SEQ ID NO: 174778 - RNA, 22 nt, Human
ugauugguauguauguuuguca

SEQ ID NO: 174779 - RNA, 22 nt, Human
ugauggaguauaauaaaaugac

SEQ ID NO: 174780 - RNA, 20 nt, Human
ugucccuggagagcugcaga

SEQ ID NO: 174781 - RNA, 22 nt, Human
ugucagccacggugugaccggc

SEQ ID NO: 174782 - RNA, 22 nt, Human
ugugcuggcuucugugagcuga

SEQ ID NO: 174783 - RNA, 22 nt, Human
ugcagugaugcuucuggcucag

SEQ ID NO: 174784 - RNA, 22 nt, Human
uguggacaccuauuaccaguga

SEQ ID NO: 174785 - RNA, 22 nt, Human
uguggcaauauggaauguguuu

SEQ ID NO: 174786 - RNA, 22 nt, Human
uguggauauauuuuaaaaggaa

SEQ ID NO: 174787 - RNA, 22 nt, Human
ugcaucccaaacaugguuuccu

SEQ ID NO: 174788 - RNA, 22 nt, Human
ugcaucccugaggcauuauccu

SEQ ID NO: 174789 - RNA, 22 nt, Human
ugcaugaucucacuuacaggug

SEQ ID NO: 174790 - RNA, 22 nt, Human
ugcaugcagcuggucgggcgcc

SEQ ID NO: 174791 - RNA, 17 nt, Human
ugcaugcgucugugaua

SEQ ID NO: 174792 - RNA, 22 nt, Human
ugcagccuuuguccuugggcua

SEQ ID NO: 174793 - RNA, 22 nt, Human
ugcagcgugaggacagcugagc

SEQ ID NO: 174794 - RNA, 22 nt, Human
ugugaugagaugaacuguagac

SEQ ID NO: 174795 - RNA, 22 nt, Human
ugugauugcauugcagauuacu

SEQ ID NO: 174796 - RNA, 22 nt, Human
ugugauugucuucugaaaguca

SEQ ID NO: 174797 - RNA, 19 nt, Human
ugcagcuguaugagcuuaa

SEQ ID NO: 174798 - RNA, 22 nt, Human
ugcagcuucucugcaacaggag

SEQ ID NO: 174799 - RNA, 22 nt, Human
ugugauuucaaagggugucuuu

SEQ ID NO: 174800 - RNA, 22 nt, Human
ugcagcuuuugguuucuagaug

SEQ ID NO: 174801 - RNA, 18 nt, Human
ugcagcuuugugauuggc

SEQ ID NO: 174802 - RNA, 19 nt, Human
ugccggccgcgggguuccu

SEQ ID NO: 174803 - RNA, 22 nt, Human
ugccgccgugggucccgacgcg

SEQ ID NO: 174804 - RNA, 22 nt, Human
uguguauguauguauguaugua

SEQ ID NO: 174805 - RNA, 22 nt, Human
ugugucgccaacaauugugucu

SEQ ID NO: 174806 - RNA, 22 nt, Human
uguguggccuccauaggguacu

SEQ ID NO: 174807 - RNA, 22 nt, Human
uguguggaaaugcuguauaugu

SEQ ID NO: 174808 - RNA, 22 nt, Human
ugugugcuaguuuugucaguau

SEQ ID NO: 174809 - RNA, 22 nt, Human
ugccgcaggaggggcgauuucu

SEQ ID NO: 174810 - RNA, 22 nt, Human
ugcccugucccuagguuugugg

SEQ ID NO: 174811 - RNA, 22 nt, Human
ugcccuuucuccagugaccauu

SEQ ID NO: 174812 - RNA, 22 nt, Human
ugccgcuuucuggcccucaguc

SEQ ID NO: 174813 - RNA, 19 nt, Human
ugccccuucuucauccauc

SEQ ID NO: 174814 - RNA, 22 nt, Human
uguggugcagcgggaacagcuu

SEQ ID NO: 174815 - RNA, 22 nt, Human
ugcauuacuuugauaagcgucu

SEQ ID NO: 174816 - RNA, 22 nt, Human
ugccagcuccgaggagcugcag

SEQ ID NO: 174817 - RNA, 22 nt, Human
ugcaugguuauauacuacuagu

SEQ ID NO: 174818 - RNA, 22 nt, Human
ugcauguuauuguggcaagaau

SEQ ID NO: 174819 - RNA, 22 nt, Human
ugcauguuucuguauguuaaug

SEQ ID NO: 174820 - RNA, 22 nt, Human
ugccccuggaggagagcaaugg

SEQ ID NO: 174821 - RNA, 22 nt, Human
ugcccagcagggagcuaccugg

SEQ ID NO: 174822 - RNA, 19 nt, Human
uccaccgcgugcaccucua

SEQ ID NO: 174823 - RNA, 22 nt, Human
ugauugaauaauguuaugugaa

SEQ ID NO: 174824 - RNA, 22 nt, Human
uccaaggacucuugucagcugu

SEQ ID NO: 174825 - RNA, 22 nt, Human
ugaugugugaauucuuaaaugu

SEQ ID NO: 174826 - RNA, 22 nt, Human
ugauggaucuguuggcggguuu

SEQ ID NO: 174827 - RNA, 22 nt, Human
ugauggugagaugucccguguu

SEQ ID NO: 174828 - RNA, 22 nt, Human
ugaucauguucuccaaaagcgu

SEQ ID NO: 174829 - RNA, 22 nt, Human
ugaugaugauacauuucuucag

SEQ ID NO: 174830 - RNA, 22 nt, Human
ugaucaacagggcuggaaagag

SEQ ID NO: 174831 - RNA, 22 nt, Human
ugauaugguaauaagauauucu

SEQ ID NO: 174832 - RNA, 21 nt, Human
ucauccagguccugcuucuuc

SEQ ID NO: 174833 - RNA, 22 nt, Human
ucaucauccuuuuuugaagagu

SEQ ID NO: 174834 - RNA, 22 nt, Human
ucauccgcaaccacuuuagccu

SEQ ID NO: 174835 - RNA, 22 nt, Human
ugaggccaagccuccucugcca

SEQ ID NO: 174836 - RNA, 17 nt, Human
ugaggcugucucccugg

SEQ ID NO: 174837 - RNA, 19 nt, Human
ugaggauugagguccagua

SEQ ID NO: 174838 - RNA, 22 nt, Human
ucauccugaagaaccugcuucc

SEQ ID NO: 174839 - RNA, 22 nt, Human
ugagugccagugcuugcucuac

SEQ ID NO: 174840 - RNA, 22 nt, Human
ucauccugucucuguucggaau

SEQ ID NO: 174841 - RNA, 22 nt, Human
ucaucgauggggagcucuacaa

SEQ ID NO: 174842 - RNA, 22 nt, Human
ucaucggcugucaucuucacgu

SEQ ID NO: 174843 - RNA, 22 nt, Human
ucaucuauaaguagcaucuggg

SEQ ID NO: 174844 - RNA, 22 nt, Human
ucaugggcaaacuuggggauca

SEQ ID NO: 174845 - RNA, 22 nt, Human
ucauggcucuaaagacauagau

SEQ ID NO: 174846 - RNA, 19 nt, Human
ucagugggacauuugcuuu

SEQ ID NO: 174847 - RNA, 22 nt, Human
ucagugguuaaguucuguccac

SEQ ID NO: 174848 - RNA, 22 nt, Human
ucaguuguuggaaguagaugua

SEQ ID NO: 174849 - RNA, 22 nt, Human
ugaggcaguucuuacuuguauu

SEQ ID NO: 174850 - RNA, 22 nt, Human
ugaggaagugguuguaugguuu

SEQ ID NO: 174851 - RNA, 22 nt, Human
ugaggaggugcuaccagcgucu

SEQ ID NO: 174852 - RNA, 21 nt, Human
ugagcccaaagcuguauuggu

SEQ ID NO: 174853 - RNA, 22 nt, Human
ugagcuauuucaccauauagau

SEQ ID NO: 174854 - RNA, 22 nt, Human
ugagcagagcacuugggaacga

SEQ ID NO: 174855 - RNA, 22 nt, Human
ugagccauguucaugaguucau

SEQ ID NO: 174856 - RNA, 22 nt, Human
ugagcaccaggcaccacagcuc

SEQ ID NO: 174857 - RNA, 22 nt, Human
ucagugagauuuuuagcaguag

SEQ ID NO: 174858 - RNA, 23 nt, Human
ucagugccaaggagaacuuggug

SEQ ID NO: 174859 - RNA, 22 nt, Human
ugagagcuccacaccuugcccu

SEQ ID NO: 174860 - RNA, 22 nt, Human
ucagguuuaagugacuggaauc

SEQ ID NO: 174861 - RNA, 22 nt, Human
ucagguuugcaaccucgggcaa

SEQ ID NO: 174862 - RNA, 22 nt, Human
ugagaacacuuuucucuuugcu

SEQ ID NO: 174863 - RNA, 22 nt, Human
ucuucaugaaauugauugcuua

SEQ ID NO: 174864 - RNA, 22 nt, Human
ucuucauuucuggggaauuggc

SEQ ID NO: 174865 - RNA, 22 nt, Human
ugagagaggugaaaugacuuuc

SEQ ID NO: 174866 - RNA, 22 nt, Human
ucagguuuuuaaggagcuagga

SEQ ID NO: 174867 - RNA, 22 nt, Human
ugagacagaccuuggaccaugu

SEQ ID NO: 174868 - RNA, 22 nt, Human
ucaguagcauuuaauguucagu

SEQ ID NO: 174869 - RNA, 22 nt, Human
uccaggacgccgacgugucggc

SEQ ID NO: 174870 - RNA, 22 nt, Human
uccagcugugcuccaggaggug

SEQ ID NO: 174871 - RNA, 22 nt, Human
uccagccugaacuuuguccaga

SEQ ID NO: 174872 - RNA, 22 nt, Human
uccagccauaucuuguagcccu

SEQ ID NO: 174873 - RNA, 22 nt, Human
ucccacacucaacacacaugua

SEQ ID NO: 174874 - RNA, 22 nt, Human
uccagagcuguccuacugugag

SEQ ID NO: 174875 - RNA, 22 nt, Human
ugauuugaaaccuuuggcaaga

SEQ ID NO: 174876 - RNA, 22 nt, Human
ucccgcccugcguucucccaug

SEQ ID NO: 174877 - RNA, 20 nt, Human
ugcacggcugugugugugca

SEQ ID NO: 174878 - RNA, 22 nt, Human
uccccaugaacuuguggcugcu

SEQ ID NO: 174879 - RNA, 22 nt, Human
ucccacugucuucucgugcucg

SEQ ID NO: 174880 - RNA, 22 nt, Human
ucccaccugcuaagauguaucc

SEQ ID NO: 174881 - RNA, 22 nt, Human
ucccacagcuuccuagccacag

SEQ ID NO: 174882 - RNA, 22 nt, Human
ugcaauggauaucugaacgugg

SEQ ID NO: 174883 - RNA, 22 nt, Human
ugcagugcagcuggaaguuggc

SEQ ID NO: 174884 - RNA, 22 nt, Human
ugcagugcagcuggaauaucuu

SEQ ID NO: 174885 - RNA, 22 nt, Human
ugcaguugcguuugcauuccau

SEQ ID NO: 174886 - RNA, 22 nt, Human
ugcaggucuggacccccacuuu

SEQ ID NO: 174887 - RNA, 22 nt, Human
uccgaccuuuacuucuugucuc

SEQ ID NO: 174888 - RNA, 22 nt, Human
uccgagggugacuaccgcuucc

SEQ ID NO: 174889 - RNA, 22 nt, Human
ucccuguggauuaaggagaugu

SEQ ID NO: 174890 - RNA, 22 nt, Human
uccgggcagcuccuggagcugu

SEQ ID NO: 174891 - RNA, 22 nt, Human
uccggcgaccuccagauguucc

SEQ ID NO: 174892 - RNA, 22 nt, Human
ugcaggagaaaguacggagcgu

SEQ ID NO: 174893 - RNA, 22 nt, Human
ugcagggucuccuguacuuggg

SEQ ID NO: 174894 - RNA, 18 nt, Human
ugcaggggaggggugaua

SEQ ID NO: 174895 - RNA, 22 nt, Human
ucccugcaggcauguacucuga

SEQ ID NO: 174896 - RNA, 21 nt, Human
ucccugcagccccaggccccc

SEQ ID NO: 174897 - RNA, 22 nt, Human
ucccugcgugagaaagcacuua

SEQ ID NO: 174898 - RNA, 22 nt, Human
ucgagauguuuguuguggugau

SEQ ID NO: 174899 - RNA, 22 nt, Human
ugccuuccuucuccccuccuuc

SEQ ID NO: 174900 - RNA, 22 nt, Human
ugccuggacgacaucacaguga

SEQ ID NO: 174901 - RNA, 22 nt, Human
uccuuguuggaauauccuuacc

SEQ ID NO: 174902 - RNA, 17 nt, Human
ugccuucgucuucaguu

SEQ ID NO: 174903 - RNA, 20 nt, Human
ugccuuccgccccgggcacc

SEQ ID NO: 174904 - RNA, 22 nt, Human
ugccuacuuuaguacuuuaaag

SEQ ID NO: 174905 - RNA, 22 nt, Human
ugccgggcugagcaagugcugc

SEQ ID NO: 174906 - RNA, 22 nt, Human
uccuuguaccauuugcucacag

SEQ ID NO: 174907 - RNA, 22 nt, Human
uccuggccuuggggagagaagu

SEQ ID NO: 174908 - RNA, 22 nt, Human
uccuggaagggaugguugagga

SEQ ID NO: 174909 - RNA, 22 nt, Human
uccugcuucaaucugcugcugg

SEQ ID NO: 174910 - RNA, 22 nt, Human
ugccccuugccaggccucugcc

SEQ ID NO: 174911 - RNA, 22 nt, Human
uccugcccuguccuugccucug

SEQ ID NO: 174912 - RNA, 22 nt, Human
ugccaaagauagagguuugagu

SEQ ID NO: 174913 - RNA, 22 nt, Human
uccuaguucugaccucgcucac

SEQ ID NO: 174914 - RNA, 22 nt, Human
uccucagcaaacacuucacucu

SEQ ID NO: 174915 - RNA, 22 nt, Human
ugcaucauuaagguacaguugg

SEQ ID NO: 174916 - RNA, 22 nt, Human
ugcaucugagcacuacggugga

SEQ ID NO: 174917 - RNA, 22 nt, Human
ugcccccggcugcccaggggaa

SEQ ID NO: 174918 - RNA, 19 nt, Human
ugccccacccucuauccag

SEQ ID NO: 174919 - RNA, 22 nt, Human
uccugcaugcuagugagugcuu

SEQ ID NO: 174920 - RNA, 22 nt, Human
ugcccacaggaagacaccagcg

SEQ ID NO: 174921 - RNA, 22 nt, Human
ugcccacuuugucuccaugcug

SEQ ID NO: 174922 - RNA, 22 nt, Human
uccucgccgucacgcagccucu

SEQ ID NO: 174923 - RNA, 22 nt, Human
ugccaacaggcuugccugaugu

SEQ ID NO: 174924 - RNA, 22 nt, Human
ucucaaagagcuacuggucuau

SEQ ID NO: 174925 - RNA, 22 nt, Human
ugcugcuguuaucauuuuacca

SEQ ID NO: 174926 - RNA, 23 nt, Human
ugcugcgggacccgagcgcgcgc

SEQ ID NO: 174927 - RNA, 22 nt, Human
ugcugcggcgcaggcacuccag

SEQ ID NO: 174928 - RNA, 22 nt, Human
ucgcgcgugccacgcgccgcgg

SEQ ID NO: 174929 - RNA, 22 nt, Human
ucgagaccagcuagaaggaagu

SEQ ID NO: 174930 - RNA, 22 nt, Human
ucuaggcugugugugggcaggg

SEQ ID NO: 174931 - RNA, 22 nt, Human
ucuagcccucauggcugaaggc

SEQ ID NO: 174932 - RNA, 22 nt, Human
ucgcuguguccuuuucacuuau

SEQ ID NO: 174933 - RNA, 22 nt, Human
ucuccaggggcagggucuggag

SEQ ID NO: 174934 - RNA, 22 nt, Human
ucucccgcuuccugcuggcugc

SEQ ID NO: 174935 - RNA, 19 nt, Human
ucucccaugccugugucua

SEQ ID NO: 174936 - RNA, 22 nt, Human
ugcuguacaagacccucuguuu

SEQ ID NO: 174937 - RNA, 18 nt, Human
ucuccgaccccgcggucc

SEQ ID NO: 174938 - RNA, 22 nt, Human
ugcuguugacuuuguuguucuu

SEQ ID NO: 174939 - RNA, 20 nt, Human
ugcugugugucuacuguggg

SEQ ID NO: 174940 - RNA, 22 nt, Human
ugcugugcuggcggcagaggcc

SEQ ID NO: 174941 - RNA, 22 nt, Human
ugcuggugauuaaauccugaag

SEQ ID NO: 174942 - RNA, 22 nt, Human
ugcugcuguuuccuacaucuca

SEQ ID NO: 174943 - RNA, 22 nt, Human
ucucugugaauggcgucaccug

SEQ ID NO: 174944 - RNA, 22 nt, Human
ucucuucacuuguaugcuauca

SEQ ID NO: 174945 - RNA, 18 nt, Human
ucugaaggaaugauucca

SEQ ID NO: 174946 - RNA, 22 nt, Human
ucugaagagaacucuuaguguu

SEQ ID NO: 174947 - RNA, 21 nt, Human
ugcuuucugugcuuuuucugc

SEQ ID NO: 174948 - RNA, 22 nt, Human
ucugaaaggagaguagggcaga

SEQ ID NO: 174949 - RNA, 22 nt, Human
ucucuuuuuuuaaaacucuaug

SEQ ID NO: 174950 - RNA, 22 nt, Human
ucugacugucccguagaggaac

SEQ ID NO: 174951 - RNA, 22 nt, Human
ucugagugacguccugacagga

SEQ ID NO: 174952 - RNA, 22 nt, Human
ucugaguuaaaauuccagaggu

SEQ ID NO: 174953 - RNA, 22 nt, Human
uggaaaagaugucuuccugaau

SEQ ID NO: 174954 - RNA, 17 nt, Human
ucugaccuuuacuccug

SEQ ID NO: 174955 - RNA, 22 nt, Human
ucugaccccccuugccuccacu

SEQ ID NO: 174956 - RNA, 22 nt, Human
ugcuuuuggcagcaguguuuau

SEQ ID NO: 174957 - RNA, 17 nt, Human
ucuccuggcucuaucag

SEQ ID NO: 174958 - RNA, 22 nt, Human
ugcuucuuuaggauguaguuau

SEQ ID NO: 174959 - RNA, 22 nt, Human
ugcuucuuugggggugaagaga

SEQ ID NO: 174960 - RNA, 21 nt, Human
ucucuaucguauaccagccgg

SEQ ID NO: 174961 - RNA, 22 nt, Human
ucucucgguacagcuggcugga

SEQ ID NO: 174962 - RNA, 22 nt, Human
ucucucggagcuaccggaaguu

SEQ ID NO: 174963 - RNA, 22 nt, Human
ugcuugacucagcaucggcaau

SEQ ID NO: 174964 - RNA, 22 nt, Human
ugcuugaacccaggaaguggag

SEQ ID NO: 174965 - RNA, 19 nt, Human
ucucugguggcuccaucag

SEQ ID NO: 174966 - RNA, 22 nt, Human
ucucugguagcucugugcucug

SEQ ID NO: 174967 - RNA, 20 nt, Human
ucuucagcuccaagucuggc

SEQ ID NO: 174968 - RNA, 22 nt, Human
ucuucaaauacagucauauuga

SEQ ID NO: 174969 - RNA, 22 nt, Human
uggcaagcuguuggcagauagc

SEQ ID NO: 174970 - RNA, 22 nt, Human
uggcaaacacaauauggguaca

SEQ ID NO: 174971 - RNA, 22 nt, Human
uggaucaugcgaggccuccccu

SEQ ID NO: 174972 - RNA, 22 nt, Human
ucuucccgggcaucucugcuca

SEQ ID NO: 174973 - RNA, 22 nt, Human
uggcagugggaagcuggaaguc

SEQ ID NO: 174974 - RNA, 22 nt, Human
ucuucaucucuaaaaugggaac

SEQ ID NO: 174975 - RNA, 22 nt, Human
uggcagugagauuucucuucug

SEQ ID NO: 174976 - RNA, 22 nt, Human
ucuuccacuugaaccuucuguc

SEQ ID NO: 174977 - RNA, 21 nt, Human
ucuuccaacacugacaccaug

SEQ ID NO: 174978 - RNA, 22 nt, Human
uggcuacguacaauggaacuuu

SEQ ID NO: 174979 - RNA, 22 nt, Human
uggcucacuuccguggagaggu

SEQ ID NO: 174980 - RNA, 22 nt, Human
uggcgugaagcuggaaggcgga

SEQ ID NO: 174981 - RNA, 22 nt, Human
uggcuacauuuauacucucauu

SEQ ID NO: 174982 - RNA, 22 nt, Human
ucuuugcagaauuuaacuuugc

SEQ ID NO: 174983 - RNA, 22 nt, Human
ucuuucugaugggaagggucaa

SEQ ID NO: 174984 - RNA, 22 nt, Human
uggccuucagcucuggggugca

SEQ ID NO: 174985 - RNA, 22 nt, Human
uggcggagacauggacuucaga

SEQ ID NO: 174986 - RNA, 22 nt, Human
uggcggcggggagguaggcaga

SEQ ID NO: 174987 - RNA, 22 nt, Human
uggcaucacagacaaggcagca

SEQ ID NO: 174988 - RNA, 22 nt, Human
uggccaaauuggccugauguau

SEQ ID NO: 174989 - RNA, 22 nt, Human
ucuguggcaaacacagugacca

SEQ ID NO: 174990 - RNA, 22 nt, Human
ucugugcuccuuccuugucauc

SEQ ID NO: 174991 - RNA, 22 nt, Human
uggaguagaagggcuccuggaa

SEQ ID NO: 174992 - RNA, 22 nt, Human
ucuguaccuuauguucagagug

SEQ ID NO: 174993 - RNA, 20 nt, Human
uggaucaccauccuguugcu

SEQ ID NO: 174994 - RNA, 22 nt, Human
ucuguuuuuaucuauucuguua

SEQ ID NO: 174995 - RNA, 22 nt, Human
ucuguucagaagaggugaaagu

SEQ ID NO: 174996 - RNA, 22 nt, Human
uggagucucacuuccuggaauu

SEQ ID NO: 174997 - RNA, 19 nt, Human
uggaagugauaguauagua

SEQ ID NO: 174998 - RNA, 22 nt, Human
uggaaggugauucucugguuaa

SEQ ID NO: 174999 - RNA, 22 nt, Human
ucuggcucuccagugcucuuag

SEQ ID NO: 175000 - RNA, 22 nt, Human
ucugggucuaucccaugccuuu

SEQ ID NO: 175001 - RNA, 22 nt, Human
ucugguagauuauuuagaguac

SEQ ID NO: 175002 - RNA, 22 nt, Human
ucugguuccugcauucauucaa

SEQ ID NO: 175003 - RNA, 22 nt, Human
ucuggugcacucugauauuuga

SEQ ID NO: 175004 - RNA, 22 nt, Human
ucuggcaguugccgcuucaguc

SEQ ID NO: 175005 - RNA, 23 nt, Human
uggaagaaaaugguuuggcugug

SEQ ID NO: 175006 - RNA, 22 nt, Human
uggaagaaaacuuggaaggcau

SEQ ID NO: 175007 - RNA, 22 nt, Human
ucuccaccccugggaggcagaa

SEQ ID NO: 175008 - RNA, 22 nt, Human
ucucgcuguuccugcuucaggu

SEQ ID NO: 175009 - RNA, 21 nt, Human
uaggaacuguucugagugguc

SEQ ID NO: 175010 - RNA, 22 nt, Human
ucgaggagagucgccagcugcu

SEQ ID NO: 175011 - RNA, 23 nt, Human
ucucaccaggauaugacugucac

SEQ ID NO: 175012 - RNA, 22 nt, Human
ucucaaagguuuuccucuuuuu

SEQ ID NO: 175013 - RNA, 22 nt, Human
ucucaggcuuccuggugcugug

SEQ ID NO: 175014 - RNA, 22 nt, Human
ucucaaacuauauaugggguuc

SEQ ID NO: 175015 - RNA, 22 nt, Human
ucugacguugguucugcccuuu

SEQ ID NO: 175016 - RNA, 22 nt, Human
uaucuguauuguagaacuguug

SEQ ID NO: 175017 - RNA, 22 nt, Human
uaucuguagucucaugguuccu

SEQ ID NO: 175018 - RNA, 22 nt, Human
uaucuucaauagcccagaugug

SEQ ID NO: 175019 - RNA, 22 nt, Human
ucugagcaggaaagagcagaga

SEQ ID NO: 175020 - RNA, 22 nt, Human
ucugaaauuuuaguuauagaaa

SEQ ID NO: 175021 - RNA, 22 nt, Human
ucucugguggcuccaucaguag

SEQ ID NO: 175022 - RNA, 22 nt, Human
ucucugcguucaucccaucaca

SEQ ID NO: 175023 - RNA, 20 nt, Human
ucucuaacaugaaugcuauc

SEQ ID NO: 175024 - RNA, 22 nt, Human
uaugccaccagucuggaacucu

SEQ ID NO: 175025 - RNA, 22 nt, Human
ucugcggccuagcgcccggcgc

SEQ ID NO: 175026 - RNA, 22 nt, Human
ucugcgggccuggcucccagcg

SEQ ID NO: 175027 - RNA, 22 nt, Human
ucugcggccggaauucccuuca

SEQ ID NO: 175028 - RNA, 22 nt, Human
uaugcgguccaucaggggcacu

SEQ ID NO: 175029 - RNA, 22 nt, Human
ucugccuucaggagcagacucu

SEQ ID NO: 175030 - RNA, 22 nt, Human
uaugaccuuaggaagcaagaag

SEQ ID NO: 175031 - RNA, 22 nt, Human
uaugagguuaucuaugucguau

SEQ ID NO: 175032 - RNA, 22 nt, Human
ucugaucagaagacaaaugagg

SEQ ID NO: 175033 - RNA, 22 nt, Human
ucugaucuuucauccuaaaugg

SEQ ID NO: 175034 - RNA, 22 nt, Human
ucugcacagcucaccucccugg

SEQ ID NO: 175035 - RNA, 22 nt, Human
ucugauucucuuguugaccuag

SEQ ID NO: 175036 - RNA, 22 nt, Human
ucugaugaccacaugugggacu

SEQ ID NO: 175037 - RNA, 22 nt, Human
ucugggccacccgccuccaggg

SEQ ID NO: 175038 - RNA, 22 nt, Human
ucuggcucaggagcuguguuca

SEQ ID NO: 175039 - RNA, 22 nt, Human
ucugcuggugucauuuuugcua

SEQ ID NO: 175040 - RNA, 22 nt, Human
ucugcguggcgugguucugugc

SEQ ID NO: 175041 - RNA, 22 nt, Human
uauggcuucucagucaugaaaa

SEQ ID NO: 175042 - RNA, 22 nt, Human
uaugcuguauucuguauguuag

SEQ ID NO: 175043 - RNA, 20 nt, Human
ucugcuugucuucagguucc

SEQ ID NO: 175044 - RNA, 22 nt, Human
ucugcuguugaucaugacuagc

SEQ ID NO: 175045 - RNA, 22 nt, Human
ucuggaggucucagggcgggaa

SEQ ID NO: 175046 - RNA, 22 nt, Human
ucuggcacuugccaguuucuau

SEQ ID NO: 175047 - RNA, 22 nt, Human
ucuguucucuuguucugacggu

SEQ ID NO: 175048 - RNA, 19 nt, Human
ucuguugcuuuguguccuc

SEQ ID NO: 175049 - RNA, 22 nt, Human
ucuguucacaauuacacacacu

SEQ ID NO: 175050 - RNA, 21 nt, Human
ucuguuguguguugaggacuu

SEQ ID NO: 175051 - RNA, 20 nt, Human
ucuguggcagguggcgcuug

SEQ ID NO: 175052 - RNA, 22 nt, Human
uauuagggaacugcaagacuaa

SEQ ID NO: 175053 - RNA, 19 nt, Human
ucuguggccuucccugaug

SEQ ID NO: 175054 - RNA, 22 nt, Human
uauuaauugugguuauuguauu

SEQ ID NO: 175055 - RNA, 22 nt, Human
ucugggguucuuaauuuggaag

SEQ ID NO: 175056 - RNA, 22 nt, Human
uauguucaauaccagguucuuu

SEQ ID NO: 175057 - RNA, 20 nt, Human
ucaguuucccuauuagguug

SEQ ID NO: 175058 - RNA, 17 nt, Human
ucaguugugcgagcagc

SEQ ID NO: 175059 - RNA, 22 nt, Human
ucaugccugcgauugucccugg

SEQ ID NO: 175060 - RNA, 22 nt, Human
ucaugcagauaagaauaaguaa

SEQ ID NO: 175061 - RNA, 22 nt, Human
ucaugcagaguagaaagggcaa

SEQ ID NO: 175062 - RNA, 22 nt, Human
ucaugagcacaggugcagggac

SEQ ID NO: 175063 - RNA, 23 nt, Human
uacagccaugucgcugauuuaac

SEQ ID NO: 175064 - RNA, 18 nt, Human
uacagauguaugucuaca

SEQ ID NO: 175065 - RNA, 22 nt, Human
uccaagcgcuucuggagcuccu

SEQ ID NO: 175066 - RNA, 22 nt, Human
ucauuuguauucuacaaagcac

SEQ ID NO: 175067 - RNA, 22 nt, Human
uaauuucauuuugcaaugaucu

SEQ ID NO: 175068 - RNA, 20 nt, Human
ucaguggcauaguugcuaag

SEQ ID NO: 175069 - RNA, 22 nt, Human
uaacgcaucuggaaacaggaca

SEQ ID NO: 175070 - RNA, 22 nt, Human
uaacauuucggugacaguggga

SEQ ID NO: 175071 - RNA, 22 nt, Human
uaacauuuaguuuuaagauggu

SEQ ID NO: 175072 - RNA, 22 nt, Human
uaacccuucauaacuagaugaa

SEQ ID NO: 175073 - RNA, 22 nt, Human
uaacaguggucugugguaucug

SEQ ID NO: 175074 - RNA, 23 nt, Human
ucagugaaggaacaacuaaauag

SEQ ID NO: 175075 - RNA, 22 nt, Human
ucaguggaacacacagaguggg

SEQ ID NO: 175076 - RNA, 22 nt, Human
uaaauuggaauaaugagaagug

SEQ ID NO: 175077 - RNA, 22 nt, Human
uaaauuccuagucacaaacuuc

SEQ ID NO: 175078 - RNA, 22 nt, Human
uaaauuagauucccagcgcuau

SEQ ID NO: 175079 - RNA, 22 nt, Human
ucagguagugguuaaguucugu

SEQ ID NO: 175080 - RNA, 22 nt, Human
ucaggcuagcccagugcuuggg

SEQ ID NO: 175081 - RNA, 21 nt, Human
ucaagcggcagagcaguuauu

SEQ ID NO: 175082 - RNA, 22 nt, Human
ucagguuuaagcuacuggaauc

SEQ ID NO: 175083 - RNA, 22 nt, Human
uccuggccucugagucaagaac

SEQ ID NO: 175084 - RNA, 22 nt, Human
uagccaaguuuucuuugaaagu

SEQ ID NO: 175085 - RNA, 22 nt, Human
uccuggcgugggcuggcugcag

SEQ ID NO: 175086 - RNA, 22 nt, Human
uccuggcuguuagagaggcaag

SEQ ID NO: 175087 - RNA, 22 nt, Human
uccuucagaggacggcagccag

SEQ ID NO: 175088 - RNA, 22 nt, Human
uccuuccucuuucaaauuuguu

SEQ ID NO: 175089 - RNA, 22 nt, Human
uccuuaggaccuagagguagua

SEQ ID NO: 175090 - RNA, 22 nt, Human
uccuucuguuguuuauuuuaaa

SEQ ID NO: 175091 - RNA, 21 nt, Human
uccugccuggccuucugacua

SEQ ID NO: 175092 - RNA, 21 nt, Human
uccugccuuaguccagagcag

SEQ ID NO: 175093 - RNA, 22 nt, Human
uccugaaggccugaguuccacc

SEQ ID NO: 175094 - RNA, 22 nt, Human
uagcagaacaauagucaaugau

SEQ ID NO: 175095 - RNA, 22 nt, Human
uccucccagguucuaucuccuc

SEQ ID NO: 175096 - RNA, 22 nt, Human
uccuccuuuccccgcuggagcc

SEQ ID NO: 175097 - RNA, 23 nt, Human
uccuccccaccuuuguccccucc

SEQ ID NO: 175098 - RNA, 22 nt, Human
uagaugaacagaaagccacugu

SEQ ID NO: 175099 - RNA, 22 nt, Human
uagaacuguaaauuaucucucc

SEQ ID NO: 175100 - RNA, 22 nt, Human
uccgacacacgugcucgcagcg

SEQ ID NO: 175101 - RNA, 22 nt, Human
uagaggauucuaaaggaagcug

SEQ ID NO: 175102 - RNA, 22 nt, Human
uccucagcaagacgcuggcagc

SEQ ID NO: 175103 - RNA, 22 nt, Human
uccgugguguuggcucuccggc

SEQ ID NO: 175104 - RNA, 22 nt, Human
uccgugggucuugaagugucac

SEQ ID NO: 175105 - RNA, 22 nt, Human
ucccugcagggccauugugcag

SEQ ID NO: 175106 - RNA, 22 nt, Human
ucccucuccugucugcuucuuu

SEQ ID NO: 175107 - RNA, 22 nt, Human
ucccugagcucacauggcagga

SEQ ID NO: 175108 - RNA, 22 nt, Human
ucccggcaccgggagccccugc

SEQ ID NO: 175109 - RNA, 22 nt, Human
uccccugccccccauccucugg

SEQ ID NO: 175110 - RNA, 21 nt, Human
uccccugugccuggcauacag

SEQ ID NO: 175111 - RNA, 22 nt, Human
uacugcaguuccugcugucucc

SEQ ID NO: 175112 - RNA, 23 nt, Human
uccccagcugcccgugucccggg

SEQ ID NO: 175113 - RNA, 22 nt, Human
uacuucccacuggggucuacca

SEQ ID NO: 175114 - RNA, 22 nt, Human
uccccgcugcgcccgcugcugc

SEQ ID NO: 175115 - RNA, 22 nt, Human
uacuucuuuuguaaaguauuga

SEQ ID NO: 175116 - RNA, 22 nt, Human
uacuugaaaugggcaucaagag

SEQ ID NO: 175117 - RNA, 22 nt, Human
uccaaggcuggaucuuuucuuu

SEQ ID NO: 175118 - RNA, 22 nt, Human
uacagcgaaaauuuagcuugau

SEQ ID NO: 175119 - RNA, 22 nt, Human
uacaggaggaugugcagccagg

SEQ ID NO: 175120 - RNA, 22 nt, Human
uccaaggcagacacauuuuuug

SEQ ID NO: 175121 - RNA, 22 nt, Human
uccaaggacuaaauucuagauu

SEQ ID NO: 175122 - RNA, 22 nt, Human
uccaggcagcugcuugaugaua

SEQ ID NO: 175123 - RNA, 22 nt, Human
uccaggagucagacagauggug

SEQ ID NO: 175124 - RNA, 22 nt, Human
uccaugcgcgauggccuggcuu

SEQ ID NO: 175125 - RNA, 22 nt, Human
uccaucauucagaaauuuuuga

SEQ ID NO: 175126 - RNA, 22 nt, Human
uaccugguuucuuaaacccaaa

SEQ ID NO: 175127 - RNA, 20 nt, Human
uaccuccccagcagucauga

SEQ ID NO: 175128 - RNA, 22 nt, Human
uccaggucauucucuccgaccg

SEQ ID NO: 175129 - RNA, 22 nt, Human
uccagguccuacuggcccauag

SEQ ID NO: 175130 - RNA, 22 nt, Human
uacuaaacugcauuucuaucua

SEQ ID NO: 175131 - RNA, 22 nt, Human
guggaagauauuucugguccag

SEQ ID NO: 175132 - RNA, 22 nt, Human
guggagaaagcuggaaucugag

SEQ ID NO: 175133 - RNA, 22 nt, Human
guggacuagaguaggaguugca

SEQ ID NO: 175134 - RNA, 22 nt, Human
guggacuuuggucugugccauc

SEQ ID NO: 175135 - RNA, 22 nt, Human
gugcuuugcuaggaccgauugu

SEQ ID NO: 175136 - RNA, 22 nt, Human
gugcugggaggcccaggaugga

SEQ ID NO: 175137 - RNA, 22 nt, Human
gugcuugcgcauaacuggggcc

SEQ ID NO: 175138 - RNA, 22 nt, Human
gugcuuuaccuuauuggucucg

SEQ ID NO: 175139 - RNA, 22 nt, Human
gugcugcaugagcaucacguag

SEQ ID NO: 175140 - RNA, 22 nt, Human
gugcuggcaaagagaacaucuu

SEQ ID NO: 175141 - RNA, 22 nt, Human
gugcuguuagcgguuuauaaca

SEQ ID NO: 175142 - RNA, 22 nt, Human
guggagaaauauguucagcuuc

SEQ ID NO: 175143 - RNA, 22 nt, Human
guggagaagggaccgggaagga

SEQ ID NO: 175144 - RNA, 22 nt, Human
guggagauauuugugauagggg

SEQ ID NO: 175145 - RNA, 22 nt, Human
guggaguggguuguacucaggg

SEQ ID NO: 175146 - RNA, 22 nt, Human
uaggagcagauggcagcaggug

SEQ ID NO: 175147 - RNA, 22 nt, Human
uaggacuugaauucagccucca

SEQ ID NO: 175148 - RNA, 22 nt, Human
uaggaaugcagaugcauaauaa

SEQ ID NO: 175149 - RNA, 22 nt, Human
uaggcaaguggaccagagguuu

SEQ ID NO: 175150 - RNA, 22 nt, Human
uaggaucaugaugguaaggcaa

SEQ ID NO: 175151 - RNA, 22 nt, Human
uaggagccagaauugcauuagu

SEQ ID NO: 175152 - RNA, 22 nt, Human
uaggauaacaauuuguaguuuc

SEQ ID NO: 175153 - RNA, 22 nt, Human
uagccguugggguaacuggaca

SEQ ID NO: 175154 - RNA, 22 nt, Human
uagccaguuuauaaaguggaag

SEQ ID NO: 175155 - RNA, 17 nt, Human
uagccagcuugugauuu

SEQ ID NO: 175156 - RNA, 22 nt, Human
uagaacugcucucauacuugcu

SEQ ID NO: 175157 - RNA, 22 nt, Human
uagcuggaggggcaggaugcug

SEQ ID NO: 175158 - RNA, 19 nt, Human
uagcuguucuugaguguga

SEQ ID NO: 175159 - RNA, 22 nt, Human
uagcugacagcagaagaguauu

SEQ ID NO: 175160 - RNA, 23 nt, Human
uagcggccaugacgggggucaca

SEQ ID NO: 175161 - RNA, 22 nt, Human
uagcguaugcugugugaugaau

SEQ ID NO: 175162 - RNA, 22 nt, Human
gugcucgagcugugcgcgcugc

SEQ ID NO: 175163 - RNA, 22 nt, Human
gugcugcaaggauggagaggca

SEQ ID NO: 175164 - RNA, 21 nt, Human
uagcuugaucauuuuauuucc

SEQ ID NO: 175165 - RNA, 22 nt, Human
gugggggcagaagcgagugcag

SEQ ID NO: 175166 - RNA, 22 nt, Human
gugggcccaagcagcggcggcc

SEQ ID NO: 175167 - RNA, 22 nt, Human
guggggcgggucccccgccugg

SEQ ID NO: 175168 - RNA, 22 nt, Human
gugggcagauuaauuucucaau

SEQ ID NO: 175169 - RNA, 18 nt, Human
gugggcacacacucuguu

SEQ ID NO: 175170 - RNA, 22 nt, Human
gugggaguggagcucagcaugu

SEQ ID NO: 175171 - RNA, 22 nt, Human
gugggagaaugggaggaguaau

SEQ ID NO: 175172 - RNA, 22 nt, Human
uaguggaaacagacugagcccg

SEQ ID NO: 175173 - RNA, 22 nt, Human
uaguggccacugaagugcuaga

SEQ ID NO: 175174 - RNA, 22 nt, Human
guggguauauauaugugugcug

SEQ ID NO: 175175 - RNA, 22 nt, Human
uagucggcuaggagggccuucu

SEQ ID NO: 175176 - RNA, 22 nt, Human
uagugauuuaagaaaggugacu

SEQ ID NO: 175177 - RNA, 20 nt, Human
uagugaccaagagggcugcu

SEQ ID NO: 175178 - RNA, 22 nt, Human
guggcauggggagcagcuagaa

SEQ ID NO: 175179 - RNA, 22 nt, Human
guggcagguguacagcucagcu

SEQ ID NO: 175180 - RNA, 22 nt, Human
guggcaguaaagcuggaaaagu

SEQ ID NO: 175181 - RNA, 22 nt, Human
uaggucaaggccacuucuugga

SEQ ID NO: 175182 - RNA, 22 nt, Human
guggcagagagcaagugucuga

SEQ ID NO: 175183 - RNA, 22 nt, Human
uaggggcccgugggauggacag

SEQ ID NO: 175184 - RNA, 19 nt, Human
uaggcccugcgaauggcuu

SEQ ID NO: 175185 - RNA, 22 nt, Human
uaggggggugaaggaggucccu

SEQ ID NO: 175186 - RNA, 22 nt, Human
uaggguuucaugcugguuucca

SEQ ID NO: 175187 - RNA, 22 nt, Human
uaggcagggauuaggguugauu

SEQ ID NO: 175188 - RNA, 22 nt, Human
uaggcaguagcuuuggauguca

SEQ ID NO: 175189 - RNA, 22 nt, Human
guggcuuucuaccauuaaauug

SEQ ID NO: 175190 - RNA, 22 nt, Human
guggcuugguauuaaggugcca

SEQ ID NO: 175191 - RNA, 22 nt, Human
guggcuggguggaacugagucu

SEQ ID NO: 175192 - RNA, 22 nt, Human
guggccugacagaucggaacag

SEQ ID NO: 175193 - RNA, 20 nt, Human
guugggagaagugucagcug

SEQ ID NO: 175194 - RNA, 21 nt, Human
ucaaccagguguugaaggcac

SEQ ID NO: 175195 - RNA, 22 nt, Human
ucaaccucccugcucaccccuc

SEQ ID NO: 175196 - RNA, 22 nt, Human
guuggugagaguuagggauuua

SEQ ID NO: 175197 - RNA, 22 nt, Human
guugggugccagaggcuucacg

SEQ ID NO: 175198 - RNA, 22 nt, Human
guuggggccuggagucucuugg

SEQ ID NO: 175199 - RNA, 22 nt, Human
guugggguuucaguggcaguca

SEQ ID NO: 175200 - RNA, 22 nt, Human
guuggcgaaggaccuggaggag

SEQ ID NO: 175201 - RNA, 22 nt, Human
guugcuggggcugaguccccag

SEQ ID NO: 175202 - RNA, 22 nt, Human
guucucauugugaugcuuaguu

SEQ ID NO: 175203 - RNA, 22 nt, Human
guucuucagauuccauuucagu

SEQ ID NO: 175204 - RNA, 22 nt, Human
uauuuguuuuuaaugcugggug

SEQ ID NO: 175205 - RNA, 22 nt, Human
guucaaggagcagcuugcuaca

SEQ ID NO: 175206 - RNA, 22 nt, Human
guguugacacagccaucuuguc

SEQ ID NO: 175207 - RNA, 22 nt, Human
guguugcaggaagauauagcug

SEQ ID NO: 175208 - RNA, 22 nt, Human
guguugaaaaguagcacugcuu

SEQ ID NO: 175209 - RNA, 22 nt, Human
guguugugauuggucagucacu

SEQ ID NO: 175210 - RNA, 21 nt, Human
guguugugagguugguguuag

SEQ ID NO: 175211 - RNA, 22 nt, Human
guguuucccuggcacaagaacc

SEQ ID NO: 175212 - RNA, 22 nt, Human
uaugugaaauggaauauagaaa

SEQ ID NO: 175213 - RNA, 22 nt, Human
uauguggcaggugggagaucag

SEQ ID NO: 175214 - RNA, 22 nt, Human
gugguggugaggcaaggggugu

SEQ ID NO: 175215 - RNA, 22 nt, Human
guggugguguuggugacaaguu

SEQ ID NO: 175216 - RNA, 22 nt, Human
gugguuugacccuucagguaaa

SEQ ID NO: 175217 - RNA, 22 nt, Human
guggugauuugggucuagcuuu

SEQ ID NO: 175218 - RNA, 22 nt, Human
gugggugucaguaucuuuaacg

SEQ ID NO: 175219 - RNA, 22 nt, Human
guggucaagaccgggaauagga

SEQ ID NO: 175220 - RNA, 22 nt, Human
guacugguuuucuuacucuggc

SEQ ID NO: 175221 - RNA, 22 nt, Human
guagaaaauagauugucucuug

SEQ ID NO: 175222 - RNA, 22 nt, Human
guacuugauucauuauugcauu

SEQ ID NO: 175223 - RNA, 22 nt, Human
guaugaguggauagauguaucu

SEQ ID NO: 175224 - RNA, 22 nt, Human
uaagaccuuuuugaaaucacug

SEQ ID NO: 175225 - RNA, 22 nt, Human
guauggaguuuuguugcacuuc

SEQ ID NO: 175226 - RNA, 21 nt, Human
uaagaacauuaucuucuuccu

SEQ ID NO: 175227 - RNA, 22 nt, Human
uaagauggaagaaaaggcggau

SEQ ID NO: 175228 - RNA, 22 nt, Human
uaaggcuguuaggaggauuaaa

SEQ ID NO: 175229 - RNA, 22 nt, Human
gucagugaaccuucaccaaacc

SEQ ID NO: 175230 - RNA, 22 nt, Human
gucacucuuuuucagcuagcuc

SEQ ID NO: 175231 - RNA, 22 nt, Human
guccaugugcuaacagugcuua

SEQ ID NO: 175232 - RNA, 19 nt, Human
guccaaauggaaccccuug

SEQ ID NO: 175233 - RNA, 22 nt, Human
gucaguggugcuuaaaguuuca

SEQ ID NO: 175234 - RNA, 23 nt, Human
gucauuacuguuaccuuauucuu

SEQ ID NO: 175235 - RNA, 22 nt, Human
guccuggugccaccugcgggau

SEQ ID NO: 175236 - RNA, 22 nt, Human
guccucugggagccuugagccu

SEQ ID NO: 175237 - RNA, 22 nt, Human
guccuucgcggcugaggccauu

SEQ ID NO: 175238 - RNA, 22 nt, Human
uaauuccacacucccgcaagcg

SEQ ID NO: 175239 - RNA, 22 nt, Human
uaauugagauuucuggcugcuu

SEQ ID NO: 175240 - RNA, 22 nt, Human
gugaccagacagagucuagccc

SEQ ID NO: 175241 - RNA, 21 nt, Human
gugaccuguuaugcaaaggca

SEQ ID NO: 175242 - RNA, 22 nt, Human
gugaaggcaugugugcugugcu

SEQ ID NO: 175243 - RNA, 22 nt, Human
uacuugcaaggcucuuggaaua

SEQ ID NO: 175244 - RNA, 22 nt, Human
uacugggugagcugggcuggga

SEQ ID NO: 175245 - RNA, 22 nt, Human
uacguggcucguuaauuuccug

SEQ ID NO: 175246 - RNA, 22 nt, Human
uacguuuuauaucuuuuggaau

SEQ ID NO: 175247 - RNA, 22 nt, Human
uaccuggauaaauguacaaccg

SEQ ID NO: 175248 - RNA, 22 nt, Human
gugaaacuggaugugaaaacaa

SEQ ID NO: 175249 - RNA, 20 nt, Human
gugaacuggagaacugaugu

SEQ ID NO: 175250 - RNA, 23 nt, Human
gugaacaaugcuccaggagauac

SEQ ID NO: 175251 - RNA, 22 nt, Human
uaccaauuaaauagccaaucua

SEQ ID NO: 175252 - RNA, 18 nt, Human
gucuguuccuuuaauguc

SEQ ID NO: 175253 - RNA, 21 nt, Human
uacaucaguuuucuuggcuca

SEQ ID NO: 175254 - RNA, 22 nt, Human
gugaaaaauggccaucaggaca

SEQ ID NO: 175255 - RNA, 22 nt, Human
gucgguacuaguacugguguug

SEQ ID NO: 175256 - RNA, 22 nt, Human
gucguucugcuauucuaugagg

SEQ ID NO: 175257 - RNA, 22 nt, Human
guaagcagcaugacgguuggau

SEQ ID NO: 175258 - RNA, 22 nt, Human
uaaaguguacaagucauaagua

SEQ ID NO: 175259 - RNA, 22 nt, Human
guacuacagguuugguaguggg

SEQ ID NO: 175260 - RNA, 22 nt, Human
guacaaagucaaggugaaaaua

SEQ ID NO: 175261 - RNA, 22 nt, Human
gguuuucagaaugcaguccugu

SEQ ID NO: 175262 - RNA, 22 nt, Human
gguuuucacgauccucccuuuu

SEQ ID NO: 175263 - RNA, 22 nt, Human
gguuugauauguuugugauucu

SEQ ID NO: 175264 - RNA, 22 nt, Human
gguugauuuuuaugaagccaug

SEQ ID NO: 175265 - RNA, 22 nt, Human
ggugugaauagagccuggagca

SEQ ID NO: 175266 - RNA, 22 nt, Human
gguguggguguuaguuugcuua

SEQ ID NO: 175267 - RNA, 22 nt, Human
ggugucagccacuuugucggag

SEQ ID NO: 175268 - RNA, 22 nt, Human
gguugaagcuacuuucuggaug

SEQ ID NO: 175269 - RNA, 22 nt, Human
uaaaaccauucauugaccuaug

SEQ ID NO: 175270 - RNA, 22 nt, Human
uaaaaaccuuguauuuaacucu

SEQ ID NO: 175271 - RNA, 22 nt, Human
gguggguccuuugacagagaug

SEQ ID NO: 175272 - RNA, 22 nt, Human
gguggggacuuggggucagcgg

SEQ ID NO: 175273 - RNA, 22 nt, Human
guuuguuugccagcuuaguaaa

SEQ ID NO: 175274 - RNA, 22 nt, Human
gguguacgaagaggcgggaguc

SEQ ID NO: 175275 - RNA, 22 nt, Human
gguguaaucacaagcuggaauu

SEQ ID NO: 175276 - RNA, 22 nt, Human
ggugguucagugguuagggcca

SEQ ID NO: 175277 - RNA, 22 nt, Human
ggugccugggcacggaaagcau

SEQ ID NO: 175278 - RNA, 22 nt, Human
ggugcagucuggggcacauuau

SEQ ID NO: 175279 - RNA, 22 nt, Human
ggugcaauaaaguuguagaacc

SEQ ID NO: 175280 - RNA, 19 nt, Human
ggugaucugucccuugcuc

SEQ ID NO: 175281 - RNA, 22 nt, Human
ggugcugcugcugaacccagcu

SEQ ID NO: 175282 - RNA, 22 nt, Human
ggugcguggcccauccuccacc

SEQ ID NO: 175283 - RNA, 22 nt, Human
guuugguucucauuguuuuucu

SEQ ID NO: 175284 - RNA, 22 nt, Human
guugguggaggcgagagaagaa

SEQ ID NO: 175285 - RNA, 22 nt, Human
gguccgcgcgcagaggcccugg

SEQ ID NO: 175286 - RNA, 22 nt, Human
ggucgacuaauguuucauuuca

SEQ ID NO: 175287 - RNA, 22 nt, Human
ggucgguuggagagaucaugaa

SEQ ID NO: 175288 - RNA, 22 nt, Human
guuguuuucagcccagcauuag

SEQ ID NO: 175289 - RNA, 22 nt, Human
gugcugucguggaacugggcug

SEQ ID NO: 175290 - RNA, 22 nt, Human
guuggaaauaucagucacguga

SEQ ID NO: 175291 - RNA, 22 nt, Human
guugggcugaagugugugcuua

SEQ ID NO: 175292 - RNA, 22 nt, Human
guuggaggaaggacaggaacag

SEQ ID NO: 175293 - RNA, 22 nt, Human
ggucugagcaaguuaccauggg

SEQ ID NO: 175294 - RNA, 22 nt, Human
ggucuagcucggugcuggcgac

SEQ ID NO: 175295 - RNA, 22 nt, Human
guuguugucauuagcuguuuaa

SEQ ID NO: 175296 - RNA, 22 nt, Human
guuguuuuuguuaaaacaguga

SEQ ID NO: 175297 - RNA, 22 nt, Human
ggucugcaaugauuugaaaaac

SEQ ID NO: 175298 - RNA, 22 nt, Human
ggugaucucuggcucugcuugu

SEQ ID NO: 175299 - RNA, 22 nt, Human
guuugcagacuauguaaacuuc

SEQ ID NO: 175300 - RNA, 22 nt, Human
guuugagcaaucccucuauccc

SEQ ID NO: 175301 - RNA, 22 nt, Human
guuucuguguugauugugcccu

SEQ ID NO: 175302 - RNA, 22 nt, Human
guuuccaggcuuugguaugguu

SEQ ID NO: 175303 - RNA, 22 nt, Human
ggugaggggauccuguuaccau

SEQ ID NO: 175304 - RNA, 22 nt, Human
ggugaaggaucccucuuggccu

SEQ ID NO: 175305 - RNA, 22 nt, Human
ggugacauuggagagacaggug

SEQ ID NO: 175306 - RNA, 22 nt, Human
gucugcccuuggccugggacuu

SEQ ID NO: 175307 - RNA, 22 nt, Human
gucugcagcacugugcacgguc

SEQ ID NO: 175308 - RNA, 22 nt, Human
gucuccugcccacccugguccc

SEQ ID NO: 175309 - RNA, 22 nt, Human
ggcugggaggcggaggcugaga

SEQ ID NO: 175310 - RNA, 22 nt, Human
ggcuggagcaggcugcacagug

SEQ ID NO: 175311 - RNA, 22 nt, Human
gucugcuuuuaucacaugucau

SEQ ID NO: 175312 - RNA, 22 nt, Human
gucuggagccacugcugcugcu

SEQ ID NO: 175313 - RNA, 22 nt, Human
gucuggugguggguguagggca

SEQ ID NO: 175314 - RNA, 22 nt, Human
gucgccuaauuaggguauccua

SEQ ID NO: 175315 - RNA, 22 nt, Human
gucgagcuggaggagcgaaugg

SEQ ID NO: 175316 - RNA, 22 nt, Human
gucgagaacauucauuaugcaa

SEQ ID NO: 175317 - RNA, 22 nt, Human
gucggagcggcugcacaggggg

SEQ ID NO: 175318 - RNA, 22 nt, Human
gucgcuuuccugaggggucuca

SEQ ID NO: 175319 - RNA, 17 nt, Human
ggcugccaggcaacaua

SEQ ID NO: 175320 - RNA, 22 nt, Human
gucgucgcucccaccuuccgcu

SEQ ID NO: 175321 - RNA, 22 nt, Human
ggcugcuauuggucuggcuugg

SEQ ID NO: 175322 - RNA, 21 nt, Human
ggcugcucgugaugaacuuca

SEQ ID NO: 175323 - RNA, 22 nt, Human
ggcugcugcccaccccugcaug

SEQ ID NO: 175324 - RNA, 22 nt, Human
ggcugcuggaguugggucucuc

SEQ ID NO: 175325 - RNA, 22 nt, Human
ggcugcuugggcuguuucuuuu

SEQ ID NO: 175326 - RNA, 22 nt, Human
gucgcuugaacccaggaagugg

SEQ ID NO: 175327 - RNA, 19 nt, Human
guccaugguaaagaaggau

SEQ ID NO: 175328 - RNA, 22 nt, Human
ggcuccaggguaccccuggaug

SEQ ID NO: 175329 - RNA, 22 nt, Human
gucaugaugauacagguggagg

SEQ ID NO: 175330 - RNA, 23 nt, Human
ggcgugcugggcugacccuuggc

SEQ ID NO: 175331 - RNA, 22 nt, Human
ggcuaaggacgggcaaguccca

SEQ ID NO: 175332 - RNA, 22 nt, Human
ggcgggucuagggcccuggagu

SEQ ID NO: 175333 - RNA, 22 nt, Human
ggcgucuugcgggcgguagcgc

SEQ ID NO: 175334 - RNA, 22 nt, Human
ggcuauuguuuuaaaaaaugag

SEQ ID NO: 175335 - RNA, 22 nt, Human
ggcuaaucaagaaggcccagug

SEQ ID NO: 175336 - RNA, 22 nt, Human
ggcuagggagacagagggcaug

SEQ ID NO: 175337 - RNA, 22 nt, Human
ggcuagggaucuagaccaggac

SEQ ID NO: 175338 - RNA, 22 nt, Human
ggcugcaagacguuauuagcgu

SEQ ID NO: 175339 - RNA, 22 nt, Human
ggcugcagugcaacucuuucua

SEQ ID NO: 175340 - RNA, 22 nt, Human
ggcugaugacgccugagucuga

SEQ ID NO: 175341 - RNA, 22 nt, Human
ggcugagguguggggaacuaua

SEQ ID NO: 175342 - RNA, 22 nt, Human
ggcucccgugggaugguggagc

SEQ ID NO: 175343 - RNA, 22 nt, Human
ggcuccugggcgucuucgaaca

SEQ ID NO: 175344 - RNA, 22 nt, Human
guccuggagcagcuggaagaug

SEQ ID NO: 175345 - RNA, 22 nt, Human
guccuguguaaguacuugcuca

SEQ ID NO: 175346 - RNA, 22 nt, Human
guccugaaaaaaaucccugagu

SEQ ID NO: 175347 - RNA, 22 nt, Human
gucccuggucuaccguggcuuc

SEQ ID NO: 175348 - RNA, 22 nt, Human
guauuugacaccagugaauggu

SEQ ID NO: 175349 - RNA, 22 nt, Human
guauuggcaguauacauagcac

SEQ ID NO: 175350 - RNA, 22 nt, Human
gucaaaggcggugcaggaggag

SEQ ID NO: 175351 - RNA, 22 nt, Human
gucaucugagggacgagauuuc

SEQ ID NO: 175352 - RNA, 22 nt, Human
gucagugcuuuaguucaggaug

SEQ ID NO: 175353 - RNA, 22 nt, Human
ggcgggggagccaggaacccag

SEQ ID NO: 175354 - RNA, 22 nt, Human
ggccccagggauuaggccaacc

SEQ ID NO: 175355 - RNA, 22 nt, Human
ggccagucaaggggauccugaa

SEQ ID NO: 175356 - RNA, 22 nt, Human
ggccaguauacaaacuuccggu

SEQ ID NO: 175357 - RNA, 22 nt, Human
ggccagcuuugagcugcaggaa

SEQ ID NO: 175358 - RNA, 21 nt, Human
gguuucugcaaaccuuguaca

SEQ ID NO: 175359 - RNA, 22 nt, Human
gguuugggaagaacuauucccu

SEQ ID NO: 175360 - RNA, 22 nt, Human
gguuugccagugcuggaaugca

SEQ ID NO: 175361 - RNA, 22 nt, Human
ggcgauuggccgggaggaggca

SEQ ID NO: 175362 - RNA, 22 nt, Human
ggcgcaguguucgcccucucgc

SEQ ID NO: 175363 - RNA, 22 nt, Human
guauccuccccgcuggccuuca

SEQ ID NO: 175364 - RNA, 22 nt, Human
ggcgcuccccgccugcgucgcg

SEQ ID NO: 175365 - RNA, 22 nt, Human
gugauggucgagcgcuuguugu

SEQ ID NO: 175366 - RNA, 22 nt, Human
gugauggggagagcgcagcuuu

SEQ ID NO: 175367 - RNA, 22 nt, Human
gugaucagaagaaccugccgaa

SEQ ID NO: 175368 - RNA, 22 nt, Human
gggaaguugguaagaggcuguu

SEQ ID NO: 175369 - RNA, 22 nt, Human
gugaugaaggccugcaccuggu

SEQ ID NO: 175370 - RNA, 22 nt, Human
gugaugaagguggagaaucaga

SEQ ID NO: 175371 - RNA, 22 nt, Human
gggacaggacuccuggggccug

SEQ ID NO: 175372 - RNA, 22 nt, Human
gggaccaaaugcuaccauucua

SEQ ID NO: 175373 - RNA, 22 nt, Human
gugauucaucuggggccuuauu

SEQ ID NO: 175374 - RNA, 19 nt, Human
gggagaaaaucuuuauccu

SEQ ID NO: 175375 - RNA, 22 nt, Human
gugcacuugaucuagacagauu

SEQ ID NO: 175376 - RNA, 22 nt, Human
gugcagcugggcgcugaccuuc

SEQ ID NO: 175377 - RNA, 21 nt, Human
gggaggagcuucccuuugccc

SEQ ID NO: 175378 - RNA, 22 nt, Human
gggagcucaccaugcucugcau

SEQ ID NO: 175379 - RNA, 22 nt, Human
gggagcugagcuggaagagaau

SEQ ID NO: 175380 - RNA, 22 nt, Human
gggauacuuuguuucccugcca

SEQ ID NO: 175381 - RNA, 22 nt, Human
gugccuggaaucuuuucuucac

SEQ ID NO: 175382 - RNA, 21 nt, Human
gggagugaguaaugauggggg

SEQ ID NO: 175383 - RNA, 22 nt, Human
gggaguggagagugaagcuaau

SEQ ID NO: 175384 - RNA, 22 nt, Human
gggagggucugagagcugcacc

SEQ ID NO: 175385 - RNA, 22 nt, Human
gggagggggauucuggcgagaa

SEQ ID NO: 175386 - RNA, 22 nt, Human
gugccaccagaugcuguugcua

SEQ ID NO: 175387 - RNA, 22 nt, Human
gugccgcuggagcuggaauuga

SEQ ID NO: 175388 - RNA, 22 nt, Human
gugccgaugaggccuggcauuc

SEQ ID NO: 175389 - RNA, 22 nt, Human
gugccugcucauucucaauauu

SEQ ID NO: 175390 - RNA, 22 nt, Human
gugccuggugcaggauaaucac

SEQ ID NO: 175391 - RNA, 22 nt, Human
gugcucaagacauuaggaauau

SEQ ID NO: 175392 - RNA, 22 nt, Human
gggaugaaugccuggcuccccc

SEQ ID NO: 175393 - RNA, 22 nt, Human
gggcaagaggguuugacaugag

SEQ ID NO: 175394 - RNA, 22 nt, Human
gggcacggaaggcgccaggggu

SEQ ID NO: 175395 - RNA, 22 nt, Human
gugcucuagaaauugucagugg

SEQ ID NO: 175396 - RNA, 22 nt, Human
gggcaagagaggaagagauggc

SEQ ID NO: 175397 - RNA, 22 nt, Human
gggcaagaagcuggaagcauuc

SEQ ID NO: 175398 - RNA, 22 nt, Human
gggaacuguaguuuacgcugcc

SEQ ID NO: 175399 - RNA, 22 nt, Human
gugaaggggaagcagggagagg

SEQ ID NO: 175400 - RNA, 22 nt, Human
gugaagguccugauuugugacc

SEQ ID NO: 175401 - RNA, 22 nt, Human
gugaagcacaugggcguugggu

SEQ ID NO: 175402 - RNA, 17 nt, Human
gugagcugagucaggac

SEQ ID NO: 175403 - RNA, 22 nt, Human
gugaggcccaggugaaauuaac

SEQ ID NO: 175404 - RNA, 22 nt, Human
gugacugagugaagguugggua

SEQ ID NO: 175405 - RNA, 22 nt, Human
gggaagagggagcuggaaugau

SEQ ID NO: 175406 - RNA, 21 nt, Human
gggaagagaagagaaaggagg

SEQ ID NO: 175407 - RNA, 22 nt, Human
gugaguugugugaguaagcaga

SEQ ID NO: 175408 - RNA, 22 nt, Human
ggcuuccuggugcagaguuaua

SEQ ID NO: 175409 - RNA, 22 nt, Human
gugaaaugaagugacuggauau

SEQ ID NO: 175410 - RNA, 19 nt, Human
ggcuuugcccuucgcuccg

SEQ ID NO: 175411 - RNA, 22 nt, Human
ggcuuuuguuauaaucaggccu

SEQ ID NO: 175412 - RNA, 22 nt, Human
gugaaaauaguaaccuggcuag

SEQ ID NO: 175413 - RNA, 22 nt, Human
gugaagaugccucaggugaccc

SEQ ID NO: 175414 - RNA, 22 nt, Human
gugaagcaagggucaccugugg

SEQ ID NO: 175415 - RNA, 22 nt, Human
ggcuucucuuggccaugguccc

SEQ ID NO: 175416 - RNA, 22 nt, Human
ggcuuacgcgcuaacagugaau

SEQ ID NO: 175417 - RNA, 22 nt, Human
ggcuguggcagcuggaaguggu

SEQ ID NO: 175418 - RNA, 22 nt, Human
gucuugugaagacggcagaaag

SEQ ID NO: 175419 - RNA, 22 nt, Human
gucuguacugccguuauucaga

SEQ ID NO: 175420 - RNA, 22 nt, Human
ggcuggggccuguugaagaugc

SEQ ID NO: 175421 - RNA, 22 nt, Human
gucugugguccaaaauugccuc

SEQ ID NO: 175422 - RNA, 22 nt, Human
gucuguuggcacagggggaggu

SEQ ID NO: 175423 - RNA, 23 nt, Human
gggaaaucaaaagauauuucuuc

SEQ ID NO: 175424 - RNA, 22 nt, Human
gcuguuucuuuggcaaacugau

SEQ ID NO: 175425 - RNA, 22 nt, Human
gcuguugugaggaucagcauau

SEQ ID NO: 175426 - RNA, 22 nt, Human
gcuguugcaaucaaggccaugg

SEQ ID NO: 175427 - RNA, 22 nt, Human
gcuguugagucagacaaguuuu

SEQ ID NO: 175428 - RNA, 22 nt, Human
ggcuucuuaacauuuggacacc

SEQ ID NO: 175429 - RNA, 22 nt, Human
gcuguguucauccugcccaggu

SEQ ID NO: 175430 - RNA, 22 nt, Human
ggcuuugggaggaugaggcggu

SEQ ID NO: 175431 - RNA, 22 nt, Human
ggccaccuaagguugugcauca

SEQ ID NO: 175432 - RNA, 22 nt, Human
ggccaagagaggauggagggau

SEQ ID NO: 175433 - RNA, 22 nt, Human
gggaagugcaguuuucuuuugg

SEQ ID NO: 175434 - RNA, 20 nt, Human
gggaauggauggauugcucc

SEQ ID NO: 175435 - RNA, 22 nt, Human
gcuugcugaacaggaaccuggc

SEQ ID NO: 175436 - RNA, 22 nt, Human
gggaagugagcuggaaucaagg

SEQ ID NO: 175437 - RNA, 22 nt, Human
gcuugaggaacucagacuugag

SEQ ID NO: 175438 - RNA, 22 nt, Human
gggacgggcuagcugccguggc

SEQ ID NO: 175439 - RNA, 22 nt, Human
gggacucugaaucuagauuccu

SEQ ID NO: 175440 - RNA, 22 nt, Human
gggaauuuuaggaugacuccua

SEQ ID NO: 175441 - RNA, 18 nt, Human
gcuuggguggcuauguuu

SEQ ID NO: 175442 - RNA, 22 nt, Human
gggacugcgagauucucaaggg

SEQ ID NO: 175443 - RNA, 22 nt, Human
gcuucccacagcuggacugggg

SEQ ID NO: 175444 - RNA, 22 nt, Human
gcuuccucaccucaaauuuccg

SEQ ID NO: 175445 - RNA, 22 nt, Human
gggaagaaccucugcuaccaau

SEQ ID NO: 175446 - RNA, 22 nt, Human
gcuucugugagugcagaugcug

SEQ ID NO: 175447 - RNA, 22 nt, Human
gggcuuguuaacuuggcuucca

SEQ ID NO: 175448 - RNA, 22 nt, Human
gggcucuuaauuuuuuucucua

SEQ ID NO: 175449 - RNA, 20 nt, Human
ggacccuggguucuucugag

SEQ ID NO: 175450 - RNA, 22 nt, Human
ggacccagggcuuauucauguu

SEQ ID NO: 175451 - RNA, 22 nt, Human
gggccugcgcuggggggagccg

SEQ ID NO: 175452 - RNA, 19 nt, Human
gggccucacccacaccucc

SEQ ID NO: 175453 - RNA, 22 nt, Human
ggaaguuaguucuuggcaaagg

SEQ ID NO: 175454 - RNA, 22 nt, Human
gggccuguccccccaggagaac

SEQ ID NO: 175455 - RNA, 18 nt, Human
ggaauagcuuguuuccca

SEQ ID NO: 175456 - RNA, 22 nt, Human
ggaaguuugagcaucuguuucc

SEQ ID NO: 175457 - RNA, 22 nt, Human
ggaagaggaagaugaggcagca

SEQ ID NO: 175458 - RNA, 22 nt, Human
gggccgcagccucuccggccug

SEQ ID NO: 175459 - RNA, 22 nt, Human
gggcccggguaggggaagagag

SEQ ID NO: 175460 - RNA, 22 nt, Human
ggaagaagagggagcuguggga

SEQ ID NO: 175461 - RNA, 22 nt, Human
ggaaaggggaaaauacagagag

SEQ ID NO: 175462 - RNA, 22 nt, Human
gggcaggcuggguggugguccc

SEQ ID NO: 175463 - RNA, 22 nt, Human
gcuuucagggucacugucaaca

SEQ ID NO: 175464 - RNA, 22 nt, Human
gcuuuccuggcccugucccugc

SEQ ID NO: 175465 - RNA, 22 nt, Human
gggacugguuguguguggugug

SEQ ID NO: 175466 - RNA, 21 nt, Human
gggagccucauuuucuucauc

SEQ ID NO: 175467 - RNA, 22 nt, Human
gggagccagcagggcauggagc

SEQ ID NO: 175468 - RNA, 20 nt, Human
gggaucgaguaccuccgggu

SEQ ID NO: 175469 - RNA, 22 nt, Human
ggguuuccugcucgcggguagc

SEQ ID NO: 175470 - RNA, 22 nt, Human
ggguuuugugauugccucugaa

SEQ ID NO: 175471 - RNA, 22 nt, Human
gguaacagaagagcacuuggca

SEQ ID NO: 175472 - RNA, 23 nt, Human
ggauccugacauauaccaucacc

SEQ ID NO: 175473 - RNA, 22 nt, Human
ggaugaguuguauauaggauuc

SEQ ID NO: 175474 - RNA, 22 nt, Human
gggugggguaggugacucucgc

SEQ ID NO: 175475 - RNA, 22 nt, Human
gggugcuucauaggugaugcug

SEQ ID NO: 175476 - RNA, 22 nt, Human
ggguggaaugugagugugugug

SEQ ID NO: 175477 - RNA, 22 nt, Human
ggagguguguucuguuuuagug

SEQ ID NO: 175478 - RNA, 22 nt, Human
ggagucugugucuugaagcagu

SEQ ID NO: 175479 - RNA, 22 nt, Human
ggagugaaugguggccguguuu

SEQ ID NO: 175480 - RNA, 22 nt, Human
ggagugaagacagagugaacuu

SEQ ID NO: 175481 - RNA, 22 nt, Human
ggagugaguauguucugaugca

SEQ ID NO: 175482 - RNA, 22 nt, Human
gggugcuuaagcuuguuuguaa

SEQ ID NO: 175483 - RNA, 22 nt, Human
ggagguaagaggcccugggccg

SEQ ID NO: 175484 - RNA, 19 nt, Human
ggaggguguccucaguguc

SEQ ID NO: 175485 - RNA, 22 nt, Human
gggcuuuuccauuccaggguuc

SEQ ID NO: 175486 - RNA, 18 nt, Human
gggcuuugggguucuauc

SEQ ID NO: 175487 - RNA, 22 nt, Human
ggagauggucacagguaaacau

SEQ ID NO: 175488 - RNA, 22 nt, Human
gggggaggcucggcgccgcggu

SEQ ID NO: 175489 - RNA, 22 nt, Human
gggggagcuacaggucccuugg

SEQ ID NO: 175490 - RNA, 22 nt, Human
gggggacagugugccuggugug

SEQ ID NO: 175491 - RNA, 22 nt, Human
gggggaaaguggagguucguga

SEQ ID NO: 175492 - RNA, 22 nt, Human
ggggcuuggguaagaaugcaaa

SEQ ID NO: 175493 - RNA, 22 nt, Human
ggaggccccccaugcagcucca

SEQ ID NO: 175494 - RNA, 22 nt, Human
ggaggcacugaaaguccuacag

SEQ ID NO: 175495 - RNA, 21 nt, Human
gggguuuuguucuuauaaugu

SEQ ID NO: 175496 - RNA, 22 nt, Human
ggaggagggaguucaggaguau

SEQ ID NO: 175497 - RNA, 22 nt, Human
ggaggccagagaagagccaggc

SEQ ID NO: 175498 - RNA, 22 nt, Human
ggaggaugaggguggugguguu

SEQ ID NO: 175499 - RNA, 22 nt, Human
ggagccuggaguuucugauggg

SEQ ID NO: 175500 - RNA, 22 nt, Human
gggguuggaugccuuggaaauu

SEQ ID NO: 175501 - RNA, 22 nt, Human
ggagcugaacccuuaacuggcu

SEQ ID NO: 175502 - RNA, 22 nt, Human
ggaugcagcagagaccuggagu

SEQ ID NO: 175503 - RNA, 22 nt, Human
ggaugauuuucaguuguguggg

SEQ ID NO: 175504 - RNA, 23 nt, Human
ggauggacauacguaugcacagg

SEQ ID NO: 175505 - RNA, 22 nt, Human
ggauggugauguacccagucau

SEQ ID NO: 175506 - RNA, 22 nt, Human
ggaugcguuugaauguguuugu

SEQ ID NO: 175507 - RNA, 22 nt, Human
ggauggaugugaucugccuccu

SEQ ID NO: 175508 - RNA, 20 nt, Human
ggucagccaagaaguuaccu

SEQ ID NO: 175509 - RNA, 22 nt, Human
ggucgagcagcacccguucggc

SEQ ID NO: 175510 - RNA, 22 nt, Human
ggucaucacugagagcagaucc

SEQ ID NO: 175511 - RNA, 18 nt, Human
ggugagggagcuggaagc

SEQ ID NO: 175512 - RNA, 22 nt, Human
ggugaggagaaacucugccccu

SEQ ID NO: 175513 - RNA, 22 nt, Human
ggcacccugcauuggcuugagu

SEQ ID NO: 175514 - RNA, 22 nt, Human
ggcacaggcugguaccaguuca

SEQ ID NO: 175515 - RNA, 22 nt, Human
ggugacuucugaaccuggagug

SEQ ID NO: 175516 - RNA, 23 nt, Human
ggugagccuuucuaguagucuug

SEQ ID NO: 175517 - RNA, 22 nt, Human
ggcaauauuauaagggcauuua

SEQ ID NO: 175518 - RNA, 22 nt, Human
ggugugugugugugugugugug

SEQ ID NO: 175519 - RNA, 22 nt, Human
gguguggcaguggaccugugaa

SEQ ID NO: 175520 - RNA, 22 nt, Human
ggugucguuucacaugacccag

SEQ ID NO: 175521 - RNA, 22 nt, Human
ggugucuuugauguugggcuga

SEQ ID NO: 175522 - RNA, 22 nt, Human
ggugucaucugggcuggagaua

SEQ ID NO: 175523 - RNA, 22 nt, Human
ggccaaagagcacaaugaauag

SEQ ID NO: 175524 - RNA, 22 nt, Human
ggccacauuccagagggcugaa

SEQ ID NO: 175525 - RNA, 19 nt, Human
ggccacacuauuaaaagau

SEQ ID NO: 175526 - RNA, 22 nt, Human
ggccacgggguuugcugaaacu

SEQ ID NO: 175527 - RNA, 22 nt, Human
ggugaucucagucuagaugguu

SEQ ID NO: 175528 - RNA, 22 nt, Human
ggugcuggggaaauuaggguag

SEQ ID NO: 175529 - RNA, 22 nt, Human
gguggcagaggaggcgggagag

SEQ ID NO: 175530 - RNA, 22 nt, Human
gguggagacucagauuuguugc

SEQ ID NO: 175531 - RNA, 22 nt, Human
gguggcauucaguaaguauaua

SEQ ID NO: 175532 - RNA, 22 nt, Human
gguggccuaacaaugguggcaa

SEQ ID NO: 175533 - RNA, 22 nt, Human
gguggccggcaccccacccucg

SEQ ID NO: 175534 - RNA, 22 nt, Human
ggcaucuuuaaugaacaugaau

SEQ ID NO: 175535 - RNA, 22 nt, Human
ggcaugcaaaugugggugaccu

SEQ ID NO: 175536 - RNA, 22 nt, Human
gcccccgccuugcugggccagg

SEQ ID NO: 175537 - RNA, 22 nt, Human
gaugguggaggaaucgcugaag

SEQ ID NO: 175538 - RNA, 22 nt, Human
gcccccagcuggcuugaggauu

SEQ ID NO: 175539 - RNA, 22 nt, Human
gccccgcgcgcguagcgccgcu

SEQ ID NO: 175540 - RNA, 22 nt, Human
gaugucauguuggcagacaguu

SEQ ID NO: 175541 - RNA, 22 nt, Human
gcccuggagauggaaguucuga

SEQ ID NO: 175542 - RNA, 22 nt, Human
gcccugaaggccuccaggacuc

SEQ ID NO: 175543 - RNA, 22 nt, Human
gcccugccauugaucggcccag

SEQ ID NO: 175544 - RNA, 22 nt, Human
gcccuguuauagucugaggccu

SEQ ID NO: 175545 - RNA, 22 nt, Human
gcccugucagcucucauggaca

SEQ ID NO: 175546 - RNA, 22 nt, Human
gcccuggucguggagggcaaca

SEQ ID NO: 175547 - RNA, 22 nt, Human
gcccuguguguuugcacugauu

SEQ ID NO: 175548 - RNA, 22 nt, Human
gauggugcaauuaucgugcaug

SEQ ID NO: 175549 - RNA, 22 nt, Human
gaugggaggaugaauuggaccu

SEQ ID NO: 175550 - RNA, 22 nt, Human
gauggguugaguucauggagcc

SEQ ID NO: 175551 - RNA, 22 nt, Human
gauggggaaaaaauggaucuuu

SEQ ID NO: 175552 - RNA, 22 nt, Human
gccaguggucagugggagggug

SEQ ID NO: 175553 - RNA, 23 nt, Human
gccaucugcugggugccccggcc

SEQ ID NO: 175554 - RNA, 22 nt, Human
gccauauucaugcaggugcuaa

SEQ ID NO: 175555 - RNA, 22 nt, Human
gcccagcucucuggccugucuu

SEQ ID NO: 175556 - RNA, 22 nt, Human
gccaucugcuuagauugcuggg

SEQ ID NO: 175557 - RNA, 22 nt, Human
gauccagauauuugggcuggua

SEQ ID NO: 175558 - RNA, 18 nt, Human
gccagcccuccaaccucc

SEQ ID NO: 175559 - RNA, 22 nt, Human
gaugaagaaacucaaccaagaa

SEQ ID NO: 175560 - RNA, 22 nt, Human
gaucugguuccaggacauugca

SEQ ID NO: 175561 - RNA, 22 nt, Human
gaucuguccuggcaguuaacac

SEQ ID NO: 175562 - RNA, 22 nt, Human
gaucuuacucacuucagcuggc

SEQ ID NO: 175563 - RNA, 22 nt, Human
gaugcauccuuucugucuucuc

SEQ ID NO: 175564 - RNA, 22 nt, Human
gccaggugauuucaaaguccuu

SEQ ID NO: 175565 - RNA, 22 nt, Human
gccaggcggcccaggagauggc

SEQ ID NO: 175566 - RNA, 22 nt, Human
gccaggagaaaaggcgaaugau

SEQ ID NO: 175567 - RNA, 22 nt, Human
gccagcuuagaucccccagccc

SEQ ID NO: 175568 - RNA, 22 nt, Human
gccaggcagcagcgaggauggu

SEQ ID NO: 175569 - RNA, 19 nt, Human
gccacccaucauauggagg

SEQ ID NO: 175570 - RNA, 21 nt, Human
gccacugcugcucauucucug

SEQ ID NO: 175571 - RNA, 22 nt, Human
gcaucuguuagagugugcaugc

SEQ ID NO: 175572 - RNA, 23 nt, Human
gcaucgcaggucuaagauuagcu

SEQ ID NO: 175573 - RNA, 22 nt, Human
gcauccugacuauggugguggu

SEQ ID NO: 175574 - RNA, 22 nt, Human
gcaucccagaagauucugauuu

SEQ ID NO: 175575 - RNA, 22 nt, Human
gaguccuggagagcccgagcgc

SEQ ID NO: 175576 - RNA, 22 nt, Human
gcaguuugugauguggcaguca

SEQ ID NO: 175577 - RNA, 22 nt, Human
gagucaucucuagaaugaugau

SEQ ID NO: 175578 - RNA, 22 nt, Human
gagucaggucaggcuuguagau

SEQ ID NO: 175579 - RNA, 22 nt, Human
gcaguugguccagccucggcug

SEQ ID NO: 175580 - RNA, 22 nt, Human
gcagugccauguggaggaucuc

SEQ ID NO: 175581 - RNA, 22 nt, Human
gcaguuaccuauuuuguagaaa

SEQ ID NO: 175582 - RNA, 22 nt, Human
gaguggcaaagagaacaaagau

SEQ ID NO: 175583 - RNA, 22 nt, Human
gaguggugagaauacaacggaa

SEQ ID NO: 175584 - RNA, 19 nt, Human
gagugaggagcaucguuua

SEQ ID NO: 175585 - RNA, 22 nt, Human
gcaguugugguuucguuuccuu

SEQ ID NO: 175586 - RNA, 23 nt, Human
gcagugacugggauggaaguaga

SEQ ID NO: 175587 - RNA, 22 nt, Human
gaguaaacagccuucucccagc

SEQ ID NO: 175588 - RNA, 22 nt, Human
gcagguggaagcagcagacuca

SEQ ID NO: 175589 - RNA, 22 nt, Human
gaguagcaguucauccacaagc

SEQ ID NO: 175590 - RNA, 22 nt, Human
gaguaucagauuggaguccuca

SEQ ID NO: 175591 - RNA, 21 nt, Human
gaucgcaaugugggaaucaug

SEQ ID NO: 175592 - RNA, 22 nt, Human
gcagggcucuggagucaggcug

SEQ ID NO: 175593 - RNA, 22 nt, Human
gcaggccuccccugcuggagcu

SEQ ID NO: 175594 - RNA, 22 nt, Human
gauuuugcuuuagugaaggaag

SEQ ID NO: 175595 - RNA, 18 nt, Human
gccucuguugacagaguu

SEQ ID NO: 175596 - RNA, 22 nt, Human
gcacggucagggugggggagug

SEQ ID NO: 175597 - RNA, 22 nt, Human
gcaccgagaaggaagcaugccu

SEQ ID NO: 175598 - RNA, 18 nt, Human
gccugccagccgagggac

SEQ ID NO: 175599 - RNA, 22 nt, Human
gcacaggcugcacgaccccagc

SEQ ID NO: 175600 - RNA, 22 nt, Human
gcaaggaggguaaccacauuuc

SEQ ID NO: 175601 - RNA, 22 nt, Human
gccugcaggaaggugugccugu

SEQ ID NO: 175602 - RNA, 20 nt, Human
gcagcagacagacaggggac

SEQ ID NO: 175603 - RNA, 23 nt, Human
gcagccaacccacgugagagaag

SEQ ID NO: 175604 - RNA, 22 nt, Human
gcgcacaaccccguggcgguga

SEQ ID NO: 175605 - RNA, 22 nt, Human
gcagcaauaaaacugaaggugu

SEQ ID NO: 175606 - RNA, 22 nt, Human
gcgcagugagguuaagaaugca

SEQ ID NO: 175607 - RNA, 22 nt, Human
gcgccgacccucccugccggac

SEQ ID NO: 175608 - RNA, 20 nt, Human
gcgcaguuccgggcgcgucu

SEQ ID NO: 175609 - RNA, 22 nt, Human
gcgcgcucugcgaggacacgcu

SEQ ID NO: 175610 - RNA, 22 nt, Human
gcagagcacccugcagugguau

SEQ ID NO: 175611 - RNA, 22 nt, Human
gcagaggcaaagucuggaugac

SEQ ID NO: 175612 - RNA, 22 nt, Human
gcagaggcugccgugggcagga

SEQ ID NO: 175613 - RNA, 22 nt, Human
gcagaugagagugugaucuggg

SEQ ID NO: 175614 - RNA, 22 nt, Human
gcagauaguaggagcuaaucuu

SEQ ID NO: 175615 - RNA, 21 nt, Human
gcagaaagugauuugcuauuc

SEQ ID NO: 175616 - RNA, 22 nt, Human
gcagagaaugucagauuuuguu

SEQ ID NO: 175617 - RNA, 20 nt, Human
gcagcugacccuagugcuug

SEQ ID NO: 175618 - RNA, 22 nt, Human
gcagcuuuggagguggaacucu

SEQ ID NO: 175619 - RNA, 22 nt, Human
gcgcugagcuuuucuuauugaa

SEQ ID NO: 175620 - RNA, 22 nt, Human
gcgcgggugagucacgggcgga

SEQ ID NO: 175621 - RNA, 22 nt, Human
gcagggcucagccgcucccacc

SEQ ID NO: 175622 - RNA, 23 nt, Human
gcgggcggagccgggaggcgggg

SEQ ID NO: 175623 - RNA, 19 nt, Human
gcgggcucuccaccccauc

SEQ ID NO: 175624 - RNA, 22 nt, Human
gcagagcugucuaagucacuuc

SEQ ID NO: 175625 - RNA, 22 nt, Human
gcaggccgauuuguuagaaguc

SEQ ID NO: 175626 - RNA, 22 nt, Human
gcaggguaggugacagguaguc

SEQ ID NO: 175627 - RNA, 22 nt, Human
gcaggucacagcugauuggcca

SEQ ID NO: 175628 - RNA, 22 nt, Human
gcaguaaauugagagucauguu

SEQ ID NO: 175629 - RNA, 22 nt, Human
gcagguuguuuaaauuaggauu

SEQ ID NO: 175630 - RNA, 22 nt, Human
gcagugacagacaacuguuuga

SEQ ID NO: 175631 - RNA, 22 nt, Human
gcaguagauccagcagccugca

SEQ ID NO: 175632 - RNA, 22 nt, Human
gcaguaaggaggggaaggguuu

SEQ ID NO: 175633 - RNA, 22 nt, Human
gcagguccgagagggucgggua

SEQ ID NO: 175634 - RNA, 23 nt, Human
gcaugcccauauguguauauaua

SEQ ID NO: 175635 - RNA, 22 nt, Human
gcaugcaggaagggcuugggga

SEQ ID NO: 175636 - RNA, 18 nt, Human
gcugaaauucuaaacaaa

SEQ ID NO: 175637 - RNA, 23 nt, Human
gcugaagcccacucccugggucu

SEQ ID NO: 175638 - RNA, 22 nt, Human
gcucggcuggcucaucucaugu

SEQ ID NO: 175639 - RNA, 22 nt, Human
gcaugcuguuuggaaacgauaa

SEQ ID NO: 175640 - RNA, 22 nt, Human
gcucaugggcccagagcagccc

SEQ ID NO: 175641 - RNA, 20 nt, Human
gcucaguggagaaaugcacc

SEQ ID NO: 175642 - RNA, 22 nt, Human
gcucagccuuuuguucuauuca

SEQ ID NO: 175643 - RNA, 22 nt, Human
gcucagagaugucugcugccuu

SEQ ID NO: 175644 - RNA, 22 nt, Human
gcucagagaaaacuggggcuug

SEQ ID NO: 175645 - RNA, 22 nt, Human
gcauagauauguaaugcaucau

SEQ ID NO: 175646 - RNA, 22 nt, Human
gcucagcuggagagggacgggu

SEQ ID NO: 175647 - RNA, 22 nt, Human
gcuaggagccucgacucuggag

SEQ ID NO: 175648 - RNA, 22 nt, Human
gcuagaaggaagccccugcuga

SEQ ID NO: 175649 - RNA, 22 nt, Human
gcaguccuuaggagaggaagua

SEQ ID NO: 175650 - RNA, 22 nt, Human
gcagugcauggaagggggugug

SEQ ID NO: 175651 - RNA, 23 nt, Human
gcaguggagcgagaacuuccugu

SEQ ID NO: 175652 - RNA, 22 nt, Human
gcagugcugcgacagucgggug

SEQ ID NO: 175653 - RNA, 22 nt, Human
gcuugggcugaaggccuggguc

SEQ ID NO: 175654 - RNA, 22 nt, Human
gcuuucacugcaauagaugaau

SEQ ID NO: 175655 - RNA, 22 nt, Human
gccgcgggucugggucuggcuc

SEQ ID NO: 175656 - RNA, 20 nt, Human
gcuugcggacagguggcuca

SEQ ID NO: 175657 - RNA, 22 nt, Human
gcuugcaucaggggcuggggcc

SEQ ID NO: 175658 - RNA, 20 nt, Human
gcuugcgugggaggaggggg

SEQ ID NO: 175659 - RNA, 22 nt, Human
gcuuuugaauacuacaggaguu

SEQ ID NO: 175660 - RNA, 22 nt, Human
gcuuuugcaaagcuggagaauu

SEQ ID NO: 175661 - RNA, 22 nt, Human
ggaaaaugcugaagcaucugaa

SEQ ID NO: 175662 - RNA, 22 nt, Human
gccucucagcuagaaggcaggu

SEQ ID NO: 175663 - RNA, 22 nt, Human
gccuccggagucgcagugucuu

SEQ ID NO: 175664 - RNA, 22 nt, Human
gccgggagaggcggcgcagggg

SEQ ID NO: 175665 - RNA, 22 nt, Human
gccgggagugcagcgggcgcgc

SEQ ID NO: 175666 - RNA, 22 nt, Human
gccggcccugcgcggggcggaa

SEQ ID NO: 175667 - RNA, 22 nt, Human
gccggcugggggcggagggcag

SEQ ID NO: 175668 - RNA, 22 nt, Human
gccugcacucaaacacucucuu

SEQ ID NO: 175669 - RNA, 22 nt, Human
gccugccucugacuggggcuga

SEQ ID NO: 175670 - RNA, 17 nt, Human
ggaagaaaaggaucauc

SEQ ID NO: 175671 - RNA, 22 nt, Human
gccugcagccagggaguucucu

SEQ ID NO: 175672 - RNA, 22 nt, Human
gccugcaaagacuuccuucucu

SEQ ID NO: 175673 - RNA, 22 nt, Human
ggaaaggaagggaaggagaugc

SEQ ID NO: 175674 - RNA, 22 nt, Human
gccugagucaagauguggcacc

SEQ ID NO: 175675 - RNA, 21 nt, Human
gcuucaauucauccaccucuc

SEQ ID NO: 175676 - RNA, 22 nt, Human
gcuucacucugagacuuggagc

SEQ ID NO: 175677 - RNA, 22 nt, Human
gcuuccuccaucuggggcuugc

SEQ ID NO: 175678 - RNA, 22 nt, Human
gcuucuguuaggauguggcuua

SEQ ID NO: 175679 - RNA, 21 nt, Human
gccgaugugacucuacguagu

SEQ ID NO: 175680 - RNA, 22 nt, Human
gccgcagauucugagacgugua

SEQ ID NO: 175681 - RNA, 22 nt, Human
gccgcaacggacccugggaguc

SEQ ID NO: 175682 - RNA, 22 nt, Human
gcuguggagaagcugccuaugg

SEQ ID NO: 175683 - RNA, 18 nt, Human
gcuguccgguagcuggug

SEQ ID NO: 175684 - RNA, 22 nt, Human
gcugugacaagaggcugcuucu

SEQ ID NO: 175685 - RNA, 22 nt, Human
gcuguggacacagcucucuuca

SEQ ID NO: 175686 - RNA, 22 nt, Human
gcuguguaugaugcaggcaccu

SEQ ID NO: 175687 - RNA, 22 nt, Human
gcuguuggaggaguucagugcu

SEQ ID NO: 175688 - RNA, 22 nt, Human
gcuguuguugcacggaaggugg

SEQ ID NO: 175689 - RNA, 22 nt, Human
gcuguuuaaguggaauuuguuu

SEQ ID NO: 175690 - RNA, 22 nt, Human
gcugguggcagagcuccgcggc

SEQ ID NO: 175691 - RNA, 22 nt, Human
gcugucccccaaagaugcuccu

SEQ ID NO: 175692 - RNA, 22 nt, Human
gcccucugccacaggacgccag

SEQ ID NO: 175693 - RNA, 22 nt, Human
gcugucauggacaugucuguuu

SEQ ID NO: 175694 - RNA, 20 nt, Human
gcccuucccccuccgcgagc

SEQ ID NO: 175695 - RNA, 22 nt, Human
gcccuguuuucuggguuccuug

SEQ ID NO: 175696 - RNA, 22 nt, Human
gcccuggcauuucuauucaugu

SEQ ID NO: 175697 - RNA, 22 nt, Human
gccccaggggaggugcccugca

SEQ ID NO: 175698 - RNA, 22 nt, Human
gcauuggaaacugcuuuaugcu

SEQ ID NO: 175699 - RNA, 22 nt, Human
gcccccauuccugcggccuuca

SEQ ID NO: 175700 - RNA, 22 nt, Human
gcaugguuagacaucaauguga

SEQ ID NO: 175701 - RNA, 22 nt, Human
gcugacuauaaggcugcucugu

SEQ ID NO: 175702 - RNA, 22 nt, Human
gcugacucugcuuuuagccucc

SEQ ID NO: 175703 - RNA, 22 nt, Human
gcugacuuauuagaaaaggaca

SEQ ID NO: 175704 - RNA, 22 nt, Human
gcugacuguagcugggggaaga

SEQ ID NO: 175705 - RNA, 22 nt, Human
gcugagcaaugcacugccgcau

SEQ ID NO: 175706 - RNA, 22 nt, Human
ggcagucuuucccuugagcucu

SEQ ID NO: 175707 - RNA, 20 nt, Human
ggcaucugacaacuaguugc

SEQ ID NO: 175708 - RNA, 22 nt, Human
ggcaguguggauccuggagaag

SEQ ID NO: 175709 - RNA, 22 nt, Human
ggcauggugggggaggacuugg

SEQ ID NO: 175710 - RNA, 22 nt, Human
ggcauugauggggucuugggga

SEQ ID NO: 175711 - RNA, 22 nt, Human
ggcauuccucucuguucaugga

SEQ ID NO: 175712 - RNA, 22 nt, Human
gcucaacuucuaggacuucagg

SEQ ID NO: 175713 - RNA, 22 nt, Human
gcuagcugugcuuggaaguuug

SEQ ID NO: 175714 - RNA, 20 nt, Human
gcuaggggacuggagggagg

SEQ ID NO: 175715 - RNA, 22 nt, Human
ggcaguagucagaggguuuuac

SEQ ID NO: 175716 - RNA, 22 nt, Human
ggcagguccugaguccugaggc

SEQ ID NO: 175717 - RNA, 22 nt, Human
gcguaccugaaauuacggcacu

SEQ ID NO: 175718 - RNA, 22 nt, Human
gcgguuguucugugugcaugga

SEQ ID NO: 175719 - RNA, 22 nt, Human
gcgguuggacguucgccucggg

SEQ ID NO: 175720 - RNA, 22 nt, Human
gcgugcauggccguguguaugc

SEQ ID NO: 175721 - RNA, 22 nt, Human
gcgugcauguguguaugcgugu

SEQ ID NO: 175722 - RNA, 20 nt, Human
ggcagcaaccauaugcuaca

SEQ ID NO: 175723 - RNA, 22 nt, Human
ggcagcagaaccaacuguggcu

SEQ ID NO: 175724 - RNA, 22 nt, Human
ggcagcuuucaauaggguuaug

SEQ ID NO: 175725 - RNA, 22 nt, Human
gcuagaaacuguuuaaucucuu

SEQ ID NO: 175726 - RNA, 22 nt, Human
ggcacagcgacuaccaucgaaa

SEQ ID NO: 175727 - RNA, 22 nt, Human
ggcacacugaaguuugagaacc

SEQ ID NO: 175728 - RNA, 22 nt, Human
ggcacgagccaguguguguguu

SEQ ID NO: 175729 - RNA, 22 nt, Human
ggaguucacagcaauggaacag

SEQ ID NO: 175730 - RNA, 22 nt, Human
ggaguuucugucaucccguccc

SEQ ID NO: 175731 - RNA, 22 nt, Human
ggauaaaugaaggcauacagau

SEQ ID NO: 175732 - RNA, 22 nt, Human
gcggaucuccuugagugggcaa

SEQ ID NO: 175733 - RNA, 20 nt, Human
gcgcuucccuacgcucugcu

SEQ ID NO: 175734 - RNA, 22 nt, Human
gcgcucuccugcagacagccuc

SEQ ID NO: 175735 - RNA, 22 nt, Human
gcggacaauggaagaugucauu

SEQ ID NO: 175736 - RNA, 22 nt, Human
gcggagaggcagagacuccgcg

SEQ ID NO: 175737 - RNA, 22 nt, Human
ggagagcguggaugggcuucca

SEQ ID NO: 175738 - RNA, 22 nt, Human
gcgcggcgcggguccucggccu

SEQ ID NO: 175739 - RNA, 21 nt, Human
gcgcgcucgugcucgacgcgc

SEQ ID NO: 175740 - RNA, 22 nt, Human
ggagacagugacuuagagacug

SEQ ID NO: 175741 - RNA, 22 nt, Human
ggagacuaagaaaauagagucc

SEQ ID NO: 175742 - RNA, 23 nt, Human
ggagaaggaugucaucaaaagac

SEQ ID NO: 175743 - RNA, 22 nt, Human
ggagacagauggcgucucaguu

SEQ ID NO: 175744 - RNA, 22 nt, Human
ggagguggagcuggaaguucca

SEQ ID NO: 175745 - RNA, 22 nt, Human
ggagucguguuugggaucggag

SEQ ID NO: 175746 - RNA, 22 nt, Human
ggaggguggaggagggaauuga

SEQ ID NO: 175747 - RNA, 22 nt, Human
ggaggaggggcggggaggggag

SEQ ID NO: 175748 - RNA, 22 nt, Human
ggaggccgugcugugcugccag

SEQ ID NO: 175749 - RNA, 22 nt, Human
ggaggcggaaguccaagcaggu

SEQ ID NO: 175750 - RNA, 22 nt, Human
gccuucauuggaaucuagcuuc

SEQ ID NO: 175751 - RNA, 22 nt, Human
gccucucagagcuguucaguuu

SEQ ID NO: 175752 - RNA, 18 nt, Human
ggacaguuguagaggacu

SEQ ID NO: 175753 - RNA, 22 nt, Human
ggacauuguuguuggauccuug

SEQ ID NO: 175754 - RNA, 22 nt, Human
gccuuuugcaaugguguuggug

SEQ ID NO: 175755 - RNA, 17 nt, Human
ggacuuucugccugucc

SEQ ID NO: 175756 - RNA, 22 nt, Human
ggaccagagcuaaugcgcgccc

SEQ ID NO: 175757 - RNA, 22 nt, Human
ggacuggugaagccuucggaga

SEQ ID NO: 175758 - RNA, 22 nt, Human
ggacuuucuccugcacaaagug

SEQ ID NO: 175759 - RNA, 22 nt, Human
gccuggggaacuugauccuguc

SEQ ID NO: 175760 - RNA, 22 nt, Human
gccugggugcugugggguggag

SEQ ID NO: 175761 - RNA, 22 nt, Human
gccugggguuugcggggcugca

SEQ ID NO: 175762 - RNA, 22 nt, Human
gccugggccgggcgcggccccc

SEQ ID NO: 175763 - RNA, 22 nt, Human
ggaauuaagaggcuggacaggg

SEQ ID NO: 175764 - RNA, 22 nt, Human
ggaaugcuuggcaugagaaccu

SEQ ID NO: 175765 - RNA, 22 nt, Human
ggaagacuuagaguagcaucag

SEQ ID NO: 175766 - RNA, 23 nt, Human
uuuuccaaaucgacucucuaguu

SEQ ID NO: 175767 - RNA, 22 nt, Human
uuauuucauguaaaauuuaugu

SEQ ID NO: 175768 - RNA, 22 nt, Human
aucacuagaguuacauugccag

SEQ ID NO: 175769 - RNA, 22 nt, Human
ucuucaugaaauugauugcuua

SEQ ID NO: 175770 - RNA, 22 nt, Human
ugcauucugaacguaaauguga

SEQ ID NO: 175771 - RNA, 22 nt, Human
caaauguuugguggcauuuugu

SEQ ID NO: 175772 - RNA, 22 nt, Human
guuaaaaugauuugugauuuau

SEQ ID NO: 175773 - RNA, 22 nt, Human
aucuucuuucaucagccccuca

SEQ ID NO: 175774 - RNA, 22 nt, Human
aaauguuugguggauaaaagga

SEQ ID NO: 175775 - RNA, 22 nt, Human
uggggagacauggaguaaaaga

SEQ ID NO: 175776 - RNA, 22 nt, Human
ugcuuggauuuccaaaugguuu

SEQ ID NO: 175777 - RNA, 22 nt, Human
cuucuuuuggggaugaaaaugg

SEQ ID NO: 175778 - RNA, 22 nt, Human
uuuuaaauggcuuuuacuuuuc

SEQ ID NO: 175779 - RNA, 22 nt, Human
uuuuaaaagguugcuguuauaa

SEQ ID NO: 175780 - RNA, 22 nt, Human
gcuggaaauaacuuguguagaa

SEQ ID NO: 175781 - RNA, 22 nt, Human
ccuaggcuggcugucuucaggu

SEQ ID NO: 175782 - RNA, 22 nt, Human
auuuaaaaacugguacaacagg

SEQ ID NO: 175783 - RNA, 22 nt, Human
uuguuuuaguagaaguuacaug

SEQ ID NO: 175784 - RNA, 22 nt, Human
aaauguaaacuguauuuauaaa

SEQ ID NO: 175785 - RNA, 22 nt, Human
aacugcauaagcuucgggaccu

SEQ ID NO: 175786 - RNA, 22 nt, Human
gcugucccccaaagaugcuccu

SEQ ID NO: 175787 - RNA, 22 nt, Human
uauuucaugagugaauaucuag

SEQ ID NO: 175788 - RNA, 16 nt, Human
gaauuccauugcucug

SEQ ID NO: 175789 - RNA, 22 nt, Human
auucuucauguugaagcuguca

SEQ ID NO: 175790 - RNA, 22 nt, Human
aaaacauuuaggguuuuuuuua

SEQ ID NO: 175791 - RNA, 22 nt, Human
ggcagaggagcuggaaacaugg

SEQ ID NO: 175792 - RNA, 22 nt, Human
agagcuccaggguuuuguagug

SEQ ID NO: 175793 - RNA, 22 nt, Human
auauauguauauaugugugugu

SEQ ID NO: 175794 - RNA, 22 nt, Human
cagcuccaucuugcuuauacca

SEQ ID NO: 175795 - RNA, 22 nt, Human
aaucauaacaaaagcaauuaua

SEQ ID NO: 175796 - RNA, 22 nt, Human
uuaaaagaauccuguuauccuc

SEQ ID NO: 175797 - RNA, 21 nt, Human
uuccuggaggcagaaacguga

SEQ ID NO: 175798 - RNA, 22 nt, Human
auuuuauuuugggaucuuuuua

SEQ ID NO: 175799 - RNA, 22 nt, Human
uucuucuucuuccucauccuca

SEQ ID NO: 175800 - RNA, 22 nt, Human
cuagcacagugcuuggcacaca

SEQ ID NO: 175801 - RNA, 22 nt, Human
uuuaaucaguugguaauauuga

SEQ ID NO: 175802 - RNA, 20 nt, Human
aauaaauauaacccauaauu

SEQ ID NO: 175803 - RNA, 22 nt, Human
aacacuaaaggucaguuagaag

SEQ ID NO: 175804 - RNA, 22 nt, Human
uuauuucaggcauuuguaaaug

SEQ ID NO: 175805 - RNA, 22 nt, Human
cagcuuguucugaccugugauu

SEQ ID NO: 175806 - RNA, 22 nt, Human
guucuucagcccucagguccua

SEQ ID NO: 175807 - RNA, 22 nt, Human
ugagauguaauguaguacuuug

SEQ ID NO: 175808 - RNA, 22 nt, Human
cagcuccagcccaggcagcucc

SEQ ID NO: 175809 - RNA, 22 nt, Human
uguuggaaucuucuagucuucc

SEQ ID NO: 175810 - RNA, 22 nt, Human
gugugucucaguugcuccgaag

SEQ ID NO: 175811 - RNA, 22 nt, Human
agagauacugcaggccauaaau

SEQ ID NO: 175812 - RNA, 22 nt, Human
ucucucucucuuccagcauguu

SEQ ID NO: 175813 - RNA, 22 nt, Human
auuuuuauuugccuaugauaua

SEQ ID NO: 175814 - RNA, 22 nt, Human
uaccuggauaaauguacaaccg

SEQ ID NO: 175815 - RNA, 22 nt, Human
aacgagcugggggggccggggg

SEQ ID NO: 175816 - RNA, 22 nt, Human
cuggagaacucugugcuucacu

SEQ ID NO: 175817 - RNA, 22 nt, Human
uauuuuaaaagcauuaauucuu

SEQ ID NO: 175818 - RNA, 22 nt, Human
ucauacuuuuuugacccuugug

SEQ ID NO: 175819 - RNA, 22 nt, Human
uuucuggacuaaagggagagau

SEQ ID NO: 175820 - RNA, 22 nt, Human
gaaacauuuguugaguacuugc

SEQ ID NO: 175821 - RNA, 23 nt, Human
cagagaaaauagaauaugcugug

SEQ ID NO: 175822 - RNA, 22 nt, Human
auauuuuacagcucucguugaa

SEQ ID NO: 175823 - RNA, 22 nt, Human
uauuaaaagagaaaaagccacc

SEQ ID NO: 175824 - RNA, 22 nt, Human
uagacugugagcuccuugaggg

SEQ ID NO: 175825 - RNA, 22 nt, Human
auguuccaugacuaugcaugaa

SEQ ID NO: 175826 - RNA, 22 nt, Human
ucuucacagaugcauauacuuc

SEQ ID NO: 175827 - RNA, 22 nt, Human
aggcaguguggagggcuguugc

SEQ ID NO: 175828 - RNA, 22 nt, Human
aaauuuuguugaaaaauauuuu

SEQ ID NO: 175829 - RNA, 22 nt, Human
cuccccuuauuccucaacauga

SEQ ID NO: 175830 - RNA, 22 nt, Human
aaauauuugaaugguguaagau

SEQ ID NO: 175831 - RNA, 22 nt, Human
ugugugcuaguuuugucaguau

SEQ ID NO: 175832 - RNA, 22 nt, Human
uucaaaaugcagaauaguuugg

SEQ ID NO: 175833 - RNA, 22 nt, Human
uuuaaaauguuuuauuuauuua

SEQ ID NO: 175834 - RNA, 22 nt, Human
aaaugcuuuaauugaguucaug

SEQ ID NO: 175835 - RNA, 22 nt, Human
uacuuacacugaagcaaagaua

SEQ ID NO: 175836 - RNA, 22 nt, Human
gaagaaggaagaucaugcuuga

SEQ ID NO: 175837 - RNA, 22 nt, Human
uuuccuaggaaaugauugaagu

SEQ ID NO: 175838 - RNA, 22 nt, Human
cuaaauucuauauccuugcuuc

SEQ ID NO: 175839 - RNA, 22 nt, Human
aaugauuuucugcaaacaguga

SEQ ID NO: 175840 - RNA, 22 nt, Human
guucuucagauuccauuucagu

SEQ ID NO: 175841 - RNA, 17 nt, Human
ccacuagauagguugug

SEQ ID NO: 175842 - RNA, 22 nt, Human
uucacccuucucuggcuuucag

SEQ ID NO: 175843 - RNA, 22 nt, Human
auuuccagcagcauauuugucu

SEQ ID NO: 175844 - RNA, 22 nt, Human
ggcagagguagcuggaaccagg

SEQ ID NO: 175845 - RNA, 22 nt, Human
gagaaaaauuucuuugcugcac

SEQ ID NO: 175846 - RNA, 22 nt, Human
cuucuuuucuacuggccuagaa

SEQ ID NO: 175847 - RNA, 22 nt, Human
ucuucaucucuaaaaugggaac

SEQ ID NO: 175848 - RNA, 22 nt, Human
uugccaggggacaucuggagcc

SEQ ID NO: 175849 - RNA, 22 nt, Human
aaauguauuagccuaugugaga

SEQ ID NO: 175850 - RNA, 22 nt, Human
uuuuuaaaauuaggacggcacg

SEQ ID NO: 175851 - RNA, 22 nt, Human
auuaaaaaaagauaaugaguua

SEQ ID NO: 175852 - RNA, 22 nt, Human
augaaaacggaccagagcuauu

SEQ ID NO: 175853 - RNA, 22 nt, Human
uuuacaaggcaguuauuuuccu

SEQ ID NO: 175854 - RNA, 23 nt, Human
uuucugaguuuuuuaaaagucca

SEQ ID NO: 175855 - RNA, 22 nt, Human
accuccauggcccacaucuagu

SEQ ID NO: 175856 - RNA, 22 nt, Human
ggcagucuuucccuugagcucu

SEQ ID NO: 175857 - RNA, 22 nt, Human
uuuucauagccagaaacugaaa

SEQ ID NO: 175858 - RNA, 22 nt, Human
uaauuccacacucccgcaagcg

SEQ ID NO: 175859 - RNA, 22 nt, Human
aaggcuguuugagcacuggagc

SEQ ID NO: 175860 - RNA, 21 nt, Human
uuucauuaguacaucaauuug

SEQ ID NO: 175861 - RNA, 22 nt, Human
aaaauacuaggaaaauaaauca

SEQ ID NO: 175862 - RNA, 22 nt, Human
gugucccaaagauuagaaauca

SEQ ID NO: 175863 - RNA, 22 nt, Human
uaguuucuucaacugucccagc

SEQ ID NO: 175864 - RNA, 22 nt, Human
ccauuucacaucccugacaugu

SEQ ID NO: 175865 - RNA, 22 nt, Human
aagaggcuacagcccugugucu

SEQ ID NO: 175866 - RNA, 21 nt, Human
uccccugugccuggcauacag

SEQ ID NO: 175867 - RNA, 22 nt, Human
aaauauagugacacuuauaguc

SEQ ID NO: 175868 - RNA, 22 nt, Human
guuuucuuguuaauuuugaacg

SEQ ID NO: 175869 - RNA, 22 nt, Human
auuuuugguuucaccugcacgc

SEQ ID NO: 175870 - RNA, 22 nt, Human
uucuaauauuaugauuucuaag

SEQ ID NO: 175871 - RNA, 22 nt, Human
cuccaugagccaggagggcuac

SEQ ID NO: 175872 - RNA, 22 nt, Human
guaaauaucucacgaaugauuc

SEQ ID NO: 175873 - RNA, 22 nt, Human
ccagucuuggugucuguagcac

SEQ ID NO: 175874 - RNA, 22 nt, Human
uuuuaaaacaugucaaaaugug

SEQ ID NO: 175875 - RNA, 22 nt, Human
gaauuccaggugagagaaggua

SEQ ID NO: 175876 - RNA, 22 nt, Human
gguagacugagcuccuugagga

SEQ ID NO: 175877 - RNA, 22 nt, Human
gcuguggagaagcugccuaugg

SEQ ID NO: 175878 - RNA, 22 nt, Human
guccuguguaaguacuugcuca

SEQ ID NO: 175879 - RNA, 23 nt, Human
uugcuuuugccccaaaagaguua

SEQ ID NO: 175880 - RNA, 22 nt, Human
cuucuuaaaguugucacagcug

SEQ ID NO: 175881 - RNA, 22 nt, Human
ugcuuggagaaucagucccagc

SEQ ID NO: 175882 - RNA, 22 nt, Human
auuaauaucaauauauuauaug

SEQ ID NO: 175883 - RNA, 22 nt, Human
aauauuuugggacugaggaauu

SEQ ID NO: 175884 - RNA, 22 nt, Human
guccccugcguguucauccugg

SEQ ID NO: 175885 - RNA, 22 nt, Human
aguuuccacuggagacacugug

SEQ ID NO: 175886 - RNA, 22 nt, Human
uggaguuuuaaucuguacagaa

SEQ ID NO: 175887 - RNA, 22 nt, Human
uuauuuuauaaagagaagacuu

SEQ ID NO: 175888 - RNA, 20 nt, Human
cauuccaugcaucuuggucc

SEQ ID NO: 175889 - RNA, 22 nt, Human
uuauuuaagaucuuaauauaua

SEQ ID NO: 175890 - RNA, 22 nt, Human
gcuucuguuaggauguggcuua

SEQ ID NO: 175891 - RNA, 19 nt, Human
ccaguuuuuuaauauucaa

SEQ ID NO: 175892 - RNA, 22 nt, Human
uucuucuuuccuauaauuaauu

SEQ ID NO: 175893 - RNA, 22 nt, Human
auuguuuugugaaacauaguga

SEQ ID NO: 175894 - RNA, 22 nt, Human
uauuucuagggcaugaaaauaa

SEQ ID NO: 175895 - RNA, 22 nt, Human
ccccauggaaaacccaccuagg

SEQ ID NO: 175896 - RNA, 22 nt, Human
cagaccuggaaaacaggcuugc

SEQ ID NO: 175897 - RNA, 22 nt, Human
auuucacucuuaauugcuuccu

SEQ ID NO: 175898 - RNA, 22 nt, Human
auagaaauagacaaugcaaaga

SEQ ID NO: 175899 - RNA, 22 nt, Human
ucgagcucagcagggaggugcg

SEQ ID NO: 175900 - RNA, 22 nt, Human
uguauuuuuucccugaaauaaa

SEQ ID NO: 175901 - RNA, 22 nt, Human
aaauucuuccaggaggaaauac

SEQ ID NO: 175902 - RNA, 22 nt, Human
uccuuucaaauuuauuugacau

SEQ ID NO: 175903 - RNA, 23 nt, Human
uggaaguugagagucugcuuugu

SEQ ID NO: 175904 - RNA, 22 nt, Human
uccaugaguuuuuuaguuucac

SEQ ID NO: 175905 - RNA, 22 nt, Human
uuauaucagaaggugagauuga

SEQ ID NO: 175906 - RNA, 22 nt, Human
cugcaucacagcaggaggcaca

SEQ ID NO: 175907 - RNA, 17 nt, Human
auucaugaacauguccu

SEQ ID NO: 175908 - RNA, 22 nt, Human
uuuuacaaugcaaauucuugcu

SEQ ID NO: 175909 - RNA, 22 nt, Human
aggcaguguguagcuggaagag

SEQ ID NO: 175910 - RNA, 22 nt, Human
aagugugugugcgcaugugcau

SEQ ID NO: 175911 - RNA, 22 nt, Human
auacaucuuaacgcgcucuugg

SEQ ID NO: 175912 - RNA, 22 nt, Human
aaauguuucauucuauuuuuag

SEQ ID NO: 175913 - RNA, 22 nt, Human
uggagucuugcuuugggagugc

SEQ ID NO: 175914 - RNA, 21 nt, Human
cuauaaaaaugguucuuugcg

SEQ ID NO: 175915 - RNA, 22 nt, Human
ugaaauuuuuuggagauaauuu

SEQ ID NO: 175916 - RNA, 22 nt, Human
guugagaaucucuagcuuagga

SEQ ID NO: 175917 - RNA, 22 nt, Human
aggaaauaggaccagacaaagc

SEQ ID NO: 175918 - RNA, 22 nt, Human
aaaauauucuauaucaaagaua

SEQ ID NO: 175919 - RNA, 22 nt, Human
uugugugugcccaccuguggcc

SEQ ID NO: 175920 - RNA, 22 nt, Human
agucugugguccucuguaucuc

SEQ ID NO: 175921 - RNA, 22 nt, Human
uggaaaauuuagaaagauuuau

SEQ ID NO: 175922 - RNA, 22 nt, Human
auguaugagagauucuuuuauu

SEQ ID NO: 175923 - RNA, 23 nt, Human
cuuauauaaucauuagaaaccau

SEQ ID NO: 175924 - RNA, 22 nt, Human
uugccaggagacaucuggagcc

SEQ ID NO: 175925 - RNA, 22 nt, Human
uagcacauaguaggcacaggcu

SEQ ID NO: 175926 - RNA, 22 nt, Human
auagagcuggggaagaagcugg

SEQ ID NO: 175927 - RNA, 22 nt, Human
uucaaacaguguagaauauaug

SEQ ID NO: 175928 - RNA, 22 nt, Human
aacccugaacuuaguucuagga

SEQ ID NO: 175929 - RNA, 22 nt, Human
uuaucaaaaaauaguacuuuga

SEQ ID NO: 175930 - RNA, 17 nt, Human
auuguuuuuaauuugca

SEQ ID NO: 175931 - RNA, 22 nt, Human
aggcaguggagcuggaauaggc

SEQ ID NO: 175932 - RNA, 20 nt, Human
agugauuuguuaguacauug

SEQ ID NO: 175933 - RNA, 22 nt, Human
uuucuaaaaccagaguuuauaa

SEQ ID NO: 175934 - RNA, 22 nt, Human
uuuuuaaaagaugauuuaauga

SEQ ID NO: 175935 - RNA, 22 nt, Human
ucaaauaugggccagaggaaau

SEQ ID NO: 175936 - RNA, 22 nt, Human
guuuccaggcuuugguaugguu

SEQ ID NO: 175937 - RNA, 22 nt, Human
cuucuucaucuuuuggaggaac

SEQ ID NO: 175938 - RNA, 22 nt, Human
ggcuguggcagcuggaaguggu

SEQ ID NO: 175939 - RNA, 22 nt, Human
ugaaaaauauuuuuagaaauaa

SEQ ID NO: 175940 - RNA, 22 nt, Human
ucugaggacagugcugugccug

SEQ ID NO: 175941 - RNA, 22 nt, Human
gaauauuuaucucagcugcaga

SEQ ID NO: 175942 - RNA, 22 nt, Human
aaaucauagccaugaacauuug

SEQ ID NO: 175943 - RNA, 22 nt, Human
augaaaacgugugugugugugu

SEQ ID NO: 175944 - RNA, 22 nt, Human
gugugugucuacuuucaucucu

SEQ ID NO: 175945 - RNA, 22 nt, Human
acuuuuccuggguagcuccugg

SEQ ID NO: 175946 - RNA, 22 nt, Human
ggagaggaaguuuaaagaauug

SEQ ID NO: 175947 - RNA, 22 nt, Human
aucuaaaacuacgaauacuacc

SEQ ID NO: 175948 - RNA, 22 nt, Human
aauaucuugaguuauaaauuca

SEQ ID NO: 175949 - RNA, 22 nt, Human
auucuuuucucuaaaugaugaa

SEQ ID NO: 175950 - RNA, 22 nt, Human
uucauagaagggaguuuuuccu

SEQ ID NO: 175951 - RNA, 22 nt, Human
aauguugaaccuuuuuggccug

SEQ ID NO: 175952 - RNA, 22 nt, Pseudomonas putida KT2440
uugcuccagcaauugccgcgug

SEQ ID NO: 175953 - RNA, 22 nt, Pseudomonas putida KT2440
ugcguacaggucgauggucguu

SEQ ID NO: 175954 - RNA, 22 nt, Pseudomonas putida KT2440
aggcuguccaccugcuggugca

SEQ ID NO: 175955 - RNA, 22 nt, Pseudomonas putida KT2440
uucagcgcuuucaugcguccgg

SEQ ID NO: 175956 - RNA, 22 nt, Pseudomonas putida KT2440
uucggcagcggaccuugcccug

SEQ ID NO: 175957 - RNA, 22 nt, Pseudomonas putida KT2440
gcagcaugugugcggcaauugg

SEQ ID NO: 175958 - RNA, 22 nt, Pseudomonas putida KT2440
caccgaagcgccguaagugugg

SEQ ID NO: 175959 - RNA, 22 nt, Pseudomonas putida KT2440
auucgcuggccgaauuccgcac

SEQ ID NO: 175960 - RNA, 22 nt, Pseudomonas putida KT2440
ucagggucacgaccaggucgug

SEQ ID NO: 175961 - RNA, 22 nt, Pseudomonas putida KT2440
ucgaugucgaucuaccagcugc

SEQ ID NO: 175962 - RNA, 22 nt, Pseudomonas putida KT2440
caucgcgacacaaggccgcucc

SEQ ID NO: 175963 - RNA, 22 nt, Pseudomonas putida KT2440
cgacaggucagugaacggcagu

SEQ ID NO: 175964 - RNA, 22 nt, Pseudomonas putida KT2440
acugcgcgauugcgcgguuggg

SEQ ID NO: 175965 - RNA, 22 nt, Pseudomonas putida KT2440
caggucggcacguuguucagga

SEQ ID NO: 175966 - RNA, 22 nt, Pseudomonas putida KT2440
accgccgaugucgauggcuggc

SEQ ID NO: 175967 - RNA, 22 nt, Pseudomonas putida KT2440
auuguugcugccguuguggcua

SEQ ID NO: 175968 - RNA, 23 nt, Pseudomonas putida KT2440
accuuggcgauugcccuggcguu

SEQ ID NO: 175969 - RNA, 22 nt, Pseudomonas putida KT2440
gcauuaucugugggagcggccu

SEQ ID NO: 175970 - RNA, 22 nt, Pseudomonas putida KT2440
acguccagcggcaugccguauu

SEQ ID NO: 175971 - RNA, 22 nt, Pseudomonas putida KT2440
cuccuacauugacugcgcgaug

SEQ ID NO: 175972 - RNA, 22 nt, Pseudomonas putida KT2440
ucaucgaucaauccgggcuggc

SEQ ID NO: 175973 - RNA, 22 nt, Pseudomonas putida KT2440
uuguaggagcggguucacccgc

SEQ ID NO: 175974 - RNA, 22 nt, Pseudomonas putida KT2440
cgggcaugcucgcccccacagg

SEQ ID NO: 175975 - RNA, 22 nt, Pseudomonas putida KT2440
cgcucccacaggcagggcgcaa

SEQ ID NO: 175976 - RNA, 22 nt, Pseudomonas putida KT2440
uccuggccaugcaccgcaucga

SEQ ID NO: 175977 - RNA, 22 nt, Pseudomonas putida KT2440
gugauaccugugggagcgggcg

SEQ ID NO: 175978 - RNA, 22 nt, Pseudomonas putida KT2440
caguucagaaccgccguagacc

SEQ ID NO: 175979 - RNA, 22 nt, Pseudomonas putida KT2440
ucggugaguuucuuagaaucgu

SEQ ID NO: 175980 - RNA, 22 nt, Pseudomonas putida KT2440
cgugccuucggcaggaaauccu

SEQ ID NO: 175981 - RNA, 22 nt, Pseudomonas putida KT2440
aagcccgcuccuacggaaucug

SEQ ID NO: 175982 - RNA, 22 nt, Pseudomonas putida KT2440
cgccuggucgucggccuuggcc

SEQ ID NO: 175983 - RNA, 22 nt, Pseudomonas putida KT2440
ugcuggcgguaaugcucgcggg

SEQ ID NO: 175984 - RNA, 22 nt, Pseudomonas putida KT2440
acguggguuucgccaagcuuga

SEQ ID NO: 175985 - RNA, 22 nt, Pseudomonas putida KT2440
uagcgccacucuggcugcuuuu

SEQ ID NO: 175986 - RNA, 22 nt, Pseudomonas putida KT2440
uaccgugaggcgcgccuggagg

SEQ ID NO: 175987 - RNA, 22 nt, Pseudomonas putida KT2440
agccugccaugacacggcuuca

SEQ ID NO: 175988 - RNA, 22 nt, Pseudomonas putida KT2440
cuugccuggcgucgagaauggc

SEQ ID NO: 175989 - RNA, 22 nt, Pseudomonas putida KT2440
accgacucgaucaucagcgaac

SEQ ID NO: 175990 - RNA, 22 nt, Pseudomonas putida KT2440
cgccugcaagaguugcugcugg

SEQ ID NO: 175991 - RNA, 22 nt, Pseudomonas putida KT2440
auaccgguaauuucacgcucca

SEQ ID NO: 175992 - RNA, 22 nt, Pseudomonas putida KT2440
gcucccacaggaucaccacaug

SEQ ID NO: 175993 - RNA, 22 nt, Pseudomonas putida KT2440
gcgcgugaugaugcaguggucg

SEQ ID NO: 175994 - RNA, 22 nt, Pseudomonas putida KT2440
cguaggcgcggcuuuagccggg

SEQ ID NO: 175995 - RNA, 22 nt, Pseudomonas putida KT2440
ccaugcucauccugcuguuccu

SEQ ID NO: 175996 - RNA, 23 nt, Pseudomonas putida KT2440
gggcagucgaguagcguauggau

SEQ ID NO: 175997 - RNA, 22 nt, Pseudomonas putida KT2440
ugcagggccguggagccuucac

SEQ ID NO: 175998 - RNA, 22 nt, Pseudomonas putida KT2440
gacgcaaggccguucccacaaa

SEQ ID NO: 175999 - RNA, 22 nt, Pseudomonas putida KT2440
gucgauggcacuggcgguguug

SEQ ID NO: 176000 - RNA, 22 nt, Pseudomonas putida KT2440
gcgagcaugcuguugacguucu

SEQ ID NO: 176001 - RNA, 22 nt, Pseudomonas putida KT2440
ucgaccugcgccauguccgggu

SEQ ID NO: 176002 - RNA, 22 nt, Pseudomonas putida KT2440
aggcgaucgauacggccgucca

SEQ ID NO: 176003 - RNA, 22 nt, Pseudomonas putida KT2440
ugcauucgcgggcacgcccgcu

SEQ ID NO: 176004 - RNA, 22 nt, Pseudomonas putida KT2440
uucgcccgcuacucgaugaacu

SEQ ID NO: 176005 - RNA, 22 nt, Pseudomonas putida KT2440
cuggaacugggcgucaagcacg

SEQ ID NO: 176006 - RNA, 22 nt, Pseudomonas putida KT2440
gcucgcugcccgacggcuugau

SEQ ID NO: 176007 - RNA, 21 nt, Pseudomonas putida KT2440
ggccagacggagcgugcgcug

SEQ ID NO: 176008 - RNA, 22 nt, Pseudomonas putida KT2440
gugcagugacuuuaccgucgaa

SEQ ID NO: 176009 - RNA, 22 nt, Pseudomonas putida KT2440
ugaccagcagcuccuugccgac

SEQ ID NO: 176010 - RNA, 22 nt, Pseudomonas putida KT2440
uggccugacgccauauuaucug

SEQ ID NO: 176011 - RNA, 22 nt, Pseudomonas putida KT2440
cugacaggccuggugguguucg

SEQ ID NO: 176012 - RNA, 22 nt, Pseudomonas putida KT2440
ugcggcauugcuuaggcuuacg

SEQ ID NO: 176013 - RNA, 20 nt, Pseudomonas putida KT2440
cuaucgacaggauuuuuauu

SEQ ID NO: 176014 - RNA, 22 nt, Pseudomonas putida KT2440
accuccgcuacaugcacccagg

SEQ ID NO: 176015 - RNA, 22 nt, Pseudomonas putida KT2440
gugcgccaggcccgggcaagcg

SEQ ID NO: 176016 - RNA, 22 nt, Pseudomonas putida KT2440
agcaaggcgcuuuccggccggc

SEQ ID NO: 176017 - RNA, 22 nt, Pseudomonas putida KT2440
uguccgccugugggagcgggca

SEQ ID NO: 176018 - RNA, 22 nt, Pseudomonas putida KT2440
ugucggccccgagcugccugug

SEQ ID NO: 176019 - RNA, 22 nt, Pseudomonas putida KT2440
ugcagccgcgcaguugcuuggc

SEQ ID NO: 176020 - RNA, 22 nt, Pseudomonas putida KT2440
ucauugaccacauaggcgaagg

SEQ ID NO: 176021 - RNA, 22 nt, Pseudomonas putida KT2440
aggugcaagaggcgcgugcggc

SEQ ID NO: 176022 - RNA, 21 nt, Pseudomonas putida KT2440
gcacuucacugacggcguaac

SEQ ID NO: 176023 - RNA, 22 nt, Pseudomonas putida KT2440
aggucaugcccagcggcugcug

SEQ ID NO: 176024 - RNA, 22 nt, Pseudomonas putida KT2440
aggugcacgaagagcagcacga

SEQ ID NO: 176025 - RNA, 22 nt, Pseudomonas putida KT2440
ggucggauccagcggcgauuca

SEQ ID NO: 176026 - RNA, 22 nt, Pseudomonas putida KT2440
cgaguuauuggccguauuugca

SEQ ID NO: 176027 - RNA, 22 nt, Pseudomonas putida KT2440
aggcgacgguugaguucgagcc

SEQ ID NO: 176028 - RNA, 22 nt, Pseudomonas putida KT2440
uuucgcggguaaacccgcuccu

SEQ ID NO: 176029 - RNA, 22 nt, Pseudomonas putida KT2440
guguaggagcggguuuacccgc

SEQ ID NO: 176030 - RNA, 22 nt, Pseudomonas putida KT2440
accuggcccugcuggcggcggu

SEQ ID NO: 176031 - RNA, 22 nt, Pseudomonas putida KT2440
guggccuacuggugcguucgga

SEQ ID NO: 176032 - RNA, 22 nt, Pseudomonas putida KT2440
acugcugagcuugaacagcuug

SEQ ID NO: 176033 - RNA, 22 nt, Pseudomonas putida KT2440
ugugcgcacggucauugccgac

SEQ ID NO: 176034 - RNA, 22 nt, Pseudomonas putida KT2440
uguagcgauaguccgucuugcu

SEQ ID NO: 176035 - RNA, 22 nt, Pseudomonas putida KT2440
uaggcuucgcucuccagcaggu

SEQ ID NO: 176036 - RNA, 22 nt, Pseudomonas putida KT2440
cggcaagguagugcugccggug

SEQ ID NO: 176037 - RNA, 22 nt, Pseudomonas putida KT2440
agcagggcgaugugaucaccgu

SEQ ID NO: 176038 - RNA, 22 nt, Pseudomonas putida KT2440
uuggccuugcuguugccguuga

SEQ ID NO: 176039 - RNA, 22 nt, Pseudomonas putida KT2440
ugcccgucaguuugggcgggcu

SEQ ID NO: 176040 - RNA, 22 nt, Pseudomonas putida KT2440
gcugagugcgucguuuuaacug

SEQ ID NO: 176041 - RNA, 22 nt, Pseudomonas putida KT2440
ucuggcaguuccuggcugcgcc

SEQ ID NO: 176042 - RNA, 22 nt, Pseudomonas putida KT2440
uucauccgcugcuaccagcgca

SEQ ID NO: 176043 - RNA, 22 nt, Pseudomonas putida KT2440
uugucagcguccggcgcaccug

SEQ ID NO: 176044 - RNA, 22 nt, Pseudomonas putida KT2440
cguugccugcuucgugggcaag

SEQ ID NO: 176045 - RNA, 22 nt, Pseudomonas putida KT2440
uacgagccgcaggcaagcgcag

SEQ ID NO: 176046 - RNA, 22 nt, Pseudomonas putida KT2440
gugcgccaggcaaagcgcuucg

SEQ ID NO: 176047 - RNA, 22 nt, Pseudomonas putida KT2440
caggcgaaggaucucuagcggc

SEQ ID NO: 176048 - RNA, 22 nt, Pseudomonas putida KT2440
cuucaguacauugcuggugcuc

SEQ ID NO: 176049 - RNA, 22 nt, Pseudomonas putida KT2440
ugcccgcuccaacaacgacugc

SEQ ID NO: 176050 - RNA, 22 nt, Pseudomonas putida KT2440
cagauguucggcaacucgagca

SEQ ID NO: 176051 - RNA, 22 nt, Pseudomonas putida KT2440
uaugcgggcgcagcuucagccg

SEQ ID NO: 176052 - RNA, 22 nt, Pseudomonas putida KT2440
agucggcaugguguuccagcac

SEQ ID NO: 176053 - RNA, 19 nt, Pseudomonas putida KT2440
gcauucgucacaggucacc

SEQ ID NO: 176054 - RNA, 22 nt, Pseudomonas putida KT2440
gcaaugcaaguaccguugaagc

SEQ ID NO: 176055 - RNA, 22 nt, Pseudomonas putida KT2440
aacccgcuccuacaggggacgc

SEQ ID NO: 176056 - RNA, 21 nt, Pseudomonas putida KT2440
augccgaucaagccgccaccc

SEQ ID NO: 176057 - RNA, 22 nt, Pseudomonas putida KT2440
ugcugauccgcuggcacaagcc

SEQ ID NO: 176058 - RNA, 22 nt, Pseudomonas putida KT2440
uagcgcagaugccggucguagc

SEQ ID NO: 176059 - RNA, 18 nt, Pseudomonas putida KT2440
ugguggccucggacuacc

SEQ ID NO: 176060 - RNA, 22 nt, Pseudomonas putida KT2440
ccggagcaggucaugggccgca

SEQ ID NO: 176061 - RNA, 22 nt, Pseudomonas putida KT2440
gccguccuugucgaagugguac

SEQ ID NO: 176062 - RNA, 22 nt, Pseudomonas putida KT2440
cggcagcaucgaacauggcgaa

SEQ ID NO: 176063 - RNA, 22 nt, Pseudomonas putida KT2440
accagcgcgcucauccaggugu

SEQ ID NO: 176064 - RNA, 22 nt, Pseudomonas putida KT2440
cgccacagcucugaagguucga

SEQ ID NO: 176065 - RNA, 22 nt, Pseudomonas putida KT2440
gcuuggccuucuuuucggcagu

SEQ ID NO: 176066 - RNA, 22 nt, Pseudomonas putida KT2440
gaucgacggauccccuguagcc

SEQ ID NO: 176067 - RNA, 22 nt, Pseudomonas putida KT2440
gcugaaccugugggagcgggca

SEQ ID NO: 176068 - RNA, 22 nt, Pseudomonas putida KT2440
cugagccggcgcacccuggacg

SEQ ID NO: 176069 - RNA, 22 nt, Pseudomonas putida KT2440
auucgggcgcaacuucggcugg

SEQ ID NO: 176070 - RNA, 22 nt, Pseudomonas putida KT2440
cgagcaugugaucgacagccgu

SEQ ID NO: 176071 - RNA, 22 nt, Pseudomonas putida KT2440
agggcugcggugcugguggcau

SEQ ID NO: 176072 - RNA, 22 nt, Pseudomonas putida KT2440
ugauuaccugugggagcgggca

SEQ ID NO: 176073 - RNA, 22 nt, Pseudomonas putida KT2440
gugcaauaccugugggagcggg

SEQ ID NO: 176074 - RNA, 22 nt, Pseudomonas putida KT2440
gcaugucgauuaccugcaugau

SEQ ID NO: 176075 - RNA, 21 nt, Pseudomonas putida KT2440
caaggguugggccugcagcag

SEQ ID NO: 176076 - RNA, 20 nt, Pseudomonas putida KT2440
uugccgagcaguuguguauc

SEQ ID NO: 176077 - RNA, 20 nt, Pseudomonas putida KT2440
aaggcccaacucgccgagga

SEQ ID NO: 176078 - RNA, 22 nt, Pseudomonas putida KT2440
gggcagugaggcugcggguaaa

SEQ ID NO: 176079 - RNA, 22 nt, Pseudomonas putida KT2440
cuggucagaaccuggaaaugag

SEQ ID NO: 176080 - RNA, 22 nt, Pseudomonas putida KT2440
gugcgcguggugcacggggaaa

SEQ ID NO: 176081 - RNA, 22 nt, Pseudomonas putida KT2440
gcugucgaaaagaugggcggca

SEQ ID NO: 176082 - RNA, 22 nt, Pseudomonas putida KT2440
cgcugcagacugagauuugucu

SEQ ID NO: 176083 - RNA, 22 nt, Pseudomonas putida KT2440
acugcugccaggcauucuggag

SEQ ID NO: 176084 - RNA, 22 nt, Pseudomonas putida KT2440
cgaagggccgcaaggcggcccc

SEQ ID NO: 176085 - RNA, 22 nt, Pseudomonas putida KT2440
ggcgcugucgaguuugcguggc

SEQ ID NO: 176086 - RNA, 22 nt, Pseudomonas putida KT2440
aacucgcuugccgaucaggccu

SEQ ID NO: 176087 - RNA, 19 nt, Pseudomonas putida KT2440
guguccgacgacggcacgu

SEQ ID NO: 176088 - RNA, 22 nt, Pseudomonas putida KT2440
agcccgcuccuacaacgacugc

SEQ ID NO: 176089 - RNA, 22 nt, Pseudomonas putida KT2440
augacccguuccugcacaggaa

SEQ ID NO: 176090 - RNA, 22 nt, Pseudomonas putida KT2440
accucgagaagguuaaggcagu

SEQ ID NO: 176091 - RNA, 22 nt, Pseudomonas putida KT2440
agccuucgccacagcgcacgcc

SEQ ID NO: 176092 - RNA, 22 nt, Pseudomonas putida KT2440
caaagcucagcgugcugccguu

SEQ ID NO: 176093 - RNA, 22 nt, Pseudomonas putida KT2440
gcccaugcccagguuggugcag

SEQ ID NO: 176094 - RNA, 22 nt, Pseudomonas putida KT2440
ucgcggguaacccgcuccuaca

SEQ ID NO: 176095 - RNA, 22 nt, Pseudomonas putida KT2440
aucgugcccuuggucaaccugc

SEQ ID NO: 176096 - RNA, 22 nt, Pseudomonas putida KT2440
aacgacgcgcuggaucgaaagc

SEQ ID NO: 176097 - RNA, 22 nt, Pseudomonas putida KT2440
aggguugcagcguccuggagcc

SEQ ID NO: 176098 - RNA, 22 nt, Pseudomonas putida KT2440
uugcuucacauagcgggcacac

SEQ ID NO: 176099 - RNA, 22 nt, Pseudomonas putida KT2440
ugccuucgcccugccgauccug

SEQ ID NO: 176100 - RNA, 22 nt, Pseudomonas putida KT2440
ccagugcagugggccugggcgc

SEQ ID NO: 176101 - RNA, 22 nt, Pseudomonas putida KT2440
agcucuuggcugagcgcugaau

SEQ ID NO: 176102 - RNA, 22 nt, Pseudomonas putida KT2440
ugugacuuaccugugggagcgg

SEQ ID NO: 176103 - RNA, 22 nt, Pseudomonas putida KT2440
ucaugccguggugggcgaacag

SEQ ID NO: 176104 - RNA, 22 nt, Pseudomonas putida KT2440
uugcuguacaggcccucggccu

SEQ ID NO: 176105 - RNA, 22 nt, Pseudomonas putida KT2440
aucacccuuuggggugagccgg

SEQ ID NO: 176106 - RNA, 22 nt, Pseudomonas putida KT2440
ucacgccguugacgcugaguuu

SEQ ID NO: 176107 - RNA, 22 nt, Pseudomonas putida KT2440
cgaccgaggaugaagacgauca

SEQ ID NO: 176108 - RNA, 22 nt, Pseudomonas putida KT2440
gcggugucuucuucgcggguaa

SEQ ID NO: 176109 - RNA, 22 nt, Pseudomonas putida KT2440
gagguugcgcgccaacuugccg

SEQ ID NO: 176110 - RNA, 22 nt, Pseudomonas putida KT2440
ugcccgcuccugccggaauacc

SEQ ID NO: 176111 - RNA, 22 nt, Pseudomonas putida KT2440
ggcaccuucgccuaugugguca

SEQ ID NO: 176112 - RNA, 22 nt, Pseudomonas putida KT2440
auugccuggugcuugaugugcc

SEQ ID NO: 176113 - RNA, 22 nt, Pseudomonas putida KT2440
agacccguuccuacgcaggcac

SEQ ID NO: 176114 - RNA, 22 nt, Pseudomonas putida KT2440
cggcaacggugcugcccauggc

SEQ ID NO: 176115 - RNA, 22 nt, Pseudomonas putida KT2440
cgcaacgugccucgacccgcuu

SEQ ID NO: 176116 - RNA, 22 nt, Pseudomonas putida KT2440
agccugucgggguaucucaaga

SEQ ID NO: 176117 - RNA, 22 nt, Pseudomonas putida KT2440
caguaccugugggagcgggcgc

SEQ ID NO: 176118 - RNA, 22 nt, Pseudomonas putida KT2440
gggcaugaagcgguggcgugga

SEQ ID NO: 176119 - RNA, 22 nt, Pseudomonas putida KT2440
uggcgcgucaugaguaccccca

SEQ ID NO: 176120 - RNA, 22 nt, Pseudomonas putida KT2440
gugaaaugcagggcaaaaagaa

SEQ ID NO: 176121 - RNA, 22 nt, Pseudomonas putida KT2440
aagcagaucgcgaauuucaacu

SEQ ID NO: 176122 - RNA, 22 nt, Pseudomonas putida KT2440
cugggcguagcccuguccaaaa

SEQ ID NO: 176123 - RNA, 22 nt, Pseudomonas putida KT2440
gacacguuguucgcgcgcuguu

SEQ ID NO: 176124 - RNA, 22 nt, Pseudomonas putida KT2440
ggucuucaucggguggcuggcc

SEQ ID NO: 176125 - RNA, 22 nt, Pseudomonas putida KT2440
aagaagcugcugcgcgaaaucg

SEQ ID NO: 176126 - RNA, 22 nt, Pseudomonas putida KT2440
cgcggcaaggugggguugacca

SEQ ID NO: 176127 - RNA, 22 nt, Pseudomonas putida KT2440
ucgaaggcauuguugcgggcac

SEQ ID NO: 176128 - RNA, 22 nt, Pseudomonas putida KT2440
gcgcagucguuguaggagcggg

SEQ ID NO: 176129 - RNA, 22 nt, Pseudomonas putida KT2440
gcuauugagaaacaagaucgaa

SEQ ID NO: 176130 - RNA, 22 nt, Pseudomonas putida KT2440
ggcacaaggucgcuuccacaag

SEQ ID NO: 176131 - RNA, 22 nt, Pseudomonas putida KT2440
uccagguccucguugcgcggcg

SEQ ID NO: 176132 - RNA, 22 nt, Pseudomonas putida KT2440
aggcugcagcguuguaccagcc

SEQ ID NO: 176133 - RNA, 22 nt, Pseudomonas putida KT2440
ugccgucguacaggccagugug

SEQ ID NO: 176134 - RNA, 22 nt, Pseudomonas putida KT2440
guagaggcguaccaguggcaac

SEQ ID NO: 176135 - RNA, 22 nt, Pseudomonas putida KT2440
cccugcaggcacggcuuuagcc

SEQ ID NO: 176136 - RNA, 22 nt, Pseudomonas putida KT2440
ccgcuuugacggccugcugcga

SEQ ID NO: 176137 - RNA, 22 nt, Pseudomonas putida KT2440
ugcugggcgccaaccacuggca

SEQ ID NO: 176138 - RNA, 23 nt, Pseudomonas putida KT2440
uggugccaguuucagcaagagaa

SEQ ID NO: 176139 - RNA, 22 nt, Pseudomonas putida KT2440
aauggcaaugucgagcuggcgg

SEQ ID NO: 176140 - RNA, 22 nt, Pseudomonas putida KT2440
agucccugugggagcggccuug

SEQ ID NO: 176141 - RNA, 22 nt, Pseudomonas putida KT2440
ugcaguucagcgaccgacagga

SEQ ID NO: 176142 - RNA, 22 nt, Pseudomonas putida KT2440
ugcacgcacuggagaaguacac

SEQ ID NO: 176143 - RNA, 22 nt, Pseudomonas putida KT2440
guggcgaaaucaacuacgaagu

SEQ ID NO: 176144 - RNA, 22 nt, Pseudomonas putida KT2440
uguaccucaacucgcugaacca

SEQ ID NO: 176145 - RNA, 22 nt, Pseudomonas putida KT2440
gugcaucacgcguacaucaggc

SEQ ID NO: 176146 - RNA, 18 nt, Pseudomonas putida KT2440
cgucugcugcuggccgau

SEQ ID NO: 176147 - RNA, 22 nt, Pseudomonas putida KT2440
cgugcgcuggacgaagugcgcc

SEQ ID NO: 176148 - RNA, 22 nt, Pseudomonas putida KT2440
ccagcccucgaccuuccaugcc

SEQ ID NO: 176149 - RNA, 22 nt, Pseudomonas putida KT2440
gagcgcguucaauugcagggug

SEQ ID NO: 176150 - RNA, 22 nt, Pseudomonas putida KT2440
gcacagcugcugcagcggccgg

SEQ ID NO: 176151 - RNA, 22 nt, Pseudomonas putida KT2440
ugaagugcuggaacaccaucga

SEQ ID NO: 176152 - RNA, 22 nt, Pseudomonas putida KT2440
gguuuacccgugaagaggcugg

SEQ ID NO: 176153 - RNA, 22 nt, Pseudomonas putida KT2440
gggcugaucgccucgccgccgg

SEQ ID NO: 176154 - RNA, 22 nt, Pseudomonas putida KT2440
ucgaucagcaaggagccuguga

SEQ ID NO: 176155 - RNA, 22 nt, Pseudomonas putida KT2440
cgcccugacgggcugcgcaggu

SEQ ID NO: 176156 - RNA, 22 nt, Pseudomonas putida KT2440
guucgagccgauguaccggcag

SEQ ID NO: 176157 - RNA, 23 nt, Pseudomonas putida KT2440
acucaaggcgcucagugauggug

SEQ ID NO: 176158 - RNA, 22 nt, Pseudomonas putida KT2440
guucauccgaggcguugcggca

SEQ ID NO: 176159 - RNA, 22 nt, Pseudomonas putida KT2440
cgaggcauugauggaaugcauu

SEQ ID NO: 176160 - RNA, 22 nt, Pseudomonas putida KT2440
cgcucccacagguacagcacag

SEQ ID NO: 176161 - RNA, 20 nt, Pseudomonas putida KT2440
ggcuugauauuuucggcagc

SEQ ID NO: 176162 - RNA, 22 nt, Pseudomonas putida KT2440
gaccgugcaccugggugaaggc

SEQ ID NO: 176163 - RNA, 22 nt, Pseudomonas putida KT2440
accaggcgccgguggccuuccc

SEQ ID NO: 176164 - RNA, 22 nt, Pseudomonas putida KT2440
gccagugggcggugcaggcgca

SEQ ID NO: 176165 - RNA, 22 nt, Pseudomonas putida KT2440
gcgacacaaggccgcucccaca

SEQ ID NO: 176166 - RNA, 22 nt, Pseudomonas putida KT2440
augccgcuccuaccggaccagc

SEQ ID NO: 176167 - RNA, 22 nt, Pseudomonas putida KT2440
agccgccaugaugucgaccuua

SEQ ID NO: 176168 - RNA, 22 nt, Pseudomonas putida KT2440
uguccgcaagcugaaggugggu

SEQ ID NO: 176169 - RNA, 22 nt, Pseudomonas putida KT2440
uucgccggcccuggcgcagccu

SEQ ID NO: 176170 - RNA, 22 nt, Pseudomonas putida KT2440
gccaacgccgccgugcuggcca

SEQ ID NO: 176171 - RNA, 22 nt, Pseudomonas putida KT2440
aucgggcgggguuugaucgaug

SEQ ID NO: 176172 - RNA, 23 nt, Pseudomonas putida KT2440
gcgauaguucaggcgacgcagau

SEQ ID NO: 176173 - RNA, 22 nt, Pseudomonas putida KT2440
gcugcauuggucgugacgcucg

SEQ ID NO: 176174 - RNA, 23 nt, Pseudomonas putida KT2440
ugugccggaagcgugcagccagc

SEQ ID NO: 176175 - RNA, 22 nt, Pseudomonas putida KT2440
ggcgggaugaaggccgaggacu

SEQ ID NO: 176176 - RNA, 20 nt, Pseudomonas putida KT2440
gcacagguugagugggugca

SEQ ID NO: 176177 - RNA, 22 nt, Pseudomonas putida KT2440
gccuugcacgcuucaagggcgc

SEQ ID NO: 176178 - RNA, 22 nt, Pseudomonas putida KT2440
uuccaagauugucgacaauccu

SEQ ID NO: 176179 - RNA, 22 nt, Pseudomonas putida KT2440
gaaugcaccagcaccaguucga

SEQ ID NO: 176180 - RNA, 22 nt, Pseudomonas putida KT2440
guggcaugcgccuguuccagac

SEQ ID NO: 176181 - RNA, 21 nt, Pseudomonas putida KT2440
aagaggccagugcaggugaug

SEQ ID NO: 176182 - RNA, 22 nt, Pseudomonas putida KT2440
aggcugaagagguucggcguca

SEQ ID NO: 176183 - RNA, 22 nt, Pseudomonas putida KT2440
uaggugaaggucagcgugcaau

SEQ ID NO: 176184 - RNA, 22 nt, Pseudomonas putida KT2440
ucggccucuucggccaugucca

SEQ ID NO: 176185 - RNA, 22 nt, Pseudomonas putida KT2440
cggcgcaaccgucggucguagg

SEQ ID NO: 176186 - RNA, 22 nt, Pseudomonas putida KT2440
guugcucuucaggcggcgcugg

SEQ ID NO: 176187 - RNA, 23 nt, Pseudomonas putida KT2440
ggucgacgcuguucuugccugcg

SEQ ID NO: 176188 - RNA, 22 nt, Pseudomonas putida KT2440
aucgucuucgccgaugaagcag

SEQ ID NO: 176189 - RNA, 22 nt, Pseudomonas putida KT2440
aaccugaaucaaguacagggag

SEQ ID NO: 176190 - RNA, 22 nt, Pseudomonas putida KT2440
gcucauccacauagcgcgcccc

SEQ ID NO: 176191 - RNA, 22 nt, Pseudomonas putida KT2440
ugcuugaagugugccgcgccgc

SEQ ID NO: 176192 - RNA, 23 nt, Pseudomonas putida KT2440
caacggugauguccuggucagcg

SEQ ID NO: 176193 - RNA, 22 nt, Pseudomonas putida KT2440
cugccgaggaagagggccuugc

SEQ ID NO: 176194 - RNA, 22 nt, Pseudomonas putida KT2440
ggucaguauaugcucuaugcga

SEQ ID NO: 176195 - RNA, 22 nt, Pseudomonas putida KT2440
aucgaucagcgaggccagcacc

SEQ ID NO: 176196 - RNA, 22 nt, Pseudomonas putida KT2440
ucgaccuuggaguauggcaggu

SEQ ID NO: 176197 - RNA, 22 nt, Pseudomonas putida KT2440
uagaggccugcaauagcuugag

SEQ ID NO: 176198 - RNA, 22 nt, Pseudomonas putida KT2440
ugccggugcuggccccggcacu

SEQ ID NO: 176199 - RNA, 22 nt, Pseudomonas putida KT2440
gcugaacaggguuaugcgcgca

SEQ ID NO: 176200 - RNA, 22 nt, Pseudomonas putida KT2440
gccggcaacaacgugcucggua

SEQ ID NO: 176201 - RNA, 22 nt, Pseudomonas putida KT2440
guaggagcgggcuugcccgcga

SEQ ID NO: 176202 - RNA, 22 nt, Pseudomonas putida KT2440
cuugucggacgaugcagccucu

SEQ ID NO: 176203 - RNA, 22 nt, Pseudomonas putida KT2440
ccugggucaagccccagcgcgc

SEQ ID NO: 176204 - RNA, 22 nt, Pseudomonas putida KT2440
gauguaccuguaggagcggguu

SEQ ID NO: 176205 - RNA, 22 nt, Pseudomonas putida KT2440
gcugccaaagaaacugugggac

SEQ ID NO: 176206 - RNA, 22 nt, Pseudomonas putida KT2440
uaucaucgacugguucagcgcc

SEQ ID NO: 176207 - RNA, 22 nt, Pseudomonas putida KT2440
cgacgcaaggccgcucccacag

SEQ ID NO: 176208 - RNA, 22 nt, Pseudomonas putida KT2440
uuugccggggucggccuugccg

SEQ ID NO: 176209 - RNA, 22 nt, Pseudomonas putida KT2440
gcgcacacguucggccacgcug

SEQ ID NO: 176210 - RNA, 22 nt, Pseudomonas putida KT2440
ucaucgcuggccugcuccaggg

SEQ ID NO: 176211 - RNA, 22 nt, Pseudomonas putida KT2440
ucgaccugcacggcacccuggc

SEQ ID NO: 176212 - RNA, 22 nt, Pseudomonas putida KT2440
ccaucgacaaggucgaguucuu

SEQ ID NO: 176213 - RNA, 22 nt, Pseudomonas putida KT2440
acugggccugacuaucugcgcc

SEQ ID NO: 176214 - RNA, 22 nt, Pseudomonas putida KT2440
ccuggcuuuucaugccggagaa

SEQ ID NO: 176215 - RNA, 22 nt, Pseudomonas putida KT2440
ucgaggaugcuggugucgucgg

SEQ ID NO: 176216 - RNA, 22 nt, Pseudomonas putida KT2440
cgugauggcauguuuuaucugc

SEQ ID NO: 176217 - RNA, 22 nt, Pseudomonas putida KT2440
aucugggugaugaauuggccgg

SEQ ID NO: 176218 - RNA, 22 nt, Pseudomonas putida KT2440
aagcgcauggcgaggcauccag

SEQ ID NO: 176219 - RNA, 22 nt, Pseudomonas putida KT2440
ugccugaacaaaaaauacaagg

SEQ ID NO: 176220 - RNA, 22 nt, Pseudomonas putida KT2440
uuacccaggagagaagccauga

SEQ ID NO: 176221 - RNA, 22 nt, Pseudomonas putida KT2440
ucggucgaucggguuggcgccg

SEQ ID NO: 176222 - RNA, 22 nt, Pseudomonas putida KT2440
cgagcaccagcaguugcuugcg

SEQ ID NO: 176223 - RNA, 22 nt, Pseudomonas putida KT2440
aggccugccagugcacaugccg

SEQ ID NO: 176224 - RNA, 21 nt, Pseudomonas putida KT2440
ucgccgaccguguugucgcgc

SEQ ID NO: 176225 - RNA, 22 nt, Pseudomonas putida KT2440
uugcuggaucaaguauucacuu

SEQ ID NO: 176226 - RNA, 22 nt, Pseudomonas putida KT2440
cgccaguuucaucagcgcacgg

SEQ ID NO: 176227 - RNA, 22 nt, Pseudomonas putida KT2440
aagaucagcucugcgccauggc

SEQ ID NO: 176228 - RNA, 18 nt, Pseudomonas putida KT2440
ggcaaugugguugguacu

SEQ ID NO: 176229 - RNA, 22 nt, Pseudomonas putida KT2440
cagugcccagcaauacgccacc

SEQ ID NO: 176230 - RNA, 22 nt, Pseudomonas putida KT2440
agaaugaucagggugcuggagg

SEQ ID NO: 176231 - RNA, 22 nt, Pseudomonas putida KT2440
auauggcgcuccuucggggugg

SEQ ID NO: 176232 - RNA, 22 nt, Pseudomonas putida KT2440
cgcgcguucccacggguuugcc

SEQ ID NO: 176233 - RNA, 22 nt, Pseudomonas putida KT2440
cgaaggugggcaggcuggagcc

SEQ ID NO: 176234 - RNA, 22 nt, Pseudomonas putida KT2440
ucaucccguuguaguccuccag

SEQ ID NO: 176235 - RNA, 22 nt, Pseudomonas putida KT2440
caucaacugaucuggaccuacc

SEQ ID NO: 176236 - RNA, 22 nt, Pseudomonas putida KT2440
cgaccugcagguucucgaaguu

SEQ ID NO: 176237 - RNA, 17 nt, Pseudomonas putida KT2440
cgccggaucggugccuu

SEQ ID NO: 176238 - RNA, 22 nt, Pseudomonas putida KT2440
gcaucgccauccaggccuuuca

SEQ ID NO: 176239 - RNA, 22 nt, Pseudomonas putida KT2440
ucacggcgaugaucggcaguuu

SEQ ID NO: 176240 - RNA, 19 nt, Pseudomonas putida KT2440
ccggccaaucugagcuucg

SEQ ID NO: 176241 - RNA, 18 nt, Pseudomonas putida KT2440
gccaggcucccagccucg

SEQ ID NO: 176242 - RNA, 22 nt, Pseudomonas putida KT2440
cagggucgaaacagccguuaag

SEQ ID NO: 176243 - RNA, 22 nt, Pseudomonas putida KT2440
ccuguaggagcgggucuacccg

SEQ ID NO: 176244 - RNA, 22 nt, Pseudomonas putida KT2440
acccgcuccuacacggucacca

SEQ ID NO: 176245 - RNA, 22 nt, Pseudomonas putida KT2440
ucucaaggcuuaauacagcccc

SEQ ID NO: 176246 - RNA, 22 nt, Pseudomonas putida KT2440
ccaggcauggaucgcccacugu

SEQ ID NO: 176247 - RNA, 22 nt, Pseudomonas putida KT2440
ggcuucuuugcaagccuugugg

SEQ ID NO: 176248 - RNA, 22 nt, Pseudomonas putida KT2440
ucgucgccuuugacagcggcuu

SEQ ID NO: 176249 - RNA, 22 nt, Pseudomonas putida KT2440
ucguugcgcgucgagaacaggu

SEQ ID NO: 176250 - RNA, 22 nt, Pseudomonas putida KT2440
gucgcacaggaccaggucgaac

SEQ ID NO: 176251 - RNA, 22 nt, Pseudomonas putida KT2440
uggcagccauguugaaaguggc

SEQ ID NO: 176252 - RNA, 22 nt, Pseudomonas putida KT2440
agugcucagucagucgaucagc

SEQ ID NO: 176253 - RNA, 22 nt, Pseudomonas putida KT2440
uggcgcaaccagucgaucaaug

SEQ ID NO: 176254 - RNA, 22 nt, Pseudomonas putida KT2440
cccgcgaacuguucggggugcu

SEQ ID NO: 176255 - RNA, 22 nt, Pseudomonas putida KT2440
agcucguuaaucaugugcggcg

SEQ ID NO: 176256 - RNA, 22 nt, Pseudomonas putida KT2440
gcgguaccugguaggagcgggu

SEQ ID NO: 176257 - RNA, 22 nt, Pseudomonas putida KT2440
gcuacgaccggcaucugcgcua

SEQ ID NO: 176258 - RNA, 22 nt, Pseudomonas putida KT2440
ugccaccugugacgguuucuuc

SEQ ID NO: 176259 - RNA, 22 nt, Pseudomonas putida KT2440
agguuucgucgacgaucugguu

SEQ ID NO: 176260 - RNA, 22 nt, Pseudomonas putida KT2440
cagguaaugguggugguacuga

SEQ ID NO: 176261 - RNA, 21 nt, Pseudomonas putida KT2440
uucugggccgugcuguuuccc

SEQ ID NO: 176262 - RNA, 22 nt, Pseudomonas putida KT2440
caauuucguuuuccagaggcgc

SEQ ID NO: 176263 - RNA, 22 nt, Pseudomonas putida KT2440
gcggcgaucuggauguugcagg

SEQ ID NO: 176264 - RNA, 22 nt, Pseudomonas putida KT2440
aaggacaucggcccgguggugg

SEQ ID NO: 176265 - RNA, 22 nt, Pseudomonas putida KT2440
cgcauucgcggguaaacccggg

SEQ ID NO: 176266 - RNA, 22 nt, Pseudomonas putida KT2440
cagcuguucggcggcgcggguc

SEQ ID NO: 176267 - RNA, 22 nt, Pseudomonas putida KT2440
cuggagcugcgccucaagcaga

SEQ ID NO: 176268 - RNA, 22 nt, Pseudomonas putida KT2440
agggccuggaaacgcugcgccu

SEQ ID NO: 176269 - RNA, 22 nt, Pseudomonas putida KT2440
agcuggacgagcagggccagca

SEQ ID NO: 176270 - RNA, 22 nt, Pseudomonas putida KT2440
gcgcaccaggaugcccgcggca

SEQ ID NO: 176271 - RNA, 19 nt, Pseudomonas putida KT2440
gcacccgagccaguagcuc

SEQ ID NO: 176272 - RNA, 22 nt, Pseudomonas putida KT2440
caucauccguaccgaggaauau

SEQ ID NO: 176273 - RNA, 22 nt, Pseudomonas putida KT2440
cggcccuuucgcggguaaaccc

SEQ ID NO: 176274 - RNA, 22 nt, Pseudomonas putida KT2440
aucgccaucagccucuauccgc

SEQ ID NO: 176275 - RNA, 22 nt, Pseudomonas putida KT2440
ucgaccaaugcccaggccacgu

SEQ ID NO: 176276 - RNA, 23 nt, Pseudomonas putida KT2440
cguggcagucuuccuugcccugc

SEQ ID NO: 176277 - RNA, 22 nt, Pseudomonas putida KT2440
uugcugcugagugugccgguaa

SEQ ID NO: 176278 - RNA, 22 nt, Pseudomonas putida KT2440
cgcgguuuuccacaugcggguu

SEQ ID NO: 176279 - RNA, 22 nt, Pseudomonas putida KT2440
cggcuccaucacguucagcugc

SEQ ID NO: 176280 - RNA, 22 nt, Pseudomonas putida KT2440
cgauagcgguauaucgaggacu

SEQ ID NO: 176281 - RNA, 21 nt, Pseudomonas putida KT2440
cguugcugcaaguuauguauu

SEQ ID NO: 176282 - RNA, 22 nt, Pseudomonas putida KT2440
agcgcuuuaccccaggggaggu

SEQ ID NO: 176283 - RNA, 22 nt, Pseudomonas putida KT2440
ccugccacgugacaccuucaug

SEQ ID NO: 176284 - RNA, 22 nt, Pseudomonas putida KT2440
gugcauuaccugugggagcggg

SEQ ID NO: 176285 - RNA, 22 nt, Pseudomonas putida KT2440
ucuacgagcagaugcucgagcc

SEQ ID NO: 176286 - RNA, 22 nt, Pseudomonas putida KT2440
cucgccaugcaccaggcggcuu

SEQ ID NO: 176287 - RNA, 22 nt, Pseudomonas putida KT2440
gagcacggaaccgaccauaccg

SEQ ID NO: 176288 - RNA, 22 nt, Pseudomonas putida KT2440
ucuaccuggguagccaccucac

SEQ ID NO: 176289 - RNA, 22 nt, Pseudomonas putida KT2440
ugcggaugccauugauguugaa

SEQ ID NO: 176290 - RNA, 22 nt, Pseudomonas putida KT2440
agcccgcucccacaggaauggc

SEQ ID NO: 176291 - RNA, 22 nt, Pseudomonas putida KT2440
agcaguggaugggccgggucga

SEQ ID NO: 176292 - RNA, 22 nt, Pseudomonas putida KT2440
uuugccagagccgcuggcaccg

SEQ ID NO: 176293 - RNA, 22 nt, Pseudomonas putida KT2440
uggccuucgagcgccugccgca

SEQ ID NO: 176294 - RNA, 22 nt, Pseudomonas putida KT2440
ucggugcuaccgaccuguucca

SEQ ID NO: 176295 - RNA, 22 nt, Pseudomonas putida KT2440
accuucagcuugcggacauuga

SEQ ID NO: 176296 - RNA, 22 nt, Pseudomonas putida KT2440
cgguugaucguugagcgcagcg

SEQ ID NO: 176297 - RNA, 22 nt, Pseudomonas putida KT2440
ggccgcuucuugcgcuggggcu

SEQ ID NO: 176298 - RNA, 22 nt, Pseudomonas putida KT2440
ggcacgucgaucacuguuaccc

SEQ ID NO: 176299 - RNA, 22 nt, Pseudomonas putida KT2440
caggauagagccgucuuugauc

SEQ ID NO: 176300 - RNA, 22 nt, Pseudomonas putida KT2440
ucccugugggugcgggcgggcc

SEQ ID NO: 176301 - RNA, 22 nt, Pseudomonas putida KT2440
cgagguuggcagccuggcaaug

SEQ ID NO: 176302 - RNA, 22 nt, Pseudomonas putida KT2440
aggucuugcccagcacggugua

SEQ ID NO: 176303 - RNA, 22 nt, Pseudomonas putida KT2440
ugugcugcgaggggccauuaca

SEQ ID NO: 176304 - RNA, 22 nt, Pseudomonas putida KT2440
uggcgaguccgaagcccgcgcc

SEQ ID NO: 176305 - RNA, 22 nt, Pseudomonas putida KT2440
cgaggaccaggcugaaguuguc

SEQ ID NO: 176306 - RNA, 22 nt, Pseudomonas putida KT2440
ccggaucugccggcugucguag

SEQ ID NO: 176307 - RNA, 22 nt, Pseudomonas putida KT2440
gacggugugaaaacgugaugac

SEQ ID NO: 176308 - RNA, 22 nt, Pseudomonas putida KT2440
agcagcgagcgacaagacaaga

SEQ ID NO: 176309 - RNA, 22 nt, Pseudomonas putida KT2440
ccugaucgccgccuccuugcgc

SEQ ID NO: 176310 - RNA, 22 nt, Pseudomonas putida KT2440
augcugcucagcauuucgccgc

SEQ ID NO: 176311 - RNA, 22 nt, Pseudomonas putida KT2440
ucaucgaguccggcccguacag

SEQ ID NO: 176312 - RNA, 22 nt, Pseudomonas putida KT2440
gcauuccucaaccuggaugaag

SEQ ID NO: 176313 - RNA, 22 nt, Pseudomonas putida KT2440
cgaucguugguugagugccacu

SEQ ID NO: 176314 - RNA, 22 nt, Pseudomonas putida KT2440
uggcggcagccagaagggcuag

SEQ ID NO: 176315 - RNA, 22 nt, Pseudomonas putida KT2440
gaugcgcugugcaaacgcuacg

SEQ ID NO: 176316 - RNA, 22 nt, Pseudomonas putida KT2440
ucgacaugcucgagcguggugu

SEQ ID NO: 176317 - RNA, 22 nt, Pseudomonas putida KT2440
aagcgggcaccgccgucuucug

SEQ ID NO: 176318 - RNA, 22 nt, Pseudomonas putida KT2440
aagccggcgaaguuauccauga

SEQ ID NO: 176319 - RNA, 22 nt, Pseudomonas putida KT2440
cgcacuguucaaagaaccggaa

SEQ ID NO: 176320 - RNA, 22 nt, Pseudomonas putida KT2440
gcccuggucgacgccaugggcg

SEQ ID NO: 176321 - RNA, 23 nt, Pseudomonas putida KT2440
cuggcgguucuggguggcguagc

SEQ ID NO: 176322 - RNA, 22 nt, Pseudomonas putida KT2440
agcuggucgauauggcgggcau

SEQ ID NO: 176323 - RNA, 22 nt, Pseudomonas putida KT2440
gguggccugcgucagccaggcc

SEQ ID NO: 176324 - RNA, 22 nt, Pseudomonas putida KT2440
gcguucuaccgcuggcuggcau

SEQ ID NO: 176325 - RNA, 22 nt, Pseudomonas putida KT2440
cagguggaccugccgacugccg

SEQ ID NO: 176326 - RNA, 22 nt, Pseudomonas putida KT2440
cuggcgcaccugguagccguau

SEQ ID NO: 176327 - RNA, 23 nt, Pseudomonas putida KT2440
ugugcugaucgagcucggcacgc

SEQ ID NO: 176328 - RNA, 22 nt, Pseudomonas putida KT2440
gggcgaauuucucgggguucug

SEQ ID NO: 176329 - RNA, 22 nt, Pseudomonas putida KT2440
ugcuggaggauguuggcgagca

SEQ ID NO: 176330 - RNA, 22 nt, Pseudomonas putida KT2440
gugcuggaaaaccugugccugg

SEQ ID NO: 176331 - RNA, 22 nt, Pseudomonas putida KT2440
cggguaucgcacaccaguucga

SEQ ID NO: 176332 - RNA, 22 nt, Pseudomonas putida KT2440
uggucaccacugcggcuggccu

SEQ ID NO: 176333 - RNA, 22 nt, Pseudomonas putida KT2440
ccuggcaccgugugggagcggg

SEQ ID NO: 176334 - RNA, 22 nt, Pseudomonas putida KT2440
gcacccaguuggugccagguuc

SEQ ID NO: 176335 - RNA, 22 nt, Pseudomonas putida KT2440
uuggagcggguuuacccgcgaa

SEQ ID NO: 176336 - RNA, 22 nt, Pseudomonas putida KT2440
cgcuacccagauaggcuugagg

SEQ ID NO: 176337 - RNA, 21 nt, Pseudomonas putida KT2440
agcuggugcaccgccuggauc

SEQ ID NO: 176338 - RNA, 22 nt, Pseudomonas putida KT2440
gaccuugacuucgauggugucg

SEQ ID NO: 176339 - RNA, 22 nt, Pseudomonas putida KT2440
ggcagcauaaaguaagggugug

SEQ ID NO: 176340 - RNA, 22 nt, Pseudomonas putida KT2440
gucauuggucgugcgcaggcca

SEQ ID NO: 176341 - RNA, 22 nt, Pseudomonas putida KT2440
cuggccaccacuggccauggca

SEQ ID NO: 176342 - RNA, 22 nt, Pseudomonas putida KT2440
ccgcagugcuugcuucgcgggc

SEQ ID NO: 176343 - RNA, 22 nt, Pseudomonas putida KT2440
aacuggccgcagccuugccagc

SEQ ID NO: 176344 - RNA, 22 nt, Pseudomonas putida KT2440
ugcugcucaaggccagcgcggg

SEQ ID NO: 176345 - RNA, 22 nt, Pseudomonas putida KT2440
gugaugucgcugauccugcugg

SEQ ID NO: 176346 - RNA, 22 nt, Pseudomonas putida KT2440
cuucacgcugcacgacaaugca

SEQ ID NO: 176347 - RNA, 22 nt, Pseudomonas putida KT2440
ucugcaccaucgggcgcgaugc

SEQ ID NO: 176348 - RNA, 22 nt, Pseudomonas putida KT2440
ccuggccaguguacugcccgag

SEQ ID NO: 176349 - RNA, 22 nt, Pseudomonas putida KT2440
acgccuuguucuuuuucgagga

SEQ ID NO: 176350 - RNA, 22 nt, Pseudomonas putida KT2440
guacccugcaucggggcguuga

SEQ ID NO: 176351 - RNA, 22 nt, Pseudomonas putida KT2440
cgcucccacaggugucucgcaa

SEQ ID NO: 176352 - RNA, 22 nt, Pseudomonas putida KT2440
ugcagucguuguuggagcgggc

SEQ ID NO: 176353 - RNA, 22 nt, Pseudomonas putida KT2440
uguugccggccuggagcgcgcc

SEQ ID NO: 176354 - RNA, 22 nt, Pseudomonas putida KT2440
ggacccugaacgcagccugaug

SEQ ID NO: 176355 - RNA, 22 nt, Pseudomonas putida KT2440
aagcccgcucccgcagguuuuu

SEQ ID NO: 176356 - RNA, 20 nt, Pseudomonas putida KT2440
gccaggcauccagggcaucg

SEQ ID NO: 176357 - RNA, 22 nt, Pseudomonas putida KT2440
accuuggcuucaagcggguuag

SEQ ID NO: 176358 - RNA, 22 nt, Pseudomonas putida KT2440
aggcucagcaauugugcccggg

SEQ ID NO: 176359 - RNA, 22 nt, Pseudomonas putida KT2440
guguucaccgcaccugugggca

SEQ ID NO: 176360 - RNA, 22 nt, Pseudomonas putida KT2440
uugaacgcgucgcuuucggccu

SEQ ID NO: 176361 - RNA, 23 nt, Pseudomonas putida KT2440
auggccgagcaucgcguucaucu

SEQ ID NO: 176362 - RNA, 22 nt, Pseudomonas putida KT2440
caggcaguggcggccgccgaca

SEQ ID NO: 176363 - RNA, 22 nt, Pseudomonas putida KT2440
cgcgagcuggccgagggcucgc

SEQ ID NO: 176364 - RNA, 22 nt, Pseudomonas putida KT2440
gaucaucggacauucggggugg

SEQ ID NO: 176365 - RNA, 22 nt, Pseudomonas putida KT2440
aggcugauccgggucggcgaua

SEQ ID NO: 176366 - RNA, 22 nt, Pseudomonas putida KT2440
uccucggcgauugccaccgaaa

SEQ ID NO: 176367 - RNA, 20 nt, Pseudomonas putida KT2440
uugagggcgccguuguaggc

SEQ ID NO: 176368 - RNA, 22 nt, Pseudomonas putida KT2440
cugcuugacgagauguaccgga

SEQ ID NO: 176369 - RNA, 22 nt, Pseudomonas putida KT2440
uccaggccuucgaugguggugc

SEQ ID NO: 176370 - RNA, 22 nt, Pseudomonas putida KT2440
gccugguacagugcaacggugu

SEQ ID NO: 176371 - RNA, 22 nt, Pseudomonas putida KT2440
ccauggccagcgagugggcauu

SEQ ID NO: 176372 - RNA, 23 nt, Pseudomonas putida KT2440
cuuccugaccgaugaccugcuca

SEQ ID NO: 176373 - RNA, 22 nt, Pseudomonas putida KT2440
guucgacucgauucagggcuug

SEQ ID NO: 176374 - RNA, 22 nt, Pseudomonas putida KT2440
ugcaggcgcggguuuacccgcg

SEQ ID NO: 176375 - RNA, 22 nt, Pseudomonas putida KT2440
acagccugaaccggcccuuucg

SEQ ID NO: 176376 - RNA, 22 nt, Pseudomonas putida KT2440
ucggagacaggugcggcgcgcc

SEQ ID NO: 176377 - RNA, 22 nt, Pseudomonas putida KT2440
auggccagcagcaccuuguuca

SEQ ID NO: 176378 - RNA, 22 nt, Pseudomonas putida KT2440
cagcagcagcgucuggucaucg

SEQ ID NO: 176379 - RNA, 22 nt, Pseudomonas putida KT2440
cugcacgguggugcccgguucg

SEQ ID NO: 176380 - RNA, 22 nt, Pseudomonas putida KT2440
aggugguagcaggucgagcaag

SEQ ID NO: 176381 - RNA, 22 nt, Pseudomonas putida KT2440
aacccgcuccuacaauggauug

SEQ ID NO: 176382 - RNA, 22 nt, Pseudomonas putida KT2440
cuggcaguggcugaccaccugu

SEQ ID NO: 176383 - RNA, 22 nt, Pseudomonas putida KT2440
agccgaccacguggcuuaucgg

SEQ ID NO: 176384 - RNA, 22 nt, Pseudomonas putida KT2440
ugaacacccaugaguuguaucc

SEQ ID NO: 176385 - RNA, 22 nt, Pseudomonas putida KT2440
cagugggcacgguuggcgaucc

SEQ ID NO: 176386 - RNA, 22 nt, Pseudomonas putida KT2440
ccgguaccgguguugaagugcu

SEQ ID NO: 176387 - RNA, 22 nt, Pseudomonas putida KT2440
aauggcgcgugucgagcggcgg

SEQ ID NO: 176388 - RNA, 22 nt, Pseudomonas putida KT2440
gcccagauacacccaagggucg

SEQ ID NO: 176389 - RNA, 22 nt, Pseudomonas putida KT2440
auacccgcaacaaugcacagcg

SEQ ID NO: 176390 - RNA, 22 nt, Pseudomonas putida KT2440
augccgcgccgcgacaacagcu

SEQ ID NO: 176391 - RNA, 22 nt, Pseudomonas putida KT2440
uacguugcagcgccugccagau

SEQ ID NO: 176392 - RNA, 22 nt, Pseudomonas putida KT2440
gccgucgaccacgcgaaucgac

SEQ ID NO: 176393 - RNA, 22 nt, Pseudomonas putida KT2440
ugggcuccacggugaccaccgg

SEQ ID NO: 176394 - RNA, 22 nt, Pseudomonas putida KT2440
guucuggcucagguacugguua

SEQ ID NO: 176395 - RNA, 22 nt, Pseudomonas putida KT2440
ggcggguacagugcauuggauc

SEQ ID NO: 176396 - RNA, 22 nt, Pseudomonas putida KT2440
accugggccuucuucauugccg

SEQ ID NO: 176397 - RNA, 22 nt, Pseudomonas putida KT2440
gugccaaugggcgccggcgcug

SEQ ID NO: 176398 - RNA, 22 nt, Pseudomonas putida KT2440
ggugcguacuugaccagcuggu

SEQ ID NO: 176399 - RNA, 21 nt, Pseudomonas putida KT2440
ccgguaccggcguugcaggcg

SEQ ID NO: 176400 - RNA, 22 nt, Pseudomonas putida KT2440
caggccgaggccggcaccggcu

SEQ ID NO: 176401 - RNA, 22 nt, Pseudomonas putida KT2440
gaucaaguuccaggccgacaug

SEQ ID NO: 176402 - RNA, 22 nt, Pseudomonas putida KT2440
uccucgaaacacuugaugguaa

SEQ ID NO: 176403 - RNA, 22 nt, Pseudomonas putida KT2440
agcccguuccugcacagaucgc

SEQ ID NO: 176404 - RNA, 19 nt, Pseudomonas putida KT2440
ggaaggucuugccggcgac

SEQ ID NO: 176405 - RNA, 22 nt, Pseudomonas putida KT2440
ggccgaguucgaagugucgauu

SEQ ID NO: 176406 - RNA, 20 nt, Pseudomonas putida KT2440
ucguccugucgccugcugcu

SEQ ID NO: 176407 - RNA, 22 nt, Pseudomonas putida KT2440
ugagcugcuugaguucuuuuuc

SEQ ID NO: 176408 - RNA, 22 nt, Pseudomonas putida KT2440
agucaggcugacgcugcgcgug

SEQ ID NO: 176409 - RNA, 22 nt, Pseudomonas putida KT2440
gggcugcugugcuggugccucg

SEQ ID NO: 176410 - RNA, 22 nt, Pseudomonas putida KT2440
cgcauucgcggguaaacccgcu

SEQ ID NO: 176411 - RNA, 22 nt, Pseudomonas putida KT2440
uaggagcggguuuacccgcgua

SEQ ID NO: 176412 - RNA, 22 nt, Pseudomonas putida KT2440
uuauccaguguaggagcggguu

SEQ ID NO: 176413 - RNA, 23 nt, Pseudomonas putida KT2440
cgcugguggcacguagcaccgcu

SEQ ID NO: 176414 - RNA, 22 nt, Pseudomonas putida KT2440
uucagcucgaugcuugcagugc

SEQ ID NO: 176415 - RNA, 22 nt, Pseudomonas putida KT2440
ucgccauuugagcgccgacaag

SEQ ID NO: 176416 - RNA, 22 nt, Pseudomonas putida KT2440
caggcguaacaggccgucuucg

SEQ ID NO: 176417 - RNA, 22 nt, Pseudomonas putida KT2440
aucagccugcugcucacccacg

SEQ ID NO: 176418 - RNA, 22 nt, Pseudomonas putida KT2440
uucgcacacauugggcacuucg

SEQ ID NO: 176419 - RNA, 22 nt, Pseudomonas putida KT2440
gccguugccuggcggcgcucgg

SEQ ID NO: 176420 - RNA, 22 nt, Pseudomonas putida KT2440
uuggcaccugugagaucgagug

SEQ ID NO: 176421 - RNA, 18 nt, Pseudomonas putida KT2440
aggugggcaacugguugc

SEQ ID NO: 176422 - RNA, 22 nt, Pseudomonas putida KT2440
uucgcggguaaacccgcuccaa

SEQ ID NO: 176423 - RNA, 22 nt, Pseudomonas putida KT2440
acaccaggcagaacucggcguu

SEQ ID NO: 176424 - RNA, 22 nt, Pseudomonas putida KT2440
aucggcgagguacugaucggcg

SEQ ID NO: 176425 - RNA, 22 nt, Pseudomonas putida KT2440
gcuugucgaauaucagugccgc

SEQ ID NO: 176426 - RNA, 22 nt, Pseudomonas putida KT2440
ucggccagggcaacuggcugcc

SEQ ID NO: 176427 - RNA, 22 nt, Pseudomonas putida KT2440
gccaugcgcucuuugaagcugg

SEQ ID NO: 176428 - RNA, 22 nt, Pseudomonas putida KT2440
ucagcugauuguugagcaggaa

SEQ ID NO: 176429 - RNA, 22 nt, Pseudomonas putida KT2440
ucacccggaucauuucgucgag

SEQ ID NO: 176430 - RNA, 22 nt, Pseudomonas putida KT2440
aucggccuguucguguggggcu

SEQ ID NO: 176431 - RNA, 22 nt, Pseudomonas putida KT2440
cauggucgccgccauuggcgcg

SEQ ID NO: 176432 - RNA, 22 nt, Pseudomonas putida KT2440
ugaccgaucaucagccagcaau

SEQ ID NO: 176433 - RNA, 22 nt, Pseudomonas putida KT2440
caagcccgcuccugcaugucca

SEQ ID NO: 176434 - RNA, 22 nt, Pseudomonas putida KT2440
ugguggaccuguccggccagau

SEQ ID NO: 176435 - RNA, 22 nt, Pseudomonas putida KT2440
agcaguaccgcauugccuuggc

SEQ ID NO: 176436 - RNA, 22 nt, Pseudomonas putida KT2440
aacugccgguaaagcagagcgc

SEQ ID NO: 176437 - RNA, 22 nt, Pseudomonas putida KT2440
cauucggagcguuucgucgcgg

SEQ ID NO: 176438 - RNA, 22 nt, Pseudomonas putida KT2440
cgaguugucugcuucgcgggcg

SEQ ID NO: 176439 - RNA, 22 nt, Pseudomonas putida KT2440
ugucgcgcuuuucgucgguccu

SEQ ID NO: 176440 - RNA, 22 nt, Pseudomonas putida KT2440
aggcgcugccgucauccuggau

SEQ ID NO: 176441 - RNA, 22 nt, Pseudomonas putida KT2440
uccucggcgaguugggccuuag

SEQ ID NO: 176442 - RNA, 23 nt, Pseudomonas putida KT2440
auggucgacgagaaccuggagca

SEQ ID NO: 176443 - RNA, 22 nt, Pseudomonas putida KT2440
gcagugcauggaaugccaccgc

SEQ ID NO: 176444 - RNA, 22 nt, Pseudomonas putida KT2440
cagcaguugcucgucgcgcagg

SEQ ID NO: 176445 - RNA, 22 nt, Pseudomonas putida KT2440
cugcagccguccacguaggcgu

SEQ ID NO: 176446 - RNA, 22 nt, Pseudomonas putida KT2440
ggcgacaugccggugucgcugc

SEQ ID NO: 176447 - RNA, 19 nt, Pseudomonas putida KT2440
aaguucggcagcuugcgcc

SEQ ID NO: 176448 - RNA, 22 nt, Pseudomonas putida KT2440
aagucugggguccugcccugaa

SEQ ID NO: 176449 - RNA, 22 nt, Pseudomonas putida KT2440
gcaagcgcaucuccagccacca

SEQ ID NO: 176450 - RNA, 22 nt, Pseudomonas putida KT2440
cggugcgauuacugugggagcg

SEQ ID NO: 176451 - RNA, 23 nt, Pseudomonas putida KT2440
cgccuucgagcgcaagguacucg

SEQ ID NO: 176452 - RNA, 22 nt, Pseudomonas putida KT2440
gucggcguugaaaguaucgguu

SEQ ID NO: 176453 - RNA, 22 nt, Pseudomonas putida KT2440
aggccaguacguggccgucgag

SEQ ID NO: 176454 - RNA, 22 nt, Pseudomonas putida KT2440
cgcgguguggcuggggcgcugu

SEQ ID NO: 176455 - RNA, 22 nt, Pseudomonas putida KT2440
caagucacccaggaggcugccg

SEQ ID NO: 176456 - RNA, 22 nt, Pseudomonas putida KT2440
cagggccuggccaagcugcgcg

SEQ ID NO: 176457 - RNA, 22 nt, Pseudomonas putida KT2440
ugggccauaccugaugcgcgac

SEQ ID NO: 176458 - RNA, 22 nt, Pseudomonas putida KT2440
ggccuugaccccggccucaccg

SEQ ID NO: 176459 - RNA, 22 nt, Pseudomonas putida KT2440
auuccggguaaacccgcuccua

SEQ ID NO: 176460 - RNA, 22 nt, Pseudomonas putida KT2440
gcuggucagcaagcaggaccug

SEQ ID NO: 176461 - RNA, 22 nt, Pseudomonas putida KT2440
aucggccaggcgcagacuggca

SEQ ID NO: 176462 - RNA, 22 nt, Pseudomonas putida KT2440
cgccuuggccagcaguuugccg

SEQ ID NO: 176463 - RNA, 22 nt, Pseudomonas putida KT2440
gugcgcugcugugggucgaggu

SEQ ID NO: 176464 - RNA, 22 nt, Pseudomonas putida KT2440
guucggcggcgaucagcgaacg

SEQ ID NO: 176465 - RNA, 22 nt, Pseudomonas putida KT2440
agccgcgaaugaacgcaccgcg

SEQ ID NO: 176466 - RNA, 22 nt, Pseudomonas putida KT2440
aauaccugauuggcaguggcaa

SEQ ID NO: 176467 - RNA, 22 nt, Pseudomonas putida KT2440
cgaugguguccacgcccagcgc

SEQ ID NO: 176468 - RNA, 19 nt, Pseudomonas putida KT2440
acaugcaggcgaucauguc

SEQ ID NO: 176469 - RNA, 22 nt, Pseudomonas putida KT2440
gcccgucagcuuggcauggcca

SEQ ID NO: 176470 - RNA, 22 nt, Pseudomonas putida KT2440
uguucgacgccucgaucggcua

SEQ ID NO: 176471 - RNA, 22 nt, Pseudomonas putida KT2440
aggcacugucgagcagugacug

SEQ ID NO: 176472 - RNA, 22 nt, Pseudomonas putida KT2440
acgacccguacuuuucucucac

SEQ ID NO: 176473 - RNA, 22 nt, Pseudomonas putida KT2440
acggcgcucgcugccgacauga

SEQ ID NO: 176474 - RNA, 22 nt, Pseudomonas putida KT2440
ggccgacuaugcgcugcuggcc

SEQ ID NO: 176475 - RNA, 22 nt, Pseudomonas putida KT2440
uggcucggccccggagcuggcc

SEQ ID NO: 176476 - RNA, 22 nt, Pseudomonas putida KT2440
ccgcuguucuaccucaagcgcu

SEQ ID NO: 176477 - RNA, 22 nt, Pseudomonas putida KT2440
ccugaccgacaacgagcuggcc

SEQ ID NO: 176478 - RNA, 22 nt, Pseudomonas putida KT2440
agcgcgcauuuguuccccgagu

SEQ ID NO: 176479 - RNA, 18 nt, Pseudomonas putida KT2440
ugcugcucagccuggcgg

SEQ ID NO: 176480 - RNA, 22 nt, Pseudomonas putida KT2440
ggucgcaaccgacguuguuggg

SEQ ID NO: 176481 - RNA, 22 nt, Pseudomonas putida KT2440
cgcgccaucgaagaucgccgca

SEQ ID NO: 176482 - RNA, 22 nt, Pseudomonas putida KT2440
ccaaucgcaucccacgcgaauc

SEQ ID NO: 176483 - RNA, 22 nt, Pseudomonas putida KT2440
cuuugcugacgggcugugcagg

SEQ ID NO: 176484 - RNA, 21 nt, Pseudomonas putida KT2440
ggcgaagcauuggaacaggac

SEQ ID NO: 176485 - RNA, 22 nt, Pseudomonas putida KT2440
ggucauggagucggcugugucc

SEQ ID NO: 176486 - RNA, 22 nt, Pseudomonas putida KT2440
uggccucuucgcggguaaaccc

SEQ ID NO: 176487 - RNA, 22 nt, Pseudomonas putida KT2440
ucaccgucguacacuuggccau

SEQ ID NO: 176488 - RNA, 22 nt, Pseudomonas putida KT2440
ggaggcuguacgugucauagcc

SEQ ID NO: 176489 - RNA, 22 nt, Pseudomonas putida KT2440
aaggccauggccagcaguauca

SEQ ID NO: 176490 - RNA, 22 nt, Pseudomonas putida KT2440
ugugccguaccugugggagcgg

SEQ ID NO: 176491 - RNA, 22 nt, Pseudomonas putida KT2440
ugaucggcaaugcaaaacgccc

SEQ ID NO: 176492 - RNA, 22 nt, Pseudomonas putida KT2440
ccacgccuuggccgugacgccg

SEQ ID NO: 176493 - RNA, 22 nt, Pseudomonas putida KT2440
uugcagcaggcggaucgagucg

SEQ ID NO: 176494 - RNA, 22 nt, Pseudomonas putida KT2440
cgccaucgccauggccgccaac

SEQ ID NO: 176495 - RNA, 22 nt, Pseudomonas putida KT2440
caccugucgccgcaggccauga

SEQ ID NO: 176496 - RNA, 22 nt, Pseudomonas putida KT2440
ccagcucggcguguuggccggu

SEQ ID NO: 176497 - RNA, 22 nt, Pseudomonas putida KT2440
cgcgcgaaccgguguagccguu

SEQ ID NO: 176498 - RNA, 22 nt, Pseudomonas putida KT2440
uguaggagcgggcuugccgcga

SEQ ID NO: 176499 - RNA, 22 nt, Pseudomonas putida KT2440
uugucgaucuuccccgaccgca

SEQ ID NO: 176500 - RNA, 22 nt, Pseudomonas putida KT2440
gcgauguucaccagauagccuu

SEQ ID NO: 176501 - RNA, 22 nt, Pseudomonas putida KT2440
ugguagcggcagugugcgccug

SEQ ID NO: 176502 - RNA, 22 nt, Pseudomonas putida KT2440
ggcgagcugaucaucaucaagc

SEQ ID NO: 176503 - RNA, 22 nt, Pseudomonas putida KT2440
aguaccuggccaagcacggcaa

SEQ ID NO: 176504 - RNA, 22 nt, Pseudomonas putida KT2440
agugcgcagcgugcuguucggu

SEQ ID NO: 176505 - RNA, 22 nt, Pseudomonas putida KT2440
uucgcggguuagcccuccccua

SEQ ID NO: 176506 - RNA, 22 nt, Pseudomonas putida KT2440
uugucgaggaggcgcuacguca

SEQ ID NO: 176507 - RNA, 22 nt, Pseudomonas putida KT2440
uccuucaauccugcgacucgca

SEQ ID NO: 176508 - RNA, 22 nt, Pseudomonas putida KT2440
acuacgacaucaacgacuacgg

SEQ ID NO: 176509 - RNA, 22 nt, Pseudomonas putida KT2440
gauacccugccacugaaccuga

SEQ ID NO: 176510 - RNA, 22 nt, Pseudomonas putida KT2440
ucggacagcgccagguagcugg

SEQ ID NO: 176511 - RNA, 22 nt, Pseudomonas putida KT2440
ugggagcgggcgugcccgcgaa

SEQ ID NO: 176512 - RNA, 22 nt, Pseudomonas putida KT2440
ggauugucggcagugugcuggc

SEQ ID NO: 176513 - RNA, 22 nt, Pseudomonas putida KT2440
gcgggcaugcccgcucccgcag

SEQ ID NO: 176514 - RNA, 22 nt, Pseudomonas putida KT2440
gcgugccaguggcagcagcacu

SEQ ID NO: 176515 - RNA, 22 nt, Pseudomonas putida KT2440
cggugccugcuucgcgggcucg

SEQ ID NO: 176516 - RNA, 22 nt, Pseudomonas putida KT2440
ucgcggugguggccgacgaggu

SEQ ID NO: 176517 - RNA, 23 nt, Pseudomonas putida KT2440
gacagccaugcccuggucggcga

SEQ ID NO: 176518 - RNA, 22 nt, Pseudomonas putida KT2440
acccgcgaaggcgucgguccug

SEQ ID NO: 176519 - RNA, 22 nt, Pseudomonas putida KT2440
ugcagaccugugggagcgggca

SEQ ID NO: 176520 - RNA, 22 nt, Pseudomonas putida KT2440
uuugcgcuugugcguacucggc

SEQ ID NO: 176521 - RNA, 22 nt, Pseudomonas putida KT2440
cugaugaacggcuuccugucga

SEQ ID NO: 176522 - RNA, 22 nt, Pseudomonas putida KT2440
uugcugucggugguuuaccugu

SEQ ID NO: 176523 - RNA, 22 nt, Pseudomonas putida KT2440
gaucggcacaaacgaaaacgcc

SEQ ID NO: 176524 - RNA, 22 nt, Pseudomonas putida KT2440
uuucgcgacacaaggccgcucc

SEQ ID NO: 176525 - RNA, 22 nt, Pseudomonas putida KT2440
gcuggccacgaauacaugaucg

SEQ ID NO: 176526 - RNA, 22 nt, Pseudomonas putida KT2440
gagcgucaaggcugccaggcca

SEQ ID NO: 176527 - RNA, 22 nt, Pseudomonas putida KT2440
gcggccauccuguaggagcggg

SEQ ID NO: 176528 - RNA, 22 nt, Pseudomonas putida KT2440
agugcauugaccuucacgcuga

SEQ ID NO: 176529 - RNA, 22 nt, Pseudomonas putida KT2440
uggcaauguccucugugucgaa

SEQ ID NO: 176530 - RNA, 22 nt, Pseudomonas putida KT2440
gccugggagaucgagcgccgcc

SEQ ID NO: 176531 - RNA, 22 nt, Pseudomonas putida KT2440
ccagggcuucacacguguggcu

SEQ ID NO: 176532 - RNA, 22 nt, Pseudomonas putida KT2440
gcucgcugaucaugccggugau

SEQ ID NO: 176533 - RNA, 22 nt, Pseudomonas putida KT2440
cgaacggaucaaggccuugcgc

SEQ ID NO: 176534 - RNA, 22 nt, Pseudomonas putida KT2440
agcgaugcgaugcgauguacca

SEQ ID NO: 176535 - RNA, 22 nt, Pseudomonas putida KT2440
ucgucgaauuggucagcccgcu

SEQ ID NO: 176536 - RNA, 22 nt, Pseudomonas putida KT2440
cugaggauagagucgccaccga

SEQ ID NO: 176537 - RNA, 22 nt, Pseudomonas putida KT2440
cucgggcucgcccgcucccaca

SEQ ID NO: 176538 - RNA, 22 nt, Pseudomonas putida KT2440
uucgauccggggcaguacacca

SEQ ID NO: 176539 - RNA, 22 nt, Pseudomonas putida KT2440
cuuugcaguacuugugggagcg

SEQ ID NO: 176540 - RNA, 22 nt, Pseudomonas putida KT2440
cagugaaagcgguugcgcccgg

SEQ ID NO: 176541 - RNA, 22 nt, Pseudomonas putida KT2440
uuucggccugcucgcgcaggaa

SEQ ID NO: 176542 - RNA, 22 nt, Pseudomonas putida KT2440
agcgccugugagauccagcgcc

SEQ ID NO: 176543 - RNA, 20 nt, Pseudomonas putida KT2440
uggcaggaucugaugcaggu

SEQ ID NO: 176544 - RNA, 22 nt, Pseudomonas putida KT2440
gacugugugaaaacggcugacc

SEQ ID NO: 176545 - RNA, 22 nt, Pseudomonas putida KT2440
cuucggcagcaaagguggcgga

SEQ ID NO: 176546 - RNA, 22 nt, Pseudomonas putida KT2440
cccgcgaaacaagcgacgcggu

SEQ ID NO: 176547 - RNA, 20 nt, Pseudomonas putida KT2440
acugaagguuggcgguggcc

SEQ ID NO: 176548 - RNA, 22 nt, Pseudomonas putida KT2440
uguucgcuuugaguuccgauca

SEQ ID NO: 176549 - RNA, 20 nt, Pseudomonas putida KT2440
gcugcugccgcuuuacuacc

SEQ ID NO: 176550 - RNA, 22 nt, Pseudomonas putida KT2440
uggccuguuggcugaaaugcug

SEQ ID NO: 176551 - RNA, 22 nt, Pseudomonas putida KT2440
gcuucgagacggagauugucga

SEQ ID NO: 176552 - RNA, 22 nt, Pseudomonas putida KT2440
gucggccagggcauauccggcg

SEQ ID NO: 176553 - RNA, 22 nt, Pseudomonas putida KT2440
gaacccgcuccuacgacgggcu

SEQ ID NO: 176554 - RNA, 22 nt, Pseudomonas putida KT2440
uacugcuggaagcggguucacg

SEQ ID NO: 176555 - RNA, 22 nt, Pseudomonas putida KT2440
cggcuugaaccauggcuggcua

SEQ ID NO: 176556 - RNA, 22 nt, Pseudomonas putida KT2440
ugacgcccuugugggagcgggu

SEQ ID NO: 176557 - RNA, 22 nt, Pseudomonas putida KT2440
ugcccaguugccaaugggcaug

SEQ ID NO: 176558 - RNA, 22 nt, Pseudomonas putida KT2440
gcucacugaacgaggugcagcu

SEQ ID NO: 176559 - RNA, 22 nt, Pseudomonas putida KT2440
caguucgaagcgguggcuuuca

SEQ ID NO: 176560 - RNA, 21 nt, Pseudomonas putida KT2440
ugcucggcggcggacuucugc

SEQ ID NO: 176561 - RNA, 22 nt, Pseudomonas putida KT2440
ugccguuuagcuccgucgcuag

SEQ ID NO: 176562 - RNA, 22 nt, Pseudomonas putida KT2440
uggccugcacgcuggugcgcga

SEQ ID NO: 176563 - RNA, 22 nt, Pseudomonas putida KT2440
gccuuggcugcuggcacguugu

SEQ ID NO: 176564 - RNA, 20 nt, Pseudomonas putida KT2440
aagaggccggcucaggcgau

SEQ ID NO: 176565 - RNA, 22 nt, Pseudomonas putida KT2440
cacgaucaguggcaacugcgcg

SEQ ID NO: 176566 - RNA, 22 nt, Pseudomonas putida KT2440
uggugacgggugccguaguguu

SEQ ID NO: 176567 - RNA, 22 nt, Pseudomonas putida KT2440
cugccuggucagcgaacgaagg

SEQ ID NO: 176568 - RNA, 22 nt, Pseudomonas putida KT2440
uccagcgauuuggcgugguggc

SEQ ID NO: 176569 - RNA, 22 nt, Pseudomonas putida KT2440
caugggugaaauauuagcgaug

SEQ ID NO: 176570 - RNA, 22 nt, Pseudomonas putida KT2440
ucccggucacggucgagcgccu

SEQ ID NO: 176571 - RNA, 22 nt, Pseudomonas putida KT2440
gcuccuacacagagacggugca

SEQ ID NO: 176572 - RNA, 22 nt, Pseudomonas putida KT2440
uugagcaccaugcgcaagguga

SEQ ID NO: 176573 - RNA, 22 nt, Pseudomonas putida KT2440
ugaggccuggcgcgaggcgcug

SEQ ID NO: 176574 - RNA, 22 nt, Pseudomonas putida KT2440
cccgcgaaugcgauagcucagg

SEQ ID NO: 176575 - RNA, 18 nt, Pseudomonas putida KT2440
uccaggccucggccaugc

SEQ ID NO: 176576 - RNA, 21 nt, Pseudomonas putida KT2440
cggaucaucccauguacaccg

SEQ ID NO: 176577 - RNA, 22 nt, Pseudomonas putida KT2440
ggucaacaagauugccguuugg

SEQ ID NO: 176578 - RNA, 22 nt, Pseudomonas putida KT2440
caucacugacagcaccagugcc

SEQ ID NO: 176579 - RNA, 18 nt, Pseudomonas putida KT2440
uggugcgcuguugagcca

SEQ ID NO: 176580 - RNA, 22 nt, Pseudomonas putida KT2440
aagugcgguguggaacuggccg

SEQ ID NO: 176581 - RNA, 22 nt, Pseudomonas putida KT2440
uucuaccagcaaguacuggcga

SEQ ID NO: 176582 - RNA, 22 nt, Pseudomonas putida KT2440
cacagguagguuuucggcugga

SEQ ID NO: 176583 - RNA, 22 nt, Pseudomonas putida KT2440
aaccugcgcccacacggacugu

SEQ ID NO: 176584 - RNA, 22 nt, Pseudomonas putida KT2440
aacugccgcagcguaaggcaua

SEQ ID NO: 176585 - RNA, 22 nt, Pseudomonas putida KT2440
ugggagcgggcuugcccgcgaa

SEQ ID NO: 176586 - RNA, 17 nt, Pseudomonas putida KT2440
accugggcggcucaugg

SEQ ID NO: 176587 - RNA, 22 nt, Pseudomonas putida KT2440
agcggguuuacccgcgaauacg

SEQ ID NO: 176588 - RNA, 22 nt, Pseudomonas putida KT2440
agcucgucgaacgagguuuccu

SEQ ID NO: 176589 - RNA, 22 nt, Pseudomonas putida KT2440
ugccauuuaucugucgacucgu

SEQ ID NO: 176590 - RNA, 22 nt, Pseudomonas putida KT2440
agcccgcuccgacauugaucgg

SEQ ID NO: 176591 - RNA, 22 nt, Pseudomonas putida KT2440
cgacugguacaagaagagcacc

SEQ ID NO: 176592 - RNA, 22 nt, Pseudomonas putida KT2440
cguacgacaccuggaucucgca

SEQ ID NO: 176593 - RNA, 22 nt, Pseudomonas putida KT2440
gaccagcgcggugguaaggcuc

SEQ ID NO: 176594 - RNA, 22 nt, Pseudomonas putida KT2440
agggugcuagcucaaugaugca

SEQ ID NO: 176595 - RNA, 22 nt, Pseudomonas putida KT2440
ggugccuuguucagcgccagcc

SEQ ID NO: 176596 - RNA, 22 nt, Pseudomonas putida KT2440
acggucauucagcaccacggcc

SEQ ID NO: 176597 - RNA, 22 nt, Pseudomonas putida KT2440
cucgagcaugauuugcuggcca

SEQ ID NO: 176598 - RNA, 22 nt, Pseudomonas putida KT2440
gcggucagugaacggcugcggc

SEQ ID NO: 176599 - RNA, 22 nt, Pseudomonas putida KT2440
gagcccaugucggcguacuugc

SEQ ID NO: 176600 - RNA, 22 nt, Pseudomonas putida KT2440
gcaaggcuuguucggcguuguc

SEQ ID NO: 176601 - RNA, 22 nt, Pseudomonas putida KT2440
gaacaggccgcgccugcuuaaa

SEQ ID NO: 176602 - RNA, 22 nt, Pseudomonas putida KT2440
gcuaaagccgugccugcagggg

SEQ ID NO: 176603 - RNA, 22 nt, Pseudomonas putida KT2440
ggaauccuuccucgcgcgcaug

SEQ ID NO: 176604 - RNA, 22 nt, Pseudomonas putida KT2440
gcagucgaggcuuugcgcgaau

SEQ ID NO: 176605 - RNA, 22 nt, Pseudomonas putida KT2440
cggucaaugauuucgugggcgc

SEQ ID NO: 176606 - RNA, 22 nt, Pseudomonas putida KT2440
cugcgucugcuucugcuuuugc

SEQ ID NO: 176607 - RNA, 22 nt, Pseudomonas putida KT2440
gcgaucugugcaggaacgggcu

SEQ ID NO: 176608 - RNA, 22 nt, Pseudomonas putida KT2440
uugccguggcguacgcacggua

SEQ ID NO: 176609 - RNA, 22 nt, Pseudomonas putida KT2440
ucgcggguaaacccgcuccuac

SEQ ID NO: 176610 - RNA, 21 nt, Pseudomonas putida KT2440
cugccgaggucauugccgagc

SEQ ID NO: 176611 - RNA, 22 nt, Pseudomonas putida KT2440
accaucuaaaaggccauugggg

SEQ ID NO: 176612 - RNA, 22 nt, Pseudomonas putida KT2440
guccugaaccaugucgcgcugg

SEQ ID NO: 176613 - RNA, 22 nt, Pseudomonas putida KT2440
augucgcgcaccagguggucgu

SEQ ID NO: 176614 - RNA, 22 nt, Pseudomonas putida KT2440
ugucuacagcgcgcagaugaua

SEQ ID NO: 176615 - RNA, 22 nt, Pseudomonas putida KT2440
uuugagcaguuccagccagcug

SEQ ID NO: 176616 - RNA, 22 nt, Pseudomonas putida KT2440
aggcccgugccacagaugcgcu

SEQ ID NO: 176617 - RNA, 22 nt, Pseudomonas putida KT2440
gacccguugucggugaucguug

SEQ ID NO: 176618 - RNA, 22 nt, Pseudomonas putida KT2440
ugguccagacgauuucgcgcgg

SEQ ID NO: 176619 - RNA, 22 nt, Pseudomonas putida KT2440
acgcgucacagagcaagguguc

SEQ ID NO: 176620 - RNA, 22 nt, Pseudomonas putida KT2440
ugcggacuuuucgcccuuucga

SEQ ID NO: 176621 - RNA, 22 nt, Pseudomonas putida KT2440
cgcucccacaggaucaccgcaa

SEQ ID NO: 176622 - RNA, 22 nt, Pseudomonas putida KT2440
ggcacucgaucucacaggugcc

SEQ ID NO: 176623 - RNA, 18 nt, Pseudomonas putida KT2440
ggguccgaacagugcucg

SEQ ID NO: 176624 - RNA, 17 nt, Pseudomonas putida KT2440
uguggcgcuggcuggac

SEQ ID NO: 176625 - RNA, 22 nt, Pseudomonas putida KT2440
gccagguuggcaaggcguugcu

SEQ ID NO: 176626 - RNA, 22 nt, Pseudomonas putida KT2440
gccguaccugcacagggccuug

SEQ ID NO: 176627 - RNA, 22 nt, Pseudomonas putida KT2440
cuucggucgcgugcugucggcc

SEQ ID NO: 176628 - RNA, 22 nt, Pseudomonas putida KT2440
cgagcgcagcaggcccuuggcc

SEQ ID NO: 176629 - RNA, 22 nt, Pseudomonas putida KT2440
gagcggguuuacccgcgaaagg

SEQ ID NO: 176630 - RNA, 22 nt, Pseudomonas putida KT2440
gcaggcugcaacgguuuuccaa

SEQ ID NO: 176631 - RNA, 22 nt, Pseudomonas putida KT2440
cugugcaggcguguuagccgug

SEQ ID NO: 176632 - RNA, 22 nt, Pseudomonas putida KT2440
cugcagcagccuggcggcggca

SEQ ID NO: 176633 - RNA, 23 nt, Pseudomonas putida KT2440
ugugccagcuuguagugaagggg

SEQ ID NO: 176634 - RNA, 22 nt, Pseudomonas putida KT2440
gcacugcaagcaucgagcugaa

SEQ ID NO: 176635 - RNA, 19 nt, Pseudomonas putida KT2440
ugggugccgccacgcuggu

SEQ ID NO: 176636 - RNA, 22 nt, Pseudomonas putida KT2440
cuucaagcugcaagaaaaagca

SEQ ID NO: 176637 - RNA, 22 nt, Pseudomonas putida KT2440
cugcugaagaaaaauccgaacg

SEQ ID NO: 176638 - RNA, 22 nt, Pseudomonas putida KT2440
gugcgccugaaggcggcggugu

SEQ ID NO: 176639 - RNA, 22 nt, Pseudomonas putida KT2440
gggucguacaguucgaucaguu

SEQ ID NO: 176640 - RNA, 22 nt, Pseudomonas putida KT2440
gcacaugucauccacaaguccu

SEQ ID NO: 176641 - RNA, 22 nt, Pseudomonas putida KT2440
accgggcuggugguguaagcga

SEQ ID NO: 176642 - RNA, 22 nt, Pseudomonas putida KT2440
gugaaaccaaacgcuugcaagc

SEQ ID NO: 176643 - RNA, 22 nt, Pseudomonas putida KT2440
ugcugagcaaggccgggcucga

SEQ ID NO: 176644 - RNA, 22 nt, Pseudomonas putida KT2440
aagcugcacgccggcgguaagu

SEQ ID NO: 176645 - RNA, 22 nt, Pseudomonas putida KT2440
ugcccgaccaggccgcccaguu

SEQ ID NO: 176646 - RNA, 22 nt, Pseudomonas putida KT2440
agaacacucgagcgcagcgcuc

SEQ ID NO: 176647 - RNA, 22 nt, Pseudomonas putida KT2440
acgacggcuuguagcgguucgg

SEQ ID NO: 176648 - RNA, 22 nt, Pseudomonas putida KT2440
ucggccuuggcagugguguaga

SEQ ID NO: 176649 - RNA, 22 nt, Pseudomonas putida KT2440
ccagguacagcaccgcacccgc

SEQ ID NO: 176650 - RNA, 22 nt, Pseudomonas putida KT2440
cacugcuucagaguucgcgcuu

SEQ ID NO: 176651 - RNA, 22 nt, Pseudomonas putida KT2440
acccgcgaacaccggcgcagcc

SEQ ID NO: 176652 - RNA, 22 nt, Pseudomonas putida KT2440
ucuuucagccggacccggccug

SEQ ID NO: 176653 - RNA, 19 nt, Pseudomonas putida KT2440
uugaaggcacccagucgau

SEQ ID NO: 176654 - RNA, 22 nt, Pseudomonas putida KT2440
accugacccucgugggugagcg

SEQ ID NO: 176655 - RNA, 22 nt, Pseudomonas putida KT2440
ucugcgaagggcugaggaauug

SEQ ID NO: 176656 - RNA, 22 nt, Pseudomonas putida KT2440
ugcuggacaugcuggacgaagu

SEQ ID NO: 176657 - RNA, 22 nt, Pseudomonas putida KT2440
cggcugauggcgcuggcgcauu

SEQ ID NO: 176658 - RNA, 22 nt, Pseudomonas putida KT2440
cggguaaacccgcuccuacagg

SEQ ID NO: 176659 - RNA, 22 nt, Pseudomonas putida KT2440
gugcggaacugcgcgccaaggc

SEQ ID NO: 176660 - RNA, 22 nt, Pseudomonas putida KT2440
gcccuuguagugcuccaggucg

SEQ ID NO: 176661 - RNA, 22 nt, Pseudomonas putida KT2440
cgaugcucuggagucggccuuu

SEQ ID NO: 176662 - RNA, 22 nt, Pseudomonas putida KT2440
ugugcaaugccugugggagcgg

SEQ ID NO: 176663 - RNA, 22 nt, Pseudomonas putida KT2440
acuugcagacguauuccugagu

SEQ ID NO: 176664 - RNA, 22 nt, Pseudomonas putida KT2440
gcagcacggugaggaucacauc

SEQ ID NO: 176665 - RNA, 22 nt, Pseudomonas putida KT2440
gaccugggaaaaugcucagcug

SEQ ID NO: 176666 - RNA, 19 nt, Pseudomonas putida KT2440
auggcaccgacacccgcga

SEQ ID NO: 176667 - RNA, 22 nt, Pseudomonas putida KT2440
uugcgcccugccugugggagcg

SEQ ID NO: 176668 - RNA, 22 nt, Pseudomonas putida KT2440
ggugccugcguaggaacggguc

SEQ ID NO: 176669 - RNA, 22 nt, Pseudomonas putida KT2440
ugagcguagcagugaggcggcg

SEQ ID NO: 176670 - RNA, 18 nt, Pseudomonas putida KT2440
ucagguacacgcgaggcg

SEQ ID NO: 176671 - RNA, 22 nt, Pseudomonas putida KT2440
uauccaucgcccuggcucaggg

SEQ ID NO: 176672 - RNA, 22 nt, Pseudomonas putida KT2440
aaggcgucgaucacgguguuac

SEQ ID NO: 176673 - RNA, 22 nt, Pseudomonas putida KT2440
ggucggucaagucguccgcagg

SEQ ID NO: 176674 - RNA, 22 nt, Pseudomonas putida KT2440
ucaucgguguuuugcgccaugg

SEQ ID NO: 176675 - RNA, 22 nt, Pseudomonas putida KT2440
gcugguucaucgacuggaugcu

SEQ ID NO: 176676 - RNA, 22 nt, Pseudomonas putida KT2440
cggucugcugcuggcgcggccu

SEQ ID NO: 176677 - RNA, 22 nt, Pseudomonas putida KT2440
ccgcuguuggaugucaugcaga

SEQ ID NO: 176678 - RNA, 22 nt, Pseudomonas putida KT2440
ccuggaugaagucgagcucgcu

SEQ ID NO: 176679 - RNA, 22 nt, Pseudomonas putida KT2440
agcacggccagguggucgguga

SEQ ID NO: 176680 - RNA, 22 nt, Pseudomonas putida KT2440
ucucuacagcguugacaggcau

SEQ ID NO: 176681 - RNA, 22 nt, Pseudomonas putida KT2440
cgccaugguugaagcugcaccu

SEQ ID NO: 176682 - RNA, 23 nt, Pseudomonas putida KT2440
ucgcgucgguacaugugccacuc

SEQ ID NO: 176683 - RNA, 21 nt, Pseudomonas putida KT2440
ugaucgcgcacagccagcuuu

SEQ ID NO: 176684 - RNA, 19 nt, Pseudomonas putida KT2440
ugaucgcugacgugauucc

SEQ ID NO: 176685 - RNA, 22 nt, Pseudomonas putida KT2440
ucggcauugucguuaucggcca

SEQ ID NO: 176686 - RNA, 22 nt, Pseudomonas putida KT2440
uugcccgcucgcgcgacaagcu

SEQ ID NO: 176687 - RNA, 22 nt, Pseudomonas putida KT2440
agcaccuugcgcgucagccuca

SEQ ID NO: 176688 - RNA, 22 nt, Pseudomonas putida KT2440
gacugccaggccucaagccucg

SEQ ID NO: 176689 - RNA, 22 nt, Pseudomonas putida KT2440
uuccugguggccggcucggugu

SEQ ID NO: 176690 - RNA, 23 nt, Pseudomonas putida KT2440
cagcucgucggaagggcgcuugg

SEQ ID NO: 176691 - RNA, 22 nt, Pseudomonas putida KT2440
uggacaacguauuugacuucga

SEQ ID NO: 176692 - RNA, 22 nt, Pseudomonas putida KT2440
cgccguguaacaguugcuucuc

SEQ ID NO: 176693 - RNA, 22 nt, Pseudomonas putida KT2440
caugaugacuaaaaacauccua

SEQ ID NO: 176694 - RNA, 22 nt, Pseudomonas putida KT2440
cgcugcuggucauccuucaugg

SEQ ID NO: 176695 - RNA, 17 nt, Pseudomonas putida KT2440
caccaugcucgcugccc

SEQ ID NO: 176696 - RNA, 22 nt, Pseudomonas putida KT2440
aucacucaucgaaucaggcgga

SEQ ID NO: 176697 - RNA, 22 nt, Pseudomonas putida KT2440
ucaguucauugccccggcagcu

SEQ ID NO: 176698 - RNA, 22 nt, Pseudomonas putida KT2440
ucguggauuuccagcgugccgu

SEQ ID NO: 176699 - RNA, 22 nt, Pseudomonas putida KT2440
gugaccguguaggagcggguuu

SEQ ID NO: 176700 - RNA, 22 nt, Pseudomonas putida KT2440
gacaucgcgcuggaugccgaug

SEQ ID NO: 176701 - RNA, 22 nt, Pseudomonas putida KT2440
gcgaagccaaagaugccgagca

SEQ ID NO: 176702 - RNA, 21 nt, Pseudomonas putida KT2440
ugcucgaucaacgccgcaugc

SEQ ID NO: 176703 - RNA, 22 nt, Pseudomonas putida KT2440
cggugaagaaccugugggggcg

SEQ ID NO: 176704 - RNA, 22 nt, Pseudomonas putida KT2440
cugcggcaggcgcucuagugcg

SEQ ID NO: 176705 - RNA, 22 nt, Pseudomonas putida KT2440
accugagcacgagacgaaaaau

SEQ ID NO: 176706 - RNA, 22 nt, Pseudomonas putida KT2440
ugagccugcccggucgggucaa

SEQ ID NO: 176707 - RNA, 22 nt, Pseudomonas putida KT2440
uccaucugcacaucaggauguc

SEQ ID NO: 176708 - RNA, 22 nt, Pseudomonas putida KT2440
cgaugcagcgauuggcgguggu

SEQ ID NO: 176709 - RNA, 22 nt, Pseudomonas putida KT2440
ugaugaaaacccucgggcaguu

SEQ ID NO: 176710 - RNA, 22 nt, Pseudomonas putida KT2440
cgcucccacagggaccucacag

SEQ ID NO: 176711 - RNA, 22 nt, Pseudomonas putida KT2440
aaggacgugggcaucgaccaga

SEQ ID NO: 176712 - RNA, 22 nt, Pseudomonas putida KT2440
gaacaacgcgguugucguuggc

SEQ ID NO: 176713 - RNA, 22 nt, Pseudomonas putida KT2440
ucgccaugcuggaggagggggu

SEQ ID NO: 176714 - RNA, 22 nt, Pseudomonas putida KT2440
uaggugaucacgccgccuucgg

SEQ ID NO: 176715 - RNA, 22 nt, Pseudomonas putida KT2440
cgcauucacagguaaacccgcg

SEQ ID NO: 176716 - RNA, 22 nt, Pseudomonas putida KT2440
ccaggguauugagcaggccacg

SEQ ID NO: 176717 - RNA, 22 nt, Pseudomonas putida KT2440
cuggaacacgaacccgaaggcc

SEQ ID NO: 176718 - RNA, 22 nt, Pseudomonas putida KT2440
ucagcuugaggcaugugcuguc

SEQ ID NO: 176719 - RNA, 22 nt, Pseudomonas putida KT2440
agccuugucgcgcucgcccggg

SEQ ID NO: 176720 - RNA, 22 nt, Pseudomonas putida KT2440
ugcaggccguuggugcggauuu

SEQ ID NO: 176721 - RNA, 22 nt, Pseudomonas putida KT2440
cugcgcagcuguucaccggccu

SEQ ID NO: 176722 - RNA, 22 nt, Pseudomonas putida KT2440
uguccggcuaccugagccgggg

SEQ ID NO: 176723 - RNA, 22 nt, Pseudomonas putida KT2440
uagcauggucauuccgcuggcg

SEQ ID NO: 176724 - RNA, 22 nt, Pseudomonas putida KT2440
ucacgcacaagcugcugaccag

SEQ ID NO: 176725 - RNA, 22 nt, Pseudomonas putida KT2440
acugaaggccaagcaggacggc

SEQ ID NO: 176726 - RNA, 22 nt, Pseudomonas putida KT2440
agcgcagcgguggacuccugca

SEQ ID NO: 176727 - RNA, 22 nt, Pseudomonas putida KT2440
ucauggcuucucuccuggguaa

SEQ ID NO: 176728 - RNA, 22 nt, Pseudomonas putida KT2440
ggcaugcacgagcaggguggcc

SEQ ID NO: 176729 - RNA, 22 nt, Pseudomonas putida KT2440
aggccguaggaguacgccagca

SEQ ID NO: 176730 - RNA, 22 nt, Pseudomonas putida KT2440
aauaccugugggagcgggcaag

SEQ ID NO: 176731 - RNA, 22 nt, Pseudomonas putida KT2440
cgcgaagaggccagacaggcaa

SEQ ID NO: 176732 - RNA, 22 nt, Pseudomonas putida KT2440
ugucucgcgaugaccugaucug

SEQ ID NO: 176733 - RNA, 22 nt, Pseudomonas putida KT2440
aucgagagcuggcucaaugacu

SEQ ID NO: 176734 - RNA, 22 nt, Pseudomonas putida KT2440
ugguaggagcggguucacccgc

SEQ ID NO: 176735 - RNA, 22 nt, Pseudomonas putida KT2440
gccgguguacguacaaccgccu

SEQ ID NO: 176736 - RNA, 22 nt, Pseudomonas putida KT2440
aaauagcacaccgagcagugua

SEQ ID NO: 176737 - RNA, 22 nt, Pseudomonas putida KT2440
aggugcucgaugaucaucccgg

SEQ ID NO: 176738 - RNA, 22 nt, Pseudomonas putida KT2440
guucgucgcuggcgcgcaaggc

SEQ ID NO: 176739 - RNA, 21 nt, Pseudomonas putida KT2440
aucgcagcuagggagcggcca

SEQ ID NO: 176740 - RNA, 22 nt, Pseudomonas putida KT2440
gguacgugcguagcgggcaucu

SEQ ID NO: 176741 - RNA, 22 nt, Pseudomonas putida KT2440
gaugucgaacagguaguccagg

SEQ ID NO: 176742 - RNA, 22 nt, Pseudomonas putida KT2440
aucgacaaggcccgugagcgca

SEQ ID NO: 176743 - RNA, 22 nt, Pseudomonas putida KT2440
cugcugcuggaaugggcggcca

SEQ ID NO: 176744 - RNA, 22 nt, Pseudomonas putida KT2440
ugggcgauccagcgcaauucgc

SEQ ID NO: 176745 - RNA, 22 nt, Pseudomonas putida KT2440
ucuggucuucguugcgcaggcu

SEQ ID NO: 176746 - RNA, 19 nt, Pseudomonas putida KT2440
cgcuuccgacaggcacggc

SEQ ID NO: 176747 - RNA, 22 nt, Pseudomonas putida KT2440
gcgcgcuauguggaugagcguu

SEQ ID NO: 176748 - RNA, 22 nt, Pseudomonas putida KT2440
gugucggcguucuucaucagcu

SEQ ID NO: 176749 - RNA, 22 nt, Pseudomonas putida KT2440
cugguugcguucgucgaugucu

SEQ ID NO: 176750 - RNA, 19 nt, Pseudomonas putida KT2440
agcuggugcccuggucggc

SEQ ID NO: 176751 - RNA, 22 nt, Pseudomonas putida KT2440
ggcaugaugcaccugugagagc

SEQ ID NO: 176752 - RNA, 22 nt, Pseudomonas putida KT2440
ugaugucggagaacagcagcuu

SEQ ID NO: 176753 - RNA, 22 nt, Pseudomonas putida KT2440
gccaggucacugagcagcuggg

SEQ ID NO: 176754 - RNA, 22 nt, Pseudomonas putida KT2440
gugccguuggccggcacgguga

SEQ ID NO: 176755 - RNA, 22 nt, Pseudomonas putida KT2440
auggccuggucggcggucggca

SEQ ID NO: 176756 - RNA, 22 nt, Pseudomonas putida KT2440
cgcggguuaacccgcgccuaca

SEQ ID NO: 176757 - RNA, 22 nt, Pseudomonas putida KT2440
uuggccugaaucuucgcggcga

SEQ ID NO: 176758 - RNA, 21 nt, Pseudomonas putida KT2440
uggcaccauugccgcccugcu

SEQ ID NO: 176759 - RNA, 22 nt, Pseudomonas putida KT2440
agcccgcuccuacaacgaucug

SEQ ID NO: 176760 - RNA, 20 nt, Pseudomonas putida KT2440
gcaccgacggucaagguggc

SEQ ID NO: 176761 - RNA, 22 nt, Pseudomonas putida KT2440
ugcagcaguucuuccaugcgcu

SEQ ID NO: 176762 - RNA, 22 nt, Pseudomonas putida KT2440
cagcucucacaggugcaucaug

SEQ ID NO: 176763 - RNA, 22 nt, Pseudomonas putida KT2440
ucgaggugucguccugcagaac

SEQ ID NO: 176764 - RNA, 22 nt, Pseudomonas putida KT2440
ggucaacggugugucgcugcgc

SEQ ID NO: 176765 - RNA, 23 nt, Pseudomonas putida KT2440
ucgcuggacgaagugcgcaccgc

SEQ ID NO: 176766 - RNA, 22 nt, Pseudomonas putida KT2440
uguaggagcggguucacccgcg

SEQ ID NO: 176767 - RNA, 22 nt, Pseudomonas putida KT2440
uguaggcgcggguuaacccgcg

SEQ ID NO: 176768 - RNA, 22 nt, Pseudomonas putida KT2440
ugaccuugggugagcggggcgg

SEQ ID NO: 176769 - RNA, 22 nt, Pseudomonas putida KT2440
uuuggacgaucccaacagguga

SEQ ID NO: 176770 - RNA, 22 nt, Pseudomonas putida KT2440
accgggcagucgguguggcgcu

SEQ ID NO: 176771 - RNA, 22 nt, Pseudomonas putida KT2440
cggguaaacccgcuccuacaca

SEQ ID NO: 176772 - RNA, 22 nt, Pseudomonas putida KT2440
uggcccuuggcgagcaucuggg

SEQ ID NO: 176773 - RNA, 22 nt, Pseudomonas putida KT2440
augcccgccggggucagccaug

SEQ ID NO: 176774 - RNA, 22 nt, Pseudomonas putida KT2440
ccuuuagcgggcgcgcccgcuc

SEQ ID NO: 176775 - RNA, 22 nt, Pseudomonas putida KT2440
agccgcuccuacaggggcugca

SEQ ID NO: 176776 - RNA, 22 nt, Pseudomonas putida KT2440
uauccgcgucgagggcgugcgg

SEQ ID NO: 176777 - RNA, 22 nt, Pseudomonas putida KT2440
uucggccugcaacaucgccagg

SEQ ID NO: 176778 - RNA, 22 nt, Pseudomonas putida KT2440
agguaacggcuaucgcggcuac

SEQ ID NO: 176779 - RNA, 22 nt, Pseudomonas putida KT2440
uguagugcaucagguucguugc

SEQ ID NO: 176780 - RNA, 22 nt, Pseudomonas putida KT2440
uccagggugcgcgcagucgcuu

SEQ ID NO: 176781 - RNA, 22 nt, Pseudomonas putida KT2440
cuggccguugcugcgugugucc

SEQ ID NO: 176782 - RNA, 19 nt, Pseudomonas putida KT2440
cugcucgucgcucaguggu

SEQ ID NO: 176783 - RNA, 22 nt, Pseudomonas putida KT2440
uucgcagcaccagacugccccg

SEQ ID NO: 176784 - RNA, 22 nt, Pseudomonas putida KT2440
cagugccagugccgccgggccg

SEQ ID NO: 176785 - RNA, 22 nt, Pseudomonas putida KT2440
gugacccguguaggagcggguu

SEQ ID NO: 176786 - RNA, 23 nt, Pseudomonas putida KT2440
ucgggcaugugaucacccagggc

SEQ ID NO: 176787 - RNA, 22 nt, Pseudomonas putida KT2440
uacgcggguaaacccgcuccua

SEQ ID NO: 176788 - RNA, 23 nt, Pseudomonas putida KT2440
ucgaugcuaaacagcgugaagcc

SEQ ID NO: 176789 - RNA, 22 nt, Pseudomonas putida KT2440
cgugacgcuucaugguuggcuc

SEQ ID NO: 176790 - RNA, 22 nt, Pseudomonas putida KT2440
gggcugacgcgauucugcucga

SEQ ID NO: 176791 - RNA, 22 nt, Pseudomonas putida KT2440
ccagugcugcguucauggcuuc

SEQ ID NO: 176792 - RNA, 22 nt, Pseudomonas putida KT2440
uucgaaguacuggcuaccaacg

SEQ ID NO: 176793 - RNA, 18 nt, Pseudomonas putida KT2440
uggccauggccuugcgac

SEQ ID NO: 176794 - RNA, 22 nt, Pseudomonas putida KT2440
uccagcacguugcugucggugg

SEQ ID NO: 176795 - RNA, 22 nt, Pseudomonas putida KT2440
cccgcgaacaccggcaaugccg

SEQ ID NO: 176796 - RNA, 22 nt, Pseudomonas putida KT2440
cgggcucaaugcguuccaagau

SEQ ID NO: 176797 - RNA, 22 nt, Pseudomonas putida KT2440
agucggcgaaugcuuuucuaga

SEQ ID NO: 176798 - RNA, 22 nt, Pseudomonas putida KT2440
gccacuguucaucgucauugug

SEQ ID NO: 176799 - RNA, 22 nt, Pseudomonas putida KT2440
uugacgaagucagcaaaaagga

SEQ ID NO: 176800 - RNA, 22 nt, Pseudomonas putida KT2440
aggccguagaucaggucgaggu

SEQ ID NO: 176801 - RNA, 22 nt, Pseudomonas putida KT2440
uuucgccggccaccagcagcuc

SEQ ID NO: 176802 - RNA, 22 nt, Pseudomonas putida KT2440
aauccgcuccuacaggcgcgga

SEQ ID NO: 176803 - RNA, 22 nt, Pseudomonas putida KT2440
ucgcguugaugggccaagcggc

SEQ ID NO: 176804 - RNA, 22 nt, Pseudomonas putida KT2440
gcggguaaacccgcuccuacaa

SEQ ID NO: 176805 - RNA, 22 nt, Pseudomonas putida KT2440
gaggcgguagccgcgaaugaac

SEQ ID NO: 176806 - RNA, 20 nt, Pseudomonas putida KT2440
ggguuacccgcgaagaggcc

SEQ ID NO: 176807 - RNA, 22 nt, Pseudomonas putida KT2440
ggcaucgucgaccugugcgggc

SEQ ID NO: 176808 - RNA, 22 nt, Pseudomonas putida KT2440
gcgcugugacgaccugcuggcg

SEQ ID NO: 176809 - RNA, 22 nt, Pseudomonas putida KT2440
ccgacagacgcacgaugaccuu

SEQ ID NO: 176810 - RNA, 22 nt, Pseudomonas putida KT2440
ucuucgcgggcaagcccgcucc

SEQ ID NO: 176811 - RNA, 22 nt, Pseudomonas putida KT2440
uucaaacuuucgcaaaugcuug

SEQ ID NO: 176812 - RNA, 21 nt, Pseudomonas putida KT2440
gcgcuguacauugacgaucgc

SEQ ID NO: 176813 - RNA, 22 nt, Pseudomonas putida KT2440
ucgccgacgucgagaaaggcau

SEQ ID NO: 176814 - RNA, 22 nt, Pseudomonas putida KT2440
ugucagcuggccgugcuguuga

SEQ ID NO: 176815 - RNA, 22 nt, Pseudomonas putida KT2440
gucgccuaugccggacgcaagc

SEQ ID NO: 176816 - RNA, 22 nt, Pseudomonas putida KT2440
ggcaucgaccugggccggggua

SEQ ID NO: 176817 - RNA, 22 nt, Pseudomonas putida KT2440
cgcauagggcucuuggccguug

SEQ ID NO: 176818 - RNA, 22 nt, Pseudomonas putida KT2440
uccagcaccugcugcuggccga

SEQ ID NO: 176819 - RNA, 22 nt, Pseudomonas putida KT2440
uggaugccucgccaugcgcuug

SEQ ID NO: 176820 - RNA, 22 nt, Pseudomonas putida KT2440
ugcgagacaccugugggagcgg

SEQ ID NO: 176821 - RNA, 22 nt, Pseudomonas putida KT2440
ugcguuccuuggcguggaugac

SEQ ID NO: 176822 - RNA, 19 nt, Pseudomonas putida KT2440
ugcugcuggugggcaaggc

SEQ ID NO: 176823 - RNA, 22 nt, Pseudomonas putida KT2440
ggccaguucgucgcuguccagc

SEQ ID NO: 176824 - RNA, 18 nt, Pseudomonas putida KT2440
auggagccgaucaugcgc

SEQ ID NO: 176825 - RNA, 22 nt, Pseudomonas putida KT2440
ggucacggcacuguuggccgag

SEQ ID NO: 176826 - RNA, 22 nt, Pseudomonas putida KT2440
accgggugcucaggaaagugca

SEQ ID NO: 176827 - RNA, 20 nt, Pseudomonas putida KT2440
gcagugucagcuuuggcgcc

SEQ ID NO: 176828 - RNA, 21 nt, Pseudomonas putida KT2440
acuggcgcgcuugccggcugg

SEQ ID NO: 176829 - RNA, 22 nt, Pseudomonas putida KT2440
gccuggaucaguucggcgaugg

SEQ ID NO: 176830 - RNA, 22 nt, Pseudomonas putida KT2440
gcggcgaucuucaccgaaaugu

SEQ ID NO: 176831 - RNA, 22 nt, Pseudomonas putida KT2440
uccuggcuuugcggcgugguuc

SEQ ID NO: 176832 - RNA, 22 nt, Pseudomonas putida KT2440
guaccgagcacguuguugccgg

SEQ ID NO: 176833 - RNA, 22 nt, Pseudomonas putida KT2440
cugcgcgaucacugugggagcg

SEQ ID NO: 176834 - RNA, 22 nt, Pseudomonas putida KT2440
accucgggaauggucguaucgu

SEQ ID NO: 176835 - RNA, 22 nt, Pseudomonas putida KT2440
guccgccauggcgaagcggggu

SEQ ID NO: 176836 - RNA, 22 nt, Pseudomonas putida KT2440
acuggcccuccgcgugcgguac

SEQ ID NO: 176837 - RNA, 22 nt, Pseudomonas putida KT2440
agcgccgagaagaacagcucca

SEQ ID NO: 176838 - RNA, 22 nt, Pseudomonas putida KT2440
ggucgcugcugaucagcugggu

SEQ ID NO: 176839 - RNA, 22 nt, Pseudomonas putida KT2440
uucgcggacacgcccgcuccca

SEQ ID NO: 176840 - RNA, 22 nt, Pseudomonas putida KT2440
cgcguuggauucuucgcgggca

SEQ ID NO: 176841 - RNA, 22 nt, Pseudomonas putida KT2440
ucguaggagcggguuuacccgc

SEQ ID NO: 176842 - RNA, 22 nt, Pseudomonas putida KT2440
uuaccguguggggccauucgau

SEQ ID NO: 176843 - RNA, 22 nt, Pseudomonas putida KT2440
cucaccgccaucgcugauggcc

SEQ ID NO: 176844 - RNA, 22 nt, Pseudomonas putida KT2440
guugccgcacaggccuugcggg

SEQ ID NO: 176845 - RNA, 22 nt, Pseudomonas putida KT2440
acuggccagugauuucgcaccg

SEQ ID NO: 176846 - RNA, 22 nt, Pseudomonas putida KT2440
ugcacgucgccgaugaugucaa

SEQ ID NO: 176847 - RNA, 20 nt, Pseudomonas putida KT2440
cgcacugcuggcccaaggca

SEQ ID NO: 176848 - RNA, 19 nt, Pseudomonas putida KT2440
gcugcaggggcaccacagc

SEQ ID NO: 176849 - RNA, 22 nt, Pseudomonas putida KT2440
cuuucgcggguaaacccgcucc

SEQ ID NO: 176850 - RNA, 22 nt, Pseudomonas putida KT2440
uugccggugucggucagcacga

SEQ ID NO: 176851 - RNA, 22 nt, Pseudomonas putida KT2440
ucggcuuggcgcuugcuggugu

SEQ ID NO: 176852 - RNA, 22 nt, Pseudomonas putida KT2440
uugccuguaccagcccuuucgc

SEQ ID NO: 176853 - RNA, 22 nt, Pseudomonas putida KT2440
gcagcgacuacugcugcguugg

SEQ ID NO: 176854 - RNA, 22 nt, Pseudomonas putida KT2440
uggcucaggcugccauccgugc

SEQ ID NO: 176855 - RNA, 22 nt, Pseudomonas putida KT2440
uccugaucgcgaccaugaccua

SEQ ID NO: 176856 - RNA, 22 nt, Pseudomonas putida KT2440
ggcgugcaaauaucucuaacga

SEQ ID NO: 176857 - RNA, 18 nt, Pseudomonas putida KT2440
agcguagcggugcgcgcc

SEQ ID NO: 176858 - RNA, 22 nt, Pseudomonas putida KT2440
gguccagcacaccggcagcucu

SEQ ID NO: 176859 - RNA, 22 nt, Pseudomonas putida KT2440
gcauucgcgggcaagcccgcuc

SEQ ID NO: 176860 - RNA, 22 nt, Pseudomonas putida KT2440
gcgcaugcugcuuggucacgaa

SEQ ID NO: 176861 - RNA, 22 nt, Pseudomonas putida KT2440
auggugcggcauugcucggggc

SEQ ID NO: 176862 - RNA, 22 nt, Pseudomonas putida KT2440
gcuuccaucuuggcgacggugu

SEQ ID NO: 176863 - RNA, 20 nt, Pseudomonas putida KT2440
cuguagccugcuuguuaugc

SEQ ID NO: 176864 - RNA, 22 nt, Pseudomonas putida KT2440
uugcgcgaguuugccgcacugu

SEQ ID NO: 176865 - RNA, 22 nt, Pseudomonas putida KT2440
ugacgcuaccccuguaggagcg

SEQ ID NO: 176866 - RNA, 22 nt, Pseudomonas putida KT2440
uucgagcagcuugcgggccacg

SEQ ID NO: 176867 - RNA, 22 nt, Pseudomonas putida KT2440
cauuggcgagcuuguucgauuu

SEQ ID NO: 176868 - RNA, 22 nt, Pseudomonas putida KT2440
agccgugggucggugaacaucu

SEQ ID NO: 176869 - RNA, 22 nt, Pseudomonas putida KT2440
ucucgcuaaaauugugcaguug

SEQ ID NO: 176870 - RNA, 22 nt, Pseudomonas putida KT2440
ggcggugauggucgagcuguuc

SEQ ID NO: 176871 - RNA, 22 nt, Pseudomonas putida KT2440
aagcggcuggaggauggcagcg

SEQ ID NO: 176872 - RNA, 22 nt, Pseudomonas putida KT2440
cugugagccgcccguggugcgg

SEQ ID NO: 176873 - RNA, 22 nt, Pseudomonas putida KT2440
uggcgucggcggucaaucgcuu

SEQ ID NO: 176874 - RNA, 22 nt, Pseudomonas putida KT2440
cgcucccacagggucggcguau

SEQ ID NO: 176875 - RNA, 22 nt, Pseudomonas putida KT2440
gcuguucaaggcuguuguagcu

SEQ ID NO: 176876 - RNA, 22 nt, Pseudomonas putida KT2440
accuuggccaaucgcugucgcu

SEQ ID NO: 176877 - RNA, 22 nt, Pseudomonas putida KT2440
gcuucgccgauuuucagcgggu

SEQ ID NO: 176878 - RNA, 21 nt, Pseudomonas putida KT2440
gaucugucauucguuuggcug

SEQ ID NO: 176879 - RNA, 22 nt, Pseudomonas putida KT2440
ccggcguuuucggcgacguugc

SEQ ID NO: 176880 - RNA, 22 nt, Pseudomonas putida KT2440
ugcagcguuuuaucugguacug

SEQ ID NO: 176881 - RNA, 22 nt, Pseudomonas putida KT2440
gaugcgcgacauuuucggcgcg

SEQ ID NO: 176882 - RNA, 22 nt, Pseudomonas putida KT2440
cucaccgaaguauucgauaagg

SEQ ID NO: 176883 - RNA, 22 nt, Pseudomonas putida KT2440
acggugaacaccgggaaacugu

SEQ ID NO: 176884 - RNA, 22 nt, Pseudomonas putida KT2440
uucaccguugaacugcaucagg

SEQ ID NO: 176885 - RNA, 21 nt, Pseudomonas putida KT2440
ucuccgcgcgcagcauugccg

SEQ ID NO: 176886 - RNA, 22 nt, Pseudomonas putida KT2440
gcaucgugaauaucuccaguuc

SEQ ID NO: 176887 - RNA, 22 nt, Pseudomonas putida KT2440
agaccgcugcugccacagggug

SEQ ID NO: 176888 - RNA, 22 nt, Pseudomonas putida KT2440
uuaccggacuccaguagccaga

SEQ ID NO: 176889 - RNA, 22 nt, Pseudomonas putida KT2440
gucgcugaugcguucgccggug

SEQ ID NO: 176890 - RNA, 22 nt, Pseudomonas putida KT2440
cuacgcaucgacuggucgucca

SEQ ID NO: 176891 - RNA, 22 nt, Pseudomonas putida KT2440
auucgcgggcuugcucgcuccc

SEQ ID NO: 176892 - RNA, 22 nt, Pseudomonas putida KT2440
ucgaacaccgccggcucgcccu

SEQ ID NO: 176893 - RNA, 22 nt, Pseudomonas putida KT2440
aacgugcguccaugaaguugcg

SEQ ID NO: 176894 - RNA, 22 nt, Pseudomonas putida KT2440
gcagacgccuccugagggcugc

SEQ ID NO: 176895 - RNA, 22 nt, Pseudomonas putida KT2440
cgcggguaaacccgauccuaca

SEQ ID NO: 176896 - RNA, 22 nt, Pseudomonas putida KT2440
uguaggcgcggguuugcccgcg

SEQ ID NO: 176897 - RNA, 22 nt, Pseudomonas putida KT2440
ucgaggaugcgcgguacaucug

SEQ ID NO: 176898 - RNA, 22 nt, Pseudomonas putida KT2440
aggugucgcguuccugcuguga

SEQ ID NO: 176899 - RNA, 22 nt, Pseudomonas putida KT2440
uugcgcuguaccugugggagcg

SEQ ID NO: 176900 - RNA, 22 nt, Pseudomonas putida KT2440
ugacucgaggcagggucaccuu

SEQ ID NO: 176901 - RNA, 23 nt, Pseudomonas putida KT2440
ccugauccugcugaccgagcgcc

SEQ ID NO: 176902 - RNA, 22 nt, Pseudomonas putida KT2440
ggcucaccgaagcguuccagug

SEQ ID NO: 176903 - RNA, 22 nt, Pseudomonas putida KT2440
cgcggguaaacccgcuccugcg

SEQ ID NO: 176904 - RNA, 22 nt, Pseudomonas putida KT2440
uaccugaccacacgcggaucug

SEQ ID NO: 176905 - RNA, 22 nt, Pseudomonas putida KT2440
ucgucggugaugaucucgaugu

SEQ ID NO: 176906 - RNA, 22 nt, Pseudomonas putida KT2440
ccaguacugcucgaugaacagu

SEQ ID NO: 176907 - RNA, 22 nt, Pseudomonas putida KT2440
ggugaagcagguucgcgugucg

SEQ ID NO: 176908 - RNA, 22 nt, Pseudomonas putida KT2440
gccaucaagguggcugggggcg

SEQ ID NO: 176909 - RNA, 22 nt, Pseudomonas putida KT2440
gcuucgucgaugucguggcuga

SEQ ID NO: 176910 - RNA, 22 nt, Pseudomonas putida KT2440
gccagcaagguggguuaugccc

SEQ ID NO: 176911 - RNA, 22 nt, Pseudomonas putida KT2440
gugcaguugcaggccagguugc

SEQ ID NO: 176912 - RNA, 22 nt, Pseudomonas putida KT2440
uggucggcgaucaccgugaagu

SEQ ID NO: 176913 - RNA, 22 nt, Pseudomonas putida KT2440
uaggaggcgucaggaggucaug

SEQ ID NO: 176914 - RNA, 22 nt, Pseudomonas putida KT2440
aacccgcuccuacagggugcug

SEQ ID NO: 176915 - RNA, 22 nt, Pseudomonas putida KT2440
ugaccucacgcauucgcgggca

SEQ ID NO: 176916 - RNA, 22 nt, Pseudomonas putida KT2440
uucucggucgaucagcacgucc

SEQ ID NO: 176917 - RNA, 22 nt, Pseudomonas putida KT2440
cuguucgucgagaugccuucgu

SEQ ID NO: 176918 - RNA, 22 nt, Pseudomonas putida KT2440
gacgcuggucuuuagcggguau

SEQ ID NO: 176919 - RNA, 21 nt, Pseudomonas putida KT2440
uggagauguagucguuguugu

SEQ ID NO: 176920 - RNA, 22 nt, Pseudomonas putida KT2440
uggugccugcuucgcgggcaag

SEQ ID NO: 176921 - RNA, 22 nt, Pseudomonas putida KT2440
ccaugguguuuuucugcugguu

SEQ ID NO: 176922 - RNA, 22 nt, Pseudomonas putida KT2440
gccgauguuggcggcggcgaac

SEQ ID NO: 176923 - RNA, 22 nt, Pseudomonas putida KT2440
gucgcggugcaggcuggccagu

SEQ ID NO: 176924 - RNA, 22 nt, Pseudomonas putida KT2440
cgagauggucaacggcaauuuc

SEQ ID NO: 176925 - RNA, 22 nt, Pseudomonas putida KT2440
ggccaacaugggcaugaacguc

SEQ ID NO: 176926 - RNA, 22 nt, Pseudomonas putida KT2440
gggcgugacggcagugacuggc

SEQ ID NO: 176927 - RNA, 22 nt, Pseudomonas putida KT2440
aauugcuggggccgcuuugcgg

SEQ ID NO: 176928 - RNA, 22 nt, Pseudomonas putida KT2440
ugagcaggcugccaucggcacu

SEQ ID NO: 176929 - RNA, 22 nt, Pseudomonas putida KT2440
ugggagcgagcaagcccgcgaa

SEQ ID NO: 176930 - RNA, 22 nt, Pseudomonas putida KT2440
aaccugcacagugugcuuagcg

SEQ ID NO: 176931 - RNA, 22 nt, Pseudomonas putida KT2440
agccggugauuaccgacugacc

SEQ ID NO: 176932 - RNA, 22 nt, Pseudomonas putida KT2440
cgaugcccagcgccucggccug

SEQ ID NO: 176933 - RNA, 22 nt, Pseudomonas putida KT2440
uccgaugacgauaucuaccaga

SEQ ID NO: 176934 - RNA, 22 nt, Pseudomonas putida KT2440
gcuugccguuggcguugugcgg

SEQ ID NO: 176935 - RNA, 22 nt, Pseudomonas putida KT2440
guuccgcgacuacgccgccuac

SEQ ID NO: 176936 - RNA, 22 nt, Pseudomonas putida KT2440
uggcgagugaacuuuucggcgc

SEQ ID NO: 176937 - RNA, 22 nt, Pseudomonas putida KT2440
aggccuucaggccuucgaagca

SEQ ID NO: 176938 - RNA, 22 nt, Pseudomonas putida KT2440
gauggcggucaagccguucauc

SEQ ID NO: 176939 - RNA, 22 nt, Pseudomonas putida KT2440
ucgcgcucgaacuggaagcggu

SEQ ID NO: 176940 - RNA, 22 nt, Pseudomonas putida KT2440
gaugucggugaucgccacaccg

SEQ ID NO: 176941 - RNA, 22 nt, Pseudomonas putida KT2440
guucgucugcggguugcugaug

SEQ ID NO: 176942 - RNA, 19 nt, Pseudomonas putida KT2440
uugcccugaagcaggugcg

SEQ ID NO: 176943 - RNA, 22 nt, Pseudomonas putida KT2440
ugcuggcgcucgaugucggugg

SEQ ID NO: 176944 - RNA, 22 nt, Pseudomonas putida KT2440
ugguaggcggguuuacccgcga

SEQ ID NO: 176945 - RNA, 22 nt, Pseudomonas putida KT2440
ucgacgccgcuggugugcucgg

SEQ ID NO: 176946 - RNA, 22 nt, Pseudomonas putida KT2440
cgcuuugcggcucugugggggc

SEQ ID NO: 176947 - RNA, 22 nt, Pseudomonas putida KT2440
gucgccuugcaacguaccccac

SEQ ID NO: 176948 - RNA, 23 nt, Pseudomonas putida KT2440
uugagcaggaacagguugguaau

SEQ ID NO: 176949 - RNA, 22 nt, Pseudomonas putida KT2440
cgcgacuucgugcagcaggaua

SEQ ID NO: 176950 - RNA, 22 nt, Pseudomonas putida KT2440
ugaugcaguucaacggugaagg

SEQ ID NO: 176951 - RNA, 22 nt, Pseudomonas putida KT2440
cugcagugauccugugggagcg

SEQ ID NO: 176952 - RNA, 22 nt, Pseudomonas putida KT2440
uucacaggcuccuugcugaucg

SEQ ID NO: 176953 - RNA, 22 nt, Pseudomonas putida KT2440
cgcugcacagguauucgcguug

SEQ ID NO: 176954 - RNA, 22 nt, Pseudomonas putida KT2440
aguucgguaucggcacgcugcu

SEQ ID NO: 176955 - RNA, 22 nt, Pseudomonas putida KT2440
augggucaggucuucgaccaug

SEQ ID NO: 176956 - RNA, 22 nt, Pseudomonas putida KT2440
uucaggugcgcucggucagcgc

SEQ ID NO: 176957 - RNA, 22 nt, Pseudomonas putida KT2440
aaggguugcaacgcaaccccaa

SEQ ID NO: 176958 - RNA, 22 nt, Pseudomonas putida KT2440
uuccagcgcaguuacuuucucg

SEQ ID NO: 176959 - RNA, 22 nt, Pseudomonas putida KT2440
uaccguuggccggcacggugau

SEQ ID NO: 176960 - RNA, 22 nt, Pseudomonas putida KT2440
gaucgcauccaggucauccccu

SEQ ID NO: 176961 - RNA, 22 nt, Pseudomonas putida KT2440
gcaccugcggccaccucggugc

SEQ ID NO: 176962 - RNA, 22 nt, Pseudomonas putida KT2440
ccaguugaauggcccggcgguu

SEQ ID NO: 176963 - RNA, 22 nt, Pseudomonas putida KT2440
agcgcaagacucaggcugggcu

SEQ ID NO: 176964 - RNA, 22 nt, Pseudomonas putida KT2440
gugaaaugcaggguaaaaagaa

SEQ ID NO: 176965 - RNA, 22 nt, Pseudomonas putida KT2440
gcugccaucgagguggucguug

SEQ ID NO: 176966 - RNA, 22 nt, Pseudomonas putida KT2440
ucgggucugcccgcgcaggcgc

SEQ ID NO: 176967 - RNA, 21 nt, Pseudomonas putida KT2440
accagcgcgcgcagggccagc

SEQ ID NO: 176968 - RNA, 22 nt, Pseudomonas putida KT2440
uggccugccguucgacagugug

SEQ ID NO: 176969 - RNA, 22 nt, Pseudomonas putida KT2440
guggccacuggcauugucgggc

SEQ ID NO: 176970 - RNA, 22 nt, Pseudomonas putida KT2440
uucugggccgugcuguuucccu

SEQ ID NO: 176971 - RNA, 21 nt, Pseudomonas putida KT2440
auucgccaacgugacugccuc

SEQ ID NO: 176972 - RNA, 22 nt, Pseudomonas putida KT2440
ggcgguacaucaggucucgcca

SEQ ID NO: 176973 - RNA, 22 nt, Pseudomonas putida KT2440
ucgcacguaccgacgaucgcau

SEQ ID NO: 176974 - RNA, 22 nt, Pseudomonas putida KT2440
cauccagguccggcagcgugcc

SEQ ID NO: 176975 - RNA, 21 nt, Pseudomonas putida KT2440
cgcugcucacgacgcaggucu

SEQ ID NO: 176976 - RNA, 21 nt, Pseudomonas putida KT2440
cucaaucccucgcaucugugg

SEQ ID NO: 176977 - RNA, 22 nt, Pseudomonas putida KT2440
ccgggauugcccuggcggcggu

SEQ ID NO: 176978 - RNA, 22 nt, Pseudomonas putida KT2440
gugucgaacugcucaacgacgc

SEQ ID NO: 176979 - RNA, 20 nt, Pseudomonas putida KT2440
ucagccugguggugaacagc

SEQ ID NO: 176980 - RNA, 22 nt, Pseudomonas putida KT2440
caucgcgaaucaggucugccgu

SEQ ID NO: 176981 - RNA, 22 nt, Pseudomonas putida KT2440
agugccgcggacucgucgccag

SEQ ID NO: 176982 - RNA, 22 nt, Pseudomonas putida KT2440
gcgccugugagaccgagcgccg

SEQ ID NO: 176983 - RNA, 22 nt, Pseudomonas putida KT2440
guugaucauggccggcgcacgu

SEQ ID NO: 176984 - RNA, 22 nt, Pseudomonas putida KT2440
cugcugugcguggagggugucg

SEQ ID NO: 176985 - RNA, 19 nt, Pseudomonas putida KT2440
caaguuggcgagcagcauc

SEQ ID NO: 176986 - RNA, 22 nt, Pseudomonas putida KT2440
acuguuccugccagccgugcau

SEQ ID NO: 176987 - RNA, 22 nt, Pseudomonas putida KT2440
accgcgaacaagaacggcgaaa

SEQ ID NO: 176988 - RNA, 22 nt, Pseudomonas putida KT2440
gccugugagaucgagcgccgcc

SEQ ID NO: 176989 - RNA, 22 nt, Pseudomonas putida KT2440
uguaggagcugguuuacccgcg

SEQ ID NO: 176990 - RNA, 17 nt, Pseudomonas putida KT2440
ugccggcuuuuacccau

SEQ ID NO: 176991 - RNA, 22 nt, Pseudomonas putida KT2440
cgcggguuuacccgcgaaugcg

SEQ ID NO: 176992 - RNA, 22 nt, Pseudomonas putida KT2440
ugcugcgcagcccuuucgcgac

SEQ ID NO: 176993 - RNA, 22 nt, Pseudomonas putida KT2440
cgccagcucgucgagcaggccg

SEQ ID NO: 176994 - RNA, 22 nt, Pseudomonas putida KT2440
ugccagcggcaagcaagcgccg

SEQ ID NO: 176995 - RNA, 22 nt, Pseudomonas putida KT2440
cugagcguugucgaacacgccc

SEQ ID NO: 176996 - RNA, 22 nt, Pseudomonas putida KT2440
ucggugccagcaacggcgauac

SEQ ID NO: 176997 - RNA, 22 nt, Pseudomonas putida KT2440
ugccacggguuugcaggugacc

SEQ ID NO: 176998 - RNA, 22 nt, Pseudomonas putida KT2440
accggcuucgccgguguucgcg

SEQ ID NO: 176999 - RNA, 22 nt, Pseudomonas putida KT2440
caaggcuucuauacccggcaug

SEQ ID NO: 177000 - RNA, 22 nt, Pseudomonas putida KT2440
cggugcugggcuugcgccaagg

SEQ ID NO: 177001 - RNA, 22 nt, Pseudomonas putida KT2440
guucgucgacagugagcaugcc

SEQ ID NO: 177002 - RNA, 22 nt, Pseudomonas putida KT2440
ccggcuucacccgugccgguca

SEQ ID NO: 177003 - RNA, 22 nt, Pseudomonas putida KT2440
uucgcggguaaacccgcugcug

SEQ ID NO: 177004 - RNA, 22 nt, Pseudomonas putida KT2440
ggccugcuggugcgcuuuggug

SEQ ID NO: 177005 - RNA, 22 nt, Pseudomonas putida KT2440
gcgaagcggccagaacaggcaa

SEQ ID NO: 177006 - RNA, 22 nt, Pseudomonas putida KT2440
uccagccgaaaaccuaccugug

SEQ ID NO: 177007 - RNA, 22 nt, Pseudomonas putida KT2440
ucggccaaccaacugaugggug

SEQ ID NO: 177008 - RNA, 22 nt, Pseudomonas putida KT2440
gguuguccggggucugcacggc

SEQ ID NO: 177009 - RNA, 22 nt, Pseudomonas putida KT2440
guugcccguggccaccgugguu

SEQ ID NO: 177010 - RNA, 22 nt, Pseudomonas putida KT2440
cgcauggugucucuccuuucau

SEQ ID NO: 177011 - RNA, 22 nt, Pseudomonas putida KT2440
gcgcagaccaggaguggccugg

SEQ ID NO: 177012 - RNA, 22 nt, Pseudomonas putida KT2440
cucgugguccgacucgucgcgc

SEQ ID NO: 177013 - RNA, 22 nt, Pseudomonas putida KT2440
ucguacgacaaguccaaagagu

SEQ ID NO: 177014 - RNA, 22 nt, Pseudomonas putida KT2440
ucagcgugaaggucaaugcacu

SEQ ID NO: 177015 - RNA, 22 nt, Pseudomonas putida KT2440
guacgugccgaucgaugaagca

SEQ ID NO: 177016 - RNA, 22 nt, Pseudomonas putida KT2440
ccugauccuguccaacccgccg

SEQ ID NO: 177017 - RNA, 22 nt, Pseudomonas putida KT2440
accucgcccuuguagccgucga

SEQ ID NO: 177018 - RNA, 22 nt, Pseudomonas putida KT2440
ugcgcgcauuuugcccaucgau

SEQ ID NO: 177019 - RNA, 22 nt, Pseudomonas putida KT2440
gucgcgcugcacauagugaugg

SEQ ID NO: 177020 - RNA, 23 nt, Pseudomonas putida KT2440
ggcgcuguauggcuaugcccagg

SEQ ID NO: 177021 - RNA, 22 nt, Pseudomonas putida KT2440
cuucagccugagccugcagcuu

SEQ ID NO: 177022 - RNA, 22 nt, Pseudomonas putida KT2440
ugggcgagcuugucgaggaacu

SEQ ID NO: 177023 - RNA, 17 nt, Pseudomonas putida KT2440
uccagcgaugacccggc

SEQ ID NO: 177024 - RNA, 20 nt, Pseudomonas putida KT2440
ucagccguuuucacacaguc

SEQ ID NO: 177025 - RNA, 22 nt, Pseudomonas putida KT2440
gcuugcaagcguuugguuucac

SEQ ID NO: 177026 - RNA, 22 nt, Pseudomonas putida KT2440
gucauggucucuccuucgcuua

SEQ ID NO: 177027 - RNA, 22 nt, Pseudomonas putida KT2440
cgcguagcgccgugacucgacc

SEQ ID NO: 177028 - RNA, 22 nt, Pseudomonas putida KT2440
gccgaccagccacugggccggg

SEQ ID NO: 177029 - RNA, 22 nt, Pseudomonas putida KT2440
cgguccagcgcacgcuccgucu

SEQ ID NO: 177030 - RNA, 22 nt, Pseudomonas putida KT2440
accgucaccgccgaacgcaucc

SEQ ID NO: 177031 - RNA, 22 nt, Pseudomonas putida KT2440
gcagggucucgagcacaccgcc

SEQ ID NO: 177032 - RNA, 22 nt, Pseudomonas putida KT2440
ggcugagggcgaugccgaugcu

SEQ ID NO: 177033 - RNA, 22 nt, Pseudomonas putida KT2440
ugcuguaccuguguaggagcgg

SEQ ID NO: 177034 - RNA, 22 nt, Pseudomonas putida KT2440
gcucccacaaggcuugcaaaga

SEQ ID NO: 177035 - RNA, 21 nt, Pseudomonas putida KT2440
gcugcaggccuucgccugggc

SEQ ID NO: 177036 - RNA, 22 nt, Pseudomonas putida KT2440
cucggccugcuucagcaaggcu

SEQ ID NO: 177037 - RNA, 22 nt, Pseudomonas putida KT2440
ugcaccugggcauuggcggcgu

SEQ ID NO: 177038 - RNA, 22 nt, Pseudomonas putida KT2440
aacuacaucgaaggccugagca

SEQ ID NO: 177039 - RNA, 22 nt, Pseudomonas putida KT2440
gggcugucaacaaucuguggag

SEQ ID NO: 177040 - RNA, 21 nt, Pseudomonas putida KT2440
gcuacaccaugaccggugcgc

SEQ ID NO: 177041 - RNA, 22 nt, Pseudomonas putida KT2440
gcaagcggcugcccaguucguc

SEQ ID NO: 177042 - RNA, 22 nt, Pseudomonas putida KT2440
ucaugcuuucuggcaggugcgg

SEQ ID NO: 177043 - RNA, 22 nt, Pseudomonas putida KT2440
gcgcacuucuucgaucaggcug

SEQ ID NO: 177044 - RNA, 22 nt, Pseudomonas putida KT2440
ggguaaccucgcgcagaucgau

SEQ ID NO: 177045 - RNA, 22 nt, Pseudomonas putida KT2440
gguggccugcugaaaaugccac

SEQ ID NO: 177046 - RNA, 22 nt, Pseudomonas putida KT2440
cgcucccacaggcauugcacag

SEQ ID NO: 177047 - RNA, 22 nt, Pseudomonas putida KT2440
gaagcucaguacaacaucgacc

SEQ ID NO: 177048 - RNA, 22 nt, Pseudomonas putida KT2440
guugaucgagcacccggcggug

SEQ ID NO: 177049 - RNA, 22 nt, Pseudomonas putida KT2440
uacgcgccgggcauccgcugcc

SEQ ID NO: 177050 - RNA, 22 nt, Pseudomonas putida KT2440
ucaccggcuucucugaucgcga

SEQ ID NO: 177051 - RNA, 22 nt, Pseudomonas putida KT2440
guucggcgaagcccaggguguc

SEQ ID NO: 177052 - RNA, 22 nt, Pseudomonas putida KT2440
cauuggugaugcgggcguucuc

SEQ ID NO: 177053 - RNA, 22 nt, Pseudomonas putida KT2440
cgaagaguugcuguuccucagc

SEQ ID NO: 177054 - RNA, 22 nt, Pseudomonas putida KT2440
gguaccguccgaacugggcggc

SEQ ID NO: 177055 - RNA, 22 nt, Pseudomonas putida KT2440
cgcuggagcauggugugcuggg

SEQ ID NO: 177056 - RNA, 22 nt, Pseudomonas putida KT2440
ucuagaaaagcauucgccgacu

SEQ ID NO: 177057 - RNA, 22 nt, Pseudomonas putida KT2440
cgaacaguagaagcccuccucg

SEQ ID NO: 177058 - RNA, 19 nt, Pseudomonas putida KT2440
ucgaguaccgauggggcau

SEQ ID NO: 177059 - RNA, 19 nt, Pseudomonas putida KT2440
gcugcugauucaguacugg

SEQ ID NO: 177060 - RNA, 22 nt, Pseudomonas putida KT2440
uggcuccgaucgucugaucgaa

SEQ ID NO: 177061 - RNA, 22 nt, Pseudomonas putida KT2440
ugguccugcucgaagcgauggu

SEQ ID NO: 177062 - RNA, 20 nt, Pseudomonas putida KT2440
ugaccacgccacaggcgcug

SEQ ID NO: 177063 - RNA, 23 nt, Pseudomonas putida KT2440
ggcacgguuucgucggagccugg

SEQ ID NO: 177064 - RNA, 22 nt, Pseudomonas putida KT2440
ucaacccgucuccaagauucug

SEQ ID NO: 177065 - RNA, 22 nt, Pseudomonas putida KT2440
caggucaggaucagccgucagc

SEQ ID NO: 177066 - RNA, 22 nt, Pseudomonas putida KT2440
uucgccgcuugccauucagggu

SEQ ID NO: 177067 - RNA, 22 nt, Pseudomonas putida KT2440
guccugcaaggucagguugguc

SEQ ID NO: 177068 - RNA, 22 nt, Pseudomonas putida KT2440
cagcgcuauaagcuaaagucca

SEQ ID NO: 177069 - RNA, 22 nt, Pseudomonas putida KT2440
aucccgcgaaacggcucggcug

SEQ ID NO: 177070 - RNA, 22 nt, Pseudomonas putida KT2440
cccaggcaguacaucagcgaca

SEQ ID NO: 177071 - RNA, 22 nt, Pseudomonas putida KT2440
uggagcgcaccacaucuucauu

SEQ ID NO: 177072 - RNA, 22 nt, Pseudomonas putida KT2440
aggcguuuguagucaaguggcg

SEQ ID NO: 177073 - RNA, 22 nt, Pseudomonas putida KT2440
ugcagggacguaaugcgggauc

SEQ ID NO: 177074 - RNA, 21 nt, Pseudomonas putida KT2440
caccuguuuaccgguacgguc

SEQ ID NO: 177075 - RNA, 22 nt, Pseudomonas putida KT2440
ucgaggcgcacuucggcguacc

SEQ ID NO: 177076 - RNA, 22 nt, Pseudomonas putida KT2440
ggcugugauggugaccuugacc

SEQ ID NO: 177077 - RNA, 22 nt, Pseudomonas putida KT2440
cggcgaucacaucgguggccgc

SEQ ID NO: 177078 - RNA, 22 nt, Pseudomonas putida KT2440
ugccggucggucaucagguuca

SEQ ID NO: 177079 - RNA, 21 nt, Pseudomonas putida KT2440
accgauccuguacgugcuggc

SEQ ID NO: 177080 - RNA, 22 nt, Pseudomonas putida KT2440
ggcccugugggagcggccuugu

SEQ ID NO: 177081 - RNA, 22 nt, Pseudomonas putida KT2440
accgccgucaggaggcugccgu

SEQ ID NO: 177082 - RNA, 22 nt, Pseudomonas putida KT2440
cggaagaucagcgccgcacggc

SEQ ID NO: 177083 - RNA, 22 nt, Pseudomonas putida KT2440
gcgcauguaggucgacuuaccg

SEQ ID NO: 177084 - RNA, 22 nt, Pseudomonas putida KT2440
aauugccguuguaugcgcguau

SEQ ID NO: 177085 - RNA, 22 nt, Pseudomonas putida KT2440
guacgucuggagcgcgaaaggu

SEQ ID NO: 177086 - RNA, 22 nt, Pseudomonas putida KT2440
ugcuggccuacgccgcgucgug

SEQ ID NO: 177087 - RNA, 22 nt, Pseudomonas putida KT2440
agcaacuucuucggugcugccg

SEQ ID NO: 177088 - RNA, 22 nt, Pseudomonas putida KT2440
ggugcugaugcucggcgacggg

SEQ ID NO: 177089 - RNA, 22 nt, Pseudomonas putida KT2440
gccgcuuguacgcaguggcgag

SEQ ID NO: 177090 - RNA, 22 nt, Pseudomonas putida KT2440
gugcacagccaucuggucagcg

SEQ ID NO: 177091 - RNA, 22 nt, Pseudomonas putida KT2440
gccuucgacgaugaacaccacg

SEQ ID NO: 177092 - RNA, 22 nt, Pseudomonas putida KT2440
augcccgccauaucgaccagcu

SEQ ID NO: 177093 - RNA, 22 nt, Pseudomonas putida KT2440
aucgcccuuaaugcuggaguuc

SEQ ID NO: 177094 - RNA, 22 nt, Pseudomonas putida KT2440
gcgggcuugcccgcucccacag

SEQ ID NO: 177095 - RNA, 22 nt, Pseudomonas putida KT2440
uggcgagacucacggcgagccc

SEQ ID NO: 177096 - RNA, 22 nt, Pseudomonas putida KT2440
uguucaagcugaccgaugagcu

SEQ ID NO: 177097 - RNA, 22 nt, Pseudomonas putida KT2440
ccaggcuugcgcccaggccgau

SEQ ID NO: 177098 - RNA, 22 nt, Pseudomonas putida KT2440
uagcagcggccagagcgcucua

SEQ ID NO: 177099 - RNA, 22 nt, Pseudomonas putida KT2440
guacgccgaucuccgacaggcg

SEQ ID NO: 177100 - RNA, 22 nt, Pseudomonas putida KT2440
ggcggugagcuauuccgacccg

SEQ ID NO: 177101 - RNA, 22 nt, Pseudomonas putida KT2440
augaccagucucuggccgcaag

SEQ ID NO: 177102 - RNA, 22 nt, Pseudomonas putida KT2440
guaaacccgcuccuaccagggg

SEQ ID NO: 177103 - RNA, 22 nt, Pseudomonas putida KT2440
uguaccugugugagcgggcuug

SEQ ID NO: 177104 - RNA, 22 nt, Pseudomonas putida KT2440
ggccagaaucaucgccaacugg

SEQ ID NO: 177105 - RNA, 22 nt, Pseudomonas putida KT2440
cgcggguaagcccgcuccuaca

SEQ ID NO: 177106 - RNA, 22 nt, Pseudomonas putida KT2440
cagcgcuugcacggcaccggca

SEQ ID NO: 177107 - RNA, 19 nt, Pseudomonas putida KT2440
gccuuccagccacugggcc

SEQ ID NO: 177108 - RNA, 22 nt, Pseudomonas putida KT2440
cguggguacaccaggaaggucg

SEQ ID NO: 177109 - RNA, 22 nt, Pseudomonas putida KT2440
cgaugacgucacccuguaccag

SEQ ID NO: 177110 - RNA, 22 nt, Pseudomonas putida KT2440
ccgcagcacugccugaagagcc

SEQ ID NO: 177111 - RNA, 22 nt, Pseudomonas putida KT2440
uucgacgaugaccuugcgccgg

SEQ ID NO: 177112 - RNA, 22 nt, Pseudomonas putida KT2440
cacagccgguuggcaaacugau

SEQ ID NO: 177113 - RNA, 22 nt, Pseudomonas putida KT2440
uacuuggcagucuuugcggcgc

SEQ ID NO: 177114 - RNA, 22 nt, Pseudomonas putida KT2440
ugucggccuugcccuggucgcu

SEQ ID NO: 177115 - RNA, 22 nt, Pseudomonas putida KT2440
ggcugaucaggcgcugaugugc

SEQ ID NO: 177116 - RNA, 22 nt, Pseudomonas putida KT2440
ucaacgguguaugucgcuaggu

SEQ ID NO: 177117 - RNA, 22 nt, Pseudomonas putida KT2440
aucgagauggaggucggcuggg

SEQ ID NO: 177118 - RNA, 22 nt, Pseudomonas putida KT2440
uccaaccguacccuuccuggag

SEQ ID NO: 177119 - RNA, 22 nt, Pseudomonas putida KT2440
uacacgggcguagacugcgggc

SEQ ID NO: 177120 - RNA, 22 nt, Pseudomonas putida KT2440
acucggcgggggauguguuccu

SEQ ID NO: 177121 - RNA, 22 nt, Pseudomonas putida KT2440
uaaacccgcuccuaccacggcg

SEQ ID NO: 177122 - RNA, 22 nt, Pseudomonas putida KT2440
uaaagccguuccuacagggggu

SEQ ID NO: 177123 - RNA, 20 nt, Pseudomonas putida KT2440
acauggccauggcgucgaug

SEQ ID NO: 177124 - RNA, 22 nt, Pseudomonas putida KT2440
acgacugugacaugguucaggg

SEQ ID NO: 177125 - RNA, 22 nt, Pseudomonas putida KT2440
cggugcguucugcagccucggu

SEQ ID NO: 177126 - RNA, 22 nt, Pseudomonas putida KT2440
guggugcauugcaaauaagcga

SEQ ID NO: 177127 - RNA, 22 nt, Pseudomonas putida KT2440
guggucauccccggcaagggcc

SEQ ID NO: 177128 - RNA, 20 nt, Pseudomonas putida KT2440
ggcagcaauuacgaauggcg

SEQ ID NO: 177129 - RNA, 22 nt, Pseudomonas putida KT2440
cagugaugucuuccagugggcg

SEQ ID NO: 177130 - RNA, 22 nt, Pseudomonas putida KT2440
gcagagcguauucggcaucaac

SEQ ID NO: 177131 - RNA, 22 nt, Pseudomonas putida KT2440
gccucgguaucgccgugaccgg

SEQ ID NO: 177132 - RNA, 22 nt, Pseudomonas putida KT2440
ccgguagacaagcuggaccuga

SEQ ID NO: 177133 - RNA, 22 nt, Pseudomonas putida KT2440
caggcgcauggccaggcaaccg

SEQ ID NO: 177134 - RNA, 22 nt, Pseudomonas putida KT2440
acccugggccaccugcgguuug

SEQ ID NO: 177135 - RNA, 22 nt, Pseudomonas putida KT2440
gacggcagugccagcgugccac

SEQ ID NO: 177136 - RNA, 19 nt, Pseudomonas putida KT2440
uggauggcucgucaucgag

SEQ ID NO: 177137 - RNA, 22 nt, Pseudomonas putida KT2440
cgcuccuacaaguagugcaccg

SEQ ID NO: 177138 - RNA, 22 nt, Pseudomonas putida KT2440
uccagcugccuagccgaagacc

SEQ ID NO: 177139 - RNA, 21 nt, Pseudomonas putida KT2440
agcaggaugccacgcgcuugc

SEQ ID NO: 177140 - RNA, 22 nt, Pseudomonas putida KT2440
cuggugaacaguggcugggccg

SEQ ID NO: 177141 - RNA, 22 nt, Pseudomonas putida KT2440
cuucgcggguaaacccgcuccu

SEQ ID NO: 177142 - RNA, 22 nt, Pseudomonas putida KT2440
accgccugguggaagaggugaa

SEQ ID NO: 177143 - RNA, 22 nt, Pseudomonas putida KT2440
ugagcaggucaucggucaggaa

SEQ ID NO: 177144 - RNA, 22 nt, Pseudomonas putida KT2440
cggugcagcgcuugaaguguuc

SEQ ID NO: 177145 - RNA, 22 nt, Pseudomonas putida KT2440
auccacucacaguaguggcugg

SEQ ID NO: 177146 - RNA, 22 nt, Pseudomonas putida KT2440
ucauggcgccaacggucagcgc

SEQ ID NO: 177147 - RNA, 22 nt, Pseudomonas putida KT2440
ugccguuggcguacaucggcuc

SEQ ID NO: 177148 - RNA, 22 nt, Pseudomonas putida KT2440
cguggcuucgucgcgggccugg

SEQ ID NO: 177149 - RNA, 19 nt, Pseudomonas putida KT2440
ucggaggcuuucugcgcgu

SEQ ID NO: 177150 - RNA, 23 nt, Pseudomonas putida KT2440
cgugaguugcacggcgcacugcu

SEQ ID NO: 177151 - RNA, 22 nt, Pseudomonas putida KT2440
cggugaugaucagcaugcgcgu

SEQ ID NO: 177152 - RNA, 22 nt, Pseudomonas putida KT2440
cgcggcuaaacccgcuccuaca

SEQ ID NO: 177153 - RNA, 22 nt, Pseudomonas putida KT2440
cacgaggcgggccugcggugcg

SEQ ID NO: 177154 - RNA, 21 nt, Pseudomonas putida KT2440
accaccugcaggcugcgcgcc

SEQ ID NO: 177155 - RNA, 22 nt, Pseudomonas putida KT2440
gcugaacugguggcgcugcagc

SEQ ID NO: 177156 - RNA, 22 nt, Pseudomonas putida KT2440
gguugccauggauuauuggaaa

SEQ ID NO: 177157 - RNA, 22 nt, Pseudomonas putida KT2440
cauuggccugggcgauuucacc

SEQ ID NO: 177158 - RNA, 21 nt, Pseudomonas putida KT2440
cugguucucgaccugguuguu

SEQ ID NO: 177159 - RNA, 22 nt, Pseudomonas putida KT2440
cggugguaguagcuggccgggu

SEQ ID NO: 177160 - RNA, 22 nt, Pseudomonas putida KT2440
gagcggguuuacccgcgaaggu

SEQ ID NO: 177161 - RNA, 22 nt, Pseudomonas putida KT2440
cuggcaauguagccuucgauga

SEQ ID NO: 177162 - RNA, 22 nt, Pseudomonas putida KT2440
cagcauuaagggcgaugguguc

SEQ ID NO: 177163 - RNA, 22 nt, Pseudomonas putida KT2440
cucccaggccgccaggucugcc

SEQ ID NO: 177164 - RNA, 22 nt, Pseudomonas putida KT2440
cgauaccugcgcaagcggcuug

SEQ ID NO: 177165 - RNA, 22 nt, Pseudomonas putida KT2440
guagcccacgaacagcaacaug

SEQ ID NO: 177166 - RNA, 22 nt, Pseudomonas putida KT2440
ucgagcauguccaaggccgcac

SEQ ID NO: 177167 - RNA, 22 nt, Pseudomonas putida KT2440
acaggcugauggccuggacgcu

SEQ ID NO: 177168 - RNA, 22 nt, Pseudomonas putida KT2440
agccuucgagcuccgccagcca

SEQ ID NO: 177169 - RNA, 22 nt, Pseudomonas putida KT2440
acccgcuccuaccagggacgug

SEQ ID NO: 177170 - RNA, 22 nt, Pseudomonas putida KT2440
uacgcccagaacggcaucgccc

SEQ ID NO: 177171 - RNA, 22 nt, Pseudomonas putida KT2440
cuugagcacugggccgcgaaug

SEQ ID NO: 177172 - RNA, 22 nt, Pseudomonas putida KT2440
cugguugcgcaugugcuggggc

SEQ ID NO: 177173 - RNA, 22 nt, Pseudomonas putida KT2440
cuugaacagguagaccgccgcc

SEQ ID NO: 177174 - RNA, 22 nt, Pseudomonas putida KT2440
agucaagaaugcgugggucuuu

SEQ ID NO: 177175 - RNA, 22 nt, Pseudomonas putida KT2440
uauccacacuuuccugauucaa

SEQ ID NO: 177176 - RNA, 22 nt, Pseudomonas putida KT2440
gcguugccgguguucgcgggca

SEQ ID NO: 177177 - RNA, 22 nt, Pseudomonas putida KT2440
agggcaacgcgggcagcggucu

SEQ ID NO: 177178 - RNA, 22 nt, Pseudomonas putida KT2440
agccgccuuugauuaccgccac

SEQ ID NO: 177179 - RNA, 22 nt, Pseudomonas putida KT2440
cgcgaaagggccgguacagguu

SEQ ID NO: 177180 - RNA, 22 nt, Pseudomonas putida KT2440
agugcauugaccuucacccuga

SEQ ID NO: 177181 - RNA, 22 nt, Pseudomonas putida KT2440
cgggccuugauauugagaauuu

SEQ ID NO: 177182 - RNA, 22 nt, Pseudomonas putida KT2440
cgcuccuacagguacagcgcag

SEQ ID NO: 177183 - RNA, 22 nt, Pseudomonas putida KT2440
uaggagcggguuuacccgcgaa

SEQ ID NO: 177184 - RNA, 22 nt, Pseudomonas putida KT2440
ggcugaagccgcuccuacaggg

SEQ ID NO: 177185 - RNA, 22 nt, Pseudomonas putida KT2440
cguggucaguugcucgaggugg

SEQ ID NO: 177186 - RNA, 22 nt, Pseudomonas putida KT2440
cuggguaugacccagcguguau

SEQ ID NO: 177187 - RNA, 20 nt, Pseudomonas putida KT2440
gccagguagauggugucggg

SEQ ID NO: 177188 - RNA, 22 nt, Pseudomonas putida KT2440
acuguggugugccgcugggcgg

SEQ ID NO: 177189 - RNA, 22 nt, Pseudomonas putida KT2440
aagcccagguuagccagguauu

SEQ ID NO: 177190 - RNA, 22 nt, Pseudomonas putida KT2440
gcaagcucgcgccuacaaugga

SEQ ID NO: 177191 - RNA, 22 nt, Pseudomonas putida KT2440
ccacgcgaauaccugugcagcg

SEQ ID NO: 177192 - RNA, 22 nt, Pseudomonas putida KT2440
ggcgcgaagcggccccgggauu

SEQ ID NO: 177193 - RNA, 22 nt, Pseudomonas putida KT2440
gcugcucacgcagccauugcgg

SEQ ID NO: 177194 - RNA, 22 nt, Pseudomonas putida KT2440
cugccgguuccuuguucggucg

SEQ ID NO: 177195 - RNA, 22 nt, Pseudomonas putida KT2440
uaccggugggcucaucggcgaa

SEQ ID NO: 177196 - RNA, 22 nt, Pseudomonas putida KT2440
ucguaggagcgaguuuacccgc

SEQ ID NO: 177197 - RNA, 22 nt, Pseudomonas putida KT2440
gggcguauucacgcagagcgcc

SEQ ID NO: 177198 - RNA, 23 nt, Pseudomonas putida KT2440
cgaacgccacgaccgaugcagcc

SEQ ID NO: 177199 - RNA, 22 nt, Pseudomonas putida KT2440
gaggcugauggcgaucuugagc

SEQ ID NO: 177200 - RNA, 22 nt, Pseudomonas putida KT2440
aucgacuugcugcccggcuggg

SEQ ID NO: 177201 - RNA, 22 nt, Pseudomonas putida KT2440
uucgugcagccacaguugcugg

SEQ ID NO: 177202 - RNA, 22 nt, Pseudomonas putida KT2440
gcggcgaugugguugcaagcgg

SEQ ID NO: 177203 - RNA, 18 nt, Pseudomonas putida KT2440
ugcuggucuuggucgcca

SEQ ID NO: 177204 - RNA, 22 nt, Pseudomonas putida KT2440
aucacacugaagaaguuggccu

SEQ ID NO: 177205 - RNA, 22 nt, Pseudomonas putida KT2440
uggucauccacccgccgcugac

SEQ ID NO: 177206 - RNA, 22 nt, Pseudomonas putida KT2440
gacuucaaucgccuuggcaacg

SEQ ID NO: 177207 - RNA, 22 nt, Pseudomonas putida KT2440
aggugcacaccgugcgccuggc

SEQ ID NO: 177208 - RNA, 22 nt, Pseudomonas putida KT2440
acuaucgagaagauucuugcuc

SEQ ID NO: 177209 - RNA, 22 nt, Pseudomonas putida KT2440
aggccuugcgccugcuggccaa

SEQ ID NO: 177210 - RNA, 22 nt, Pseudomonas putida KT2440
gccaucguuauugugcuugcca

SEQ ID NO: 177211 - RNA, 22 nt, Pseudomonas putida KT2440
augccgguguugauggccugga

SEQ ID NO: 177212 - RNA, 22 nt, Pseudomonas putida KT2440
gagcgguucuugcagugucggc

SEQ ID NO: 177213 - RNA, 22 nt, Pseudomonas putida KT2440
gacggucgauuuugccuuccgc

SEQ ID NO: 177214 - RNA, 22 nt, Pseudomonas putida KT2440
ugcuggcguauuucuucccgga

SEQ ID NO: 177215 - RNA, 22 nt, Pseudomonas putida KT2440
cugucgccuuggcuggugucug

SEQ ID NO: 177216 - RNA, 22 nt, Pseudomonas putida KT2440
gcauggcugaccccggcgggca

SEQ ID NO: 177217 - RNA, 22 nt, Pseudomonas putida KT2440
ucgcggguaaacccgcgccugc

SEQ ID NO: 177218 - RNA, 22 nt, Pseudomonas putida KT2440
uggucugcgacuacgacgcggg

SEQ ID NO: 177219 - RNA, 22 nt, Pseudomonas putida KT2440
ccgugcucaaucggcagccagc

SEQ ID NO: 177220 - RNA, 22 nt, Pseudomonas putida KT2440
cgcucccacaguaucaccacag

SEQ ID NO: 177221 - RNA, 22 nt, Pseudomonas putida KT2440
uugaaucagcgcauuaccacgu

SEQ ID NO: 177222 - RNA, 22 nt, Pseudomonas putida KT2440
ccggcaucggcaaacgccugcu

SEQ ID NO: 177223 - RNA, 22 nt, Pseudomonas putida KT2440
gugacgcugcucgguagagucg

SEQ ID NO: 177224 - RNA, 22 nt, Pseudomonas putida KT2440
gcuguucggccuguaucaacgc

SEQ ID NO: 177225 - RNA, 22 nt, Pseudomonas putida KT2440
ggcgauguuuuccuugccgucc

SEQ ID NO: 177226 - RNA, 22 nt, Pseudomonas putida KT2440
cugugcuguaccugugggagcg

SEQ ID NO: 177227 - RNA, 22 nt, Pseudomonas putida KT2440
agcagggcgcugacguccaccg

SEQ ID NO: 177228 - RNA, 22 nt, Pseudomonas putida KT2440
gagccgaaaauaagcgauauua

SEQ ID NO: 177229 - RNA, 22 nt, Pseudomonas putida KT2440
cggucgauggcggcaucgacuu

SEQ ID NO: 177230 - RNA, 22 nt, Pseudomonas putida KT2440
acgugcacaaugccucggucga

SEQ ID NO: 177231 - RNA, 22 nt, Pseudomonas putida KT2440
ucgauaccggagaacugcgguu

SEQ ID NO: 177232 - RNA, 23 nt, Pseudomonas putida KT2440
ugcgagggacgugggguguauug

SEQ ID NO: 177233 - RNA, 22 nt, Pseudomonas putida KT2440
uccggcuggccucgaucugcgu

SEQ ID NO: 177234 - RNA, 22 nt, Pseudomonas putida KT2440
ugcgugaucgaguugcggguag

SEQ ID NO: 177235 - RNA, 22 nt, Pseudomonas putida KT2440
uugucggcgcguuuacggcugc

SEQ ID NO: 177236 - RNA, 22 nt, Pseudomonas putida KT2440
cgggcgaugguguuuucgcagu

SEQ ID NO: 177237 - RNA, 22 nt, Pseudomonas putida KT2440
ggccuucgauccggaugcugac

SEQ ID NO: 177238 - RNA, 22 nt, Pseudomonas putida KT2440
cuggcgucugugagaucgagcg

SEQ ID NO: 177239 - RNA, 22 nt, Pseudomonas putida KT2440
gcugccauggccgucggcgagc

SEQ ID NO: 177240 - RNA, 22 nt, Pseudomonas putida KT2440
ggguuuacccgcgaagaggucc

SEQ ID NO: 177241 - RNA, 22 nt, Pseudomonas putida KT2440
ucggaaggugaguuccccggac

SEQ ID NO: 177242 - RNA, 23 nt, Pseudomonas putida KT2440
ggcuaucggcaagucugcgacua

SEQ ID NO: 177243 - RNA, 22 nt, Pseudomonas putida KT2440
cgggcacaucagccugcagcca

SEQ ID NO: 177244 - RNA, 22 nt, Pseudomonas putida KT2440
gcugcacggcuugcugccgagc

SEQ ID NO: 177245 - RNA, 22 nt, Pseudomonas putida KT2440
caauggcggccuugaucgcugc

SEQ ID NO: 177246 - RNA, 22 nt, Pseudomonas putida KT2440
cgggaugucgaagcguaggugu

SEQ ID NO: 177247 - RNA, 20 nt, Pseudomonas putida KT2440
ucagcagguuggugaugauc

SEQ ID NO: 177248 - RNA, 22 nt, Pseudomonas putida KT2440
gaccgcuacuucaagcagaucg

SEQ ID NO: 177249 - RNA, 22 nt, Pseudomonas putida KT2440
ugcgucaguuguucggccaugc

SEQ ID NO: 177250 - RNA, 22 nt, Pseudomonas putida KT2440
gacgcgaucacccuuauugcca

SEQ ID NO: 177251 - RNA, 20 nt, Pseudomonas putida KT2440
uccagguggcaaugaacugg

SEQ ID NO: 177252 - RNA, 22 nt, Pseudomonas putida KT2440
cuugccugauguaaucagcgau

SEQ ID NO: 177253 - RNA, 22 nt, Pseudomonas putida KT2440
gccaugguguuguugcuguacu

SEQ ID NO: 177254 - RNA, 22 nt, Pseudomonas putida KT2440
aaguugccuguaccugccucuu

SEQ ID NO: 177255 - RNA, 22 nt, Pseudomonas putida KT2440
ugcugcugggugagguuggcuu

SEQ ID NO: 177256 - RNA, 22 nt, Pseudomonas putida KT2440
cacggcuggcaccgcucuugcg

SEQ ID NO: 177257 - RNA, 23 nt, Pseudomonas putida KT2440
ggcacagguucagcucaccuucg

SEQ ID NO: 177258 - RNA, 22 nt, Pseudomonas putida KT2440
ugaacugacgcauucgcgggca

SEQ ID NO: 177259 - RNA, 22 nt, Pseudomonas putida KT2440
ccagccuuggcguucggcgggu

SEQ ID NO: 177260 - RNA, 22 nt, Pseudomonas putida KT2440
uccaggcugggcagcaacccgg

SEQ ID NO: 177261 - RNA, 22 nt, Pseudomonas putida KT2440
gccuuguaucggcccucucgcg

SEQ ID NO: 177262 - RNA, 22 nt, Pseudomonas putida KT2440
cggugcacuacuuguaggagcg

SEQ ID NO: 177263 - RNA, 22 nt, Pseudomonas putida KT2440
uggagccggaggugcugcugcu

SEQ ID NO: 177264 - RNA, 22 nt, Pseudomonas putida KT2440
cauguaggagcggguuuacccg

SEQ ID NO: 177265 - RNA, 22 nt, Pseudomonas putida KT2440
cccgcgaacaccggcaaagccg

SEQ ID NO: 177266 - RNA, 22 nt, Pseudomonas putida KT2440
caaggacccgucgccgaaggac

SEQ ID NO: 177267 - RNA, 22 nt, Pseudomonas putida KT2440
aucgacgcgguuggaucgcggg

SEQ ID NO: 177268 - RNA, 22 nt, Pseudomonas putida KT2440
acgguugacgcauggggcucca

SEQ ID NO: 177269 - RNA, 21 nt, Pseudomonas putida KT2440
acggacaaccccgaaguugua

SEQ ID NO: 177270 - RNA, 22 nt, Pseudomonas putida KT2440
gcgugauacguugcagcaucug

SEQ ID NO: 177271 - RNA, 22 nt, Pseudomonas putida KT2440
ugguaacccugugggagcgggc

SEQ ID NO: 177272 - RNA, 22 nt, Pseudomonas putida KT2440
gcgccugugaggucgagcgccg

SEQ ID NO: 177273 - RNA, 22 nt, Pseudomonas putida KT2440
cucgaucuggcaggcgcugcaa

SEQ ID NO: 177274 - RNA, 22 nt, Pseudomonas putida KT2440
uagcagcggccagaacgcucua

SEQ ID NO: 177275 - RNA, 22 nt, Pseudomonas putida KT2440
uagcggguggcgagcaugccgc

SEQ ID NO: 177276 - RNA, 22 nt, Pseudomonas putida KT2440
gcaguacgucguagucuuucag

SEQ ID NO: 177277 - RNA, 22 nt, Pseudomonas putida KT2440
gacagcacaugccucaagcuga

SEQ ID NO: 177278 - RNA, 22 nt, Pseudomonas putida KT2440
caacggcgaaccggccguguuc

SEQ ID NO: 177279 - RNA, 22 nt, Pseudomonas putida KT2440
ucgcggguggcgauguacaugg

SEQ ID NO: 177280 - RNA, 22 nt, Pseudomonas putida KT2440
ggaguacgcgguggccgauuac

SEQ ID NO: 177281 - RNA, 22 nt, Pseudomonas putida KT2440
uggcgcauuacgaccgggcgcg

SEQ ID NO: 177282 - RNA, 22 nt, Pseudomonas putida KT2440
ucaguggcgagcgugucacacc

SEQ ID NO: 177283 - RNA, 22 nt, Pseudomonas putida KT2440
cuggcugcggugcaagcagaag

SEQ ID NO: 177284 - RNA, 22 nt, Pseudomonas putida KT2440
cacgcugggcucgucgagcacg

SEQ ID NO: 177285 - RNA, 22 nt, Pseudomonas putida KT2440
ccaccuguggguagcgcucggu

SEQ ID NO: 177286 - RNA, 22 nt, Pseudomonas putida KT2440
caaggccgcucccacagggacu

SEQ ID NO: 177287 - RNA, 22 nt, Pseudomonas putida KT2440
gcgccguacgugugggagcggg

SEQ ID NO: 177288 - RNA, 22 nt, Pseudomonas putida KT2440
uguucugcgaggucauggccac

SEQ ID NO: 177289 - RNA, 22 nt, Pseudomonas putida KT2440
accuaugacacgcacaccuuac

SEQ ID NO: 177290 - RNA, 22 nt, Pseudomonas putida KT2440
cacccauuucugguugccggug

SEQ ID NO: 177291 - RNA, 22 nt, Pseudomonas putida KT2440
cagcuguucgacgugcuguauc

SEQ ID NO: 177292 - RNA, 18 nt, Pseudomonas putida KT2440
cugcuggcugaccgcgcc

SEQ ID NO: 177293 - RNA, 22 nt, Pseudomonas putida KT2440
guugcccagaugauccaaccag

SEQ ID NO: 177294 - RNA, 22 nt, Pseudomonas putida KT2440
aucaccugcacuggccucuucg

SEQ ID NO: 177295 - RNA, 22 nt, Pseudomonas putida KT2440
ucgcgggugaacccgcugaugg

SEQ ID NO: 177296 - RNA, 22 nt, Pseudomonas putida KT2440
agugcuggcggaccucaucgug

SEQ ID NO: 177297 - RNA, 22 nt, Pseudomonas putida KT2440
cuggugaugaguacgaccccau

SEQ ID NO: 177298 - RNA, 22 nt, Pseudomonas putida KT2440
accggccaggagguaauggcgu

SEQ ID NO: 177299 - RNA, 22 nt, Pseudomonas putida KT2440
cagcggcuggccagcuuccugg

SEQ ID NO: 177300 - RNA, 21 nt, Pseudomonas putida KT2440
ugcagcucgguuucauccagg

SEQ ID NO: 177301 - RNA, 22 nt, Pseudomonas putida KT2440
ucgcgcaauucgacgcggcuga

SEQ ID NO: 177302 - RNA, 22 nt, Pseudomonas putida KT2440
ucggcugauggcgcaggcgaug

SEQ ID NO: 177303 - RNA, 20 nt, Pseudomonas putida KT2440
gguuuacccgcgaagaggcc

SEQ ID NO: 177304 - RNA, 22 nt, Pseudomonas putida KT2440
uucgauguguauggcaacguuu

SEQ ID NO: 177305 - RNA, 22 nt, Pseudomonas putida KT2440
ucggccuugccuuugguggccu

SEQ ID NO: 177306 - RNA, 22 nt, Pseudomonas putida KT2440
ucgcuguugaucugacgcugca

SEQ ID NO: 177307 - RNA, 22 nt, Pseudomonas putida KT2440
aagccaauggcguaugccagau

SEQ ID NO: 177308 - RNA, 23 nt, Pseudomonas putida KT2440
uggaccggcaguuccaggccagc

SEQ ID NO: 177309 - RNA, 22 nt, Pseudomonas putida KT2440
cagaccaggcucuggcgcugcu

SEQ ID NO: 177310 - RNA, 22 nt, Pseudomonas putida KT2440
ugcugcgccuggccgagcaaac

SEQ ID NO: 177311 - RNA, 22 nt, Pseudomonas putida KT2440
uguuagcgucacuguaugcgcc

SEQ ID NO: 177312 - RNA, 22 nt, Pseudomonas putida KT2440
caggccuugggcuucggccagc

SEQ ID NO: 177313 - RNA, 22 nt, Pseudomonas putida KT2440
gacguugguagcgguggcguug

SEQ ID NO: 177314 - RNA, 22 nt, Pseudomonas putida KT2440
ccggcaagccagcgccacaggu

SEQ ID NO: 177315 - RNA, 22 nt, Pseudomonas putida KT2440
ugcgaacaggguguugugcggg

SEQ ID NO: 177316 - RNA, 22 nt, Pseudomonas putida KT2440
uaucgccguggacgugcgcaaa

SEQ ID NO: 177317 - RNA, 22 nt, Pseudomonas putida KT2440
cuucgcgggcaagcccgcuccu

SEQ ID NO: 177318 - RNA, 22 nt, Pseudomonas putida KT2440
agcuacuguccgcgucaccuug

SEQ ID NO: 177319 - RNA, 22 nt, Pseudomonas putida KT2440
acugcgcgauagccuguggggc

SEQ ID NO: 177320 - RNA, 18 nt, Pseudomonas putida KT2440
ucacguuuucacaccguc

SEQ ID NO: 177321 - RNA, 22 nt, Pseudomonas putida KT2440
uggccuuucgugagcagccgcu

SEQ ID NO: 177322 - RNA, 22 nt, Pseudomonas putida KT2440
cugguugaacuccaaccugggc

SEQ ID NO: 177323 - RNA, 22 nt, Pseudomonas putida KT2440
acggccugguacucaguggccg

SEQ ID NO: 177324 - RNA, 22 nt, Pseudomonas putida KT2440
gcauggcguugagggcugggug

SEQ ID NO: 177325 - RNA, 22 nt, Pseudomonas putida KT2440
gaugcgcucgacgaccaugaug

SEQ ID NO: 177326 - RNA, 22 nt, Pseudomonas putida KT2440
cgcucccacaggauaggcgccg

SEQ ID NO: 177327 - RNA, 22 nt, Pseudomonas putida KT2440
ggcacggaucggucaggcggcc

SEQ ID NO: 177328 - RNA, 22 nt, Pseudomonas putida KT2440
uucaucguucugaaucuuccug

SEQ ID NO: 177329 - RNA, 22 nt, Pseudomonas putida KT2440
gccgucaauguacagggccgcg

SEQ ID NO: 177330 - RNA, 22 nt, Pseudomonas putida KT2440
ucucggccaaguggcgcugugc

SEQ ID NO: 177331 - RNA, 22 nt, Pseudomonas putida KT2440
gccuauccugugggagcgggcu

SEQ ID NO: 177332 - RNA, 22 nt, Pseudomonas putida KT2440
accagaucaccgugaccgggcc

SEQ ID NO: 177333 - RNA, 23 nt, Pseudomonas putida KT2440
cagaacgugcuggccgaccuggc

SEQ ID NO: 177334 - RNA, 22 nt, Pseudomonas putida KT2440
guuguucaugauuucagugccg

SEQ ID NO: 177335 - RNA, 22 nt, Pseudomonas putida KT2440
ggcgagcacacuucuugguugc

SEQ ID NO: 177336 - RNA, 22 nt, Pseudomonas putida KT2440
ugaaagugccccaguggggugc

SEQ ID NO: 177337 - RNA, 22 nt, Pseudomonas putida KT2440
cgauaggcuugcugaaggucuu

SEQ ID NO: 177338 - RNA, 22 nt, Pseudomonas putida KT2440
aacugacaggcccuguacugau

SEQ ID NO: 177339 - RNA, 22 nt, Pseudomonas putida KT2440
ucggcgcuuuuugcauaguccg

SEQ ID NO: 177340 - RNA, 22 nt, Pseudomonas putida KT2440
uggacgcucaacgcggcgagcg

SEQ ID NO: 177341 - RNA, 22 nt, Pseudomonas putida KT2440
ggccagcaacuggucguucagc

SEQ ID NO: 177342 - RNA, 22 nt, Pseudomonas putida KT2440
ugaggcugacgcgcaaggugcu

SEQ ID NO: 177343 - RNA, 22 nt, Pseudomonas putida KT2440
uccagcgccaguacugccacgc

SEQ ID NO: 177344 - RNA, 22 nt, Pseudomonas putida KT2440
cagcgccugggcgaggaugggu

SEQ ID NO: 177345 - RNA, 22 nt, Pseudomonas putida KT2440
uguacgaaaucaucccgggcuu

SEQ ID NO: 177346 - RNA, 23 nt, Pseudomonas putida KT2440
uaggagcggguucacccgcgaag

SEQ ID NO: 177347 - RNA, 22 nt, Pseudomonas putida KT2440
ccagaugguagauacgcgucau

SEQ ID NO: 177348 - RNA, 22 nt, Pseudomonas putida KT2440
gucgcguucguugagguacagg

SEQ ID NO: 177349 - RNA, 22 nt, Pseudomonas putida KT2440
cuucgcgggugaacccgcuccu

SEQ ID NO: 177350 - RNA, 22 nt, Pseudomonas putida KT2440
cuucggccugggccacggcggg

SEQ ID NO: 177351 - RNA, 22 nt, Pseudomonas putida KT2440
ggcgacauggcguugaugacga

SEQ ID NO: 177352 - RNA, 22 nt, Pseudomonas putida KT2440
cggcaucaauggcggccucaag

SEQ ID NO: 177353 - RNA, 22 nt, Pseudomonas putida KT2440
acgccgaccgccucauggagcu

SEQ ID NO: 177354 - RNA, 22 nt, Pseudomonas putida KT2440
ucaguucacggguaucgaugcc

SEQ ID NO: 177355 - RNA, 22 nt, Pseudomonas putida KT2440
accucgcgugccgccgacgaca

SEQ ID NO: 177356 - RNA, 22 nt, Pseudomonas putida KT2440
cugccagggcuacggcacgccg

SEQ ID NO: 177357 - RNA, 22 nt, Pseudomonas putida KT2440
uggcgcuggacagcgagcgccu

SEQ ID NO: 177358 - RNA, 22 nt, Pseudomonas putida KT2440
cuuucgcggcugaagccgcucc

SEQ ID NO: 177359 - RNA, 22 nt, Pseudomonas putida KT2440
gaggcuugcuguucaucggggc

SEQ ID NO: 177360 - RNA, 22 nt, Pseudomonas putida KT2440
cgcuugagcgaggcgcuggugg

SEQ ID NO: 177361 - RNA, 22 nt, Pseudomonas putida KT2440
ucaggucaccaucaaggcuggc

SEQ ID NO: 177362 - RNA, 22 nt, Pseudomonas putida KT2440
cucggaagucaggucuggcaag

SEQ ID NO: 177363 - RNA, 22 nt, Pseudomonas putida KT2440
uucgcgggugaacccgcuccua

SEQ ID NO: 177364 - RNA, 22 nt, Pseudomonas putida KT2440
cgcauucgcggguaagccuguu

SEQ ID NO: 177365 - RNA, 22 nt, Pseudomonas putida KT2440
acgugcccugaaagcuuuugcc

SEQ ID NO: 177366 - RNA, 22 nt, Pseudomonas putida KT2440
ccagcagugcggucuugccaga

SEQ ID NO: 177367 - RNA, 22 nt, Pseudomonas putida KT2440
ugcaggugauaguggcccacca

SEQ ID NO: 177368 - RNA, 23 nt, Pseudomonas putida KT2440
ccguuacuggaguuacgagcggc

SEQ ID NO: 177369 - RNA, 22 nt, Pseudomonas putida KT2440
aagcagcacaccgcggcacgcu

SEQ ID NO: 177370 - RNA, 20 nt, Pseudomonas putida KT2440
cugccaaaggugcauugccg

SEQ ID NO: 177371 - RNA, 22 nt, Pseudomonas putida KT2440
aaaccuguaccggcccuuucgc

SEQ ID NO: 177372 - RNA, 19 nt, Pseudomonas putida KT2440
agcuggucggcaucagcgc

SEQ ID NO: 177373 - RNA, 22 nt, Pseudomonas putida KT2440
acgccgcacauugccuguaugg

SEQ ID NO: 177374 - RNA, 22 nt, Pseudomonas putida KT2440
gccuggcugucggcuaccaccg

SEQ ID NO: 177375 - RNA, 22 nt, Pseudomonas putida KT2440
cgggccuucaauaagcuugucg

SEQ ID NO: 177376 - RNA, 22 nt, Pseudomonas putida KT2440
ucgggcucaguggccuggugcu

SEQ ID NO: 177377 - RNA, 22 nt, Pseudomonas putida KT2440
cuggcgcugauggcauacaccg

SEQ ID NO: 177378 - RNA, 22 nt, Pseudomonas putida KT2440
cagauucgugccauccagcgcg

SEQ ID NO: 177379 - RNA, 22 nt, Pseudomonas putida KT2440
cugugggagcggccuugugucg

SEQ ID NO: 177380 - RNA, 22 nt, Pseudomonas putida KT2440
agcguugacgauggcuuuccgc

SEQ ID NO: 177381 - RNA, 22 nt, Pseudomonas putida KT2440
ccagcgaacacuggcaaggccc

SEQ ID NO: 177382 - RNA, 22 nt, Pseudomonas putida KT2440
acgguguaugucgagcgccagc

SEQ ID NO: 177383 - RNA, 22 nt, Pseudomonas putida KT2440
aacccgcucccacaagggcguc

SEQ ID NO: 177384 - RNA, 22 nt, Pseudomonas putida KT2440
ugcccgcuggcuuccaggaucu

SEQ ID NO: 177385 - RNA, 22 nt, Pseudomonas putida KT2440
uugcgaaggcguuacgcuuccc

SEQ ID NO: 177386 - RNA, 22 nt, Pseudomonas putida KT2440
cgcuccuacagguucaccacag

SEQ ID NO: 177387 - RNA, 22 nt, Pseudomonas putida KT2440
acccgcuccuacaggggggcgc

SEQ ID NO: 177388 - RNA, 23 nt, Pseudomonas putida KT2440
uuguggcagcacgggugcagcag

SEQ ID NO: 177389 - RNA, 22 nt, Pseudomonas putida KT2440
agcugggucgaugcggaaaaca

SEQ ID NO: 177390 - RNA, 22 nt, Pseudomonas putida KT2440
caaggcuuuucauacgggccuu

SEQ ID NO: 177391 - RNA, 22 nt, Pseudomonas putida KT2440
cggccaacugcuguucgggggu

SEQ ID NO: 177392 - RNA, 22 nt, Pseudomonas putida KT2440
uuggccuguucgucgagcagaa

SEQ ID NO: 177393 - RNA, 22 nt, Pseudomonas putida KT2440
ugucaucgaccaguugcucgac

SEQ ID NO: 177394 - RNA, 22 nt, Pseudomonas putida KT2440
ggcugcuguggcgcaacgggcu

SEQ ID NO: 177395 - RNA, 22 nt, Pseudomonas putida KT2440
aggcggucagcgauggcuggau

SEQ ID NO: 177396 - RNA, 22 nt, Pseudomonas putida KT2440
cguuaucguucauucgcggcua

SEQ ID NO: 177397 - RNA, 22 nt, Pseudomonas putida KT2440
ccaguacgaccuggaugccccg

SEQ ID NO: 177398 - RNA, 22 nt, Pseudomonas putida KT2440
aaagcgcuugccgugcgcuucc

SEQ ID NO: 177399 - RNA, 22 nt, Pseudomonas putida KT2440
augcgcguggccgagcguaucc

SEQ ID NO: 177400 - RNA, 22 nt, Pseudomonas putida KT2440
agacgcgccuguauuucgaccu

SEQ ID NO: 177401 - RNA, 22 nt, Pseudomonas putida KT2440
cacggcuuacgaccuggccugg

SEQ ID NO: 177402 - RNA, 22 nt, Pseudomonas putida KT2440
guggaccagacaauggugcggu

SEQ ID NO: 177403 - RNA, 22 nt, Pseudomonas putida KT2440
uugccgcguuugacgcuggcgg

SEQ ID NO: 177404 - RNA, 22 nt, Pseudomonas putida KT2440
uccacagauuguugacagccca

SEQ ID NO: 177405 - RNA, 22 nt, Pseudomonas putida KT2440
uuguaggagcggguuuacccgc

SEQ ID NO: 177406 - RNA, 22 nt, Pseudomonas putida KT2440
cggcuaaagccgcuccuacagg

SEQ ID NO: 177407 - RNA, 22 nt, Pseudomonas putida KT2440
gcguugucuucggcguuggaca

SEQ ID NO: 177408 - RNA, 22 nt, Pseudomonas putida KT2440
gccgcugauguguggcccgagu

SEQ ID NO: 177409 - RNA, 22 nt, Pseudomonas putida KT2440
ugaccgguauugccagccguca

SEQ ID NO: 177410 - RNA, 22 nt, Pseudomonas putida KT2440
cgucggugaucacauagcuguu

SEQ ID NO: 177411 - RNA, 22 nt, Pseudomonas putida KT2440
cuugagcacgagugccauagca

SEQ ID NO: 177412 - RNA, 22 nt, Pseudomonas putida KT2440
uggucgucgagcuugggguugg

SEQ ID NO: 177413 - RNA, 22 nt, Pseudomonas putida KT2440
ugcugugcgcgaucuucauugc

SEQ ID NO: 177414 - RNA, 22 nt, Pseudomonas putida KT2440
gucuucggcggcuugcugagcg

SEQ ID NO: 177415 - RNA, 22 nt, Pseudomonas putida KT2440
gcagccuugcuuaccucgauca

SEQ ID NO: 177416 - RNA, 22 nt, Pseudomonas putida KT2440
ucggugccagcgcgcaugucca

SEQ ID NO: 177417 - RNA, 22 nt, Pseudomonas putida KT2440
aggguccaggcauugaucgcca

SEQ ID NO: 177418 - RNA, 22 nt, Pseudomonas putida KT2440
ggucgaggcuucgccaggcggu

SEQ ID NO: 177419 - RNA, 22 nt, Pseudomonas putida KT2440
cgauggugaaggccgcgugcac

SEQ ID NO: 177420 - RNA, 19 nt, Pseudomonas putida KT2440
ccagguuauugaaggcacg

SEQ ID NO: 177421 - RNA, 22 nt, Pseudomonas putida KT2440
uagcagauagugcaguuucaug

SEQ ID NO: 177422 - RNA, 23 nt, Pseudomonas putida KT2440
gacaccaucgcccuuaaugcugg

SEQ ID NO: 177423 - RNA, 22 nt, Pseudomonas putida KT2440
cugauuggucgcauucgcgggc

SEQ ID NO: 177424 - RNA, 22 nt, Pseudomonas putida KT2440
ucgcgggaagugauagccccgg

SEQ ID NO: 177425 - RNA, 22 nt, Pseudomonas putida KT2440
ucgccgaaacgguuuucaucag

SEQ ID NO: 177426 - RNA, 22 nt, Pseudomonas putida KT2440
gguugcaccgguguucgcgggu

SEQ ID NO: 177427 - RNA, 23 nt, Pseudomonas putida KT2440
cguugugcaccggugugauggac

SEQ ID NO: 177428 - RNA, 22 nt, Pseudomonas putida KT2440
cggucgugaagagagaucugag

SEQ ID NO: 177429 - RNA, 22 nt, Pseudomonas putida KT2440
guguaggcgaucugcuuguucg

SEQ ID NO: 177430 - RNA, 22 nt, Pseudomonas putida KT2440
aagucuguacaggccucuucgc

SEQ ID NO: 177431 - RNA, 22 nt, Pseudomonas putida KT2440
uggcagguguggauccaaugac

SEQ ID NO: 177432 - RNA, 21 nt, Pseudomonas putida KT2440
gugcagguuuugucaguaccc

SEQ ID NO: 177433 - RNA, 22 nt, Pseudomonas putida KT2440
uuccgccaggucuucgcuggcg

SEQ ID NO: 177434 - RNA, 22 nt, Pseudomonas putida KT2440
cucgcgcagguugagguugugg

SEQ ID NO: 177435 - RNA, 22 nt, Pseudomonas putida KT2440
aaugaucuugaacgcuucggua

SEQ ID NO: 177436 - RNA, 22 nt, Pseudomonas putida KT2440
cagcuucagccuggcgcugcag

SEQ ID NO: 177437 - RNA, 22 nt, Pseudomonas putida KT2440
cgcucccacagguucaccgcug

SEQ ID NO: 177438 - RNA, 22 nt, Pseudomonas putida KT2440
cgcgcuugccagggguagccaa

SEQ ID NO: 177439 - RNA, 22 nt, Pseudomonas putida KT2440
ugcaggagcgggcuugcccgca

SEQ ID NO: 177440 - RNA, 22 nt, Pseudomonas putida KT2440
gcuucgcggccaagccgcugcc

SEQ ID NO: 177441 - RNA, 22 nt, Pseudomonas putida KT2440
ucugcacgacaucuucuucgaa

SEQ ID NO: 177442 - RNA, 22 nt, Pseudomonas putida KT2440
uucgcgcuguggaccgugcugg

SEQ ID NO: 177443 - RNA, 22 nt, Pseudomonas putida KT2440
ugcaaucgauagacgcacguua

SEQ ID NO: 177444 - RNA, 22 nt, Pseudomonas putida KT2440
uggcccugcuguuggcccuggc

SEQ ID NO: 177445 - RNA, 22 nt, Pseudomonas putida KT2440
gaaguuggcguggucggugaaa

SEQ ID NO: 177446 - RNA, 22 nt, Pseudomonas putida KT2440
agcggccaguucccugucgcgc

SEQ ID NO: 177447 - RNA, 22 nt, Pseudomonas putida KT2440
gucggccagagccuucaguucg

SEQ ID NO: 177448 - RNA, 22 nt, Pseudomonas putida KT2440
cagcuggcauugggccauggcu

SEQ ID NO: 177449 - RNA, 22 nt, Pseudomonas putida KT2440
cacgguuggugcugcgccaaug

SEQ ID NO: 177450 - RNA, 20 nt, Pseudomonas putida KT2440
gcauucgcggguaaacccgc

SEQ ID NO: 177451 - RNA, 22 nt, Pseudomonas putida KT2440
guccagcgcagaggccacacgg

SEQ ID NO: 177452 - RNA, 22 nt, Pseudomonas putida KT2440
cgucgcugauagggagcgccca

SEQ ID NO: 177453 - RNA, 22 nt, Pseudomonas putida KT2440
ugcagugccugugagaucgagc

SEQ ID NO: 177454 - RNA, 22 nt, Pseudomonas putida KT2440
gcaggaucaagaaucaccgccg

SEQ ID NO: 177455 - RNA, 22 nt, Pseudomonas putida KT2440
gucuuccagcgaagcgucgggu

SEQ ID NO: 177456 - RNA, 22 nt, Pseudomonas putida KT2440
caacuggugggcagugcggcgg

SEQ ID NO: 177457 - RNA, 22 nt, Pseudomonas putida KT2440
gcaggucugaguaguucaggua

SEQ ID NO: 177458 - RNA, 22 nt, Pseudomonas putida KT2440
acccgcuccuacagguacauca

SEQ ID NO: 177459 - RNA, 22 nt, Pseudomonas putida KT2440
uggaccugugggagcgggcgcg

SEQ ID NO: 177460 - RNA, 22 nt, Pseudomonas putida KT2440
uggcagcuuacugcgugacguu

SEQ ID NO: 177461 - RNA, 22 nt, Pseudomonas putida KT2440
cgcggcuaaagccgcuccuacg

SEQ ID NO: 177462 - RNA, 22 nt, Pseudomonas putida KT2440
cgguauggucgguuccgugcuc

SEQ ID NO: 177463 - RNA, 22 nt, Pseudomonas putida KT2440
gcaggucggcugaauaaugaaa

SEQ ID NO: 177464 - RNA, 22 nt, Pseudomonas putida KT2440
uucgcgggcaagcccgcuucua

SEQ ID NO: 177465 - RNA, 22 nt, Pseudomonas putida KT2440
gagaaugccgauaucaguacga

SEQ ID NO: 177466 - RNA, 22 nt, Pseudomonas putida KT2440
aucgcgaagcccgccuggcggc

SEQ ID NO: 177467 - RNA, 20 nt, Pseudomonas putida KT2440
aacaggcgccauugccguug

SEQ ID NO: 177468 - RNA, 22 nt, Pseudomonas putida KT2440
gcgaaccagcuacggcgcugcu

SEQ ID NO: 177469 - RNA, 22 nt, Pseudomonas putida KT2440
ggcaggcucauggcgcgugccu

SEQ ID NO: 177470 - RNA, 22 nt, Pseudomonas putida KT2440
aggcgcugcuguugcaucgcgu

SEQ ID NO: 177471 - RNA, 22 nt, Pseudomonas putida KT2440
acccgcuccuacacgggucacc

SEQ ID NO: 177472 - RNA, 22 nt, Pseudomonas putida KT2440
guugcgcgaguuuguuguucag

SEQ ID NO: 177473 - RNA, 22 nt, Pseudomonas putida KT2440
ugcgccagggggcucgcgugcg

SEQ ID NO: 177474 - RNA, 22 nt, Pseudomonas putida KT2440
gccaggagcugacgccacuguu

SEQ ID NO: 177475 - RNA, 21 nt, Pseudomonas putida KT2440
accucggccugguagucgcgc

SEQ ID NO: 177476 - RNA, 22 nt, Pseudomonas putida KT2440
ucggugcaggccgcccgaggca

SEQ ID NO: 177477 - RNA, 22 nt, Pseudomonas putida KT2440
ggugccgaggaacugcggcgcg

SEQ ID NO: 177478 - RNA, 22 nt, Pseudomonas putida KT2440
gagcgcgagguugucggacucg

SEQ ID NO: 177479 - RNA, 22 nt, Pseudomonas putida KT2440
gagcggguuuacccgcgaauac

SEQ ID NO: 177480 - RNA, 22 nt, Pseudomonas putida KT2440
ggucgaugaagcccaguggucg

SEQ ID NO: 177481 - RNA, 23 nt, Pseudomonas putida KT2440
uggcccgucgcggucacagucgg

SEQ ID NO: 177482 - RNA, 22 nt, Pseudomonas putida KT2440
cagccucuucacggucugcggu

SEQ ID NO: 177483 - RNA, 22 nt, Pseudomonas putida KT2440
cccgcgaacaccggcgcagccg

SEQ ID NO: 177484 - RNA, 22 nt, Pseudomonas putida KT2440
cgauuaccaggacagcccggcg

SEQ ID NO: 177485 - RNA, 22 nt, Pseudomonas putida KT2440
cagcuggcggugguggguucgu

SEQ ID NO: 177486 - RNA, 22 nt, Pseudomonas putida KT2440
accaccugauccccuccggcuc

SEQ ID NO: 177487 - RNA, 22 nt, Pseudomonas putida KT2440
cggcagucaccaggucggugca

SEQ ID NO: 177488 - RNA, 22 nt, Pseudomonas putida KT2440
caggccacggucaaggucauga

SEQ ID NO: 177489 - RNA, 22 nt, Pseudomonas putida KT2440
caagcgccuugacgagaacaac

SEQ ID NO: 177490 - RNA, 22 nt, Pseudomonas putida KT2440
gugguacguaacacgcguugaa

SEQ ID NO: 177491 - RNA, 22 nt, Pseudomonas putida KT2440
auucgcggguaaacccgcuccu

SEQ ID NO: 177492 - RNA, 22 nt, Pseudomonas putida KT2440
uacucgaggucacagucgauca

SEQ ID NO: 177493 - RNA, 22 nt, Pseudomonas putida KT2440
gucacugacgaugucgauaccg

SEQ ID NO: 177494 - RNA, 22 nt, Pseudomonas putida KT2440
aagcggcugguaguaggugggu

SEQ ID NO: 177495 - RNA, 22 nt, Pseudomonas putida KT2440
uacuucgaacgcagggccauga

SEQ ID NO: 177496 - RNA, 22 nt, Pseudomonas putida KT2440
cgguggcuuguugcugaucgaa

SEQ ID NO: 177497 - RNA, 22 nt, Pseudomonas putida KT2440
gugaacggccgucacacaggcg

SEQ ID NO: 177498 - RNA, 22 nt, Pseudomonas putida KT2440
ggccucuucgcgggcgaguccc

SEQ ID NO: 177499 - RNA, 22 nt, Pseudomonas putida KT2440
ucaggccuuugucgaaggcauc

SEQ ID NO: 177500 - RNA, 22 nt, Pseudomonas putida KT2440
ggccucuucgcggguaaacccu

SEQ ID NO: 177501 - RNA, 22 nt, Pseudomonas putida KT2440
gccgcugugcacccgggccaca

SEQ ID NO: 177502 - RNA, 22 nt, Pseudomonas putida KT2440
guauucgcggguaaacccgcuc

SEQ ID NO: 177503 - RNA, 22 nt, Pseudomonas putida KT2440
guaaacccgcuccuacaggauc

SEQ ID NO: 177504 - RNA, 22 nt, Pseudomonas putida KT2440
ggugcggagcgccccuacgauu

SEQ ID NO: 177505 - RNA, 22 nt, Pseudomonas putida KT2440
agccgccucgaaggccugcaca

SEQ ID NO: 177506 - RNA, 21 nt, Pseudomonas putida KT2440
accggcaguggcuuguucagg

SEQ ID NO: 177507 - RNA, 21 nt, Pseudomonas putida KT2440
acccucgcuggggugcaugcu

SEQ ID NO: 177508 - RNA, 22 nt, Pseudomonas putida KT2440
uuccugaucucggcgacgccga

SEQ ID NO: 177509 - RNA, 22 nt, Pseudomonas putida KT2440
cgcucgaucucauaggcgcuga

SEQ ID NO: 177510 - RNA, 22 nt, Pseudomonas putida KT2440
acucgaguuugcugccuucgua

SEQ ID NO: 177511 - RNA, 23 nt, Pseudomonas putida KT2440
ccuggcucaggcuauguaccaau

SEQ ID NO: 177512 - RNA, 22 nt, Pseudomonas putida KT2440
uucaucacugcgcgcagccuca

SEQ ID NO: 177513 - RNA, 22 nt, Pseudomonas putida KT2440
cuacaucgauaucuucguggcc

SEQ ID NO: 177514 - RNA, 22 nt, Pseudomonas putida KT2440
agcagguggagaucaucaccag

SEQ ID NO: 177515 - RNA, 22 nt, Pseudomonas putida KT2440
acgcugaccugccugccgguag

SEQ ID NO: 177516 - RNA, 22 nt, Pseudomonas putida KT2440
caaggcggugaccaccacgaag

SEQ ID NO: 177517 - RNA, 22 nt, Pseudomonas putida KT2440
gcguugccugcuucgcggguga

SEQ ID NO: 177518 - RNA, 22 nt, Pseudomonas putida KT2440
ucgcagcggguggucacagcca

SEQ ID NO: 177519 - RNA, 22 nt, Pseudomonas putida KT2440
caagcugaucaagcgcgaggag

SEQ ID NO: 177520 - RNA, 22 nt, Pseudomonas putida KT2440
cgcggguaaagccgcaccugca

SEQ ID NO: 177521 - RNA, 22 nt, Pseudomonas putida KT2440
uuuggccguaucgaauacagca

SEQ ID NO: 177522 - RNA, 22 nt, Pseudomonas putida KT2440
ugcgccagggcgaugugcuguu

SEQ ID NO: 177523 - RNA, 22 nt, Pseudomonas putida KT2440
ucgccgguguucgcgggcgugc

SEQ ID NO: 177524 - RNA, 22 nt, Pseudomonas putida KT2440
uccggcaaugcaccuuuggcag

SEQ ID NO: 177525 - RNA, 22 nt, Pseudomonas putida KT2440
uacacccuaccggcaggcaggu

SEQ ID NO: 177526 - RNA, 23 nt, Pseudomonas putida KT2440
aacuggccccagaggcuuuugcc

SEQ ID NO: 177527 - RNA, 22 nt, Pseudomonas putida KT2440
uaccugguggucgauacgcccg

SEQ ID NO: 177528 - RNA, 22 nt, Pseudomonas putida KT2440
cggcaaugaccucggcaggaag

SEQ ID NO: 177529 - RNA, 21 nt, Pseudomonas putida KT2440
uguucgcugccgccugcuguc

SEQ ID NO: 177530 - RNA, 22 nt, Pseudomonas putida KT2440
gguggcaggaucgauguucaug

SEQ ID NO: 177531 - RNA, 22 nt, Pseudomonas putida KT2440
cugcuguucggcauugaccaug

SEQ ID NO: 177532 - RNA, 22 nt, Pseudomonas putida KT2440
aggugugcgugucauaggucuu

SEQ ID NO: 177533 - RNA, 22 nt, Pseudomonas putida KT2440
cguguaccugaucgacagcggc

SEQ ID NO: 177534 - RNA, 22 nt, Pseudomonas putida KT2440
ccguccugcugcuccagccauu

SEQ ID NO: 177535 - RNA, 22 nt, Pseudomonas putida KT2440
cuggucuggccucuucgcgggu

SEQ ID NO: 177536 - RNA, 22 nt, Pseudomonas putida KT2440
ggucgaccucgacaggcugcug

SEQ ID NO: 177537 - RNA, 22 nt, Pseudomonas putida KT2440
ugggccguggcuuugccguggu

SEQ ID NO: 177538 - RNA, 22 nt, Pseudomonas putida KT2440
auggugcugcuguugccggccc

SEQ ID NO: 177539 - RNA, 22 nt, Pseudomonas putida KT2440
caggccaugcaacgauccgggc

SEQ ID NO: 177540 - RNA, 22 nt, Pseudomonas putida KT2440
cgugucgccugauucgcgggca

SEQ ID NO: 177541 - RNA, 22 nt, Pseudomonas putida KT2440
gaucuggccuugcucagccaac

SEQ ID NO: 177542 - RNA, 22 nt, Pseudomonas putida KT2440
ccgcccaugaaccgucugccuu

SEQ ID NO: 177543 - RNA, 22 nt, Pseudomonas putida KT2440
accugccacuggucagcgccug

SEQ ID NO: 177544 - RNA, 22 nt, Pseudomonas putida KT2440
cgggaugagcgaccugugggaa

SEQ ID NO: 177545 - RNA, 21 nt, Pseudomonas putida KT2440
cgcucagguagugcggcacug

SEQ ID NO: 177546 - RNA, 22 nt, Pseudomonas putida KT2440
uggucgcuguugacccggguaa

SEQ ID NO: 177547 - RNA, 22 nt, Pseudomonas putida KT2440
aacugggcggccuggucgggca

SEQ ID NO: 177548 - RNA, 22 nt, Pseudomonas putida KT2440
cgguugccuggccaugcgccug

SEQ ID NO: 177549 - RNA, 22 nt, Pseudomonas putida KT2440
cauuggcuucgauuuuaucccg

SEQ ID NO: 177550 - RNA, 22 nt, Pseudomonas putida KT2440
augagcuuggcccaggggcacu

SEQ ID NO: 177551 - RNA, 22 nt, Pseudomonas putida KT2440
uacggcuuccucgagugcguca

SEQ ID NO: 177552 - RNA, 22 nt, Pseudomonas putida KT2440
aggucguauugccaacuggcgg

SEQ ID NO: 177553 - RNA, 22 nt, Pseudomonas putida KT2440
gcgugcaguuuucaagcuguug

SEQ ID NO: 177554 - RNA, 22 nt, Pseudomonas putida KT2440
caguggcccggagcggucaagc

SEQ ID NO: 177555 - RNA, 22 nt, Pseudomonas putida KT2440
gcgugcguaaccuggcugguuu

SEQ ID NO: 177556 - RNA, 22 nt, Pseudomonas putida KT2440
uuugccaggcagggcggcguuu

SEQ ID NO: 177557 - RNA, 22 nt, Pseudomonas putida KT2440
gauguucguggucaucuucauc

SEQ ID NO: 177558 - RNA, 22 nt, Pseudomonas putida KT2440
gcgcaaggcggugucggccagc

SEQ ID NO: 177559 - RNA, 22 nt, Pseudomonas putida KT2440
cugggucugagaaccaucgggg

SEQ ID NO: 177560 - RNA, 22 nt, Pseudomonas putida KT2440
gccguuggugguuaccuugcca

SEQ ID NO: 177561 - RNA, 22 nt, Pseudomonas putida KT2440
aucaucgcccuucggcgccacc

SEQ ID NO: 177562 - RNA, 22 nt, Pseudomonas putida KT2440
gacguuaccgcacgcuugccgg

SEQ ID NO: 177563 - RNA, 22 nt, Pseudomonas putida KT2440
ucgcugagcgggaucgggccaa

SEQ ID NO: 177564 - RNA, 22 nt, Pseudomonas putida KT2440
ccaucagugccaaugccagcac

SEQ ID NO: 177565 - RNA, 22 nt, Pseudomonas putida KT2440
caccugugaggggcgggucugc

SEQ ID NO: 177566 - RNA, 20 nt, Pseudomonas putida KT2440
agcaaugccgcagggcagga

SEQ ID NO: 177567 - RNA, 22 nt, Pseudomonas putida KT2440
acuguucguaguagccucgccc

SEQ ID NO: 177568 - RNA, 22 nt, Pseudomonas putida KT2440
gcucuucgcgagcgagucagac

SEQ ID NO: 177569 - RNA, 22 nt, Pseudomonas putida KT2440
cuggacugccgcgacggcgcuu

SEQ ID NO: 177570 - RNA, 22 nt, Pseudomonas putida KT2440
agcaucaucgacgauugcguga

SEQ ID NO: 177571 - RNA, 22 nt, Pseudomonas putida KT2440
cccgcgaacaccggcuacgccg

SEQ ID NO: 177572 - RNA, 22 nt, Pseudomonas putida KT2440
cggcgugagcugguggccgagc

SEQ ID NO: 177573 - RNA, 19 nt, Pseudomonas putida KT2440
ggcguugagcugcuggcgu

SEQ ID NO: 177574 - RNA, 22 nt, Pseudomonas putida KT2440
gaucggugugcgguagcguagc

SEQ ID NO: 177575 - RNA, 22 nt, Pseudomonas putida KT2440
ugucgagaaaauucugguuggc

SEQ ID NO: 177576 - RNA, 22 nt, Pseudomonas putida KT2440
ccaguacugugugcucagcggu

SEQ ID NO: 177577 - RNA, 22 nt, Pseudomonas putida KT2440
uguaggagcggguuuacccgcg

SEQ ID NO: 177578 - RNA, 22 nt, Pseudomonas putida KT2440
caaggcccgcuugguugauucg

SEQ ID NO: 177579 - RNA, 22 nt, Pseudomonas putida KT2440
ucacggugauccucgacagcau

SEQ ID NO: 177580 - RNA, 22 nt, Pseudomonas putida KT2440
uguaggagcggauuuacccgcg

SEQ ID NO: 177581 - RNA, 22 nt, Pseudomonas putida KT2440
ugaacgacacccccgaggcgcu

SEQ ID NO: 177582 - RNA, 19 nt, Pseudomonas putida KT2440
acaccucgaugucgcugcc

SEQ ID NO: 177583 - RNA, 22 nt, Pseudomonas putida KT2440
gugcagcgccugccagaucgug

SEQ ID NO: 177584 - RNA, 22 nt, Pseudomonas putida KT2440
ggugcuacuuggugcuucugcu

SEQ ID NO: 177585 - RNA, 22 nt, Pseudomonas putida KT2440
gcugucagcgaugcauucgaaa

SEQ ID NO: 177586 - RNA, 22 nt, Pseudomonas putida KT2440
gcgguuccagguuacgccgaug

SEQ ID NO: 177587 - RNA, 22 nt, Pseudomonas putida KT2440
ugcaccgucucuguguaggagc

SEQ ID NO: 177588 - RNA, 22 nt, Pseudomonas putida KT2440
accguauucgcggguaaacccg

SEQ ID NO: 177589 - RNA, 22 nt, Pseudomonas putida KT2440
ucccuguaggagcggcuucagc

SEQ ID NO: 177590 - RNA, 22 nt, Pseudomonas putida KT2440
uguucgcugagguugccgcuga

SEQ ID NO: 177591 - RNA, 22 nt, Pseudomonas putida KT2440
ugggccuguaugaaaagccuug

SEQ ID NO: 177592 - RNA, 22 nt, Pseudomonas putida KT2440
caccuugccguggcuggccggu

SEQ ID NO: 177593 - RNA, 22 nt, Pseudomonas putida KT2440
cgugcuuuuuaaccuggccagu

SEQ ID NO: 177594 - RNA, 22 nt, Pseudomonas putida KT2440
cauuugugucgacagcgagccu

SEQ ID NO: 177595 - RNA, 22 nt, Pseudomonas putida KT2440
gcagcugcuggaccugccgguu

SEQ ID NO: 177596 - RNA, 22 nt, Pseudomonas putida KT2440
ugggucgaugacgauggcccgg

SEQ ID NO: 177597 - RNA, 22 nt, Pseudomonas putida KT2440
cgguugucgcgggcauccaccu

SEQ ID NO: 177598 - RNA, 21 nt, Pseudomonas putida KT2440
uguaggcuuugaccccggccu

SEQ ID NO: 177599 - RNA, 22 nt, Pseudomonas putida KT2440
ucgccggugccgauggcaaagc

SEQ ID NO: 177600 - RNA, 22 nt, Pseudomonas putida KT2440
cugucgggccgaccagcccacc

SEQ ID NO: 177601 - RNA, 22 nt, Pseudomonas putida KT2440
cggccaugaaugucgcgccgca

SEQ ID NO: 177602 - RNA, 19 nt, Pseudomonas putida KT2440
ugcgccguggauagagugg

SEQ ID NO: 177603 - RNA, 22 nt, Pseudomonas putida KT2440
uggcaguugcaguucgaacaag

SEQ ID NO: 177604 - RNA, 22 nt, Pseudomonas putida KT2440
cggcaacauccgucagcuggaa

SEQ ID NO: 177605 - RNA, 17 nt, Pseudomonas putida KT2440
uugucgacaaucuugga

SEQ ID NO: 177606 - RNA, 22 nt, Pseudomonas putida KT2440
gcgcaguuuuugccccaccacg

SEQ ID NO: 177607 - RNA, 22 nt, Pseudomonas putida KT2440
gcugcccaggccggaacugagg

SEQ ID NO: 177608 - RNA, 22 nt, Pseudomonas putida KT2440
ugcucaguacgcggcuuugcgg

SEQ ID NO: 177609 - RNA, 22 nt, Pseudomonas putida KT2440
aagcagugccgcgcuggugcgc

SEQ ID NO: 177610 - RNA, 22 nt, Pseudomonas putida KT2440
agcugcgagaaggcgaugacca

SEQ ID NO: 177611 - RNA, 22 nt, Pseudomonas putida KT2440
acgcuguucaugcgcuccaugg

SEQ ID NO: 177612 - RNA, 22 nt, Pseudomonas putida KT2440
aucgcccugguccagcacggug

SEQ ID NO: 177613 - RNA, 22 nt, Pseudomonas putida KT2440
ucaccgugccggccaacggcac

SEQ ID NO: 177614 - RNA, 22 nt, Pseudomonas putida KT2440
gcgcaggucggcagcaaucggc

SEQ ID NO: 177615 - RNA, 22 nt, Pseudomonas putida KT2440
gcaggagcggguuuacccgcga

SEQ ID NO: 177616 - RNA, 22 nt, Pseudomonas putida KT2440
accgcgcucuucaagguggcgg

SEQ ID NO: 177617 - RNA, 22 nt, Pseudomonas putida KT2440
ccggugugggcuugcccagcca

SEQ ID NO: 177618 - RNA, 22 nt, Pseudomonas putida KT2440
cucggucacccgcagcguggcc

SEQ ID NO: 177619 - RNA, 21 nt, Pseudomonas putida KT2440
uacccugaacgugcgccugga

SEQ ID NO: 177620 - RNA, 22 nt, Pseudomonas putida KT2440
agcuugugguucugaugcugca

SEQ ID NO: 177621 - RNA, 22 nt, Pseudomonas putida KT2440
ugggcgaucgacagcagcaggu

SEQ ID NO: 177622 - RNA, 22 nt, Pseudomonas putida KT2440
acucaccgcggaaaguccgccg

SEQ ID NO: 177623 - RNA, 22 nt, Pseudomonas putida KT2440
gucagcgaggugauggcaccgu

SEQ ID NO: 177624 - RNA, 22 nt, Pseudomonas putida KT2440
aacgggucuuguggaaagggga

SEQ ID NO: 177625 - RNA, 22 nt, Pseudomonas putida KT2440
cacgccgaugucgugcucgauc

SEQ ID NO: 177626 - RNA, 22 nt, Pseudomonas putida KT2440
cuggaugucgucgaggucguag

SEQ ID NO: 177627 - RNA, 22 nt, Pseudomonas putida KT2440
agccaggcgcuggaucaguuga

SEQ ID NO: 177628 - RNA, 22 nt, Pseudomonas putida KT2440
cuccaggaaggguacgguugga

SEQ ID NO: 177629 - RNA, 22 nt, Pseudomonas putida KT2440
uugcucggcuggcuggcucagc

SEQ ID NO: 177630 - RNA, 22 nt, Pseudomonas putida KT2440
cgccgaguucugccuggugucg

SEQ ID NO: 177631 - RNA, 22 nt, Pseudomonas putida KT2440
uugccuguucuggccgcuucgc

SEQ ID NO: 177632 - RNA, 22 nt, Pseudomonas putida KT2440
uccagguguuacgcagcacauc

SEQ ID NO: 177633 - RNA, 22 nt, Pseudomonas putida KT2440
gcggucaguggcuucaucgguc

SEQ ID NO: 177634 - RNA, 22 nt, Pseudomonas putida KT2440
cgccagcuccaucagugggaac

SEQ ID NO: 177635 - RNA, 22 nt, Pseudomonas putida KT2440
gcugcugccagggcaauggaug

SEQ ID NO: 177636 - RNA, 22 nt, Pseudomonas putida KT2440
ugacagccaucagcaucggaug

SEQ ID NO: 177637 - RNA, 22 nt, Pseudomonas putida KT2440
ccgugaaguggacugcaugcag

SEQ ID NO: 177638 - RNA, 22 nt, Pseudomonas putida KT2440
guggacgaggugguuuucgacg

SEQ ID NO: 177639 - RNA, 21 nt, Pseudomonas putida KT2440
gccugcuugaugaucgagauc

SEQ ID NO: 177640 - RNA, 22 nt, Pseudomonas putida KT2440
ccugugcugcaccugugggagc

SEQ ID NO: 177641 - RNA, 22 nt, Pseudomonas putida KT2440
cugcgcugucuuccggcagcug

SEQ ID NO: 177642 - RNA, 22 nt, Pseudomonas putida KT2440
aucgagcaccaccacauggugg

SEQ ID NO: 177643 - RNA, 22 nt, Pseudomonas putida KT2440
gaucgaggcgcugcgccaguug

SEQ ID NO: 177644 - RNA, 22 nt, Pseudomonas putida KT2440
uacugcgccaccagcguuccgg

SEQ ID NO: 177645 - RNA, 21 nt, Pseudomonas putida KT2440
caccuggcgauguggaugggg

SEQ ID NO: 177646 - RNA, 22 nt, Pseudomonas putida KT2440
gaacgcaaagcggcgacuuggc

SEQ ID NO: 177647 - RNA, 22 nt, Pseudomonas putida KT2440
gcgcuaccguuccugcugaccc

SEQ ID NO: 177648 - RNA, 22 nt, Pseudomonas putida KT2440
aggaagccgaaguuguugcgga

SEQ ID NO: 177649 - RNA, 22 nt, Pseudomonas putida KT2440
acaggcgcccgagcacacggcg

SEQ ID NO: 177650 - RNA, 22 nt, Pseudomonas putida KT2440
acaccgcucuccaugaaacuca

SEQ ID NO: 177651 - RNA, 22 nt, Pseudomonas putida KT2440
uugugcaggcucaacguggcac

SEQ ID NO: 177652 - RNA, 22 nt, Pseudomonas putida KT2440
gaccgugcaguguucauuaccc

SEQ ID NO: 177653 - RNA, 22 nt, Pseudomonas putida KT2440
cugggcaacgaagagauggcgc

SEQ ID NO: 177654 - RNA, 22 nt, Pseudomonas putida KT2440
gauuggcagccaggccacggua

SEQ ID NO: 177655 - RNA, 22 nt, Pseudomonas putida KT2440
cucggucggccgggguaaaagc

SEQ ID NO: 177656 - RNA, 22 nt, Pseudomonas putida KT2440
cacgaccuggucgugacccuga

SEQ ID NO: 177657 - RNA, 22 nt, Pseudomonas putida KT2440
gcaggcuucaaggccacgcggu

SEQ ID NO: 177658 - RNA, 22 nt, Pseudomonas putida KT2440
augauguucaagucguauucgg

SEQ ID NO: 177659 - RNA, 23 nt, Pseudomonas putida KT2440
ugcuggcgcggaagucgcugagc

SEQ ID NO: 177660 - RNA, 22 nt, Pseudomonas putida KT2440
uucgccauguuccagcagcagc

SEQ ID NO: 177661 - RNA, 22 nt, Pseudomonas putida KT2440
cguggcacugcgucaaaacccg

SEQ ID NO: 177662 - RNA, 22 nt, Pseudomonas putida KT2440
ugcugucguuacgccacuguug

SEQ ID NO: 177663 - RNA, 22 nt, Pseudomonas putida KT2440
gucgaccgaauaacuguuggca

SEQ ID NO: 177664 - RNA, 22 nt, Pseudomonas putida KT2440
uguaggcgcggguuuacccgcg

SEQ ID NO: 177665 - RNA, 22 nt, Pseudomonas putida KT2440
aagucgaucccguccaacguac

SEQ ID NO: 177666 - RNA, 22 nt, Pseudomonas putida KT2440
uugccgucgaguucgaccugcu

SEQ ID NO: 177667 - RNA, 22 nt, Pseudomonas putida KT2440
guugccgcugcguacgcccuug

SEQ ID NO: 177668 - RNA, 21 nt, Pseudomonas putida KT2440
ucugaucguugaucggcgaag

SEQ ID NO: 177669 - RNA, 22 nt, Pseudomonas putida KT2440
gggcgguagcgcaugcagcggu

SEQ ID NO: 177670 - RNA, 22 nt, Pseudomonas putida KT2440
cugcgucagguggugaccaagu

SEQ ID NO: 177671 - RNA, 21 nt, Pseudomonas putida KT2440
uugccgggcaugcuuggcggu

SEQ ID NO: 177672 - RNA, 22 nt, Pseudomonas putida KT2440
aaccgcuaccugcucagcgccu

SEQ ID NO: 177673 - RNA, 22 nt, Pseudomonas putida KT2440
ggccgguuugcuggugcuggca

SEQ ID NO: 177674 - RNA, 22 nt, Pseudomonas putida KT2440
cgaggcuugaggccuggcaguc

SEQ ID NO: 177675 - RNA, 22 nt, Pseudomonas putida KT2440
ugauggcguagcucagcagcgu

SEQ ID NO: 177676 - RNA, 22 nt, Pseudomonas putida KT2440
ccuguaggaacggcuuuagccg

SEQ ID NO: 177677 - RNA, 22 nt, Pseudomonas putida KT2440
agccagcggcgcuacccguucu

SEQ ID NO: 177678 - RNA, 22 nt, Pseudomonas putida KT2440
accuguggcgcuggcuugccgg

SEQ ID NO: 177679 - RNA, 22 nt, Pseudomonas putida KT2440
aguggcguggucaugacgaggc

SEQ ID NO: 177680 - RNA, 22 nt, Pseudomonas putida KT2440
ugggcaaguuugccgacguagu

SEQ ID NO: 177681 - RNA, 22 nt, Pseudomonas putida KT2440
gauggccaagcgggagauugug

SEQ ID NO: 177682 - RNA, 22 nt, Pseudomonas putida KT2440
cgcgacgaaacgcuccgaaugc

SEQ ID NO: 177683 - RNA, 22 nt, Pseudomonas putida KT2440
gcgcaagaggcggcgaucaucu

SEQ ID NO: 177684 - RNA, 22 nt, Pseudomonas putida KT2440
ugcgggcaagaccgcgccugca

SEQ ID NO: 177685 - RNA, 22 nt, Pseudomonas putida KT2440
uggccugcugccgccguggggu

SEQ ID NO: 177686 - RNA, 22 nt, Pseudomonas putida KT2440
gaugcuggcagcgccgcgcagu

SEQ ID NO: 177687 - RNA, 22 nt, Pseudomonas putida KT2440
ggccaugcuuuucucgaucauc

SEQ ID NO: 177688 - RNA, 22 nt, Pseudomonas putida KT2440
ccuggcucaagaagcuggcucg

SEQ ID NO: 177689 - RNA, 22 nt, Pseudomonas putida KT2440
ugcaggcgcggucuugcccgca

SEQ ID NO: 177690 - RNA, 22 nt, Pseudomonas putida KT2440
ccgcagucaccugugucggugc

SEQ ID NO: 177691 - RNA, 22 nt, Pseudomonas putida KT2440
cgcggguaaaccagcuccuaca

SEQ ID NO: 177692 - RNA, 22 nt, Pseudomonas putida KT2440
cgcggguaaacccgcgccuaca

SEQ ID NO: 177693 - RNA, 22 nt, Pseudomonas putida KT2440
agcccgcuccugcagauuaccc

SEQ ID NO: 177694 - RNA, 22 nt, Pseudomonas putida KT2440
guugccacuggugcugcugcag

SEQ ID NO: 177695 - RNA, 22 nt, Pseudomonas putida KT2440
cagaccgucguaggagcggguu

SEQ ID NO: 177696 - RNA, 22 nt, Pseudomonas putida KT2440
aggcugacccgcgccaucaugg

SEQ ID NO: 177697 - RNA, 22 nt, Pseudomonas putida KT2440
accgggcagauccacggccuga

SEQ ID NO: 177698 - RNA, 22 nt, Pseudomonas putida KT2440
cgcuccuacagggguagcgcca

SEQ ID NO: 177699 - RNA, 22 nt, Pseudomonas putida KT2440
ugcagauuccguaggagcgggc

SEQ ID NO: 177700 - RNA, 22 nt, Pseudomonas putida KT2440
ccguaggaucggguuuacccgc

SEQ ID NO: 177701 - RNA, 20 nt, Pseudomonas putida KT2440
gucacugccuugccauuggc

SEQ ID NO: 177702 - RNA, 22 nt, Pseudomonas putida KT2440
ugauagccucgauaguggaguc

SEQ ID NO: 177703 - RNA, 22 nt, Pseudomonas putida KT2440
uucgcggguaaacccgccccua

SEQ ID NO: 177704 - RNA, 23 nt, Pseudomonas putida KT2440
acuugcccaccgccgugaccagc

SEQ ID NO: 177705 - RNA, 22 nt, Pseudomonas putida KT2440
augaggaucuugugcgccucca

SEQ ID NO: 177706 - RNA, 22 nt, Pseudomonas putida KT2440
ugggugaccguggagcgggcgc

SEQ ID NO: 177707 - RNA, 22 nt, Pseudomonas putida KT2440
ugcacgucagucuugggcacgc

SEQ ID NO: 177708 - RNA, 22 nt, Pseudomonas putida KT2440
uuuccaauaauccauggcaacc

SEQ ID NO: 177709 - RNA, 22 nt, Pseudomonas putida KT2440
ugguccaugccgaacagguaga

SEQ ID NO: 177710 - RNA, 22 nt, Pseudomonas putida KT2440
uccuugugggagcgggcgggcc

SEQ ID NO: 177711 - RNA, 22 nt, Pseudomonas putida KT2440
agguggcugcccaaugacucgg

SEQ ID NO: 177712 - RNA, 22 nt, Pseudomonas putida KT2440
cgauggccguacgguagugcuc

SEQ ID NO: 177713 - RNA, 19 nt, Pseudomonas putida KT2440
uggcacaaaugaaggcaug

SEQ ID NO: 177714 - RNA, 22 nt, Pseudomonas putida KT2440
cauaagcucuuugaaaaugcuu

SEQ ID NO: 177715 - RNA, 20 nt, Pseudomonas putida KT2440
uugaacccggacugacgcuu

SEQ ID NO: 177716 - RNA, 22 nt, Pseudomonas putida KT2440
aacccgcuccuacaggauggcc

SEQ ID NO: 177717 - RNA, 22 nt, Pseudomonas putida KT2440
gcgaaaucaugucgucgugccu

SEQ ID NO: 177718 - RNA, 22 nt, Pseudomonas putida KT2440
gcaguaccugugggagcgggcg

SEQ ID NO: 177719 - RNA, 22 nt, Pseudomonas putida KT2440
cugugggaacgggcaagcccgc

SEQ ID NO: 177720 - RNA, 22 nt, Pseudomonas putida KT2440
augacccacgugaccauuguca

SEQ ID NO: 177721 - RNA, 22 nt, Pseudomonas putida KT2440
uugcagugcugagcauguucug

SEQ ID NO: 177722 - RNA, 22 nt, Pseudomonas putida KT2440
aucggcgccauuggcuuugcgc

SEQ ID NO: 177723 - RNA, 22 nt, Pseudomonas putida KT2440
aucugcgccuggaccgcggcga

SEQ ID NO: 177724 - RNA, 22 nt, Pseudomonas putida KT2440
gccuguucaccgacacugccga

SEQ ID NO: 177725 - RNA, 22 nt, Pseudomonas putida KT2440
ccuguucggucuugccgaccca

SEQ ID NO: 177726 - RNA, 22 nt, Pseudomonas putida KT2440
cgcuccuacagguacagugcag

SEQ ID NO: 177727 - RNA, 22 nt, Pseudomonas putida KT2440
cuucgccaugcaaggcgccgug

SEQ ID NO: 177728 - RNA, 22 nt, Pseudomonas putida KT2440
cugcaguuucguagcgaaggcg

SEQ ID NO: 177729 - RNA, 23 nt, Pseudomonas putida KT2440
guaggcagccacuuccaggugga

SEQ ID NO: 177730 - RNA, 22 nt, Pseudomonas putida KT2440
cgcggucugguaccgccgggug

SEQ ID NO: 177731 - RNA, 22 nt, Pseudomonas putida KT2440
ggccaguuucucggugcccaug

SEQ ID NO: 177732 - RNA, 22 nt, Pseudomonas putida KT2440
uaggagcgggcuugcccgcgaa

SEQ ID NO: 177733 - RNA, 22 nt, Pseudomonas putida KT2440
gcgggugaacccgcuccuacca

SEQ ID NO: 177734 - RNA, 22 nt, Pseudomonas putida KT2440
uccggcgaguuggcccgcgagc

SEQ ID NO: 177735 - RNA, 22 nt, Pseudomonas putida KT2440
aucagcccgucgcagaugggca

SEQ ID NO: 177736 - RNA, 22 nt, Pseudomonas putida KT2440
gccagugagcaccgcggacaag

SEQ ID NO: 177737 - RNA, 22 nt, Pseudomonas putida KT2440
cugccugggcggcgcuguucgc

SEQ ID NO: 177738 - RNA, 22 nt, Pseudomonas putida KT2440
acaaaggcgccguguugccccg

SEQ ID NO: 177739 - RNA, 22 nt, Pseudomonas putida KT2440
uagcugaggccguuggugcccg

SEQ ID NO: 177740 - RNA, 22 nt, Pseudomonas putida KT2440
uccguggucgggcccaaugccu

SEQ ID NO: 177741 - RNA, 22 nt, Pseudomonas putida KT2440
ggugugccacgugcgcuggagc

SEQ ID NO: 177742 - RNA, 22 nt, Pseudomonas putida KT2440
cuguucgacuuccagccgcugg

SEQ ID NO: 177743 - RNA, 22 nt, Pseudomonas putida KT2440
ccaguucaccgcgcauggcgcg

SEQ ID NO: 177744 - RNA, 22 nt, Pseudomonas putida KT2440
cuugagccuuggacgccuggcc

SEQ ID NO: 177745 - RNA, 22 nt, Pseudomonas putida KT2440
cgcguaccugagcucggggaga

SEQ ID NO: 177746 - RNA, 22 nt, Pseudomonas putida KT2440
acgguacagcguucaggaugga

SEQ ID NO: 177747 - RNA, 22 nt, Pseudomonas putida KT2440
ggcucgaucugcugcagggcuu

SEQ ID NO: 177748 - RNA, 22 nt, Pseudomonas putida KT2440
acgguaauggguaucccuugcg

SEQ ID NO: 177749 - RNA, 22 nt, Pseudomonas putida KT2440
uacccgcgaaagggccagcaca

SEQ ID NO: 177750 - RNA, 22 nt, Pseudomonas putida KT2440
ggcgaucuugcugcccaggcgg

SEQ ID NO: 177751 - RNA, 22 nt, Pseudomonas putida KT2440
gaucccggggcgcauugcgacg

SEQ ID NO: 177752 - RNA, 22 nt, Pseudomonas putida KT2440
augcccgcgaauacgucagcag

SEQ ID NO: 177753 - RNA, 22 nt, Pseudomonas putida KT2440
augcgcaggucuucgccgauca

SEQ ID NO: 177754 - RNA, 18 nt, Pseudomonas putida KT2440
gccaaaugccuccagcuc

SEQ ID NO: 177755 - RNA, 22 nt, Pseudomonas putida KT2440
ucguucgcuacgcuggaagugc

SEQ ID NO: 177756 - RNA, 22 nt, Pseudomonas putida KT2440
uguagcggcggguuuacccgcg

SEQ ID NO: 177757 - RNA, 22 nt, Pseudomonas putida KT2440
acguccaguggcgagugcugca

SEQ ID NO: 177758 - RNA, 21 nt, Pseudomonas putida KT2440
gugcugcgcccuugccuggca

SEQ ID NO: 177759 - RNA, 22 nt, Pseudomonas putida KT2440
ccauuccgcugaaucgcggagu

SEQ ID NO: 177760 - RNA, 22 nt, Pseudomonas putida KT2440
gccgugcucccagcggguacgu

SEQ ID NO: 177761 - RNA, 22 nt, Pseudomonas putida KT2440
acaucaaggacaauugcuucau

SEQ ID NO: 177762 - RNA, 20 nt, Pseudomonas putida KT2440
gcggagcagaagaacaacac

SEQ ID NO: 177763 - RNA, 22 nt, Pseudomonas putida KT2440
ggacuacaccaucgcccuggug

SEQ ID NO: 177764 - RNA, 18 nt, Pseudomonas putida KT2440
cugcugcugcggaugaau

SEQ ID NO: 177765 - RNA, 22 nt, Pseudomonas putida KT2440
cagucgguucauggcugcaccu

SEQ ID NO: 177766 - RNA, 22 nt, Pseudomonas putida KT2440
aagcgcuucagguacugcauug

SEQ ID NO: 177767 - RNA, 22 nt, Pseudomonas putida KT2440
gguaccuccaccgaugucaucg

SEQ ID NO: 177768 - RNA, 22 nt, Pseudomonas putida KT2440
ucaagguacgacgcugggcgua

SEQ ID NO: 177769 - RNA, 22 nt, Pseudomonas putida KT2440
caacagucugugucugcacggc

SEQ ID NO: 177770 - RNA, 22 nt, Pseudomonas putida KT2440
gacgaagcgguuggggaaauug

SEQ ID NO: 177771 - RNA, 22 nt, Pseudomonas putida KT2440
auggcgauguccuguucgccgc

SEQ ID NO: 177772 - RNA, 22 nt, Pseudomonas putida KT2440
gcucaugcuuacuucuucgccu

SEQ ID NO: 177773 - RNA, 22 nt, Pseudomonas putida KT2440
uggaugccugcgaaacgcuguc

SEQ ID NO: 177774 - RNA, 22 nt, Pseudomonas putida KT2440
acccgcgaaugcgucggagcag

SEQ ID NO: 177775 - RNA, 22 nt, Pseudomonas putida KT2440
ugcuuacccaauagcguguccu

SEQ ID NO: 177776 - RNA, 22 nt, Pseudomonas putida KT2440
gcucagcgugaaggucaaugca

SEQ ID NO: 177777 - RNA, 22 nt, Pseudomonas putida KT2440
cgcuggauggacucggcaaucg

SEQ ID NO: 177778 - RNA, 22 nt, Pseudomonas putida KT2440
guucgcgggcaagcccgcuccu

SEQ ID NO: 177779 - RNA, 22 nt, Pseudomonas putida KT2440
ugcgcgguccuuguaggagcgg

SEQ ID NO: 177780 - RNA, 22 nt, Pseudomonas putida KT2440
uguuccgcgugcugguggacuu

SEQ ID NO: 177781 - RNA, 22 nt, Pseudomonas putida KT2440
uggccagcuuaucuauacccgg

SEQ ID NO: 177782 - RNA, 22 nt, Pseudomonas putida KT2440
gcgggcaugccugcccccacgg

SEQ ID NO: 177783 - RNA, 22 nt, Pseudomonas putida KT2440
gguuucacaucgaacggguugg

SEQ ID NO: 177784 - RNA, 22 nt, Pseudomonas putida KT2440
ucgcaucagugaccguguucgg

SEQ ID NO: 177785 - RNA, 22 nt, Pseudomonas putida KT2440
gugaagauccccguaggagcgg

SEQ ID NO: 177786 - RNA, 22 nt, Pseudomonas putida KT2440
ucccguggugacccgugaacaa

SEQ ID NO: 177787 - RNA, 22 nt, Pseudomonas putida KT2440
aguacggcaggcgaaugcgccc

SEQ ID NO: 177788 - RNA, 22 nt, Pseudomonas putida KT2440
caacuucauggacgcacguuau

SEQ ID NO: 177789 - RNA, 22 nt, Pseudomonas putida KT2440
uaggaucggguuuacccgcgaa

SEQ ID NO: 177790 - RNA, 22 nt, Pseudomonas putida KT2440
accugcugacgcauucgcgggc

SEQ ID NO: 177791 - RNA, 22 nt, Pseudomonas putida KT2440
ugggagcgaccuugugucgcga

SEQ ID NO: 177792 - RNA, 22 nt, Pseudomonas putida KT2440
cgcuccuacagggaucgccacg

SEQ ID NO: 177793 - RNA, 22 nt, Pseudomonas putida KT2440
cauguucgucuggaacaugguc

SEQ ID NO: 177794 - RNA, 22 nt, Pseudomonas putida KT2440
agcgcugccccuguguuugccc

SEQ ID NO: 177795 - RNA, 22 nt, Pseudomonas putida KT2440
cgagccacagcgccuggucgcc

SEQ ID NO: 177796 - RNA, 22 nt, Pseudomonas putida KT2440
gccuguaucugugcaggggcag

SEQ ID NO: 177797 - RNA, 22 nt, Pseudomonas putida KT2440
aauggcguagaagucgaucagg

SEQ ID NO: 177798 - RNA, 22 nt, Pseudomonas putida KT2440
caggcaccagggcgggccugug

SEQ ID NO: 177799 - RNA, 22 nt, Pseudomonas putida KT2440
uguucgucaagagccgaaaggg

SEQ ID NO: 177800 - RNA, 22 nt, Pseudomonas putida KT2440
gcaugcccaccgacuugggcug

SEQ ID NO: 177801 - RNA, 22 nt, Pseudomonas putida KT2440
auuguucgaacagcagcauggc

SEQ ID NO: 177802 - RNA, 22 nt, Pseudomonas putida KT2440
cagcaugcagaccuggcacggg

SEQ ID NO: 177803 - RNA, 22 nt, Pseudomonas putida KT2440
ggcugagggccugggucacugu

SEQ ID NO: 177804 - RNA, 22 nt, Pseudomonas putida KT2440
auccugcuagcgaccagcgucu

SEQ ID NO: 177805 - RNA, 22 nt, Pseudomonas putida KT2440
gugacgaucgcaggcagguuca

SEQ ID NO: 177806 - RNA, 22 nt, Pseudomonas putida KT2440
uggaccucaauacucgccuggc

SEQ ID NO: 177807 - RNA, 22 nt, Pseudomonas putida KT2440
aucaagcagccacugucagugu

SEQ ID NO: 177808 - RNA, 22 nt, Pseudomonas putida KT2440
ccugaaucuccacguggcgugg

SEQ ID NO: 177809 - RNA, 22 nt, Pseudomonas putida KT2440
agaucgagugcgagcccgcucc

SEQ ID NO: 177810 - RNA, 22 nt, Pseudomonas putida KT2440
gauccguuaaaucuguggccau

SEQ ID NO: 177811 - RNA, 22 nt, Pseudomonas putida KT2440
gcuugaccgcuccgggccacug

SEQ ID NO: 177812 - RNA, 22 nt, Pseudomonas putida KT2440
cgcucccacagggcucaccaca

SEQ ID NO: 177813 - RNA, 22 nt, Pseudomonas putida KT2440
uugaugacaaugcacugguugg

SEQ ID NO: 177814 - RNA, 22 nt, Pseudomonas putida KT2440
caccugggugaacaucgccagc

SEQ ID NO: 177815 - RNA, 20 nt, Pseudomonas putida KT2440
aucugguuaguggccagccc

SEQ ID NO: 177816 - RNA, 22 nt, Pseudomonas putida KT2440
caggugaccuucgugucgauca

SEQ ID NO: 177817 - RNA, 22 nt, Pseudomonas putida KT2440
cggguuuacccgcgaaugcgau

SEQ ID NO: 177818 - RNA, 22 nt, Pseudomonas putida KT2440
gauccguugcugcgguaaggau

SEQ ID NO: 177819 - RNA, 22 nt, Pseudomonas putida KT2440
ucuacgacaugaucuucaccca

SEQ ID NO: 177820 - RNA, 22 nt, Pseudomonas putida KT2440
ucgccuggaaccacagcagccc

SEQ ID NO: 177821 - RNA, 22 nt, Pseudomonas putida KT2440
gccuguggcaugcgugccucgg

SEQ ID NO: 177822 - RNA, 22 nt, Pseudomonas putida KT2440
gagucguugcgcugguucauug

SEQ ID NO: 177823 - RNA, 22 nt, Pseudomonas putida KT2440
uccuuagcagucugcgucggcu

SEQ ID NO: 177824 - RNA, 22 nt, Pseudomonas putida KT2440
uguucguacucagcuugaugua

SEQ ID NO: 177825 - RNA, 22 nt, Pseudomonas putida KT2440
uggccagccagauggcaucgau

SEQ ID NO: 177826 - RNA, 22 nt, Pseudomonas putida KT2440
uccggccaacccugcugaugau

SEQ ID NO: 177827 - RNA, 22 nt, Pseudomonas putida KT2440
ggaugacgcggugaucauccuc

SEQ ID NO: 177828 - RNA, 22 nt, Pseudomonas putida KT2440
ucauguucggccgcagccggaa

SEQ ID NO: 177829 - RNA, 22 nt, Pseudomonas putida KT2440
gauucccuucuauuggcgcgau

SEQ ID NO: 177830 - RNA, 22 nt, Pseudomonas putida KT2440
ccggacaguggcgaugcggccc

SEQ ID NO: 177831 - RNA, 22 nt, Pseudomonas putida KT2440
ugggccaagucuuauuuggauu

SEQ ID NO: 177832 - RNA, 22 nt, Pseudomonas putida KT2440
cgcgguuugcuggugcugcagg

SEQ ID NO: 177833 - RNA, 22 nt, Pseudomonas putida KT2440
aggccgcacaggcgcucggcgu

SEQ ID NO: 177834 - RNA, 22 nt, Pseudomonas putida KT2440
aggcgcugaucacacaguuugc

SEQ ID NO: 177835 - RNA, 22 nt, Pseudomonas putida KT2440
uugaccuuggccaugguuucgg

SEQ ID NO: 177836 - RNA, 22 nt, Pseudomonas putida KT2440
uccaccugguuuagcagaagcu

SEQ ID NO: 177837 - RNA, 22 nt, Pseudomonas putida KT2440
gcguugauggugugccaggugg

SEQ ID NO: 177838 - RNA, 22 nt, Pseudomonas putida KT2440
cguaggagcggcuuuagccgcg

SEQ ID NO: 177839 - RNA, 22 nt, Pseudomonas putida KT2440
aaugauggcccauugucggcau

SEQ ID NO: 177840 - RNA, 22 nt, Pseudomonas putida KT2440
gcgauggcgucgacaaugagcu

SEQ ID NO: 177841 - RNA, 22 nt, Pseudomonas putida KT2440
cgcggguagggcucgaaguagg

SEQ ID NO: 177842 - RNA, 22 nt, Pseudomonas putida KT2440
agguugccaaaccauggccagc

SEQ ID NO: 177843 - RNA, 22 nt, Pseudomonas putida KT2440
agcuggaucuacaucggcagcc

SEQ ID NO: 177844 - RNA, 22 nt, Pseudomonas putida KT2440
guggcccugggcaguaccggcg

SEQ ID NO: 177845 - RNA, 22 nt, Pseudomonas putida KT2440
ucuaccugauuccagcgguggc

SEQ ID NO: 177846 - RNA, 22 nt, Pseudomonas putida KT2440
gguucgucacagugaaaucggg

SEQ ID NO: 177847 - RNA, 22 nt, Pseudomonas putida KT2440
agaugcccuuuucacggucguc

SEQ ID NO: 177848 - RNA, 22 nt, Pseudomonas putida KT2440
cgagugaaaggccuugagcugg

SEQ ID NO: 177849 - RNA, 22 nt, Pseudomonas putida KT2440
aggcagcuaugggucgaaugcg

SEQ ID NO: 177850 - RNA, 22 nt, Pseudomonas putida KT2440
gcauuagcagguaaacccgcgc

SEQ ID NO: 177851 - RNA, 22 nt, Pseudomonas putida KT2440
aaagggccgcaaagcggccccg

SEQ ID NO: 177852 - RNA, 22 nt, Pseudomonas putida KT2440
uuucauugaucucaguacugau

SEQ ID NO: 177853 - RNA, 22 nt, Pseudomonas putida KT2440
gcgaucgcguuccgcguacggu

SEQ ID NO: 177854 - RNA, 22 nt, Pseudomonas putida KT2440
gcuuccaucugcuuggccuggu

SEQ ID NO: 177855 - RNA, 22 nt, Pseudomonas putida KT2440
cgcagguugacccggcggcgga

SEQ ID NO: 177856 - RNA, 22 nt, Pseudomonas putida KT2440
aucaguguggugcccagggcau

SEQ ID NO: 177857 - RNA, 22 nt, Pseudomonas putida KT2440
ugcccgcucccacagguacggu

SEQ ID NO: 177858 - RNA, 22 nt, Pseudomonas putida KT2440
ucacuugcuggcucagcgccca

SEQ ID NO: 177859 - RNA, 22 nt, Pseudomonas putida KT2440
aggccgguguaggcgcggguuu

SEQ ID NO: 177860 - RNA, 22 nt, Pseudomonas putida KT2440
uuggcaagcaccuggauucggu

SEQ ID NO: 177861 - RNA, 22 nt, Pseudomonas putida KT2440
agcagcgccaacaucgccacug

SEQ ID NO: 177862 - RNA, 22 nt, Pseudomonas putida KT2440
gcucggucucacaggcgcugaa

SEQ ID NO: 177863 - RNA, 22 nt, Pseudomonas putida KT2440
caggcgcacugguugggcagga

SEQ ID NO: 177864 - RNA, 22 nt, Pseudomonas putida KT2440
gcgugguagugccugccggcaa

SEQ ID NO: 177865 - RNA, 22 nt, Pseudomonas putida KT2440
uucgcgggcaagcccgcccuua

SEQ ID NO: 177866 - RNA, 22 nt, Pseudomonas putida KT2440
cagugcuuaucauugcucgggu

SEQ ID NO: 177867 - RNA, 22 nt, Pseudomonas putida KT2440
ucuggcguugcugggccuguac

SEQ ID NO: 177868 - RNA, 22 nt, Pseudomonas putida KT2440
accgcaauccuuggcauugacg

SEQ ID NO: 177869 - RNA, 22 nt, Pseudomonas putida KT2440
auacagcuguagcgccggggcu

SEQ ID NO: 177870 - RNA, 22 nt, Pseudomonas putida KT2440
gcuugaggccguagcccuggua

SEQ ID NO: 177871 - RNA, 22 nt, Pseudomonas putida KT2440
ccagguggagacccugggugcc

SEQ ID NO: 177872 - RNA, 22 nt, Pseudomonas putida KT2440
gcgcguguaccgggcagcgguu

SEQ ID NO: 177873 - RNA, 22 nt, Pseudomonas putida KT2440
ugcgccuggucgagcacaugcc

SEQ ID NO: 177874 - RNA, 22 nt, Pseudomonas putida KT2440
guaggcaggugcgccuggcacu

SEQ ID NO: 177875 - RNA, 22 nt, Pseudomonas putida KT2440
agguguacagcagcgccugcag

SEQ ID NO: 177876 - RNA, 22 nt, Pseudomonas putida KT2440
gcgugacgcagaugggcguggc

SEQ ID NO: 177877 - RNA, 22 nt, Pseudomonas putida KT2440
gagcuggcgcagcugguuguuc

SEQ ID NO: 177878 - RNA, 22 nt, Pseudomonas putida KT2440
caggcguucaagggucagugca

SEQ ID NO: 177879 - RNA, 22 nt, Pseudomonas putida KT2440
cgaccuggacgagaagaccagc

SEQ ID NO: 177880 - RNA, 22 nt, Pseudomonas putida KT2440
agacuucgucggggcugcgcag

SEQ ID NO: 177881 - RNA, 22 nt, Pseudomonas putida KT2440
caaggccaaccacgccugcgcc

SEQ ID NO: 177882 - RNA, 22 nt, Pseudomonas putida KT2440
ugguggcaaaacgcuuggccaa

SEQ ID NO: 177883 - RNA, 22 nt, Pseudomonas putida KT2440
gacgaagucaaaggccuggugg

SEQ ID NO: 177884 - RNA, 22 nt, Pseudomonas putida KT2440
ggcacgaucucggcgcccagca

SEQ ID NO: 177885 - RNA, 22 nt, Pseudomonas putida KT2440
gcaucgaucaccagugcuucgg

SEQ ID NO: 177886 - RNA, 21 nt, Pseudomonas putida KT2440
agucagcugguuguuggccgc

SEQ ID NO: 177887 - RNA, 22 nt, Pseudomonas putida KT2440
aucgaucauggccagguacugc

SEQ ID NO: 177888 - RNA, 22 nt, Pseudomonas putida KT2440
accuguggacgcuggcuugccg

SEQ ID NO: 177889 - RNA, 22 nt, Pseudomonas putida KT2440
ugcccaucacgggugauggccg

SEQ ID NO: 177890 - RNA, 22 nt, Pseudomonas putida KT2440
uugauuucgaacgggggguaau

SEQ ID NO: 177891 - RNA, 22 nt, Pseudomonas putida KT2440
ccgggauugcgggugccuucgg

SEQ ID NO: 177892 - RNA, 22 nt, Pseudomonas putida KT2440
cauaccucugacgcuggccugc

SEQ ID NO: 177893 - RNA, 22 nt, Pseudomonas putida KT2440
cuugagcuguggauggcgcgcc

SEQ ID NO: 177894 - RNA, 20 nt, Pseudomonas putida KT2440
gcgagcgucggcccuggaug

SEQ ID NO: 177895 - RNA, 23 nt, Pseudomonas putida KT2440
gccaacgaguuguuacgccgcuc

SEQ ID NO: 177896 - RNA, 19 nt, Pseudomonas putida KT2440
cgugcacgcuugaucagca

SEQ ID NO: 177897 - RNA, 22 nt, Pseudomonas putida KT2440
gccggcaugcgaggcaaacugu

SEQ ID NO: 177898 - RNA, 22 nt, Pseudomonas putida KT2440
augcuguagacaagguuucgau

SEQ ID NO: 177899 - RNA, 22 nt, Pseudomonas putida KT2440
gaggcgcuugcgcggcucugga

SEQ ID NO: 177900 - RNA, 22 nt, Pseudomonas putida KT2440
uuacaucgacuucgucggcggu

SEQ ID NO: 177901 - RNA, 22 nt, Pseudomonas putida KT2440
cgcauucgcgggugaacccgcu

SEQ ID NO: 177902 - RNA, 22 nt, Pseudomonas putida KT2440
gcgaauggggccuuacaggccu

SEQ ID NO: 177903 - RNA, 22 nt, Pseudomonas putida KT2440
guggcugacagaguccugcaca

SEQ ID NO: 177904 - RNA, 22 nt, Pseudomonas putida KT2440
uggucgacggccgcgccaugac

SEQ ID NO: 177905 - RNA, 22 nt, Pseudomonas putida KT2440
ucagcggugcauuuuaccauuc

SEQ ID NO: 177906 - RNA, 22 nt, Pseudomonas putida KT2440
agccgaucaggcucucggcgac

SEQ ID NO: 177907 - RNA, 22 nt, Pseudomonas putida KT2440
ggcagguggccuacgaucgccg

SEQ ID NO: 177908 - RNA, 22 nt, Pseudomonas putida KT2440
augcuggcggcagacugguaug

SEQ ID NO: 177909 - RNA, 21 nt, Pseudomonas putida KT2440
gcaaccgggggucacuggugc

SEQ ID NO: 177910 - RNA, 22 nt, Pseudomonas putida KT2440
ugaucguucgccacuuugccga

SEQ ID NO: 177911 - RNA, 22 nt, Pseudomonas putida KT2440
aaaggcaucgaccgcggcacgg

SEQ ID NO: 177912 - RNA, 22 nt, Pseudomonas putida KT2440
aacagccgcagaaugcucgguu

SEQ ID NO: 177913 - RNA, 22 nt, Pseudomonas putida KT2440
gcuuucgaaccagacgcguuac

SEQ ID NO: 177914 - RNA, 22 nt, Pseudomonas putida KT2440
gacgguggugccggccugauua

SEQ ID NO: 177915 - RNA, 22 nt, Pseudomonas putida KT2440
auuccugaaaaguaagggccgg

SEQ ID NO: 177916 - RNA, 22 nt, Pseudomonas putida KT2440
gcaaggcugcucggccgaggag

SEQ ID NO: 177917 - RNA, 22 nt, Pseudomonas putida KT2440
gggugaucucucaucaaacaaa

SEQ ID NO: 177918 - RNA, 22 nt, Pseudomonas putida KT2440
cuggccagcggcgugcagcuga

SEQ ID NO: 177919 - RNA, 22 nt, Pseudomonas putida KT2440
cgaagugcucaauauugccagc

SEQ ID NO: 177920 - RNA, 22 nt, Pseudomonas putida KT2440
ggugguacagcggcgaagcgau

SEQ ID NO: 177921 - RNA, 22 nt, Pseudomonas putida KT2440
aacuccgcuuccugggcuguuu

SEQ ID NO: 177922 - RNA, 22 nt, Pseudomonas putida KT2440
ucgaugcgcguguaggacagcu

SEQ ID NO: 177923 - RNA, 22 nt, Pseudomonas putida KT2440
ccucgcugcugcuggcgccguu

SEQ ID NO: 177924 - RNA, 22 nt, Pseudomonas putida KT2440
ugcuuggccugagcuggcagca

SEQ ID NO: 177925 - RNA, 22 nt, Pseudomonas putida KT2440
gcugcuggucuucagugggccu

SEQ ID NO: 177926 - RNA, 22 nt, Pseudomonas putida KT2440
gucuggccuuccggugccuggu

SEQ ID NO: 177927 - RNA, 22 nt, Pseudomonas putida KT2440
gcgcagguggucgaacagggcc

SEQ ID NO: 177928 - RNA, 22 nt, Pseudomonas putida KT2440
guauuaccugugggagcggccu

SEQ ID NO: 177929 - RNA, 22 nt, Pseudomonas putida KT2440
gccuugcugccggugcaggaaa

SEQ ID NO: 177930 - RNA, 22 nt, Pseudomonas putida KT2440
augacaaaguggcaggcguaaa

SEQ ID NO: 177931 - RNA, 22 nt, Pseudomonas putida KT2440
ggugcacgugcucgggguggcu

SEQ ID NO: 177932 - RNA, 22 nt, Pseudomonas putida KT2440
cgccuuggcgaucaaggcacaa

SEQ ID NO: 177933 - RNA, 22 nt, Pseudomonas putida KT2440
ggugauccuggccgguggcugc

SEQ ID NO: 177934 - RNA, 22 nt, Pseudomonas putida KT2440
acgugucggcuauguaaauggu

SEQ ID NO: 177935 - RNA, 22 nt, Pseudomonas putida KT2440
cuaccaucuagauccggaguau

SEQ ID NO: 177936 - RNA, 22 nt, Pseudomonas putida KT2440
uucugccgcacugacaucagag

SEQ ID NO: 177937 - RNA, 22 nt, Pseudomonas putida KT2440
guugcgccuggccacccugcca

SEQ ID NO: 177938 - RNA, 22 nt, Pseudomonas putida KT2440
agcagcuguucaacggcgccua

SEQ ID NO: 177939 - RNA, 22 nt, Pseudomonas putida KT2440
ugcaaucgacccaaagcugccc

SEQ ID NO: 177940 - RNA, 22 nt, Pseudomonas putida KT2440
acccucgggcgucagccagggc

SEQ ID NO: 177941 - RNA, 22 nt, Pseudomonas putida KT2440
aaccuggcuguaaggcggcucc

SEQ ID NO: 177942 - RNA, 22 nt, Pseudomonas putida KT2440
cuucauggccaaggaccgcauc

SEQ ID NO: 177943 - RNA, 16 nt, Pseudomonas putida KT2440
agcuggccugcagccc

SEQ ID NO: 177944 - RNA, 22 nt, Pseudomonas putida KT2440
aaggcgcacaccagcgcgccau

SEQ ID NO: 177945 - RNA, 22 nt, Pseudomonas putida KT2440
gcugccacgcccaucugcguca

SEQ ID NO: 177946 - RNA, 18 nt, Pseudomonas putida KT2440
aggcgguaaucacuuucc

SEQ ID NO: 177947 - RNA, 22 nt, Pseudomonas putida KT2440
ucugucgcucggucaucgagga

SEQ ID NO: 177948 - RNA, 22 nt, Pseudomonas putida KT2440
guagccgucggcacgcaggacg

SEQ ID NO: 177949 - RNA, 21 nt, Pseudomonas putida KT2440
ugaugccguucuucuccaugc

SEQ ID NO: 177950 - RNA, 22 nt, Pseudomonas putida KT2440
ucggaagaaaccuucaugggca

SEQ ID NO: 177951 - RNA, 22 nt, Pseudomonas putida KT2440
gccaugaucgaaggccaguucg

SEQ ID NO: 177952 - RNA, 22 nt, Pseudomonas putida KT2440
caggcgcuggugccacacgacc

SEQ ID NO: 177953 - RNA, 22 nt, Pseudomonas putida KT2440
cagcuugagguauuccucgcga

SEQ ID NO: 177954 - RNA, 19 nt, Pseudomonas putida KT2440
uugcgggcgcugcaggguc

SEQ ID NO: 177955 - RNA, 22 nt, Pseudomonas putida KT2440
gugauuccugugggagcgggcg

SEQ ID NO: 177956 - RNA, 22 nt, Pseudomonas putida KT2440
uucgcgggcaugcccgcuccca

SEQ ID NO: 177957 - RNA, 22 nt, Pseudomonas putida KT2440
ucgugcugauccugggcuugcu

SEQ ID NO: 177958 - RNA, 17 nt, Pseudomonas putida KT2440
ucgaagugcugcacaac

SEQ ID NO: 177959 - RNA, 22 nt, Pseudomonas putida KT2440
uguaggagcggguuuagccgcg

SEQ ID NO: 177960 - RNA, 20 nt, Pseudomonas putida KT2440
ugcauaccgccaugccgauc

SEQ ID NO: 177961 - RNA, 22 nt, Pseudomonas putida KT2440
ugcccugggccagcagcaaggu

SEQ ID NO: 177962 - RNA, 22 nt, Pseudomonas putida KT2440
gaugcggugcauggccaggagu

SEQ ID NO: 177963 - RNA, 22 nt, Pseudomonas putida KT2440
uauccggcggucugcacggugu

SEQ ID NO: 177964 - RNA, 22 nt, Pseudomonas putida KT2440
ucgcaacaacgcugaugcauca

SEQ ID NO: 177965 - RNA, 21 nt, Pseudomonas putida KT2440
cgaaucuguucgucgcugggc

SEQ ID NO: 177966 - RNA, 22 nt, Pseudomonas putida KT2440
cuguggccuucaacgaugucga

SEQ ID NO: 177967 - RNA, 22 nt, Pseudomonas putida KT2440
cucucgauuuucccagaggcca

SEQ ID NO: 177968 - RNA, 22 nt, Pseudomonas putida KT2440
cgcggguaaacucgcuccuacg

SEQ ID NO: 177969 - RNA, 22 nt, Pseudomonas putida KT2440
uggcgagugaccgguucaccac

SEQ ID NO: 177970 - RNA, 22 nt, Pseudomonas putida KT2440
agcugugcacgaccugugggag

SEQ ID NO: 177971 - RNA, 22 nt, Pseudomonas putida KT2440
gggcugcauagcagccccaggu

SEQ ID NO: 177972 - RNA, 22 nt, Pseudomonas putida KT2440
ggugcucgauaaacguagugac

SEQ ID NO: 177973 - RNA, 22 nt, Pseudomonas putida KT2440
ucggucguucggucagucauag

SEQ ID NO: 177974 - RNA, 22 nt, Pseudomonas putida KT2440
ugcuaccugcaggccggccgug

SEQ ID NO: 177975 - RNA, 22 nt, Pseudomonas putida KT2440
ucagccacuugggcgaagagcc

SEQ ID NO: 177976 - RNA, 22 nt, Pseudomonas putida KT2440
ggucgucaccuucccagaugau

SEQ ID NO: 177977 - RNA, 22 nt, Pseudomonas putida KT2440
uggcuuaucggcguagcgccaa

SEQ ID NO: 177978 - RNA, 22 nt, Pseudomonas putida KT2440
agcagguucugcgcggucagca

SEQ ID NO: 177979 - RNA, 22 nt, Pseudomonas putida KT2440
ugacaucggcgaaguccugaug

SEQ ID NO: 177980 - RNA, 22 nt, Pseudomonas putida KT2440
cguacucgcuccugccuggggu

SEQ ID NO: 177981 - RNA, 22 nt, Pseudomonas putida KT2440
aucgccuugguaccgcugcugg

SEQ ID NO: 177982 - RNA, 22 nt, Pseudomonas putida KT2440
ucgcggguaaacccgccuacca

SEQ ID NO: 177983 - RNA, 22 nt, Pseudomonas putida KT2440
ugcggcagaagcagcagacccu

SEQ ID NO: 177984 - RNA, 17 nt, Pseudomonas putida KT2440
ugugccagcggugguug

SEQ ID NO: 177985 - RNA, 22 nt, Pseudomonas putida KT2440
guggguaagucacacauuggcu

SEQ ID NO: 177986 - RNA, 22 nt, Pseudomonas putida KT2440
gaucguccacccgcagcaugga

SEQ ID NO: 177987 - RNA, 22 nt, Pseudomonas putida KT2440
gagcggguucacccgcgaaugc

SEQ ID NO: 177988 - RNA, 22 nt, Pseudomonas putida KT2440
cuucgcggcuaaagccgcuccu

SEQ ID NO: 177989 - RNA, 22 nt, Pseudomonas putida KT2440
gugcaauugcaguugaaugccg

SEQ ID NO: 177990 - RNA, 22 nt, Pseudomonas putida KT2440
uguaagcaggcgcggccuguuc

SEQ ID NO: 177991 - RNA, 22 nt, Pseudomonas putida KT2440
ggagcuguucuucucggcgcug

SEQ ID NO: 177992 - RNA, 22 nt, Pseudomonas putida KT2440
cuggaggucucguucgcugugg

SEQ ID NO: 177993 - RNA, 22 nt, Pseudomonas putida KT2440
cggaguucgcgguugugccgga

SEQ ID NO: 177994 - RNA, 21 nt, Pseudomonas putida KT2440
gccuugucgaugucaucgcgc

SEQ ID NO: 177995 - RNA, 22 nt, Pseudomonas putida KT2440
agcgucugcggaguacggcggu

SEQ ID NO: 177996 - RNA, 22 nt, Pseudomonas putida KT2440
cguauucgcggguaaacccgcu

SEQ ID NO: 177997 - RNA, 22 nt, Pseudomonas putida KT2440
uaggugcacugcgaguguuuga

SEQ ID NO: 177998 - RNA, 20 nt, Pseudomonas putida KT2440
ccuguucagccuucaccucg

SEQ ID NO: 177999 - RNA, 22 nt, Pseudomonas putida KT2440
cagauugucggcagcgugcuga

SEQ ID NO: 178000 - RNA, 20 nt, Pseudomonas putida KT2440
ucgucugagcaucgacgggg

SEQ ID NO: 178001 - RNA, 22 nt, Pseudomonas putida KT2440
acggcgaugcggaacucgucga

SEQ ID NO: 178002 - RNA, 22 nt, Pseudomonas putida KT2440
cgguucgccgccggaagcuugc

SEQ ID NO: 178003 - RNA, 22 nt, Pseudomonas putida KT2440
acgagcugucggcaccgaugcu

SEQ ID NO: 178004 - RNA, 22 nt, Pseudomonas putida KT2440
gaugcuguugucgcugccuucg

SEQ ID NO: 178005 - RNA, 22 nt, Pseudomonas putida KT2440
aggugcaugacaguuucaaggu

SEQ ID NO: 178006 - RNA, 22 nt, Pseudomonas putida KT2440
uaucgccugagccggccucuuc

SEQ ID NO: 178007 - RNA, 22 nt, Pseudomonas putida KT2440
gcaugguguacggcaucgucga

SEQ ID NO: 178008 - RNA, 22 nt, Pseudomonas putida KT2440
uuguggaagcgaccuugugccg

SEQ ID NO: 178009 - RNA, 22 nt, Pseudomonas putida KT2440
ugcaggagcgggcuugcccgcg

SEQ ID NO: 178010 - RNA, 22 nt, Pseudomonas putida KT2440
ugcugguccgguaggagcggca

SEQ ID NO: 178011 - RNA, 22 nt, Pseudomonas putida KT2440
ccgguuacaaauggaaccgguu

SEQ ID NO: 178012 - RNA, 22 nt, Pseudomonas putida KT2440
cgauggaaauggugcgcauggu

SEQ ID NO: 178013 - RNA, 22 nt, Pseudomonas putida KT2440
gccaggugcugcuggcauugcu

SEQ ID NO: 178014 - RNA, 20 nt, Pseudomonas putida KT2440
aucgauccagcgcaacaggc

SEQ ID NO: 178015 - RNA, 22 nt, Pseudomonas putida KT2440
uguagaagcgggcuugcccgcg

SEQ ID NO: 178016 - RNA, 22 nt, Pseudomonas putida KT2440
gccagcaucuggucgggcaccu

SEQ ID NO: 178017 - RNA, 22 nt, Pseudomonas putida KT2440
uugcgcaugccgguacaccugg

SEQ ID NO: 178018 - RNA, 22 nt, Pseudomonas putida KT2440
uugcgcuugaguuccugaucgu

SEQ ID NO: 178019 - RNA, 22 nt, Pseudomonas putida KT2440
cgcucccacaggucgugcacag

SEQ ID NO: 178020 - RNA, 22 nt, Pseudomonas putida KT2440
ucggugagggucagcucaagca

SEQ ID NO: 178021 - RNA, 22 nt, Pseudomonas putida KT2440
caugcccgcucccacagguuca

SEQ ID NO: 178022 - RNA, 22 nt, Pseudomonas putida KT2440
ggugucgaugcccugguacugg

SEQ ID NO: 178023 - RNA, 22 nt, Pseudomonas putida KT2440
cauucgcggguaaacccguucc

SEQ ID NO: 178024 - RNA, 22 nt, Pseudomonas putida KT2440
aagugguguggaacaagaaguu

SEQ ID NO: 178025 - RNA, 22 nt, Pseudomonas putida KT2440
gcgcgacuccugugggagcggg

SEQ ID NO: 178026 - RNA, 22 nt, Pseudomonas putida KT2440
uguacuggccucuucgcgggca

SEQ ID NO: 178027 - RNA, 22 nt, Pseudomonas putida KT2440
gguuccugugggagcgggcgcg

SEQ ID NO: 178028 - RNA, 22 nt, Pseudomonas putida KT2440
auucgcgggcaagcccgcuccu

SEQ ID NO: 178029 - RNA, 22 nt, Pseudomonas putida KT2440
ccacgucgcuuucgccggccag

SEQ ID NO: 178030 - RNA, 22 nt, Pseudomonas putida KT2440
guccuguuccaaugcuucgccc

SEQ ID NO: 178031 - RNA, 22 nt, Pseudomonas putida KT2440
ccggugaagcacugcucuuugc

SEQ ID NO: 178032 - RNA, 22 nt, Pseudomonas putida KT2440
uacucgcgaaggcgcagaccug

SEQ ID NO: 178033 - RNA, 22 nt, Pseudomonas putida KT2440
gcaacgccggcuggucgggguu

SEQ ID NO: 178034 - RNA, 22 nt, Pseudomonas putida KT2440
cgcggguaaacccgccgcuaca

SEQ ID NO: 178035 - RNA, 22 nt, Pseudomonas putida KT2440
ugguucgccuacuucgagcccu

SEQ ID NO: 178036 - RNA, 22 nt, Pseudomonas putida KT2440
aguugaccaguaccgccagcgc

SEQ ID NO: 178037 - RNA, 22 nt, Pseudomonas putida KT2440
cgccucgaaguugcgcgccugc

SEQ ID NO: 178038 - RNA, 22 nt, Pseudomonas putida KT2440
ugccgccaggcaaccgcuggca

SEQ ID NO: 178039 - RNA, 22 nt, Pseudomonas putida KT2440
guucgaggugaaggcugaacag

SEQ ID NO: 178040 - RNA, 22 nt, Pseudomonas putida KT2440
ggcaucggccugaucaccgaag

SEQ ID NO: 178041 - RNA, 22 nt, Pseudomonas putida KT2440
gagccaggcgaguauugagguc

SEQ ID NO: 178042 - RNA, 22 nt, Pseudomonas putida KT2440
ucgagcggccggguagcggcga

SEQ ID NO: 178043 - RNA, 22 nt, Pseudomonas putida KT2440
uucgcggguaaacccgcuccua

SEQ ID NO: 178044 - RNA, 22 nt, Pseudomonas putida KT2440
gucaccgcaaucagggcgaaca

SEQ ID NO: 178045 - RNA, 22 nt, Pseudomonas putida KT2440
ucgcgcaacugucgcugagccu

SEQ ID NO: 178046 - RNA, 22 nt, Pseudomonas putida KT2440
gccgauggccaugacuucaccc

SEQ ID NO: 178047 - RNA, 22 nt, Pseudomonas putida KT2440
uuacccugcgggagcgggcgug

SEQ ID NO: 178048 - RNA, 22 nt, Pseudomonas putida KT2440
ucaacucgucguagcggaucgc

SEQ ID NO: 178049 - RNA, 21 nt, Pseudomonas putida KT2440
augacgucaucagcgcacgga

SEQ ID NO: 178050 - RNA, 22 nt, Pseudomonas putida KT2440
aggucgacuucggcggugucca

SEQ ID NO: 178051 - RNA, 22 nt, Pseudomonas putida KT2440
uugcccacgaagcaggcaacgc

SEQ ID NO: 178052 - RNA, 22 nt, Pseudomonas putida KT2440
agugccggggcugcuucgcagc

SEQ ID NO: 178053 - RNA, 22 nt, Pseudomonas putida KT2440
ugggucaacugguagcgcagga

SEQ ID NO: 178054 - RNA, 22 nt, Pseudomonas putida KT2440
uggugccauuccugugggagcg

SEQ ID NO: 178055 - RNA, 22 nt, Pseudomonas putida KT2440
ucggcacgcuugagggugucgc

SEQ ID NO: 178056 - RNA, 22 nt, Pseudomonas putida KT2440
cgcuggaucucacaggcgcugc

SEQ ID NO: 178057 - RNA, 22 nt, Pseudomonas putida KT2440
ggucacgugucaguugcugggc

SEQ ID NO: 178058 - RNA, 22 nt, Pseudomonas putida KT2440
acgccuugccccucggcggugu

SEQ ID NO: 178059 - RNA, 22 nt, Pseudomonas putida KT2440
cgguacucaggcuguugaucga

SEQ ID NO: 178060 - RNA, 22 nt, Pseudomonas putida KT2440
auucgcggguaaacccgcgccu

SEQ ID NO: 178061 - RNA, 22 nt, Pseudomonas putida KT2440
uccugcguucaauggucuuggc

SEQ ID NO: 178062 - RNA, 22 nt, Pseudomonas putida KT2440
cccagcguuugaugccgagcua

SEQ ID NO: 178063 - RNA, 22 nt, Pseudomonas putida KT2440
gucggccagguaggcgucgacg

SEQ ID NO: 178064 - RNA, 23 nt, Pseudomonas putida KT2440
accacagucgccuuggcacccug

SEQ ID NO: 178065 - RNA, 22 nt, Pseudomonas putida KT2440
uaaccgagcauucugcggcugu

SEQ ID NO: 178066 - RNA, 22 nt, Pseudomonas putida KT2440
ggaguacgucgcaguugauggg

SEQ ID NO: 178067 - RNA, 22 nt, Pseudomonas putida KT2440
cauggucgaagucgucaccacc

SEQ ID NO: 178068 - RNA, 22 nt, Pseudomonas putida KT2440
ugcuggaacgcugggggccgcc

SEQ ID NO: 178069 - RNA, 22 nt, Pseudomonas putida KT2440
aaccggguuaccaggaccaugc

SEQ ID NO: 178070 - RNA, 17 nt, Pseudomonas putida KT2440
ggcgaucaccccacccu

SEQ ID NO: 178071 - RNA, 22 nt, Pseudomonas putida KT2440
aucaacgacaauuggccaugca

SEQ ID NO: 178072 - RNA, 22 nt, Pseudomonas putida KT2440
gucagcagcuggcugguggugu

SEQ ID NO: 178073 - RNA, 22 nt, Pseudomonas putida KT2440
aagaucgacuggaugucguagu

SEQ ID NO: 178074 - RNA, 22 nt, Pseudomonas putida KT2440
uucgacaucccagugcugggca

SEQ ID NO: 178075 - RNA, 22 nt, Pseudomonas putida KT2440
ugaccguggugcuguucgccau

SEQ ID NO: 178076 - RNA, 22 nt, Pseudomonas putida KT2440
uucgcggguaaacccgcgccua

SEQ ID NO: 178077 - RNA, 22 nt, Pseudomonas putida KT2440
cgaugguagagaacccgaggca

SEQ ID NO: 178078 - RNA, 22 nt, Pseudomonas putida KT2440
ccgaccagguugagaucagccu

SEQ ID NO: 178079 - RNA, 22 nt, Pseudomonas putida KT2440
uggugccgacguagacguuguc

SEQ ID NO: 178080 - RNA, 22 nt, Pseudomonas putida KT2440
agugccaggcgcaccugccuac

SEQ ID NO: 178081 - RNA, 19 nt, Pseudomonas putida KT2440
agcuucaggcgcuggaccg

SEQ ID NO: 178082 - RNA, 22 nt, Pseudomonas putida KT2440
cuggccagcuugcgggagcagg

SEQ ID NO: 178083 - RNA, 22 nt, Pseudomonas putida KT2440
uucgcgcagggugccggccagc

SEQ ID NO: 178084 - RNA, 22 nt, Pseudomonas putida KT2440
cggcacaaucccuggaggcggu

SEQ ID NO: 178085 - RNA, 22 nt, Pseudomonas putida KT2440
gcgcauggcguccagcugcucu

SEQ ID NO: 178086 - RNA, 22 nt, Pseudomonas putida KT2440
uggcuugcgaucucgcgcaacu

SEQ ID NO: 178087 - RNA, 20 nt, Pseudomonas putida KT2440
acucgcuggcggugaccgag

SEQ ID NO: 178088 - RNA, 22 nt, Pseudomonas putida KT2440
aggcauuggcagugaucgguca

SEQ ID NO: 178089 - RNA, 20 nt, Pseudomonas putida KT2440
acggaugguuugccgggcca

SEQ ID NO: 178090 - RNA, 22 nt, Pseudomonas putida KT2440
guugccaaggcgauugaagucg

SEQ ID NO: 178091 - RNA, 22 nt, Pseudomonas putida KT2440
cauggcagccuguuggcguugu

SEQ ID NO: 178092 - RNA, 22 nt, Pseudomonas putida KT2440
aucgaucagcaccgccuugggc

SEQ ID NO: 178093 - RNA, 22 nt, Pseudomonas putida KT2440
gaccggcacgggugaagccggu

SEQ ID NO: 178094 - RNA, 22 nt, Pseudomonas putida KT2440
gcugcgcagggaucaggccggu

SEQ ID NO: 178095 - RNA, 22 nt, Pseudomonas putida KT2440
uccgccugacggguggcgagcc

SEQ ID NO: 178096 - RNA, 22 nt, Pseudomonas putida KT2440
aaggccagcgggucagccgugu

SEQ ID NO: 178097 - RNA, 22 nt, Pseudomonas putida KT2440
uuggcaaguuugaugaucaguu

SEQ ID NO: 178098 - RNA, 22 nt, Pseudomonas putida KT2440
gccugccaaccggccagcagga

SEQ ID NO: 178099 - RNA, 22 nt, Pseudomonas putida KT2440
gccaggaccuggaccuguuccg

SEQ ID NO: 178100 - RNA, 22 nt, Pseudomonas putida KT2440
acaggucggcgcccuggcggac

SEQ ID NO: 178101 - RNA, 22 nt, Pseudomonas putida KT2440
cugggugaauaccugcagcgcc

SEQ ID NO: 178102 - RNA, 22 nt, Pseudomonas putida KT2440
cccggcuaaagccgcgccuacg

SEQ ID NO: 178103 - RNA, 22 nt, Pseudomonas putida KT2440
ugaucguacugaucacggccuu

SEQ ID NO: 178104 - RNA, 22 nt, Pseudomonas putida KT2440
agaacccugugagagcgggcuu

SEQ ID NO: 178105 - RNA, 22 nt, Pseudomonas putida KT2440
gugcgcagaugccagcguugcu

SEQ ID NO: 178106 - RNA, 22 nt, Pseudomonas putida KT2440
guucgagacgggagcagaguug

SEQ ID NO: 178107 - RNA, 22 nt, Pseudomonas putida KT2440
acacugcugccugcgccaguug

SEQ ID NO: 178108 - RNA, 23 nt, Pseudomonas putida KT2440
aggccgaugccggccagcagcag

SEQ ID NO: 178109 - RNA, 22 nt, Pseudomonas putida KT2440
aagccacgucggcagggucuga

SEQ ID NO: 178110 - RNA, 22 nt, Pseudomonas putida KT2440
ugcugcccacaggccgccgcgu

SEQ ID NO: 178111 - RNA, 22 nt, Pseudomonas putida KT2440
caacaguggcguaacgacagca

SEQ ID NO: 178112 - RNA, 20 nt, Pseudomonas putida KT2440
agcaggcgauucguguggcc

SEQ ID NO: 178113 - RNA, 22 nt, Pseudomonas putida KT2440
ccguguucgccgccuugcggcu

SEQ ID NO: 178114 - RNA, 22 nt, Pseudomonas putida KT2440
cggcuaaagccgcuccuacaag

SEQ ID NO: 178115 - RNA, 22 nt, Pseudomonas putida KT2440
gccgucgacgcggcggcugauc

SEQ ID NO: 178116 - RNA, 22 nt, Pseudomonas putida KT2440
uucauucgacacagaggacauu

SEQ ID NO: 178117 - RNA, 22 nt, Pseudomonas putida KT2440
ucgcgacacaaggccgcuccca

SEQ ID NO: 178118 - RNA, 22 nt, Pseudomonas putida KT2440
acugcgaaagcgcucaggcccu

SEQ ID NO: 178119 - RNA, 22 nt, Pseudomonas putida KT2440
aacugaucguucagggccuguu

SEQ ID NO: 178120 - RNA, 22 nt, Pseudomonas putida KT2440
agugaaugauuugcggcugguu

SEQ ID NO: 178121 - RNA, 22 nt, Pseudomonas putida KT2440
uugugcagguccugugcgagcg

SEQ ID NO: 178122 - RNA, 22 nt, Pseudomonas putida KT2440
ccgaaucgcagugaggaucugc

SEQ ID NO: 178123 - RNA, 23 nt, Pseudomonas putida KT2440
ccuguucgaagguuuggcgauca

SEQ ID NO: 178124 - RNA, 22 nt, Pseudomonas putida KT2440
uggagcacgccgggcuggcgcg

SEQ ID NO: 178125 - RNA, 22 nt, Pseudomonas putida KT2440
uugcccggucuuggccauguag

SEQ ID NO: 178126 - RNA, 22 nt, Pseudomonas putida KT2440
guuuacccgcgaagaggccgga

SEQ ID NO: 178127 - RNA, 22 nt, Pseudomonas putida KT2440
uagcccugagcaagccucccgu

SEQ ID NO: 178128 - RNA, 22 nt, Pseudomonas putida KT2440
agcagcacauggcguggguccg

SEQ ID NO: 178129 - RNA, 22 nt, Pseudomonas putida KT2440
gcuggucagcacggucacgcca

SEQ ID NO: 178130 - RNA, 22 nt, Pseudomonas putida KT2440
uccaggucagccaugugggugc

SEQ ID NO: 178131 - RNA, 22 nt, Pseudomonas putida KT2440
gaugcgaucaguugcaggccug

SEQ ID NO: 178132 - RNA, 22 nt, Pseudomonas putida KT2440
ccuggguaccgguugugugcug

SEQ ID NO: 178133 - RNA, 22 nt, Pseudomonas putida KT2440
gaacaggccgcgccugcuuaca

SEQ ID NO: 178134 - RNA, 20 nt, Pseudomonas putida KT2440
cugaucaucgucgcgggucg

SEQ ID NO: 178135 - RNA, 22 nt, Pseudomonas putida KT2440
uggaggcagguggccugugcuu

SEQ ID NO: 178136 - RNA, 22 nt, Pseudomonas putida KT2440
cccgaucgcucgggcugcuguu

SEQ ID NO: 178137 - RNA, 22 nt, Pseudomonas putida KT2440
ugcacccaggccaugugcggca

SEQ ID NO: 178138 - RNA, 22 nt, Pseudomonas putida KT2440
acgcuaugaccaggugauggac

SEQ ID NO: 178139 - RNA, 22 nt, Pseudomonas putida KT2440
cgcuccagguuaccgaucacgc

SEQ ID NO: 178140 - RNA, 22 nt, Pseudomonas putida KT2440
aggcgcuuggccagcaaggacg

SEQ ID NO: 178141 - RNA, 22 nt, Pseudomonas putida KT2440
gagcagcacuuccgugaagacc

SEQ ID NO: 178142 - RNA, 22 nt, Pseudomonas putida KT2440
gcacauggaugucauuucugcc

SEQ ID NO: 178143 - RNA, 22 nt, Pseudomonas putida KT2440
gcgggugaacccgcuccuacaa

SEQ ID NO: 178144 - RNA, 22 nt, Pseudomonas putida KT2440
ugccaagucgccgcuuugcguu

SEQ ID NO: 178145 - RNA, 22 nt, Pseudomonas putida KT2440
cgccgacuuugaacuggacccg

SEQ ID NO: 178146 - RNA, 22 nt, Pseudomonas putida KT2440
aagcgcugcucgcguucgucga

SEQ ID NO: 178147 - RNA, 23 nt, Pseudomonas putida KT2440
ccgagcuugucaggucggcuggc

SEQ ID NO: 178148 - RNA, 22 nt, Pseudomonas putida KT2440
aggcaugcuguggcauggcagc

SEQ ID NO: 178149 - RNA, 22 nt, Pseudomonas putida KT2440
cugacuuccuagaugcuuccaa

SEQ ID NO: 178150 - RNA, 21 nt, Pseudomonas putida KT2440
cggcaugaucaacggcaugau

SEQ ID NO: 178151 - RNA, 22 nt, Pseudomonas putida KT2440
gaugaagcucuuaugaauaguu

SEQ ID NO: 178152 - RNA, 21 nt, Pseudomonas putida KT2440
ucgggcgucugguuguucucg

SEQ ID NO: 178153 - RNA, 22 nt, Pseudomonas putida KT2440
auguugcugguggccaccaggg

SEQ ID NO: 178154 - RNA, 22 nt, Pseudomonas putida KT2440
gcaagccuggcggcggcgccug

SEQ ID NO: 178155 - RNA, 22 nt, Pseudomonas putida KT2440
gcgcuggucuucgccacggugg

SEQ ID NO: 178156 - RNA, 22 nt, Pseudomonas putida KT2440
gaggucgaagcgcucgaucagc

SEQ ID NO: 178157 - RNA, 22 nt, Pseudomonas putida KT2440
ucgagcggguugccguugucgu

SEQ ID NO: 178158 - RNA, 22 nt, Pseudomonas putida KT2440
gccgagaucaugcgcaacaccg

SEQ ID NO: 178159 - RNA, 22 nt, Pseudomonas putida KT2440
ccgggaucaacaucuucgaccu

SEQ ID NO: 178160 - RNA, 22 nt, Pseudomonas putida KT2440
ugcccgcucccacaguaaucgc

SEQ ID NO: 178161 - RNA, 22 nt, Pseudomonas putida KT2440
aggcaucgaagauuuugagcug

SEQ ID NO: 178162 - RNA, 23 nt, Pseudomonas putida KT2440
caccgacuacagcgugguggucg

SEQ ID NO: 178163 - RNA, 22 nt, Pseudomonas putida KT2440
gaguaucggcgggagcgggcau

SEQ ID NO: 178164 - RNA, 22 nt, Pseudomonas putida KT2440
ggugaugcuucaacggggccgg

SEQ ID NO: 178165 - RNA, 22 nt, Pseudomonas putida KT2440
caugucggccuggaacuugauc

SEQ ID NO: 178166 - RNA, 22 nt, Pseudomonas putida KT2440
guggcgcuguaguucgacugca

SEQ ID NO: 178167 - RNA, 21 nt, Pseudomonas putida KT2440
cuguacggaggugaucgaacc

SEQ ID NO: 178168 - RNA, 22 nt, Pseudomonas putida KT2440
ugugucaguucaagcacgauga

SEQ ID NO: 178169 - RNA, 22 nt, Pseudomonas putida KT2440
aacgccgugccuugcgccuggc

SEQ ID NO: 178170 - RNA, 23 nt, Pseudomonas putida KT2440
ugcaggcgcggguuuacccgcga

SEQ ID NO: 178171 - RNA, 22 nt, Pseudomonas putida KT2440
guugccuguccccgcgggccug

SEQ ID NO: 178172 - RNA, 22 nt, Pseudomonas putida KT2440
cgaagccaccggggccuuguug

SEQ ID NO: 178173 - RNA, 22 nt, Pseudomonas putida KT2440
agugcuggccaugcaguuacgu

SEQ ID NO: 178174 - RNA, 22 nt, Pseudomonas putida KT2440
caggugaucguugcgcgccagg

SEQ ID NO: 178175 - RNA, 22 nt, Pseudomonas putida KT2440
agggcgcugucgauggccgccu

SEQ ID NO: 178176 - RNA, 22 nt, Pseudomonas putida KT2440
ucaccgcugcgcuugaucagcg

SEQ ID NO: 178177 - RNA, 22 nt, Pseudomonas putida KT2440
agcggguuuucucgcgaaugcg

SEQ ID NO: 178178 - RNA, 22 nt, Pseudomonas putida KT2440
guaggagcggguuacccgcgaa

SEQ ID NO: 178179 - RNA, 22 nt, Pseudomonas putida KT2440
agcguugcggugcgggcugcag

SEQ ID NO: 178180 - RNA, 22 nt, Pseudomonas putida KT2440
agcagcgcccggacacugcguu

SEQ ID NO: 178181 - RNA, 22 nt, Pseudomonas putida KT2440
ucgaccugucugggcacagccu

SEQ ID NO: 178182 - RNA, 22 nt, Pseudomonas putida KT2440
gauggccauggcuggccuggcc

SEQ ID NO: 178183 - RNA, 22 nt, Pseudomonas putida KT2440
caguucgaccaccugggccagg

SEQ ID NO: 178184 - RNA, 22 nt, Pseudomonas putida KT2440
aucugguagugaucgcgcaugg

SEQ ID NO: 178185 - RNA, 22 nt, Pseudomonas putida KT2440
aggcugcgugcgaucgguucca

SEQ ID NO: 178186 - RNA, 22 nt, Pseudomonas putida KT2440
gcgcugacgcuguuguugccuc

SEQ ID NO: 178187 - RNA, 22 nt, Pseudomonas putida KT2440
agcgcgugacccucgacagccg

SEQ ID NO: 178188 - RNA, 22 nt, Pseudomonas putida KT2440
uugagccuagauaauucauuga

SEQ ID NO: 178189 - RNA, 22 nt, Pseudomonas putida KT2440
ggucgcaccugucgcacugcuc

SEQ ID NO: 178190 - RNA, 22 nt, Pseudomonas putida KT2440
cgcgcucaagcaacacuugcca

SEQ ID NO: 178191 - RNA, 22 nt, Pseudomonas putida KT2440
cggugccugcgguacccgcucg

SEQ ID NO: 178192 - RNA, 22 nt, Pseudomonas putida KT2440
ugaguaccuucggcgacggcga

SEQ ID NO: 178193 - RNA, 22 nt, Pseudomonas putida KT2440
agcggguucacccgcgaauacg

SEQ ID NO: 178194 - RNA, 22 nt, Pseudomonas putida KT2440
gccgguaccugcuucgugaaga

SEQ ID NO: 178195 - RNA, 22 nt, Pseudomonas putida KT2440
ugcucgaaaccgucgagcugau

SEQ ID NO: 178196 - RNA, 22 nt, Pseudomonas putida KT2440
agacgcaggcggauggcuucga

SEQ ID NO: 178197 - RNA, 22 nt, Pseudomonas putida KT2440
ucggccagcaggcgcaggguuu

SEQ ID NO: 178198 - RNA, 22 nt, Pseudomonas putida KT2440
ucgucgaugaggcccugcagcg

SEQ ID NO: 178199 - RNA, 22 nt, Pseudomonas putida KT2440
acgcaggugaucgcucggcaau

SEQ ID NO: 178200 - RNA, 22 nt, Pseudomonas putida KT2440
cagguaaaaaucaugcaguucu

SEQ ID NO: 178201 - RNA, 22 nt, Pseudomonas putida KT2440
ucggcgauggccggguguaccg

SEQ ID NO: 178202 - RNA, 22 nt, Pseudomonas putida KT2440
ccaggaucaacucauccuugau

SEQ ID NO: 178203 - RNA, 22 nt, Pseudomonas putida KT2440
ccuguaggagcggcuuuagccg

SEQ ID NO: 178204 - RNA, 22 nt, Pseudomonas putida KT2440
aagcgcgcaggcccuccuggcc

SEQ ID NO: 178205 - RNA, 22 nt, Pseudomonas putida KT2440
agcgcucuucuucggcggcggc

SEQ ID NO: 178206 - RNA, 22 nt, Pseudomonas putida KT2440
uggcgucgagcuggugcgcagc

SEQ ID NO: 178207 - RNA, 21 nt, Pseudomonas putida KT2440
aacagguagaagcucgcgccg

SEQ ID NO: 178208 - RNA, 22 nt, Pseudomonas putida KT2440
gugccguuggccggcacaguga

SEQ ID NO: 178209 - RNA, 22 nt, Pseudomonas putida KT2440
ccggguaacgcuuguacuuggc

SEQ ID NO: 178210 - RNA, 20 nt, Pseudomonas putida KT2440
cggucugcugcggcgagcgc

SEQ ID NO: 178211 - RNA, 22 nt, Pseudomonas putida KT2440
agcggcaagcugcaagaaagca

SEQ ID NO: 178212 - RNA, 22 nt, Pseudomonas putida KT2440
aacugcaugagguuccaguggg

SEQ ID NO: 178213 - RNA, 22 nt, Pseudomonas putida KT2440
ccugcagccacaugcccguaaa

SEQ ID NO: 178214 - RNA, 22 nt, Pseudomonas putida KT2440
ucgccgaggcgcuggaggccga

SEQ ID NO: 178215 - RNA, 22 nt, Pseudomonas putida KT2440
aggaggcuggcugcaucaggua

SEQ ID NO: 178216 - RNA, 23 nt, Pseudomonas putida KT2440
cgccaugcugacccgaccgacgc

SEQ ID NO: 178217 - RNA, 22 nt, Pseudomonas putida KT2440
ucacuugggucuucucggccgg

SEQ ID NO: 178218 - RNA, 22 nt, Pseudomonas putida KT2440
ugaugcccagcgucaguggcaa

SEQ ID NO: 178219 - RNA, 22 nt, Pseudomonas putida KT2440
ugugcagcccccguaggagcgg

SEQ ID NO: 178220 - RNA, 21 nt, Pseudomonas putida KT2440
gcaucgaaacgaccagcucgc

SEQ ID NO: 178221 - RNA, 22 nt, Pseudomonas putida KT2440
ggccuaccugguggcgccgcgg

SEQ ID NO: 178222 - RNA, 22 nt, Pseudomonas putida KT2440
caggccgugcaccuggacauca

SEQ ID NO: 178223 - RNA, 22 nt, Pseudomonas putida KT2440
cuggaaauggccaaggcgcuga

SEQ ID NO: 178224 - RNA, 22 nt, Pseudomonas putida KT2440
aaagggcugcgaagcagccccg

SEQ ID NO: 178225 - RNA, 22 nt, Pseudomonas putida KT2440
augccgaagucugggacacuga

SEQ ID NO: 178226 - RNA, 22 nt, Pseudomonas putida KT2440
ggcgaucaccaaggcgugcaag

SEQ ID NO: 178227 - RNA, 22 nt, Pseudomonas putida KT2440
ugcggccuugcgcagcgguacc

SEQ ID NO: 178228 - RNA, 22 nt, Pseudomonas putida KT2440
acaacgcgcccgccuggcccug

SEQ ID NO: 178229 - RNA, 22 nt, Pseudomonas putida KT2440
aucuugcgcaagauccagggug

SEQ ID NO: 178230 - RNA, 22 nt, Pseudomonas putida KT2440
ugucaucggccaaggggcagcc

SEQ ID NO: 178231 - RNA, 20 nt, Pseudomonas putida KT2440
uuugccgacggcguggcggu

SEQ ID NO: 178232 - RNA, 22 nt, Pseudomonas putida KT2440
cugaucaagcccuucgcuuucu

SEQ ID NO: 178233 - RNA, 22 nt, Pseudomonas putida KT2440
uggagggccuacggguugcggu

SEQ ID NO: 178234 - RNA, 22 nt, Pseudomonas putida KT2440
ccgcgucagccuugaccaggcc

SEQ ID NO: 178235 - RNA, 22 nt, Pseudomonas putida KT2440
gcguacugacccaggagucggg

SEQ ID NO: 178236 - RNA, 22 nt, Pseudomonas putida KT2440
auucgcgggugaacccgcuccc

SEQ ID NO: 178237 - RNA, 22 nt, Pseudomonas putida KT2440
cugggugaggugucuucggcgg

SEQ ID NO: 178238 - RNA, 22 nt, Pseudomonas putida KT2440
gacgaucugcaauugcggauga

SEQ ID NO: 178239 - RNA, 22 nt, Pseudomonas putida KT2440
guggcgaucugccgguucaugu

SEQ ID NO: 178240 - RNA, 22 nt, Pseudomonas putida KT2440
aguugccggagcgcgucagccc

SEQ ID NO: 178241 - RNA, 22 nt, Pseudomonas putida KT2440
ggucauggccggggucaagcug

SEQ ID NO: 178242 - RNA, 22 nt, Pseudomonas putida KT2440
ugccgaacucggaccauggggg

SEQ ID NO: 178243 - RNA, 22 nt, Pseudomonas putida KT2440
aagacguuggcgcccuguuccu

SEQ ID NO: 178244 - RNA, 22 nt, Pseudomonas putida KT2440
gugaacuguucggcgaccgugg

SEQ ID NO: 178245 - RNA, 22 nt, Pseudomonas putida KT2440
uggccucuucacggccaauggc

SEQ ID NO: 178246 - RNA, 22 nt, Pseudomonas putida KT2440
uacagccuuggggagcguccgu

SEQ ID NO: 178247 - RNA, 22 nt, Pseudomonas putida KT2440
gugaacggcuguuccagcuguc

SEQ ID NO: 178248 - RNA, 22 nt, Pseudomonas putida KT2440
gcggauuggcugcgacucaggu

SEQ ID NO: 178249 - RNA, 22 nt, Pseudomonas putida KT2440
cgcucugugacagcugcauggc

SEQ ID NO: 178250 - RNA, 22 nt, Pseudomonas putida KT2440
uugcgcuuguggaugagguugc

SEQ ID NO: 178251 - RNA, 22 nt, Pseudomonas putida KT2440
accgcguccagguacgcgcccu

SEQ ID NO: 178252 - RNA, 22 nt, Pseudomonas putida KT2440
cggcgauaguagucgugcgcau

SEQ ID NO: 178253 - RNA, 22 nt, Pseudomonas putida KT2440
uucgcggaagcccgcuccuaca

SEQ ID NO: 178254 - RNA, 22 nt, Pseudomonas putida KT2440
augaagacuauaucgaucugaa

SEQ ID NO: 178255 - RNA, 22 nt, Pseudomonas putida KT2440
ugucgggcaucgacuucgaaca

SEQ ID NO: 178256 - RNA, 22 nt, Pseudomonas putida KT2440
ccgcucaccccaaagggugauu

SEQ ID NO: 178257 - RNA, 22 nt, Pseudomonas putida KT2440
augcuguugagcuguuugaggu

SEQ ID NO: 178258 - RNA, 22 nt, Pseudomonas putida KT2440
agcucuucaaccuuggcgucga

SEQ ID NO: 178259 - RNA, 22 nt, Pseudomonas putida KT2440
ccguggcugggccaaugcggcg

SEQ ID NO: 178260 - RNA, 22 nt, Pseudomonas putida KT2440
ugcuccgaauaaccauggccgg

SEQ ID NO: 178261 - RNA, 22 nt, Pseudomonas putida KT2440
ccuguggcagcagcggucuugu

SEQ ID NO: 178262 - RNA, 22 nt, Pseudomonas putida KT2440
agcuguugucgcggcgcggcau

SEQ ID NO: 178263 - RNA, 22 nt, Pseudomonas putida KT2440
aaagggcugcuggcggcguugu

SEQ ID NO: 178264 - RNA, 20 nt, Pseudomonas putida KT2440
gucagcauggcguuagucca

SEQ ID NO: 178265 - RNA, 22 nt, Pseudomonas putida KT2440
gugccagcggucagcgcggugc

SEQ ID NO: 178266 - RNA, 22 nt, Pseudomonas putida KT2440
accggccuugauggugaccugg

SEQ ID NO: 178267 - RNA, 17 nt, Pseudomonas putida KT2440
cggcaaggaacaggauu

SEQ ID NO: 178268 - RNA, 22 nt, Pseudomonas putida KT2440
cgcguugccugcuucgcgggug

SEQ ID NO: 178269 - RNA, 22 nt, Pseudomonas putida KT2440
cgugcgcauugccgucgagccg

SEQ ID NO: 178270 - RNA, 22 nt, Pseudomonas putida KT2440
ucagcuuuggcuaucagccgug

SEQ ID NO: 178271 - RNA, 22 nt, Pseudomonas putida KT2440
aucgauacgccccggcgccugu

SEQ ID NO: 178272 - RNA, 22 nt, Pseudomonas putida KT2440
gcagcugcguccggugcgcugg

SEQ ID NO: 178273 - RNA, 22 nt, Pseudomonas putida KT2440
cuggcgcugacguugaucggcc

SEQ ID NO: 178274 - RNA, 22 nt, Pseudomonas putida KT2440
gauacagcacgucgaacagcug

SEQ ID NO: 178275 - RNA, 22 nt, Pseudomonas putida KT2440
cgcgaagaggcagguacaggca

SEQ ID NO: 178276 - RNA, 23 nt, Pseudomonas putida KT2440
caguaccgccuugaagcacuuga

SEQ ID NO: 178277 - RNA, 22 nt, Pseudomonas putida KT2440
gauauucacgaugcuggccaag

SEQ ID NO: 178278 - RNA, 22 nt, Pseudomonas putida KT2440
cagcggcacgcucggcggcaag

SEQ ID NO: 178279 - RNA, 22 nt, Pseudomonas putida KT2440
uucgcugugucggcgacgugaa

SEQ ID NO: 178280 - RNA, 22 nt, Pseudomonas putida KT2440
ucggcgaacugggcgcgcaagg

SEQ ID NO: 178281 - RNA, 22 nt, Pseudomonas putida KT2440
uugcggcaaguuguuccagcgu

SEQ ID NO: 178282 - RNA, 22 nt, Pseudomonas putida KT2440
cuugccggccagcagguggccg

SEQ ID NO: 178283 - RNA, 22 nt, Pseudomonas putida KT2440
uugaacugcggcuggucgaggu

SEQ ID NO: 178284 - RNA, 22 nt, Pseudomonas putida KT2440
ucaucgaugugggcgaauuggg

SEQ ID NO: 178285 - RNA, 22 nt, Pseudomonas putida KT2440
guccuugaccgugucggccacg

SEQ ID NO: 178286 - RNA, 22 nt, Pseudomonas putida KT2440
cacagccugagccugccguucc

SEQ ID NO: 178287 - RNA, 22 nt, Pseudomonas putida KT2440
ggguucacccgcgaagaggcca

SEQ ID NO: 178288 - RNA, 22 nt, Pseudomonas putida KT2440
uggugaacauagccuguuuucc

SEQ ID NO: 178289 - RNA, 22 nt, Pseudomonas putida KT2440
cgcccaugaccuccugacgccu

SEQ ID NO: 178290 - RNA, 22 nt, Pseudomonas putida KT2440
cagaucguuguaggagcgggcu

SEQ ID NO: 178291 - RNA, 22 nt, Pseudomonas putida KT2440
ugcuggucaaccgccuggauga

SEQ ID NO: 178292 - RNA, 22 nt, Pseudomonas putida KT2440
uuggccaugggccugggcugau

SEQ ID NO: 178293 - RNA, 22 nt, Pseudomonas putida KT2440
gcggccaaccacuucaucgagg

SEQ ID NO: 178294 - RNA, 23 nt, Pseudomonas putida KT2440
acggcgaggaagccagcuucauc

SEQ ID NO: 178295 - RNA, 23 nt, Pseudomonas putida KT2440
gguggccagcacuucgaauacgc

SEQ ID NO: 178296 - RNA, 22 nt, Pseudomonas putida KT2440
aggccgcucccacagauaaugc

SEQ ID NO: 178297 - RNA, 22 nt, Pseudomonas putida KT2440
cgcggguaaacccgcgccugca

SEQ ID NO: 178298 - RNA, 22 nt, Pseudomonas putida KT2440
uuaggcuucaguuauaccugua

SEQ ID NO: 178299 - RNA, 22 nt, Pseudomonas putida KT2440
ccaguaccugaucgagcauuug

SEQ ID NO: 178300 - RNA, 18 nt, Pseudomonas putida KT2440
ggccauguugagcugguu

SEQ ID NO: 178301 - RNA, 22 nt, Pseudomonas putida KT2440
cucgguguucgccaagcugccc

SEQ ID NO: 178302 - RNA, 22 nt, Pseudomonas putida KT2440
ugcggguaaucgaucgucagac

SEQ ID NO: 178303 - RNA, 22 nt, Pseudomonas putida KT2440
cgcggguaaacccgcuccuacg

SEQ ID NO: 178304 - RNA, 22 nt, Pseudomonas putida KT2440
gcauggagcccagcgaggucac

SEQ ID NO: 178305 - RNA, 22 nt, Pseudomonas putida KT2440
ccaacgguugcgaucgacauca

SEQ ID NO: 178306 - RNA, 22 nt, Pseudomonas putida KT2440
aucggcuuggcgaugcgugugg

SEQ ID NO: 178307 - RNA, 22 nt, Pseudomonas putida KT2440
uucgcgcucaucgucacggccc

SEQ ID NO: 178308 - RNA, 22 nt, Pseudomonas putida KT2440
ucgcggcaagcccgcuccuaca

SEQ ID NO: 178309 - RNA, 22 nt, Pseudomonas putida KT2440
augggacagauccgccggcuug

SEQ ID NO: 178310 - RNA, 22 nt, Pseudomonas putida KT2440
uuacccgcgagccgggcgacgc

SEQ ID NO: 178311 - RNA, 22 nt, Pseudomonas putida KT2440
cgggcgaugaccugaagcugcu

SEQ ID NO: 178312 - RNA, 22 nt, Pseudomonas putida KT2440
gcauugaaggcggguaccggca

SEQ ID NO: 178313 - RNA, 21 nt, Pseudomonas putida KT2440
ugcccaagggcuuggucaggu

SEQ ID NO: 178314 - RNA, 22 nt, Pseudomonas putida KT2440
cgcggguuuaccugugaaugcg

SEQ ID NO: 178315 - RNA, 23 nt, Pseudomonas putida KT2440
gccgugaccguggcuggcguggu

SEQ ID NO: 178316 - RNA, 22 nt, Pseudomonas putida KT2440
cuucgcggguaaacccgccccu

SEQ ID NO: 178317 - RNA, 22 nt, Pseudomonas putida KT2440
aagguccgcugccgaaacugaa

SEQ ID NO: 178318 - RNA, 22 nt, Pseudomonas putida KT2440
uugccgugcucgugggggauga

SEQ ID NO: 178319 - RNA, 22 nt, Pseudomonas putida KT2440
uggcuggacgaggucggcgccg

SEQ ID NO: 178320 - RNA, 22 nt, Pseudomonas putida KT2440
ggagcuguuucggggguugccg

SEQ ID NO: 178321 - RNA, 22 nt, Pseudomonas putida KT2440
uaucagcaucacaaguggccau

SEQ ID NO: 178322 - RNA, 22 nt, Pseudomonas putida KT2440
gagaugcuggugcugcagcucg

SEQ ID NO: 178323 - RNA, 22 nt, Pseudomonas putida KT2440
caaggucggcgggcgggugcug

SEQ ID NO: 178324 - RNA, 22 nt, Pseudomonas putida KT2440
cggucgucguaggagcggguuc

SEQ ID NO: 178325 - RNA, 22 nt, Pseudomonas putida KT2440
ucgauguguugaagcugggugg

SEQ ID NO: 178326 - RNA, 22 nt, Pseudomonas putida KT2440
guuccugggcgaggugacgcag

SEQ ID NO: 178327 - RNA, 22 nt, Pseudomonas putida KT2440
ugcgaagucaaucgcgugaauu

SEQ ID NO: 178328 - RNA, 22 nt, Pseudomonas putida KT2440
ccuguuugcugugcgacagcgc

SEQ ID NO: 178329 - RNA, 22 nt, Pseudomonas putida KT2440
ggcaugcccgcgaaucaggcga

SEQ ID NO: 178330 - RNA, 21 nt, Pseudomonas putida KT2440
ucguggucaucagccagcgcc

SEQ ID NO: 178331 - RNA, 22 nt, Pseudomonas putida KT2440
uguaggagcgggcuugcccgcg

SEQ ID NO: 178332 - RNA, 22 nt, Pseudomonas putida KT2440
agcggccucuucgcggguaaac

SEQ ID NO: 178333 - RNA, 22 nt, Pseudomonas putida KT2440
ggccucugugcgcguggggggu

SEQ ID NO: 178334 - RNA, 22 nt, Pseudomonas putida KT2440
cgcgucaccuguuucgcgggca

SEQ ID NO: 178335 - RNA, 20 nt, Pseudomonas putida KT2440
ccaggcuggacgaggccaug

SEQ ID NO: 178336 - RNA, 22 nt, Pseudomonas putida KT2440
cgagcauugucuggauccguuu

SEQ ID NO: 178337 - RNA, 22 nt, Pseudomonas putida KT2440
ucccggugcaccugcagcaggu

SEQ ID NO: 178338 - RNA, 22 nt, Pseudomonas putida KT2440
uugaacagggugcgguacuggu

SEQ ID NO: 178339 - RNA, 22 nt, Pseudomonas putida KT2440
cggcaagccagcguccacaggu

SEQ ID NO: 178340 - RNA, 22 nt, Pseudomonas putida KT2440
ugcagucagucuaccgagggac

SEQ ID NO: 178341 - RNA, 22 nt, Pseudomonas putida KT2440
ugggcugaccccgcuguaccuu

SEQ ID NO: 178342 - RNA, 22 nt, Pseudomonas putida KT2440
ccgaucaaugucggagcgggcu

SEQ ID NO: 178343 - RNA, 22 nt, Pseudomonas putida KT2440
uaugccugucggaucuacguca

SEQ ID NO: 178344 - RNA, 22 nt, Pseudomonas putida KT2440
cccgcgaacaccggcgaagccg

SEQ ID NO: 178345 - RNA, 22 nt, Pseudomonas putida KT2440
guggccgaggucggccugaucg

SEQ ID NO: 178346 - RNA, 22 nt, Pseudomonas putida KT2440
gcauucgcgggugaacccgcuc

SEQ ID NO: 178347 - RNA, 22 nt, Pseudomonas putida KT2440
uguaggaguggguuggcucacg

SEQ ID NO: 178348 - RNA, 22 nt, Pseudomonas putida KT2440
agcggguucacccgcgaaugcg

SEQ ID NO: 178349 - RNA, 22 nt, Pseudomonas putida KT2440
ucuggaggugaucaagcaugga

SEQ ID NO: 178350 - RNA, 22 nt, Pseudomonas putida KT2440
accucgcuuuuccgcaggagaa

SEQ ID NO: 178351 - RNA, 22 nt, Pseudomonas putida KT2440
gugaccaacgucgccaccccca

SEQ ID NO: 178352 - RNA, 22 nt, Pseudomonas putida KT2440
aaggcgcuacagcuaccgucag

SEQ ID NO: 178353 - RNA, 22 nt, Pseudomonas putida KT2440
caucgcccagcggaacuggcuu

SEQ ID NO: 178354 - RNA, 22 nt, Pseudomonas putida KT2440
ccggacuucugguucagccgcg

SEQ ID NO: 178355 - RNA, 22 nt, Pseudomonas putida KT2440
agacucagguugcuuggaaagu

SEQ ID NO: 178356 - RNA, 22 nt, Pseudomonas putida KT2440
ccgacccugugggagcgggcuu

SEQ ID NO: 178357 - RNA, 22 nt, Pseudomonas putida KT2440
ugcggcuugcugaggcgcgacu

SEQ ID NO: 178358 - RNA, 22 nt, Pseudomonas putida KT2440
augcccgcucccacagguagcc

SEQ ID NO: 178359 - RNA, 22 nt, Pseudomonas putida KT2440
cagcagcgguaccaaggcgauc

SEQ ID NO: 178360 - RNA, 22 nt, Pseudomonas putida KT2440
acuucgcggguaaacccgcucc

SEQ ID NO: 178361 - RNA, 22 nt, Pseudomonas putida KT2440
agugcgcguguucgugggcuug

SEQ ID NO: 178362 - RNA, 22 nt, Pseudomonas putida KT2440
cagccgcugcugcgcugggcca

SEQ ID NO: 178363 - RNA, 22 nt, Pseudomonas putida KT2440
uugccgaugacacugucguggc

SEQ ID NO: 178364 - RNA, 22 nt, Pseudomonas putida KT2440
aucagugggugccugccuaacu

SEQ ID NO: 178365 - RNA, 22 nt, Pseudomonas putida KT2440
cacugauauccagguccagggu

SEQ ID NO: 178366 - RNA, 22 nt, Pseudomonas putida KT2440
gucgaagaggccgccaccggca

SEQ ID NO: 178367 - RNA, 22 nt, Pseudomonas putida KT2440
ucccugguguaagcgaggcaau

SEQ ID NO: 178368 - RNA, 22 nt, Pseudomonas putida KT2440
cgcuggaacaacccgccgcugc

SEQ ID NO: 178369 - RNA, 19 nt, Pseudomonas putida KT2440
augccgcgaagugcugcgc

SEQ ID NO: 178370 - RNA, 22 nt, Pseudomonas putida KT2440
aucucgauaucgguggccugac

SEQ ID NO: 178371 - RNA, 19 nt, Pseudomonas putida KT2440
ggucggacaaggcagacau

SEQ ID NO: 178372 - RNA, 22 nt, Pseudomonas putida KT2440
uaaacccgcuccuacaaagguu

SEQ ID NO: 178373 - RNA, 22 nt, Pseudomonas putida KT2440
cggugauuacugcguggugcac

SEQ ID NO: 178374 - RNA, 22 nt, Pseudomonas putida KT2440
ggaggcaugucgaugguguguu

SEQ ID NO: 178375 - RNA, 22 nt, Pseudomonas putida KT2440
augaacauccccaacgccgcgu

SEQ ID NO: 178376 - RNA, 22 nt, Pseudomonas putida KT2440
ugacauugucgaagccgucauc

SEQ ID NO: 178377 - RNA, 22 nt, Pseudomonas putida KT2440
uccgcagcgccuucgcccucuu

SEQ ID NO: 178378 - RNA, 22 nt, Pseudomonas putida KT2440
ugaucgagcagguuggccaggc

SEQ ID NO: 178379 - RNA, 22 nt, Pseudomonas putida KT2440
aacggcgagcgcauugccgcca

SEQ ID NO: 178380 - RNA, 22 nt, Pseudomonas putida KT2440
ugcugauaucggcggcggccag

SEQ ID NO: 178381 - RNA, 22 nt, Pseudomonas putida KT2440
ugcccgcucccacagggaccgc

SEQ ID NO: 178382 - RNA, 22 nt, Pseudomonas putida KT2440
cugagcgugcugacagcggcca

SEQ ID NO: 178383 - RNA, 22 nt, Pseudomonas putida KT2440
ucaaggauggccaccaggguca

SEQ ID NO: 178384 - RNA, 22 nt, Pseudomonas putida KT2440
acuuccacaacuaccggcagcu

SEQ ID NO: 178385 - RNA, 22 nt, Pseudomonas putida KT2440
ggcuccgucaaagugaugcugg

SEQ ID NO: 178386 - RNA, 22 nt, Pseudomonas putida KT2440
ucgaucgacaugggcggcagca

SEQ ID NO: 178387 - RNA, 22 nt, Pseudomonas putida KT2440
aguugauuuugcggucugccau

SEQ ID NO: 178388 - RNA, 22 nt, Pseudomonas putida KT2440
acggcuaugacacguacagccu

SEQ ID NO: 178389 - RNA, 22 nt, Pseudomonas putida KT2440
ggugccaccguauucgcugaug

SEQ ID NO: 178390 - RNA, 22 nt, Pseudomonas putida KT2440
uugcccgcgaacaccggcaacg

SEQ ID NO: 178391 - RNA, 22 nt, Pseudomonas putida KT2440
uggcagcgaggugggcaucaag

SEQ ID NO: 178392 - RNA, 22 nt, Pseudomonas putida KT2440
aagccgguggcggccucuuggc

SEQ ID NO: 178393 - RNA, 22 nt, Pseudomonas putida KT2440
aucuggcaggcgcugcacuauu

SEQ ID NO: 178394 - RNA, 22 nt, Pseudomonas putida KT2440
guccaccacugucaaacgcuuc

SEQ ID NO: 178395 - RNA, 23 nt, Pseudomonas putida KT2440
caggcucaugccuugggccgagc

SEQ ID NO: 178396 - RNA, 22 nt, Pseudomonas putida KT2440
ugugccggauggcuauguauug

SEQ ID NO: 178397 - RNA, 22 nt, Pseudomonas putida KT2440
uuaccagcgcuggcgccgggug

SEQ ID NO: 178398 - RNA, 22 nt, Pseudomonas putida KT2440
auacaccgccugugccucugcg

SEQ ID NO: 178399 - RNA, 22 nt, Pseudomonas putida KT2440
caucccguaucugugcugcuag

SEQ ID NO: 178400 - RNA, 22 nt, Pseudomonas putida KT2440
agccgcuccuacgaggacccca

SEQ ID NO: 178401 - RNA, 22 nt, Pseudomonas putida KT2440
aggccgcucccacagguaauac

SEQ ID NO: 178402 - RNA, 22 nt, Pseudomonas putida KT2440
gaacggguuuacccgcgaaugc

SEQ ID NO: 178403 - RNA, 22 nt, Pseudomonas putida KT2440
cugggcuacgagguaggguuga

SEQ ID NO: 178404 - RNA, 19 nt, Pseudomonas putida KT2440
cgugaucgcagcguugcgu

SEQ ID NO: 178405 - RNA, 22 nt, Pseudomonas putida KT2440
agcuugucgcgcgagcgggcaa

SEQ ID NO: 178406 - RNA, 22 nt, Pseudomonas putida KT2440
aggucgaagaaguugcggccga

SEQ ID NO: 178407 - RNA, 22 nt, Pseudomonas putida KT2440
cauugccaacccugaccuggug

SEQ ID NO: 178408 - RNA, 22 nt, Pseudomonas putida KT2440
cggguaaacccgcuccuacaac

SEQ ID NO: 178409 - RNA, 23 nt, Pseudomonas putida KT2440
uccugguucgucacgagcaggcg

SEQ ID NO: 178410 - RNA, 22 nt, Pseudomonas putida KT2440
ugcgcagguauagggcuacgug

SEQ ID NO: 178411 - RNA, 22 nt, Pseudomonas putida KT2440
uggagauguagucguuguugua

SEQ ID NO: 178412 - RNA, 22 nt, Pseudomonas putida KT2440
cgcgucauccgaugcagcaguc

SEQ ID NO: 178413 - RNA, 23 nt, Pseudomonas putida KT2440
agcggguagcggcgucuuuuucg

SEQ ID NO: 178414 - RNA, 22 nt, Pseudomonas putida KT2440
cagguaguuacccagcgcacca

SEQ ID NO: 178415 - RNA, 22 nt, Pseudomonas putida KT2440
aucuggcgcaugcgcagggcau

SEQ ID NO: 178416 - RNA, 22 nt, Pseudomonas putida KT2440
gcggguaaacccgcuccuacga

SEQ ID NO: 178417 - RNA, 22 nt, Pseudomonas putida KT2440
gcguucggauuuuucuucagca

SEQ ID NO: 178418 - RNA, 22 nt, Pseudomonas putida KT2440
acaguaccugugggagcgggca

SEQ ID NO: 178419 - RNA, 22 nt, Pseudomonas putida KT2440
ugcugcaaggcugccaacauug

SEQ ID NO: 178420 - RNA, 22 nt, Pseudomonas putida KT2440
ucgcuggacggccugcgugccg

SEQ ID NO: 178421 - RNA, 20 nt, Pseudomonas putida KT2440
auuugccugaucacccuggu

SEQ ID NO: 178422 - RNA, 22 nt, Pseudomonas putida KT2440
aaguguuggugcaccuggagau

SEQ ID NO: 178423 - RNA, 21 nt, Pseudomonas putida KT2440
ugaugcgguccuuggccauga

SEQ ID NO: 178424 - RNA, 22 nt, Pseudomonas putida KT2440
gauaccaaucaccauugaccug

SEQ ID NO: 178425 - RNA, 22 nt, Pseudomonas putida KT2440
ccuggcgagucagcagcgccag

SEQ ID NO: 178426 - RNA, 22 nt, Pseudomonas putida KT2440
ugcagggcgcgggugaaggcuu

SEQ ID NO: 178427 - RNA, 22 nt, Pseudomonas putida KT2440
acgcugacagcaugcccgcuca

SEQ ID NO: 178428 - RNA, 22 nt, Pseudomonas putida KT2440
cgcggguaaacccgcuccuaca

SEQ ID NO: 178429 - RNA, 22 nt, Pseudomonas putida KT2440
aacagccuccgggucgccgaag

SEQ ID NO: 178430 - RNA, 22 nt, Pseudomonas putida KT2440
ggccaaguguacgacggugagc

SEQ ID NO: 178431 - RNA, 22 nt, Pseudomonas putida KT2440
ucagcgcccgcugcauuucgaa

SEQ ID NO: 178432 - RNA, 22 nt, Pseudomonas putida KT2440
cgguccuuguaggugcggguuu

SEQ ID NO: 178433 - RNA, 22 nt, Pseudomonas putida KT2440
auucgagcugcaggcgguccug

SEQ ID NO: 178434 - RNA, 22 nt, Pseudomonas putida KT2440
agguuugccacacguguuuauc

SEQ ID NO: 178435 - RNA, 22 nt, Pseudomonas putida KT2440
ugcaggcggccccguacgcgcu

SEQ ID NO: 178436 - RNA, 22 nt, Pseudomonas putida KT2440
ugugugccaggcggcugaccag

SEQ ID NO: 178437 - RNA, 22 nt, Pseudomonas putida KT2440
accugucgaugcgcauguuugc

SEQ ID NO: 178438 - RNA, 22 nt, Pseudomonas putida KT2440
ccggcguugaccgcguugcucg

SEQ ID NO: 178439 - RNA, 22 nt, Pseudomonas putida KT2440
ucaucaugcuguucauccugcu

SEQ ID NO: 178440 - RNA, 22 nt, Pseudomonas putida KT2440
ggcucgcugggcgaugucaugg

SEQ ID NO: 178441 - RNA, 22 nt, Pseudomonas putida KT2440
ggcccaguggcuggucggccug

SEQ ID NO: 178442 - RNA, 22 nt, Pseudomonas putida KT2440
aaggacgcuaaacuggcgcugg

SEQ ID NO: 178443 - RNA, 22 nt, Pseudomonas putida KT2440
uccucgaugauccgcugaucgu

SEQ ID NO: 178444 - RNA, 22 nt, Pseudomonas putida KT2440
uugccugugcugacccuuucgc

SEQ ID NO: 178445 - RNA, 22 nt, Pseudomonas putida KT2440
gccuggacaugguacgaacggg

SEQ ID NO: 178446 - RNA, 22 nt, Pseudomonas putida KT2440
cuggaucgacgccgcuucgucc

SEQ ID NO: 178447 - RNA, 22 nt, Pseudomonas putida KT2440
gucguugaguucggcaauggca

SEQ ID NO: 178448 - RNA, 22 nt, Pseudomonas putida KT2440
aucggcgagcguggaggugacc

SEQ ID NO: 178449 - RNA, 22 nt, Pseudomonas putida KT2440
ugcaccguaccugugggagcgg

SEQ ID NO: 178450 - RNA, 22 nt, Pseudomonas putida KT2440
cagaagcgucgaggucgagcca

SEQ ID NO: 178451 - RNA, 22 nt, Pseudomonas putida KT2440
cucgguaccuggcugcaggaac

SEQ ID NO: 178452 - RNA, 22 nt, Pseudomonas putida KT2440
aagggcugcaacgcaaccccgg

SEQ ID NO: 178453 - RNA, 22 nt, Pseudomonas putida KT2440
gcgggugaaaagccacugcuga

SEQ ID NO: 178454 - RNA, 22 nt, Pseudomonas putida KT2440
gaguggcucaugugcugcgcgg

SEQ ID NO: 178455 - RNA, 22 nt, Pseudomonas putida KT2440
ggugcagaaccuggugcgcaau

SEQ ID NO: 178456 - RNA, 22 nt, Pseudomonas putida KT2440
gaccaggacgcuaucgaauaca

SEQ ID NO: 178457 - RNA, 22 nt, Pseudomonas putida KT2440
uuggccguggagcagcuggccg

SEQ ID NO: 178458 - RNA, 22 nt, Pseudomonas putida KT2440
cugucggugccgaucggcgcga

SEQ ID NO: 178459 - RNA, 22 nt, Pseudomonas putida KT2440
ccgcucugaacgcagcugcucc

SEQ ID NO: 178460 - RNA, 19 nt, Pseudomonas putida KT2440
ugcugucgguggcagugau

SEQ ID NO: 178461 - RNA, 22 nt, Pseudomonas putida KT2440
cgcggguaaacccgccccuaua

SEQ ID NO: 178462 - RNA, 22 nt, Pseudomonas putida KT2440
cgcggguaaaccugccccuaca

SEQ ID NO: 178463 - RNA, 22 nt, Pseudomonas putida KT2440
ugcggcaggauggugcuuugca

SEQ ID NO: 178464 - RNA, 22 nt, Pseudomonas putida KT2440
gcuaucgaagcguugcggcauu

SEQ ID NO: 178465 - RNA, 22 nt, Pseudomonas putida KT2440
gagcugauaggcgauauucucg

SEQ ID NO: 178466 - RNA, 22 nt, Pseudomonas putida KT2440
gugcggcuucuucgcggcugua

SEQ ID NO: 178467 - RNA, 22 nt, Pseudomonas putida KT2440
ucagcccaauaucgcaggcccc

SEQ ID NO: 178468 - RNA, 22 nt, Pseudomonas putida KT2440
cugggugauccccggcgggcau

SEQ ID NO: 178469 - RNA, 22 nt, Pseudomonas putida KT2440
acccgcuccuacaggggccuug

SEQ ID NO: 178470 - RNA, 22 nt, Pseudomonas putida KT2440
uauggccuggcuggcgagcgug

SEQ ID NO: 178471 - RNA, 22 nt, Pseudomonas putida KT2440
ugcacggccagccgcugcaggg

SEQ ID NO: 178472 - RNA, 22 nt, Pseudomonas putida KT2440
uugccgcgcuuuguacuggacc

SEQ ID NO: 178473 - RNA, 21 nt, Pseudomonas putida KT2440
cauguggucgauguggccagu

SEQ ID NO: 178474 - RNA, 22 nt, Pseudomonas putida KT2440
ucgggcaguugaacugccaagg

SEQ ID NO: 178475 - RNA, 18 nt, Pseudomonas putida KT2440
aguuggccuguggaaaca

SEQ ID NO: 178476 - RNA, 22 nt, Pseudomonas putida KT2440
ucgauggggccaguggugcgcu

SEQ ID NO: 178477 - RNA, 22 nt, Pseudomonas putida KT2440
agcaccugggccaggcgcugcg

SEQ ID NO: 178478 - RNA, 23 nt, Pseudomonas putida KT2440
ucggaagcagcgccaucgccggc

SEQ ID NO: 178479 - RNA, 22 nt, Pseudomonas putida KT2440
ucuugcgugguuugugcuugcu

SEQ ID NO: 178480 - RNA, 22 nt, Pseudomonas putida KT2440
accaccggugguugcugcaguc

SEQ ID NO: 178481 - RNA, 22 nt, Pseudomonas putida KT2440
cagcagcagcgccugugcaucg

SEQ ID NO: 178482 - RNA, 22 nt, Pseudomonas putida KT2440
ucggccuuguacgagcucuccu

SEQ ID NO: 178483 - RNA, 22 nt, Pseudomonas putida KT2440
aacccgcuccuacgggggcugc

SEQ ID NO: 178484 - RNA, 22 nt, Pseudomonas putida KT2440
ucgucagaagucagcaggcugu

SEQ ID NO: 178485 - RNA, 22 nt, Pseudomonas putida KT2440
gguggccaccgcgcuugcagcg

SEQ ID NO: 178486 - RNA, 22 nt, Pseudomonas putida KT2440
aagugcaaggcugaguccgguc

SEQ ID NO: 178487 - RNA, 22 nt, Pseudomonas putida KT2440
ucugcgcaccaguuggcuuacg

SEQ ID NO: 178488 - RNA, 22 nt, Pseudomonas putida KT2440
ugaugcugccccgaagccacac

SEQ ID NO: 178489 - RNA, 22 nt, Pseudomonas putida KT2440
cggcaaugcucucugaagaucu

SEQ ID NO: 178490 - RNA, 22 nt, Pseudomonas putida KT2440
cucgaacauuucgccgccggcc

SEQ ID NO: 178491 - RNA, 22 nt, Pseudomonas putida KT2440
aucggccacgcgcagacguugc

SEQ ID NO: 178492 - RNA, 22 nt, Pseudomonas putida KT2440
cagagcagaugcggucuugcag

SEQ ID NO: 178493 - RNA, 22 nt, Pseudomonas putida KT2440
acuggccaggcggcuguccaua

SEQ ID NO: 178494 - RNA, 22 nt, Pseudomonas putida KT2440
ucauuggcagcgcaucgacuga

SEQ ID NO: 178495 - RNA, 22 nt, Pseudomonas putida KT2440
cgauguaguugcgcgaacugga

SEQ ID NO: 178496 - RNA, 22 nt, Pseudomonas putida KT2440
ggagucgauggccaccaggguc

SEQ ID NO: 178497 - RNA, 22 nt, Pseudomonas putida KT2440
ccaagcucagcauugucuauuc

SEQ ID NO: 178498 - RNA, 22 nt, Pseudomonas putida KT2440
cuugcaugauucggcuauucau

SEQ ID NO: 178499 - RNA, 22 nt, Pseudomonas putida KT2440
gucugaucgaacguucuggccg

SEQ ID NO: 178500 - RNA, 22 nt, Pseudomonas putida KT2440
uucgcgggcaagcccgcuccua

SEQ ID NO: 178501 - RNA, 22 nt, Pseudomonas putida KT2440
gcgcgguaguugcgcgaguccu

SEQ ID NO: 178502 - RNA, 22 nt, Pseudomonas putida KT2440
cggcguagccgguguucgcggg

SEQ ID NO: 178503 - RNA, 22 nt, Pseudomonas putida KT2440
uugcuggagcuggcccgccagc

SEQ ID NO: 178504 - RNA, 22 nt, Pseudomonas putida KT2440
uugccuguguuggccucuucgc

SEQ ID NO: 178505 - RNA, 22 nt, Pseudomonas putida KT2440
gcgaaggcgcccgacauggacu

SEQ ID NO: 178506 - RNA, 22 nt, Pseudomonas putida KT2440
cagcgccucgcgccaggccuca

SEQ ID NO: 178507 - RNA, 22 nt, Pseudomonas putida KT2440
accugugggagcgggcgugccc

SEQ ID NO: 178508 - RNA, 22 nt, Pseudomonas putida KT2440
cagcaucgcagggggagccguu

SEQ ID NO: 178509 - RNA, 22 nt, Pseudomonas putida KT2440
ggucaaccagcaacuggcacug

SEQ ID NO: 178510 - RNA, 22 nt, Pseudomonas putida KT2440
aucagguuggcguacucguugg

SEQ ID NO: 178511 - RNA, 22 nt, Pseudomonas putida KT2440
ggcgucgagccguggcaaggac

SEQ ID NO: 178512 - RNA, 22 nt, Pseudomonas putida KT2440
ggccuuugucguaugugggguu

SEQ ID NO: 178513 - RNA, 22 nt, Pseudomonas putida KT2440
aaggauuucuaagcuuucaaua

SEQ ID NO: 178514 - RNA, 22 nt, Pseudomonas putida KT2440
cuugcccgcucccacaaguacu

SEQ ID NO: 178515 - RNA, 22 nt, Pseudomonas putida KT2440
gucguagaucgacaugccggcg

SEQ ID NO: 178516 - RNA, 22 nt, Pseudomonas putida KT2440
uggcgaucccuguaggagcggg

SEQ ID NO: 178517 - RNA, 22 nt, Pseudomonas putida KT2440
ugaccagaacggccgcgacauu

SEQ ID NO: 178518 - RNA, 22 nt, Pseudomonas putida KT2440
aacgcggguugcgguugcggcu

SEQ ID NO: 178519 - RNA, 22 nt, Pseudomonas putida KT2440
gcagccaagaucgucauuggug

SEQ ID NO: 178520 - RNA, 22 nt, Pseudomonas putida KT2440
ugcaauccauuguaggagcggg

SEQ ID NO: 178521 - RNA, 22 nt, Pseudomonas putida KT2440
aaggauuucuaagcuuucaaua

SEQ ID NO: 178522 - RNA, 22 nt, Pseudomonas putida KT2440
cagagcucuugcuucgauuagg

SEQ ID NO: 178523 - RNA, 22 nt, Pseudomonas putida KT2440
aucagccugcugcucacccacg

SEQ ID NO: 178524 - RNA, 22 nt, Pseudomonas putida KT2440
aggcuguccaccugcuggugca

SEQ ID NO: 178525 - RNA, 22 nt, Pseudomonas putida KT2440
gcagucuucggucgaaggccug

SEQ ID NO: 178526 - RNA, 22 nt, Pseudomonas putida KT2440
cgagcaccagcaguugcuugcg

SEQ ID NO: 178527 - RNA, 22 nt, Pseudomonas putida KT2440
cuugccuggcgucgagaauggc

SEQ ID NO: 178528 - RNA, 22 nt, Pseudomonas putida KT2440
uccgaugacgauaucuaccaga

SEQ ID NO: 178529 - RNA, 22 nt, Pseudomonas putida KT2440
ucaucaugcuguucauccugcu

SEQ ID NO: 178530 - RNA, 22 nt, Pseudomonas putida KT2440
ucuccaauaagccucauggacc

SEQ ID NO: 178531 - RNA, 22 nt, Pseudomonas putida KT2440
ucuaccuggguagccaccucac

SEQ ID NO: 178532 - RNA, 22 nt, Pseudomonas putida KT2440
aacugcaugagguuccaguggg

SEQ ID NO: 178533 - RNA, 22 nt, Pseudomonas putida KT2440
acgagcugucggcaccgaugcu

SEQ ID NO: 178534 - RNA, 22 nt, Pseudomonas putida KT2440
accaucuaaaaggccauugggg

SEQ ID NO: 178535 - RNA, 23 nt, Pseudomonas putida KT2440
accaugagcgccauccgucuggc

SEQ ID NO: 178536 - RNA, 22 nt, Pseudomonas putida KT2440
agcuugugguucugaugcugca

SEQ ID NO: 178537 - RNA, 22 nt, Pseudomonas putida KT2440
uuuccaauaauccauggcaacc

SEQ ID NO: 178538 - RNA, 22 nt, Pseudomonas putida KT2440
uuugcaaauacggccaauaacu

SEQ ID NO: 178539 - RNA, 22 nt, Pseudomonas putida KT2440
uugauuucgaacgggggguaau

SEQ ID NO: 178540 - RNA, 22 nt, Pseudomonas putida KT2440
uaggcuucgcucuccagcaggu

SEQ ID NO: 178541 - RNA, 22 nt, Pseudomonas putida KT2440
gugaacuguucggcgaccgugg

SEQ ID NO: 178542 - RNA, 22 nt, Pseudomonas putida KT2440
ccgagcucggacuugaguguga

SEQ ID NO: 178543 - RNA, 21 nt, Pseudomonas putida KT2440
cauguggucgauguggccagu

SEQ ID NO: 178544 - RNA, 22 nt, Human
uaauaaaaauuuaauucacauu

SEQ ID NO: 178545 - RNA, 22 nt, Human
ccaaggcuguggggcugugcag

SEQ ID NO: 178546 - RNA, 17 nt, Human
ucuuuuacuuucucucc

SEQ ID NO: 178547 - RNA, 22 nt, Human
ggcucacuguaccugccgccgc

SEQ ID NO: 178548 - RNA, 22 nt, Human
uuuauuuagguaaacaugaguu

SEQ ID NO: 178549 - RNA, 22 nt, Human
cuauauucuggaauguccauuu

SEQ ID NO: 178550 - RNA, 22 nt, Human
guuaaaaugauuugugauuuau

SEQ ID NO: 178551 - RNA, 22 nt, Human
gucuuucuuuuacauauuugug

SEQ ID NO: 178552 - RNA, 22 nt, Human
ccagucuuggugucuguagcac

SEQ ID NO: 178553 - RNA, 22 nt, Human
uucugcuuuaaagcucauguuu

SEQ ID NO: 178554 - RNA, 22 nt, Human
uggcucaggccuacgacgccuu

SEQ ID NO: 178555 - RNA, 22 nt, Human
gcacaaaagguacuucauguag

SEQ ID NO: 178556 - RNA, 22 nt, Human
aucacuagaguuacauugccag

SEQ ID NO: 178557 - RNA, 22 nt, Human
ugggcagggagcuggaaccaca

SEQ ID NO: 178558 - RNA, 22 nt, Human
uguauaaaauggaaugucagaa

SEQ ID NO: 178559 - RNA, 22 nt, Human
aggcaggggagcuggaagggua

SEQ ID NO: 178560 - RNA, 22 nt, Human
uaguuucuaauguugaaauuau

SEQ ID NO: 178561 - RNA, 22 nt, Human
auauauguauauaugugugugu

SEQ ID NO: 178562 - RNA, 22 nt, Human
agugucugcgggcagaggagcg

SEQ ID NO: 178563 - RNA, 22 nt, Human
ucucucugcuguccagcguuau

SEQ ID NO: 178564 - RNA, 22 nt, Human
gaggccagcacccagaugcaug

SEQ ID NO: 178565 - RNA, 22 nt, Human
agucugugguccucuguaucuc

SEQ ID NO: 178566 - RNA, 22 nt, Human
ugggcagggauuuggggaaacu

SEQ ID NO: 178567 - RNA, 22 nt, Human
uuacuuaucugaugugauuuuu

SEQ ID NO: 178568 - RNA, 22 nt, Human
acauuuuaaaaacaguaccugg

SEQ ID NO: 178569 - RNA, 23 nt, Human
uccuccccaccuuuguccccucc

SEQ ID NO: 178570 - RNA, 22 nt, Human
ggaggaagagaccagggggcuu

SEQ ID NO: 178571 - RNA, 22 nt, Human
ugugugcuaguuuugucaguau

SEQ ID NO: 178572 - RNA, 22 nt, Human
cucaaagcagacuuuucccuuu

SEQ ID NO: 178573 - RNA, 22 nt, Human
cugguuuauuucauaguuuguu

SEQ ID NO: 178574 - RNA, 22 nt, Human
uuuuguuuacauuaaauuuuga

SEQ ID NO: 178575 - RNA, 20 nt, Human
agucuucaggugugaggauu

SEQ ID NO: 178576 - RNA, 22 nt, Human
uuucucuuguauuugaaucacu

SEQ ID NO: 178577 - RNA, 22 nt, Human
aagcugcagacccccugucuca

SEQ ID NO: 178578 - RNA, 22 nt, Human
aauaucuugaguuauaaauuca

SEQ ID NO: 178579 - RNA, 22 nt, Human
cucagaauugucaccucaaaaa

SEQ ID NO: 178580 - RNA, 22 nt, Human
augaagguggacagauuuuuuu

SEQ ID NO: 178581 - RNA, 22 nt, Human
uguuuuuauucuuaauguuuca

SEQ ID NO: 178582 - RNA, 22 nt, Human
acauuuccaaagaugccaguca

SEQ ID NO: 178583 - RNA, 22 nt, Human
uuugauuuuguuuauagugccg

SEQ ID NO: 178584 - RNA, 22 nt, Human
acauaaauagcacugugaauuu

SEQ ID NO: 178585 - RNA, 22 nt, Human
ugagggaggggaaugugugcag

SEQ ID NO: 178586 - RNA, 22 nt, Human
aagcauuuuagauaaagcauca

SEQ ID NO: 178587 - RNA, 22 nt, Human
gagccucaggguuuuguugaca

SEQ ID NO: 178588 - RNA, 22 nt, Human
ucuugcuguggcagaucuggag

SEQ ID NO: 178589 - RNA, 22 nt, Human
cuuacauuuguuuaguguuucc

SEQ ID NO: 178590 - RNA, 22 nt, Human
uauuaauugugguuauuguauu

SEQ ID NO: 178591 - RNA, 20 nt, Human
uucacagaggacucagguca

SEQ ID NO: 178592 - RNA, 22 nt, Human
aaauguaaacuguauuuauaaa

SEQ ID NO: 178593 - RNA, 22 nt, Human
agaugaugugugucuucagcua

SEQ ID NO: 178594 - RNA, 18 nt, Human
uucaggcucuugcaugaa

SEQ ID NO: 178595 - RNA, 22 nt, Human
caggccccagggacugggcgcu

SEQ ID NO: 178596 - RNA, 19 nt, Human
ccacacacuggucucuggg

SEQ ID NO: 178597 - RNA, 23 nt, Human
ucucacucauucuccucugucca

SEQ ID NO: 178598 - RNA, 22 nt, Human
gggugcuucauaggugaugcug

SEQ ID NO: 178599 - RNA, 22 nt, Human
auucuuauaaaaaguguugacu

SEQ ID NO: 178600 - RNA, 22 nt, Human
gagggagugggcccgugggcac

SEQ ID NO: 178601 - RNA, 22 nt, Human
agggaggagggacagaaagagg

SEQ ID NO: 178602 - RNA, 22 nt, Human
caucuaaaauaagccuuauaau

SEQ ID NO: 178603 - RNA, 22 nt, Human
ggcuagggaucuagaccaggac

SEQ ID NO: 178604 - RNA, 22 nt, Human
gaacauauuuagcaccuaauau

SEQ ID NO: 178605 - RNA, 22 nt, Human
caguagcuuuuugcagacaaga

SEQ ID NO: 178606 - RNA, 22 nt, Human
gcauaauauugagaaauuauua

SEQ ID NO: 178607 - RNA, 22 nt, Human
uuuuccuucugauacuccauuu

SEQ ID NO: 178608 - RNA, 20 nt, Human
uucacagaucucuaacugag

SEQ ID NO: 178609 - RNA, 23 nt, Human
agagggaagagcuuagaugggga

SEQ ID NO: 178610 - RNA, 22 nt, Human
cuuuuuaaaguaaauggcuaga

SEQ ID NO: 178611 - RNA, 22 nt, Human
ucuuuuucccugguuccuuuuu

SEQ ID NO: 178612 - RNA, 21 nt, Human
ugccuggccuuugcuuuuccu

SEQ ID NO: 178613 - RNA, 22 nt, Human
uuccuucccccuucuuugccuu

SEQ ID NO: 178614 - RNA, 22 nt, Human
gucuccuucauuuacuguuucc

SEQ ID NO: 178615 - RNA, 22 nt, Human
uuuaucaggccaucuuaugucu

SEQ ID NO: 178616 - RNA, 22 nt, Human
augugccuuaauauaggcgcug

SEQ ID NO: 178617 - RNA, 22 nt, Human
gggauggggagcuggaaagggg

SEQ ID NO: 178618 - RNA, 22 nt, Human
aguaggaauucaaagagacaaa

SEQ ID NO: 178619 - RNA, 22 nt, Human
uauuuuuuuaacauuuauugua

SEQ ID NO: 178620 - RNA, 22 nt, Human
cagagccagcuguccuuggcau

SEQ ID NO: 178621 - RNA, 22 nt, Human
agcacauguuucuuuugcaauu

SEQ ID NO: 178622 - RNA, 22 nt, Human
gaaggagaggauugugaggcug

SEQ ID NO: 178623 - RNA, 22 nt, Human
gaggggaacaggcauucuuaag

SEQ ID NO: 178624 - RNA, 22 nt, Human
ucagucucuggggcuucuguuu

SEQ ID NO: 178625 - RNA, 22 nt, Human
auggaggugagccccccauccu

SEQ ID NO: 178626 - RNA, 22 nt, Human
ccauuuggccauucaguuguuc

SEQ ID NO: 178627 - RNA, 22 nt, Human
augugagcuggaugaauuuaua

SEQ ID NO: 178628 - RNA, 22 nt, Human
uuucacuucgaucagaguuuuu

SEQ ID NO: 178629 - RNA, 22 nt, Human
ugaauuuuggcaauuuucugug

SEQ ID NO: 178630 - RNA, 22 nt, Human
ggcagagcugugcgcccaccca

SEQ ID NO: 178631 - RNA, 22 nt, Human
agauauucugccuaacagguuu

SEQ ID NO: 178632 - RNA, 22 nt, Human
uggaugccuugggggaggagga

SEQ ID NO: 178633 - RNA, 22 nt, Human
gggggacagugugccuggugug

SEQ ID NO: 178634 - RNA, 22 nt, Human
auguguguaugacugaaucuau

SEQ ID NO: 178635 - RNA, 22 nt, Human
gugaaaaauggccaucaggaca

SEQ ID NO: 178636 - RNA, 21 nt, Human
uaagcuaaacauucaguuaac

SEQ ID NO: 178637 - RNA, 22 nt, Human
uacuauuuugacaugaaauuga

SEQ ID NO: 178638 - RNA, 21 nt, Human
cuauaaaaaugguucuuugcg

SEQ ID NO: 178639 - RNA, 22 nt, Human
gcagguggaagcagcagacuca

SEQ ID NO: 178640 - RNA, 22 nt, Human
agccagugucgugugacaugag

SEQ ID NO: 178641 - RNA, 22 nt, Human
auguguuuugaccccugcuaaa

SEQ ID NO: 178642 - RNA, 22 nt, Human
uuuuacaaugcaaauucuugcu

SEQ ID NO: 178643 - RNA, 22 nt, Human
uccaaggacucuugucagcugu

SEQ ID NO: 178644 - RNA, 22 nt, Human
gguagacugagcuccuugagga

SEQ ID NO: 178645 - RNA, 21 nt, Human
acuuccacaucacugaguaga

SEQ ID NO: 178646 - RNA, 22 nt, Human
cuuucuuuuugguuucccccca

SEQ ID NO: 178647 - RNA, 22 nt, Human
cuagcacagugcuuggcacaca

SEQ ID NO: 178648 - RNA, 22 nt, Human
auacaucuuaacgcgcucuugg

SEQ ID NO: 178649 - RNA, 22 nt, Human
uggagccugauggauaggaacg

SEQ ID NO: 178650 - RNA, 20 nt, Human
cuccuccccucggccccacc

SEQ ID NO: 178651 - RNA, 22 nt, Human
gcuguggagaagcugccuaugg

SEQ ID NO: 178652 - RNA, 22 nt, Human
uuugaagaaacagucuuaagag

SEQ ID NO: 178653 - RNA, 22 nt, Human
aaugcuuuuugcgaaaugugca

SEQ ID NO: 178654 - RNA, 22 nt, Human
uuuguauuguuuauuucauuuu

SEQ ID NO: 178655 - RNA, 22 nt, Human
ugcuuucagauaucuguuucaa

SEQ ID NO: 178656 - RNA, 22 nt, Human
cuggccagccucccagguaccc

SEQ ID NO: 178657 - RNA, 22 nt, Human
uuuuaaaacaugucaaaaugug

SEQ ID NO: 178658 - RNA, 22 nt, Human
gcagaggcugccgugggcagga

SEQ ID NO: 178659 - RNA, 22 nt, Human
auuuuuagucuugcugcaauca

SEQ ID NO: 178660 - RNA, 22 nt, Human
ucauuguuuacugucuuuuuuc

SEQ ID NO: 178661 - RNA, 22 nt, Human
cuggaagcgucggaggaagggc

SEQ ID NO: 178662 - RNA, 22 nt, Human
cagauaagcuauaaguaguacc

SEQ ID NO: 178663 - RNA, 22 nt, Human
auguuuucuugucuggagaagu

SEQ ID NO: 178664 - RNA, 22 nt, Human
ccuuuccuggaaaugguaaguu

SEQ ID NO: 178665 - RNA, 22 nt, Human
uuucuggacuaaagggagagau

SEQ ID NO: 178666 - RNA, 22 nt, Human
cacugcacuccagccugggcaa

SEQ ID NO: 178667 - RNA, 22 nt, Human
acuguugagggaagcagaugaa

SEQ ID NO: 178668 - RNA, 22 nt, Human
guuuuucuuugauuuagaacca

SEQ ID NO: 178669 - RNA, 22 nt, Human
gggggcagguuccaggccagcu

SEQ ID NO: 178670 - RNA, 22 nt, Human
gcuuauuagguuauuucaagga

SEQ ID NO: 178671 - RNA, 22 nt, Human
aggcauauaguguuuaaaaaaa

SEQ ID NO: 178672 - RNA, 22 nt, Human
uaggggguuuuucuagagauug

SEQ ID NO: 178673 - RNA, 22 nt, Human
uggaagaucugguguagcuccu

SEQ ID NO: 178674 - RNA, 19 nt, Human
augaaauagcauuuucuga

SEQ ID NO: 178675 - RNA, 22 nt, Human
ucccugcugggcgaucuucucu

SEQ ID NO: 178676 - RNA, 22 nt, Human
ugguuuuuuguaggauaaacau

SEQ ID NO: 178677 - RNA, 22 nt, Human
ugcuccucugcaugucugcggc

SEQ ID NO: 178678 - RNA, 22 nt, Human
ucgagcucagcagggaggugcg

SEQ ID NO: 178679 - RNA, 22 nt, Human
uuuucucaguuuuuuucaaaag

SEQ ID NO: 178680 - RNA, 22 nt, Human
aaauauagugacacuuauaguc

SEQ ID NO: 178681 - RNA, 22 nt, Human
aguaaaugaaagcaauuuuaga

SEQ ID NO: 178682 - RNA, 22 nt, Human
aaggcuguuugagcacuggagc

SEQ ID NO: 178683 - RNA, 22 nt, Human
guccuguguaaguacuugcuca

SEQ ID NO: 178684 - RNA, 22 nt, Human
uuccuuuuuaauuaaucuaauu

SEQ ID NO: 178685 - RNA, 22 nt, Human
auauuuuacagcucucguugaa

SEQ ID NO: 178686 - RNA, 22 nt, Human
cucuguguguuugugugugugu

SEQ ID NO: 178687 - RNA, 22 nt, Human
auagcacuuaauaugaaacagu

SEQ ID NO: 178688 - RNA, 22 nt, Human
gcuucuguuaggauguggcuua

SEQ ID NO: 178689 - RNA, 22 nt, Human
cugcugugcagacagacucucu

SEQ ID NO: 178690 - RNA, 22 nt, Human
aaaauauuuaucuagcucuuaa

SEQ ID NO: 178691 - RNA, 22 nt, Human
gcagggcucuggagucaggcug

SEQ ID NO: 178692 - RNA, 22 nt, Human
cugaccucuaaguaacagagaa

SEQ ID NO: 178693 - RNA, 22 nt, Human
cagguggauggcgagcccugca

SEQ ID NO: 178694 - RNA, 20 nt, Human
uacaauauucccacuuugcu

SEQ ID NO: 178695 - RNA, 22 nt, Human
cuguccauuuucgugccuccuu

SEQ ID NO: 178696 - RNA, 22 nt, Human
uguugaaacagcuauugacuuu

SEQ ID NO: 178697 - RNA, 22 nt, Human
ucagcucucucuuggugaucuc

SEQ ID NO: 178698 - RNA, 22 nt, Human
agcgcucauuuuccuccugcuc

SEQ ID NO: 178699 - RNA, 22 nt, Human
gauuucuucauuuaaaaauauu

SEQ ID NO: 178700 - RNA, 22 nt, Human
ucuucaaauacagucauauuga

SEQ ID NO: 178701 - RNA, 22 nt, Human
cggggcuccgaagagcucgguu

SEQ ID NO: 178702 - RNA, 22 nt, Human
guuuuguagucuggagacuguc

SEQ ID NO: 178703 - RNA, 22 nt, Human
ggggaggguuuggaugagaguc

SEQ ID NO: 178704 - RNA, 22 nt, Human
caaaaaauccauagaaagaggu

SEQ ID NO: 178705 - RNA, 22 nt, Human
aaaauacuaggaaaauaaauca

SEQ ID NO: 178706 - RNA, 22 nt, Human
aaaaacuuaccccagggcaagg

SEQ ID NO: 178707 - RNA, 22 nt, Human
aaggggaauaguaggaccuggg

SEQ ID NO: 178708 - RNA, 22 nt, Human
ugcuuggagaaucagucccagc

SEQ ID NO: 178709 - RNA, 22 nt, Human
uggcaagcuguuggcagauagc

SEQ ID NO: 178710 - RNA, 22 nt, Human
cagcuggggagagacauggcag

SEQ ID NO: 178711 - RNA, 19 nt, Human
agagucuccacuccacuug

SEQ ID NO: 178712 - RNA, 22 nt, Human
ugaccucaagcaugcggagggc

SEQ ID NO: 178713 - RNA, 22 nt, Human
gccaguggucagugggagggug

SEQ ID NO: 178714 - RNA, 22 nt, Human
cagguugaaaguggaggagcua

SEQ ID NO: 178715 - RNA, 22 nt, Human
gagcagcucgagaaggaagcag

SEQ ID NO: 178716 - RNA, 22 nt, Human
ucacuguuucaccgucugaagg

SEQ ID NO: 178717 - RNA, 22 nt, Human
ggaagauagaaguucaaaaguu

SEQ ID NO: 178718 - RNA, 22 nt, Human
ggcugguggcgggcagcacaga

SEQ ID NO: 178719 - RNA, 22 nt, Human
ggaagcuguugugagugcagca

SEQ ID NO: 178720 - RNA, 22 nt, Human
aggaaauaguuuagucccaaaa

SEQ ID NO: 178721 - RNA, 18 nt, Human
aguuuuuuuggcaaaagg

SEQ ID NO: 178722 - RNA, 21 nt, Human
acugggcuagccugacuucug

SEQ ID NO: 178723 - RNA, 22 nt, Human
uuuuucuuugcuuuccacuggc

SEQ ID NO: 178724 - RNA, 22 nt, Human
gauauuuugugaaaaaacaacu

SEQ ID NO: 178725 - RNA, 22 nt, Human
uuuuaaauaaacuacacugauu

SEQ ID NO: 178726 - RNA, 22 nt, Human
uacauguggagauaacugaagc

SEQ ID NO: 178727 - RNA, 22 nt, Human
uagacugugagcuccuugaggg

SEQ ID NO: 178728 - RNA, 22 nt, Human
ucagcuucaucuugagcccaca

SEQ ID NO: 178729 - RNA, 22 nt, Human
gggcaagaagcuggaagcauuc

SEQ ID NO: 178730 - RNA, 22 nt, Human
ccccauggaaaacccaccuagg

SEQ ID NO: 178731 - RNA, 20 nt, Human
ccugggcuccaggagccccg

SEQ ID NO: 178732 - RNA, 22 nt, Human
agacuucucuuggcuauauuau

SEQ ID NO: 178733 - RNA, 22 nt, Human
auuuccagcagcauauuugucu

SEQ ID NO: 178734 - RNA, 22 nt, Human
gcaggggguaaggggcagggcu

SEQ ID NO: 178735 - RNA, 22 nt, Human
ggagcucacuacgaaauaagcu

SEQ ID NO: 178736 - RNA, 22 nt, Human
aggccaggcgccggcgcgagac

SEQ ID NO: 178737 - RNA, 22 nt, Human
aagugugugugcgcaugugcau

SEQ ID NO: 178738 - RNA, 22 nt, Human
ggagauggucacagguaaacau

SEQ ID NO: 178739 - RNA, 22 nt, Human
cacauguguaccugccucucug

SEQ ID NO: 178740 - RNA, 21 nt, Human
acaaaaccuaacuuggcugcu

SEQ ID NO: 178741 - RNA, 22 nt, Human
cuccuuugagcaaaucuuugau

SEQ ID NO: 178742 - RNA, 22 nt, Human
gugcugggaggcccaggaugga

SEQ ID NO: 178743 - RNA, 22 nt, Human
gaggagcuucagaggaaucuua

SEQ ID NO: 178744 - RNA, 22 nt, Human
acuuccuuccagcaaauggcau

SEQ ID NO: 178745 - RNA, 22 nt, Human
ugagauguaauguaguacuuug

SEQ ID NO: 178746 - RNA, 22 nt, Human
gcuguggaaaaugggucuccaa

SEQ ID NO: 178747 - RNA, 22 nt, Human
cccagaggcugaguugggagca

SEQ ID NO: 178748 - RNA, 22 nt, Human
gguuuucacgauccucccuuuu

SEQ ID NO: 178749 - RNA, 22 nt, Human
ugaguucugacugagcaugggg

SEQ ID NO: 178750 - RNA, 21 nt, Human
auauuguugggguuuucuuuu

SEQ ID NO: 178751 - RNA, 22 nt, Human
cucuugacagcuuuaguaucau

SEQ ID NO: 178752 - RNA, 22 nt, Human
ucagagccagacacacagcaga

SEQ ID NO: 178753 - RNA, 22 nt, Human
ucccuguggauuaaggagaugu

SEQ ID NO: 178754 - RNA, 22 nt, Human
cuccuagagcacaaaaggccau

SEQ ID NO: 178755 - RNA, 22 nt, Human
cuacuucucccuagaucagaaa

SEQ ID NO: 178756 - RNA, 22 nt, Human
gugugucucaguugcuccgaag

SEQ ID NO: 178757 - RNA, 22 nt, Human
uuaccuuggaccggguaucaga

SEQ ID NO: 178758 - RNA, 22 nt, Human
gacauuuauuggauuuuacgag

SEQ ID NO: 178759 - RNA, 20 nt, Human
gccaaggaggagaaacaggc

SEQ ID NO: 178760 - RNA, 22 nt, Human
uuguuuucuaguguuuugaaua

SEQ ID NO: 178761 - RNA, 22 nt, Human
caaagaugccaaaaggaagaca

SEQ ID NO: 178762 - RNA, 22 nt, Human
cucaagugacucagccugguug

SEQ ID NO: 178763 - RNA, 22 nt, Human
gcaguuugugauguggcaguca

SEQ ID NO: 178764 - RNA, 22 nt, Human
agaacauaucuguuuucuaacu

SEQ ID NO: 178765 - RNA, 22 nt, Human
ugguucuagaugagaugaugag

SEQ ID NO: 178766 - RNA, 22 nt, Human
uucuagcucauggugacagauc

SEQ ID NO: 178767 - RNA, 21 nt, Human
uuccauggacccugucagugu

SEQ ID NO: 178768 - RNA, 22 nt, Human
aagggagagggagaagguggga

SEQ ID NO: 178769 - RNA, 22 nt, Human
uguuuuuucccccccuucuaaa

SEQ ID NO: 178770 - RNA, 22 nt, Human
uaauauauuuuuuaagggaugu

SEQ ID NO: 178771 - RNA, 22 nt, Human
gggcagagagcuggaacuccuu

SEQ ID NO: 178772 - RNA, 22 nt, Human
uccaugauauauaugugcacau

SEQ ID NO: 178773 - RNA, 22 nt, Human
acuuuauacuagugauaguuug

SEQ ID NO: 178774 - RNA, 22 nt, Human
aaauagucagaaaucaacgugc

SEQ ID NO: 178775 - RNA, 22 nt, Human
ccucuccuugcuccccuuccuu

SEQ ID NO: 178776 - RNA, 22 nt, Human
cagccuuuucuuaaaaugcaag

SEQ ID NO: 178777 - RNA, 22 nt, Human
uucauuuccauuuuauagauaa

SEQ ID NO: 178778 - RNA, 22 nt, Human
cuucagagugacucagcaucuu

SEQ ID NO: 178779 - RNA, 22 nt, Human
agggcucacuacaacccuggga

SEQ ID NO: 178780 - RNA, 22 nt, Human
auacauauaugcacauuaauau

SEQ ID NO: 178781 - RNA, 22 nt, Human
auuuauuugaagagccauugca

SEQ ID NO: 178782 - RNA, 22 nt, Human
uauuuuagccaacagaaugaug

SEQ ID NO: 178783 - RNA, 22 nt, Human
auauucaaugaggucauauaag

SEQ ID NO: 178784 - RNA, 20 nt, Human
acacaccugcucagacugag

SEQ ID NO: 178785 - RNA, 22 nt, Human
guuguuuuuguuaaaacaguga

SEQ ID NO: 178786 - RNA, 22 nt, Human
gagaacagauaugaugacuuca

SEQ ID NO: 178787 - RNA, 22 nt, Human
aaagggagauaaaguaauuuua

SEQ ID NO: 178788 - RNA, 22 nt, Human
augaaaacggaccagagcuauu

SEQ ID NO: 178789 - RNA, 22 nt, Human
acugucuuguuguaugugagcu

SEQ ID NO: 178790 - RNA, 22 nt, Human
uuuuuaaaauuaggacggcacg

SEQ ID NO: 178791 - RNA, 22 nt, Human
auuugcauguuuauuucuuaga

SEQ ID NO: 178792 - RNA, 22 nt, Human
ucccaaguguuuggcgaggaga

SEQ ID NO: 178793 - RNA, 22 nt, Human
augccugcugucaggaacucuu

SEQ ID NO: 178794 - RNA, 23 nt, Human
cagagaaaauagaauaugcugug

SEQ ID NO: 178795 - RNA, 22 nt, Human
auauuuuugcagaauuuuucgu

SEQ ID NO: 178796 - RNA, 22 nt, Human
auguuccaugacuaugcaugaa

SEQ ID NO: 178797 - RNA, 22 nt, Human
aaagcugaaacgaaaugacaac

SEQ ID NO: 178798 - RNA, 22 nt, Human
ugaggaagugguuguaugguuu

SEQ ID NO: 178799 - RNA, 22 nt, Human
agucacuguucugucaugucaa

SEQ ID NO: 178800 - RNA, 20 nt, Human
uuuuuuaaauagagcuguug

SEQ ID NO: 178801 - RNA, 22 nt, Human
caagggcagaggcagggccccg

SEQ ID NO: 178802 - RNA, 22 nt, Human
aaauucuuccaggaggaaauac

SEQ ID NO: 178803 - RNA, 23 nt, Human
uugcuuuugccccaaaagaguua

SEQ ID NO: 178804 - RNA, 22 nt, Human
aggggcugugucauuuguccua

SEQ ID NO: 178805 - RNA, 22 nt, Human
gaggagggagcuggaagcucuu

SEQ ID NO: 178806 - RNA, 22 nt, Human
uuuuuaagguuuguuuauauau

SEQ ID NO: 178807 - RNA, 22 nt, Human
aggauggauagcaaggaagccg

SEQ ID NO: 178808 - RNA, 22 nt, Human
ccccccaaauguuacagugacc

SEQ ID NO: 178809 - RNA, 22 nt, Human
ccugcccaucccaccccagcau

SEQ ID NO: 178810 - RNA, 22 nt, Human
guuuaaaagcaaccaacaggcu

SEQ ID NO: 178811 - RNA, 22 nt, Human
ggcugggagguggcgaggaggc

SEQ ID NO: 178812 - RNA, 22 nt, Human
auauaguacauguauauauaua

SEQ ID NO: 178813 - RNA, 22 nt, Human
ggaaguggauucagggcugcua

SEQ ID NO: 178814 - RNA, 22 nt, Human
uaccuggauaaauguacaaccg

SEQ ID NO: 178815 - RNA, 22 nt, Human
cagagcugucauuugccaguga

SEQ ID NO: 178816 - RNA, 19 nt, Human
uggugcgcuguuccugagc

SEQ ID NO: 178817 - RNA, 22 nt, Human
uuuguuuuggugucaugcguga

SEQ ID NO: 178818 - RNA, 22 nt, Human
aagagaggaaagggugugaggu

SEQ ID NO: 178819 - RNA, 22 nt, Human
ucucaaagguuuuccucuuuuu

SEQ ID NO: 178820 - RNA, 22 nt, Human
ggcugugguggacgcgggaaac

SEQ ID NO: 178821 - RNA, 22 nt, Human
uuguuauuauuauuuucguucu

SEQ ID NO: 178822 - RNA, 22 nt, Human
uguguuguuggggauguuuuca

SEQ ID NO: 178823 - RNA, 22 nt, Human
uuuuuguuauuuagguguagag

SEQ ID NO: 178824 - RNA, 20 nt, Human
uaguggaccuugaaggccuc

SEQ ID NO: 178825 - RNA, 22 nt, Human
ucauacuuuuuugacccuugug

SEQ ID NO: 178826 - RNA, 22 nt, Human
ucugaggacagugcugugccug

SEQ ID NO: 178827 - RNA, 22 nt, Human
guucucuuaauccuaguuggua

SEQ ID NO: 178828 - RNA, 22 nt, Human
uagcauuucacugaucuucacu

SEQ ID NO: 178829 - RNA, 22 nt, Human
uaguucugaauagcauugaaga

SEQ ID NO: 178830 - RNA, 22 nt, Human
aaacccaggguuuugucuuccc

SEQ ID NO: 178831 - RNA, 22 nt, Human
uccaaggacuaaauucuagauu

SEQ ID NO: 178832 - RNA, 22 nt, Human
uccaugaguuuuuuaguuucac

SEQ ID NO: 178833 - RNA, 22 nt, Human
agauuuucuuuuccaucuuugu

SEQ ID NO: 178834 - RNA, 22 nt, Human
cagaccuggaaaacaggcuugc

SEQ ID NO: 178835 - RNA, 22 nt, Human
cuguuucucugccugcacacau

SEQ ID NO: 178836 - RNA, 21 nt, Human
cuuugccuccagcagccgcag

SEQ ID NO: 178837 - RNA, 22 nt, Human
caauccccaggucccagaacag

SEQ ID NO: 178838 - RNA, 22 nt, Human
ugagagggagacagcucuagca

SEQ ID NO: 178839 - RNA, 19 nt, Human
agugaacuccauaucaggu

SEQ ID NO: 178840 - RNA, 22 nt, Human
aaggccuaggaguugacauggg

SEQ ID NO: 178841 - RNA, 22 nt, Human
aagugaggagaccucuucuuca

SEQ ID NO: 178842 - RNA, 22 nt, Human
ugccagcuccgaggagcugcag

SEQ ID NO: 178843 - RNA, 22 nt, Human
uccuuuauuuaugggcagugua

SEQ ID NO: 178844 - RNA, 22 nt, Human
acuuccuuuuuuggggauagca

SEQ ID NO: 178845 - RNA, 19 nt, Human
agcaucuccacagaaaaag

SEQ ID NO: 178846 - RNA, 22 nt, Human
gacuggggcauuagaguagcuu

SEQ ID NO: 178847 - RNA, 22 nt, Human
auguucucagguuguauuuauu

SEQ ID NO: 178848 - RNA, 22 nt, Human
acauauaugugcauacaacuau

SEQ ID NO: 178849 - RNA, 22 nt, Human
gucugcccuuggccugggacuu

SEQ ID NO: 178850 - RNA, 22 nt, Human
uugucaggaacuaugauuaugc

SEQ ID NO: 178851 - RNA, 22 nt, Human
gaguggccugccccagccaggc

SEQ ID NO: 178852 - RNA, 20 nt, Human
uugauucacaaaaagcuuag

SEQ ID NO: 178853 - RNA, 22 nt, Human
uucacccuucucuggcuuucag

SEQ ID NO: 178854 - RNA, 22 nt, Human
auguacugacuguacuuuuaaa

SEQ ID NO: 178855 - RNA, 19 nt, Human
caggucuucuuggaggacu

SEQ ID NO: 178856 - RNA, 19 nt, Human
ucuuugcuuuucuaagagg

SEQ ID NO: 178857 - RNA, 18 nt, Human
aggcuggggaucacaggg

SEQ ID NO: 178858 - RNA, 22 nt, Human
uaugaauauaccacaauuuagg

SEQ ID NO: 178859 - RNA, 22 nt, Human
uucuccaccugcuccucccacc

SEQ ID NO: 178860 - RNA, 22 nt, Human
aagaugaguuacaaaggaguaa

SEQ ID NO: 178861 - RNA, 19 nt, Human
ggaggguguccucaguguc

SEQ ID NO: 178862 - RNA, 22 nt, Human
uucucaauggcaacuuguugcu

SEQ ID NO: 178863 - RNA, 22 nt, Human
caauaccucuuggugauugggc

SEQ ID NO: 178864 - RNA, 22 nt, Human
aaugaaaaucugucaguucaag

SEQ ID NO: 178865 - RNA, 20 nt, Human
cuguucucuugccacaugag

SEQ ID NO: 178866 - RNA, 22 nt, Human
ucuugugguggaucccucauuu

SEQ ID NO: 178867 - RNA, 22 nt, Human
uucagaauuaucauaauuuuga

SEQ ID NO: 178868 - RNA, 22 nt, Human
cauaaauuuuaccuuguaagug

SEQ ID NO: 178869 - RNA, 22 nt, Human
aagugauuuucccaccaucuac

SEQ ID NO: 178870 - RNA, 21 nt, Human
uggcaggcagcuggaagcuug

SEQ ID NO: 178871 - RNA, 22 nt, Human
aggguggaggacaggccaguga

SEQ ID NO: 178872 - RNA, 22 nt, Human
uaguggaaccuucuaaaugacg

SEQ ID NO: 178873 - RNA, 22 nt, Human
auguaugagagauucuuuuauu

SEQ ID NO: 178874 - RNA, 22 nt, Human
uggagagcaaugaggggcaggc

SEQ ID NO: 178875 - RNA, 18 nt, Human
aguaaauguuaaauauug

SEQ ID NO: 178876 - RNA, 22 nt, Human
uucuauaagagaugaauacagu

SEQ ID NO: 178877 - RNA, 22 nt, Human
uauuuguauugucuuaucacuu

SEQ ID NO: 178878 - RNA, 22 nt, Human
uucuucuuuccuauaauuaauu

SEQ ID NO: 178879 - RNA, 22 nt, Human
uggggcuccuccuggcaggagg

SEQ ID NO: 178880 - RNA, 22 nt, Human
cauuccuucucagguacuggca

SEQ ID NO: 178881 - RNA, 22 nt, Human
uucugcuagugguauauguuga

SEQ ID NO: 178882 - RNA, 22 nt, Human
cagggacugcaggaggacaggu

SEQ ID NO: 178883 - RNA, 22 nt, Human
uauuuuauuuagguuuaguugu

SEQ ID NO: 178884 - RNA, 22 nt, Human
uggggcauacgugaaauaauuu

SEQ ID NO: 178885 - RNA, 22 nt, Human
gaauauuuaucucagcugcaga

SEQ ID NO: 178886 - RNA, 22 nt, Human
uucuuaaugcauccuguguuca

SEQ ID NO: 178887 - RNA, 22 nt, Human
ugauucacagacuucacaaggc

SEQ ID NO: 178888 - RNA, 20 nt, Human
acacagccuagaguuuggcu

SEQ ID NO: 178889 - RNA, 22 nt, Human
guucuucagcccucagguccua

SEQ ID NO: 178890 - RNA, 22 nt, Human
acucugcaguaaggaauuguuu

SEQ ID NO: 178891 - RNA, 22 nt, Human
guuuuaucuauguaauuauaaa

SEQ ID NO: 178892 - RNA, 22 nt, Human
aguauuuuaaaauacauuaucc

SEQ ID NO: 178893 - RNA, 22 nt, Human
acauuccugaagguaaugagaa

SEQ ID NO: 178894 - RNA, 22 nt, Human
ucuuccuuguaagggcuuuaga

SEQ ID NO: 178895 - RNA, 22 nt, Human
guguucucagcacccacuucau

SEQ ID NO: 178896 - RNA, 22 nt, Human
ggaaauauaagcaguuugugug

SEQ ID NO: 178897 - RNA, 22 nt, Human
uguggccaccagagcugcuauu

SEQ ID NO: 178898 - RNA, 22 nt, Human
uauguggcaggugggagaucag

SEQ ID NO: 178899 - RNA, 23 nt, Human
gucucacaaccaccugagaaaau

SEQ ID NO: 178900 - RNA, 21 nt, Human
uuccuccucuggagaagaaga

SEQ ID NO: 178901 - RNA, 22 nt, Human
agagaacaggcagcuggugccg

SEQ ID NO: 178902 - RNA, 22 nt, Human
aagcucuuuccacuaaaccacu

SEQ ID NO: 178903 - RNA, 22 nt, Human
gcccagccucagggcaucagcu

SEQ ID NO: 178904 - RNA, 22 nt, Human
ucuuccuuacucuggauguuau

SEQ ID NO: 178905 - RNA, 22 nt, Human
aauuaaauguuugguuugagcu

SEQ ID NO: 178906 - RNA, 22 nt, Human
uuuuccuuagaaauacauugau

SEQ ID NO: 178907 - RNA, 22 nt, Human
agggagucuggccgucggcugg

SEQ ID NO: 178908 - RNA, 22 nt, Human
cauccagcuccugggggccacc

SEQ ID NO: 178909 - RNA, 22 nt, Human
guugagaaucucuagcuuagga

SEQ ID NO: 178910 - RNA, 22 nt, Human
uuuucauuguuaguuucuccuu

SEQ ID NO: 178911 - RNA, 22 nt, Human
auuuuucuuucacauuuucuua

SEQ ID NO: 178912 - RNA, 22 nt, Human
gggcuguggggccugcagaagg

SEQ ID NO: 178913 - RNA, 22 nt, Human
uggaaaauuuagaaagauuuau

SEQ ID NO: 178914 - RNA, 22 nt, Human
guuuccaggcuuugguaugguu

SEQ ID NO: 178915 - RNA, 22 nt, Human
ggacauaguugcuauggagagu

SEQ ID NO: 178916 - RNA, 22 nt, Human
cuucuucaucuuuuggaggaac

SEQ ID NO: 178917 - RNA, 22 nt, Human
uacugcaguuccugcugucucc

SEQ ID NO: 178918 - RNA, 21 nt, Human
caguucuaagugucaucuuuu

SEQ ID NO: 178919 - RNA, 22 nt, Human
uuuucacugacuuggucuggaa

SEQ ID NO: 178920 - RNA, 22 nt, Human
aaugauuuucugcaaacaguga

SEQ ID NO: 178921 - RNA, 22 nt, Human
aacccugaacuuaguucuagga

SEQ ID NO: 178922 - RNA, 22 nt, Human
gggagggucugagagcugcacc

SEQ ID NO: 178923 - RNA, 22 nt, Human
uggggggacagauggagaggac

SEQ ID NO: 178924 - RNA, 22 nt, Human
cuguguguauaauguuugauaa

SEQ ID NO: 178925 - RNA, 22 nt, Human
ccaaccaguuucuuggcuuuag

SEQ ID NO: 178926 - RNA, 22 nt, Human
ugucccaucacagaggagacua

SEQ ID NO: 178927 - RNA, 22 nt, Human
ccaggaguccgugggucuugag

SEQ ID NO: 178928 - RNA, 22 nt, Human
agcugacagugcauggagggac

SEQ ID NO: 178929 - RNA, 22 nt, Human
uuaaacauuuccacuugccagu

SEQ ID NO: 178930 - RNA, 22 nt, Human
auuugcuuguucaccaguacuu

SEQ ID NO: 178931 - RNA, 22 nt, Human
uucugugacuccucagagauuu

SEQ ID NO: 178932 - RNA, 22 nt, Human
agggcaguuuuacugaaaggug

SEQ ID NO: 178933 - RNA, 22 nt, Human
gauuuuaaaagauguauaaggu

SEQ ID NO: 178934 - RNA, 22 nt, Human
gggcaugcagcaauucuguggu

SEQ ID NO: 178935 - RNA, 22 nt, Human
cuucucuuccuucucauccuca

SEQ ID NO: 178936 - RNA, 22 nt, Human
augaaaacgugugugugugugu

SEQ ID NO: 178937 - RNA, 22 nt, Human
cucugcuuguaucacauuugcu

SEQ ID NO: 178938 - RNA, 22 nt, Human
guucuguauauauccuagcaaa

SEQ ID NO: 178939 - RNA, 20 nt, Human
aauagcacagcucaaacauu

SEQ ID NO: 178940 - RNA, 22 nt, Human
uguccuuuauauguuuuuuagu

SEQ ID NO: 178941 - RNA, 22 nt, Human
uguggacaccuauuaccaguga

SEQ ID NO: 178942 - RNA, 22 nt, Human
ucucugaggaagcgaucuuuag

SEQ ID NO: 178943 - RNA, 22 nt, Human
uaaggaaaugcaaauuuaagaa

SEQ ID NO: 178944 - RNA, 22 nt, Human
ugcauucugaacguaaauguga

SEQ ID NO: 178945 - RNA, 22 nt, Human
cucugugucugauucugggaag

SEQ ID NO: 178946 - RNA, 22 nt, Human
cuucucugcugccugccucuuu

SEQ ID NO: 178947 - RNA, 22 nt, Human
ggagacagugacuuagagacug

SEQ ID NO: 178948 - RNA, 19 nt, Human
aacaaaauaguucuaguua

SEQ ID NO: 178949 - RNA, 19 nt, Human
acuggggcaggcugggcuu

SEQ ID NO: 178950 - RNA, 22 nt, Human
uacaagcucuuguagggggaaa

SEQ ID NO: 178951 - RNA, 22 nt, Human
uggcagccugcgugaaggagcu

SEQ ID NO: 178952 - RNA, 23 nt, Human
aacugcaagguugcugggaagua

SEQ ID NO: 178953 - RNA, 21 nt, Human
uccccugugccuggcauacag

SEQ ID NO: 178954 - RNA, 22 nt, Human
aaggugggacugagaggggaca

SEQ ID NO: 178955 - RNA, 22 nt, Human
uuuguuugcugagugaauucaa

SEQ ID NO: 178956 - RNA, 22 nt, Human
uucacuguucuuagagaagacc

SEQ ID NO: 178957 - RNA, 22 nt, Human
cuuuuuuucuccauauuucugg

SEQ ID NO: 178958 - RNA, 22 nt, Human
aggggaggcugggcuggggggc

SEQ ID NO: 178959 - RNA, 22 nt, Human
gugguuuagccuucauuaaccu

SEQ ID NO: 178960 - RNA, 22 nt, Human
agacacagcaauaacuacuguu

SEQ ID NO: 178961 - RNA, 22 nt, Human
ugugucuuuggcgaugucugga

SEQ ID NO: 178962 - RNA, 22 nt, Human
acucacuguuuugaaauugaac

SEQ ID NO: 178963 - RNA, 22 nt, Human
ucacccagacugucugacucuu

SEQ ID NO: 178964 - RNA, 22 nt, Human
gcugcuacagagcuggaggggg

SEQ ID NO: 178965 - RNA, 20 nt, Human
acuagaaagucacugggggg

SEQ ID NO: 178966 - RNA, 22 nt, Human
uugccaggggacaucuggagcc

SEQ ID NO: 178967 - RNA, 22 nt, Human
ccucuagaauuaucacuuuuaa

SEQ ID NO: 178968 - RNA, 22 nt, Human
aauauuuaaauagaauuacauc

SEQ ID NO: 178969 - RNA, 22 nt, Human
guggguauauauaugugugcug

SEQ ID NO: 178970 - RNA, 22 nt, Human
guucuucagauuccauuucagu

SEQ ID NO: 178971 - RNA, 22 nt, Human
ucucuagaggaauuguucuagg

SEQ ID NO: 178972 - RNA, 22 nt, Human
gucuugugaagacggcagaaag

SEQ ID NO: 178973 - RNA, 22 nt, Human
aagcucagcugguggugauugc

SEQ ID NO: 178974 - RNA, 22 nt, Human
uugcaagcccugaagggcugga

SEQ ID NO: 178975 - RNA, 22 nt, Human
cuguggcuaggaagcuguggga

SEQ ID NO: 178976 - RNA, 19 nt, Human
ccaguuuuuuaauauucaa

SEQ ID NO: 178977 - RNA, 22 nt, Human
auuuuagagaaacaaacguagg

SEQ ID NO: 178978 - RNA, 18 nt, Human
cccagaggaaugccugga

SEQ ID NO: 178979 - RNA, 22 nt, Human
ucagaaggagagacagcgugga

SEQ ID NO: 178980 - RNA, 22 nt, Human
ucagcucacaauguugagaaag

SEQ ID NO: 178981 - RNA, 22 nt, Human
aauaacuuacucuaugcuuagu

SEQ ID NO: 178982 - RNA, 22 nt, Human
uucauuagcacauuuccuuggu

SEQ ID NO: 178983 - RNA, 17 nt, Human
auucuuauacucuguga

SEQ ID NO: 178984 - RNA, 22 nt, Human
uugccaggagacaucuggagcc

SEQ ID NO: 178985 - RNA, 22 nt, Human
uugcuuucuuuguagguuuucc

SEQ ID NO: 178986 - RNA, 22 nt, Human
ggcagucuuucccuugagcucu

SEQ ID NO: 178987 - RNA, 22 nt, Human
uggccccauuuuucuggagccu

SEQ ID NO: 178988 - RNA, 22 nt, Human
gaagaaggaagaucaugcuuga

SEQ ID NO: 178989 - RNA, 22 nt, Human
cagaccagaaggaagccgacaa

SEQ ID NO: 178990 - RNA, 22 nt, Human
uuauuuaaaauguagguuggga

SEQ ID NO: 178991 - RNA, 22 nt, Human
auuuuuuuggucauaugagaua

SEQ ID NO: 178992 - RNA, 22 nt, Human
uauauuaaagugcuuugcagug

SEQ ID NO: 178993 - RNA, 22 nt, Human
guuuauucuuuuauuugugaga

SEQ ID NO: 178994 - RNA, 22 nt, Human
ucccuucccaccccugccuuuu

SEQ ID NO: 178995 - RNA, 22 nt, Human
ggagaggaaguuuaaagaauug

SEQ ID NO: 178996 - RNA, 22 nt, Human
ucacuuccuugcagcuguagaa

SEQ ID NO: 178997 - RNA, 22 nt, Human
cagaaguugcuugagagagagc

SEQ ID NO: 178998 - RNA, 22 nt, Human
uuuuccuuaacagagggagaaa

SEQ ID NO: 178999 - RNA, 22 nt, Human
cuaagguuggcaguggaauugg

SEQ ID NO: 179000 - RNA, 22 nt, Human
auaaaucaagggcaguauuucc

SEQ ID NO: 179001 - RNA, 22 nt, Human
ugcagcuuuugguuucuagaug

SEQ ID NO: 179002 - RNA, 22 nt, Human
aggccagggacaaugaggcaga

SEQ ID NO: 179003 - RNA, 22 nt, Human
uacuuuaauugcaaaaauaaau

SEQ ID NO: 179004 - RNA, 22 nt, Human
uucuucgacuguauaaaaguau

SEQ ID NO: 179005 - RNA, 22 nt, Human
ugaaguuuagaaaaagugccuu

SEQ ID NO: 179006 - RNA, 22 nt, Human
uagcacauaguaggcacaggcu

SEQ ID NO: 179007 - RNA, 22 nt, Human
ucaguggaacacacagaguggg

SEQ ID NO: 179008 - RNA, 22 nt, Human
aggugagaacguggaggggcgg

SEQ ID NO: 179009 - RNA, 22 nt, Human
gcugcagggagcuggaaggcuc

SEQ ID NO: 179010 - RNA, 17 nt, Human
ugucuuuuuccuccucc

SEQ ID NO: 179011 - RNA, 22 nt, Human
acaggcgucgccugcucuugcc

SEQ ID NO: 179012 - RNA, 22 nt, Human
uucuuuuaauuucugucugcag

SEQ ID NO: 179013 - RNA, 22 nt, Human
uuucagaaauggcacugaaauc

SEQ ID NO: 179014 - RNA, 22 nt, Human
cucagaugcacacaggugaggg

SEQ ID NO: 179015 - RNA, 20 nt, Human
uuccuuucuuucuuuuuuuu

SEQ ID NO: 179016 - RNA, 22 nt, Human
aggagguagggugugaaacagc

SEQ ID NO: 179017 - RNA, 20 nt, Human
gggcucugcauccaucagcc

SEQ ID NO: 179018 - RNA, 22 nt, Human
uuggugaugcccaccuuuucau

SEQ ID NO: 179019 - RNA, 22 nt, Human
aaaugcuuuaauugaguucaug

SEQ ID NO: 179020 - RNA, 22 nt, Human
uuuacaaggcaguuauuuuccu

SEQ ID NO: 179021 - RNA, 22 nt, Human
uacuuacacugaagcaaagaua

SEQ ID NO: 179022 - RNA, 22 nt, Human
cucacugucagcugcagggcuu

SEQ ID NO: 179023 - RNA, 22 nt, Human
uuaucaaaaaauaguacuuuga

SEQ ID NO: 179024 - RNA, 20 nt, Human
agugauuuguuaguacauug

SEQ ID NO: 179025 - RNA, 22 nt, Human
cucuucauguuggugcagaagc

SEQ ID NO: 179026 - RNA, 22 nt, Human
cauaggcucuucagagaacuga

SEQ ID NO: 179027 - RNA, 22 nt, Human
aacucaggagagaguaacaggg

SEQ ID NO: 179028 - RNA, 22 nt, Human
uccuuguuggaauauccuuacc

SEQ ID NO: 179029 - RNA, 22 nt, Human
uuauuuuuaggaauguagaggu

SEQ ID NO: 179030 - RNA, 22 nt, Human
uaaaaucaugacagauugacau

SEQ ID NO: 179031 - RNA, 22 nt, Human
augcuuucucuucuauuucuca

SEQ ID NO: 179032 - RNA, 22 nt, Human
uccucccugcacucagugaagu

SEQ ID NO: 179033 - RNA, 22 nt, Human
gaaccauuuaauggagaugcuc

SEQ ID NO: 179034 - RNA, 22 nt, Human
cucuuucauucuguccuuguuu

SEQ ID NO: 179035 - RNA, 21 nt, Human
acauccaggguccucacugcc

SEQ ID NO: 179036 - RNA, 22 nt, Human
cuucuuuucuacuggccuagaa

SEQ ID NO: 179037 - RNA, 22 nt, Human
ugguugauuaauuuugccaagc

SEQ ID NO: 179038 - RNA, 22 nt, Human
aaacucaucaguuuagaaaccu

SEQ ID NO: 179039 - RNA, 22 nt, Human
cugaaagacagccaggcaaagc

SEQ ID NO: 179040 - RNA, 22 nt, Human
gcagagcugucuaagucacuuc

SEQ ID NO: 179041 - RNA, 22 nt, Human
ggcucagaggagcuggaacggu

SEQ ID NO: 179042 - RNA, 22 nt, Human
uuuuauuuguauguugaaugua

SEQ ID NO: 179043 - RNA, 22 nt, Human
ucacaucugugugauugucauu

SEQ ID NO: 179044 - RNA, 22 nt, Human
cuccagagagaaaggaggccgc

SEQ ID NO: 179045 - RNA, 22 nt, Human
aucuucaaagcacaucguuugu

SEQ ID NO: 179046 - RNA, 22 nt, Human
gggagggaggagccccggccau

SEQ ID NO: 179047 - RNA, 22 nt, Human
cuucuuucuuuucuucuucucu

SEQ ID NO: 179048 - RNA, 22 nt, Human
uuucuugugauuuugaugaacu

SEQ ID NO: 179049 - RNA, 22 nt, Human
auucuuuauuuucuguacuugc

SEQ ID NO: 179050 - RNA, 22 nt, Human
ggggcucauuugcaggggggag

SEQ ID NO: 179051 - RNA, 22 nt, Human
ugagacucuccugugcagccuc

SEQ ID NO: 179052 - RNA, 22 nt, Human
aggcucagcaucugauucauau

SEQ ID NO: 179053 - RNA, 22 nt, Human
ucaaauaugggccagaggaaau

SEQ ID NO: 179054 - RNA, 17 nt, Human
ugguucuuuuccugacc

SEQ ID NO: 179055 - RNA, 22 nt, Human
cacacagcuagugacaggagaa

SEQ ID NO: 179056 - RNA, 20 nt, Human
gaauucugaagauaauuugg

SEQ ID NO: 179057 - RNA, 22 nt, Human
cacuguugagcaauguacagug

SEQ ID NO: 179058 - RNA, 22 nt, Human
uacauuugauuuuugcuucuuu

SEQ ID NO: 179059 - RNA, 22 nt, Human
augauuauuugaaugaagagga

SEQ ID NO: 179060 - RNA, 22 nt, Human
uucucuugccuucucuuuuauc

SEQ ID NO: 179061 - RNA, 22 nt, Human
uuauuugcccauguuuagcaga

SEQ ID NO: 179062 - RNA, 22 nt, Human
uuuuuaaaagaugauuuaauga

SEQ ID NO: 179063 - RNA, 22 nt, Human
auagagcuggggaagaagcugg

SEQ ID NO: 179064 - RNA, 22 nt, Human
ggcagguggcacugcugcuccc

SEQ ID NO: 179065 - RNA, 22 nt, Human
caccucagagcuccuucuucuc

SEQ ID NO: 179066 - RNA, 22 nt, Human
uauuuucucugccacacuucca

SEQ ID NO: 179067 - RNA, 22 nt, Human
gagggugguggcggccggcacc

SEQ ID NO: 179068 - RNA, 22 nt, Human
caagaaaaaacaugaugagugu

SEQ ID NO: 179069 - RNA, 22 nt, Human
agauaagaacauuaguaagccg

SEQ ID NO: 179070 - RNA, 22 nt, Human
uuuauuugggauuucucaucug

SEQ ID NO: 179071 - RNA, 18 nt, Human
uucuagaggucucaucca

SEQ ID NO: 179072 - RNA, 22 nt, Human
caggggcuccaggugagccugg

SEQ ID NO: 179073 - RNA, 20 nt, Human
aggggcuguaguuagaugac

SEQ ID NO: 179074 - RNA, 22 nt, Human
agauggaguccugaagccagaa

SEQ ID NO: 179075 - RNA, 22 nt, Human
gcuuucacugcaauagaugaau

SEQ ID NO: 179076 - RNA, 22 nt, Human
auagggaggcggagggagcugg

SEQ ID NO: 179077 - RNA, 22 nt, Human
aaaaggaacaauaugguauuuu

SEQ ID NO: 179078 - RNA, 22 nt, Human
uuauauuuuauuuaauuaaaua

SEQ ID NO: 179079 - RNA, 21 nt, Human
gcagcucaggauauagacuug

SEQ ID NO: 179080 - RNA, 22 nt, Human
aucuguuccccuaugcucucua

SEQ ID NO: 179081 - RNA, 22 nt, Human
uagggaggguuugggguggagg

SEQ ID NO: 179082 - RNA, 21 nt, Human
caguuugcuauuuuaguauga

SEQ ID NO: 179083 - RNA, 22 nt, Human
auuuuuuuuccugucucuuuca

SEQ ID NO: 179084 - RNA, 17 nt, Human
auucaugaacauguccu

SEQ ID NO: 179085 - RNA, 22 nt, Human
ggugaguagaaguaguuggcuu

SEQ ID NO: 179086 - RNA, 22 nt, Human
uuauaucagaaggugagauuga

SEQ ID NO: 179087 - RNA, 22 nt, Human
aacagaauaucaaaagauuaug

SEQ ID NO: 179088 - RNA, 22 nt, Human
gaggugauuccucccauguaau

SEQ ID NO: 179089 - RNA, 22 nt, Human
augaggaacagcaagaauauuu

SEQ ID NO: 179090 - RNA, 20 nt, Human
uuguacuuaugugagaagga

SEQ ID NO: 179091 - RNA, 22 nt, Human
ggcucccgugggaugguggagc

SEQ ID NO: 179092 - RNA, 22 nt, Human
auuuuauuuugggaucuuuuua

SEQ ID NO: 179093 - RNA, 22 nt, Human
ggagacagauggcgucucaguu

SEQ ID NO: 179094 - RNA, 22 nt, Human
agagcaucgguggaguccccac

SEQ ID NO: 179095 - RNA, 22 nt, Human
uugauagauuuuagaggcaggc

SEQ ID NO: 179096 - RNA, 19 nt, Human
agcucaggcccaucguccc

SEQ ID NO: 179097 - RNA, 22 nt, Human
ucuuuuaucuguuguguaacaa

SEQ ID NO: 179098 - RNA, 22 nt, Human
uuuccuuuguuuugguauaugu

SEQ ID NO: 179099 - RNA, 22 nt, Human
uccuuucaaauuuauuugacau

SEQ ID NO: 179100 - RNA, 22 nt, Human
aaugaauaaauuuuaaagacag

SEQ ID NO: 179101 - RNA, 22 nt, Human
agcaauucugaaauuacuugac

SEQ ID NO: 179102 - RNA, 22 nt, Human
caguggacacuuccucuacaau

SEQ ID NO: 179103 - RNA, 22 nt, Human
uuuuccuugagucggggcacag

SEQ ID NO: 179104 - RNA, 22 nt, Human
cucagaagaacaaaggcucuac

SEQ ID NO: 179105 - RNA, 22 nt, Human
gggcaggggcagugguggcauu

SEQ ID NO: 179106 - RNA, 22 nt, Human
gaaggaaaagacgugcuaagua

SEQ ID NO: 179107 - RNA, 22 nt, Human
aaauauauccuucuguccugcc

SEQ ID NO: 179108 - RNA, 22 nt, Human
gcuuccuuagcuuaccaaguau

SEQ ID NO: 179109 - RNA, 22 nt, Human
uugaaaaaugcccagcagacaa

SEQ ID NO: 179110 - RNA, 21 nt, Human
ggcugcucgugaugaacuuca

SEQ ID NO: 179111 - RNA, 22 nt, Human
ccuucugcuggucaucccagug

SEQ ID NO: 179112 - RNA, 22 nt, Human
auuugccaguuacucacaccac

SEQ ID NO: 179113 - RNA, 22 nt, Human
aagacagugacagucacaauug

SEQ ID NO: 179114 - RNA, 22 nt, Human
gaggcuugccacuguccauggc

SEQ ID NO: 179115 - RNA, 22 nt, Human
aaaauaaccuucauuugcauug

SEQ ID NO: 179116 - RNA, 22 nt, Human
caggaacagcaccaggagcuag

SEQ ID NO: 179117 - RNA, 23 nt, Human
ccagcugugccuggcccaggagc

SEQ ID NO: 179118 - RNA, 22 nt, Human
caaggaaaugucagaaaggcaa

SEQ ID NO: 179119 - RNA, 22 nt, Human
auuuucuugucucuguuguagg

SEQ ID NO: 179120 - RNA, 22 nt, Human
gucuuuguaguuuuaauuugag

SEQ ID NO: 179121 - RNA, 23 nt, Human
ucagaccaaccucuugcuggaac

SEQ ID NO: 179122 - RNA, 22 nt, Human
gcagcccucuuggucacuaggc

SEQ ID NO: 179123 - RNA, 21 nt, Human
uaaaagaugacaagacagcuc

SEQ ID NO: 179124 - RNA, 20 nt, Human
ucugugugccaucaccuaac

SEQ ID NO: 179125 - RNA, 22 nt, Human
uccuccuggagacuuucucucu

SEQ ID NO: 179126 - RNA, 22 nt, Human
cuuuacauuaauuucuacugau

SEQ ID NO: 179127 - RNA, 22 nt, Human
auuuaaaaacugguacaacagg

SEQ ID NO: 179128 - RNA, 22 nt, Human
uuccgcuuucaauggcuuggcu

SEQ ID NO: 179129 - RNA, 22 nt, Human
cuccacagccccuccaguggca

SEQ ID NO: 179130 - RNA, 22 nt, Human
auccuccuuugcccugagauca

SEQ ID NO: 179131 - RNA, 22 nt, Human
auuuucauauggguuauuugua

SEQ ID NO: 179132 - RNA, 22 nt, Human
uuuuagaagcauuuaugagauu

SEQ ID NO: 179133 - RNA, 22 nt, Human
gcucagccuuuuguucuauuca

SEQ ID NO: 179134 - RNA, 22 nt, Human
ugaaauuuuuuggagauaauuu

SEQ ID NO: 179135 - RNA, 22 nt, Human
auaaggaaagugagugcuuaaa

SEQ ID NO: 179136 - RNA, 22 nt, Human
agcuugagauaauucaagcuga

SEQ ID NO: 179137 - RNA, 19 nt, Human
auagcagaagucauuuuca

SEQ ID NO: 179138 - RNA, 22 nt, Human
aagccucaugccagauccaggu

SEQ ID NO: 179139 - RNA, 22 nt, Human
gauauauuucaaauucuuuugc

SEQ ID NO: 179140 - RNA, 22 nt, Human
uuucuaaaaccagaguuuauaa

SEQ ID NO: 179141 - RNA, 20 nt, Human
ugccagagagcucauacccu

SEQ ID NO: 179142 - RNA, 22 nt, Human
aauaugaugccaaauugcuaca

SEQ ID NO: 179143 - RNA, 22 nt, Human
cccuguccugcuaggcccuggu

SEQ ID NO: 179144 - RNA, 22 nt, Human
ugugucuccacugugcuauuuu

SEQ ID NO: 179145 - RNA, 22 nt, Human
cuaaaccaauauauuuucuucc

SEQ ID NO: 179146 - RNA, 22 nt, Human
gcugucccccaaagaugcuccu

SEQ ID NO: 179147 - RNA, 22 nt, Human
uccauguauugcuaacaaauag

SEQ ID NO: 179148 - RNA, 22 nt, Human
aagagggguggucugugaggau

SEQ ID NO: 179149 - RNA, 22 nt, Human
guggggguaggggguuuucugg

SEQ ID NO: 179150 - RNA, 22 nt, Human
auucuguaggcuuuuguuaaaa

SEQ ID NO: 179151 - RNA, 22 nt, Human
aauucuuuguuccucugccaag

SEQ ID NO: 179152 - RNA, 20 nt, Human
cagagccaggguuuuguuuu

SEQ ID NO: 179153 - RNA, 22 nt, Human
uguuggaaucuucuagucuucc

SEQ ID NO: 179154 - RNA, 22 nt, Human
acagccaacgucuuucuuacuu

SEQ ID NO: 179155 - RNA, 23 nt, Human
ucugccuccuaauuguugguguc

SEQ ID NO: 179156 - RNA, 22 nt, Human
agagggagagaccuccgugccu

SEQ ID NO: 179157 - RNA, 22 nt, Human
uucacuuuuucucugcuugaga

SEQ ID NO: 179158 - RNA, 22 nt, Human
auuguuuugugaaacauaguga

SEQ ID NO: 179159 - RNA, 22 nt, Human
ggugucuuugauguugggcuga

SEQ ID NO: 179160 - RNA, 22 nt, Human
uggcucaguaaucgagucuccu

SEQ ID NO: 179161 - RNA, 20 nt, Human
ucagugggaaagugagagug

SEQ ID NO: 179162 - RNA, 22 nt, Human
aucauguauauuuuugcuauua

SEQ ID NO: 179163 - RNA, 22 nt, Human
uuaagagaagaguaucuagaac

SEQ ID NO: 179164 - RNA, 22 nt, Human
ucuuuaucugugagcagucucc

SEQ ID NO: 179165 - RNA, 22 nt, Human
uuucagagaaagcccaaagacu

SEQ ID NO: 179166 - RNA, 22 nt, Human
aagaggcuacagcccugugucu

SEQ ID NO: 179167 - RNA, 22 nt, Human
uacaaaugaucaucucuuugaa

SEQ ID NO: 179168 - RNA, 19 nt, Human
ucagcagauuuugcaaaca

SEQ ID NO: 179169 - RNA, 22 nt, Human
cucuugugucaccauggauaaa

SEQ ID NO: 179170 - RNA, 22 nt, Human
acuuuuccuggguagcuccugg

SEQ ID NO: 179171 - RNA, 22 nt, Human
guuuucuuguuaauuuugaacg

SEQ ID NO: 179172 - RNA, 22 nt, Human
augcugugccuggaaagcggcu

SEQ ID NO: 179173 - RNA, 20 nt, Human
ggcagagcuaugucuguugc

SEQ ID NO: 179174 - RNA, 22 nt, Human
ugucuuuuaaaaauguguaaaa

SEQ ID NO: 179175 - RNA, 22 nt, Human
uacauuccagaaaguuucugua

SEQ ID NO: 179176 - RNA, 22 nt, Human
ugcugcacccuucauuuuccca

SEQ ID NO: 179177 - RNA, 22 nt, Human
aggcaguggagcuggaauaggc

SEQ ID NO: 179178 - RNA, 22 nt, Human
uucccugugcaguauguuccaa

SEQ ID NO: 179179 - RNA, 22 nt, Human
ccuaggcuggcugucuucaggu

SEQ ID NO: 179180 - RNA, 22 nt, Human
gagggggaaaagggcagcagag

SEQ ID NO: 179181 - RNA, 22 nt, Human
uucuuuucuucccuguuuauua

SEQ ID NO: 179182 - RNA, 22 nt, Human
cuguuaauugugaauuuuacau

SEQ ID NO: 179183 - RNA, 22 nt, Human
cagcucugcugggaggaugcag

SEQ ID NO: 179184 - RNA, 22 nt, Human
ccuuuuaucgcgaagaacucca

SEQ ID NO: 179185 - RNA, 22 nt, Human
uauauacacgcacauauacaua

SEQ ID NO: 179186 - RNA, 22 nt, Human
aaucacuucuuugucuucuuca

SEQ ID NO: 179187 - RNA, 22 nt, Human
cacaaggagaaauagauauuga

SEQ ID NO: 179188 - RNA, 22 nt, Human
aacaguuaagaggaggcagaga

SEQ ID NO: 179189 - RNA, 22 nt, Human
agauggggccugaggacacugu

SEQ ID NO: 179190 - RNA, 22 nt, Human
uauuucaugagugaauaucuag

SEQ ID NO: 179191 - RNA, 21 nt, Human
ugcuuucugugcuuuuucugc

SEQ ID NO: 179192 - RNA, 22 nt, Human
ccucccuucccggcauggcucu

SEQ ID NO: 179193 - RNA, 22 nt, Human
agcaggagagacuggcccaaaa

SEQ ID NO: 179194 - RNA, 22 nt, Human
caaauguuugguggcauuuugu

SEQ ID NO: 179195 - RNA, 22 nt, Human
uuaacauuguccuuagcagauu

SEQ ID NO: 179196 - RNA, 22 nt, Human
agcagggagacagugcagcauu

SEQ ID NO: 179197 - RNA, 22 nt, Human
uggagcugguucuggggaagcu

SEQ ID NO: 179198 - RNA, 22 nt, Human
uagcugucauuggaucagaagg

SEQ ID NO: 179199 - RNA, 22 nt, Human
ggagccucuaaacaguuaucaa

SEQ ID NO: 179200 - RNA, 20 nt, Human
uccaguuuuggagacauucu

SEQ ID NO: 179201 - RNA, 22 nt, Human
auaaaaauguuuuuguguggua

SEQ ID NO: 179202 - RNA, 22 nt, Human
uuucuacauuuguaaccagauu

SEQ ID NO: 179203 - RNA, 19 nt, Human
acacaccagugccugugac

SEQ ID NO: 179204 - RNA, 22 nt, Human
guaauucugugugaaucuauua

SEQ ID NO: 179205 - RNA, 22 nt, Human
gugaaauuguacacucaguacc

SEQ ID NO: 179206 - RNA, 22 nt, Human
agcugugaccuucaagagcuac

SEQ ID NO: 179207 - RNA, 22 nt, Human
ggcagggaauucagagggaagg

SEQ ID NO: 179208 - RNA, 22 nt, Human
agugccuggcugauggguccug

SEQ ID NO: 179209 - RNA, 22 nt, Human
aggaaauaagggcacuucagau

SEQ ID NO: 179210 - RNA, 22 nt, Human
uucuaauauuaugauuucuaag

SEQ ID NO: 179211 - RNA, 19 nt, Human
agcuccucaccucucgcgg

SEQ ID NO: 179212 - RNA, 22 nt, Human
uccucaaauccuagccucaucg

SEQ ID NO: 179213 - RNA, 22 nt, Human
uaguuccucuucucagggccau

SEQ ID NO: 179214 - RNA, 22 nt, Human
cugcccgcaugcaggaaugcug

SEQ ID NO: 179215 - RNA, 22 nt, Human
uucuucuguuggcagagcauac

SEQ ID NO: 179216 - RNA, 22 nt, Human
uuuauuuacuuucgguucugcu

SEQ ID NO: 179217 - RNA, 22 nt, Human
cggggcuggcguuagggaggca

SEQ ID NO: 179218 - RNA, 22 nt, Human
aagaaauagauagaggaauacu

SEQ ID NO: 179219 - RNA, 22 nt, Human
ugagguauuuggauuuauauuu

SEQ ID NO: 179220 - RNA, 22 nt, Human
acuugggaaaugaaaauacaga

SEQ ID NO: 179221 - RNA, 22 nt, Human
ugcugcacucacaggaagaguu

SEQ ID NO: 179222 - RNA, 22 nt, Human
aguuuccacuggagacacugug

SEQ ID NO: 179223 - RNA, 22 nt, Human
gaggagcugggucagggagaca

SEQ ID NO: 179224 - RNA, 22 nt, Human
gccucucuggcaaagcggugau

SEQ ID NO: 179225 - RNA, 22 nt, Human
uaguauuuguaauuaucaaagc

SEQ ID NO: 179226 - RNA, 22 nt, Human
uuuuuuuguagguguaugaaaa

SEQ ID NO: 179227 - RNA, 22 nt, Human
gccagggcucgagcaggccagc

SEQ ID NO: 179228 - RNA, 22 nt, Human
uggaaauacaagaaguauguca

SEQ ID NO: 179229 - RNA, 22 nt, Human
auggugaugaugaugaugauaa

SEQ ID NO: 179230 - RNA, 22 nt, Human
uggagucuugcuuugggagugc

SEQ ID NO: 179231 - RNA, 20 nt, Human
gggaauggauggauugcucc

SEQ ID NO: 179232 - RNA, 22 nt, Human
auuuuuauuugccuaugauaua

SEQ ID NO: 179233 - RNA, 22 nt, Human
uggaggcccagcugggggccgg

SEQ ID NO: 179234 - RNA, 22 nt, Human
auuuuacuaugauaguugagaa

SEQ ID NO: 179235 - RNA, 22 nt, Human
uuuuccuucuuccugccuugcc

SEQ ID NO: 179236 - RNA, 22 nt, Human
ugggggaggaggagacagacug

SEQ ID NO: 179237 - RNA, 22 nt, Human
aagcccucagagccucuuugac

SEQ ID NO: 179238 - RNA, 22 nt, Human
ggcagggagagcgccgccaugc

SEQ ID NO: 179239 - RNA, 22 nt, Human
aucuuuguaaguaaucaaagcu

SEQ ID NO: 179240 - RNA, 22 nt, Human
uggaguuuuaaucuguacagaa

SEQ ID NO: 179241 - RNA, 22 nt, Human
ucuccaggaaagacacuggacu

SEQ ID NO: 179242 - RNA, 22 nt, Human
uagagaaauuacagcuuucuuu

SEQ ID NO: 179243 - RNA, 22 nt, Human
agaucugucaccauccuggagc

SEQ ID NO: 179244 - RNA, 22 nt, Human
guguugaugugucuguauucua

SEQ ID NO: 179245 - RNA, 22 nt, Human
cuguucuccacuccugacuucu

SEQ ID NO: 179246 - RNA, 22 nt, Human
agggcaguuaugaaugucucca

SEQ ID NO: 179247 - RNA, 22 nt, Human
uguugaagcaccucugucuuuc

SEQ ID NO: 179248 - RNA, 22 nt, Human
uuuuaaauggcuuuuacuuuuc

SEQ ID NO: 179249 - RNA, 22 nt, Human
uuccccaccagagacagagcug

SEQ ID NO: 179250 - RNA, 22 nt, Human
cuauguuucagauauauauaua

SEQ ID NO: 179251 - RNA, 21 nt, Human
aucagaaucucuagauuugga

SEQ ID NO: 179252 - RNA, 17 nt, Human
ccacuagauagguugug

SEQ ID NO: 179253 - RNA, 22 nt, Human
ugaauucaaacuuuuuaacaag

SEQ ID NO: 179254 - RNA, 22 nt, Human
ugccuucugccaaggacggugc

SEQ ID NO: 179255 - RNA, 22 nt, Human
cucagcgagggaaagaggccgc

SEQ ID NO: 179256 - RNA, 22 nt, Human
acauaaaccccccuuccccagg

SEQ ID NO: 179257 - RNA, 22 nt, Human
uaugucuauugacuuaggauuu

SEQ ID NO: 179258 - RNA, 22 nt, Human
uuaggggcuuaggcagaguuug

SEQ ID NO: 179259 - RNA, 20 nt, Human
ucaucuuucaaauuugugac

SEQ ID NO: 179260 - RNA, 22 nt, Human
aaauauuagacauaccuggaga

SEQ ID NO: 179261 - RNA, 22 nt, Human
gaaaagcucuuuagaagagguu

SEQ ID NO: 179262 - RNA, 22 nt, Human
gggagcucaccaugcucugcau

SEQ ID NO: 179263 - RNA, 22 nt, Human
auuuucuucauuuugauuguau

SEQ ID NO: 179264 - RNA, 22 nt, Human
agggggaauccugcuuauggau

SEQ ID NO: 179265 - RNA, 22 nt, Human
cacacgagcccuggagccagca

SEQ ID NO: 179266 - RNA, 22 nt, Human
uuccagauguuuaaguucugcu

SEQ ID NO: 179267 - RNA, 22 nt, Human
agggcaggguuggugcuggugc

SEQ ID NO: 179268 - RNA, 22 nt, Human
ucucucucucuuccagcauguu

SEQ ID NO: 179269 - RNA, 22 nt, Human
guuuugaugugauuucucaugu

SEQ ID NO: 179270 - RNA, 22 nt, Human
uauuuccugcguuucugugagc

SEQ ID NO: 179271 - RNA, 22 nt, Human
cagcuccaucuugcuuauacca

SEQ ID NO: 179272 - RNA, 22 nt, Human
agagcuccaggguuuuguagug

SEQ ID NO: 179273 - RNA, 22 nt, Human
cacacacacacacacucucaca

SEQ ID NO: 179274 - RNA, 22 nt, Human
auggagguuugucugguuuugu

SEQ ID NO: 179275 - RNA, 22 nt, Human
gaggcaggcggggcccaggugg

SEQ ID NO: 179276 - RNA, 22 nt, Human
uauauauacauauagaauaugu

SEQ ID NO: 179277 - RNA, 22 nt, Human
uggaaauagauguaggaaauug

SEQ ID NO: 179278 - RNA, 22 nt, Human
auuucacucuuaauugcuuccu

SEQ ID NO: 179279 - RNA, 18 nt, Human
uucucucuggauaguagu

SEQ ID NO: 179280 - RNA, 22 nt, Human
cggggcucugcacaggccagga

SEQ ID NO: 179281 - RNA, 22 nt, Human
ucaccauguuuucauaggaaca

SEQ ID NO: 179282 - RNA, 22 nt, Human
gcucagagaaaacuggggcuug

SEQ ID NO: 179283 - RNA, 22 nt, Human
uucuuuguccuagcauucuaca

SEQ ID NO: 179284 - RNA, 22 nt, Human
uuccacauucggaauuuucuga

SEQ ID NO: 179285 - RNA, 22 nt, Human
uggaagugggcaucaccaucca

SEQ ID NO: 179286 - RNA, 22 nt, Human
cuucucuuggguguggugucuu

SEQ ID NO: 179287 - RNA, 22 nt, Human
uauuuaaagucagcaacuuuuc

SEQ ID NO: 179288 - RNA, 22 nt, Human
aggccccacaaacucgccuuug

SEQ ID NO: 179289 - RNA, 22 nt, Human
ccagaugggggcugugggaggg

SEQ ID NO: 179290 - RNA, 22 nt, Human
aggauagacuucagaaggcaua

SEQ ID NO: 179291 - RNA, 22 nt, Human
agagaaauguacuagucuaacu

SEQ ID NO: 179292 - RNA, 22 nt, Human
ggcuggagcaggcugcacagug

SEQ ID NO: 179293 - RNA, 22 nt, Human
uuuuugaauaagugcaucauca

SEQ ID NO: 179294 - RNA, 22 nt, Human
agcaaggguugguuuucugaca

SEQ ID NO: 179295 - RNA, 22 nt, Human
augugugugcgagcgugugugu

SEQ ID NO: 179296 - RNA, 22 nt, Human
aggcagagaggucuuccuggaa

SEQ ID NO: 179297 - RNA, 22 nt, Human
uuuaaaauguuuuauuuauuua

SEQ ID NO: 179298 - RNA, 22 nt, Human
gauguuggugcauucacuucug

SEQ ID NO: 179299 - RNA, 22 nt, Human
gaaacauuuguugaguacuugc

SEQ ID NO: 179300 - RNA, 22 nt, Human
agggcugggcuuggcaggcugg

SEQ ID NO: 179301 - RNA, 22 nt, Human
gcuguugugaggaucagcauau

SEQ ID NO: 179302 - RNA, 22 nt, Human
uauuuuuaccuaauuuaugaga

SEQ ID NO: 179303 - RNA, 22 nt, Human
auccugugggguauugcugcau

SEQ ID NO: 179304 - RNA, 22 nt, Human
aggaacaguuucaaagagugaa

SEQ ID NO: 179305 - RNA, 22 nt, Human
ucucugaccuccaccccaggag

SEQ ID NO: 179306 - RNA, 19 nt, Human
gauauugagcugagaauuc

SEQ ID NO: 179307 - RNA, 22 nt, Human
cugucucugauaagcucgaggg

SEQ ID NO: 179308 - RNA, 22 nt, Human
uccagcugugcuccaggaggug

SEQ ID NO: 179309 - RNA, 22 nt, Human
uucauagaagggaguuuuuccu

SEQ ID NO: 179310 - RNA, 22 nt, Human
ugguggcuuuucguagguucac

SEQ ID NO: 179311 - RNA, 22 nt, Human
agggaaauaggagaagaaagga

SEQ ID NO: 179312 - RNA, 22 nt, Human
ggcuccaggguaccccuggaug

SEQ ID NO: 179313 - RNA, 22 nt, Human
ucccaaaacuugaagcaagccu

SEQ ID NO: 179314 - RNA, 22 nt, Human
uggggcuggccaggaggagucu

SEQ ID NO: 179315 - RNA, 23 nt, Human
ucacugccaagaaaaguuacaga

SEQ ID NO: 179316 - RNA, 17 nt, Human
ugaggcugucucccugg

SEQ ID NO: 179317 - RNA, 22 nt, Human
uuccacaugaucauuguaauaa

SEQ ID NO: 179318 - RNA, 22 nt, Human
gaauuccaggugagagaaggua

SEQ ID NO: 179319 - RNA, 22 nt, Human
ccauggaaaagacgggcaggcc

SEQ ID NO: 179320 - RNA, 22 nt, Human
cuccugcuuuuucuucuuccga

SEQ ID NO: 179321 - RNA, 22 nt, Human
aaauguauuagccuaugugaga

SEQ ID NO: 179322 - RNA, 22 nt, Human
uucugugacgcaaagcugggaa

SEQ ID NO: 179323 - RNA, 22 nt, Human
cacugguugccucuuucuguuc

SEQ ID NO: 179324 - RNA, 22 nt, Human
caaaucuguuaauuucaaguug

SEQ ID NO: 179325 - RNA, 22 nt, Human
cugggggacagagagaggcggu

SEQ ID NO: 179326 - RNA, 22 nt, Human
acaugggggugggacggcagag

SEQ ID NO: 179327 - RNA, 22 nt, Human
agagauacugcaggccauaaau

SEQ ID NO: 179328 - RNA, 22 nt, Human
uuaaagaguuuauuacuuguaa

SEQ ID NO: 179329 - RNA, 22 nt, Human
uuauuuucgugugugugugugu

SEQ ID NO: 179330 - RNA, 22 nt, Human
uucuugugugaauauaauuaca

SEQ ID NO: 179331 - RNA, 22 nt, Human
ugaaagcuggcucugcagagug

SEQ ID NO: 179332 - RNA, 22 nt, Human
ucuucacagaugcauauacuuc

SEQ ID NO: 179333 - RNA, 22 nt, Human
uucucuuguaaaauuccuuuuu

SEQ ID NO: 179334 - RNA, 22 nt, Human
gccuggccaaucgccgucuagg

SEQ ID NO: 179335 - RNA, 22 nt, Human
cugccucucaugccugcuugcu

SEQ ID NO: 179336 - RNA, 22 nt, Human
uguaaauucuauacacuuaaaa

SEQ ID NO: 179337 - RNA, 22 nt, Human
ggaggcccagaaggaagcccag

SEQ ID NO: 179338 - RNA, 22 nt, Human
aaaauauaaaggauguggguuu

SEQ ID NO: 179339 - RNA, 22 nt, Human
uggagccuugugagaccacaau

SEQ ID NO: 179340 - RNA, 22 nt, Human
uauuguuuuaagguguauuaau

SEQ ID NO: 179341 - RNA, 22 nt, Human
cuccccuuauuccucaacauga

SEQ ID NO: 179342 - RNA, 22 nt, Human
agugaggggagaaugaggugga

SEQ ID NO: 179343 - RNA, 22 nt, Human
gccccaggggaggugcccugca

SEQ ID NO: 179344 - RNA, 22 nt, Human
uucuucuucuuccucauccuca

SEQ ID NO: 179345 - RNA, 22 nt, Human
uggcucacaggaggcagaggug

SEQ ID NO: 179346 - RNA, 22 nt, Human
uuuugccuauuguaucaucgua

SEQ ID NO: 179347 - RNA, 22 nt, Human
ggcuguggcagcuggaaguggu

SEQ ID NO: 179348 - RNA, 22 nt, Human
caaggaguuuggggaccaagga

SEQ ID NO: 179349 - RNA, 22 nt, Human
cuucuuaaaguugucacagcug

SEQ ID NO: 179350 - RNA, 22 nt, Human
uauuucuagggcaugaaaauaa

SEQ ID NO: 179351 - RNA, 22 nt, Human
uauaagaaaagucauuaucaaa

SEQ ID NO: 179352 - RNA, 22 nt, Human
uuuuuauaagauuuaaaaugua

SEQ ID NO: 179353 - RNA, 22 nt, Human
cgguuuuuaaaagucucuucua

SEQ ID NO: 179354 - RNA, 23 nt, Human
gugugccuuuaucuucuguacuc

SEQ ID NO: 179355 - RNA, 22 nt, Human
uuuaacauaugaaagaauauuu

SEQ ID NO: 179356 - RNA, 22 nt, Human
aauguugaaccuuuuuggccug

SEQ ID NO: 179357 - RNA, 22 nt, Human
aggggcugagaguuugaugugg

SEQ ID NO: 179358 - RNA, 22 nt, Human
uuguuauaggaucagugucacu

SEQ ID NO: 179359 - RNA, 22 nt, Human
cacaugugugugccuacaugca

SEQ ID NO: 179360 - RNA, 22 nt, Human
aguuugauuugucuaucuucau

SEQ ID NO: 179361 - RNA, 22 nt, Human
ggcucccccauggcugacagac

SEQ ID NO: 179362 - RNA, 22 nt, Human
acuauauaaugcacacaguaua

SEQ ID NO: 179363 - RNA, 22 nt, Human
uauuuuuacuguuugaugauuc

SEQ ID NO: 179364 - RNA, 22 nt, Human
augcaaaaucuuauuuuuucua

SEQ ID NO: 179365 - RNA, 22 nt, Human
cuuuaaaaauguauuuuugugg

SEQ ID NO: 179366 - RNA, 22 nt, Human
uauuuuaaaagcauuaauucuu

SEQ ID NO: 179367 - RNA, 22 nt, Human
gcuguggacacagcucucuuca

SEQ ID NO: 179368 - RNA, 22 nt, Human
gagugaucuguaggcagcaugg

SEQ ID NO: 179369 - RNA, 22 nt, Human
uccucagcaagacgcuggcagc

SEQ ID NO: 179370 - RNA, 20 nt, Human
uuggagaucacguguccagg

SEQ ID NO: 179371 - RNA, 22 nt, Human
auuaauaucaauauauuauaug

SEQ ID NO: 179372 - RNA, 22 nt, Human
gugccugcucauucucaauauu

SEQ ID NO: 179373 - RNA, 22 nt, Human
aaauauuugaaugguguaagau

SEQ ID NO: 179374 - RNA, 22 nt, Human
guguuggugagcucauuuccac

SEQ ID NO: 179375 - RNA, 22 nt, Human
aaaauaauauuauaccacugcu

SEQ ID NO: 179376 - RNA, 22 nt, Human
uuuugcuucuaguauauuuuuu

SEQ ID NO: 179377 - RNA, 22 nt, Human
uauaaagaccuuauccuucaua

SEQ ID NO: 179378 - RNA, 22 nt, Human
uguccuuucagagcuccuuuug

SEQ ID NO: 179379 - RNA, 22 nt, Human
ggugcuucgauagguguccaua

SEQ ID NO: 179380 - RNA, 22 nt, Human
uaaaugauaguauugaagguag

SEQ ID NO: 179381 - RNA, 22 nt, Human
agcaaaauuccaaaaugcuaau

SEQ ID NO: 179382 - RNA, 22 nt, Human
cccagagggcugaggauaugaa

SEQ ID NO: 179383 - RNA, 22 nt, Human
ggcuggggccuguugaagaugc

SEQ ID NO: 179384 - RNA, 21 nt, Human
guucuuaguuauauucucaau

SEQ ID NO: 179385 - RNA, 18 nt, Human
uauuuacuguguguuacc

SEQ ID NO: 179386 - RNA, 22 nt, Human
aauuauguugaaauaugagaac

SEQ ID NO: 179387 - RNA, 22 nt, Human
cuugucuaguuccuggugaugu

SEQ ID NO: 179388 - RNA, 22 nt, Human
uucaugucuuugauucugauaa

SEQ ID NO: 179389 - RNA, 20 nt, Human
agcauucaacuuucuauguu

SEQ ID NO: 179390 - RNA, 22 nt, Human
uauauaauacacaaauauguac

SEQ ID NO: 179391 - RNA, 22 nt, Human
guucaaucucucaugcauuuuc

SEQ ID NO: 179392 - RNA, 22 nt, Human
cucucugcugucuuucgggaaa

SEQ ID NO: 179393 - RNA, 22 nt, Human
aucaaaauguguagucuugauc

SEQ ID NO: 179394 - RNA, 22 nt, Human
auggauggaagcagccugaacu

SEQ ID NO: 179395 - RNA, 22 nt, Human
cacacaccagaaagccugggac

SEQ ID NO: 179396 - RNA, 22 nt, Human
uggaagcccagaaggaagcaga

SEQ ID NO: 179397 - RNA, 18 nt, Human
ggccucagccuggccgga

SEQ ID NO: 179398 - RNA, 22 nt, Human
ugugaagaauuaaugugaauca

SEQ ID NO: 179399 - RNA, 19 nt, Human
ucaggaggucgaccuggca

SEQ ID NO: 179400 - RNA, 22 nt, Human
guaaauaucucacgaaugauuc

SEQ ID NO: 179401 - RNA, 22 nt, Human
uccuuccucuuucaaauuuguu

SEQ ID NO: 179402 - RNA, 22 nt, Human
cuccuuccuccgcccuuccucg

SEQ ID NO: 179403 - RNA, 22 nt, Human
uucugggguaagcacugaggau

SEQ ID NO: 179404 - RNA, 22 nt, Human
agagggagagauuggcaaucag

SEQ ID NO: 179405 - RNA, 23 nt, Human
uggaaguugagagucugcuuugu

SEQ ID NO: 179406 - RNA, 22 nt, Human
aaucauaacaaaagcaauuaua

SEQ ID NO: 179407 - RNA, 22 nt, Human
caauggagccaagaggaggaaa

SEQ ID NO: 179408 - RNA, 22 nt, Human
acugcagauccucugagaaacc

SEQ ID NO: 179409 - RNA, 22 nt, Human
agggaguuccgaucugugcacc

SEQ ID NO: 179410 - RNA, 22 nt, Human
aaaucuuucacauauuuuuuau

SEQ ID NO: 179411 - RNA, 22 nt, Human
gagcagacugcacaguucuugc

SEQ ID NO: 179412 - RNA, 22 nt, Human
ucaccaugcccuucucugcucu

SEQ ID NO: 179413 - RNA, 21 nt, Human
uguggccauuugaaaacaggg

SEQ ID NO: 179414 - RNA, 19 nt, Human
auguuuccauuucuggaua

SEQ ID NO: 179415 - RNA, 22 nt, Human
ugcaggagcccaggaauacuau

SEQ ID NO: 179416 - RNA, 20 nt, Human
uucucugcagcaggcggccc

SEQ ID NO: 179417 - RNA, 20 nt, Human
cucuuucugcuuuaugccuc

SEQ ID NO: 179418 - RNA, 22 nt, Human
ggcugcagugcaacucuuucua

SEQ ID NO: 179419 - RNA, 22 nt, Human
gggagccucccacugggggaag

SEQ ID NO: 179420 - RNA, 22 nt, Human
uuuuuuaaucaaguaggaaaca

SEQ ID NO: 179421 - RNA, 22 nt, Human
uguaaagugguauuuaauuuua

SEQ ID NO: 179422 - RNA, 22 nt, Human
ugcuuucaaugaauuguauacu

SEQ ID NO: 179423 - RNA, 20 nt, Human
auucuuguuccauuucccag

SEQ ID NO: 179424 - RNA, 22 nt, Human
gucacuuugcuugcgaugcucc

SEQ ID NO: 179425 - RNA, 22 nt, Human
uauuaaaagagaaaaagccacc

SEQ ID NO: 179426 - RNA, 22 nt, Human
gaggaggcuggagaggccagga

SEQ ID NO: 179427 - RNA, 22 nt, Human
guacauauccuuuacguuuugu

SEQ ID NO: 179428 - RNA, 22 nt, Human
auggagugggaggacaugaagg

SEQ ID NO: 179429 - RNA, 22 nt, Human
uagcauuuagaacaccuugaga

SEQ ID NO: 179430 - RNA, 22 nt, Human
uaaaugaaaggguuuaauuuau

SEQ ID NO: 179431 - RNA, 22 nt, Human
augggagggagcagugaguguu

SEQ ID NO: 179432 - RNA, 22 nt, Human
uagcauuuauugggcuagcaaa

SEQ ID NO: 179433 - RNA, 22 nt, Human
guuauuguuauugcguugucga

SEQ ID NO: 179434 - RNA, 22 nt, Human
aaaacuuucagggauacagaaa

SEQ ID NO: 179435 - RNA, 22 nt, Human
ggcaaggaagaaagcagaaguu

SEQ ID NO: 179436 - RNA, 23 nt, Human
aggcugcagaagaauagggucau

SEQ ID NO: 179437 - RNA, 22 nt, Human
uuggugauguagcagcaauugu

SEQ ID NO: 179438 - RNA, 22 nt, Human
cggugcuuuccauaucagcagc

SEQ ID NO: 179439 - RNA, 22 nt, Human
aaaucauagccaugaacauuug

SEQ ID NO: 179440 - RNA, 22 nt, Human
gcacagauaaucugccuuacca

SEQ ID NO: 179441 - RNA, 22 nt, Human
ccagggcuggaccagugcuugg

SEQ ID NO: 179442 - RNA, 22 nt, Human
ggcugugaaguacguugaaggu

SEQ ID NO: 179443 - RNA, 22 nt, Human
uuauuucaggcauuuguaaaug

SEQ ID NO: 179444 - RNA, 22 nt, Human
aggggaggggaguaucaggauu

SEQ ID NO: 179445 - RNA, 22 nt, Human
uuucuaaaauuacugcagucgg

SEQ ID NO: 179446 - RNA, 22 nt, Human
gaggggaaggguguucaauggg

SEQ ID NO: 179447 - RNA, 23 nt, Human
agauaaggaagcauuugagccag

SEQ ID NO: 179448 - RNA, 22 nt, Human
guuuggguggcuagagaaagaa

SEQ ID NO: 179449 - RNA, 22 nt, Human
uuccuuuucuucuaccacaugu

SEQ ID NO: 179450 - RNA, 22 nt, Human
agggaugugcagggcuugccau

SEQ ID NO: 179451 - RNA, 22 nt, Human
ggggaggugugcaggacaccuc

SEQ ID NO: 179452 - RNA, 22 nt, Human
uucaaacaguguagaauauaug

SEQ ID NO: 179453 - RNA, 22 nt, Human
ggcugcagggaacaggaugggu

SEQ ID NO: 179454 - RNA, 22 nt, Human
uuuacuuuugguaaggucauuu

SEQ ID NO: 179455 - RNA, 22 nt, Human
caguggagaccugccugcugga

SEQ ID NO: 179456 - RNA, 22 nt, Human
ccucaggaauuuauucuucugu

SEQ ID NO: 179457 - RNA, 22 nt, Human
auucauucugaccucaagagaa

SEQ ID NO: 179458 - RNA, 22 nt, Human
uugguuuacucuggggauaucu

SEQ ID NO: 179459 - RNA, 18 nt, Human
acaaaaauagugcuuugg

SEQ ID NO: 179460 - RNA, 22 nt, Human
auggaguguggccaggcaguaa

SEQ ID NO: 179461 - RNA, 19 nt, Human
cagagacuguaacacuuuu

SEQ ID NO: 179462 - RNA, 21 nt, Human
gaaaaucuaaugugacaaugc

SEQ ID NO: 179463 - RNA, 22 nt, Human
gucugcagcacugugcacgguc

SEQ ID NO: 179464 - RNA, 20 nt, Human
aauaaauauaacccauaauu

SEQ ID NO: 179465 - RNA, 22 nt, Human
ggaggccagagaagagccaggc

SEQ ID NO: 179466 - RNA, 22 nt, Human
uggggcugguaccguaauauau

SEQ ID NO: 179467 - RNA, 22 nt, Human
ccagggcuggaggaggucagga

SEQ ID NO: 179468 - RNA, 22 nt, Human
ugugccuguugguguagacaua

SEQ ID NO: 179469 - RNA, 22 nt, Human
uucauggauuugugaaauuuag

SEQ ID NO: 179470 - RNA, 21 nt, Human
uuccuggaggcagaaacguga

SEQ ID NO: 179471 - RNA, 22 nt, Human
aaaggaaacuaugaaucucugg

SEQ ID NO: 179472 - RNA, 22 nt, Human
aagugaaaaaagucaguacuga

SEQ ID NO: 179473 - RNA, 22 nt, Human
accuccauggcccacaucuagu

SEQ ID NO: 179474 - RNA, 22 nt, Human
aacauuuccggccuuuuguucu

SEQ ID NO: 179475 - RNA, 22 nt, Human
uggagggaagcaaacacuagau

SEQ ID NO: 179476 - RNA, 22 nt, Human
uggcccugaaucaaggccagca

SEQ ID NO: 179477 - RNA, 22 nt, Human
guuuguuugccagcuuaguaaa

SEQ ID NO: 179478 - RNA, 20 nt, Human
gaacauaaauaacucuuuac

SEQ ID NO: 179479 - RNA, 21 nt, Human
gggagugaguaaugauggggg

SEQ ID NO: 179480 - RNA, 20 nt, Human
uggguucaguuguuucuggc

SEQ ID NO: 179481 - RNA, 22 nt, Human
uuuccuaggaaaugauugaagu

SEQ ID NO: 179482 - RNA, 22 nt, Human
aggcgaagggaccagacgguag

SEQ ID NO: 179483 - RNA, 22 nt, Human
gaaagugaauguaacauguuau

SEQ ID NO: 179484 - RNA, 23 nt, Human
cuuauauaaucauuagaaaccau

SEQ ID NO: 179485 - RNA, 22 nt, Human
aaauuuuguugaaaaauauuuu

SEQ ID NO: 179486 - RNA, 22 nt, Human
guuauuuugucuuguucaugaa

SEQ ID NO: 179487 - RNA, 22 nt, Human
auuuauuuucccucaaguaccu

SEQ ID NO: 179488 - RNA, 22 nt, Human
ccagggaggucauagugcuggu

SEQ ID NO: 179489 - RNA, 22 nt, Human
gucucacuucauuuucuuagcc

SEQ ID NO: 179490 - RNA, 22 nt, Human
guuuuauguuuuauagacacaa

SEQ ID NO: 179491 - RNA, 22 nt, Human
agugccaucuuuaacuguccca

SEQ ID NO: 179492 - RNA, 22 nt, Human
agcaagggucucucauggcuug

SEQ ID NO: 179493 - RNA, 17 nt, Human
ucuguguccgcucaguc

SEQ ID NO: 179494 - RNA, 22 nt, Human
ucacucuuuaucuuuuaugucu

SEQ ID NO: 179495 - RNA, 22 nt, Human
gcacccagggcaggaagugagg

SEQ ID NO: 179496 - RNA, 22 nt, Human
uucauaugaauuggguuuuuuu

SEQ ID NO: 179497 - RNA, 22 nt, Human
uuuuacauuuuauucguuuauu

SEQ ID NO: 179498 - RNA, 22 nt, Human
aaauguuucauucuauuuuuag

SEQ ID NO: 179499 - RNA, 22 nt, Human
agggcugcugcuccgggcccag

SEQ ID NO: 179500 - RNA, 22 nt, Human
ggaggaugaggguggugguguu

SEQ ID NO: 179501 - RNA, 22 nt, Human
uuuucauagccagaaacugaaa

SEQ ID NO: 179502 - RNA, 22 nt, Human
ggcagagguagcuggaaccagg

SEQ ID NO: 179503 - RNA, 22 nt, Human
uguuuucuuuccccuucuuuuc

SEQ ID NO: 179504 - RNA, 22 nt, Human
uguuuagcucugacuaugugau

SEQ ID NO: 179505 - RNA, 22 nt, Human
uaggauugguguauguagguuu

SEQ ID NO: 179506 - RNA, 22 nt, Human
acgugugugugcacguguguau

SEQ ID NO: 179507 - RNA, 20 nt, Human
cuggaguguagcaguggcug

SEQ ID NO: 179508 - RNA, 22 nt, Human
guuuauuucuuaucaucacuau

SEQ ID NO: 179509 - RNA, 22 nt, Human
gggacugguuguguguggugug

SEQ ID NO: 179510 - RNA, 22 nt, Human
ggggcaucguugauugcauggu

SEQ ID NO: 179511 - RNA, 22 nt, Human
guguucuuuguagaggaucuug

SEQ ID NO: 179512 - RNA, 22 nt, Human
uguuuccuaagugucucugaag

SEQ ID NO: 179513 - RNA, 22 nt, Human
ggagagcuagugagcuggaggu

SEQ ID NO: 179514 - RNA, 22 nt, Human
aagaaggaaggcaagagauggg

SEQ ID NO: 179515 - RNA, 22 nt, Human
gugugugucuacuuucaucucu

SEQ ID NO: 179516 - RNA, 22 nt, Human
gagaaaaauuucuuugcugcac

SEQ ID NO: 179517 - RNA, 19 nt, Human
ugccuggcaccagcuccac

SEQ ID NO: 179518 - RNA, 22 nt, Human
gcacuguauuuaaauauuuaaa

SEQ ID NO: 179519 - RNA, 22 nt, Human
ggauggugauguacccagucau

SEQ ID NO: 179520 - RNA, 22 nt, Human
gaauucuaguucuguaucucug

SEQ ID NO: 179521 - RNA, 22 nt, Human
uucaaaaugcagaauaguuugg

SEQ ID NO: 179522 - RNA, 22 nt, Human
gcugcaggaggugguagggucu

SEQ ID NO: 179523 - RNA, 22 nt, Human
caugcuaacacguugcucaccg

SEQ ID NO: 179524 - RNA, 22 nt, Human
cagcccuugcgacacccuggcu

SEQ ID NO: 179525 - RNA, 22 nt, Human
cuccuugguuccggcguuggag

SEQ ID NO: 179526 - RNA, 22 nt, Human
guucuacaugacacucaacauu

SEQ ID NO: 179527 - RNA, 22 nt, Human
cacagcuggggaagcugaggcc

SEQ ID NO: 179528 - RNA, 22 nt, Human
uggucuuuccuucauuguccag

SEQ ID NO: 179529 - RNA, 20 nt, Human
ccuuguggaugucuuuuuug

SEQ ID NO: 179530 - RNA, 22 nt, Human
aggaaauaggaccagacaaagc

SEQ ID NO: 179531 - RNA, 19 nt, Human
uccuacaugagacagagag

SEQ ID NO: 179532 - RNA, 22 nt, Human
gcuggccugcgagggcaggcug

SEQ ID NO: 179533 - RNA, 22 nt, Human
acucauuuggauuuuggaguuu

SEQ ID NO: 179534 - RNA, 22 nt, Human
cguggccacaguggagcugagc

SEQ ID NO: 179535 - RNA, 22 nt, Human
auuucauuuuagaaauaagugu

SEQ ID NO: 179536 - RNA, 22 nt, Human
acaugugugucugugugugugu

SEQ ID NO: 179537 - RNA, 22 nt, Human
auuaaauagcagaagaaagaug

SEQ ID NO: 179538 - RNA, 23 nt, Human
aaggugaagccaccaggugagga

SEQ ID NO: 179539 - RNA, 22 nt, Human
gaggggacugucuggcuccgag

SEQ ID NO: 179540 - RNA, 22 nt, Human
agucccugauggacuggaugag

SEQ ID NO: 179541 - RNA, 22 nt, Human
uguuccucuuagucuuaugugu

SEQ ID NO: 179542 - RNA, 22 nt, Human
uuuuuugucuugaagaaauggu

SEQ ID NO: 179543 - RNA, 22 nt, Human
uguauuuuuucccugaaauaaa

SEQ ID NO: 179544 - RNA, 22 nt, Human
ggcugcuauuggucuggcuugg

SEQ ID NO: 179545 - RNA, 22 nt, Human
gcagggcucagccgcucccacc

SEQ ID NO: 179546 - RNA, 22 nt, Human
ucuucaugaaauugauugcuua

SEQ ID NO: 179547 - RNA, 22 nt, Human
uccaggagucagacagauggug

SEQ ID NO: 179548 - RNA, 22 nt, Human
aagagaaaaaucuuaaucuagu

SEQ ID NO: 179549 - RNA, 22 nt, Human
aggcuccucugggggccccgga

SEQ ID NO: 179550 - RNA, 22 nt, Human
ugcagcagaauauggcugcagg

SEQ ID NO: 179551 - RNA, 22 nt, Human
aggauggaaguaacuggauaau

SEQ ID NO: 179552 - RNA, 22 nt, Human
ucagccuugguuuugguguugg

SEQ ID NO: 179553 - RNA, 22 nt, Human
cagagagcguccauccggugcc

SEQ ID NO: 179554 - RNA, 22 nt, Human
uuauuuaaguauuuauugaagu

SEQ ID NO: 179555 - RNA, 22 nt, Human
uaauauaacugccaguuaaggu

SEQ ID NO: 179556 - RNA, 22 nt, Human
uuauuuuauaaagagaagacuu

SEQ ID NO: 179557 - RNA, 22 nt, Human
cagcccugagagaaccaucuau

SEQ ID NO: 179558 - RNA, 17 nt, Human
auuguuuuuaauuugca

SEQ ID NO: 179559 - RNA, 22 nt, Human
aggcaguguggagggcuguugc

SEQ ID NO: 179560 - RNA, 22 nt, Human
ggagugaguauguucugaugca

SEQ ID NO: 179561 - RNA, 22 nt, Human
ucaccauguacaugaagggcgg

SEQ ID NO: 179562 - RNA, 22 nt, Human
uuuuucuccucucucuuucauu

SEQ ID NO: 179563 - RNA, 22 nt, Human
ggaaggggagcuggaaagggua

SEQ ID NO: 179564 - RNA, 22 nt, Human
agccccaauuacagcugugcug

SEQ ID NO: 179565 - RNA, 22 nt, Human
uccuuaggaccuagagguagua

SEQ ID NO: 179566 - RNA, 22 nt, Human
guuuucuccugcuauacagugc

SEQ ID NO: 179567 - RNA, 22 nt, Human
uuugcaggaaauguacugaaug

SEQ ID NO: 179568 - RNA, 22 nt, Human
acauucucuuuuagaaagcugu

SEQ ID NO: 179569 - RNA, 22 nt, Human
ucuuucugaugggaagggucaa

SEQ ID NO: 179570 - RNA, 22 nt, Human
agauggaggaaagcaguuagaa

SEQ ID NO: 179571 - RNA, 22 nt, Human
ccugaagaugguugauccccuu

SEQ ID NO: 179572 - RNA, 22 nt, Human
accuggcccugggucuccugac

SEQ ID NO: 179573 - RNA, 22 nt, Human
ucaucuuucuuuauggaaauac

SEQ ID NO: 179574 - RNA, 22 nt, Human
ggcagaggagcuggaaacaugg

SEQ ID NO: 179575 - RNA, 22 nt, Human
uaggaagagauuuucacauggc

SEQ ID NO: 179576 - RNA, 22 nt, Human
gauuccuuucgccugccgagcu

SEQ ID NO: 179577 - RNA, 22 nt, Human
caggggaagccagcugccaugu

SEQ ID NO: 179578 - RNA, 22 nt, Human
gcuucucacccuuacuaucucu

SEQ ID NO: 179579 - RNA, 22 nt, Human
ugccuuuggcuguucugugacc

SEQ ID NO: 179580 - RNA, 22 nt, Human
agggaagaggaccagagucucu

SEQ ID NO: 179581 - RNA, 22 nt, Human
ugggggagggagaguugauggg

SEQ ID NO: 179582 - RNA, 22 nt, Human
uuucacugaguaggagagcacu

SEQ ID NO: 179583 - RNA, 22 nt, Human
uuuuaaaagguugcuguuauaa

SEQ ID NO: 179584 - RNA, 22 nt, Human
uuauuuuuguuuguuaagccua

SEQ ID NO: 179585 - RNA, 22 nt, Human
uuagaaauguccuacuaauaug

SEQ ID NO: 179586 - RNA, 22 nt, Human
ggcuuguccuucugguugucuu

SEQ ID NO: 179587 - RNA, 22 nt, Human
cuccaggacugaggacagagcu

SEQ ID NO: 179588 - RNA, 22 nt, Human
ucauuauuuugauguauuuccu

SEQ ID NO: 179589 - RNA, 22 nt, Human
cuguggcugcgcccugggggag

SEQ ID NO: 179590 - RNA, 22 nt, Human
ccuccuggaguuacuuccaaaa

SEQ ID NO: 179591 - RNA, 22 nt, Human
gggggcugugugcccgcucccc

SEQ ID NO: 179592 - RNA, 22 nt, Human
uuaucuuuuaaaaacacuugug

SEQ ID NO: 179593 - RNA, 17 nt, Human
uuuguuucauacuucau

SEQ ID NO: 179594 - RNA, 22 nt, Human
uaaagugaaguucagaauggcu

SEQ ID NO: 179595 - RNA, 22 nt, Human
ucuccucucugaucuugcuccg

SEQ ID NO: 179596 - RNA, 22 nt, Human
aacugcauaagcuucgggaccu

SEQ ID NO: 179597 - RNA, 22 nt, Human
uacaggaggaugugcagccagg

SEQ ID NO: 179598 - RNA, 20 nt, Human
ucucuuuuucuucuuuucuc

SEQ ID NO: 179599 - RNA, 22 nt, Human
ucgcccagguuggagugcagug

SEQ ID NO: 179600 - RNA, 21 nt, Human
ggccagauucucccauagcug

SEQ ID NO: 179601 - RNA, 22 nt, Human
ugcuuggauuuccaaaugguuu

SEQ ID NO: 179602 - RNA, 22 nt, Human
ucccuugacauuacuugggagg

SEQ ID NO: 179603 - RNA, 22 nt, Human
auuuuguugaaacccuuguugu

SEQ ID NO: 179604 - RNA, 22 nt, Human
cacugcaaccuccaccucccgg

SEQ ID NO: 179605 - RNA, 22 nt, Human
gugaucagaagaaccugccgaa

SEQ ID NO: 179606 - RNA, 22 nt, Human
uaaaacuaugcaaccuacuacc

SEQ ID NO: 179607 - RNA, 22 nt, Human
uuuauguuuguuuuugaaauaa

SEQ ID NO: 179608 - RNA, 22 nt, Human
cagcuguggagauggggugcau

SEQ ID NO: 179609 - RNA, 22 nt, Human
acagagcucccagccaucuccu

SEQ ID NO: 179610 - RNA, 22 nt, Human
gccugggguuugcggggcugca

SEQ ID NO: 179611 - RNA, 17 nt, Human
uuagagcuacauguuga

SEQ ID NO: 179612 - RNA, 22 nt, Human
ccagcugggucccugcuggggc

SEQ ID NO: 179613 - RNA, 22 nt, Human
ggcuccagauguccccuggcaa

SEQ ID NO: 179614 - RNA, 22 nt, Human
ugcugcacuuauggcucugagg

SEQ ID NO: 179615 - RNA, 22 nt, Human
gggcugcuccgcccgcugcgcc

SEQ ID NO: 179616 - RNA, 22 nt, Human
cauaaucaagggguugugaugu

SEQ ID NO: 179617 - RNA, 22 nt, Human
aauguaaauaauuguaaaauuu

SEQ ID NO: 179618 - RNA, 22 nt, Human
cguuuugaguagauagccauau

SEQ ID NO: 179619 - RNA, 22 nt, Human
cuuuccaugucuucuuucucca

SEQ ID NO: 179620 - RNA, 22 nt, Human
agagacuguaaugagagguaca

SEQ ID NO: 179621 - RNA, 22 nt, Human
auaguaaauguuaacagcaaca

SEQ ID NO: 179622 - RNA, 22 nt, Human
aagagaaaugcuuuaacuuuau

SEQ ID NO: 179623 - RNA, 22 nt, Human
ucauuguuucugcuuuucauga

SEQ ID NO: 179624 - RNA, 22 nt, Human
agcuuucuauauaugaguugcu

SEQ ID NO: 179625 - RNA, 22 nt, Human
uuuccuucccuccugggccuuc

SEQ ID NO: 179626 - RNA, 22 nt, Human
cuuucuuucaaguucugcuuua

SEQ ID NO: 179627 - RNA, 22 nt, Human
cacauuaagcccaagcauagaa

SEQ ID NO: 179628 - RNA, 22 nt, Human
aguuucuugaagacugauguuu

SEQ ID NO: 179629 - RNA, 22 nt, Human
uuacuuuuuucccccuuagaug

SEQ ID NO: 179630 - RNA, 22 nt, Human
uguacauacauagauauacaca

SEQ ID NO: 179631 - RNA, 22 nt, Human
uuuauuuuccaugucucuaggu

SEQ ID NO: 179632 - RNA, 22 nt, Human
cugcaucacagcaggaggcaca

SEQ ID NO: 179633 - RNA, 20 nt, Human
agaaggagagaugaggcaaa

SEQ ID NO: 179634 - RNA, 22 nt, Human
uggguauauauguugcuacaga

SEQ ID NO: 179635 - RNA, 23 nt, Human
caggggacaggugaccugggcuc

SEQ ID NO: 179636 - RNA, 22 nt, Human
cccuguccuucccuccaucuga

SEQ ID NO: 179637 - RNA, 22 nt, Human
aggggaggcugcgggcugccgu

SEQ ID NO: 179638 - RNA, 22 nt, Human
ccaggcucaccuggagccccug

SEQ ID NO: 179639 - RNA, 22 nt, Human
ugucuuugaccuuaagaaguuu

SEQ ID NO: 179640 - RNA, 21 nt, Human
agaugaggauacugaggccua

SEQ ID NO: 179641 - RNA, 19 nt, Human
uagaggagaauggcaaaga

SEQ ID NO: 179642 - RNA, 22 nt, Human
cauuuugguaauguucguuugc

SEQ ID NO: 179643 - RNA, 22 nt, Human
gagggaggugacaaggacauag

SEQ ID NO: 179644 - RNA, 22 nt, Human
uacagaccaguaguucucagcg

SEQ ID NO: 179645 - RNA, 22 nt, Human
agcacagugccugacauauaug

SEQ ID NO: 179646 - RNA, 22 nt, Human
aauaauuuuuuugugauuaugu

SEQ ID NO: 179647 - RNA, 22 nt, Human
acagacuuuuagacuuaugagu

SEQ ID NO: 179648 - RNA, 22 nt, Human
uggcucacuuccguggagaggu

SEQ ID NO: 179649 - RNA, 22 nt, Human
guccccugcguguucauccugg

SEQ ID NO: 179650 - RNA, 22 nt, Human
ucuggcaguugccgcuucaguc

SEQ ID NO: 179651 - RNA, 22 nt, Human
uuauuuaagaucuuaauauaua

SEQ ID NO: 179652 - RNA, 22 nt, Human
uuuguuuccagccuuuugucuu

SEQ ID NO: 179653 - RNA, 20 nt, Human
uggagggaggaggggcccaa

SEQ ID NO: 179654 - RNA, 22 nt, Human
uugucuuucguauggaacacua

SEQ ID NO: 179655 - RNA, 22 nt, Human
agauucucccuccuggcgcugu

SEQ ID NO: 179656 - RNA, 22 nt, Human
ugcaggagcaccagcucacccu

SEQ ID NO: 179657 - RNA, 22 nt, Human
cacauuuuccagaagaaucaga

SEQ ID NO: 179658 - RNA, 18 nt, Human
acuguccucaggacguug

SEQ ID NO: 179659 - RNA, 20 nt, Human
cauuccaugcaucuuggucc

SEQ ID NO: 179660 - RNA, 22 nt, Human
aauauuuugggacugaggaauu

SEQ ID NO: 179661 - RNA, 22 nt, Human
ucuugccuuuucuagcuucuag

SEQ ID NO: 179662 - RNA, 23 nt, Human
uuucugaguuuuuuaaaagucca

SEQ ID NO: 179663 - RNA, 19 nt, Human
cuuguggcuaugcagauac

SEQ ID NO: 179664 - RNA, 22 nt, Human
aucuucuuucaucagccccuca

SEQ ID NO: 179665 - RNA, 22 nt, Human
uuuugaauaauucagaaacagc

SEQ ID NO: 179666 - RNA, 22 nt, Human
uuuuauaauacccuugacuaau

SEQ ID NO: 179667 - RNA, 22 nt, Human
ugaaaaauauuuuuagaaauaa

SEQ ID NO: 179668 - RNA, 22 nt, Human
gggcugagagcuggaaucugag

SEQ ID NO: 179669 - RNA, 22 nt, Human
auaaaagcacaauagaguuaug

SEQ ID NO: 179670 - RNA, 22 nt, Human
uuuucucuuugcuucucuaaaa

SEQ ID NO: 179671 - RNA, 22 nt, Human
uggugccuuccgagagcuguga

SEQ ID NO: 179672 - RNA, 21 nt, Human
auuauagugacuaaauugaua

SEQ ID NO: 179673 - RNA, 22 nt, Human
cauggcggcgcucucccugccu

SEQ ID NO: 179674 - RNA, 22 nt, Human
uuuuaaaguaauugaagcuugu

SEQ ID NO: 179675 - RNA, 22 nt, Human
ggaauuauuuuaaauagacauu

SEQ ID NO: 179676 - RNA, 22 nt, Human
acuggagcccguggaggcgcag

SEQ ID NO: 179677 - RNA, 22 nt, Human
uucuugucuuuguuauguagga

SEQ ID NO: 179678 - RNA, 22 nt, Human
uggcucagcgcggccuggucuu

SEQ ID NO: 179679 - RNA, 23 nt, Human
acaaguguuuccaauauggcugg

SEQ ID NO: 179680 - RNA, 22 nt, Human
guggggguaggggguuuccugg

SEQ ID NO: 179681 - RNA, 22 nt, Human
uucucagagaaagcuccucaug

SEQ ID NO: 179682 - RNA, 22 nt, Human
cuucuuuuggggaugaaaaugg

SEQ ID NO: 179683 - RNA, 22 nt, Human
gaggggaaggauuucuucagaa

SEQ ID NO: 179684 - RNA, 22 nt, Human
ccauuucacaucccugacaugu

SEQ ID NO: 179685 - RNA, 22 nt, Human
ggacuggugaagccuucggaga

SEQ ID NO: 179686 - RNA, 22 nt, Human
uaagggagcagaagcugugaaa

SEQ ID NO: 179687 - RNA, 22 nt, Human
auucuucauguugaagcuguca

SEQ ID NO: 179688 - RNA, 22 nt, Human
aaaacauuuaggguuuuuuuua

SEQ ID NO: 179689 - RNA, 22 nt, Human
gcucagagaugucugcugccuu

SEQ ID NO: 179690 - RNA, 22 nt, Human
cugguacuggaggaguucagag

SEQ ID NO: 179691 - RNA, 16 nt, Human
gaauuccauugcucug

SEQ ID NO: 179692 - RNA, 22 nt, Human
agcggccucgcugccugcucag

SEQ ID NO: 179693 - RNA, 22 nt, Human
uucuuuuaauagagauccugug

SEQ ID NO: 179694 - RNA, 21 nt, Human
uuucauuaguacaucaauuug

SEQ ID NO: 179695 - RNA, 22 nt, Human
agcugaggccccgcagcagggu

SEQ ID NO: 179696 - RNA, 22 nt, Human
uuuuccuuccugucucuuuauu

SEQ ID NO: 179697 - RNA, 22 nt, Human
agcuccucagauuuggguggcg

SEQ ID NO: 179698 - RNA, 22 nt, Human
ucuaaagcuccuuccacuaaaa

SEQ ID NO: 179699 - RNA, 22 nt, Human
ccagcaggagacuagcaacaua

SEQ ID NO: 179700 - RNA, 22 nt, Human
ugagggaguguggauacaguag

SEQ ID NO: 179701 - RNA, 22 nt, Human
ggcuagggagacagagggcaug

SEQ ID NO: 179702 - RNA, 22 nt, Human
aggcaguguguagcuggaagag

SEQ ID NO: 179703 - RNA, 22 nt, Human
agucaccuacagcucaugcuuc

SEQ ID NO: 179704 - RNA, 22 nt, Human
cggcugcagcggagcaggcugg

SEQ ID NO: 179705 - RNA, 22 nt, Human
ccugccagaaaagagggaguuc

SEQ ID NO: 179706 - RNA, 22 nt, Human
cccauggaaggguuggcccaga

SEQ ID NO: 179707 - RNA, 22 nt, Human
aacgagcugggggggccggggg

SEQ ID NO: 179708 - RNA, 22 nt, Human
uguuuucuauuaccugagauug

SEQ ID NO: 179709 - RNA, 22 nt, Human
uccauuuacuauucucauaucg

SEQ ID NO: 179710 - RNA, 18 nt, Human
guucaagcauuuugcucu

SEQ ID NO: 179711 - RNA, 22 nt, Human
uuggaggucucugugguggugg

SEQ ID NO: 179712 - RNA, 20 nt, Human
ugcugugugucuacuguggg

SEQ ID NO: 179713 - RNA, 22 nt, Human
cuuggggauuuuaaagaccucu

SEQ ID NO: 179714 - RNA, 19 nt, Human
aggaaggggauaaguaaca

SEQ ID NO: 179715 - RNA, 22 nt, Human
aaacuuuugaaggaggaaaaag

SEQ ID NO: 179716 - RNA, 22 nt, Human
auuaaacuaaauuaugaauugg

SEQ ID NO: 179717 - RNA, 22 nt, Human
cagggggacuuguuagguuuua

SEQ ID NO: 179718 - RNA, 16 nt, Human
aaguuuuaucuucuca

SEQ ID NO: 179719 - RNA, 22 nt, Human
ggacggggagcuggaaagggga

SEQ ID NO: 179720 - RNA, 22 nt, Human
agcaggaaggcuagaagcagga

SEQ ID NO: 179721 - RNA, 21 nt, Human
cuccuguaaaucaccuccgca

SEQ ID NO: 179722 - RNA, 22 nt, Human
gcccugucagcucucauggaca

SEQ ID NO: 179723 - RNA, 22 nt, Human
acauuucuccuacuuguuauuu

SEQ ID NO: 179724 - RNA, 22 nt, Human
auuagugguguauuuggcacua

SEQ ID NO: 179725 - RNA, 21 nt, Human
uccugccuuaguccagagcag

SEQ ID NO: 179726 - RNA, 22 nt, Human
aguuuucugccucuggaugcgu

SEQ ID NO: 179727 - RNA, 22 nt, Human
guauauuuaugagcauuagccu

SEQ ID NO: 179728 - RNA, 22 nt, Human
auugaaauuugcuuccucacug

SEQ ID NO: 179729 - RNA, 22 nt, Human
aagagaggcccaaguggcuggc

SEQ ID NO: 179730 - RNA, 22 nt, Human
ccaggcuccccaggaggcccuu

SEQ ID NO: 179731 - RNA, 22 nt, Human
aauucuguugguuagaguugga

SEQ ID NO: 179732 - RNA, 22 nt, Human
cacaugugggcacagggcugca

SEQ ID NO: 179733 - RNA, 22 nt, Human
ggaggccgugcugugcugccag

SEQ ID NO: 179734 - RNA, 22 nt, Human
aucuaaaacuacgaauacuacc

SEQ ID NO: 179735 - RNA, 22 nt, Human
uuuuuuuuacuccggacagcuc

SEQ ID NO: 179736 - RNA, 22 nt, Human
ugcacacaguucucaggaaaga

SEQ ID NO: 179737 - RNA, 22 nt, Human
gaauuagguaauagaacuagua

SEQ ID NO: 179738 - RNA, 22 nt, Human
cuuccuuucagaggaaggccug

SEQ ID NO: 179739 - RNA, 22 nt, Human
aaauuaaaguuuuauuuagagc

SEQ ID NO: 179740 - RNA, 22 nt, Human
uuguuuuaguagaaguuacaug

SEQ ID NO: 179741 - RNA, 22 nt, Human
uucacauucauuucuuauguuu

SEQ ID NO: 179742 - RNA, 22 nt, Human
uagcuucccagcuaaccauguc

SEQ ID NO: 179743 - RNA, 22 nt, Human
uuccuaauugccaugaaguuau

SEQ ID NO: 179744 - RNA, 22 nt, Human
aguuauuuuucacuauuaggcu

SEQ ID NO: 179745 - RNA, 22 nt, Human
uuuucaauuuucauuugcaaga

SEQ ID NO: 179746 - RNA, 18 nt, Human
ggagaagaacagaugugg

SEQ ID NO: 179747 - RNA, 22 nt, Human
uaguuucuucaacugucccagc

SEQ ID NO: 179748 - RNA, 22 nt, Human
auagaaauagacaaugcaaaga

SEQ ID NO: 179749 - RNA, 22 nt, Human
auucuuuucucuaaaugaugaa

SEQ ID NO: 179750 - RNA, 22 nt, Human
uugaaaauuaauagguguacaa

SEQ ID NO: 179751 - RNA, 22 nt, Human
uuuauaauuacguaaaauauuu

SEQ ID NO: 179752 - RNA, 22 nt, Human
uggguucaaauccugguuccac

SEQ ID NO: 179753 - RNA, 22 nt, Human
ucuugccccugcuuuggaacaa

SEQ ID NO: 179754 - RNA, 21 nt, Human
gggagaguagcgguagggagg

SEQ ID NO: 179755 - RNA, 22 nt, Human
ugcucacugcuuguguucaguu

SEQ ID NO: 179756 - RNA, 22 nt, Human
aaauauauauaauauauauauu

SEQ ID NO: 179757 - RNA, 22 nt, Human
gugauggucgagcgcuuguugu

SEQ ID NO: 179758 - RNA, 22 nt, Human
cuccucccagcccaggcgccac

SEQ ID NO: 179759 - RNA, 22 nt, Human
aauguuuuucaaguguggagca

SEQ ID NO: 179760 - RNA, 22 nt, Human
caggaggugugucccaccgggu

SEQ ID NO: 179761 - RNA, 22 nt, Human
gaggcaggaagggaggguugug

SEQ ID NO: 179762 - RNA, 22 nt, Human
agauaaacaacucuuagcuguu

SEQ ID NO: 179763 - RNA, 22 nt, Human
uuucauguuggauacuguuuca

SEQ ID NO: 179764 - RNA, 22 nt, Human
uggcaaggccacaggugcaguu

SEQ ID NO: 179765 - RNA, 22 nt, Human
uuauuuuuguaacacuguauag

SEQ ID NO: 179766 - RNA, 22 nt, Human
guuguuuucagcccagcauuag

SEQ ID NO: 179767 - RNA, 22 nt, Human
gagggcugccacguugggcgag

SEQ ID NO: 179768 - RNA, 22 nt, Human
uugugugugcccaccuguggcc

SEQ ID NO: 179769 - RNA, 23 nt, Human
gaugauggcaacuacauccggug

SEQ ID NO: 179770 - RNA, 22 nt, Human
aaaauauucuauaucaaagaua

SEQ ID NO: 179771 - RNA, 22 nt, Human
uuuuuuuaaguuuugauuuuag

SEQ ID NO: 179772 - RNA, 22 nt, Human
cagcuuguucugaccugugauu

SEQ ID NO: 179773 - RNA, 22 nt, Human
gggaaauagagcuggaaccuug

SEQ ID NO: 179774 - RNA, 22 nt, Human
gcuggaaauaacuuguguagaa

SEQ ID NO: 179775 - RNA, 22 nt, Human
cauggcaggugcagauucugug

SEQ ID NO: 179776 - RNA, 22 nt, Human
acaggaaugaagaugagagagu

SEQ ID NO: 179777 - RNA, 22 nt, Human
uuauuuuguagcucugaucuuu

SEQ ID NO: 179778 - RNA, 22 nt, Human
uaauuccacacucccgcaagcg

SEQ ID NO: 179779 - RNA, 23 nt, Human
ucuuuccuuucauacagucagcu

SEQ ID NO: 179780 - RNA, 20 nt, Human
gacaugagggagcaaagagc

SEQ ID NO: 179781 - RNA, 22 nt, Human
uuuaaauuucugaaucuugagg

SEQ ID NO: 179782 - RNA, 22 nt, Human
caaaacauucagagagcucacu

SEQ ID NO: 179783 - RNA, 22 nt, Human
ccuuucuaacagauuguggauc

SEQ ID NO: 179784 - RNA, 22 nt, Human
ggggaaggaaggggagggcacg

SEQ ID NO: 179785 - RNA, 22 nt, Human
gcuguguaugaugcaggcaccu

SEQ ID NO: 179786 - RNA, 22 nt, Human
uucucugcgcuccggcccaguu

SEQ ID NO: 179787 - RNA, 20 nt, Human
ucacuguaauugccuacauu

SEQ ID NO: 179788 - RNA, 22 nt, Human
gugggggugaggaauguucuau

SEQ ID NO: 179789 - RNA, 21 nt, Human
aaguuuuggcuguacaguugu

SEQ ID NO: 179790 - RNA, 22 nt, Human
uuauuguuuggguauaauuuga

SEQ ID NO: 179791 - RNA, 22 nt, Human
uauauauaauguguacagguga

SEQ ID NO: 179792 - RNA, 22 nt, Human
aagcugccugggaggaagggcu

SEQ ID NO: 179793 - RNA, 22 nt, Human
aaggucuucgaaccuuauguua

SEQ ID NO: 179794 - RNA, 22 nt, Human
agagacaggguuuugucguguu

SEQ ID NO: 179795 - RNA, 22 nt, Human
caaggaaaacagaugaucaaca

SEQ ID NO: 179796 - RNA, 22 nt, Human
agguggucccaauggcugggca

SEQ ID NO: 179797 - RNA, 22 nt, Human
caucucagguuuguucugagac

SEQ ID NO: 179798 - RNA, 22 nt, Human
acuuuaaauaucauuugguagg

SEQ ID NO: 179799 - RNA, 22 nt, Human
aaauguuugguggauaaaagga

SEQ ID NO: 179800 - RNA, 22 nt, Human
uuggggagaagagcuggucagg

SEQ ID NO: 179801 - RNA, 20 nt, Human
agagaacaguuuggucacag

SEQ ID NO: 179802 - RNA, 22 nt, Human
agguuuuugucauuuucuggua

SEQ ID NO: 179803 - RNA, 22 nt, Human
auuuuuaucuaaaauccacuuu

SEQ ID NO: 179804 - RNA, 22 nt, Human
gggagguaaugggggugcaggg

SEQ ID NO: 179805 - RNA, 22 nt, Human
cauuccaagaaguaguucugca

SEQ ID NO: 179806 - RNA, 22 nt, Human
uuaaaagaauccuguuauccuc

SEQ ID NO: 179807 - RNA, 22 nt, Human
aauaagaguuaagaaguauauu

SEQ ID NO: 179808 - RNA, 22 nt, Human
agauaaaucauuuauuaagcgg

SEQ ID NO: 179809 - RNA, 22 nt, Human
uguguuguuuggggauguccau

SEQ ID NO: 179810 - RNA, 20 nt, Human
cuuauuuuggagaacuuuuc

SEQ ID NO: 179811 - RNA, 22 nt, Human
uuuuuuccuguuugucuuuggg

SEQ ID NO: 179812 - RNA, 22 nt, Human
uuuguacuuucuaauguauuua

SEQ ID NO: 179813 - RNA, 20 nt, Human
ugauuauuccaacaagaaug

SEQ ID NO: 179814 - RNA, 22 nt, Human
ggccugcuaccagcugugaccu

SEQ ID NO: 179815 - RNA, 22 nt, Human
aaaguaaagccuauuuaauaau

SEQ ID NO: 179816 - RNA, 22 nt, Human
aucguuaugauagagaaagaga

SEQ ID NO: 179817 - RNA, 22 nt, Human
gcuuuggcuucuccuggcagga

SEQ ID NO: 179818 - RNA, 22 nt, Human
gaggggaauguuccugagcugg

SEQ ID NO: 179819 - RNA, 21 nt, Human
aggugaaggcgagggggacag

SEQ ID NO: 179820 - RNA, 22 nt, Human
uucacugugauugggguggauu

SEQ ID NO: 179821 - RNA, 22 nt, Human
ucuucaucucuaaaaugggaac

SEQ ID NO: 179822 - RNA, 23 nt, Human
uuuuccaaaucgacucucuaguu

SEQ ID NO: 179823 - RNA, 21 nt, Human
ugagcccaaagcuguauuggu

SEQ ID NO: 179824 - RNA, 23 nt, Human
aaguggugacugugcuacugaga

SEQ ID NO: 179825 - RNA, 23 nt, Human
uucuuuccuuaucccauuuacuu

SEQ ID NO: 179826 - RNA, 22 nt, Human
ugcuuucaaaacucagaggaau

SEQ ID NO: 179827 - RNA, 22 nt, Human
cuagcagaagcuccuugagggu

SEQ ID NO: 179828 - RNA, 22 nt, Human
ccuuuccucuucaugacuuucu

SEQ ID NO: 179829 - RNA, 22 nt, Human
gcucucuggccugggaggagga

SEQ ID NO: 179830 - RNA, 22 nt, Human
uggggagacauggaguaaaaga

SEQ ID NO: 179831 - RNA, 22 nt, Human
agguggcuaugaggaugcaguc

SEQ ID NO: 179832 - RNA, 22 nt, Human
gcucagcuggagagggacgggu

SEQ ID NO: 179833 - RNA, 22 nt, Human
aaccaggcgagagagcggucag

SEQ ID NO: 179834 - RNA, 22 nt, Human
gugucccaaagauuagaaauca

SEQ ID NO: 179835 - RNA, 22 nt, Human
cuccagcucgcgagcucugcuc

SEQ ID NO: 179836 - RNA, 22 nt, Human
uuauuucauguaaaauuuaugu

SEQ ID NO: 179837 - RNA, 22 nt, Human
auuuuugguuucaccugcacgc

SEQ ID NO: 179838 - RNA, 22 nt, Human
cagggcagaguuaagaugcugg

SEQ ID NO: 179839 - RNA, 22 nt, Human
uuuaaucaguugguaauauuga

SEQ ID NO: 179840 - RNA, 22 nt, Human
agugaaauaugcccauugcugu

SEQ ID NO: 179841 - RNA, 22 nt, Human
guggaaggaauuaacagacuag

SEQ ID NO: 179842 - RNA, 21 nt, Human
uccucucuaaguuccgccccg

SEQ ID NO: 179843 - RNA, 22 nt, Human
cuccaugagccaggagggcuac

SEQ ID NO: 179844 - RNA, 20 nt, Human
cccuggaaugagaugcauau

SEQ ID NO: 179845 - RNA, 22 nt, Human
agugagaguauuaaugugaacu

SEQ ID NO: 179846 - RNA, 22 nt, Human
auccuccuggggcagucuuccc

SEQ ID NO: 179847 - RNA, 22 nt, Human
cugcagagaccuaggucagguu

SEQ ID NO: 179848 - RNA, 22 nt, Human
gagaugugguucaaggguguuu

SEQ ID NO: 179849 - RNA, 23 nt, Human
ugggagcuauguuuggaaugggg

SEQ ID NO: 179850 - RNA, 22 nt, Human
gugcucuagaaauugucagugg

SEQ ID NO: 179851 - RNA, 22 nt, Human
gcaggaagauugcagaaggcug

SEQ ID NO: 179852 - RNA, 22 nt, Human
ccuccuuuccuguuuuccugag

SEQ ID NO: 179853 - RNA, 22 nt, Human
cuccuuuuccuacucauacuau

SEQ ID NO: 179854 - RNA, 22 nt, Human
ucucaaagagcuacuggucuau

SEQ ID NO: 179855 - RNA, 22 nt, Human
uucacugugauguuuaagagaa

SEQ ID NO: 179856 - RNA, 22 nt, Human
aaugcuaaagaagaaggaguag

SEQ ID NO: 179857 - RNA, 22 nt, Human
augcggcugugggggaauggga

SEQ ID NO: 179858 - RNA, 22 nt, Human
aacacuaaaggucaguuagaag

SEQ ID NO: 179859 - RNA, 22 nt, Human
gcuggggaucgaaggcagagcc

SEQ ID NO: 179860 - RNA, 22 nt, Human
uaugggcaagagauaggugguc

SEQ ID NO: 179861 - RNA, 22 nt, Human
ucugcaugccucaggaggccug

SEQ ID NO: 179862 - RNA, 22 nt, Human
uaugaggagaacauuccugaac

SEQ ID NO: 179863 - RNA, 22 nt, Human
ucugagugacguccugacagga

SEQ ID NO: 179864 - RNA, 22 nt, Human
cagcuccagcccaggcagcucc

SEQ ID NO: 179865 - RNA, 20 nt, Human
uuggggacaggagugugaug

SEQ ID NO: 179866 - RNA, 22 nt, Human
uuuacuguuuacagcuaaugca

SEQ ID NO: 179867 - RNA, 22 nt, Human
gaguucuagauguauuauuaau

SEQ ID NO: 179868 - RNA, 19 nt, Human
uuccuuucuauccugggua

SEQ ID NO: 179869 - RNA, 22 nt, Human
uguuuuuuagagugauacuuuu

SEQ ID NO: 179870 - RNA, 22 nt, Human
ugguccuuuccauuggagacac

SEQ ID NO: 179871 - RNA, 22 nt, Human
gggggagcuacaggucccuugg

SEQ ID NO: 179872 - RNA, 22 nt, Human
cauuucaaacaguuacagcugc

SEQ ID NO: 179873 - RNA, 22 nt, Human
auauguuaugccauuuucaagg

SEQ ID NO: 179874 - RNA, 22 nt, Human
ugcagaggagcuggaaggcugg

SEQ ID NO: 179875 - RNA, 22 nt, Human
aucucacuucugucauguggca

SEQ ID NO: 179876 - RNA, 22 nt, Human
gcuuucagggucacugucaaca

SEQ ID NO: 179877 - RNA, 22 nt, Human
gaggcucagagggacuuucaag

SEQ ID NO: 179878 - RNA, 22 nt, Human
aguaggauguuuagcccuucuu

SEQ ID NO: 179879 - RNA, 22 nt, Human
cuggagaacucugugcuucacu

SEQ ID NO: 179880 - RNA, 22 nt, Human
aaggacaccaaacuaauuggga

SEQ ID NO: 179881 - RNA, 22 nt, Human
gagcagcugagcuggaaugaga

SEQ ID NO: 179882 - RNA, 22 nt, Human
aagaaaccauauuaguuccugg

SEQ ID NO: 179883 - RNA, 22 nt, Human
auaaaguaaugcauauaaugug

SEQ ID NO: 179884 - RNA, 22 nt, Human
gugucacuuucaggagcucuaa

SEQ ID NO: 179885 - RNA, 22 nt, Human
cuaaauucuauauccuugcuuc

SEQ ID NO: 179886 - RNA, 22 nt, Human
uagguuuugugucagaguagaa

SEQ ID NO: 179887 - RNA, 22 nt, Human
gacacugccaagugccccgaga

SEQ ID NO: 179888 - RNA, 18 nt, Human
auucauuugcguuuggcu

SEQ ID NO: 179889 - RNA, 22 nt, Human
ucuccuuuacuggcuccuuuug

SEQ ID NO: 179890 - RNA, 22 nt, Human
ugcccacuucaaaaucuucauu

SEQ ID NO: 179891 - RNA, 22 nt, Human
gccugccucugacuggggcuga

SEQ ID NO: 179892 - RNA, 22 nt, Human
uuuaaaacagcauuuaaaaggu

SEQ ID NO: 179893 - RNA, 22 nt, Human
auuaaaaaaagauaaugaguua

SEQ ID NO: 179894 - RNA, 22 nt, Human
uaaguuguagaacguuuucuua

SEQ ID NO: 179895 - RNA, 22 nt, Human
augggagggugaggaggcagcu

SEQ ID NO: 179896 - RNA, 21 nt, Human
uccugccuggccuucugacua

SEQ ID NO: 179897 - RNA, 22 nt, Human
uggacacugguggauauggaau

SEQ ID NO: 179898 - RNA, 22 nt, Rickettsia prowazekii
uguaugaaccacgggaucuaau

SEQ ID NO: 179899 - RNA, 22 nt, Rickettsia prowazekii
ucaggcuguaagugcaccugua

SEQ ID NO: 179900 - RNA, 22 nt, Rickettsia prowazekii
ggcucaagccuuaguuguagca

SEQ ID NO: 179901 - RNA, 23 nt, Rickettsia prowazekii
cugcaucauuaaaaugugcaggu

SEQ ID NO: 179902 - RNA, 22 nt, Rickettsia prowazekii
cucuuggcaauaugggugaaga

SEQ ID NO: 179903 - RNA, 22 nt, Rickettsia prowazekii
caguaaauuguuggaaaauuua

SEQ ID NO: 179904 - RNA, 22 nt, Rickettsia prowazekii
acuugucuugauaaugaugaug

SEQ ID NO: 179905 - RNA, 22 nt, Rickettsia prowazekii
agguauuagugguauuagaucu

SEQ ID NO: 179906 - RNA, 22 nt, Rickettsia prowazekii
aguucauaguuuuacuaagauu

SEQ ID NO: 179907 - RNA, 22 nt, Rickettsia prowazekii
aucaaguguuuuauaacuccug

SEQ ID NO: 179908 - RNA, 22 nt, Rickettsia prowazekii
auugcaucgguuaaagugguua

SEQ ID NO: 179909 - RNA, 22 nt, Rickettsia prowazekii
ugucucaucuauuauauugcua

SEQ ID NO: 179910 - RNA, 22 nt, Rickettsia prowazekii
uguucaagugugaagaauccuu

SEQ ID NO: 179911 - RNA, 22 nt, Rickettsia prowazekii
uagauucuuucuguguaaagag

SEQ ID NO: 179912 - RNA, 22 nt, Rickettsia prowazekii
ucaaagaauuaucauagcaaga

SEQ ID NO: 179913 - RNA, 22 nt, Rickettsia prowazekii
uugaauagcuaagguuuuugug

SEQ ID NO: 179914 - RNA, 22 nt, Rickettsia prowazekii
uugguaaaagucguagucauau

SEQ ID NO: 179915 - RNA, 22 nt, Human
aaaaaauugcuggcagagcugu

SEQ ID NO: 179916 - RNA, 20 nt, Human
aaaaauguguuuauggagau

SEQ ID NO: 179917 - RNA, 22 nt, Human
aaaaaguaccacuuggacacuu

SEQ ID NO: 179918 - RNA, 22 nt, Human
aaaaauuucuggugaaaugccu

SEQ ID NO: 179919 - RNA, 20 nt, Human
aaaaacaguaaugcugaaga

SEQ ID NO: 179920 - RNA, 22 nt, Human
aaaaaaacuaauuuuaaaugug

SEQ ID NO: 179921 - RNA, 22 nt, Human
aaaaaggagaaagagagggaga

SEQ ID NO: 179922 - RNA, 22 nt, Human
aaaaacuuaccccagggcaagg

SEQ ID NO: 179923 - RNA, 22 nt, Human
aaaagauguaaacauauauuaa

SEQ ID NO: 179924 - RNA, 22 nt, Human
aaaagaaugaugggagcugggu

SEQ ID NO: 179925 - RNA, 22 nt, Human
aaaaccugcaagaugaaaucag

SEQ ID NO: 179926 - RNA, 22 nt, Human
aaaacuuucagggauacagaaa

SEQ ID NO: 179927 - RNA, 18 nt, Human
aaacauggcuuaaaggcu

SEQ ID NO: 179928 - RNA, 22 nt, Human
aaaauacuaggaaaauaaauca

SEQ ID NO: 179929 - RNA, 22 nt, Human
aaaauauaaaggauguggguuu

SEQ ID NO: 179930 - RNA, 21 nt, Human
aaacaugcagccugccaauuc

SEQ ID NO: 179931 - RNA, 22 nt, Human
aaaccagaguucauaguauuca

SEQ ID NO: 179932 - RNA, 22 nt, Human
aaacauguagugcaugaggauc

SEQ ID NO: 179933 - RNA, 22 nt, Human
aaacauaugccuucuuuuguaa

SEQ ID NO: 179934 - RNA, 22 nt, Human
aaacagguuugaacuucuuaac

SEQ ID NO: 179935 - RNA, 22 nt, Human
aaacaagagcuuacauggcugc

SEQ ID NO: 179936 - RNA, 22 nt, Human
aaacaauaauaauuaggaagga

SEQ ID NO: 179937 - RNA, 22 nt, Human
aaaauaauauuauaccacugcu

SEQ ID NO: 179938 - RNA, 22 nt, Human
aaaaggaacaauaugguauuuu

SEQ ID NO: 179939 - RNA, 22 nt, Human
aaaagcgaagagaacugaaguu

SEQ ID NO: 179940 - RNA, 22 nt, Human
aaaagcauuauuagucugggug

SEQ ID NO: 179941 - RNA, 22 nt, Human
aaacucaugccagagaacuuaa

SEQ ID NO: 179942 - RNA, 23 nt, Human
aaacuacauuuauaguuuuucuc

SEQ ID NO: 179943 - RNA, 22 nt, Human
aaacugcuuucucugccuuucc

SEQ ID NO: 179944 - RNA, 22 nt, Human
aaacuugaggcaaugaaggugu

SEQ ID NO: 179945 - RNA, 22 nt, Human
aaagaauuucaagauucccaca

SEQ ID NO: 179946 - RNA, 22 nt, Human
aaacugacugaugugaucuuau

SEQ ID NO: 179947 - RNA, 22 nt, Human
aaacucaucaguuuagaaaccu

SEQ ID NO: 179948 - RNA, 21 nt, Human
aaagaagagcucagagguaga

SEQ ID NO: 179949 - RNA, 22 nt, Human
aaagagccaacuaccgcaaauu

SEQ ID NO: 179950 - RNA, 22 nt, Human
aaagagcugccaagguuacagu

SEQ ID NO: 179951 - RNA, 22 nt, Human
aaagaagugucuuacucccucu

SEQ ID NO: 179952 - RNA, 22 nt, Human
aaagagacaacaacaacuucua

SEQ ID NO: 179953 - RNA, 22 nt, Human
aaagaccuucacuuucuggcug

SEQ ID NO: 179954 - RNA, 22 nt, Human
aaagacagccuguuggcuuucu

SEQ ID NO: 179955 - RNA, 23 nt, Human
aaagacuagaagccguggcugca

SEQ ID NO: 179956 - RNA, 22 nt, Human
aaauucggggaguuuugaggau

SEQ ID NO: 179957 - RNA, 22 nt, Human
aacacugaaaugucuuaagauu

SEQ ID NO: 179958 - RNA, 22 nt, Human
aacacaucagcacacuaacgga

SEQ ID NO: 179959 - RNA, 22 nt, Human
aacacguuuauccuaagaacuc

SEQ ID NO: 179960 - RNA, 22 nt, Human
aaauuuuguugaaaaauauuuu

SEQ ID NO: 179961 - RNA, 21 nt, Human
aaauuucauauggccaaccua

SEQ ID NO: 179962 - RNA, 22 nt, Human
aaauugcauuuuaaagguagau

SEQ ID NO: 179963 - RNA, 22 nt, Human
aaauugucuuuaaucaggucau

SEQ ID NO: 179964 - RNA, 22 nt, Human
aacaggcuaaauuguccauuuc

SEQ ID NO: 179965 - RNA, 22 nt, Human
aacaggaagaauccagauggug

SEQ ID NO: 179966 - RNA, 20 nt, Human
aacagcucucgacuuaucuu

SEQ ID NO: 179967 - RNA, 22 nt, Human
aacacuguaucagucuucaaua

SEQ ID NO: 179968 - RNA, 22 nt, Human
aacacuaaaggucaguuagaag

SEQ ID NO: 179969 - RNA, 22 nt, Human
aacagguucaucuuggaagcag

SEQ ID NO: 179970 - RNA, 22 nt, Human
aacaguacaucaugaggucauc

SEQ ID NO: 179971 - RNA, 22 nt, Human
aacagaaaucauuuagggcucu

SEQ ID NO: 179972 - RNA, 22 nt, Human
aaauuaaaguuuuauuuagagc

SEQ ID NO: 179973 - RNA, 22 nt, Human
aaauguuucauucuauuuuuag

SEQ ID NO: 179974 - RNA, 22 nt, Human
aaauggauaaucaagauaauca

SEQ ID NO: 179975 - RNA, 22 nt, Human
aaauggaaguuuguucucagcc

SEQ ID NO: 179976 - RNA, 22 nt, Human
aaauguguagaggggagagccg

SEQ ID NO: 179977 - RNA, 20 nt, Human
aaauugaacaagccaggcug

SEQ ID NO: 179978 - RNA, 22 nt, Human
aaauucagauggcuuucuuuuc

SEQ ID NO: 179979 - RNA, 22 nt, Human
aaaugggagucacacagguuua

SEQ ID NO: 179980 - RNA, 22 nt, Human
aaaugcuuuaauugaguucaug

SEQ ID NO: 179981 - RNA, 22 nt, Human
aaagacuaaccaguugucaaaa

SEQ ID NO: 179982 - RNA, 22 nt, Human
aacgauuugaguuaguuuuuag

SEQ ID NO: 179983 - RNA, 21 nt, Human
aacuauuaauaccauuagcaa

SEQ ID NO: 179984 - RNA, 22 nt, Human
aacuacucugggguggcagguu

SEQ ID NO: 179985 - RNA, 22 nt, Human
aacuagugucuguaugauaagg

SEQ ID NO: 179986 - RNA, 22 nt, Human
aaccuggaggaccuuaugcuaa

SEQ ID NO: 179987 - RNA, 22 nt, Human
aaccuggguguacauuaugguc

SEQ ID NO: 179988 - RNA, 22 nt, Human
aacgugcuuuacaaaugaccuu

SEQ ID NO: 179989 - RNA, 22 nt, Human
aacgucugagaccccuccucuc

SEQ ID NO: 179990 - RNA, 22 nt, Human
aacgcugugcacuggguccagg

SEQ ID NO: 179991 - RNA, 22 nt, Human
aacgggcacuuuauuuaaaaaa

SEQ ID NO: 179992 - RNA, 22 nt, Human
aaccugagggcaggaccccaua

SEQ ID NO: 179993 - RNA, 22 nt, Human
aacccugaacuuaguucuagga

SEQ ID NO: 179994 - RNA, 22 nt, Human
aacccguagaucaguucuaggu

SEQ ID NO: 179995 - RNA, 22 nt, Human
aaccuuucucccugcacacugg

SEQ ID NO: 179996 - RNA, 22 nt, Human
aacgagcugggggggccggggg

SEQ ID NO: 179997 - RNA, 22 nt, Human
aacgaugauaaauuguucucug

SEQ ID NO: 179998 - RNA, 22 nt, Human
aacgccgggacucgcagggagc

SEQ ID NO: 179999 - RNA, 22 nt, Human
aacgcagagaguaaugcugaac

SEQ ID NO: 180000 - RNA, 22 nt, Human
aaccggauugauccuucuuuga

SEQ ID NO: 180001 - RNA, 22 nt, Human
aaccguguucgggaacacuugu

SEQ ID NO: 180002 - RNA, 20 nt, Human
aaccuauuguaauauucuaa

SEQ ID NO: 180003 - RNA, 22 nt, Human
aaccaaucaaauuggaauugaa

SEQ ID NO: 180004 - RNA, 22 nt, Human
aacaguuaagaggaggcagaga

SEQ ID NO: 180005 - RNA, 22 nt, Human
aacaguguaggagcugguuuau

SEQ ID NO: 180006 - RNA, 22 nt, Human
aacaguaugugagauuuacaca

SEQ ID NO: 180007 - RNA, 22 nt, Human
aacaucaaaggaagaaugauau

SEQ ID NO: 180008 - RNA, 22 nt, Human
aacaucugagagcccuugugca

SEQ ID NO: 180009 - RNA, 22 nt, Human
aaccaguacuucucuauucagu

SEQ ID NO: 180010 - RNA, 22 nt, Human
aaccucgggcugcacuuggcac

SEQ ID NO: 180011 - RNA, 22 nt, Human
aaccaagcucaauggucugagu

SEQ ID NO: 180012 - RNA, 22 nt, Human
aacauuuccggccuuuuguucu

SEQ ID NO: 180013 - RNA, 22 nt, Human
aaccaauaagaggaugccauuu

SEQ ID NO: 180014 - RNA, 22 nt, Human
aaccaggcgagagagcggucag

SEQ ID NO: 180015 - RNA, 22 nt, Human
aaccauauugauuauguuuuau

SEQ ID NO: 180016 - RNA, 22 nt, Human
aaccagaagucaucagagcuga

SEQ ID NO: 180017 - RNA, 22 nt, Human
aaccucuuugugaaugucauga

SEQ ID NO: 180018 - RNA, 22 nt, Human
aaccucuuuaaaagggauauug

SEQ ID NO: 180019 - RNA, 22 nt, Human
aaccugaggguagacaaguuca

SEQ ID NO: 180020 - RNA, 22 nt, Human
aagaagguugaaugacuacuuu

SEQ ID NO: 180021 - RNA, 22 nt, Human
aagaacuagauagugguguaaa

SEQ ID NO: 180022 - RNA, 22 nt, Human
aagaaggaaggcaagagauggg

SEQ ID NO: 180023 - RNA, 22 nt, Human
aagaacaugggugugggcauuc

SEQ ID NO: 180024 - RNA, 22 nt, Human
aacuuuuucuuaggggaaagca

SEQ ID NO: 180025 - RNA, 22 nt, Human
aagaaaagaaacauggguaugc

SEQ ID NO: 180026 - RNA, 22 nt, Human
aagagaggaaagggugugaggu

SEQ ID NO: 180027 - RNA, 22 nt, Human
aagaggcuacagcccugugucu

SEQ ID NO: 180028 - RNA, 22 nt, Human
aagaggcagcuugguaggcauc

SEQ ID NO: 180029 - RNA, 22 nt, Human
aagaggacagucaaauggccgg

SEQ ID NO: 180030 - RNA, 22 nt, Human
aagagcuuguuaugcugcucuu

SEQ ID NO: 180031 - RNA, 22 nt, Human
aagagaaaaaucuuaaucuagu

SEQ ID NO: 180032 - RNA, 22 nt, Human
aagauuuaccacuuuauucaag

SEQ ID NO: 180033 - RNA, 22 nt, Human
aagagugugagguugugcuuuu

SEQ ID NO: 180034 - RNA, 22 nt, Human
aagaugcuucaugagaguuggg

SEQ ID NO: 180035 - RNA, 22 nt, Human
aagcacagggacucaggaccgg

SEQ ID NO: 180036 - RNA, 22 nt, Human
aagcaauucacaguucacuuaa

SEQ ID NO: 180037 - RNA, 22 nt, Human
aagcaacccagugcuuguauag

SEQ ID NO: 180038 - RNA, 21 nt, Human
aagagcgccgggcagggcuga

SEQ ID NO: 180039 - RNA, 22 nt, Human
aagagaggcccaaguggcuggc

SEQ ID NO: 180040 - RNA, 22 nt, Human
aagagaaaugcuuuaacuuuau

SEQ ID NO: 180041 - RNA, 22 nt, Human
aagaggaauaauaaaaauugca

SEQ ID NO: 180042 - RNA, 22 nt, Human
aagaggauuuuaguuugccaga

SEQ ID NO: 180043 - RNA, 22 nt, Human
aagaggaggacgguucccagaa

SEQ ID NO: 180044 - RNA, 22 nt, Human
aagcauuuuagauaaagcauca

SEQ ID NO: 180045 - RNA, 22 nt, Human
aagccagccaguuccagcagcu

SEQ ID NO: 180046 - RNA, 22 nt, Human
aagcagcauaugacagcaucca

SEQ ID NO: 180047 - RNA, 22 nt, Human
aagcaguuuagucaucgggauu

SEQ ID NO: 180048 - RNA, 22 nt, Human
aagcagaaaaacugagcuccaa

SEQ ID NO: 180049 - RNA, 22 nt, Human
aagcauaucaaguuuuaugugc

SEQ ID NO: 180050 - RNA, 22 nt, Human
aagcaaaagguuacacuucugg

SEQ ID NO: 180051 - RNA, 22 nt, Human
aagauuugaaaguggugcauuu

SEQ ID NO: 180052 - RNA, 22 nt, Human
aagauucaguugguuuuggaaa

SEQ ID NO: 180053 - RNA, 20 nt, Human
aacuuugagugcaugacuuu

SEQ ID NO: 180054 - RNA, 22 nt, Human
aacuuuuaugaaggaaaucaua

SEQ ID NO: 180055 - RNA, 22 nt, Human
aacuuucagaauccuaugcauu

SEQ ID NO: 180056 - RNA, 22 nt, Human
aagaaaagguaaccgcuuaucu

SEQ ID NO: 180057 - RNA, 22 nt, Human
aacuuaacucugcaauccagcu

SEQ ID NO: 180058 - RNA, 22 nt, Human
aacuuucuuugcaucuaaguuu

SEQ ID NO: 180059 - RNA, 22 nt, Human
aacuuucugaaaagcuugauca

SEQ ID NO: 180060 - RNA, 21 nt, Human
aacuuucccaauccagauuug

SEQ ID NO: 180061 - RNA, 19 nt, Human
aagaacaguucuaauuuca

SEQ ID NO: 180062 - RNA, 22 nt, Human
aacuugaagacaccccacauuc

SEQ ID NO: 180063 - RNA, 22 nt, Human
aacuuguaaugaaaggcaauag

SEQ ID NO: 180064 - RNA, 22 nt, Human
aagaaagaucugaaagaagcga

SEQ ID NO: 180065 - RNA, 22 nt, Human
aacucgaugcaauucacuuugu

SEQ ID NO: 180066 - RNA, 19 nt, Human
aacucugccgaggcaagcc

SEQ ID NO: 180067 - RNA, 23 nt, Human
aacucuggcuagcauagaauaga

SEQ ID NO: 180068 - RNA, 22 nt, Human
aacugaaguuuucagauuuugc

SEQ ID NO: 180069 - RNA, 22 nt, Human
aacuggguuuaucuaaugugua

SEQ ID NO: 180070 - RNA, 22 nt, Human
aacuucuggaaacuuccaugug

SEQ ID NO: 180071 - RNA, 22 nt, Human
aacuuauacccagggcagaaau

SEQ ID NO: 180072 - RNA, 22 nt, Human
aacugguaauuuaguauuacug

SEQ ID NO: 180073 - RNA, 22 nt, Human
aacgcaacaacuggagcuguag

SEQ ID NO: 180074 - RNA, 22 nt, Human
aacucugagaaacuugcaguug

SEQ ID NO: 180075 - RNA, 22 nt, Human
aacugagugcuacauugugauu

SEQ ID NO: 180076 - RNA, 22 nt, Human
aacugcauaagcuucgggaccu

SEQ ID NO: 180077 - RNA, 22 nt, Human
aacugggugauucaggcuguuu

SEQ ID NO: 180078 - RNA, 22 nt, Human
aacucugcaaugaaaucauguu

SEQ ID NO: 180079 - RNA, 22 nt, Human
aagccugguuauuugaggaugu

SEQ ID NO: 180080 - RNA, 22 nt, Human
aagccuccgugcugcuggaucu

SEQ ID NO: 180081 - RNA, 22 nt, Human
aaggagcuuucauuacagccuu

SEQ ID NO: 180082 - RNA, 20 nt, Human
aaggaggcuuaaaguuagaa

SEQ ID NO: 180083 - RNA, 22 nt, Human
aaggaggugauucaccuuuugg

SEQ ID NO: 180084 - RNA, 22 nt, Human
aaggaucuuucuuuuuaccauu

SEQ ID NO: 180085 - RNA, 22 nt, Human
aaggaugguaacaguuucauuu

SEQ ID NO: 180086 - RNA, 22 nt, Human
aaggcuuugugcugaguugucg

SEQ ID NO: 180087 - RNA, 22 nt, Human
aaggcugaccaguuuacacuuu

SEQ ID NO: 180088 - RNA, 22 nt, Human
aaggcuguuugagcacuggagc

SEQ ID NO: 180089 - RNA, 22 nt, Human
aaggcgccacagugauugcaaa

SEQ ID NO: 180090 - RNA, 22 nt, Human
aaggccacacuugcuggccagc

SEQ ID NO: 180091 - RNA, 22 nt, Human
aaggccuaggaguugacauggg

SEQ ID NO: 180092 - RNA, 22 nt, Human
aaggauuuccaggccugcgccu

SEQ ID NO: 180093 - RNA, 22 nt, Human
aacccuaguugauagcuugggu

SEQ ID NO: 180094 - RNA, 22 nt, Human
aagggccacaugccauuuaaaa

SEQ ID NO: 180095 - RNA, 22 nt, Human
aagggaggguaggaagagggag

SEQ ID NO: 180096 - RNA, 23 nt, Human
aagggcgauuaacauucgcucga

SEQ ID NO: 180097 - RNA, 22 nt, Human
aagggcuucucgccugugugca

SEQ ID NO: 180098 - RNA, 22 nt, Human
aagggaaggaugggcauuuaca

SEQ ID NO: 180099 - RNA, 22 nt, Human
aagguauaaauaacucgggagg

SEQ ID NO: 180100 - RNA, 22 nt, Human
aaggucuucgaaccuuauguua

SEQ ID NO: 180101 - RNA, 22 nt, Human
aaggugcugaggguccuggcuu

SEQ ID NO: 180102 - RNA, 22 nt, Human
aaguaaaucuuaugucagggag

SEQ ID NO: 180103 - RNA, 22 nt, Human
aagguggugaucaucuugaagg

SEQ ID NO: 180104 - RNA, 22 nt, Human
aagguuuuguaugaaaucucug

SEQ ID NO: 180105 - RNA, 22 nt, Human
aagguguaaguagcugguucau

SEQ ID NO: 180106 - RNA, 22 nt, Human
aagguuuuguuuucgguuuuuu

SEQ ID NO: 180107 - RNA, 21 nt, Human
aaguaaauuuuuacuuaggcc

SEQ ID NO: 180108 - RNA, 22 nt, Human
aaguacugauucuguuccucaa

SEQ ID NO: 180109 - RNA, 22 nt, Human
aauauauaugggugcaugucug

SEQ ID NO: 180110 - RNA, 22 nt, Human
aauauagagcagaucuggcucu

SEQ ID NO: 180111 - RNA, 22 nt, Human
aauaguggcuuggacuaaauau

SEQ ID NO: 180112 - RNA, 22 nt, Human
aauagguaaaugaguaagaaau

SEQ ID NO: 180113 - RNA, 22 nt, Human
aauaggaaggaaauguuuaccu

SEQ ID NO: 180114 - RNA, 22 nt, Human
aauagcacauguugguugagua

SEQ ID NO: 180115 - RNA, 22 nt, Human
aauaauacaugugaugagaauu

SEQ ID NO: 180116 - RNA, 22 nt, Human
aauaauuuuuuugugauuaugu

SEQ ID NO: 180117 - RNA, 22 nt, Human
aauaagaguuaagaaguauauu

SEQ ID NO: 180118 - RNA, 22 nt, Human
aauaauacaauuggugucaugu

SEQ ID NO: 180119 - RNA, 22 nt, Human
aauacagauggcaugugaagau

SEQ ID NO: 180120 - RNA, 21 nt, Human
aaguuucucccuaauuguugc

SEQ ID NO: 180121 - RNA, 22 nt, Human
aauaacaguuuauuugagggcu

SEQ ID NO: 180122 - RNA, 22 nt, Human
aauaagacugucauggaguaaa

SEQ ID NO: 180123 - RNA, 22 nt, Human
aaguggugagacccugcugaaa

SEQ ID NO: 180124 - RNA, 17 nt, Human
aagugggcaaagugaga

SEQ ID NO: 180125 - RNA, 22 nt, Human
aaguggcccuaauugggccaaa

SEQ ID NO: 180126 - RNA, 23 nt, Human
aaguggugacugugcuacugaga

SEQ ID NO: 180127 - RNA, 20 nt, Human
aaguagguuucaguugcugu

SEQ ID NO: 180128 - RNA, 18 nt, Human
aaguaguuugagauuguu

SEQ ID NO: 180129 - RNA, 22 nt, Human
aaguguggguaagcauuucuug

SEQ ID NO: 180130 - RNA, 22 nt, Human
aagugugugagaaggggucgca

SEQ ID NO: 180131 - RNA, 22 nt, Human
aaguccgggcagcaggaauucu

SEQ ID NO: 180132 - RNA, 22 nt, Human
aagugguuuauuguaugguuuu

SEQ ID NO: 180133 - RNA, 22 nt, Human
aagugugugugcgcaugugcau

SEQ ID NO: 180134 - RNA, 22 nt, Human
aaguguucucuguuuuaucuac

SEQ ID NO: 180135 - RNA, 22 nt, Human
aagugucucugggaggcccgga

SEQ ID NO: 180136 - RNA, 22 nt, Human
aaguugaaugucuugcugaaug

SEQ ID NO: 180137 - RNA, 22 nt, Human
aaguugacuguuuuacuuaugu

SEQ ID NO: 180138 - RNA, 22 nt, Human
aaugaacuuucaguucagagag

SEQ ID NO: 180139 - RNA, 22 nt, Human
aaugaaaaucugucaguucaag

SEQ ID NO: 180140 - RNA, 22 nt, Human
aaugacagccuauacugucugc

SEQ ID NO: 180141 - RNA, 22 nt, Human
aaugaguccuuuagugccauug

SEQ ID NO: 180142 - RNA, 22 nt, Human
aaugaacuuugaagauggugaa

SEQ ID NO: 180143 - RNA, 22 nt, Human
aaugaaugaaugaaugauuaug

SEQ ID NO: 180144 - RNA, 22 nt, Human
aaugaauaaauuuuaaagacag

SEQ ID NO: 180145 - RNA, 22 nt, Human
aaugcagaugugucuuuaauuu

SEQ ID NO: 180146 - RNA, 22 nt, Human
aaugauuuucugcaaacaguga

SEQ ID NO: 180147 - RNA, 22 nt, Human
aaugagauggaggacucuuaau

SEQ ID NO: 180148 - RNA, 22 nt, Human
aaugagauaagaaaaccuuugc

SEQ ID NO: 180149 - RNA, 22 nt, Human
aaugaguucaucugaauucugg

SEQ ID NO: 180150 - RNA, 22 nt, Human
aaugagaauguaagugaagaga

SEQ ID NO: 180151 - RNA, 22 nt, Human
aaugacaguggcacagucacuu

SEQ ID NO: 180152 - RNA, 22 nt, Human
aaugaguuuguucuauuauuug

SEQ ID NO: 180153 - RNA, 23 nt, Human
aaugaguugggcagcauacaggc

SEQ ID NO: 180154 - RNA, 22 nt, Human
aauccucguagugguuagaaag

SEQ ID NO: 180155 - RNA, 22 nt, Human
aaucgguugaacccaggaagug

SEQ ID NO: 180156 - RNA, 22 nt, Human
aaucgacuguagagacuuggcg

SEQ ID NO: 180157 - RNA, 22 nt, Human
aaucccaguugacagaacuguu

SEQ ID NO: 180158 - RNA, 22 nt, Human
aaucugacaaaauauuuccagu

SEQ ID NO: 180159 - RNA, 22 nt, Human
aaucccaguccuccugggggau

SEQ ID NO: 180160 - RNA, 22 nt, Human
aaucaauuauccauuuguuagu

SEQ ID NO: 180161 - RNA, 22 nt, Human
aaucaaagccugcaaguugacu

SEQ ID NO: 180162 - RNA, 22 nt, Human
aauauuuaccuaccugucaucu

SEQ ID NO: 180163 - RNA, 22 nt, Human
aaucucguuaugaagaugguug

SEQ ID NO: 180164 - RNA, 22 nt, Human
aaucugaccguggagaucucca

SEQ ID NO: 180165 - RNA, 22 nt, Human
aaucuuuuugaaggaggagaga

SEQ ID NO: 180166 - RNA, 22 nt, Human
aaucugugugugagaaauggca

SEQ ID NO: 180167 - RNA, 22 nt, Human
aaugaaacuaguagaaucuuug

SEQ ID NO: 180168 - RNA, 22 nt, Human
aaugcauaaugguuugugacaa

SEQ ID NO: 180169 - RNA, 22 nt, Human
aauggacuucucugagccuguu

SEQ ID NO: 180170 - RNA, 22 nt, Human
aauggaaaggagccugacuaua

SEQ ID NO: 180171 - RNA, 22 nt, Human
aaugccuucauuggcgaagugc

SEQ ID NO: 180172 - RNA, 22 nt, Human
aauggcaauagugcauuaugua

SEQ ID NO: 180173 - RNA, 22 nt, Human
aauggcagauaauuuuccagau

SEQ ID NO: 180174 - RNA, 22 nt, Human
aauggcaagccacaugcuuuuc

SEQ ID NO: 180175 - RNA, 22 nt, Human
aauguacucgaaugauguuaag

SEQ ID NO: 180176 - RNA, 22 nt, Human
aauguaaauaauuguaaaauuu

SEQ ID NO: 180177 - RNA, 22 nt, Human
aaugguuacuacccugggucuu

SEQ ID NO: 180178 - RNA, 22 nt, Human
aaugggauuaagaaagaucuug

SEQ ID NO: 180179 - RNA, 22 nt, Human
aauggugaggagugcauugaga

SEQ ID NO: 180180 - RNA, 22 nt, Human
aaugguggaugucuguucugac

SEQ ID NO: 180181 - RNA, 22 nt, Human
aauguugacguuggccagggcc

SEQ ID NO: 180182 - RNA, 22 nt, Human
aauguugaaccuuuuuggccug

SEQ ID NO: 180183 - RNA, 22 nt, Human
aauguuugaacuuugcauauuu

SEQ ID NO: 180184 - RNA, 22 nt, Human
aauguuuaacuguggucagcag

SEQ ID NO: 180185 - RNA, 22 nt, Human
aauguuguaaauauucuuugag

SEQ ID NO: 180186 - RNA, 22 nt, Human
aauguuuaagcuuuuauuuaca

SEQ ID NO: 180187 - RNA, 22 nt, Human
aauguuuaguuuuauuuuagua

SEQ ID NO: 180188 - RNA, 23 nt, Human
aauguugaggguggguuuuuaac

SEQ ID NO: 180189 - RNA, 22 nt, Human
aauuauguugaaauaugagaac

SEQ ID NO: 180190 - RNA, 22 nt, Human
aauuagaagcuguuagcaaaau

SEQ ID NO: 180191 - RNA, 22 nt, Human
aauucaggacaaauguuuucaa

SEQ ID NO: 180192 - RNA, 22 nt, Human
aauucaacagucaguuaucuca

SEQ ID NO: 180193 - RNA, 21 nt, Human
aauuauuugcauuuuucuugu

SEQ ID NO: 180194 - RNA, 22 nt, Human
aauuauugucuuuuuuaaaagc

SEQ ID NO: 180195 - RNA, 22 nt, Human
acugccauauuaggagcuucag

SEQ ID NO: 180196 - RNA, 22 nt, Human
acugccuugcaccauggcuuuu

SEQ ID NO: 180197 - RNA, 18 nt, Human
acugagcccaggacacac

SEQ ID NO: 180198 - RNA, 22 nt, Human
acuacccugaccaaguauuuua

SEQ ID NO: 180199 - RNA, 22 nt, Human
acugacuacauguccugucauu

SEQ ID NO: 180200 - RNA, 22 nt, Human
acugauuuuauauauuaccccg

SEQ ID NO: 180201 - RNA, 22 nt, Human
acuaagcugugugguucacuca

SEQ ID NO: 180202 - RNA, 22 nt, Human
acguugaaaugggcauuuuccg

SEQ ID NO: 180203 - RNA, 20 nt, Human
acuaccaugcaauuccgcuu

SEQ ID NO: 180204 - RNA, 22 nt, Human
acuacucagcaaacauuugcug

SEQ ID NO: 180205 - RNA, 22 nt, Human
acuggcaugauagaccauaaca

SEQ ID NO: 180206 - RNA, 22 nt, Human
acuggcuuggaaauggguauuu

SEQ ID NO: 180207 - RNA, 22 nt, Human
acuggcuuauuguuguggagcu

SEQ ID NO: 180208 - RNA, 15 nt, Human
acugggaaggaguau

SEQ ID NO: 180209 - RNA, 22 nt, Human
acuggggaggucuggauggauc

SEQ ID NO: 180210 - RNA, 22 nt, Human
acugggcaaggauaugaugggu

SEQ ID NO: 180211 - RNA, 22 nt, Human
acuggauuuugugguguaucuu

SEQ ID NO: 180212 - RNA, 20 nt, Human
acugcaagagacagaugaaa

SEQ ID NO: 180213 - RNA, 22 nt, Human
acugcguuucuaaaguagcaua

SEQ ID NO: 180214 - RNA, 22 nt, Human
acugcacuccagcccgagcaac

SEQ ID NO: 180215 - RNA, 22 nt, Human
acugcuguugugauggguauuu

SEQ ID NO: 180216 - RNA, 22 nt, Human
acugugcccccucuacugcuga

SEQ ID NO: 180217 - RNA, 18 nt, Human
acuguccucaggacguug

SEQ ID NO: 180218 - RNA, 22 nt, Human
acugugauguaaagaaauaggc

SEQ ID NO: 180219 - RNA, 22 nt, Human
acuggggauugguucuucaaca

SEQ ID NO: 180220 - RNA, 22 nt, Human
acugucuuguuguaugugagcu

SEQ ID NO: 180221 - RNA, 19 nt, Human
acuggggcaggcugggcuu

SEQ ID NO: 180222 - RNA, 22 nt, Human
acugguuucaaguuggacugaa

SEQ ID NO: 180223 - RNA, 22 nt, Human
acugggacuguaugugcuggac

SEQ ID NO: 180224 - RNA, 19 nt, Human
acugggaugggcagugcca

SEQ ID NO: 180225 - RNA, 22 nt, Human
acuggggcaggaaaguaugcug

SEQ ID NO: 180226 - RNA, 22 nt, Human
acuggugcucuggccaccgcug

SEQ ID NO: 180227 - RNA, 22 nt, Human
acugucauuaaugaauguaaua

SEQ ID NO: 180228 - RNA, 22 nt, Human
acugucaggauugagucucugg

SEQ ID NO: 180229 - RNA, 21 nt, Human
acugggcuagccugacuucug

SEQ ID NO: 180230 - RNA, 22 nt, Human
acuggguuguuugucucaugag

SEQ ID NO: 180231 - RNA, 22 nt, Human
acugguagcugauuaaguauag

SEQ ID NO: 180232 - RNA, 22 nt, Human
acugugacugugucuucugggc

SEQ ID NO: 180233 - RNA, 18 nt, Human
acuguggcucagaguugc

SEQ ID NO: 180234 - RNA, 22 nt, Human
acuguugcuuguuuggaauguu

SEQ ID NO: 180235 - RNA, 22 nt, Human
acugugaagagcauucuggcug

SEQ ID NO: 180236 - RNA, 22 nt, Human
acuguggcugcuacccuggcuc

SEQ ID NO: 180237 - RNA, 22 nt, Human
acuguuauugguguauguggca

SEQ ID NO: 180238 - RNA, 22 nt, Human
acuguugugaauaaugaaaugc

SEQ ID NO: 180239 - RNA, 17 nt, Human
acuuaagacaguggaaa

SEQ ID NO: 180240 - RNA, 22 nt, Human
acuuauaaauuuaguacacugu

SEQ ID NO: 180241 - RNA, 22 nt, Human
acuuugugaauagaacuggaug

SEQ ID NO: 180242 - RNA, 22 nt, Human
acuuuuccuggguagcuccugg

SEQ ID NO: 180243 - RNA, 22 nt, Human
acuuuuagccuucccacaacag

SEQ ID NO: 180244 - RNA, 22 nt, Human
acuugauggaguuucacuguau

SEQ ID NO: 180245 - RNA, 22 nt, Human
acuugaagcaugaaaauaagcc

SEQ ID NO: 180246 - RNA, 22 nt, Human
acuucuuuugcaugauucuuua

SEQ ID NO: 180247 - RNA, 22 nt, Human
acuugagcuugaaagguaugcu

SEQ ID NO: 180248 - RNA, 20 nt, Human
agaaaggaguaaagaagaga

SEQ ID NO: 180249 - RNA, 19 nt, Human
agaaauagccuuccuuguc

SEQ ID NO: 180250 - RNA, 22 nt, Human
agaaagcacccugcacuuucug

SEQ ID NO: 180251 - RNA, 22 nt, Human
agaagaagacccuaaggaaagg

SEQ ID NO: 180252 - RNA, 22 nt, Human
agaaauggggugaagcaaaugg

SEQ ID NO: 180253 - RNA, 22 nt, Human
agaaauggccagacuugccccu

SEQ ID NO: 180254 - RNA, 22 nt, Human
agaagcaauuggaaaguacagg

SEQ ID NO: 180255 - RNA, 22 nt, Human
agaagcauaagggcuuugccag

SEQ ID NO: 180256 - RNA, 21 nt, Human
agaagcggucgaaucgcagac

SEQ ID NO: 180257 - RNA, 22 nt, Human
acuuuuaaggggccuugauuua

SEQ ID NO: 180258 - RNA, 22 nt, Human
acuuuggugcgaagucacuuua

SEQ ID NO: 180259 - RNA, 22 nt, Human
acuuugucuugaucaaaggugu

SEQ ID NO: 180260 - RNA, 22 nt, Human
acuuggucguggugcagcaugg

SEQ ID NO: 180261 - RNA, 23 nt, Human
acuuugaggagaagaaugucagu

SEQ ID NO: 180262 - RNA, 22 nt, Human
acuuugccuucuuacuguguug

SEQ ID NO: 180263 - RNA, 22 nt, Human
acuuuuuugccaucccuccagc

SEQ ID NO: 180264 - RNA, 22 nt, Human
agaaaagaggcuuucuaagcau

SEQ ID NO: 180265 - RNA, 22 nt, Human
agaaaagagacaauguuuuugg

SEQ ID NO: 180266 - RNA, 22 nt, Human
agaacaagaaacccgaaaagug

SEQ ID NO: 180267 - RNA, 22 nt, Human
agaaauuguaauaaaucugguc

SEQ ID NO: 180268 - RNA, 20 nt, Human
agaaggagagaugaggcaaa

SEQ ID NO: 180269 - RNA, 22 nt, Human
agaacaggaggaagccagcucc

SEQ ID NO: 180270 - RNA, 22 nt, Human
agaaccauccugguuccagcuu

SEQ ID NO: 180271 - RNA, 22 nt, Human
agaaucaggaagacagccuggc

SEQ ID NO: 180272 - RNA, 22 nt, Human
agacauauuggcuugcuuuaau

SEQ ID NO: 180273 - RNA, 22 nt, Human
agaauguaagaaugcaaagauu

SEQ ID NO: 180274 - RNA, 22 nt, Human
agacagaacauaauuaguacug

SEQ ID NO: 180275 - RNA, 22 nt, Human
agacuguuccgucagacucagu

SEQ ID NO: 180276 - RNA, 21 nt, Human
agacugaugggaagacucugu

SEQ ID NO: 180277 - RNA, 20 nt, Human
agacauugaggagagagcau

SEQ ID NO: 180278 - RNA, 22 nt, Human
agacagcggugcaauaaauggu

SEQ ID NO: 180279 - RNA, 22 nt, Human
agacgggacagacuuuugagug

SEQ ID NO: 180280 - RNA, 22 nt, Human
agacuuugaaugaugacagcgu

SEQ ID NO: 180281 - RNA, 22 nt, Human
agacuacggggaggggagggaa

SEQ ID NO: 180282 - RNA, 22 nt, Human
agacuuuggcagggccaguggu

SEQ ID NO: 180283 - RNA, 22 nt, Human
agagaaauguacuagucuaacu

SEQ ID NO: 180284 - RNA, 22 nt, Human
agaccccuguggugaugguggu

SEQ ID NO: 180285 - RNA, 22 nt, Human
agacuguuuucccaucucuugg

SEQ ID NO: 180286 - RNA, 22 nt, Human
agagaagaauccccugguggag

SEQ ID NO: 180287 - RNA, 21 nt, Human
agagaccuaagcugagauucc

SEQ ID NO: 180288 - RNA, 22 nt, Human
agagacaggguuuugucguguu

SEQ ID NO: 180289 - RNA, 22 nt, Human
agagacaagggaccucuggaga

SEQ ID NO: 180290 - RNA, 19 nt, Human
agacugaagggcccgaguc

SEQ ID NO: 180291 - RNA, 22 nt, Human
agagaacauuuucaggguuuca

SEQ ID NO: 180292 - RNA, 20 nt, Human
agagaacaguuuggucacag

SEQ ID NO: 180293 - RNA, 22 nt, Human
agagaguacuuucaucagggaa

SEQ ID NO: 180294 - RNA, 22 nt, Human
agagcaauggugcuuuaauucu

SEQ ID NO: 180295 - RNA, 22 nt, Human
agagauggugaugaggaaaaau

SEQ ID NO: 180296 - RNA, 22 nt, Human
agagaacaggcagcuggugccg

SEQ ID NO: 180297 - RNA, 22 nt, Human
agagauuagagaagaugauaaa

SEQ ID NO: 180298 - RNA, 22 nt, Human
agagacugauggaucaccaaau

SEQ ID NO: 180299 - RNA, 22 nt, Human
agagacauagcacaguuuuucg

SEQ ID NO: 180300 - RNA, 22 nt, Human
agagaauuugggaauauaaauc

SEQ ID NO: 180301 - RNA, 22 nt, Human
agagcagcaaucuuugaaauua

SEQ ID NO: 180302 - RNA, 22 nt, Human
agaguggcaccuuaccugagac

SEQ ID NO: 180303 - RNA, 22 nt, Human
agagugagauaugugguuggua

SEQ ID NO: 180304 - RNA, 22 nt, Human
agaguguggaaauguucagagu

SEQ ID NO: 180305 - RNA, 23 nt, Human
agauaaggaagcauuugagccag

SEQ ID NO: 180306 - RNA, 22 nt, Human
agauaacauguugcagauucug

SEQ ID NO: 180307 - RNA, 22 nt, Human
agaguuaaugcaggccaagccu

SEQ ID NO: 180308 - RNA, 22 nt, Human
agaguguguggggcugagguca

SEQ ID NO: 180309 - RNA, 22 nt, Human
agagggagagauuggcaaucag

SEQ ID NO: 180310 - RNA, 22 nt, Human
agagggagccugcacagcuuuc

SEQ ID NO: 180311 - RNA, 22 nt, Human
agaggcaugaacucccguagcc

SEQ ID NO: 180312 - RNA, 23 nt, Human
agaggccaacuucuugccccucc

SEQ ID NO: 180313 - RNA, 22 nt, Human
agaggcagagcugggguuugac

SEQ ID NO: 180314 - RNA, 22 nt, Human
agagauugagcucagaagaccu

SEQ ID NO: 180315 - RNA, 22 nt, Human
agaggaauuauugaguuagauu

SEQ ID NO: 180316 - RNA, 22 nt, Human
agagcagauggagcuggaagag

SEQ ID NO: 180317 - RNA, 21 nt, Human
agaggacuuuuuugauguuuu

SEQ ID NO: 180318 - RNA, 22 nt, Human
accaccacauaguaggcacuua

SEQ ID NO: 180319 - RNA, 22 nt, Human
accccuauugcuugugauuaug

SEQ ID NO: 180320 - RNA, 22 nt, Human
accccuuaaauuuguuguuuaa

SEQ ID NO: 180321 - RNA, 22 nt, Human
accccagcucugagccacacca

SEQ ID NO: 180322 - RNA, 19 nt, Human
acccaugcucuguggacuu

SEQ ID NO: 180323 - RNA, 22 nt, Human
accaguuaaagaauaugaggcc

SEQ ID NO: 180324 - RNA, 22 nt, Human
accagcgcguuuucaguuucau

SEQ ID NO: 180325 - RNA, 22 nt, Human
accagccacacacauuagucac

SEQ ID NO: 180326 - RNA, 22 nt, Human
accaugacugucacauuauuau

SEQ ID NO: 180327 - RNA, 22 nt, Human
accagguugagacuucggcuuu

SEQ ID NO: 180328 - RNA, 22 nt, Human
accauaugaagaucacacuauc

SEQ ID NO: 180329 - RNA, 22 nt, Human
accaauguucaaccuugacugc

SEQ ID NO: 180330 - RNA, 22 nt, Human
accaagaguccaagugagguug

SEQ ID NO: 180331 - RNA, 22 nt, Human
accaauaaaagcaauucacagu

SEQ ID NO: 180332 - RNA, 21 nt, Human
acccagaauggagccaagccu

SEQ ID NO: 180333 - RNA, 22 nt, Human
acauuuuuggguugaugucuga

SEQ ID NO: 180334 - RNA, 22 nt, Human
accaacacgucugaguauuucc

SEQ ID NO: 180335 - RNA, 22 nt, Human
acauuauuguguagugugggca

SEQ ID NO: 180336 - RNA, 22 nt, Human
acauuccugaagguaaugagaa

SEQ ID NO: 180337 - RNA, 22 nt, Human
acauugcagcuccuaccuuguc

SEQ ID NO: 180338 - RNA, 22 nt, Human
acaugguguggcacuaggggcu

SEQ ID NO: 180339 - RNA, 19 nt, Human
accaaacaguggacggagc

SEQ ID NO: 180340 - RNA, 22 nt, Human
acauuuuguuuauggaaaagau

SEQ ID NO: 180341 - RNA, 22 nt, Human
accaccacugacaccagcucgg

SEQ ID NO: 180342 - RNA, 22 nt, Human
accaauguuuuauagaaaugcc

SEQ ID NO: 180343 - RNA, 22 nt, Human
acauuguuuuugugacuucuau

SEQ ID NO: 180344 - RNA, 22 nt, Human
accaggaguuuugaccaggggc

SEQ ID NO: 180345 - RNA, 22 nt, Human
accacguccugguggcuguugg

SEQ ID NO: 180346 - RNA, 17 nt, Human
accaggggcagcacugc

SEQ ID NO: 180347 - RNA, 22 nt, Human
accaggcagcaccaaagccggu

SEQ ID NO: 180348 - RNA, 22 nt, Human
accagccacccugccgcguccg

SEQ ID NO: 180349 - RNA, 22 nt, Human
acauuucuccuacuuguuauuu

SEQ ID NO: 180350 - RNA, 22 nt, Human
acauuuuaccaucuguggauga

SEQ ID NO: 180351 - RNA, 22 nt, Human
acauuuugggagaaaguuguua

SEQ ID NO: 180352 - RNA, 22 nt, Human
acauugguauuaguguggcuga

SEQ ID NO: 180353 - RNA, 21 nt, Human
acauccaggguccucacugcc

SEQ ID NO: 180354 - RNA, 22 nt, Human
acauauggcagguugaucaaug

SEQ ID NO: 180355 - RNA, 22 nt, Human
acauccaguaucagaagcauca

SEQ ID NO: 180356 - RNA, 22 nt, Human
acaucccccuacuuguguccug

SEQ ID NO: 180357 - RNA, 22 nt, Human
acaucuaugucugaggccuugg

SEQ ID NO: 180358 - RNA, 22 nt, Human
acauguggaggaggcgagggua

SEQ ID NO: 180359 - RNA, 22 nt, Human
acaugucagaaaauucagaggg

SEQ ID NO: 180360 - RNA, 20 nt, Human
acauggagaagcgagguagg

SEQ ID NO: 180361 - RNA, 22 nt, Human
acaugggggugggacggcagag

SEQ ID NO: 180362 - RNA, 22 nt, Human
acauuuuaaaaacaguaccugg

SEQ ID NO: 180363 - RNA, 22 nt, Human
acauggaauuucagaagagcau

SEQ ID NO: 180364 - RNA, 22 nt, Human
acauuuccaaagaugccaguca

SEQ ID NO: 180365 - RNA, 22 nt, Human
acaguguuacuugauaguguau

SEQ ID NO: 180366 - RNA, 22 nt, Human
acauggaaacacgcagccccaa

SEQ ID NO: 180367 - RNA, 22 nt, Human
aauugcauucauuuguauauuu

SEQ ID NO: 180368 - RNA, 22 nt, Human
aauucgcugcauuccaucuagg

SEQ ID NO: 180369 - RNA, 22 nt, Human
aauucugcagucguacuauaau

SEQ ID NO: 180370 - RNA, 22 nt, Human
aauucugaggccauuuauuucc

SEQ ID NO: 180371 - RNA, 22 nt, Human
aauucagguuauauuugcaacu

SEQ ID NO: 180372 - RNA, 22 nt, Human
acauggggaaaaaggccugcuc

SEQ ID NO: 180373 - RNA, 22 nt, Human
acauggaccucagauccuggcc

SEQ ID NO: 180374 - RNA, 22 nt, Human
acauggguuaaagaagauggaa

SEQ ID NO: 180375 - RNA, 22 nt, Human
acauauaugugcauacaacuau

SEQ ID NO: 180376 - RNA, 22 nt, Human
acaucacuugguuaaugugguc

SEQ ID NO: 180377 - RNA, 22 nt, Human
accuuuuauuuucaugcuugcu

SEQ ID NO: 180378 - RNA, 20 nt, Human
acgaacauauugcaggguuu

SEQ ID NO: 180379 - RNA, 22 nt, Human
acgaaugacaugugauuugaaa

SEQ ID NO: 180380 - RNA, 22 nt, Human
acgaagggggcauggugagagu

SEQ ID NO: 180381 - RNA, 22 nt, Human
acgauaacaauaguagcaugua

SEQ ID NO: 180382 - RNA, 22 nt, Human
accuuaagugauuaugacauau

SEQ ID NO: 180383 - RNA, 19 nt, Human
accuguucaaccucgugcu

SEQ ID NO: 180384 - RNA, 22 nt, Human
accuguagcccaaucauggcag

SEQ ID NO: 180385 - RNA, 20 nt, Human
accuucuuugguagacggaa

SEQ ID NO: 180386 - RNA, 22 nt, Human
accuucugaccucucggacuuc

SEQ ID NO: 180387 - RNA, 22 nt, Human
accuuaaacagauggcggcugg

SEQ ID NO: 180388 - RNA, 22 nt, Human
acgauuugguucagugaagaca

SEQ ID NO: 180389 - RNA, 22 nt, Human
accugcucucccucucgcaguc

SEQ ID NO: 180390 - RNA, 22 nt, Human
accuggaccugccaccuaugag

SEQ ID NO: 180391 - RNA, 23 nt, Human
acgggaggcggggcagggcugag

SEQ ID NO: 180392 - RNA, 22 nt, Human
accuuuggaggacuagggucau

SEQ ID NO: 180393 - RNA, 22 nt, Human
acgaaauaaaauuaaagcccua

SEQ ID NO: 180394 - RNA, 22 nt, Human
acgugcauuacucaaaucucaa

SEQ ID NO: 180395 - RNA, 22 nt, Human
acuaauuguuuaaggauaggaa

SEQ ID NO: 180396 - RNA, 22 nt, Human
acguuuuagccauguaguuucu

SEQ ID NO: 180397 - RNA, 22 nt, Human
acgugguaaaagaucuguaaaa

SEQ ID NO: 180398 - RNA, 22 nt, Human
acuaaagcagcucagacgagaa

SEQ ID NO: 180399 - RNA, 22 nt, Human
acuaaacauaucacugcuuuac

SEQ ID NO: 180400 - RNA, 22 nt, Human
acgguuuugugagguaguacuu

SEQ ID NO: 180401 - RNA, 22 nt, Human
acgguguuucucguucaggguu

SEQ ID NO: 180402 - RNA, 22 nt, Human
acggggagcgucggccucuccc

SEQ ID NO: 180403 - RNA, 22 nt, Human
acgggugcuuguucccgcugcu

SEQ ID NO: 180404 - RNA, 22 nt, Human
acgggugugauuccuuuugugu

SEQ ID NO: 180405 - RNA, 22 nt, Human
accgagcaggguguuugcgcac

SEQ ID NO: 180406 - RNA, 22 nt, Human
accucauucugcauagaacuuu

SEQ ID NO: 180407 - RNA, 22 nt, Human
accucaguucaagggaguuuca

SEQ ID NO: 180408 - RNA, 22 nt, Human
acccuuucgagauuucugccuu

SEQ ID NO: 180409 - RNA, 22 nt, Human
accucuuucuauggauuuuuug

SEQ ID NO: 180410 - RNA, 22 nt, Human
accugaucugagaaguggaggg

SEQ ID NO: 180411 - RNA, 22 nt, Human
accugagauuuuuacucaguaa

SEQ ID NO: 180412 - RNA, 23 nt, Human
accgccgcugccgccgcccccgc

SEQ ID NO: 180413 - RNA, 22 nt, Human
accugcagguguuuccacacuu

SEQ ID NO: 180414 - RNA, 22 nt, Human
accugauuuuauggauuuugag

SEQ ID NO: 180415 - RNA, 21 nt, Human
accgucaguacuaguauugac

SEQ ID NO: 180416 - RNA, 22 nt, Human
accgggcagcucugccccugcc

SEQ ID NO: 180417 - RNA, 22 nt, Human
accgcuggcacuggggacgggg

SEQ ID NO: 180418 - RNA, 22 nt, Human
accgauuucaaauggugcuaga

SEQ ID NO: 180419 - RNA, 21 nt, Human
accugguuuacugaucccagg

SEQ ID NO: 180420 - RNA, 21 nt, Human
accuggugaugaaugggaggc

SEQ ID NO: 180421 - RNA, 22 nt, Human
accuggauauuuucaguugcau

SEQ ID NO: 180422 - RNA, 22 nt, Human
accuggcccugggucuccugac

SEQ ID NO: 180423 - RNA, 22 nt, Human
accgugcccauucauuuacaaa

SEQ ID NO: 180424 - RNA, 22 nt, Human
accuauuuauacaacugcacca

SEQ ID NO: 180425 - RNA, 23 nt, Human
accuccuuguugaguggggguga

SEQ ID NO: 180426 - RNA, 22 nt, Human
accucccugaaaaagacagugc

SEQ ID NO: 180427 - RNA, 22 nt, Human
accucccgacggcgcgggagaa

SEQ ID NO: 180428 - RNA, 22 nt, Human
accgauguggaaaauuucauuu

SEQ ID NO: 180429 - RNA, 22 nt, Human
accaguuuuuugaccaugggug

SEQ ID NO: 180430 - RNA, 22 nt, Human
accauaugaaguugcccauauu

SEQ ID NO: 180431 - RNA, 22 nt, Human
acccugcacagagggcuuuaua

SEQ ID NO: 180432 - RNA, 22 nt, Human
acccuucugugaccugccuguc

SEQ ID NO: 180433 - RNA, 22 nt, Human
acccugacggugggcagcuuga

SEQ ID NO: 180434 - RNA, 20 nt, Human
acccaaagcucagcgugucc

SEQ ID NO: 180435 - RNA, 22 nt, Human
accauuauagaggacauuaugu

SEQ ID NO: 180436 - RNA, 22 nt, Human
acccgguuuucccagcaccucc

SEQ ID NO: 180437 - RNA, 22 nt, Human
acccggccuacucagugcccag

SEQ ID NO: 180438 - RNA, 22 nt, Human
acccuauuaacuacuacguugg

SEQ ID NO: 180439 - RNA, 22 nt, Human
accgguucccaucuggagaguu

SEQ ID NO: 180440 - RNA, 22 nt, Human
accgucagguuagaaugagcac

SEQ ID NO: 180441 - RNA, 22 nt, Human
accggucucaccaaacgcccca

SEQ ID NO: 180442 - RNA, 22 nt, Human
acccaucauuagucuuucagga

SEQ ID NO: 180443 - RNA, 18 nt, Human
acccauuauauuuguagc

SEQ ID NO: 180444 - RNA, 22 nt, Human
agcaguucucugucuagcuaga

SEQ ID NO: 180445 - RNA, 22 nt, Human
agcaguugcuuuguauauuaaa

SEQ ID NO: 180446 - RNA, 19 nt, Human
agcagugaaaucuggugag

SEQ ID NO: 180447 - RNA, 18 nt, Human
agcagugcggaucauuuu

SEQ ID NO: 180448 - RNA, 22 nt, Human
agcaggucagugguaaucaaaa

SEQ ID NO: 180449 - RNA, 21 nt, Human
agcagucugcggccggugcgg

SEQ ID NO: 180450 - RNA, 22 nt, Human
agcaggauggaguaacgugaaa

SEQ ID NO: 180451 - RNA, 22 nt, Human
agcagggagacagugcagcauu

SEQ ID NO: 180452 - RNA, 22 nt, Human
agcaggacuugcugagcccucc

SEQ ID NO: 180453 - RNA, 22 nt, Human
agauaggccauuaagaaggaua

SEQ ID NO: 180454 - RNA, 22 nt, Human
agcaggagagacuggcccaaaa

SEQ ID NO: 180455 - RNA, 22 nt, Human
agcaggagaaagaguaugggcu

SEQ ID NO: 180456 - RNA, 22 nt, Human
agcacggugguuaagagagugg

SEQ ID NO: 180457 - RNA, 17 nt, Human
agcagcuggguugaucu

SEQ ID NO: 180458 - RNA, 16 nt, Human
agcagcgugggggugg

SEQ ID NO: 180459 - RNA, 19 nt, Human
agcagccaucgaccaugga

SEQ ID NO: 180460 - RNA, 22 nt, Human
agauaggcuuagccaagcuuuc

SEQ ID NO: 180461 - RNA, 22 nt, Human
agauaagaacauuaguaagccg

SEQ ID NO: 180462 - RNA, 22 nt, Human
agcaucggacggagcaccugcu

SEQ ID NO: 180463 - RNA, 22 nt, Human
agcauauaugcaugagugugca

SEQ ID NO: 180464 - RNA, 22 nt, Human
agcaggaggagagccuggcggu

SEQ ID NO: 180465 - RNA, 22 nt, Human
agcaggaggguuuuguagaguc

SEQ ID NO: 180466 - RNA, 22 nt, Human
agcauuugcuguucuagaaagu

SEQ ID NO: 180467 - RNA, 22 nt, Human
agcauuucuacugugucagaaa

SEQ ID NO: 180468 - RNA, 22 nt, Human
agcagggugugggugugagugu

SEQ ID NO: 180469 - RNA, 22 nt, Human
agcauucccuuugcagugucau

SEQ ID NO: 180470 - RNA, 22 nt, Human
agcagguucaagggcaaagcug

SEQ ID NO: 180471 - RNA, 22 nt, Human
agcaguuagauccugguuagcg

SEQ ID NO: 180472 - RNA, 22 nt, Human
agcaguuuauccucauaaugga

SEQ ID NO: 180473 - RNA, 22 nt, Human
agccagcauauauauaguugaa

SEQ ID NO: 180474 - RNA, 22 nt, Human
agccagauuuuuugagaggcga

SEQ ID NO: 180475 - RNA, 22 nt, Human
agccacggcaaugauaggcugc

SEQ ID NO: 180476 - RNA, 21 nt, Human
agccagguuuccuuugaagag

SEQ ID NO: 180477 - RNA, 21 nt, Human
agcaucugaggcaguuuccua

SEQ ID NO: 180478 - RNA, 22 nt, Human
agcaugaauugccauuuauuaa

SEQ ID NO: 180479 - RNA, 19 nt, Human
agcaguggagccaugccug

SEQ ID NO: 180480 - RNA, 22 nt, Human
agccacagucuguagccagcuu

SEQ ID NO: 180481 - RNA, 22 nt, Human
agccuggagcaggcucugcucu

SEQ ID NO: 180482 - RNA, 22 nt, Human
agcauuuuaaaacuaguuacca

SEQ ID NO: 180483 - RNA, 22 nt, Human
agcccgggagggcugucuggga

SEQ ID NO: 180484 - RNA, 22 nt, Human
agccuggacagcuacggagaac

SEQ ID NO: 180485 - RNA, 22 nt, Human
agcccugaccuguccuguucug

SEQ ID NO: 180486 - RNA, 22 nt, Human
agcccuauacuuagauuuauuc

SEQ ID NO: 180487 - RNA, 22 nt, Human
agcauucagacaucugauggau

SEQ ID NO: 180488 - RNA, 22 nt, Human
agcauucuguggucuucuaugg

SEQ ID NO: 180489 - RNA, 22 nt, Human
agcauugguggcauuugcagcu

SEQ ID NO: 180490 - RNA, 22 nt, Human
agcaugucuaacucuucagggu

SEQ ID NO: 180491 - RNA, 22 nt, Human
agcccuucccuuucacuggugc

SEQ ID NO: 180492 - RNA, 22 nt, Human
agccgauaaauuguuuucuugg

SEQ ID NO: 180493 - RNA, 22 nt, Human
agccgcgcagccucauuaagga

SEQ ID NO: 180494 - RNA, 22 nt, Human
agccuguacuuagagggauuaa

SEQ ID NO: 180495 - RNA, 22 nt, Human
agccuugcaugauuucauucau

SEQ ID NO: 180496 - RNA, 22 nt, Human
agcgaaaagaauggaguggagu

SEQ ID NO: 180497 - RNA, 22 nt, Human
agccuuucugcgcacucuuccg

SEQ ID NO: 180498 - RNA, 22 nt, Human
agcgacuugacagacauguccu

SEQ ID NO: 180499 - RNA, 22 nt, Human
agcgcaguuaccgcgcggggcu

SEQ ID NO: 180500 - RNA, 22 nt, Human
agcgcccguugagucgcgcggu

SEQ ID NO: 180501 - RNA, 22 nt, Human
agcggcucaggccccgugggcu

SEQ ID NO: 180502 - RNA, 22 nt, Human
agcggugacauccuucugugcu

SEQ ID NO: 180503 - RNA, 22 nt, Human
agcggcaggaagcgcgcaagcg

SEQ ID NO: 180504 - RNA, 22 nt, Human
agcggcaagguguauguggcag

SEQ ID NO: 180505 - RNA, 22 nt, Human
agcggcgcgucuccgagcugga

SEQ ID NO: 180506 - RNA, 22 nt, Human
agcgcuguguucccgugggcau

SEQ ID NO: 180507 - RNA, 19 nt, Human
agcggagguuguauauugu

SEQ ID NO: 180508 - RNA, 22 nt, Human
agcggaggaggcggagcaggga

SEQ ID NO: 180509 - RNA, 22 nt, Human
agcgcgcggggcugcggcaggg

SEQ ID NO: 180510 - RNA, 22 nt, Human
agcgccgcugugauuggugagg

SEQ ID NO: 180511 - RNA, 22 nt, Human
agcgggucaugucggccgccca

SEQ ID NO: 180512 - RNA, 22 nt, Human
agcguacuugaggcuuggggcc

SEQ ID NO: 180513 - RNA, 22 nt, Human
agcuaauguauguugaaagcac

SEQ ID NO: 180514 - RNA, 22 nt, Human
agcuaaauauuuuuccugacac

SEQ ID NO: 180515 - RNA, 22 nt, Human
agcgucaugugaccagcgcgcc

SEQ ID NO: 180516 - RNA, 22 nt, Human
agcuaaaaugagguuuuuggau

SEQ ID NO: 180517 - RNA, 22 nt, Human
agcguaugaauauuugaagaga

SEQ ID NO: 180518 - RNA, 22 nt, Human
agcguucuguuccaugcuaaca

SEQ ID NO: 180519 - RNA, 22 nt, Human
agccuguuacuguccugugcca

SEQ ID NO: 180520 - RNA, 22 nt, Human
agcucagugugucuaugaggua

SEQ ID NO: 180521 - RNA, 22 nt, Human
agcucuuccuccauucuggcca

SEQ ID NO: 180522 - RNA, 22 nt, Human
agcucugcuucuugggaagaug

SEQ ID NO: 180523 - RNA, 22 nt, Human
agcucugugcaggcagaggcau

SEQ ID NO: 180524 - RNA, 22 nt, Human
agcuccugcgcacggugcacac

SEQ ID NO: 180525 - RNA, 22 nt, Human
agcucucaccauagugcuuaaa

SEQ ID NO: 180526 - RNA, 19 nt, Human
agcucaggcccaucguccc

SEQ ID NO: 180527 - RNA, 22 nt, Human
agcucggcuguccugugccccu

SEQ ID NO: 180528 - RNA, 19 nt, Human
agcuccucaccucucgcgg

SEQ ID NO: 180529 - RNA, 22 nt, Human
agcucuccuacucucuuucuag

SEQ ID NO: 180530 - RNA, 22 nt, Human
agcugcugcaaguggugcuaac

SEQ ID NO: 180531 - RNA, 19 nt, Human
agcugcugauugguggagg

SEQ ID NO: 180532 - RNA, 22 nt, Human
agcugcauucguaucauauugu

SEQ ID NO: 180533 - RNA, 22 nt, Human
agcugacagugcauggagggac

SEQ ID NO: 180534 - RNA, 20 nt, Human
agcugaauaguuuugugaaa

SEQ ID NO: 180535 - RNA, 22 nt, Human
agcugauugucuuuuuaaaagu

SEQ ID NO: 180536 - RNA, 22 nt, Human
agcugaugucucaccuguuaga

SEQ ID NO: 180537 - RNA, 22 nt, Human
agcuucuucugccuugucccug

SEQ ID NO: 180538 - RNA, 19 nt, Human
agcuuauuuacugcaggac

SEQ ID NO: 180539 - RNA, 22 nt, Human
agcuguugaccuucccuuucag

SEQ ID NO: 180540 - RNA, 22 nt, Human
agcuugauggauugcugaggca

SEQ ID NO: 180541 - RNA, 22 nt, Human
agcuugcccuuguaccagccag

SEQ ID NO: 180542 - RNA, 22 nt, Human
agcuguaacagguuaauaugga

SEQ ID NO: 180543 - RNA, 22 nt, Human
agcuggaaucucggcaaagcgu

SEQ ID NO: 180544 - RNA, 22 nt, Human
agcugcuuuacuggucggcugg

SEQ ID NO: 180545 - RNA, 22 nt, Human
aggaaagacgcauuucuguagg

SEQ ID NO: 180546 - RNA, 22 nt, Human
agcugcuggcggauguuggacu

SEQ ID NO: 180547 - RNA, 22 nt, Human
agcugaggccccgcagcagggu

SEQ ID NO: 180548 - RNA, 22 nt, Human
agcuuugucccaagugcucugg

SEQ ID NO: 180549 - RNA, 22 nt, Human
agcuuugcccaaugaguuaugu

SEQ ID NO: 180550 - RNA, 22 nt, Human
aggagaaagaccagccugccga

SEQ ID NO: 180551 - RNA, 22 nt, Human
aggacuggucucuuuucuccaa

SEQ ID NO: 180552 - RNA, 22 nt, Human
aggacauuugcuuuuuuucuuu

SEQ ID NO: 180553 - RNA, 22 nt, Human
aggauaaaugggucauuaggca

SEQ ID NO: 180554 - RNA, 23 nt, Human
aggaagucugacacuacagcguu

SEQ ID NO: 180555 - RNA, 22 nt, Human
aggaagucucucaaaacuggaa

SEQ ID NO: 180556 - RNA, 22 nt, Human
aggaaguucuggaauuacuagg

SEQ ID NO: 180557 - RNA, 22 nt, Human
aggagagaacaagaguauccug

SEQ ID NO: 180558 - RNA, 22 nt, Human
aggagacaguuuggacguguag

SEQ ID NO: 180559 - RNA, 22 nt, Human
aggacagagggaccagagccca

SEQ ID NO: 180560 - RNA, 22 nt, Human
aggacacuuccugaguggacaa

SEQ ID NO: 180561 - RNA, 20 nt, Human
aggaaggagaaucugagcaa

SEQ ID NO: 180562 - RNA, 22 nt, Human
aggaaaguugcuuguagugcug

SEQ ID NO: 180563 - RNA, 22 nt, Human
aggaaaauggaccagaguuguu

SEQ ID NO: 180564 - RNA, 22 nt, Human
aggaagccuggaguccugccca

SEQ ID NO: 180565 - RNA, 19 nt, Human
aggaaggggauaaguaaca

SEQ ID NO: 180566 - RNA, 22 nt, Human
aggaagagcuggaccagaggac

SEQ ID NO: 180567 - RNA, 20 nt, Human
aggaagauccuuucuuuuaa

SEQ ID NO: 180568 - RNA, 22 nt, Human
aggaagaagggacagaauuuug

SEQ ID NO: 180569 - RNA, 22 nt, Human
agcuuugcugcuggagaagggu

SEQ ID NO: 180570 - RNA, 22 nt, Human
aggaaaaagaagaaaagaauca

SEQ ID NO: 180571 - RNA, 22 nt, Human
aggaaaaugaaggaagugggaa

SEQ ID NO: 180572 - RNA, 22 nt, Human
agcuuucuauauaugaguugcu

SEQ ID NO: 180573 - RNA, 22 nt, Human
agcuuggcaagcacuguuugag

SEQ ID NO: 180574 - RNA, 22 nt, Human
agcuugaaccuaaaacaauaau

SEQ ID NO: 180575 - RNA, 22 nt, Human
aggaaaguugagcugucuguag

SEQ ID NO: 180576 - RNA, 22 nt, Human
aggaaauaggaccagacaaagc

SEQ ID NO: 180577 - RNA, 22 nt, Human
agcuggauuaaucacagugacu

SEQ ID NO: 180578 - RNA, 22 nt, Human
aggaacaguuucaaagagugaa

SEQ ID NO: 180579 - RNA, 22 nt, Human
aggaaauaguuuagucccaaaa

SEQ ID NO: 180580 - RNA, 22 nt, Human
agcuucccaggagaucuccgcc

SEQ ID NO: 180581 - RNA, 22 nt, Human
agcugugaccuucaagagcuac

SEQ ID NO: 180582 - RNA, 22 nt, Human
agcugugccuauucguggcaag

SEQ ID NO: 180583 - RNA, 22 nt, Human
agcugugaccaguuacgaaauu

SEQ ID NO: 180584 - RNA, 20 nt, Human
agcuggcccccgguggccug

SEQ ID NO: 180585 - RNA, 22 nt, Human
aggugcacugguacaggcuuca

SEQ ID NO: 180586 - RNA, 22 nt, Human
agguauuuuaugucgugugaug

SEQ ID NO: 180587 - RNA, 22 nt, Human
agguaguacuuuuuagagugca

SEQ ID NO: 180588 - RNA, 22 nt, Human
aggucggcuuuuuuccuuucac

SEQ ID NO: 180589 - RNA, 22 nt, Human
agguccugucuuaucucuguaa

SEQ ID NO: 180590 - RNA, 22 nt, Human
agguagaaggaccagaauuuau

SEQ ID NO: 180591 - RNA, 22 nt, Human
agguaugucccccgagugcagc

SEQ ID NO: 180592 - RNA, 22 nt, Human
agguaagaagugagcaaguuua

SEQ ID NO: 180593 - RNA, 22 nt, Human
aggggguugcgcaggggcuccc

SEQ ID NO: 180594 - RNA, 22 nt, Human
agggggccucucccgcggcgcc

SEQ ID NO: 180595 - RNA, 22 nt, Human
aggguuuucauauauuauuagu

SEQ ID NO: 180596 - RNA, 22 nt, Human
aggguggcuggaguggucuggu

SEQ ID NO: 180597 - RNA, 22 nt, Human
aggguuacuuauuuuggauagu

SEQ ID NO: 180598 - RNA, 22 nt, Human
agguaguagagaacucugcucu

SEQ ID NO: 180599 - RNA, 21 nt, Human
agguagauagccccaggaagg

SEQ ID NO: 180600 - RNA, 22 nt, Human
aggggcuuguggaguugcuggu

SEQ ID NO: 180601 - RNA, 22 nt, Human
aggggcugugucauuuguccua

SEQ ID NO: 180602 - RNA, 18 nt, Human
agggggaagccaggagga

SEQ ID NO: 180603 - RNA, 22 nt, Human
agggggaaaauguggauuaugg

SEQ ID NO: 180604 - RNA, 22 nt, Human
agggggcaugaaauaaaggaaa

SEQ ID NO: 180605 - RNA, 22 nt, Human
aggggaagagugagguuuuggu

SEQ ID NO: 180606 - RNA, 22 nt, Human
aggggagaguuaaugugaaugu

SEQ ID NO: 180607 - RNA, 22 nt, Human
agggcugcugcuccgggcccag

SEQ ID NO: 180608 - RNA, 22 nt, Human
agggcguacuuucgccccuccu

SEQ ID NO: 180609 - RNA, 22 nt, Human
agggaaguucuagggagucugg

SEQ ID NO: 180610 - RNA, 19 nt, Human
agggagagucccaagagaa

SEQ ID NO: 180611 - RNA, 22 nt, Human
agggagcagcuagagggggucc

SEQ ID NO: 180612 - RNA, 22 nt, Human
agggaaauuaaugugagcaaug

SEQ ID NO: 180613 - RNA, 20 nt, Human
agggauuugguugguauugu

SEQ ID NO: 180614 - RNA, 22 nt, Human
agggcgugguggugcuggagca

SEQ ID NO: 180615 - RNA, 22 nt, Human
agggcggucccugagacucucc

SEQ ID NO: 180616 - RNA, 22 nt, Human
aggcugcuggcaggcguggacg

SEQ ID NO: 180617 - RNA, 22 nt, Human
aggcugggaaguguguccugag

SEQ ID NO: 180618 - RNA, 22 nt, Human
aggcugccuaugaaggcagaag

SEQ ID NO: 180619 - RNA, 23 nt, Human
aggcugccacucagggugaggcu

SEQ ID NO: 180620 - RNA, 22 nt, Human
aggcggguuuaggacaaugcuu

SEQ ID NO: 180621 - RNA, 22 nt, Human
agggaagaggaccagagucucu

SEQ ID NO: 180622 - RNA, 22 nt, Human
aggccgguggaggagguggagg

SEQ ID NO: 180623 - RNA, 22 nt, Human
aggcgaagggaccagacgguag

SEQ ID NO: 180624 - RNA, 22 nt, Human
aggccugcccuuggggagccuu

SEQ ID NO: 180625 - RNA, 22 nt, Human
agggaagagaaacaaagauuca

SEQ ID NO: 180626 - RNA, 18 nt, Human
aggcuggggaucacaggg

SEQ ID NO: 180627 - RNA, 22 nt, Human
aggcugcucucgccggcggugu

SEQ ID NO: 180628 - RNA, 22 nt, Human
aggcugucucaccucaggaggg

SEQ ID NO: 180629 - RNA, 21 nt, Human
aggcuuggaucuagacaggcc

SEQ ID NO: 180630 - RNA, 22 nt, Human
aggcuucaaggacagcagccac

SEQ ID NO: 180631 - RNA, 22 nt, Human
agggaguuccgaucugugcacc

SEQ ID NO: 180632 - RNA, 22 nt, Human
agggaggcccagcagacuggcg

SEQ ID NO: 180633 - RNA, 22 nt, Human
aggcgagcgcggccggugcccc

SEQ ID NO: 180634 - RNA, 22 nt, Human
aggccugcuccucuucucaucc

SEQ ID NO: 180635 - RNA, 22 nt, Human
aggccgcuggggcagcgcccga

SEQ ID NO: 180636 - RNA, 22 nt, Human
aggccugaggaccagauaaaug

SEQ ID NO: 180637 - RNA, 23 nt, Human
aggcugcagaagaauagggucau

SEQ ID NO: 180638 - RNA, 22 nt, Human
aggcucagcaucugauucauau

SEQ ID NO: 180639 - RNA, 22 nt, Human
aggcugaagcacacucaugcag

SEQ ID NO: 180640 - RNA, 22 nt, Human
aggcgguuggcuuugucugggu

SEQ ID NO: 180641 - RNA, 22 nt, Human
aggaugagugaagagguaaauu

SEQ ID NO: 180642 - RNA, 22 nt, Human
aggauggaaguaacuggauaau

SEQ ID NO: 180643 - RNA, 22 nt, Human
aggauggauagcaaggaagccg

SEQ ID NO: 180644 - RNA, 19 nt, Human
aggagacuacuucuugcug

SEQ ID NO: 180645 - RNA, 22 nt, Human
aggccagugcagcuggaacaga

SEQ ID NO: 180646 - RNA, 22 nt, Human
aggagguagggugugaaacagc

SEQ ID NO: 180647 - RNA, 22 nt, Human
aggaggcucucagguccucccc

SEQ ID NO: 180648 - RNA, 20 nt, Human
aggccgcccgcugccgcuuc

SEQ ID NO: 180649 - RNA, 22 nt, Human
aggccgagaugacagagccacu

SEQ ID NO: 180650 - RNA, 22 nt, Human
agguuagcuguaugucuguaaa

SEQ ID NO: 180651 - RNA, 22 nt, Human
agguuaggaggggagugccaca

SEQ ID NO: 180652 - RNA, 20 nt, Human
agguugguuuacuagucugu

SEQ ID NO: 180653 - RNA, 22 nt, Human
agguuuggguucauugcuggcu

SEQ ID NO: 180654 - RNA, 18 nt, Human
agguuguguaaaaagaag

SEQ ID NO: 180655 - RNA, 22 nt, Human
aggugugcacccggucgcuucc

SEQ ID NO: 180656 - RNA, 22 nt, Human
agguuaaaagagugaguggaua

SEQ ID NO: 180657 - RNA, 22 nt, Human
agguuaauaugaacagcagaag

SEQ ID NO: 180658 - RNA, 22 nt, Human
agguuaaacuuccugcagggcu

SEQ ID NO: 180659 - RNA, 18 nt, Human
aguaaauguuaaauauug

SEQ ID NO: 180660 - RNA, 19 nt, Human
aguaaagugguggcauuuu

SEQ ID NO: 180661 - RNA, 22 nt, Human
agguuuuagaagcugaagccaa

SEQ ID NO: 180662 - RNA, 22 nt, Human
agguuuuacuuuuuuuggaggu

SEQ ID NO: 180663 - RNA, 22 nt, Human
agguuuuagagagccaggaugu

SEQ ID NO: 180664 - RNA, 22 nt, Human
agguuuuugucauuuucuggua

SEQ ID NO: 180665 - RNA, 22 nt, Human
agguggggacuccaccgaugcu

SEQ ID NO: 180666 - RNA, 22 nt, Human
agguggucccaauggcugggca

SEQ ID NO: 180667 - RNA, 22 nt, Human
aggugagaacguggaggggcgg

SEQ ID NO: 180668 - RNA, 22 nt, Human
aggugcuugcauacugcuugac

SEQ ID NO: 180669 - RNA, 22 nt, Human
aggugcagcugguggagucugg

SEQ ID NO: 180670 - RNA, 22 nt, Human
aguagucacuucacccauccca

SEQ ID NO: 180671 - RNA, 22 nt, Human
aguauagacaucaaacugaaga

SEQ ID NO: 180672 - RNA, 22 nt, Human
aguaagaaagaaugauaggccu

SEQ ID NO: 180673 - RNA, 22 nt, Human
aguaucugccagaaucucaguu

SEQ ID NO: 180674 - RNA, 23 nt, Human
aguaucuugguguggugcagaga

SEQ ID NO: 180675 - RNA, 22 nt, Human
aguauaagugaugcuaucuucu

SEQ ID NO: 180676 - RNA, 22 nt, Human
aguauuggauauaaucuaggaa

SEQ ID NO: 180677 - RNA, 22 nt, Human
aguauucaguuagugagcuaag

SEQ ID NO: 180678 - RNA, 22 nt, Human
aguauggaauuuuuaaugacag

SEQ ID NO: 180679 - RNA, 22 nt, Human
aguaucgcuuuguaucaugagg

SEQ ID NO: 180680 - RNA, 22 nt, Human
aguauccauccugcuguuucua

SEQ ID NO: 180681 - RNA, 22 nt, Human
aguaugcuggcaccuuugagug

SEQ ID NO: 180682 - RNA, 19 nt, Human
aguauuggcagguccugua

SEQ ID NO: 180683 - RNA, 22 nt, Human
aguauugguaaguguagcaaau

SEQ ID NO: 180684 - RNA, 22 nt, Human
agucaaaaaaccuagaaacacc

SEQ ID NO: 180685 - RNA, 22 nt, Human
aguauuuuaaaauacauuaucc

SEQ ID NO: 180686 - RNA, 22 nt, Human
aguauuuaguauucuauauuag

SEQ ID NO: 180687 - RNA, 22 nt, Human
aguauuuucuuuaguuuguuag

SEQ ID NO: 180688 - RNA, 21 nt, Human
agucaagcugccugcuuggca

SEQ ID NO: 180689 - RNA, 22 nt, Human
agucacuguucugucaugucaa

SEQ ID NO: 180690 - RNA, 22 nt, Human
agucaccuacagcucaugcuuc

SEQ ID NO: 180691 - RNA, 22 nt, Human
agucagaaggugucagaucuug

SEQ ID NO: 180692 - RNA, 22 nt, Human
agucagcuugucucuaggguug

SEQ ID NO: 180693 - RNA, 22 nt, Human
agucaggggaucuagacuugaa

SEQ ID NO: 180694 - RNA, 22 nt, Human
agucaacauuugagaugcaaug

SEQ ID NO: 180695 - RNA, 22 nt, Human
agucacuguuuaaucuagcuaa

SEQ ID NO: 180696 - RNA, 22 nt, Human
agucacacagccugacaaugga

SEQ ID NO: 180697 - RNA, 22 nt, Human
agucaagguggaccagaaaaau

SEQ ID NO: 180698 - RNA, 22 nt, Human
agucaguguagaaagcccaggc

SEQ ID NO: 180699 - RNA, 22 nt, Human
agucaguaugacuuauaguucu

SEQ ID NO: 180700 - RNA, 22 nt, Human
agucaguaucuucugggcggua

SEQ ID NO: 180701 - RNA, 22 nt, Human
agucaggacagauuuucugggg

SEQ ID NO: 180702 - RNA, 22 nt, Human
agucccugauggacuggaugag

SEQ ID NO: 180703 - RNA, 22 nt, Human
agucauuugucauuuuuuugag

SEQ ID NO: 180704 - RNA, 18 nt, Human
agucauguuuuagucacu

SEQ ID NO: 180705 - RNA, 22 nt, Human
aguccagggcuuagucagcggg

SEQ ID NO: 180706 - RNA, 22 nt, Human
agucauuugaggcaugauuaug

SEQ ID NO: 180707 - RNA, 22 nt, Human
agucauuguguucaguaaaauc

SEQ ID NO: 180708 - RNA, 21 nt, Human
agugaagagugggcuugauca

SEQ ID NO: 180709 - RNA, 22 nt, Human
agucugugguccucuguaucuc

SEQ ID NO: 180710 - RNA, 20 nt, Human
agucuuaucugcauuuagaa

SEQ ID NO: 180711 - RNA, 22 nt, Human
agucggguugcagacacauccu

SEQ ID NO: 180712 - RNA, 22 nt, Human
agucuauacuucccaguugaca

SEQ ID NO: 180713 - RNA, 22 nt, Human
agucuagcuguguuuugagcug

SEQ ID NO: 180714 - RNA, 22 nt, Human
agucggggagcgugaccagaga

SEQ ID NO: 180715 - RNA, 22 nt, Human
agucggauuucccagguuauug

SEQ ID NO: 180716 - RNA, 23 nt, Human
auacuuuuuuucuacguuaucuc

SEQ ID NO: 180717 - RNA, 18 nt, Human
auagacaggaaaaaugga

SEQ ID NO: 180718 - RNA, 22 nt, Human
auagacacagcuaugauuugag

SEQ ID NO: 180719 - RNA, 20 nt, Human
auacuuguuuucaggcuuuu

SEQ ID NO: 180720 - RNA, 22 nt, Human
agugagcuuuuaaaauuuacca

SEQ ID NO: 180721 - RNA, 22 nt, Human
agugagcauuagugcuuauauu

SEQ ID NO: 180722 - RNA, 21 nt, Human
agugagauuuaugccugguuc

SEQ ID NO: 180723 - RNA, 22 nt, Human
auagauguauucauuguuuggc

SEQ ID NO: 180724 - RNA, 22 nt, Human
auagauuuuaucagauuuuauc

SEQ ID NO: 180725 - RNA, 22 nt, Human
auagauugcucauauauuacuu

SEQ ID NO: 180726 - RNA, 22 nt, Human
auagaguucucuuuggaggagu

SEQ ID NO: 180727 - RNA, 22 nt, Human
auaccaaugaaucccugagaau

SEQ ID NO: 180728 - RNA, 21 nt, Human
auaccaaaagaacaccuuguu

SEQ ID NO: 180729 - RNA, 22 nt, Human
auagaguguguguuauguguga

SEQ ID NO: 180730 - RNA, 22 nt, Human
auagacuagccaaagacuucug

SEQ ID NO: 180731 - RNA, 22 nt, Human
auacaggcaguaagauucucag

SEQ ID NO: 180732 - RNA, 21 nt, Human
auacaguucagcuuuuacuau

SEQ ID NO: 180733 - RNA, 22 nt, Human
auagaaauagacaaugcaaaga

SEQ ID NO: 180734 - RNA, 22 nt, Human
auacuaagcucauuacauuuug

SEQ ID NO: 180735 - RNA, 22 nt, Human
auaggcauaacacugauguccu

SEQ ID NO: 180736 - RNA, 22 nt, Human
auagggaggcggagggagcugg

SEQ ID NO: 180737 - RNA, 22 nt, Human
auaggggagcagccagagaaga

SEQ ID NO: 180738 - RNA, 22 nt, Human
auaguaaauguuaacagcaaca

SEQ ID NO: 180739 - RNA, 22 nt, Human
auagaauggcaccagcaucuac

SEQ ID NO: 180740 - RNA, 22 nt, Human
auagagcuggggaagaagcugg

SEQ ID NO: 180741 - RNA, 22 nt, Human
auaguuuuagauacugagaaaa

SEQ ID NO: 180742 - RNA, 22 nt, Human
auaguguguaaagugcagugau

SEQ ID NO: 180743 - RNA, 23 nt, Human
auagucaggaacuguuggugugu

SEQ ID NO: 180744 - RNA, 22 nt, Human
auauaaugcaguaggugauuaa

SEQ ID NO: 180745 - RNA, 22 nt, Human
auauaagauaauaacuuuuuua

SEQ ID NO: 180746 - RNA, 20 nt, Human
auagaguggugugucacauu

SEQ ID NO: 180747 - RNA, 22 nt, Human
auauaacccaaggcaggcugug

SEQ ID NO: 180748 - RNA, 22 nt, Human
auaucugaugacgugacuaugu

SEQ ID NO: 180749 - RNA, 22 nt, Human
auaucuuguuuuugauuucuug

SEQ ID NO: 180750 - RNA, 22 nt, Human
auaugaagaaugaucugaagua

SEQ ID NO: 180751 - RNA, 22 nt, Human
auaugcacauguacauguauau

SEQ ID NO: 180752 - RNA, 22 nt, Human
auaugagaggaggagcaucagu

SEQ ID NO: 180753 - RNA, 22 nt, Human
auaggcggagccauaucaucca

SEQ ID NO: 180754 - RNA, 22 nt, Human
auagcuauuauuauuucuguua

SEQ ID NO: 180755 - RNA, 22 nt, Human
auagcaguauuaugagauaacu

SEQ ID NO: 180756 - RNA, 22 nt, Human
auauauguauauacacauauau

SEQ ID NO: 180757 - RNA, 22 nt, Human
auauaugcaacaagaaagcaua

SEQ ID NO: 180758 - RNA, 22 nt, Human
auagaugaggaaauucaggugc

SEQ ID NO: 180759 - RNA, 22 nt, Human
auagaugacaguuaggaagcug

SEQ ID NO: 180760 - RNA, 22 nt, Human
auauaguacauguauauauaua

SEQ ID NO: 180761 - RNA, 22 nt, Human
auagcaacucugcuuccuugcc

SEQ ID NO: 180762 - RNA, 19 nt, Human
auagagggaauguuuuccu

SEQ ID NO: 180763 - RNA, 22 nt, Human
auaugcagaaaauaaaggaauu

SEQ ID NO: 180764 - RNA, 22 nt, Human
auauggugauuuuaugcaggaa

SEQ ID NO: 180765 - RNA, 21 nt, Human
auauuguugggguuuucuuuu

SEQ ID NO: 180766 - RNA, 22 nt, Human
auauuucuacaggcugauuuua

SEQ ID NO: 180767 - RNA, 23 nt, Human
auaugucaugcaccagcacuuua

SEQ ID NO: 180768 - RNA, 22 nt, Human
auauguaguuucagaaguggaa

SEQ ID NO: 180769 - RNA, 22 nt, Human
auauuuguuagcugcuuuggag

SEQ ID NO: 180770 - RNA, 21 nt, Human
auauggauauuauuuuguguc

SEQ ID NO: 180771 - RNA, 22 nt, Human
auauaaugugugcuuuauugaa

SEQ ID NO: 180772 - RNA, 22 nt, Human
auauaguuggguuucauucuac

SEQ ID NO: 180773 - RNA, 22 nt, Human
auauauguauauaugugugugu

SEQ ID NO: 180774 - RNA, 22 nt, Human
auauccugguucuaucaaaagg

SEQ ID NO: 180775 - RNA, 22 nt, Human
auauguuaugccauuuucaagg

SEQ ID NO: 180776 - RNA, 22 nt, Human
auauuauuaaaauagauggaua

SEQ ID NO: 180777 - RNA, 22 nt, Human
auauucaaugaggucauauaag

SEQ ID NO: 180778 - RNA, 23 nt, Human
aucauuucuuagugagucccugc

SEQ ID NO: 180779 - RNA, 22 nt, Human
aucauuugaacagaauuuguuu

SEQ ID NO: 180780 - RNA, 22 nt, Human
aucaugugacuagguuuggcca

SEQ ID NO: 180781 - RNA, 22 nt, Human
auccucugcucaugagaaaugu

SEQ ID NO: 180782 - RNA, 22 nt, Human
auccaggguuggggucacgagu

SEQ ID NO: 180783 - RNA, 22 nt, Human
auccuccuuugcccugagauca

SEQ ID NO: 180784 - RNA, 22 nt, Human
auccgugagcgagcgagcaccc

SEQ ID NO: 180785 - RNA, 22 nt, Human
aucagugcacgcgaugggcaga

SEQ ID NO: 180786 - RNA, 22 nt, Human
aucauugaaaauuuaugcauuu

SEQ ID NO: 180787 - RNA, 20 nt, Human
aucaggagucgcggggagag

SEQ ID NO: 180788 - RNA, 22 nt, Human
aucauugcuaguaaggaucuug

SEQ ID NO: 180789 - RNA, 22 nt, Human
auccacccugcaggccaacucu

SEQ ID NO: 180790 - RNA, 22 nt, Human
aucauuuggaaauuuggccuaa

SEQ ID NO: 180791 - RNA, 22 nt, Human
auccagaaguauuuuggguacu

SEQ ID NO: 180792 - RNA, 22 nt, Human
aucaugcgguuaaggagugugu

SEQ ID NO: 180793 - RNA, 22 nt, Human
aucaugggauagugggacgagc

SEQ ID NO: 180794 - RNA, 22 nt, Human
aucaugcugacacaguuuaucu

SEQ ID NO: 180795 - RNA, 22 nt, Human
aucccuggccacgaagcugccc

SEQ ID NO: 180796 - RNA, 22 nt, Human
aucuaaaacuacgaauacuacc

SEQ ID NO: 180797 - RNA, 23 nt, Human
aucgcccggguccagucccggcu

SEQ ID NO: 180798 - RNA, 22 nt, Human
aucggucuccuauaauucaaac

SEQ ID NO: 180799 - RNA, 22 nt, Human
aucguggcacgucgccgcagcg

SEQ ID NO: 180800 - RNA, 22 nt, Human
aucguuaugauagagaaagaga

SEQ ID NO: 180801 - RNA, 22 nt, Human
auccugauggaaacugguauga

SEQ ID NO: 180802 - RNA, 22 nt, Human
auccuccuggggcagucuuccc

SEQ ID NO: 180803 - RNA, 22 nt, Human
auccucaaggaauuaaauaggg

SEQ ID NO: 180804 - RNA, 22 nt, Human
auccuucaaaaggaauagcagg

SEQ ID NO: 180805 - RNA, 22 nt, Human
auccuugacuguagugauauua

SEQ ID NO: 180806 - RNA, 20 nt, Human
auccuggucuuuggaagcuu

SEQ ID NO: 180807 - RNA, 22 nt, Human
aucauuuuuauuagcugggguu

SEQ ID NO: 180808 - RNA, 22 nt, Human
auccacggucaauuccccaucc

SEQ ID NO: 180809 - RNA, 22 nt, Human
auccaggggucugaauggauau

SEQ ID NO: 180810 - RNA, 20 nt, Human
aucaugugcacugcugacag

SEQ ID NO: 180811 - RNA, 17 nt, Human
aucagaggauaggacaa

SEQ ID NO: 180812 - RNA, 22 nt, Human
aucauguauauuuuugcuauua

SEQ ID NO: 180813 - RNA, 22 nt, Human
aucauuaacagugcagggguag

SEQ ID NO: 180814 - RNA, 22 nt, Human
aucauguuauguacaaauauga

SEQ ID NO: 180815 - RNA, 22 nt, Human
aucagagcuaguacuugcaggu

SEQ ID NO: 180816 - RNA, 19 nt, Human
aucagcaguuuugccugga

SEQ ID NO: 180817 - RNA, 22 nt, Human
aucaucuaaaauuggcucagau

SEQ ID NO: 180818 - RNA, 22 nt, Human
aucacacaccuguuaaauugug

SEQ ID NO: 180819 - RNA, 22 nt, Human
aucaucccuuucucccagugaa

SEQ ID NO: 180820 - RNA, 22 nt, Human
aucauccuagaaggaagcuagg

SEQ ID NO: 180821 - RNA, 22 nt, Human
aucauaugugauaccauaauga

SEQ ID NO: 180822 - RNA, 22 nt, Human
aucacaaauggaaucaccuccc

SEQ ID NO: 180823 - RNA, 22 nt, Human
aucagcucuugaugccuuucuu

SEQ ID NO: 180824 - RNA, 22 nt, Human
aucaauaaccauagugguuaca

SEQ ID NO: 180825 - RNA, 22 nt, Human
aucagaagaaauggaugugacu

SEQ ID NO: 180826 - RNA, 21 nt, Human
aucagaaucucuagauuugga

SEQ ID NO: 180827 - RNA, 22 nt, Human
aucaaaauguguagucuugauc

SEQ ID NO: 180828 - RNA, 22 nt, Human
auauuuuugcagaauuuuucgu

SEQ ID NO: 180829 - RNA, 22 nt, Human
auauuuuacagcucucguugaa

SEQ ID NO: 180830 - RNA, 22 nt, Human
aucaaguuauuaaguagcuuuc

SEQ ID NO: 180831 - RNA, 22 nt, Human
auauuugcccccaugcccuggc

SEQ ID NO: 180832 - RNA, 22 nt, Human
auauuuguacagcuugugaguu

SEQ ID NO: 180833 - RNA, 20 nt, Human
aucaagugucuugccaggca

SEQ ID NO: 180834 - RNA, 22 nt, Human
aucaacucacagugugcuggca

SEQ ID NO: 180835 - RNA, 22 nt, Human
auauuugucuguuuuaguggca

SEQ ID NO: 180836 - RNA, 22 nt, Human
aucaaaauuuucagauacuaca

SEQ ID NO: 180837 - RNA, 22 nt, Human
auauugcuuuauucuugaauau

SEQ ID NO: 180838 - RNA, 22 nt, Human
auauugagagagugagguguag

SEQ ID NO: 180839 - RNA, 22 nt, Human
auauuguagcaucacugucuug

SEQ ID NO: 180840 - RNA, 21 nt, Human
auauugguaucuuuuuaaauc

SEQ ID NO: 180841 - RNA, 22 nt, Human
augugagcuggaugaauuuaua

SEQ ID NO: 180842 - RNA, 22 nt, Human
augugacaagugugggcagggc

SEQ ID NO: 180843 - RNA, 22 nt, Human
augguugggggaugucagcagg

SEQ ID NO: 180844 - RNA, 22 nt, Human
augguugccugagauaagacug

SEQ ID NO: 180845 - RNA, 22 nt, Human
auggcucugcugggcaaagcaa

SEQ ID NO: 180846 - RNA, 22 nt, Human
auguaaauauuuauauaugcau

SEQ ID NO: 180847 - RNA, 22 nt, Human
augguuuuguccucuuugguuc

SEQ ID NO: 180848 - RNA, 22 nt, Human
auguauauauacauguauugua

SEQ ID NO: 180849 - RNA, 22 nt, Human
auguaacauaugugaucgcauu

SEQ ID NO: 180850 - RNA, 22 nt, Human
augguugugaaagagcaaagac

SEQ ID NO: 180851 - RNA, 22 nt, Human
augguuagauggaugagaugug

SEQ ID NO: 180852 - RNA, 22 nt, Human
augguuacgcccucacccuacc

SEQ ID NO: 180853 - RNA, 20 nt, Human
auggcgagucagcacaaaac

SEQ ID NO: 180854 - RNA, 18 nt, Human
auggcuccagugucuucc

SEQ ID NO: 180855 - RNA, 22 nt, Human
auggccguggccagggucaggg

SEQ ID NO: 180856 - RNA, 22 nt, Human
auggccuguuuccucugaaaga

SEQ ID NO: 180857 - RNA, 22 nt, Human
auggccuuucucaguggugcuu

SEQ ID NO: 180858 - RNA, 22 nt, Human
auggcuucugucuuggaaauuu

SEQ ID NO: 180859 - RNA, 22 nt, Human
auggcuguguuguuccucugaa

SEQ ID NO: 180860 - RNA, 21 nt, Human
auguguucugauagugcuugc

SEQ ID NO: 180861 - RNA, 22 nt, Human
auguguuuccaacagagaggga

SEQ ID NO: 180862 - RNA, 22 nt, Human
auguuuuaaaaaacaggcuacc

SEQ ID NO: 180863 - RNA, 22 nt, Human
auguguuuugaccccugcuaaa

SEQ ID NO: 180864 - RNA, 22 nt, Human
auguuagcaucuggcacuaugg

SEQ ID NO: 180865 - RNA, 22 nt, Human
augugaaccuggguccugggcc

SEQ ID NO: 180866 - RNA, 22 nt, Human
augugggugaggaggccauugu

SEQ ID NO: 180867 - RNA, 22 nt, Human
auguggaaagcuugucuuagag

SEQ ID NO: 180868 - RNA, 22 nt, Human
augugaaauuugggcucuggga

SEQ ID NO: 180869 - RNA, 19 nt, Human
auguucugaauuacuguaa

SEQ ID NO: 180870 - RNA, 22 nt, Human
auguugagaaucucucuucuaa

SEQ ID NO: 180871 - RNA, 22 nt, Human
augugcauguauguaucauauu

SEQ ID NO: 180872 - RNA, 22 nt, Human
augguuuugugaaaaugcuuug

SEQ ID NO: 180873 - RNA, 20 nt, Human
augucaggaagggagucagg

SEQ ID NO: 180874 - RNA, 22 nt, Human
auguauuuauguauguguuaua

SEQ ID NO: 180875 - RNA, 22 nt, Human
augugaaagagguguucagugg

SEQ ID NO: 180876 - RNA, 22 nt, Human
auguucccaaaaucccuguaga

SEQ ID NO: 180877 - RNA, 22 nt, Human
auguucucagguuguauuuauu

SEQ ID NO: 180878 - RNA, 18 nt, Human
auguuccugcaguuauuu

SEQ ID NO: 180879 - RNA, 22 nt, Human
auguuccaugacuaugcaugaa

SEQ ID NO: 180880 - RNA, 22 nt, Human
auuaagacugcccauguuuuua

SEQ ID NO: 180881 - RNA, 22 nt, Human
auuaagucugacuggauuguau

SEQ ID NO: 180882 - RNA, 20 nt, Human
auuaauuuuuagggcucacc

SEQ ID NO: 180883 - RNA, 22 nt, Human
auuacagauuauaaauuugagc

SEQ ID NO: 180884 - RNA, 22 nt, Human
auuaauguguaugauauaaauu

SEQ ID NO: 180885 - RNA, 22 nt, Human
auguuuuuugaaaauguauuuu

SEQ ID NO: 180886 - RNA, 22 nt, Human
auuaugaauuguguuacgaaga

SEQ ID NO: 180887 - RNA, 22 nt, Human
auguuuugaguuuuuuuacacc

SEQ ID NO: 180888 - RNA, 22 nt, Human
auguuuuauacacauguaucac

SEQ ID NO: 180889 - RNA, 22 nt, Human
auguuuucauuuagaagcuaau

SEQ ID NO: 180890 - RNA, 22 nt, Human
auuauacauuaggagauugauu

SEQ ID NO: 180891 - RNA, 22 nt, Human
auguuugugauugcugaaaaga

SEQ ID NO: 180892 - RNA, 22 nt, Human
auucaggacucuuccuugaaga

SEQ ID NO: 180893 - RNA, 22 nt, Human
auucaguucuaaggucagugcc

SEQ ID NO: 180894 - RNA, 22 nt, Human
auucauuuuuacaucaccaaua

SEQ ID NO: 180895 - RNA, 17 nt, Human
auucaugaacauguccu

SEQ ID NO: 180896 - RNA, 22 nt, Human
auucaucuguacuucaauaucu

SEQ ID NO: 180897 - RNA, 22 nt, Human
auuaaguuauuaagcuaaauau

SEQ ID NO: 180898 - RNA, 22 nt, Human
auuccagggaaauggggaugga

SEQ ID NO: 180899 - RNA, 22 nt, Human
auuccauccuggcuuuuuccug

SEQ ID NO: 180900 - RNA, 22 nt, Human
auuaguccuaguucauucugag

SEQ ID NO: 180901 - RNA, 22 nt, Human
auuaaaaaugagaguagggauu

SEQ ID NO: 180902 - RNA, 22 nt, Human
auuaacaggcucuguucuaguu

SEQ ID NO: 180903 - RNA, 22 nt, Human
auuauuugcuuaagcuggucuc

SEQ ID NO: 180904 - RNA, 22 nt, Human
auuauggacuuucuuguuuggg

SEQ ID NO: 180905 - RNA, 23 nt, Human
auuauuucaggguuuugacuugc

SEQ ID NO: 180906 - RNA, 22 nt, Human
auuaugcagcugccuccaaggu

SEQ ID NO: 180907 - RNA, 22 nt, Human
auuaugugagggacuuaaucau

SEQ ID NO: 180908 - RNA, 22 nt, Human
aucugcugcuccuucuucuugc

SEQ ID NO: 180909 - RNA, 22 nt, Human
augaaaacgugugugugugugu

SEQ ID NO: 180910 - RNA, 23 nt, Human
augaaaugauacuuuauucacug

SEQ ID NO: 180911 - RNA, 22 nt, Human
aucuauguaucucagaagcuag

SEQ ID NO: 180912 - RNA, 22 nt, Human
augaaacucuagcuuucagcac

SEQ ID NO: 180913 - RNA, 22 nt, Human
augagcuaagcagaaagcacac

SEQ ID NO: 180914 - RNA, 22 nt, Human
augacuguuaugaggugggugg

SEQ ID NO: 180915 - RNA, 22 nt, Human
augaggaacagcaagaauauuu

SEQ ID NO: 180916 - RNA, 22 nt, Human
augagaaauaauuguguacuga

SEQ ID NO: 180917 - RNA, 22 nt, Human
aucugucagaccuuggucacag

SEQ ID NO: 180918 - RNA, 19 nt, Human
augagccccaguucguucc

SEQ ID NO: 180919 - RNA, 22 nt, Human
augagaguuagccugcauaguu

SEQ ID NO: 180920 - RNA, 22 nt, Human
augacugaugcugacucauggg

SEQ ID NO: 180921 - RNA, 22 nt, Human
augauuauuugaaugaagagga

SEQ ID NO: 180922 - RNA, 22 nt, Human
augauucuaccaaugccaucuu

SEQ ID NO: 180923 - RNA, 22 nt, Human
augauaucuuguuuuucaugca

SEQ ID NO: 180924 - RNA, 22 nt, Human
augcacuacuagaugcaaaagu

SEQ ID NO: 180925 - RNA, 22 nt, Human
augacagcuaaggaauguguag

SEQ ID NO: 180926 - RNA, 22 nt, Human
augauggagaacaaagaaaauc

SEQ ID NO: 180927 - RNA, 22 nt, Human
augauguuggaauuuuaacuua

SEQ ID NO: 180928 - RNA, 22 nt, Human
augauuaagguacgucauuucu

SEQ ID NO: 180929 - RNA, 22 nt, Human
augaagugcccugggggccaga

SEQ ID NO: 180930 - RNA, 22 nt, Human
augaaugccggucucgggggaa

SEQ ID NO: 180931 - RNA, 22 nt, Human
augaagguggacagauuuuuuu

SEQ ID NO: 180932 - RNA, 22 nt, Human
augaugaugguuuaacuucagg

SEQ ID NO: 180933 - RNA, 22 nt, Human
augaggauuagcaucugcaaau

SEQ ID NO: 180934 - RNA, 22 nt, Human
augaggagucaaggagucggag

SEQ ID NO: 180935 - RNA, 22 nt, Human
augcgcugugcacacucuuaac

SEQ ID NO: 180936 - RNA, 22 nt, Human
augcggcugugggggaauggga

SEQ ID NO: 180937 - RNA, 21 nt, Human
augcgcgguggagugagcgaa

SEQ ID NO: 180938 - RNA, 22 nt, Human
augccugggcuuuaggguucuc

SEQ ID NO: 180939 - RNA, 22 nt, Human
augccugcugucaggaacucuu

SEQ ID NO: 180940 - RNA, 22 nt, Human
augcugugccuggaaagcggcu

SEQ ID NO: 180941 - RNA, 22 nt, Human
augcuucuguugcuuaggaggu

SEQ ID NO: 180942 - RNA, 22 nt, Human
augcugcuccuuuucaggcauu

SEQ ID NO: 180943 - RNA, 22 nt, Human
augcugcuuguccauuuauuug

SEQ ID NO: 180944 - RNA, 22 nt, Human
augcaggcuaagaguaaagacg

SEQ ID NO: 180945 - RNA, 22 nt, Human
augcugccuaaagcuacuuaca

SEQ ID NO: 180946 - RNA, 22 nt, Human
augcuugaaaguuauuucauuu

SEQ ID NO: 180947 - RNA, 18 nt, Human
augcugacacaaugugga

SEQ ID NO: 180948 - RNA, 22 nt, Human
auggccugaagcuaaccccccu

SEQ ID NO: 180949 - RNA, 22 nt, Human
augcuacuugugaaaacccagg

SEQ ID NO: 180950 - RNA, 22 nt, Human
augccucuugagagccagugcu

SEQ ID NO: 180951 - RNA, 22 nt, Human
augccccuuuauauguuaaguc

SEQ ID NO: 180952 - RNA, 22 nt, Human
augccgggguggcuccagcacc

SEQ ID NO: 180953 - RNA, 22 nt, Human
augcacaagguagauuauuauu

SEQ ID NO: 180954 - RNA, 22 nt, Human
augaucacagugucagucauua

SEQ ID NO: 180955 - RNA, 22 nt, Human
augaugauuauucauuuucugu

SEQ ID NO: 180956 - RNA, 22 nt, Human
augaucaagaauuuuguauucc

SEQ ID NO: 180957 - RNA, 22 nt, Human
augcagagacugugggaaagca

SEQ ID NO: 180958 - RNA, 22 nt, Human
augcagauguagauucugaaau

SEQ ID NO: 180959 - RNA, 22 nt, Human
augccccucucucucccaauca

SEQ ID NO: 180960 - RNA, 19 nt, Human
augcacgugaaaugcauuu

SEQ ID NO: 180961 - RNA, 22 nt, Human
augcacuaugaugagcuagucu

SEQ ID NO: 180962 - RNA, 22 nt, Human
augcagaaucucuuuccugagg

SEQ ID NO: 180963 - RNA, 22 nt, Human
augcagcggucagaggaacuca

SEQ ID NO: 180964 - RNA, 22 nt, Human
augcuacauuuugguuuauaaa

SEQ ID NO: 180965 - RNA, 22 nt, Human
augcuaaucaaacuuucugcag

SEQ ID NO: 180966 - RNA, 22 nt, Human
augcuagaaaauuucauauuau

SEQ ID NO: 180967 - RNA, 22 nt, Human
augcugacaacaaagaaggaag

SEQ ID NO: 180968 - RNA, 22 nt, Human
augcucuuaauugcuagauaag

SEQ ID NO: 180969 - RNA, 22 nt, Human
caagagcucccagaccugggca

SEQ ID NO: 180970 - RNA, 20 nt, Human
cacagcugacgaguauccaa

SEQ ID NO: 180971 - RNA, 22 nt, Human
caagaaaaaacaugaugagugu

SEQ ID NO: 180972 - RNA, 22 nt, Human
cacagccaagacuuggccccau

SEQ ID NO: 180973 - RNA, 22 nt, Human
cacagcagcaucauuuaucugg

SEQ ID NO: 180974 - RNA, 22 nt, Human
cacagaggaugcccaagcgauc

SEQ ID NO: 180975 - RNA, 22 nt, Human
cacacguuuagcuucuggcggc

SEQ ID NO: 180976 - RNA, 22 nt, Human
cacauguguaccugccucucug

SEQ ID NO: 180977 - RNA, 22 nt, Human
caagcagauauuuuagucaaga

SEQ ID NO: 180978 - RNA, 22 nt, Human
caagaugcaagaccagucaggc

SEQ ID NO: 180979 - RNA, 22 nt, Human
caagcgcgccgcuuccuuccgc

SEQ ID NO: 180980 - RNA, 22 nt, Human
caagccacugggagcugcacac

SEQ ID NO: 180981 - RNA, 22 nt, Human
cacaguccugcauuuacugccu

SEQ ID NO: 180982 - RNA, 22 nt, Human
cacagucugagcccagccuugu

SEQ ID NO: 180983 - RNA, 22 nt, Human
cacaggacuuggcuucucacag

SEQ ID NO: 180984 - RNA, 23 nt, Human
cacaggcagaaaucaagacggua

SEQ ID NO: 180985 - RNA, 22 nt, Human
caagagguaugagccgggauga

SEQ ID NO: 180986 - RNA, 22 nt, Human
cacauugguagaauuuagaaga

SEQ ID NO: 180987 - RNA, 22 nt, Human
caaggaagguugguugaaggua

SEQ ID NO: 180988 - RNA, 22 nt, Human
caaggggagcugguauggaugg

SEQ ID NO: 180989 - RNA, 22 nt, Human
caaggaguuuggggaccaagga

SEQ ID NO: 180990 - RNA, 22 nt, Human
caccacuuggcccugagguccu

SEQ ID NO: 180991 - RNA, 22 nt, Human
caccaucagacuucugggcagg

SEQ ID NO: 180992 - RNA, 22 nt, Human
caaguaugagaaagcuauuacc

SEQ ID NO: 180993 - RNA, 23 nt, Human
caccaugacaugccuauagggga

SEQ ID NO: 180994 - RNA, 22 nt, Human
caaguauuuauugaggcccugu

SEQ ID NO: 180995 - RNA, 22 nt, Human
caauaguaaucaaugcaguuag

SEQ ID NO: 180996 - RNA, 22 nt, Human
caauaccucuuggugauugggc

SEQ ID NO: 180997 - RNA, 22 nt, Human
caauaauugcuuuccagaguua

SEQ ID NO: 180998 - RNA, 22 nt, Human
caccuggaggcagcaccgggcu

SEQ ID NO: 180999 - RNA, 22 nt, Human
caccugcaaauuccagauuucu

SEQ ID NO: 181000 - RNA, 22 nt, Human
caauccccaggucccagaacag

SEQ ID NO: 181001 - RNA, 22 nt, Human
caccgagagccacuuccggaac

SEQ ID NO: 181002 - RNA, 22 nt, Human
caaagaugccaaaaggaagaca

SEQ ID NO: 181003 - RNA, 22 nt, Human
caaggaaaugucagaaaggcaa

SEQ ID NO: 181004 - RNA, 22 nt, Human
caaggaaaacagaugaucaaca

SEQ ID NO: 181005 - RNA, 22 nt, Human
caagcacaauuucuacauguua

SEQ ID NO: 181006 - RNA, 22 nt, Human
caaagaagagauuuacagagcu

SEQ ID NO: 181007 - RNA, 22 nt, Human
caaaacauucagagagcucacu

SEQ ID NO: 181008 - RNA, 22 nt, Human
caagaaccuagcgaucagguaa

SEQ ID NO: 181009 - RNA, 22 nt, Human
caagagcuuuagaaaugcucau

SEQ ID NO: 181010 - RNA, 22 nt, Human
caagauauguccuguuacuaag

SEQ ID NO: 181011 - RNA, 22 nt, Human
caagaaguugacagccagguga

SEQ ID NO: 181012 - RNA, 22 nt, Human
caaaacccaagugcuauugcaa

SEQ ID NO: 181013 - RNA, 22 nt, Human
caaggcuaagcuuuggcuuucu

SEQ ID NO: 181014 - RNA, 22 nt, Human
caagguauugaggccagugucc

SEQ ID NO: 181015 - RNA, 22 nt, Human
caaagccuggggagaguaagga

SEQ ID NO: 181016 - RNA, 22 nt, Human
caagagcgugugcagggcaagu

SEQ ID NO: 181017 - RNA, 22 nt, Human
caaaggagcccuuugccggguu

SEQ ID NO: 181018 - RNA, 22 nt, Human
caaaggauguguagugcaacca

SEQ ID NO: 181019 - RNA, 22 nt, Human
caaugcacauggacaucaggcu

SEQ ID NO: 181020 - RNA, 22 nt, Human
caaugccaggaaccugggggaa

SEQ ID NO: 181021 - RNA, 22 nt, Human
caaugaaaauuuaaguugcagc

SEQ ID NO: 181022 - RNA, 22 nt, Human
caaauacaaauacgggcagcuu

SEQ ID NO: 181023 - RNA, 22 nt, Human
caaauacguuuggcuggagcac

SEQ ID NO: 181024 - RNA, 22 nt, Human
caauggguuuucuauagagugc

SEQ ID NO: 181025 - RNA, 22 nt, Human
caaaugcaguggucgugcugga

SEQ ID NO: 181026 - RNA, 22 nt, Human
caacguggauucuuccaggggc

SEQ ID NO: 181027 - RNA, 22 nt, Human
cacaacaaaaaauaaguaugag

SEQ ID NO: 181028 - RNA, 22 nt, Human
cacaauuuccauugagcagcag

SEQ ID NO: 181029 - RNA, 22 nt, Human
caauugcuuccuucuguaagua

SEQ ID NO: 181030 - RNA, 22 nt, Human
caacaagcgcucagagcaaagc

SEQ ID NO: 181031 - RNA, 22 nt, Human
caauuaccaguaauugagguuu

SEQ ID NO: 181032 - RNA, 22 nt, Human
auuuuucacauuuugggggaca

SEQ ID NO: 181033 - RNA, 21 nt, Human
auuuuucagaaggaugugaua

SEQ ID NO: 181034 - RNA, 22 nt, Human
auuuuucucucaugugcaacua

SEQ ID NO: 181035 - RNA, 22 nt, Human
auuuuucuuucacauuuucuua

SEQ ID NO: 181036 - RNA, 20 nt, Human
caacacugcccauuguuugc

SEQ ID NO: 181037 - RNA, 22 nt, Human
caacaaguugauuucacgcugc

SEQ ID NO: 181038 - RNA, 22 nt, Human
caacacaucaguucagucuuga

SEQ ID NO: 181039 - RNA, 22 nt, Human
caaccaguagcugaguucaaaa

SEQ ID NO: 181040 - RNA, 22 nt, Human
caacuucuauucagucugcagu

SEQ ID NO: 181041 - RNA, 17 nt, Human
caaccaggaaaggaggg

SEQ ID NO: 181042 - RNA, 22 nt, Human
caaaaaauccauagaaagaggu

SEQ ID NO: 181043 - RNA, 22 nt, Human
caaaagcaaagaucuuugauug

SEQ ID NO: 181044 - RNA, 22 nt, Human
auuuuggguguuaacaaugaaa

SEQ ID NO: 181045 - RNA, 22 nt, Human
caaagagaugcaccauauuucu

SEQ ID NO: 181046 - RNA, 21 nt, Human
auuuguggugcaauuguggua

SEQ ID NO: 181047 - RNA, 22 nt, Human
auuuggucuguaauuacaugga

SEQ ID NO: 181048 - RNA, 22 nt, Human
auuuucgcaccucgcgaguugc

SEQ ID NO: 181049 - RNA, 22 nt, Human
auuuuugugcuuuauuggggua

SEQ ID NO: 181050 - RNA, 22 nt, Human
auuuucuucauuuugauuguau

SEQ ID NO: 181051 - RNA, 22 nt, Human
auuuuugugucacaucuaggaa

SEQ ID NO: 181052 - RNA, 22 nt, Human
auuuuugguuauaaaauaguuu

SEQ ID NO: 181053 - RNA, 22 nt, Human
auuugcaucagugagcgaugug

SEQ ID NO: 181054 - RNA, 22 nt, Human
auuugccaguuacucacaccac

SEQ ID NO: 181055 - RNA, 22 nt, Human
auuuuuaucuaaaauccacuuu

SEQ ID NO: 181056 - RNA, 22 nt, Human
auuugcuuguucaccaguacuu

SEQ ID NO: 181057 - RNA, 18 nt, Human
auuuguggggguuauaga

SEQ ID NO: 181058 - RNA, 22 nt, Human
auuugaaaaucuaugaugugca

SEQ ID NO: 181059 - RNA, 22 nt, Human
auuuuacuaugauaguugagaa

SEQ ID NO: 181060 - RNA, 22 nt, Human
auuuuagagaaacaaacguagg

SEQ ID NO: 181061 - RNA, 22 nt, Human
auuacagaagauaugcucaaca

SEQ ID NO: 181062 - RNA, 22 nt, Human
auuaauaucaauauauuauaug

SEQ ID NO: 181063 - RNA, 22 nt, Human
auuagcaccccuggauguggga

SEQ ID NO: 181064 - RNA, 22 nt, Human
auuacugaggcaaaguaguuuu

SEQ ID NO: 181065 - RNA, 22 nt, Human
auuagugguguauuuggcacua

SEQ ID NO: 181066 - RNA, 21 nt, Human
auuauagugacuaaauugaua

SEQ ID NO: 181067 - RNA, 22 nt, Human
auuauaauucauuaggcuuagu

SEQ ID NO: 181068 - RNA, 22 nt, Human
auuguauugcguuugcgaaugu

SEQ ID NO: 181069 - RNA, 17 nt, Human
auuguuuuuaauuugca

SEQ ID NO: 181070 - RNA, 22 nt, Human
auugacagagguguaguugaga

SEQ ID NO: 181071 - RNA, 22 nt, Human
auuuaaaaacugguacaacagg

SEQ ID NO: 181072 - RNA, 22 nt, Human
auuuauauauuuuguucuggua

SEQ ID NO: 181073 - RNA, 22 nt, Human
auuuauccuugggguagagcca

SEQ ID NO: 181074 - RNA, 22 nt, Human
auuucacucuuaauugcuuccu

SEQ ID NO: 181075 - RNA, 22 nt, Human
auuucaacagaguuugaaggca

SEQ ID NO: 181076 - RNA, 22 nt, Human
auuuauuugaagagccauugca

SEQ ID NO: 181077 - RNA, 22 nt, Human
auuuaaagaguaauacaaucca

SEQ ID NO: 181078 - RNA, 21 nt, Human
auuuggucaaugucugcguga

SEQ ID NO: 181079 - RNA, 22 nt, Human
auuggcugucagcccggauggg

SEQ ID NO: 181080 - RNA, 22 nt, Human
auuucagaaugaaaggaaaaau

SEQ ID NO: 181081 - RNA, 22 nt, Human
auuucagaguagaucguuauuu

SEQ ID NO: 181082 - RNA, 22 nt, Human
auuuauuuucccucaaguaccu

SEQ ID NO: 181083 - RNA, 22 nt, Human
auuucauaaaaacuuuaccuga

SEQ ID NO: 181084 - RNA, 22 nt, Human
auuucauuuuagaaauaagugu

SEQ ID NO: 181085 - RNA, 22 nt, Human
cagugcaacguugugcauucaa

SEQ ID NO: 181086 - RNA, 22 nt, Human
caguccaugaugacuuuugcuc

SEQ ID NO: 181087 - RNA, 22 nt, Human
caucugcagccucugcauuccc

SEQ ID NO: 181088 - RNA, 22 nt, Human
cagugcuccugccccugcccuu

SEQ ID NO: 181089 - RNA, 22 nt, Human
caugagaguaaccuagagaaga

SEQ ID NO: 181090 - RNA, 22 nt, Human
caucuccaagucuguaagcagu

SEQ ID NO: 181091 - RNA, 22 nt, Human
caugauucccacauugcgauca

SEQ ID NO: 181092 - RNA, 20 nt, Human
caugaugcaaacaguaacgu

SEQ ID NO: 181093 - RNA, 22 nt, Human
caugaugacagcauuccuuuua

SEQ ID NO: 181094 - RNA, 22 nt, Human
cagugguaaaugucguuccugu

SEQ ID NO: 181095 - RNA, 22 nt, Human
caugaccauuuggguuugugcg

SEQ ID NO: 181096 - RNA, 17 nt, Human
cagugcuguuuuagaaa

SEQ ID NO: 181097 - RNA, 22 nt, Human
caguggaugucucauaguguga

SEQ ID NO: 181098 - RNA, 22 nt, Human
caguggagaccugccugcugga

SEQ ID NO: 181099 - RNA, 22 nt, Human
caguugcagagugauguguuug

SEQ ID NO: 181100 - RNA, 22 nt, Human
caguuuuauacacugcagcucc

SEQ ID NO: 181101 - RNA, 22 nt, Human
caguuuuggaagaaacaaggaa

SEQ ID NO: 181102 - RNA, 22 nt, Human
caugccaguagccggcuugacu

SEQ ID NO: 181103 - RNA, 22 nt, Human
caugcgucugcauuggguggug

SEQ ID NO: 181104 - RNA, 22 nt, Human
caugcuaacacguugcucaccg

SEQ ID NO: 181105 - RNA, 22 nt, Human
cauggcacuuuugugucuaaau

SEQ ID NO: 181106 - RNA, 22 nt, Human
cauggcacagaagaugucguuu

SEQ ID NO: 181107 - RNA, 22 nt, Human
cauaaauuuuaccuuguaagug

SEQ ID NO: 181108 - RNA, 22 nt, Human
cauagcguuuacauguggauua

SEQ ID NO: 181109 - RNA, 22 nt, Human
cauagcuagcaccuucuuuucu

SEQ ID NO: 181110 - RNA, 22 nt, Human
cauaacuugguguuggaaacug

SEQ ID NO: 181111 - RNA, 21 nt, Human
caugguaaguacaaagaugac

SEQ ID NO: 181112 - RNA, 19 nt, Human
cauggcgguaaagaggcug

SEQ ID NO: 181113 - RNA, 22 nt, Human
cauggccaaagaauuauauuuu

SEQ ID NO: 181114 - RNA, 22 nt, Human
caugggaauaaaguuauuucaa

SEQ ID NO: 181115 - RNA, 22 nt, Human
caugguaaucggggccaucugu

SEQ ID NO: 181116 - RNA, 22 nt, Human
cauguauguuaguggcugcuuu

SEQ ID NO: 181117 - RNA, 22 nt, Human
cauguaaguucacagucgaugu

SEQ ID NO: 181118 - RNA, 22 nt, Human
cagguuguucugggcauggagg

SEQ ID NO: 181119 - RNA, 22 nt, Human
cagguugaagagguuaacgaua

SEQ ID NO: 181120 - RNA, 22 nt, Human
caggucauaacuaugcaugaac

SEQ ID NO: 181121 - RNA, 22 nt, Human
cagguaguuagaaugaccagga

SEQ ID NO: 181122 - RNA, 22 nt, Human
cagguauaugugugucuaauac

SEQ ID NO: 181123 - RNA, 22 nt, Human
cagggggcagcguagaaaauga

SEQ ID NO: 181124 - RNA, 19 nt, Human
caggggcuuaugcgaccuc

SEQ ID NO: 181125 - RNA, 22 nt, Human
cauaccuugguaagagugauca

SEQ ID NO: 181126 - RNA, 22 nt, Human
caggggucccccggcucccugg

SEQ ID NO: 181127 - RNA, 22 nt, Human
caggguaguaauuuaauacaag

SEQ ID NO: 181128 - RNA, 22 nt, Human
cagggugaagaugcgccuccug

SEQ ID NO: 181129 - RNA, 22 nt, Human
cagguuuggaagucacgaagcu

SEQ ID NO: 181130 - RNA, 20 nt, Human
caucaacaccuugucagccu

SEQ ID NO: 181131 - RNA, 22 nt, Human
cagguuucuggaugcagcccca

SEQ ID NO: 181132 - RNA, 23 nt, Human
cauauucagaaacaccuaguggu

SEQ ID NO: 181133 - RNA, 22 nt, Human
cagguuguugacugcauauagg

SEQ ID NO: 181134 - RNA, 22 nt, Human
caguaguucucauaacucauga

SEQ ID NO: 181135 - RNA, 21 nt, Human
caguagcgcgacaugguuagc

SEQ ID NO: 181136 - RNA, 22 nt, Human
caucaacagucuacuuuuugcc

SEQ ID NO: 181137 - RNA, 22 nt, Human
cauccagggguacccuggagcc

SEQ ID NO: 181138 - RNA, 22 nt, Human
cauccagcuccugggggccacc

SEQ ID NO: 181139 - RNA, 22 nt, Human
caucauuuggcuuuagggccug

SEQ ID NO: 181140 - RNA, 22 nt, Human
caguaucucccauucacagugu

SEQ ID NO: 181141 - RNA, 22 nt, Human
caggccgcccucuccuguuagc

SEQ ID NO: 181142 - RNA, 22 nt, Human
caggccccagggacugggcgcu

SEQ ID NO: 181143 - RNA, 22 nt, Human
caggccgccacugcagcagcug

SEQ ID NO: 181144 - RNA, 22 nt, Human
cagggagcggggagaucucggg

SEQ ID NO: 181145 - RNA, 22 nt, Human
caggcgcauggugagcagauga

SEQ ID NO: 181146 - RNA, 22 nt, Human
cagggcagaguuaagaugcugg

SEQ ID NO: 181147 - RNA, 22 nt, Human
cagggcaucucugaaucuucac

SEQ ID NO: 181148 - RNA, 22 nt, Human
cagggccaggccucaggggcgc

SEQ ID NO: 181149 - RNA, 22 nt, Human
cagggcuugaaucaaggaaguc

SEQ ID NO: 181150 - RNA, 22 nt, Human
cagggccagggcuauggugaag

SEQ ID NO: 181151 - RNA, 22 nt, Human
caggggaagccagcugccaugu

SEQ ID NO: 181152 - RNA, 22 nt, Human
caggcaggagaaaaggcgcggg

SEQ ID NO: 181153 - RNA, 22 nt, Human
caggcagggagcuggaaaggau

SEQ ID NO: 181154 - RNA, 21 nt, Human
caggccaaaagguucaacauu

SEQ ID NO: 181155 - RNA, 22 nt, Human
caggccagcuggaggggcagcu

SEQ ID NO: 181156 - RNA, 22 nt, Human
caguaugagcacagugccugga

SEQ ID NO: 181157 - RNA, 22 nt, Human
cagucaaauuugaaaacuuuga

SEQ ID NO: 181158 - RNA, 22 nt, Human
caggcagagagggcagugugga

SEQ ID NO: 181159 - RNA, 22 nt, Human
caggucagcacuuggaggugca

SEQ ID NO: 181160 - RNA, 22 nt, Human
cagguauuugaaggcaguggga

SEQ ID NO: 181161 - RNA, 22 nt, Human
caguacugucuuccugauggca

SEQ ID NO: 181162 - RNA, 22 nt, Human
caguaucucuaaaauuacucuu

SEQ ID NO: 181163 - RNA, 22 nt, Human
cagagcucacaaacugaaaacc

SEQ ID NO: 181164 - RNA, 22 nt, Human
cagagcugucauuugccaguga

SEQ ID NO: 181165 - RNA, 22 nt, Human
cagagaugaggcuggcgugguu

SEQ ID NO: 181166 - RNA, 22 nt, Human
cagagcagaaaccugggugauu

SEQ ID NO: 181167 - RNA, 22 nt, Human
cagagccagcuguccuuggcau

SEQ ID NO: 181168 - RNA, 18 nt, Human
cacgcaacuguaaaaccc

SEQ ID NO: 181169 - RNA, 22 nt, Human
cacaaggagaaauagauauuga

SEQ ID NO: 181170 - RNA, 22 nt, Human
cacacacacacacacucucaca

SEQ ID NO: 181171 - RNA, 22 nt, Human
cagauguuugaaugcuuaccac

SEQ ID NO: 181172 - RNA, 20 nt, Human
cagaucuuauguuuuucugu

SEQ ID NO: 181173 - RNA, 22 nt, Human
cagaaaaaaaugcagacuagca

SEQ ID NO: 181174 - RNA, 22 nt, Human
cacuuuuucccccuggugucau

SEQ ID NO: 181175 - RNA, 22 nt, Human
cagauuuaauaaaaaaugcauc

SEQ ID NO: 181176 - RNA, 21 nt, Human
cagagcuuuggagacggagga

SEQ ID NO: 181177 - RNA, 22 nt, Human
cagaggaugucuacaccuugag

SEQ ID NO: 181178 - RNA, 22 nt, Human
cagaggauggaaaugagaacaa

SEQ ID NO: 181179 - RNA, 22 nt, Human
cagaggcugagcugcgggauga

SEQ ID NO: 181180 - RNA, 22 nt, Human
cagagguagaaguagauguuug

SEQ ID NO: 181181 - RNA, 22 nt, Human
cagauaagcuauaaguaguacc

SEQ ID NO: 181182 - RNA, 22 nt, Human
cagauacaacagcaggaaugaa

SEQ ID NO: 181183 - RNA, 22 nt, Human
cagcccaucaaggggauccuga

SEQ ID NO: 181184 - RNA, 22 nt, Human
cagaguccuguaguauugcugg

SEQ ID NO: 181185 - RNA, 22 nt, Human
cagagggagcuaaccagcagcc

SEQ ID NO: 181186 - RNA, 22 nt, Human
cagaguaaugugauuuccaugu

SEQ ID NO: 181187 - RNA, 22 nt, Human
cagcugacaagaguccuuggag

SEQ ID NO: 181188 - RNA, 22 nt, Human
cagcuccagcccaggcagcucc

SEQ ID NO: 181189 - RNA, 22 nt, Human
cagcucugcugggaggaugcag

SEQ ID NO: 181190 - RNA, 22 nt, Human
cagcucuggcuauugaggacca

SEQ ID NO: 181191 - RNA, 18 nt, Human
cagcauuagcagcuucca

SEQ ID NO: 181192 - RNA, 22 nt, Human
cagcaugcaaguccagaugugg

SEQ ID NO: 181193 - RNA, 22 nt, Human
cagaaacacuguauuuagggaa

SEQ ID NO: 181194 - RNA, 22 nt, Human
cagacaaauccuuaugagacug

SEQ ID NO: 181195 - RNA, 21 nt, Human
cagcagaaaugagaggagaaa

SEQ ID NO: 181196 - RNA, 22 nt, Human
cagcagaugacuauuggagcug

SEQ ID NO: 181197 - RNA, 21 nt, Human
cagcagaugccagggucucug

SEQ ID NO: 181198 - RNA, 22 nt, Human
cagcuggggagagacauggcag

SEQ ID NO: 181199 - RNA, 22 nt, Human
cagcacaggugugaggccugau

SEQ ID NO: 181200 - RNA, 19 nt, Human
cagcaaacacuguaaaugg

SEQ ID NO: 181201 - RNA, 22 nt, Human
cagauuuagcacugauaggacu

SEQ ID NO: 181202 - RNA, 22 nt, Human
cagauggagaaagagugaaugg

SEQ ID NO: 181203 - RNA, 22 nt, Human
cagaugccauagguauaguaua

SEQ ID NO: 181204 - RNA, 22 nt, Human
caggaagagaacugcucagccu

SEQ ID NO: 181205 - RNA, 22 nt, Human
cagccuacaucagaauaccaau

SEQ ID NO: 181206 - RNA, 22 nt, Human
cagccuggccucuggauauuug

SEQ ID NO: 181207 - RNA, 22 nt, Human
cagcccuguugcgcuuccggcg

SEQ ID NO: 181208 - RNA, 22 nt, Human
cagcuucuccauucuucuggcu

SEQ ID NO: 181209 - RNA, 22 nt, Human
cagcuuguucugaccugugauu

SEQ ID NO: 181210 - RNA, 22 nt, Human
cagcuuuugcagacuucuugcc

SEQ ID NO: 181211 - RNA, 22 nt, Human
cagcuuaccucccacagcucuc

SEQ ID NO: 181212 - RNA, 22 nt, Human
cagcuguggagauggggugcau

SEQ ID NO: 181213 - RNA, 22 nt, Human
cagccagaucgccuuccgccuc

SEQ ID NO: 181214 - RNA, 22 nt, Human
cagcuuauggcuucuccaguag

SEQ ID NO: 181215 - RNA, 22 nt, Human
cagccauucuaacacugccagu

SEQ ID NO: 181216 - RNA, 22 nt, Human
cagcccaggcucagauguuggg

SEQ ID NO: 181217 - RNA, 22 nt, Human
cagggagguuggauuggggccu

SEQ ID NO: 181218 - RNA, 22 nt, Human
caggccacagcuaaagaggauu

SEQ ID NO: 181219 - RNA, 22 nt, Human
caggaggaaaguuccacucaac

SEQ ID NO: 181220 - RNA, 22 nt, Human
caggcagggcugccuucugcuu

SEQ ID NO: 181221 - RNA, 22 nt, Human
caggacacagacacuaaauaua

SEQ ID NO: 181222 - RNA, 22 nt, Human
cagcuauuguucuguauaauga

SEQ ID NO: 181223 - RNA, 22 nt, Human
cagggcacaguuauggaggugg

SEQ ID NO: 181224 - RNA, 22 nt, Human
cagggcuuuuuccuccucuuug

SEQ ID NO: 181225 - RNA, 22 nt, Human
caggggacacuccugcuugggc

SEQ ID NO: 181226 - RNA, 22 nt, Human
caggggcuuuccuguuuaugga

SEQ ID NO: 181227 - RNA, 22 nt, Human
caggcacaaugagcgccaucuu

SEQ ID NO: 181228 - RNA, 22 nt, Human
cagggguaccuggguuaccugu

SEQ ID NO: 181229 - RNA, 22 nt, Human
caggguaccaagcuucgcccuc

SEQ ID NO: 181230 - RNA, 22 nt, Human
caggaaaauaauggugauggga

SEQ ID NO: 181231 - RNA, 22 nt, Human
caggguugaugaauugucugua

SEQ ID NO: 181232 - RNA, 22 nt, Human
cucuggcaacgauggugcuuau

SEQ ID NO: 181233 - RNA, 22 nt, Human
cuguauggaggaggugcuagcc

SEQ ID NO: 181234 - RNA, 22 nt, Human
cuguagaugucagguuaaugag

SEQ ID NO: 181235 - RNA, 22 nt, Human
cuguacuuguuuuaggaugaug

SEQ ID NO: 181236 - RNA, 22 nt, Human
cucugcuuguaucacauuugcu

SEQ ID NO: 181237 - RNA, 19 nt, Human
cucuggcuccugggcugcc

SEQ ID NO: 181238 - RNA, 22 nt, Human
cucuggggaagugcacucgcug

SEQ ID NO: 181239 - RNA, 17 nt, Human
cucugggucuccugcuu

SEQ ID NO: 181240 - RNA, 20 nt, Human
cucugggaggcuugucaccu

SEQ ID NO: 181241 - RNA, 22 nt, Human
cucucuccuuuuugauauuuag

SEQ ID NO: 181242 - RNA, 22 nt, Human
cucugcuagaaggucaaucucu

SEQ ID NO: 181243 - RNA, 22 nt, Human
cucugagcucgugcaguacuuc

SEQ ID NO: 181244 - RNA, 22 nt, Human
cucucuuuuuuucccuuguuaa

SEQ ID NO: 181245 - RNA, 22 nt, Human
cuguggaaugcaguugcgagca

SEQ ID NO: 181246 - RNA, 22 nt, Human
cugucucugauaagcucgaggg

SEQ ID NO: 181247 - RNA, 22 nt, Human
cucuucauuauucacgcccugu

SEQ ID NO: 181248 - RNA, 19 nt, Human
cucuucauuggaggguuga

SEQ ID NO: 181249 - RNA, 22 nt, Human
cucuucauguuggugcagaagc

SEQ ID NO: 181250 - RNA, 22 nt, Human
cucuucugugggugcuauguca

SEQ ID NO: 181251 - RNA, 22 nt, Human
cugugugugcacacguguaugg

SEQ ID NO: 181252 - RNA, 22 nt, Human
cuguguggccuaaguggagaca

SEQ ID NO: 181253 - RNA, 22 nt, Human
cugugucucccaaggaggguca

SEQ ID NO: 181254 - RNA, 22 nt, Human
cugaaggacacgugaggagcca

SEQ ID NO: 181255 - RNA, 22 nt, Human
cugaagcugggcacuuccuuuu

SEQ ID NO: 181256 - RNA, 22 nt, Human
cuguguugggauggugcgcgca

SEQ ID NO: 181257 - RNA, 22 nt, Human
cugaaucaaaugacuuagccau

SEQ ID NO: 181258 - RNA, 22 nt, Human
cugaaggcuuugaauggaauga

SEQ ID NO: 181259 - RNA, 22 nt, Human
cugaccucuaaguaacagagaa

SEQ ID NO: 181260 - RNA, 22 nt, Human
cugacagaucuggaucugaacu

SEQ ID NO: 181261 - RNA, 22 nt, Human
cuguuuggaugccauggucaag

SEQ ID NO: 181262 - RNA, 22 nt, Human
cugaaucugccuccgaggguuu

SEQ ID NO: 181263 - RNA, 22 nt, Human
cuuauaucaacuggaaaaauua

SEQ ID NO: 181264 - RNA, 22 nt, Human
cugagcuauauauuaugcauag

SEQ ID NO: 181265 - RNA, 22 nt, Human
cugagcugcucccgcugcagcg

SEQ ID NO: 181266 - RNA, 23 nt, Human
cuuauauaaucauuagaaaccau

SEQ ID NO: 181267 - RNA, 22 nt, Human
cugauagagcauuagugugaga

SEQ ID NO: 181268 - RNA, 22 nt, Human
cugaggaguaguucuggaggac

SEQ ID NO: 181269 - RNA, 19 nt, Human
cugagcagggaaaaacccu

SEQ ID NO: 181270 - RNA, 22 nt, Human
cugagaucaugggucagguggu

SEQ ID NO: 181271 - RNA, 22 nt, Human
cuggaaaaauggauccugucuu

SEQ ID NO: 181272 - RNA, 22 nt, Human
cuggaaagauuuacacggggaa

SEQ ID NO: 181273 - RNA, 22 nt, Human
cugacugauuuugcuuuuuaau

SEQ ID NO: 181274 - RNA, 22 nt, Human
cugagaaauacccaagucuggu

SEQ ID NO: 181275 - RNA, 22 nt, Human
cugaccugugagcuaugccggc

SEQ ID NO: 181276 - RNA, 22 nt, Human
cugacugaggaucaguucauca

SEQ ID NO: 181277 - RNA, 22 nt, Human
cucaaugagcuauuuguuucau

SEQ ID NO: 181278 - RNA, 22 nt, Human
cucaauuguuuggucucugguu

SEQ ID NO: 181279 - RNA, 22 nt, Human
cuggaagcgucggaggaagggc

SEQ ID NO: 181280 - RNA, 22 nt, Human
cuggagaucaguuggacaacag

SEQ ID NO: 181281 - RNA, 22 nt, Human
cuggagaagagguaguauguag

SEQ ID NO: 181282 - RNA, 22 nt, Human
cuggagaacagagcuguuuaga

SEQ ID NO: 181283 - RNA, 22 nt, Human
cuggagucagcaaggacgaggc

SEQ ID NO: 181284 - RNA, 22 nt, Human
cucaggugagcgagcuaaauua

SEQ ID NO: 181285 - RNA, 22 nt, Human
cuggauagaggaugguaggcac

SEQ ID NO: 181286 - RNA, 22 nt, Human
cuggaugucugggaggcuuccc

SEQ ID NO: 181287 - RNA, 22 nt, Human
cuggauagaccccuuauugcau

SEQ ID NO: 181288 - RNA, 22 nt, Human
cuggcaguguccagcucgugau

SEQ ID NO: 181289 - RNA, 22 nt, Human
cuccuggagcagcaggcgcagg

SEQ ID NO: 181290 - RNA, 22 nt, Human
cugggaccugugugccugggcc

SEQ ID NO: 181291 - RNA, 22 nt, Human
cucgccugacucggaugggcug

SEQ ID NO: 181292 - RNA, 22 nt, Human
cugggacccagcccaagucuuu

SEQ ID NO: 181293 - RNA, 22 nt, Human
cugggagaggaaccucgagggu

SEQ ID NO: 181294 - RNA, 22 nt, Human
cucuccagucauauucucaguc

SEQ ID NO: 181295 - RNA, 22 nt, Human
cucuauuuuuucaucuuucagg

SEQ ID NO: 181296 - RNA, 22 nt, Human
cucuaaauguggucugcagaua

SEQ ID NO: 181297 - RNA, 22 nt, Human
cucggaggaccuguuuuaugca

SEQ ID NO: 181298 - RNA, 22 nt, Human
cucggagggcaaguacuggcug

SEQ ID NO: 181299 - RNA, 22 nt, Human
cuccggccuucugacuccccug

SEQ ID NO: 181300 - RNA, 22 nt, Human
cucccgagccuuacucuguucc

SEQ ID NO: 181301 - RNA, 22 nt, Human
cuggcuuucauggcgcaguuga

SEQ ID NO: 181302 - RNA, 22 nt, Human
cugggaaucuagagggcucauu

SEQ ID NO: 181303 - RNA, 22 nt, Human
cuggccuuaucacaaagcuaga

SEQ ID NO: 181304 - RNA, 22 nt, Human
cuccccauuuucaugggcaggu

SEQ ID NO: 181305 - RNA, 22 nt, Human
cucccccugccucuccucccug

SEQ ID NO: 181306 - RNA, 22 nt, Human
cuccaucccccugugugucaau

SEQ ID NO: 181307 - RNA, 22 nt, Human
cuccaugagccaggagggcuac

SEQ ID NO: 181308 - RNA, 22 nt, Human
cugcugccagcuuaauacucac

SEQ ID NO: 181309 - RNA, 22 nt, Human
cugcuguugagguuccaggcca

SEQ ID NO: 181310 - RNA, 22 nt, Human
cugcugucuuuauuucacugcu

SEQ ID NO: 181311 - RNA, 22 nt, Human
cugcugcuugauugcaggaagu

SEQ ID NO: 181312 - RNA, 22 nt, Human
cuuggugagcuccuggcgcagc

SEQ ID NO: 181313 - RNA, 22 nt, Human
cuuggguacaguaaagggaggu

SEQ ID NO: 181314 - RNA, 22 nt, Human
cugcuugaugaggaaaggauug

SEQ ID NO: 181315 - RNA, 22 nt, Human
cugcuguuuucugggcuucuua

SEQ ID NO: 181316 - RNA, 22 nt, Human
cugcguugaccagacuccuggg

SEQ ID NO: 181317 - RNA, 22 nt, Human
cugcgcagaucugcuguucucu

SEQ ID NO: 181318 - RNA, 22 nt, Human
cugcuacgguguccgguggggc

SEQ ID NO: 181319 - RNA, 22 nt, Human
cugcuauaacacuaacaucuaa

SEQ ID NO: 181320 - RNA, 22 nt, Human
cuuggcacauuuuguucuucug

SEQ ID NO: 181321 - RNA, 22 nt, Human
cuuuacauuaauuucuacugau

SEQ ID NO: 181322 - RNA, 22 nt, Human
cuuuccugaaaucucuucugca

SEQ ID NO: 181323 - RNA, 22 nt, Human
cuuuagugaguguggagcuaga

SEQ ID NO: 181324 - RNA, 22 nt, Human
cuuuccaugucuucuuucucca

SEQ ID NO: 181325 - RNA, 22 nt, Human
cuuugauuucucugguccaauc

SEQ ID NO: 181326 - RNA, 22 nt, Human
cuggaugagcuucgugcgcacg

SEQ ID NO: 181327 - RNA, 22 nt, Human
cuuucuuucaaguucugcuuua

SEQ ID NO: 181328 - RNA, 18 nt, Human
cuuucugcccccauuagc

SEQ ID NO: 181329 - RNA, 19 nt, Human
cuuguggcuaugcagauac

SEQ ID NO: 181330 - RNA, 22 nt, Human
cuggagaacucugugcuucacu

SEQ ID NO: 181331 - RNA, 22 nt, Human
cuggacucuuuguuuaguucug

SEQ ID NO: 181332 - RNA, 22 nt, Human
cuggaauugcuugagcuaggaa

SEQ ID NO: 181333 - RNA, 22 nt, Human
cuggaaauggcagaguugcauu

SEQ ID NO: 181334 - RNA, 22 nt, Human
cugcacuggguacauagaaaca

SEQ ID NO: 181335 - RNA, 22 nt, Human
cugcacagucauuuccucucaa

SEQ ID NO: 181336 - RNA, 22 nt, Human
cuucauccguaccacggccaca

SEQ ID NO: 181337 - RNA, 22 nt, Human
cuucauaagauuguugugagga

SEQ ID NO: 181338 - RNA, 22 nt, Human
cuucaggaccugaagcccaucu

SEQ ID NO: 181339 - RNA, 22 nt, Human
cuucaugucacugucuuaggua

SEQ ID NO: 181340 - RNA, 22 nt, Human
cugauguuuaucucaagaguuc

SEQ ID NO: 181341 - RNA, 20 nt, Human
cugauguucgugcuuccugg

SEQ ID NO: 181342 - RNA, 22 nt, Human
cuuccugcaacaccuguguugc

SEQ ID NO: 181343 - RNA, 22 nt, Human
cuuccuuucagaggaaggccug

SEQ ID NO: 181344 - RNA, 22 nt, Human
cugcagauguagcugcuuuccu

SEQ ID NO: 181345 - RNA, 22 nt, Human
cugcagagaccuaggucagguu

SEQ ID NO: 181346 - RNA, 22 nt, Human
cugcaguguccgcuugcucagc

SEQ ID NO: 181347 - RNA, 22 nt, Human
cugccacuaccaugcuggauga

SEQ ID NO: 181348 - RNA, 21 nt, Human
cuucgcuguuccagcucuugg

SEQ ID NO: 181349 - RNA, 23 nt, Human
cuucggcgcucgcugggcggagg

SEQ ID NO: 181350 - RNA, 22 nt, Human
cuucuaauucuuauguaagcuu

SEQ ID NO: 181351 - RNA, 22 nt, Human
cuucucuuggguguggugucuu

SEQ ID NO: 181352 - RNA, 22 nt, Human
cuucucuuccuucucauccuca

SEQ ID NO: 181353 - RNA, 22 nt, Human
cuucuggaggcucuagaggaga

SEQ ID NO: 181354 - RNA, 22 nt, Human
cuucugaugugugcucuuaguu

SEQ ID NO: 181355 - RNA, 22 nt, Human
cuucuuuucuacuggccuagaa

SEQ ID NO: 181356 - RNA, 22 nt, Human
cuucuuuuggggaugaaaaugg

SEQ ID NO: 181357 - RNA, 22 nt, Human
cuucuuuccauguguuuugguu

SEQ ID NO: 181358 - RNA, 22 nt, Human
cuucuuucuuuucuucuucucu

SEQ ID NO: 181359 - RNA, 22 nt, Human
cuucuucuagaagauggggaag

SEQ ID NO: 181360 - RNA, 22 nt, Human
cuucuugucagugauuucuucc

SEQ ID NO: 181361 - RNA, 22 nt, Human
cugccucucaugccugcuugcu

SEQ ID NO: 181362 - RNA, 22 nt, Human
cugcccgcaugcaggaaugcug

SEQ ID NO: 181363 - RNA, 22 nt, Human
cugccgaugcgcaguggcgccu

SEQ ID NO: 181364 - RNA, 22 nt, Human
cugcccugcagcuccacggacu

SEQ ID NO: 181365 - RNA, 22 nt, Human
cuugauucauuuaagguuggag

SEQ ID NO: 181366 - RNA, 22 nt, Human
gagaggcagcucaggaggucag

SEQ ID NO: 181367 - RNA, 22 nt, Human
gagaggcugagcaguccggguu

SEQ ID NO: 181368 - RNA, 22 nt, Human
gagaggguugggaggcagcaga

SEQ ID NO: 181369 - RNA, 22 nt, Human
gagaggugaagcuaauuaauuu

SEQ ID NO: 181370 - RNA, 22 nt, Human
gagagcugucagcguagcaccg

SEQ ID NO: 181371 - RNA, 22 nt, Human
gagagauacauucccaaccuga

SEQ ID NO: 181372 - RNA, 22 nt, Human
gagagucuuaaguuacagaacu

SEQ ID NO: 181373 - RNA, 22 nt, Human
gaaaugggggcaugcguuacau

SEQ ID NO: 181374 - RNA, 22 nt, Human
gagauuugaguuccuacugagu

SEQ ID NO: 181375 - RNA, 22 nt, Human
gagauuguggcagcagcuguuu

SEQ ID NO: 181376 - RNA, 22 nt, Human
gagauuucauuugugaggcuca

SEQ ID NO: 181377 - RNA, 22 nt, Human
gagauggauuuuuuugccaguc

SEQ ID NO: 181378 - RNA, 22 nt, Human
gagaucuguguuugcugaagcu

SEQ ID NO: 181379 - RNA, 22 nt, Human
gagcagccugaggauucugcuc

SEQ ID NO: 181380 - RNA, 22 nt, Human
gaacucuugguggucauuagau

SEQ ID NO: 181381 - RNA, 22 nt, Human
gagcacuucagcauaaaucaca

SEQ ID NO: 181382 - RNA, 22 nt, Human
gagcacauguggagagucuggg

SEQ ID NO: 181383 - RNA, 22 nt, Human
gaacaugaguuuuaugguauuu

SEQ ID NO: 181384 - RNA, 22 nt, Human
gagcagacugcacaguucuugc

SEQ ID NO: 181385 - RNA, 22 nt, Human
gagcaguuagggaccgcaggcu

SEQ ID NO: 181386 - RNA, 22 nt, Human
gagcaggucuuugguaaugcuu

SEQ ID NO: 181387 - RNA, 22 nt, Human
gagcagguuauuagaaauggaa

SEQ ID NO: 181388 - RNA, 22 nt, Human
gagcaggucucaguucugccuc

SEQ ID NO: 181389 - RNA, 22 nt, Human
gaagaaggaagaucaugcuuga

SEQ ID NO: 181390 - RNA, 22 nt, Human
gagcagcugagcuggaaugaga

SEQ ID NO: 181391 - RNA, 22 nt, Human
gagcagggagaggcagagaggc

SEQ ID NO: 181392 - RNA, 22 nt, Human
gaacugggguagggguagcuuu

SEQ ID NO: 181393 - RNA, 22 nt, Human
gacuccugccucucuacuucug

SEQ ID NO: 181394 - RNA, 22 nt, Human
gacugggacucaacccaccauu

SEQ ID NO: 181395 - RNA, 22 nt, Human
gacuggucuuuugugauggaug

SEQ ID NO: 181396 - RNA, 22 nt, Human
gaaaaagucuuaaaguaaggca

SEQ ID NO: 181397 - RNA, 22 nt, Human
gacuucaucagagcguacuguu

SEQ ID NO: 181398 - RNA, 22 nt, Human
gaaaagcucuuuagaagagguu

SEQ ID NO: 181399 - RNA, 22 nt, Human
gaaaaggaggggaggcagaugg

SEQ ID NO: 181400 - RNA, 22 nt, Human
gagaauuauacaugagcuauuu

SEQ ID NO: 181401 - RNA, 22 nt, Human
gaaaccauggcaaccagguccu

SEQ ID NO: 181402 - RNA, 22 nt, Human
gaaagagaugucguuugucuuc

SEQ ID NO: 181403 - RNA, 22 nt, Human
gaaagcuuggaaacgacuuuau

SEQ ID NO: 181404 - RNA, 22 nt, Human
gaaagggggcuuggacacuggc

SEQ ID NO: 181405 - RNA, 22 nt, Human
gaaagcauucuggaggggcaga

SEQ ID NO: 181406 - RNA, 22 nt, Human
gagaagugggggucugggauga

SEQ ID NO: 181407 - RNA, 22 nt, Human
gagaagguggaccugaaggagc

SEQ ID NO: 181408 - RNA, 22 nt, Human
gagaaguagcgucuucccgggg

SEQ ID NO: 181409 - RNA, 22 nt, Human
gagaauaauaauaggcauggug

SEQ ID NO: 181410 - RNA, 22 nt, Human
cuuguuuuaaacuguuguggcu

SEQ ID NO: 181411 - RNA, 22 nt, Human
cuuuaaaaauguauuuuugugg

SEQ ID NO: 181412 - RNA, 22 nt, Human
cuuguuaacaauugguaucuuu

SEQ ID NO: 181413 - RNA, 20 nt, Human
cuuguuaaauaugcagguag

SEQ ID NO: 181414 - RNA, 18 nt, Human
gacaaaaguacagacaga

SEQ ID NO: 181415 - RNA, 19 nt, Human
gaauugcacgagcagaggc

SEQ ID NO: 181416 - RNA, 22 nt, Human
gacauugaauugaauccagauu

SEQ ID NO: 181417 - RNA, 22 nt, Human
gacaucuguccauggcacugga

SEQ ID NO: 181418 - RNA, 20 nt, Human
gacaugagggagcaaagagc

SEQ ID NO: 181419 - RNA, 22 nt, Human
gaccaggagauuugagcuaggc

SEQ ID NO: 181420 - RNA, 22 nt, Human
cuuuuaccuuaauuucgacaca

SEQ ID NO: 181421 - RNA, 22 nt, Human
cuuuucaaacaggacagguccu

SEQ ID NO: 181422 - RNA, 22 nt, Human
cuuuucuuuucuucucuuccca

SEQ ID NO: 181423 - RNA, 22 nt, Human
cuuuuccuccaggaagccaagc

SEQ ID NO: 181424 - RNA, 22 nt, Human
gacggggcagccagcugguggc

SEQ ID NO: 181425 - RNA, 22 nt, Human
cuuuuucuugugguuaauaucu

SEQ ID NO: 181426 - RNA, 22 nt, Human
cuuuuucuuaucuuuuucuaug

SEQ ID NO: 181427 - RNA, 22 nt, Human
gacucuucucucccaaaugccc

SEQ ID NO: 181428 - RNA, 22 nt, Human
cuucuguguggauacagucccu

SEQ ID NO: 181429 - RNA, 22 nt, Human
cuucuucaucuuuuggaggaac

SEQ ID NO: 181430 - RNA, 22 nt, Human
cuucuggaggcugcagaaaaga

SEQ ID NO: 181431 - RNA, 22 nt, Human
cuucucuuugacaguugggugu

SEQ ID NO: 181432 - RNA, 22 nt, Human
cuucucuugugauguuagcgga

SEQ ID NO: 181433 - RNA, 22 nt, Human
cuuccagugcauagguagauca

SEQ ID NO: 181434 - RNA, 22 nt, Human
gaaggcagucuggggagcagcc

SEQ ID NO: 181435 - RNA, 22 nt, Human
gaaggauaauuuugcuggaugu

SEQ ID NO: 181436 - RNA, 22 nt, Human
gaaggcaguaaauggcuguuuu

SEQ ID NO: 181437 - RNA, 22 nt, Human
gaaggaagcugucuggaugugu

SEQ ID NO: 181438 - RNA, 22 nt, Human
cuucaguuaguuucaugugagc

SEQ ID NO: 181439 - RNA, 22 nt, Human
cuucauuacagcaaccauuuga

SEQ ID NO: 181440 - RNA, 22 nt, Human
gaagcuucucaacugguggaau

SEQ ID NO: 181441 - RNA, 22 nt, Human
cuucauuucaggcugaagaaua

SEQ ID NO: 181442 - RNA, 22 nt, Human
gaagcuucgaaagagugauuuc

SEQ ID NO: 181443 - RNA, 19 nt, Human
cuucaguguucaccuggcc

SEQ ID NO: 181444 - RNA, 22 nt, Human
gaagcucaguugcuuagaucuc

SEQ ID NO: 181445 - RNA, 22 nt, Human
gaagcgucaugaaagaaaggcu

SEQ ID NO: 181446 - RNA, 22 nt, Human
gaauagauuagaaagaguaugu

SEQ ID NO: 181447 - RNA, 22 nt, Human
gaauauuuaucucagcugcaga

SEQ ID NO: 181448 - RNA, 22 nt, Human
gaauaccauuuacauuugaaaa

SEQ ID NO: 181449 - RNA, 22 nt, Human
gaaucucuuugucccugaguuu

SEQ ID NO: 181450 - RNA, 20 nt, Human
gaaucuggucaaaugucuau

SEQ ID NO: 181451 - RNA, 22 nt, Human
cuugccuuugaaagcauuucuc

SEQ ID NO: 181452 - RNA, 22 nt, Human
gaaugacuugcucauucugugu

SEQ ID NO: 181453 - RNA, 21 nt, Human
cuuggagacucuuggccacau

SEQ ID NO: 181454 - RNA, 22 nt, Human
cuugcugggagagcuuuagaga

SEQ ID NO: 181455 - RNA, 22 nt, Human
cuugcuguccgaugggucugua

SEQ ID NO: 181456 - RNA, 22 nt, Human
gaauggagaacccuggacacug

SEQ ID NO: 181457 - RNA, 22 nt, Human
gaaugccugggguucuucgauc

SEQ ID NO: 181458 - RNA, 20 nt, Human
gaauucugaagauaauuugg

SEQ ID NO: 181459 - RNA, 22 nt, Human
cuuuggacaacugagugacguu

SEQ ID NO: 181460 - RNA, 21 nt, Human
cuuuggcaagggagaagucac

SEQ ID NO: 181461 - RNA, 19 nt, Human
cuuugugguuuucagaacu

SEQ ID NO: 181462 - RNA, 22 nt, Human
cuuuuaaucuaauuuuuauauu

SEQ ID NO: 181463 - RNA, 22 nt, Human
cuuuguaaucaauaagucuuuu

SEQ ID NO: 181464 - RNA, 22 nt, Human
cuggcagcucugagucccuucu

SEQ ID NO: 181465 - RNA, 22 nt, Human
cuggauuaaacaguuugauacu

SEQ ID NO: 181466 - RNA, 22 nt, Human
cuggccagccucccagguaccc

SEQ ID NO: 181467 - RNA, 22 nt, Human
cuggccaggugggggguagugg

SEQ ID NO: 181468 - RNA, 22 nt, Human
cugugcauguucucuagcugau

SEQ ID NO: 181469 - RNA, 22 nt, Human
cuggcccugucagcacagaauc

SEQ ID NO: 181470 - RNA, 22 nt, Human
cuguggcugcgcccugggggag

SEQ ID NO: 181471 - RNA, 22 nt, Human
cuguggcuaggaagcuguggga

SEQ ID NO: 181472 - RNA, 22 nt, Human
gaaauaggcccuuacauggaaa

SEQ ID NO: 181473 - RNA, 22 nt, Human
gaaauagagacaguaagugucu

SEQ ID NO: 181474 - RNA, 22 nt, Human
gaaagugaauguaacauguuau

SEQ ID NO: 181475 - RNA, 22 nt, Human
gaaaugucaagauauguuugga

SEQ ID NO: 181476 - RNA, 22 nt, Human
cuucacugcagucauggcucug

SEQ ID NO: 181477 - RNA, 20 nt, Human
cuuauuuuggagaacuuuuc

SEQ ID NO: 181478 - RNA, 22 nt, Human
gaagccaugauaaccagugugg

SEQ ID NO: 181479 - RNA, 22 nt, Human
cuuaggcgugugcgggugaggc

SEQ ID NO: 181480 - RNA, 22 nt, Human
cuuacaauuuucuuggacuuuu

SEQ ID NO: 181481 - RNA, 20 nt, Human
cuuaugcaaaauguuaggga

SEQ ID NO: 181482 - RNA, 22 nt, Human
gaacaaaagauagcccaaacau

SEQ ID NO: 181483 - RNA, 22 nt, Human
cuguuacggaggcuuucuaguu

SEQ ID NO: 181484 - RNA, 22 nt, Human
cuguucagugcauauguauuga

SEQ ID NO: 181485 - RNA, 22 nt, Human
cuguguuaggaucuugcuggca

SEQ ID NO: 181486 - RNA, 20 nt, Human
cuguucucuugccacaugag

SEQ ID NO: 181487 - RNA, 22 nt, Human
cuguuuggcuuccacugcuucu

SEQ ID NO: 181488 - RNA, 22 nt, Human
cuguuucucugccugcacacau

SEQ ID NO: 181489 - RNA, 20 nt, Human
cuguuugcuaucaugagcug

SEQ ID NO: 181490 - RNA, 22 nt, Human
cccagggguugaggccguaggg

SEQ ID NO: 181491 - RNA, 22 nt, Human
cccaggaaugagcaggcagggg

SEQ ID NO: 181492 - RNA, 22 nt, Human
cccagcuuugcggacccgggag

SEQ ID NO: 181493 - RNA, 22 nt, Human
cccagcuggcaaaggcguccuu

SEQ ID NO: 181494 - RNA, 22 nt, Human
cccagcgccugcccuccgccgc

SEQ ID NO: 181495 - RNA, 20 nt, Human
ccccagcauccuuuucaucu

SEQ ID NO: 181496 - RNA, 22 nt, Human
ccagcaagacucgcagugggau

SEQ ID NO: 181497 - RNA, 22 nt, Human
ccagauaaacauuccuuggccu

SEQ ID NO: 181498 - RNA, 22 nt, Human
cccagccgaaugcucccuuccc

SEQ ID NO: 181499 - RNA, 22 nt, Human
cccagccugaucucggccagcu

SEQ ID NO: 181500 - RNA, 22 nt, Human
cccagcaccauaacucaggccu

SEQ ID NO: 181501 - RNA, 22 nt, Human
cccagcccaucauuccugcaaa

SEQ ID NO: 181502 - RNA, 22 nt, Human
caucaaaugcaagagcguucuu

SEQ ID NO: 181503 - RNA, 22 nt, Human
ccagggagggccacagggccau

SEQ ID NO: 181504 - RNA, 22 nt, Human
ccagggcggacaaggucuuuga

SEQ ID NO: 181505 - RNA, 22 nt, Human
cccgggccgagucuuccagcga

SEQ ID NO: 181506 - RNA, 22 nt, Human
ccaggcccugcuccucacacca

SEQ ID NO: 181507 - RNA, 23 nt, Human
cccgggaagugcugcuuaucugg

SEQ ID NO: 181508 - RNA, 22 nt, Human
cccggcgccucguuuccuaguc

SEQ ID NO: 181509 - RNA, 22 nt, Human
cccgccggccacaccggccgcc

SEQ ID NO: 181510 - RNA, 22 nt, Human
ccagccugccaagcccagcccu

SEQ ID NO: 181511 - RNA, 22 nt, Human
ccagccugagcuugcugcccuc

SEQ ID NO: 181512 - RNA, 22 nt, Human
ccagcugcugcaccgugcaugg

SEQ ID NO: 181513 - RNA, 22 nt, Human
ccagcuuuucagaaucugccug

SEQ ID NO: 181514 - RNA, 21 nt, Human
ccccuguggagcacauguggc

SEQ ID NO: 181515 - RNA, 22 nt, Human
ccccuuguuuuauucaaauugg

SEQ ID NO: 181516 - RNA, 22 nt, Human
ccagcucgaggcaggggcugca

SEQ ID NO: 181517 - RNA, 22 nt, Human
ccccugcucagggaggagaccg

SEQ ID NO: 181518 - RNA, 23 nt, Human
ccccugcauggcaccacauuccc

SEQ ID NO: 181519 - RNA, 22 nt, Human
ccaugugaccugugucaguugc

SEQ ID NO: 181520 - RNA, 23 nt, Human
ccaugugcaggguucagcacuua

SEQ ID NO: 181521 - RNA, 22 nt, Human
cccaaccagaaauugacagaga

SEQ ID NO: 181522 - RNA, 22 nt, Human
ccgccacggggcaugggaggca

SEQ ID NO: 181523 - RNA, 22 nt, Human
ccgaggaguagggugucuacgg

SEQ ID NO: 181524 - RNA, 21 nt, Human
ccgaggagugcggggagcccc

SEQ ID NO: 181525 - RNA, 22 nt, Human
ccgauuuaugucucugacuuga

SEQ ID NO: 181526 - RNA, 22 nt, Human
ccgcagggcccggcgggcucag

SEQ ID NO: 181527 - RNA, 22 nt, Human
ccgcaccgucugccauacacgc

SEQ ID NO: 181528 - RNA, 22 nt, Human
ccaucccugagucacaggaggg

SEQ ID NO: 181529 - RNA, 22 nt, Human
ccauggaugcucagauguuagc

SEQ ID NO: 181530 - RNA, 22 nt, Human
ccaugauguugccuacacugcu

SEQ ID NO: 181531 - RNA, 21 nt, Human
cccuugccugcacuccucggc

SEQ ID NO: 181532 - RNA, 21 nt, Human
ccgacggcgcagaugccggcc

SEQ ID NO: 181533 - RNA, 22 nt, Human
ccgaaaaacagaaucuuggaac

SEQ ID NO: 181534 - RNA, 22 nt, Human
cccuuuuuuauggaguuggcca

SEQ ID NO: 181535 - RNA, 19 nt, Human
cccucggcuucugguuacu

SEQ ID NO: 181536 - RNA, 22 nt, Human
cccucucaaucuuuaaaauaca

SEQ ID NO: 181537 - RNA, 22 nt, Human
ccagguuggccaccuucacggg

SEQ ID NO: 181538 - RNA, 22 nt, Human
ccagguggacggcgaguacagg

SEQ ID NO: 181539 - RNA, 22 nt, Human
ccagggcugcugccugggcugg

SEQ ID NO: 181540 - RNA, 22 nt, Human
ccagggcuggaccagugcuugg

SEQ ID NO: 181541 - RNA, 22 nt, Human
ccagggaggucauagugcuggu

SEQ ID NO: 181542 - RNA, 22 nt, Human
ccagggcuggaggaggucagga

SEQ ID NO: 181543 - RNA, 22 nt, Human
cccgggcucuggcagaggcggu

SEQ ID NO: 181544 - RNA, 22 nt, Human
cccgguggagaugugggacagg

SEQ ID NO: 181545 - RNA, 22 nt, Human
cccguggugggaugacaccaug

SEQ ID NO: 181546 - RNA, 22 nt, Human
cccuccagugucccagugggga

SEQ ID NO: 181547 - RNA, 22 nt, Human
cccuggacuccauuuucccgua

SEQ ID NO: 181548 - RNA, 20 nt, Human
cccuggcuggcaucuggacu

SEQ ID NO: 181549 - RNA, 22 nt, Human
cccugggccccgaacugcugag

SEQ ID NO: 181550 - RNA, 22 nt, Human
ccagucugccggcccggccccu

SEQ ID NO: 181551 - RNA, 22 nt, Human
ccagugcaguacaaaccuuagu

SEQ ID NO: 181552 - RNA, 22 nt, Human
ccaguuuuuccagugcuuucug

SEQ ID NO: 181553 - RNA, 19 nt, Human
ccaguuuuuuaauauucaa

SEQ ID NO: 181554 - RNA, 22 nt, Human
cccuggucucugacuugauccu

SEQ ID NO: 181555 - RNA, 22 nt, Human
cccaggucgucagcaguguggu

SEQ ID NO: 181556 - RNA, 22 nt, Human
ccguaugacuuuuuguuguugu

SEQ ID NO: 181557 - RNA, 22 nt, Human
ccguccgcuccuccagccgcug

SEQ ID NO: 181558 - RNA, 22 nt, Human
cccaguuguuccuauucuucuu

SEQ ID NO: 181559 - RNA, 22 nt, Human
cccauauacuuuuucuggucca

SEQ ID NO: 181560 - RNA, 22 nt, Human
cccauuuuuuggauguguggau

SEQ ID NO: 181561 - RNA, 22 nt, Human
ccccaggcagcccuccaggagc

SEQ ID NO: 181562 - RNA, 22 nt, Human
ccccguggcugggggacagagc

SEQ ID NO: 181563 - RNA, 22 nt, Human
cccccucuuccccucauugcuu

SEQ ID NO: 181564 - RNA, 22 nt, Human
cccccauccccugaaggagcug

SEQ ID NO: 181565 - RNA, 22 nt, Human
ccucaguguguggauguuagag

SEQ ID NO: 181566 - RNA, 22 nt, Human
ccucaucagaaagcagaaagca

SEQ ID NO: 181567 - RNA, 22 nt, Human
ccuauuuucaaaauuguuuauc

SEQ ID NO: 181568 - RNA, 22 nt, Human
ccuacccucaagggccuggggg

SEQ ID NO: 181569 - RNA, 22 nt, Human
ccuaauuuuagacccacuccua

SEQ ID NO: 181570 - RNA, 22 nt, Human
ccguuugugcugcaggagaucg

SEQ ID NO: 181571 - RNA, 22 nt, Human
ccuaacaugguuauuguuaauu

SEQ ID NO: 181572 - RNA, 22 nt, Human
ccgugggugggguacgggcugg

SEQ ID NO: 181573 - RNA, 22 nt, Human
cccagaccagagugccuggacg

SEQ ID NO: 181574 - RNA, 22 nt, Human
ccgcuggaagcgaguggugggc

SEQ ID NO: 181575 - RNA, 22 nt, Human
ccgcuggccgacuuccgagagc

SEQ ID NO: 181576 - RNA, 16 nt, Human
cccaccuggacuaccu

SEQ ID NO: 181577 - RNA, 22 nt, Human
ccgcucuuugagacucucccga

SEQ ID NO: 181578 - RNA, 22 nt, Human
ccgcggcagaggcgggggcgcc

SEQ ID NO: 181579 - RNA, 22 nt, Human
ccgccucucgcucccagcuugc

SEQ ID NO: 181580 - RNA, 22 nt, Human
ccggcggaaacauggcggcgcc

SEQ ID NO: 181581 - RNA, 22 nt, Human
ccggcggguggagcaugcgcgg

SEQ ID NO: 181582 - RNA, 22 nt, Human
cccagccgcuguggucuagggu

SEQ ID NO: 181583 - RNA, 22 nt, Human
ccgggcggcauccagccguucc

SEQ ID NO: 181584 - RNA, 22 nt, Human
cccaggccguguaaucagcagc

SEQ ID NO: 181585 - RNA, 22 nt, Human
ccggguccagugggcacugggc

SEQ ID NO: 181586 - RNA, 22 nt, Human
cccagcugaacuugcauuccaa

SEQ ID NO: 181587 - RNA, 22 nt, Human
cccggagcagucgggcuccggg

SEQ ID NO: 181588 - RNA, 22 nt, Human
cccgcucaccccacuccaccag

SEQ ID NO: 181589 - RNA, 19 nt, Human
ccuccguguuaccuguccu

SEQ ID NO: 181590 - RNA, 22 nt, Human
cccggcucggcuucuuccccac

SEQ ID NO: 181591 - RNA, 22 nt, Human
ccucccuucccggcauggcucu

SEQ ID NO: 181592 - RNA, 22 nt, Human
ccuccuuuccuguuuuccugag

SEQ ID NO: 181593 - RNA, 22 nt, Human
ccucgcucauggauucugccug

SEQ ID NO: 181594 - RNA, 22 nt, Human
ccucgugcgauaguuaugucag

SEQ ID NO: 181595 - RNA, 22 nt, Human
cccgaaaauuguuguacugcag

SEQ ID NO: 181596 - RNA, 19 nt, Human
cccgauggagacuuagcag

SEQ ID NO: 181597 - RNA, 18 nt, Human
ccuccccuguggaggucc

SEQ ID NO: 181598 - RNA, 22 nt, Human
cccuaaucuuggaaaugccauu

SEQ ID NO: 181599 - RNA, 22 nt, Human
cccgugggaugagaggcccugg

SEQ ID NO: 181600 - RNA, 22 nt, Human
cccgguugggguuccagggcgc

SEQ ID NO: 181601 - RNA, 22 nt, Human
ccucuaugcccuucuggggguc

SEQ ID NO: 181602 - RNA, 22 nt, Human
ccugaccauuugccacaugggu

SEQ ID NO: 181603 - RNA, 22 nt, Human
ccugacagcgugucccuggccc

SEQ ID NO: 181604 - RNA, 22 nt, Human
ccucuggacuugggacagugag

SEQ ID NO: 181605 - RNA, 22 nt, Human
ccugaaaugaguucugcucacu

SEQ ID NO: 181606 - RNA, 22 nt, Human
ccugauauggugucauuuaaac

SEQ ID NO: 181607 - RNA, 22 nt, Human
ccugagacucuccugugcagcc

SEQ ID NO: 181608 - RNA, 22 nt, Human
cccuggcucaggcagcuuuguu

SEQ ID NO: 181609 - RNA, 17 nt, Human
cccugcauugauccuca

SEQ ID NO: 181610 - RNA, 20 nt, Human
cccuggaaugagaugcauau

SEQ ID NO: 181611 - RNA, 22 nt, Human
ccugcccaucccaccccagcau

SEQ ID NO: 181612 - RNA, 19 nt, Human
ccugcugaagugaugcagc

SEQ ID NO: 181613 - RNA, 22 nt, Human
ccugcaugacuuugucagaccu

SEQ ID NO: 181614 - RNA, 22 nt, Human
cccuuuucuaauuuagccuguu

SEQ ID NO: 181615 - RNA, 22 nt, Human
cccuuuuuugccauuccuuccu

SEQ ID NO: 181616 - RNA, 22 nt, Human
cucuggagggaggcugagcugg

SEQ ID NO: 181617 - RNA, 18 nt, Human
cucuggacagcaggcauc

SEQ ID NO: 181618 - RNA, 22 nt, Human
cucuccaguuauagcugauuug

SEQ ID NO: 181619 - RNA, 22 nt, Human
cucuguauauugagugcuuacu

SEQ ID NO: 181620 - RNA, 22 nt, Human
cucugguuucgcaggaaauaga

SEQ ID NO: 181621 - RNA, 22 nt, Human
cucugugucugauucugggaag

SEQ ID NO: 181622 - RNA, 22 nt, Human
cucuguguguuugugugugugu

SEQ ID NO: 181623 - RNA, 22 nt, Human
cucugucuggggaggggagagg

SEQ ID NO: 181624 - RNA, 22 nt, Human
cucuuauaaagaugucucuguu

SEQ ID NO: 181625 - RNA, 22 nt, Human
cucuugacagcuuuaguaucau

SEQ ID NO: 181626 - RNA, 22 nt, Human
cucuuuuuccuaugaaaucuau

SEQ ID NO: 181627 - RNA, 22 nt, Human
cucuuuguauucuagaagcucu

SEQ ID NO: 181628 - RNA, 22 nt, Human
cugaaacuauggggaggggagc

SEQ ID NO: 181629 - RNA, 22 nt, Human
cucuuuuuuugucuuaagaacc

SEQ ID NO: 181630 - RNA, 22 nt, Human
cucuuuucaaaccuguuuaugg

SEQ ID NO: 181631 - RNA, 19 nt, Human
cugaaacacagagagggcu

SEQ ID NO: 181632 - RNA, 22 nt, Human
cggcugcgguucaccuagggca

SEQ ID NO: 181633 - RNA, 22 nt, Human
cgggcacagguugagguagaug

SEQ ID NO: 181634 - RNA, 22 nt, Human
cggggcaaggggggcuggugga

SEQ ID NO: 181635 - RNA, 20 nt, Human
cgggacacucaagcucuggg

SEQ ID NO: 181636 - RNA, 22 nt, Human
cgggagaugaggagagcuucgg

SEQ ID NO: 181637 - RNA, 22 nt, Human
cggcuucucgggucggauuccg

SEQ ID NO: 181638 - RNA, 22 nt, Human
cggggcggcgagcgggccgggc

SEQ ID NO: 181639 - RNA, 22 nt, Human
cugaaagacgaggggaagucgg

SEQ ID NO: 181640 - RNA, 20 nt, Human
cugaccagcagccugucucc

SEQ ID NO: 181641 - RNA, 22 nt, Human
cugaccgugccgcgguacugcu

SEQ ID NO: 181642 - RNA, 22 nt, Human
cugaauucuuguugucggagca

SEQ ID NO: 181643 - RNA, 20 nt, Human
cugaauaccacagagccauc

SEQ ID NO: 181644 - RNA, 19 nt, Human
cggggcuugguggguucuc

SEQ ID NO: 181645 - RNA, 22 nt, Human
cgggguguggggcgguagugug

SEQ ID NO: 181646 - RNA, 22 nt, Human
cggggucuggaguuguggugug

SEQ ID NO: 181647 - RNA, 22 nt, Human
cggucggagagaaugaccugga

SEQ ID NO: 181648 - RNA, 22 nt, Human
cuauaagguguuucuauugguc

SEQ ID NO: 181649 - RNA, 22 nt, Human
cuacaaggucuuuaucugcuuu

SEQ ID NO: 181650 - RNA, 22 nt, Human
cuaauuguaagcuccuugaggg

SEQ ID NO: 181651 - RNA, 22 nt, Human
cuauauucuggaauguccauuu

SEQ ID NO: 181652 - RNA, 22 nt, Human
cucagaagaacaaaggcucuac

SEQ ID NO: 181653 - RNA, 22 nt, Human
cucacccaaacuauaucuuuaa

SEQ ID NO: 181654 - RNA, 22 nt, Human
cucacgguuugcaucaagagug

SEQ ID NO: 181655 - RNA, 22 nt, Human
cuauuauuauugucguuuuaca

SEQ ID NO: 181656 - RNA, 22 nt, Human
cuauugguaucacacugauuuc

SEQ ID NO: 181657 - RNA, 22 nt, Human
cucagaugcacacaggugaggg

SEQ ID NO: 181658 - RNA, 22 nt, Human
cucagaauugucaccucaaaaa

SEQ ID NO: 181659 - RNA, 22 nt, Human
cgcugcagcggcugagucccgc

SEQ ID NO: 181660 - RNA, 22 nt, Human
cgcucggugagccaguggcgga

SEQ ID NO: 181661 - RNA, 22 nt, Human
cgcucggcuuucccuccgccgg

SEQ ID NO: 181662 - RNA, 22 nt, Human
cuccaguugugucuuguaagaa

SEQ ID NO: 181663 - RNA, 22 nt, Human
cuccagggcuaccagguuuuag

SEQ ID NO: 181664 - RNA, 22 nt, Human
cuccaggcccagggccaagagc

SEQ ID NO: 181665 - RNA, 22 nt, Human
cuccagucccuccuugcccagc

SEQ ID NO: 181666 - RNA, 22 nt, Human
cuccccuuauuccucaacauga

SEQ ID NO: 181667 - RNA, 22 nt, Human
cuccugcuuuuucuucuuccga

SEQ ID NO: 181668 - RNA, 22 nt, Human
cucagcugauuaauuucauguu

SEQ ID NO: 181669 - RNA, 22 nt, Human
cgcuuugacuuuagaaggccaa

SEQ ID NO: 181670 - RNA, 22 nt, Human
cgcuuugguaauagggcagccu

SEQ ID NO: 181671 - RNA, 22 nt, Human
cggacugaccugcucggggaga

SEQ ID NO: 181672 - RNA, 22 nt, Human
cucaugcugcaaauggcuguuu

SEQ ID NO: 181673 - RNA, 22 nt, Human
cggccuuuggcuucuccugugu

SEQ ID NO: 181674 - RNA, 22 nt, Human
cucuauucuaauggauucuggg

SEQ ID NO: 181675 - RNA, 22 nt, Human
cuccuuuuuuuaaagauggauu

SEQ ID NO: 181676 - RNA, 22 nt, Human
cuccuuuuugggaccgugcagc

SEQ ID NO: 181677 - RNA, 22 nt, Human
cuccuuuuccuacucauacuau

SEQ ID NO: 181678 - RNA, 22 nt, Human
ccugucugaaggcagggggaug

SEQ ID NO: 181679 - RNA, 22 nt, Human
ccugucuuuucugaucauacua

SEQ ID NO: 181680 - RNA, 22 nt, Human
ccugugcuucacucaacaagcc

SEQ ID NO: 181681 - RNA, 22 nt, Human
ccugugucaucagcuguggcua

SEQ ID NO: 181682 - RNA, 22 nt, Human
ccugggcucgcgcacuucaccc

SEQ ID NO: 181683 - RNA, 22 nt, Human
ccuggggcucugcacagagcag

SEQ ID NO: 181684 - RNA, 22 nt, Human
ccugggcauaaaucacuccaag

SEQ ID NO: 181685 - RNA, 22 nt, Human
ccugggcauuuguuucacaggu

SEQ ID NO: 181686 - RNA, 22 nt, Human
ccuggcccugcugcuugccagc

SEQ ID NO: 181687 - RNA, 22 nt, Human
cggcgccccgcgcgggcggcuc

SEQ ID NO: 181688 - RNA, 22 nt, Human
cggcuacccaugucauauucgu

SEQ ID NO: 181689 - RNA, 22 nt, Human
ccuguuuguucauguacuguga

SEQ ID NO: 181690 - RNA, 22 nt, Human
ccuguguucguccucaccuugc

SEQ ID NO: 181691 - RNA, 22 nt, Human
cggggcuggcguuagggaggca

SEQ ID NO: 181692 - RNA, 22 nt, Human
cggggggguuggaaaagggaga

SEQ ID NO: 181693 - RNA, 22 nt, Human
cggggcucugcacaggccagga

SEQ ID NO: 181694 - RNA, 22 nt, Human
cggggcgggcgugggaggugga

SEQ ID NO: 181695 - RNA, 22 nt, Human
ccuuccaguucuugguuguaau

SEQ ID NO: 181696 - RNA, 19 nt, Human
cgguaugaauguacuaugg

SEQ ID NO: 181697 - RNA, 22 nt, Human
cggggugugacggugcgggccu

SEQ ID NO: 181698 - RNA, 22 nt, Human
ccuucaguguuacuagaaagcg

SEQ ID NO: 181699 - RNA, 19 nt, Human
cggugcugauuggugcagu

SEQ ID NO: 181700 - RNA, 22 nt, Human
cgggucgcacaggagaaaggcg

SEQ ID NO: 181701 - RNA, 19 nt, Human
cggugaagagaguuuagau

SEQ ID NO: 181702 - RNA, 22 nt, Human
cggucuauuguguaucauuuca

SEQ ID NO: 181703 - RNA, 22 nt, Human
cgucagccacagcugccccggg

SEQ ID NO: 181704 - RNA, 22 nt, Human
cggugcuuuccauaucagcagc

SEQ ID NO: 181705 - RNA, 22 nt, Human
cgugcaggagcuggagguccga

SEQ ID NO: 181706 - RNA, 22 nt, Human
ccuuuuaagggagacuagagau

SEQ ID NO: 181707 - RNA, 22 nt, Human
ccuuuuaucgcgaagaacucca

SEQ ID NO: 181708 - RNA, 22 nt, Human
cgugugugugcgugugcgugug

SEQ ID NO: 181709 - RNA, 20 nt, Human
cguugccagcccggcccggg

SEQ ID NO: 181710 - RNA, 22 nt, Human
cguuauagagcacucgaacuuu

SEQ ID NO: 181711 - RNA, 22 nt, Human
cguuuugaguagauagccauau

SEQ ID NO: 181712 - RNA, 22 nt, Human
cguugguggguguguggucgga

SEQ ID NO: 181713 - RNA, 22 nt, Human
cgaagcuuuuguuggcgugucg

SEQ ID NO: 181714 - RNA, 22 nt, Human
cgacagauuauuuugugacugc

SEQ ID NO: 181715 - RNA, 22 nt, Human
ccugcaguagagguugguaggg

SEQ ID NO: 181716 - RNA, 22 nt, Human
cgcucugccugcccuaacuucc

SEQ ID NO: 181717 - RNA, 22 nt, Human
ccugaguucuuauuuccaguca

SEQ ID NO: 181718 - RNA, 22 nt, Human
cgcuagggagcacuuggcagug

SEQ ID NO: 181719 - RNA, 22 nt, Human
cgcgcuuugggcaguguggcug

SEQ ID NO: 181720 - RNA, 22 nt, Human
ccucuuuugaaccaguucuuca

SEQ ID NO: 181721 - RNA, 22 nt, Human
ccugaauuuaucugaauggugg

SEQ ID NO: 181722 - RNA, 22 nt, Human
ccugaagaugguugauccccuu

SEQ ID NO: 181723 - RNA, 22 nt, Human
cgccuggccccgcagcgcuugu

SEQ ID NO: 181724 - RNA, 22 nt, Human
cgcgcgguguuccgcauucugc

SEQ ID NO: 181725 - RNA, 22 nt, Human
ccugcucccccugcaagccuug

SEQ ID NO: 181726 - RNA, 22 nt, Human
cggccgcgggauggcgggcagc

SEQ ID NO: 181727 - RNA, 22 nt, Human
ccugccuuccagcucuggggag

SEQ ID NO: 181728 - RNA, 22 nt, Human
ccugcaguuuuuccaugauaca

SEQ ID NO: 181729 - RNA, 22 nt, Human
ccugccagccugccaucccaca

SEQ ID NO: 181730 - RNA, 22 nt, Human
ccugccagaaaagagggaguuc

SEQ ID NO: 181731 - RNA, 22 nt, Human
cggcggcgaaccgaccugggug

SEQ ID NO: 181732 - RNA, 22 nt, Human
cggcgcugguacaguggaagag

SEQ ID NO: 181733 - RNA, 22 nt, Human
cggccuuugcccgucauucugg

SEQ ID NO: 181734 - RNA, 18 nt, Human
ccugcguggauguccucu

SEQ ID NO: 181735 - RNA, 22 nt, Human
ccugcuggagucuaguuggucu

SEQ ID NO: 181736 - RNA, 22 nt, Human
ccugcugagccuggugggcagc

SEQ ID NO: 181737 - RNA, 22 nt, Human
ccucaggaauuuauucuucugu

SEQ ID NO: 181738 - RNA, 22 nt, Human
cgacaagagaaaugcuuuguuu

SEQ ID NO: 181739 - RNA, 22 nt, Human
ccucacaaagaaugucuagaca

SEQ ID NO: 181740 - RNA, 22 nt, Human
ccucaauucgugccucacauug

SEQ ID NO: 181741 - RNA, 22 nt, Human
ccgauuuauucugacaguuuau

SEQ ID NO: 181742 - RNA, 22 nt, Human
ccugcugcugaugcuguuucac

SEQ ID NO: 181743 - RNA, 22 nt, Human
ccugcucuaauucauucaugcu

SEQ ID NO: 181744 - RNA, 22 nt, Human
cgcauugcaauucaggggauaa

SEQ ID NO: 181745 - RNA, 22 nt, Human
cgcaucggguagaggagcugga

SEQ ID NO: 181746 - RNA, 22 nt, Human
cgccaaccaggcuguccuccca

SEQ ID NO: 181747 - RNA, 22 nt, Human
cgccaguggcagcuggaacagg

SEQ ID NO: 181748 - RNA, 22 nt, Human
cgcacaggcacagacacuggga

SEQ ID NO: 181749 - RNA, 22 nt, Human
cgcagcuucagggccaggaggg

SEQ ID NO: 181750 - RNA, 22 nt, Human
cgacgacaggcgcccgaggagg

SEQ ID NO: 181751 - RNA, 22 nt, Human
cgaccccugaaaauggcagcca

SEQ ID NO: 181752 - RNA, 22 nt, Human
cgacuacuaacuacuguagaaa

SEQ ID NO: 181753 - RNA, 22 nt, Human
ccucucacucccucauggguuc

SEQ ID NO: 181754 - RNA, 22 nt, Human
uuuuuuuuacuccggacagcuc

SEQ ID NO: 181755 - RNA, 22 nt, Human
uuuuugggaagaauucugauau

SEQ ID NO: 181756 - RNA, 22 nt, Human
uuuuuguaaaugaaguuuuauu

SEQ ID NO: 181757 - RNA, 21 nt, Human
uuuuucuccagaguuuccacu

SEQ ID NO: 181758 - RNA, 22 nt, Human
uuuuucugccucucucccacau

SEQ ID NO: 181759 - RNA, 19 nt, Human
uuuuucccccucuccucag

SEQ ID NO: 181760 - RNA, 18 nt, Human
uuuuuuguucuguuuugu

SEQ ID NO: 181761 - RNA, 22 nt, Human
uuuuuuguuccuugguuuuugu

SEQ ID NO: 181762 - RNA, 22 nt, Human
uuuuuuguggcuggaagaaaaa

SEQ ID NO: 181763 - RNA, 22 nt, Human
uuuuuugucuugaagaaauggu

SEQ ID NO: 181764 - RNA, 22 nt, Human
uuuuuuccuguuugucuuuggg

SEQ ID NO: 181765 - RNA, 22 nt, Human
uuuuuucuggaguuugggguuu

SEQ ID NO: 181766 - RNA, 22 nt, Human
uuuuuucuucucuaucuuaaua

SEQ ID NO: 181767 - RNA, 20 nt, Human
uuuuuuaaauagagcuguug

SEQ ID NO: 181768 - RNA, 22 nt, Human
uuuuuguuauuuagguguagag

SEQ ID NO: 181769 - RNA, 22 nt, Human
uuuguucaccuagcaaacuuuu

SEQ ID NO: 181770 - RNA, 21 nt, Human
uuuguucaggggcaaaguuaa

SEQ ID NO: 181771 - RNA, 22 nt, Human
uuuguucuucucaugcacacaa

SEQ ID NO: 181772 - RNA, 22 nt, Human
uuuguucuagauaacugguaau

SEQ ID NO: 181773 - RNA, 22 nt, Human
uuuguucaguuuguugugggug

SEQ ID NO: 181774 - RNA, 19 nt, Human
uuuguuguaucagagcuuu

SEQ ID NO: 181775 - RNA, 23 nt, Human
uuuguugguuuaagaguagcaga

SEQ ID NO: 181776 - RNA, 22 nt, Human
uuuguuuuggugucaugcguga

SEQ ID NO: 181777 - RNA, 22 nt, Human
uuuuaaaacaugucaaaaugug

SEQ ID NO: 181778 - RNA, 22 nt, Human
uuuguuuauuuacuuugggccu

SEQ ID NO: 181779 - RNA, 17 nt, Human
uuuguuucauacuucau

SEQ ID NO: 181780 - RNA, 19 nt, Human
uuuaaugugugcugcaauc

SEQ ID NO: 181781 - RNA, 22 nt, Human
uuuacuauuaguauuucauuuu

SEQ ID NO: 181782 - RNA, 22 nt, Human
uuuaaugucuuggaaaaagacu

SEQ ID NO: 181783 - RNA, 19 nt, Human
uuuacuuaggccacagaau

SEQ ID NO: 181784 - RNA, 22 nt, Human
uuuguguuuucaggcacauggc

SEQ ID NO: 181785 - RNA, 22 nt, Human
uuuuaaaagguugcuguuauaa

SEQ ID NO: 181786 - RNA, 22 nt, Human
uuuuaaauaaacuacacugauu

SEQ ID NO: 181787 - RNA, 22 nt, Human
uuuuaacuuuaccauuucuuca

SEQ ID NO: 181788 - RNA, 23 nt, Human
uuuuaauaguaugacaugagcug

SEQ ID NO: 181789 - RNA, 23 nt, Human
uuuuacaagagugcauuugucuc

SEQ ID NO: 181790 - RNA, 22 nt, Human
uuuuacaaugcaaauucuugcu

SEQ ID NO: 181791 - RNA, 22 nt, Human
uuuuacuuuucccacuuacagc

SEQ ID NO: 181792 - RNA, 22 nt, Human
uuuucaguuccaucucugcucu

SEQ ID NO: 181793 - RNA, 22 nt, Human
uuuucacugacuuggucuggaa

SEQ ID NO: 181794 - RNA, 22 nt, Human
uuuuaguaauacuuuggccuuu

SEQ ID NO: 181795 - RNA, 22 nt, Human
uuuuauaaaaccuguuugaccu

SEQ ID NO: 181796 - RNA, 22 nt, Human
uuuugaauaauucagaaacagc

SEQ ID NO: 181797 - RNA, 22 nt, Human
uuuucuuggaguggcuguccuu

SEQ ID NO: 181798 - RNA, 22 nt, Human
uuuucugauccuucuaacuuga

SEQ ID NO: 181799 - RNA, 22 nt, Human
uuuucuucggugcuggguugau

SEQ ID NO: 181800 - RNA, 22 nt, Human
uuuucuguuuaugaaauugugu

SEQ ID NO: 181801 - RNA, 22 nt, Human
uuuucuacaaucacucuggaag

SEQ ID NO: 181802 - RNA, 22 nt, Human
uuuuccuucuuccugccuugcc

SEQ ID NO: 181803 - RNA, 22 nt, Human
uuuucuacaaaucuggacuuuu

SEQ ID NO: 181804 - RNA, 22 nt, Human
uuuuccgaccuuaggaaggaac

SEQ ID NO: 181805 - RNA, 22 nt, Human
uuuuccuuaacagagggagaaa

SEQ ID NO: 181806 - RNA, 22 nt, Human
uuuuccuuagaaauacauugau

SEQ ID NO: 181807 - RNA, 22 nt, Human
uuuuccuucugauacuccauuu

SEQ ID NO: 181808 - RNA, 22 nt, Human
uuuucauuguuaguuucuccuu

SEQ ID NO: 181809 - RNA, 22 nt, Human
uuuucauagccagaaacugaaa

SEQ ID NO: 181810 - RNA, 22 nt, Human
uuuuccccuacuaacacugagu

SEQ ID NO: 181811 - RNA, 22 nt, Human
uuuugguuugaguauuuuuuuu

SEQ ID NO: 181812 - RNA, 22 nt, Human
uuuugguaguccagaguuuagu

SEQ ID NO: 181813 - RNA, 18 nt, Human
uuuuguguuuauucugca

SEQ ID NO: 181814 - RNA, 21 nt, Human
uuuuguguugcgcacuuugag

SEQ ID NO: 181815 - RNA, 22 nt, Human
uuuuguagauagggaaacagag

SEQ ID NO: 181816 - RNA, 22 nt, Human
uuuugucuguggaaagcugcua

SEQ ID NO: 181817 - RNA, 20 nt, Human
uuuuguccaccugcaggaag

SEQ ID NO: 181818 - RNA, 22 nt, Human
uuuuucacacuccuuuccaguu

SEQ ID NO: 181819 - RNA, 22 nt, Human
uuuuuauguaaaauauuaaaag

SEQ ID NO: 181820 - RNA, 22 nt, Human
uuuuuagcuguuauuguggaag

SEQ ID NO: 181821 - RNA, 22 nt, Human
uuuuuauaagagcagcagaguu

SEQ ID NO: 181822 - RNA, 22 nt, Human
uuuuuagcauaugucaaaucag

SEQ ID NO: 181823 - RNA, 22 nt, Human
uuuuuaauuuuaagcuauuugu

SEQ ID NO: 181824 - RNA, 22 nt, Human
uuuuuaaaagaugauuuaauga

SEQ ID NO: 181825 - RNA, 22 nt, Human
gaggggcggggcgggaggagag

SEQ ID NO: 181826 - RNA, 22 nt, Human
gaggggcgaggacgcugaagua

SEQ ID NO: 181827 - RNA, 22 nt, Human
gcagaugagagugugaucuggg

SEQ ID NO: 181828 - RNA, 22 nt, Human
gcagcaaucuucacagugucau

SEQ ID NO: 181829 - RNA, 22 nt, Human
gcagcaauaaaacugaaggugu

SEQ ID NO: 181830 - RNA, 22 nt, Human
gcagcagugugggcugaaccua

SEQ ID NO: 181831 - RNA, 20 nt, Human
gcagcagacagacaggggac

SEQ ID NO: 181832 - RNA, 22 nt, Human
gaggguaaauucagaguaggag

SEQ ID NO: 181833 - RNA, 22 nt, Human
gaggggggcacuuguuuugacu

SEQ ID NO: 181834 - RNA, 22 nt, Human
gaggguggagccuccuggaagu

SEQ ID NO: 181835 - RNA, 22 nt, Human
gaggggcucuugggcaugaagg

SEQ ID NO: 181836 - RNA, 22 nt, Human
gcagaaguauuguacgguggga

SEQ ID NO: 181837 - RNA, 22 nt, Human
gagggaggugacaaggacauag

SEQ ID NO: 181838 - RNA, 22 nt, Human
gagggauuuuagugcagcaacu

SEQ ID NO: 181839 - RNA, 22 nt, Human
gcagaggcaaagucuggaugac

SEQ ID NO: 181840 - RNA, 22 nt, Human
gcagagaaugucagauuuuguu

SEQ ID NO: 181841 - RNA, 22 nt, Human
gaggggaauguuccugagcugg

SEQ ID NO: 181842 - RNA, 22 nt, Human
gaggggaaggagcgaaggcggg

SEQ ID NO: 181843 - RNA, 22 nt, Human
gaggggaagaacaauuuaauuu

SEQ ID NO: 181844 - RNA, 22 nt, Human
gcagaggcugccgugggcagga

SEQ ID NO: 181845 - RNA, 22 nt, Human
gcagccagggaccuuugacuau

SEQ ID NO: 181846 - RNA, 21 nt, Human
gcagcaugagaaagccccaaa

SEQ ID NO: 181847 - RNA, 22 nt, Human
gcagcauuaccaagacauggca

SEQ ID NO: 181848 - RNA, 22 nt, Human
gcagccauggcuggccgggcau

SEQ ID NO: 181849 - RNA, 22 nt, Human
gcagccaugcacgucauuauga

SEQ ID NO: 181850 - RNA, 22 nt, Human
gcagccauuugcaucuaauuaa

SEQ ID NO: 181851 - RNA, 22 nt, Human
gagguagcgugcagggcccgaa

SEQ ID NO: 181852 - RNA, 22 nt, Human
gagguagaggaaaagauuauca

SEQ ID NO: 181853 - RNA, 22 nt, Human
gaggucaugcagcucugaguuc

SEQ ID NO: 181854 - RNA, 22 nt, Human
gcaggagggggccuggagccca

SEQ ID NO: 181855 - RNA, 22 nt, Human
gcaggacuucuguuuaaccagu

SEQ ID NO: 181856 - RNA, 22 nt, Human
gcaggaaugguacauaccuguu

SEQ ID NO: 181857 - RNA, 22 nt, Human
gcagcucagcacgcacagguaa

SEQ ID NO: 181858 - RNA, 21 nt, Human
gcagcucaggauauagacuug

SEQ ID NO: 181859 - RNA, 20 nt, Human
gcagcugacccuagugcuug

SEQ ID NO: 181860 - RNA, 22 nt, Human
gcagccugaguuuagcucgucg

SEQ ID NO: 181861 - RNA, 22 nt, Human
gaggccauguggcccgggcugc

SEQ ID NO: 181862 - RNA, 22 nt, Human
gaggccagcacccagaugcaug

SEQ ID NO: 181863 - RNA, 22 nt, Human
gaggcaggcggggcccaggugg

SEQ ID NO: 181864 - RNA, 22 nt, Human
gcacggucagggugggggagug

SEQ ID NO: 181865 - RNA, 22 nt, Human
gcaccgagaaggaagcaugccu

SEQ ID NO: 181866 - RNA, 22 nt, Human
gaggaucuuuagcgggacugcu

SEQ ID NO: 181867 - RNA, 22 nt, Human
gcacauauuuagaucuugaugu

SEQ ID NO: 181868 - RNA, 22 nt, Human
gaggcagaggaugggacuguau

SEQ ID NO: 181869 - RNA, 22 nt, Human
gaggaugacaaagaaggcagac

SEQ ID NO: 181870 - RNA, 22 nt, Human
gaggauuugagggucacuccac

SEQ ID NO: 181871 - RNA, 22 nt, Human
gcacucuguggagacaagauag

SEQ ID NO: 181872 - RNA, 22 nt, Human
gcacucugggucaucugcugcc

SEQ ID NO: 181873 - RNA, 22 nt, Human
gaggcucagagggacuuucaag

SEQ ID NO: 181874 - RNA, 22 nt, Human
gaggcuaugucuacgcucagcg

SEQ ID NO: 181875 - RNA, 22 nt, Human
gaggcgcgcugcgagggcgcgg

SEQ ID NO: 181876 - RNA, 22 nt, Human
gagggaaaggggccaugauugg

SEQ ID NO: 181877 - RNA, 22 nt, Human
gaggcaggaagggaggguugug

SEQ ID NO: 181878 - RNA, 23 nt, Human
gcacuguuugaggagcacugugc

SEQ ID NO: 181879 - RNA, 21 nt, Human
gcagaaagugauuugcuauuc

SEQ ID NO: 181880 - RNA, 22 nt, Human
gcacagaguguaaaaguuucau

SEQ ID NO: 181881 - RNA, 22 nt, Human
gaggagacaguggagccgcuac

SEQ ID NO: 181882 - RNA, 22 nt, Human
gaggagggagcuggaagcucuu

SEQ ID NO: 181883 - RNA, 22 nt, Human
gaggaggucaccuggugagcaa

SEQ ID NO: 181884 - RNA, 22 nt, Human
gcacaaguccuccgacagcacg

SEQ ID NO: 181885 - RNA, 22 nt, Human
gaggagcggugcaugugggggc

SEQ ID NO: 181886 - RNA, 22 nt, Human
gaggagcugggucagggagaca

SEQ ID NO: 181887 - RNA, 22 nt, Human
gaggaggacauuggaaagaacu

SEQ ID NO: 181888 - RNA, 22 nt, Human
gaggaggagaagcggcggcgga

SEQ ID NO: 181889 - RNA, 22 nt, Human
gcaacuccuaggcgaggccuuc

SEQ ID NO: 181890 - RNA, 22 nt, Human
gaggagagaaauguuuucugug

SEQ ID NO: 181891 - RNA, 22 nt, Human
gaggagagcuggccagguuucu

SEQ ID NO: 181892 - RNA, 22 nt, Human
gcaaggaagcagaguugcuauc

SEQ ID NO: 181893 - RNA, 22 nt, Human
gaggagaaacagccgugauagu

SEQ ID NO: 181894 - RNA, 22 nt, Human
gcaagagaagaaagaauaguuu

SEQ ID NO: 181895 - RNA, 22 nt, Human
gaggacugguugggaaugugaa

SEQ ID NO: 181896 - RNA, 22 nt, Human
gaggacuucaggccuggccagg

SEQ ID NO: 181897 - RNA, 22 nt, Human
gaggaaagcugguuuaaaguau

SEQ ID NO: 181898 - RNA, 22 nt, Human
gagcaggcuggcagggccaggg

SEQ ID NO: 181899 - RNA, 22 nt, Human
gauguuggugcauucacuucug

SEQ ID NO: 181900 - RNA, 22 nt, Human
gauguuaauauguuucaccaaa

SEQ ID NO: 181901 - RNA, 22 nt, Human
gauuaucaccaaauggccuccu

SEQ ID NO: 181902 - RNA, 19 nt, Human
gagcaugacuggccuugca

SEQ ID NO: 181903 - RNA, 22 nt, Human
gagccaugagauaagagcaccu

SEQ ID NO: 181904 - RNA, 22 nt, Human
gagcaugacgcaacaccaagug

SEQ ID NO: 181905 - RNA, 22 nt, Human
gauucagagcugcaacaaagaa

SEQ ID NO: 181906 - RNA, 22 nt, Human
gagccgcagcugcguagggucc

SEQ ID NO: 181907 - RNA, 22 nt, Human
gauuccugcuauucacagggcu

SEQ ID NO: 181908 - RNA, 22 nt, Human
gagcccuguagcaagucauguc

SEQ ID NO: 181909 - RNA, 22 nt, Human
gauucuaucauucuguauauua

SEQ ID NO: 181910 - RNA, 22 nt, Human
gauugauguaggugauaaaucu

SEQ ID NO: 181911 - RNA, 22 nt, Human
gauuggucacacaauaguauau

SEQ ID NO: 181912 - RNA, 22 nt, Human
gauugcugccagcguguccgug

SEQ ID NO: 181913 - RNA, 22 nt, Human
gagcgcacagaaggaagcagcc

SEQ ID NO: 181914 - RNA, 22 nt, Human
gagcgacucuuuuaguccagag

SEQ ID NO: 181915 - RNA, 19 nt, Human
gagccgcucccgcagccgg

SEQ ID NO: 181916 - RNA, 22 nt, Human
gauuucauaaaacgagaaacuc

SEQ ID NO: 181917 - RNA, 22 nt, Human
gagccggggcucccugaggucc

SEQ ID NO: 181918 - RNA, 22 nt, Human
gagccuggagcuggaacgaagc

SEQ ID NO: 181919 - RNA, 22 nt, Human
gauuucuucauuuaaaaauauu

SEQ ID NO: 181920 - RNA, 22 nt, Human
gauuuucauuauagcuaguuuc

SEQ ID NO: 181921 - RNA, 22 nt, Human
gauuuuaaaagauguauaaggu

SEQ ID NO: 181922 - RNA, 21 nt, Human
gcaaccagaccacagggcagu

SEQ ID NO: 181923 - RNA, 22 nt, Human
gcaacccugggucaugguugac

SEQ ID NO: 181924 - RNA, 22 nt, Human
gauuuuuaaaaguaguuuugaa

SEQ ID NO: 181925 - RNA, 22 nt, Human
gcaaagaauugauucauuuugc

SEQ ID NO: 181926 - RNA, 22 nt, Human
gcaaaugacuuagucacuccag

SEQ ID NO: 181927 - RNA, 22 nt, Human
gauuuugcuuuagugaaggaag

SEQ ID NO: 181928 - RNA, 22 nt, Human
gagcuaagcccuggagaggucg

SEQ ID NO: 181929 - RNA, 22 nt, Human
gagcguuucccugggggucugc

SEQ ID NO: 181930 - RNA, 22 nt, Human
gagcggcucaguggccauguga

SEQ ID NO: 181931 - RNA, 22 nt, Human
gagauuaauuaaaaccuuuaug

SEQ ID NO: 181932 - RNA, 22 nt, Human
gagaugugguucaaggguguuu

SEQ ID NO: 181933 - RNA, 22 nt, Human
gagagugggagauuuccagcag

SEQ ID NO: 181934 - RNA, 22 nt, Human
gagaguuggaggguauguuagu

SEQ ID NO: 181935 - RNA, 22 nt, Human
gaugguaucugcuggcuuucag

SEQ ID NO: 181936 - RNA, 22 nt, Human
gauggugauggcccuaagcuga

SEQ ID NO: 181937 - RNA, 22 nt, Human
gauggugcaauuaucgugcaug

SEQ ID NO: 181938 - RNA, 22 nt, Human
gauggggaaaaaauggaucuuu

SEQ ID NO: 181939 - RNA, 22 nt, Human
gauggguuugagauguuugggu

SEQ ID NO: 181940 - RNA, 22 nt, Human
gauggguugaguucauggagcc

SEQ ID NO: 181941 - RNA, 22 nt, Human
gaugggaggaugaauuggaccu

SEQ ID NO: 181942 - RNA, 22 nt, Human
gagcaacacauugaaugaggau

SEQ ID NO: 181943 - RNA, 22 nt, Human
gagcacugagcuggaauuggag

SEQ ID NO: 181944 - RNA, 22 nt, Human
gagcagcacagaccaaacagaa

SEQ ID NO: 181945 - RNA, 22 nt, Human
gagcagcucgagaaggaagcag

SEQ ID NO: 181946 - RNA, 22 nt, Human
gaugugugugcccugggccugc

SEQ ID NO: 181947 - RNA, 22 nt, Human
gaugucuauguccagggccauc

SEQ ID NO: 181948 - RNA, 22 nt, Human
gagcagcaggccagguugcagg

SEQ ID NO: 181949 - RNA, 22 nt, Human
gaugguuuuacauuuuaauguu

SEQ ID NO: 181950 - RNA, 20 nt, Human
gagaauuccagguuucugug

SEQ ID NO: 181951 - RNA, 22 nt, Human
gaagauuauuacucauugcagg

SEQ ID NO: 181952 - RNA, 22 nt, Human
gagacagugucagccauugaaa

SEQ ID NO: 181953 - RNA, 22 nt, Human
gagacugcguggcucugacaca

SEQ ID NO: 181954 - RNA, 23 nt, Human
gaugauggcaacuacauccggug

SEQ ID NO: 181955 - RNA, 22 nt, Human
gaugauugaauaaauaugguca

SEQ ID NO: 181956 - RNA, 22 nt, Human
gaugauuccuuuguucauugug

SEQ ID NO: 181957 - RNA, 22 nt, Human
gagagaguaucugcugguucac

SEQ ID NO: 181958 - RNA, 22 nt, Human
gagagaggggaagagaagcucu

SEQ ID NO: 181959 - RNA, 22 nt, Human
gaugauaacagcauuucaacug

SEQ ID NO: 181960 - RNA, 22 nt, Human
gagagguuaucugcuaagguag

SEQ ID NO: 181961 - RNA, 22 nt, Human
gaugccuccaggaaagaggacg

SEQ ID NO: 181962 - RNA, 22 nt, Human
gauggcaaugcuagaaauuuag

SEQ ID NO: 181963 - RNA, 22 nt, Human
gaugccggggucguagccgugg

SEQ ID NO: 181964 - RNA, 20 nt, Human
gauuuaacgcugcgucuguc

SEQ ID NO: 181965 - RNA, 22 nt, Human
gauugggagugugacauuguau

SEQ ID NO: 181966 - RNA, 21 nt, Human
gccgugcgccuccaggcgcgc

SEQ ID NO: 181967 - RNA, 22 nt, Human
gauugcauaugcauucugauac

SEQ ID NO: 181968 - RNA, 22 nt, Human
gauugcaucaauauuuagagua

SEQ ID NO: 181969 - RNA, 22 nt, Human
gccgcguggcagucuuggugac

SEQ ID NO: 181970 - RNA, 22 nt, Human
gccggcccugcgcggggcggaa

SEQ ID NO: 181971 - RNA, 22 nt, Human
gauucugaaauuaacagacugg

SEQ ID NO: 181972 - RNA, 22 nt, Human
gauuccuuucgccugccgagcu

SEQ ID NO: 181973 - RNA, 22 nt, Human
gauugauuuaauaugagaggau

SEQ ID NO: 181974 - RNA, 22 nt, Human
gccgccgcucaccugggcgccg

SEQ ID NO: 181975 - RNA, 22 nt, Human
gccgccgccgccuuuguugcgg

SEQ ID NO: 181976 - RNA, 18 nt, Human
gccgccuugcucgugaac

SEQ ID NO: 181977 - RNA, 21 nt, Human
gccgaugugacucuacguagu

SEQ ID NO: 181978 - RNA, 22 nt, Human
gauguaucugagcugcuuaggu

SEQ ID NO: 181979 - RNA, 22 nt, Human
gaugguggggggcagcugggag

SEQ ID NO: 181980 - RNA, 22 nt, Human
gcccugaagagguagagaauuu

SEQ ID NO: 181981 - RNA, 22 nt, Human
gccuuuauauuacauuuggaag

SEQ ID NO: 181982 - RNA, 22 nt, Human
gccugggcuuccgggacccggg

SEQ ID NO: 181983 - RNA, 22 nt, Human
gcacagauaaucugccuuacca

SEQ ID NO: 181984 - RNA, 22 nt, Human
gcacagcuaugagcugaauugu

SEQ ID NO: 181985 - RNA, 22 nt, Human
gccugaaaugaaccagaggacu

SEQ ID NO: 181986 - RNA, 22 nt, Human
gccugagucaagauguggcacc

SEQ ID NO: 181987 - RNA, 22 nt, Human
gccugagauuggacauuauuua

SEQ ID NO: 181988 - RNA, 22 nt, Human
gccuggaaugcaaugugacgaa

SEQ ID NO: 181989 - RNA, 22 nt, Human
gccugcuugaaagcacuuucug

SEQ ID NO: 181990 - RNA, 22 nt, Human
gccucaaaaguguuguagaggg

SEQ ID NO: 181991 - RNA, 22 nt, Human
gccuccgccuuccugucucccc

SEQ ID NO: 181992 - RNA, 22 nt, Human
gccuccuccaucauugcuucau

SEQ ID NO: 181993 - RNA, 21 nt, Human
gauuuuagggcagccaaacac

SEQ ID NO: 181994 - RNA, 22 nt, Human
gcaaaaacaguguagucuucug

SEQ ID NO: 181995 - RNA, 22 nt, Human
gcaacguauauggguaaggaua

SEQ ID NO: 181996 - RNA, 22 nt, Human
gagguuuaguccauaguauuua

SEQ ID NO: 181997 - RNA, 22 nt, Human
gagguuggagggcugcccugca

SEQ ID NO: 181998 - RNA, 22 nt, Human
gcaggccgauuuguuagaaguc

SEQ ID NO: 181999 - RNA, 22 nt, Human
gaggugggaggcgggccugcau

SEQ ID NO: 182000 - RNA, 22 nt, Human
gaggugcaggggcccgggcugg

SEQ ID NO: 182001 - RNA, 22 nt, Human
gagguucgauacagcguauuua

SEQ ID NO: 182002 - RNA, 22 nt, Human
gcaugcgugcgugcgugcaugu

SEQ ID NO: 182003 - RNA, 22 nt, Human
gauaaugcuuuggucagacaug

SEQ ID NO: 182004 - RNA, 22 nt, Human
gcauggaaaagggaugcuaacu

SEQ ID NO: 182005 - RNA, 22 nt, Human
gaguugucggaggaagggggcg

SEQ ID NO: 182006 - RNA, 22 nt, Human
gaguuucacguagaucaggguc

SEQ ID NO: 182007 - RNA, 22 nt, Human
gaguuggggcugcguguuucca

SEQ ID NO: 182008 - RNA, 22 nt, Human
gcauuggaaacugcuuuaugcu

SEQ ID NO: 182009 - RNA, 22 nt, Human
gcauuuaaauuugaacuucaga

SEQ ID NO: 182010 - RNA, 20 nt, Human
gauagcacaaagagaauggg

SEQ ID NO: 182011 - RNA, 22 nt, Human
gauauauuucaaauucuuuugc

SEQ ID NO: 182012 - RNA, 22 nt, Human
gcauuccagaguugcuggaaaa

SEQ ID NO: 182013 - RNA, 22 nt, Human
gcauuagacuaguacacggcag

SEQ ID NO: 182014 - RNA, 22 nt, Human
gauaauuauaggcuaagccacu

SEQ ID NO: 182015 - RNA, 23 nt, Human
gcaugcccauauguguauauaua

SEQ ID NO: 182016 - RNA, 22 nt, Human
gcauguucaaguuaguauauuu

SEQ ID NO: 182017 - RNA, 22 nt, Human
gauacaugucacaaguugugca

SEQ ID NO: 182018 - RNA, 22 nt, Human
gauacuugaggagaucaccaca

SEQ ID NO: 182019 - RNA, 22 nt, Human
gauagaaagagaaucagaacuu

SEQ ID NO: 182020 - RNA, 22 nt, Human
gcccagaagguagcgaguaguc

SEQ ID NO: 182021 - RNA, 22 nt, Human
gauggcauucacaaacuuaacu

SEQ ID NO: 182022 - RNA, 23 nt, Human
gcccagaggccccuggccugagc

SEQ ID NO: 182023 - RNA, 22 nt, Human
gcccagacaucuguugggaccu

SEQ ID NO: 182024 - RNA, 22 nt, Human
gcccgccaacuugccagcggug

SEQ ID NO: 182025 - RNA, 22 nt, Human
gccauggugagccaccuggugg

SEQ ID NO: 182026 - RNA, 22 nt, Human
gaugauuuuguaacuggggaca

SEQ ID NO: 182027 - RNA, 22 nt, Human
gccauguucuugaaucuggguc

SEQ ID NO: 182028 - RNA, 22 nt, Human
gccaucuucggcagccgccugg

SEQ ID NO: 182029 - RNA, 22 nt, Human
gauggacgguuuuaccagacag

SEQ ID NO: 182030 - RNA, 22 nt, Human
gauggauuuuuuauuaaaucag

SEQ ID NO: 182031 - RNA, 22 nt, Human
gaugcucuugauuggaccaggg

SEQ ID NO: 182032 - RNA, 22 nt, Human
gaugcuaauuaaugaagaggag

SEQ ID NO: 182033 - RNA, 22 nt, Human
gcauuucauaaccagccaugcu

SEQ ID NO: 182034 - RNA, 23 nt, Human
gcauuugcaggaaacuggaaaag

SEQ ID NO: 182035 - RNA, 22 nt, Human
gccaguaaaguaucuccuuuug

SEQ ID NO: 182036 - RNA, 22 nt, Human
gaugaaguaguccacuggaagg

SEQ ID NO: 182037 - RNA, 22 nt, Human
gccaggugauuucaaaguccuu

SEQ ID NO: 182038 - RNA, 22 nt, Human
gaucauuuucauuaauguugca

SEQ ID NO: 182039 - RNA, 22 nt, Human
gcggcccggguccccagcagca

SEQ ID NO: 182040 - RNA, 22 nt, Human
gcggaucuccuugagugggcaa

SEQ ID NO: 182041 - RNA, 23 nt, Human
gcagccaacccacgugagagaag

SEQ ID NO: 182042 - RNA, 22 nt, Human
gcggagaggcagagacuccgcg

SEQ ID NO: 182043 - RNA, 22 nt, Human
gcggagcuaaagauuggcuccu

SEQ ID NO: 182044 - RNA, 22 nt, Human
gcgauugguuuggggccagagu

SEQ ID NO: 182045 - RNA, 22 nt, Human
gccuuucuugguuugucaggca

SEQ ID NO: 182046 - RNA, 22 nt, Human
gccuuggacuaccacucccaca

SEQ ID NO: 182047 - RNA, 22 nt, Human
gcaggacugauggagcauaugu

SEQ ID NO: 182048 - RNA, 22 nt, Human
gcguagaagaaagcugcugcua

SEQ ID NO: 182049 - RNA, 22 nt, Human
gcgguggcuacuaaaguucgaa

SEQ ID NO: 182050 - RNA, 22 nt, Human
gcggucuaggaccucagugugu

SEQ ID NO: 182051 - RNA, 22 nt, Human
gcagcgcugagaugauuuguug

SEQ ID NO: 182052 - RNA, 22 nt, Human
gcagcguguggcuaauggcucu

SEQ ID NO: 182053 - RNA, 22 nt, Human
gcagcguuaacauuuuuccugu

SEQ ID NO: 182054 - RNA, 22 nt, Human
gcggcgucccagcuccgacggc

SEQ ID NO: 182055 - RNA, 22 nt, Human
gcgucucugggcugacccaggu

SEQ ID NO: 182056 - RNA, 22 nt, Human
gcgugcauggccguguguaugc

SEQ ID NO: 182057 - RNA, 21 nt, Human
gcaggggugugugagcugggg

SEQ ID NO: 182058 - RNA, 22 nt, Human
gcguggccugcugaaggacuuc

SEQ ID NO: 182059 - RNA, 22 nt, Human
gcuaagcuuugagucuggacag

SEQ ID NO: 182060 - RNA, 22 nt, Human
gcuacaaauaaaaugggugacu

SEQ ID NO: 182061 - RNA, 22 nt, Human
gcaguuaccuauuuuguagaaa

SEQ ID NO: 182062 - RNA, 22 nt, Human
gcuauacuugccuccucuccac

SEQ ID NO: 182063 - RNA, 17 nt, Human
gcuaguuguuuccagua

SEQ ID NO: 182064 - RNA, 22 nt, Human
gcaguugguccagccucggcug

SEQ ID NO: 182065 - RNA, 19 nt, Human
gcaguuccucuuaagagaa

SEQ ID NO: 182066 - RNA, 19 nt, Human
gcaguuauggcccacuucc

SEQ ID NO: 182067 - RNA, 22 nt, Human
gcuauuggcuaauuguugcaac

SEQ ID NO: 182068 - RNA, 22 nt, Human
gcauaacaacagacucuguguu

SEQ ID NO: 182069 - RNA, 22 nt, Human
gcaucuccugagucagauuuug

SEQ ID NO: 182070 - RNA, 22 nt, Human
gcaugaauggaacccccugagu

SEQ ID NO: 182071 - RNA, 19 nt, Human
gcuccugcagcuagagugc

SEQ ID NO: 182072 - RNA, 22 nt, Human
gccaguuuguuuacugaugguu

SEQ ID NO: 182073 - RNA, 22 nt, Human
gccauauucaugcaggugcuaa

SEQ ID NO: 182074 - RNA, 22 nt, Human
gccagggcucgagcaggccagc

SEQ ID NO: 182075 - RNA, 22 nt, Human
gcugcgcugggacgccaccaac

SEQ ID NO: 182076 - RNA, 22 nt, Human
gccaggcggcccaggagauggc

SEQ ID NO: 182077 - RNA, 22 nt, Human
gcugcuacagagcuggaggggg

SEQ ID NO: 182078 - RNA, 22 nt, Human
gcugcucaaaaaaacacuagcu

SEQ ID NO: 182079 - RNA, 22 nt, Human
gcugcuggcggagcuggcgcug

SEQ ID NO: 182080 - RNA, 22 nt, Human
gcuggaagggccagcuuucagg

SEQ ID NO: 182081 - RNA, 22 nt, Human
gccaucugcuuagauugcuggg

SEQ ID NO: 182082 - RNA, 22 nt, Human
gcuggauaaggaucaguuucuu

SEQ ID NO: 182083 - RNA, 22 nt, Human
gcuggauuuaggguucccuccu

SEQ ID NO: 182084 - RNA, 22 nt, Human
gcuggaugucugugccaggcac

SEQ ID NO: 182085 - RNA, 22 nt, Human
gcuggccugcgagggcaggcug

SEQ ID NO: 182086 - RNA, 22 nt, Human
gccauguuuugguaaauaccau

SEQ ID NO: 182087 - RNA, 21 nt, Human
gcuggcugucucuuacacggu

SEQ ID NO: 182088 - RNA, 22 nt, Human
gccaugguggggccucccugac

SEQ ID NO: 182089 - RNA, 22 nt, Human
gcugagaguguaggauguuuac

SEQ ID NO: 182090 - RNA, 22 nt, Human
gcucuccuugaugcccucuguu

SEQ ID NO: 182091 - RNA, 22 nt, Human
gcucucuggccugggaggagga

SEQ ID NO: 182092 - RNA, 23 nt, Human
gcucugauaccagcuacaucuag

SEQ ID NO: 182093 - RNA, 22 nt, Human
gcauuuuaauuggggcaguuag

SEQ ID NO: 182094 - RNA, 22 nt, Human
gcucuucuaaguuuacccuucc

SEQ ID NO: 182095 - RNA, 22 nt, Human
gcugccgcugcggggcgcgggc

SEQ ID NO: 182096 - RNA, 22 nt, Human
gcugcaggaggugguagggucu

SEQ ID NO: 182097 - RNA, 22 nt, Human
gccaaucaggaggcuguacauc

SEQ ID NO: 182098 - RNA, 20 nt, Human
gccaccucugcucuuucccg

SEQ ID NO: 182099 - RNA, 22 nt, Human
gccagccggugaguggaagcgg

SEQ ID NO: 182100 - RNA, 22 nt, Human
gccagcuuagaucccccagccc

SEQ ID NO: 182101 - RNA, 18 nt, Human
gccagcccuccaaccucc

SEQ ID NO: 182102 - RNA, 16 nt, Human
gccagauugaacuuug

SEQ ID NO: 182103 - RNA, 21 nt, Human
gccacugcugcucauucucug

SEQ ID NO: 182104 - RNA, 23 nt, Human
gcugccguuucccaucgugguga

SEQ ID NO: 182105 - RNA, 22 nt, Human
gcugcgccgggagccggggccg

SEQ ID NO: 182106 - RNA, 22 nt, Human
gcugccuugaacuuggccuggg

SEQ ID NO: 182107 - RNA, 22 nt, Human
gggucuggagauccgggugaag

SEQ ID NO: 182108 - RNA, 20 nt, Human
gggucuggcaucucucucug

SEQ ID NO: 182109 - RNA, 22 nt, Human
ggguauuugacaaacugacacu

SEQ ID NO: 182110 - RNA, 19 nt, Human
ggaguugccaggagaagga

SEQ ID NO: 182111 - RNA, 22 nt, Human
ggaguuucugucaucccguccc

SEQ ID NO: 182112 - RNA, 22 nt, Human
gggugguggagguuugacagac

SEQ ID NO: 182113 - RNA, 22 nt, Human
gggugucugcugaauuucccuu

SEQ ID NO: 182114 - RNA, 22 nt, Human
ggggcguugccacggggacggg

SEQ ID NO: 182115 - RNA, 22 nt, Human
ggggcggcgugggcgcggugau

SEQ ID NO: 182116 - RNA, 22 nt, Human
ggggccaugauggacgagguga

SEQ ID NO: 182117 - RNA, 22 nt, Human
ggagaucucauugauacugaua

SEQ ID NO: 182118 - RNA, 22 nt, Human
ggggccgggccggcagacuggg

SEQ ID NO: 182119 - RNA, 22 nt, Human
ggggugaggcagggcagggguc

SEQ ID NO: 182120 - RNA, 22 nt, Human
gggguguuagucuuacccagag

SEQ ID NO: 182121 - RNA, 22 nt, Human
gggguauuugguagacauuuug

SEQ ID NO: 182122 - RNA, 22 nt, Human
gggguaggaagagaaaauagug

SEQ ID NO: 182123 - RNA, 22 nt, Human
ggaggaagagaccagggggcuu

SEQ ID NO: 182124 - RNA, 17 nt, Human
ggggcguguauuugaug

SEQ ID NO: 182125 - RNA, 22 nt, Human
gggggcugugugcccgcucccc

SEQ ID NO: 182126 - RNA, 22 nt, Human
ggggcucauuugcaggggggag

SEQ ID NO: 182127 - RNA, 22 nt, Human
ggagaugaaugugguaaaacug

SEQ ID NO: 182128 - RNA, 22 nt, Human
ggggcugggaggccggcgcgca

SEQ ID NO: 182129 - RNA, 22 nt, Human
ggagaaacuaguuagauccaau

SEQ ID NO: 182130 - RNA, 22 nt, Human
ggacuuuggauuuuauucuaaa

SEQ ID NO: 182131 - RNA, 22 nt, Human
ggggaagugguggggcuccgag

SEQ ID NO: 182132 - RNA, 22 nt, Human
ggggaaggaaggggagggcacg

SEQ ID NO: 182133 - RNA, 22 nt, Human
ggggaaauauuucugaccugug

SEQ ID NO: 182134 - RNA, 22 nt, Human
ggggaagagagaagaaugaucu

SEQ ID NO: 182135 - RNA, 22 nt, Human
gggcuggggcucuggggcuagg

SEQ ID NO: 182136 - RNA, 22 nt, Human
ggacauugaagcuggaaaggga

SEQ ID NO: 182137 - RNA, 22 nt, Human
gggcugaugcuuauacauacug

SEQ ID NO: 182138 - RNA, 23 nt, Human
ggacaugucucuggguauuuuga

SEQ ID NO: 182139 - RNA, 22 nt, Human
ggggaggaagcuggaacacggg

SEQ ID NO: 182140 - RNA, 22 nt, Human
ggagaagaggagcuggaagccu

SEQ ID NO: 182141 - RNA, 23 nt, Human
ggagaaggaugucaucaaaagac

SEQ ID NO: 182142 - RNA, 22 nt, Human
ggagagcguggaugggcuucca

SEQ ID NO: 182143 - RNA, 22 nt, Human
ggggauuuuucuuacucuuagg

SEQ ID NO: 182144 - RNA, 22 nt, Human
ggggauuucccaaugcgaagca

SEQ ID NO: 182145 - RNA, 22 nt, Human
ggagagcuagugagcuggaggu

SEQ ID NO: 182146 - RNA, 22 nt, Human
ggagaggaaguuuaaagaauug

SEQ ID NO: 182147 - RNA, 22 nt, Human
ggagauaugugaaaaagacagc

SEQ ID NO: 182148 - RNA, 22 nt, Human
ggaaggugagugcugugugauu

SEQ ID NO: 182149 - RNA, 22 nt, Human
ggaaggggagcuggaaagggua

SEQ ID NO: 182150 - RNA, 22 nt, Human
gggcaugugauggacgugugcc

SEQ ID NO: 182151 - RNA, 22 nt, Human
gggcagucagauucgggggccu

SEQ ID NO: 182152 - RNA, 22 nt, Human
gggcaggggcagugguggcauu

SEQ ID NO: 182153 - RNA, 19 nt, Human
ggaacgcugggcuccccuc

SEQ ID NO: 182154 - RNA, 17 nt, Human
ggaagaaaaggaucauc

SEQ ID NO: 182155 - RNA, 22 nt, Human
gggcggugccugucuccgaagc

SEQ ID NO: 182156 - RNA, 22 nt, Human
gggcggcguccucagucgggug

SEQ ID NO: 182157 - RNA, 22 nt, Human
gggcggggcucacggugcggca

SEQ ID NO: 182158 - RNA, 22 nt, Human
ggaaguggauucagggcugcua

SEQ ID NO: 182159 - RNA, 22 nt, Human
gggcgcuuucugggucagggcu

SEQ ID NO: 182160 - RNA, 22 nt, Human
gggcgcgcggagccucgccggg

SEQ ID NO: 182161 - RNA, 22 nt, Human
gggcgcuguguuaggugcugua

SEQ ID NO: 182162 - RNA, 22 nt, Human
gggcuacagaugggagggauga

SEQ ID NO: 182163 - RNA, 20 nt, Human
gggcucugcauccaucagcc

SEQ ID NO: 182164 - RNA, 22 nt, Human
ggacauagaucuagacuuuaaa

SEQ ID NO: 182165 - RNA, 22 nt, Human
ggacaauuguacucgauuucaa

SEQ ID NO: 182166 - RNA, 22 nt, Human
ggacagacuuuacagccccggg

SEQ ID NO: 182167 - RNA, 22 nt, Human
gcuuuucaaguuacaauuagcu

SEQ ID NO: 182168 - RNA, 22 nt, Human
gcuuuuaaauuaucugacaaug

SEQ ID NO: 182169 - RNA, 22 nt, Human
gggagcuggagcuggaagacuc

SEQ ID NO: 182170 - RNA, 21 nt, Human
gggaggagcuucccuuugccc

SEQ ID NO: 182171 - RNA, 22 nt, Human
gcuguggaaaaugggucuccaa

SEQ ID NO: 182172 - RNA, 22 nt, Human
gcuguggacacagcucucuuca

SEQ ID NO: 182173 - RNA, 22 nt, Human
gcuguggcuccaauggugagcc

SEQ ID NO: 182174 - RNA, 22 nt, Human
gcuguggagaagcugccuaugg

SEQ ID NO: 182175 - RNA, 22 nt, Human
gcuuuggcuucuccuggcagga

SEQ ID NO: 182176 - RNA, 22 nt, Human
gcuuuguucauuuaguuuuuuu

SEQ ID NO: 182177 - RNA, 22 nt, Human
gggagcugagcuggaagagaau

SEQ ID NO: 182178 - RNA, 23 nt, Human
gcuuugaaaaugcuuucuuccag

SEQ ID NO: 182179 - RNA, 22 nt, Human
gggagguaaugggggugcaggg

SEQ ID NO: 182180 - RNA, 22 nt, Human
gggagggucugagagcugcacc

SEQ ID NO: 182181 - RNA, 21 nt, Human
gggagugaguaaugauggggg

SEQ ID NO: 182182 - RNA, 22 nt, Human
gggaguauguccgggcucuaga

SEQ ID NO: 182183 - RNA, 22 nt, Human
ggaaaagaauuguuaguuagug

SEQ ID NO: 182184 - RNA, 22 nt, Human
gggcaagagaggaagagauggc

SEQ ID NO: 182185 - RNA, 22 nt, Human
gggcaagaggguuugacaugag

SEQ ID NO: 182186 - RNA, 22 nt, Human
ggccuggcacauaguaggcagu

SEQ ID NO: 182187 - RNA, 20 nt, Human
ggccugagcauggcuggcag

SEQ ID NO: 182188 - RNA, 22 nt, Human
guaguuuuucuugcaagaguag

SEQ ID NO: 182189 - RNA, 22 nt, Human
ggccgcuuucuggggagugagg

SEQ ID NO: 182190 - RNA, 22 nt, Human
ggccgggcaugcgagcugagcg

SEQ ID NO: 182191 - RNA, 22 nt, Human
ggccgccacuuuccagugcugc

SEQ ID NO: 182192 - RNA, 22 nt, Human
guagaacucuuuccugcguggg

SEQ ID NO: 182193 - RNA, 22 nt, Human
guacugggaauggagccugggc

SEQ ID NO: 182194 - RNA, 22 nt, Human
guagaaaauagauugucucuug

SEQ ID NO: 182195 - RNA, 22 nt, Human
guagucauugggucugugguca

SEQ ID NO: 182196 - RNA, 22 nt, Human
guagccauuuucuagagaguua

SEQ ID NO: 182197 - RNA, 22 nt, Human
guagaucaugaaaauucacugc

SEQ ID NO: 182198 - RNA, 22 nt, Human
guagggguggggagguggucug

SEQ ID NO: 182199 - RNA, 22 nt, Human
gguuuucuuguucauuuuuuaa

SEQ ID NO: 182200 - RNA, 22 nt, Human
guaaauaucucacgaaugauuc

SEQ ID NO: 182201 - RNA, 22 nt, Human
guaagaauauacccaggaguca

SEQ ID NO: 182202 - RNA, 22 nt, Human
guaacuuuuuccucauuggcua

SEQ ID NO: 182203 - RNA, 22 nt, Human
guacaaagucaaggugaaaaua

SEQ ID NO: 182204 - RNA, 22 nt, Human
guaagcagcaugacgguuggau

SEQ ID NO: 182205 - RNA, 22 nt, Human
guaauaggagggagucugcuuu

SEQ ID NO: 182206 - RNA, 22 nt, Human
ggcccugcuuccccaguguaca

SEQ ID NO: 182207 - RNA, 22 nt, Human
ggcccgcgcugcuggcgcgcca

SEQ ID NO: 182208 - RNA, 22 nt, Human
gguugccuguggcucccuguua

SEQ ID NO: 182209 - RNA, 22 nt, Human
gguugauuuuuaugaagccaug

SEQ ID NO: 182210 - RNA, 22 nt, Human
gguuuuccaguagaucagaaga

SEQ ID NO: 182211 - RNA, 22 nt, Human
ggcccuggggcaggagcagagg

SEQ ID NO: 182212 - RNA, 22 nt, Human
gguucuggaaaagaaagcaaag

SEQ ID NO: 182213 - RNA, 22 nt, Human
ggccagcgugggggaguagcgg

SEQ ID NO: 182214 - RNA, 22 nt, Human
gguguagggaaacuugacuaau

SEQ ID NO: 182215 - RNA, 22 nt, Human
ggucugcaaugauuugaaaaac

SEQ ID NO: 182216 - RNA, 22 nt, Human
ggucugauaccugcagguuguc

SEQ ID NO: 182217 - RNA, 22 nt, Human
ggucuuauaauuaauuuaggcu

SEQ ID NO: 182218 - RNA, 22 nt, Human
ggcaagauccagcacaaacaca

SEQ ID NO: 182219 - RNA, 22 nt, Human
ggauuugaugagacuaucuacu

SEQ ID NO: 182220 - RNA, 19 nt, Human
ggauaagguuggagugauc

SEQ ID NO: 182221 - RNA, 22 nt, Human
ggguguuaugccucugagucag

SEQ ID NO: 182222 - RNA, 22 nt, Human
gguaauugaaaguuuguugaug

SEQ ID NO: 182223 - RNA, 18 nt, Human
gguacguuuugaucaaug

SEQ ID NO: 182224 - RNA, 22 nt, Human
gguagagagugaggaggggcuc

SEQ ID NO: 182225 - RNA, 22 nt, Human
gguagaggaugaggagguugga

SEQ ID NO: 182226 - RNA, 22 nt, Human
gguagacugagcuccuugagga

SEQ ID NO: 182227 - RNA, 21 nt, Human
gguagggaagguguuccucau

SEQ ID NO: 182228 - RNA, 23 nt, Human
gguagguggggagauuaaagucu

SEQ ID NO: 182229 - RNA, 22 nt, Human
ggauugaagggaaccucagaau

SEQ ID NO: 182230 - RNA, 20 nt, Human
ggauugaacuauuucucagc

SEQ ID NO: 182231 - RNA, 22 nt, Human
ggugacauuggagagacaggug

SEQ ID NO: 182232 - RNA, 19 nt, Human
ggugaucugucccuugcuc

SEQ ID NO: 182233 - RNA, 22 nt, Human
ggugcagucuggggcacauuau

SEQ ID NO: 182234 - RNA, 22 nt, Human
ggugcguggcccauccuccacc

SEQ ID NO: 182235 - RNA, 22 nt, Human
ggcagcagaaccaacuguggcu

SEQ ID NO: 182236 - RNA, 21 nt, Human
ggcagccuggcaggggcacug

SEQ ID NO: 182237 - RNA, 18 nt, Human
ggcagggcucagcugcuc

SEQ ID NO: 182238 - RNA, 22 nt, Human
ggcagggacugggauauggaga

SEQ ID NO: 182239 - RNA, 22 nt, Human
ggcagggagagcgccgccaugc

SEQ ID NO: 182240 - RNA, 22 nt, Human
gguggcuugcugguaggugugc

SEQ ID NO: 182241 - RNA, 22 nt, Human
ggcagucaucacuuauucauca

SEQ ID NO: 182242 - RNA, 22 nt, Human
ggcagugguaggagcccaggag

SEQ ID NO: 182243 - RNA, 22 nt, Human
ggcagucuuucccuugagcucu

SEQ ID NO: 182244 - RNA, 22 nt, Human
ggugggaauccaggccuucauc

SEQ ID NO: 182245 - RNA, 22 nt, Human
ggugcugcugcugaacccagcu

SEQ ID NO: 182246 - RNA, 22 nt, Human
gcugggacacacagucuucuuu

SEQ ID NO: 182247 - RNA, 22 nt, Human
gcugggagucgcgucuguggcc

SEQ ID NO: 182248 - RNA, 22 nt, Human
gcugggagaggcagcuuucgga

SEQ ID NO: 182249 - RNA, 22 nt, Human
ggcuggaacuucuucuggcauu

SEQ ID NO: 182250 - RNA, 22 nt, Human
gcuggcgauggccgagucuccg

SEQ ID NO: 182251 - RNA, 22 nt, Human
gcuggcggguuggggaggcgga

SEQ ID NO: 182252 - RNA, 22 nt, Human
ggcugcugcccaccccugcaug

SEQ ID NO: 182253 - RNA, 22 nt, Human
ggcucuggcgagcuuuaguaca

SEQ ID NO: 182254 - RNA, 22 nt, Human
ggcugaugacgccugagucuga

SEQ ID NO: 182255 - RNA, 22 nt, Human
ggcugagguguggggaacuaua

SEQ ID NO: 182256 - RNA, 22 nt, Human
ggcugcaagacguuauuagcgu

SEQ ID NO: 182257 - RNA, 22 nt, Human
ggcucuccacuauggaugagaa

SEQ ID NO: 182258 - RNA, 22 nt, Human
gcugcuucgcugcacacccgag

SEQ ID NO: 182259 - RNA, 22 nt, Human
gcuggaaauaacuuguguagaa

SEQ ID NO: 182260 - RNA, 22 nt, Human
gcugcuggcuuccugcuguuuu

SEQ ID NO: 182261 - RNA, 22 nt, Human
gcugcuuacuauaggguuaacu

SEQ ID NO: 182262 - RNA, 22 nt, Human
gcugcuuagaaccauauuuaaa

SEQ ID NO: 182263 - RNA, 22 nt, Human
ggcuccagauguccccuggcaa

SEQ ID NO: 182264 - RNA, 22 nt, Human
ggcucagaggagcuggaacggu

SEQ ID NO: 182265 - RNA, 22 nt, Human
ggcucacuguaccugccgccgc

SEQ ID NO: 182266 - RNA, 22 nt, Human
ggcuccaggguaccccuggaug

SEQ ID NO: 182267 - RNA, 22 nt, Human
ggcuguggcagcuggaaguggu

SEQ ID NO: 182268 - RNA, 22 nt, Human
gcugguuucucucauugucagu

SEQ ID NO: 182269 - RNA, 22 nt, Human
gcugucaggaacaugccuuggu

SEQ ID NO: 182270 - RNA, 22 nt, Human
ggcugugggguccuguggugug

SEQ ID NO: 182271 - RNA, 22 nt, Human
ggcuuauauguauucccagaga

SEQ ID NO: 182272 - RNA, 22 nt, Human
gcuggguaguucuuguuuggga

SEQ ID NO: 182273 - RNA, 22 nt, Human
gcuggggaucgaaggcagagcc

SEQ ID NO: 182274 - RNA, 22 nt, Human
gcugggccucuuacuucuuacg

SEQ ID NO: 182275 - RNA, 22 nt, Human
gcuggucuggcaauccucaugg

SEQ ID NO: 182276 - RNA, 22 nt, Human
gcugguuacuucauuagguccu

SEQ ID NO: 182277 - RNA, 22 nt, Human
ggcugggagguggcgaggaggc

SEQ ID NO: 182278 - RNA, 22 nt, Human
ggcugggaggcggaggcugaga

SEQ ID NO: 182279 - RNA, 22 nt, Human
ggcugugaaguacguugaaggu

SEQ ID NO: 182280 - RNA, 22 nt, Human
ggcugguggcgggcagcacaga

SEQ ID NO: 182281 - RNA, 18 nt, Human
ggcugggcugugccccuu

SEQ ID NO: 182282 - RNA, 22 nt, Human
gcugcgcgcagccggcgccgag

SEQ ID NO: 182283 - RNA, 22 nt, Human
ggcgaugaggucuuagaaucua

SEQ ID NO: 182284 - RNA, 22 nt, Human
ggcgauuggccgggaggaggca

SEQ ID NO: 182285 - RNA, 22 nt, Human
ggccuugauuccggucauugaa

SEQ ID NO: 182286 - RNA, 22 nt, Human
ggcgacuacugaaugcuugaaa

SEQ ID NO: 182287 - RNA, 22 nt, Human
gcugccucacuagauagguaug

SEQ ID NO: 182288 - RNA, 22 nt, Human
ggccuugggauguggcugcagc

SEQ ID NO: 182289 - RNA, 22 nt, Human
ggccuugguggcuuugcugaug

SEQ ID NO: 182290 - RNA, 22 nt, Human
ggcgccauuuuugccuucggag

SEQ ID NO: 182291 - RNA, 22 nt, Human
ggcgcaguguucgcccucucgc

SEQ ID NO: 182292 - RNA, 22 nt, Human
ggcgccugguauucuuccucuc

SEQ ID NO: 182293 - RNA, 22 nt, Human
ggcggagggcuguguccccggc

SEQ ID NO: 182294 - RNA, 22 nt, Human
ggcgcuccccgccugcgucgcg

SEQ ID NO: 182295 - RNA, 22 nt, Human
ggcggaggucacgcacccgcca

SEQ ID NO: 182296 - RNA, 22 nt, Human
ggcuaagcaguaaaugggguua

SEQ ID NO: 182297 - RNA, 23 nt, Human
ggcgugcugggcugacccuuggc

SEQ ID NO: 182298 - RNA, 22 nt, Human
ggcgucuugcgggcgguagcgc

SEQ ID NO: 182299 - RNA, 22 nt, Human
ggcuauuguuuuaaaaaaugag

SEQ ID NO: 182300 - RNA, 22 nt, Human
ggcuagggagacagagggcaug

SEQ ID NO: 182301 - RNA, 22 nt, Human
ggcguccuccucgucugaggcg

SEQ ID NO: 182302 - RNA, 22 nt, Human
ggcgggucuagggcccuggagu

SEQ ID NO: 182303 - RNA, 22 nt, Human
ggcggcccaggugcuccaggcg

SEQ ID NO: 182304 - RNA, 22 nt, Human
ggcgggggagccaggaacccag

SEQ ID NO: 182305 - RNA, 22 nt, Human
ggccuggccuccugcuuuucca

SEQ ID NO: 182306 - RNA, 22 nt, Human
ggccugcuaccagcugugaccu

SEQ ID NO: 182307 - RNA, 22 nt, Human
ggccugcucuggcuguggucag

SEQ ID NO: 182308 - RNA, 22 nt, Human
ggccugagaagcaaggacacaa

SEQ ID NO: 182309 - RNA, 22 nt, Human
ggccgggugggaggcagcggag

SEQ ID NO: 182310 - RNA, 18 nt, Human
ggccucagccuggccgga

SEQ ID NO: 182311 - RNA, 22 nt, Human
ggccccggaggccguuagcuua

SEQ ID NO: 182312 - RNA, 22 nt, Human
ggccaguauacaaacuuccggu

SEQ ID NO: 182313 - RNA, 22 nt, Human
ggccgccgcuuagcugagcccc

SEQ ID NO: 182314 - RNA, 22 nt, Human
ggccgccacacagauucccccg

SEQ ID NO: 182315 - RNA, 23 nt, Human
gcugcagugaauguuguuguugu

SEQ ID NO: 182316 - RNA, 22 nt, Human
gcugcagggagcuggaaggcuc

SEQ ID NO: 182317 - RNA, 22 nt, Human
gcugcacgguccuggcaccacg

SEQ ID NO: 182318 - RNA, 22 nt, Human
gcugcccucccagggcaagcuu

SEQ ID NO: 182319 - RNA, 22 nt, Human
gcugauucuucugcuuuuucuc

SEQ ID NO: 182320 - RNA, 22 nt, Human
gcucuggcugccuuaguuuugu

SEQ ID NO: 182321 - RNA, 20 nt, Human
gcucuucuccgggucugccu

SEQ ID NO: 182322 - RNA, 22 nt, Human
gcucuggcuacuguggcuaccg

SEQ ID NO: 182323 - RNA, 22 nt, Human
gcucugcuccaucuguuuccuc

SEQ ID NO: 182324 - RNA, 21 nt, Human
gcucccgaagugcucggcguu

SEQ ID NO: 182325 - RNA, 22 nt, Human
gcgggugagauucgagagaugg

SEQ ID NO: 182326 - RNA, 22 nt, Human
gcgguguuuuaacacucccucg

SEQ ID NO: 182327 - RNA, 22 nt, Human
gcggguggaggagggacgggca

SEQ ID NO: 182328 - RNA, 22 nt, Human
gcuacaaaaccagggcaaagga

SEQ ID NO: 182329 - RNA, 22 nt, Human
gcgugugugauaugccucugca

SEQ ID NO: 182330 - RNA, 22 nt, Human
ggcaggaaguaaggaugcuaca

SEQ ID NO: 182331 - RNA, 22 nt, Human
gcggggcucuacuuggccugga

SEQ ID NO: 182332 - RNA, 22 nt, Human
gcggggggcucgggcagcucgg

SEQ ID NO: 182333 - RNA, 22 nt, Human
ggcagaggaagcuggaaguggg

SEQ ID NO: 182334 - RNA, 22 nt, Human
ggcagaggagcuggaaacaugg

SEQ ID NO: 182335 - RNA, 22 nt, Human
ggcagagcugugcgcccaccca

SEQ ID NO: 182336 - RNA, 20 nt, Human
ggcagagcuaugucuguugc

SEQ ID NO: 182337 - RNA, 22 nt, Human
gcuacaacugugucuguggggc

SEQ ID NO: 182338 - RNA, 22 nt, Human
gcuacaggggucaguccuuugc

SEQ ID NO: 182339 - RNA, 22 nt, Human
gcucaacucaacgucauuugaa

SEQ ID NO: 182340 - RNA, 22 nt, Human
gcuacauuagcuucaauggcua

SEQ ID NO: 182341 - RNA, 22 nt, Human
gcuauuuagaaaggcuuggaga

SEQ ID NO: 182342 - RNA, 22 nt, Human
ggcaggauggagcagggcuaaa

SEQ ID NO: 182343 - RNA, 22 nt, Human
ggcagggaauucagagggaagg

SEQ ID NO: 182344 - RNA, 22 nt, Human
gcucaugggcccagagcagccc

SEQ ID NO: 182345 - RNA, 22 nt, Human
ggcagggagagcaugcugauaa

SEQ ID NO: 182346 - RNA, 22 nt, Human
gcucagcuggagagggacgggu

SEQ ID NO: 182347 - RNA, 20 nt, Human
gcucaguggagaaaugcacc

SEQ ID NO: 182348 - RNA, 22 nt, Human
ggaugcugcuccacaucccaca

SEQ ID NO: 182349 - RNA, 22 nt, Human
ggaucuaaagccagaauauaug

SEQ ID NO: 182350 - RNA, 22 nt, Human
ggaugauacuuggagaaauauu

SEQ ID NO: 182351 - RNA, 22 nt, Human
ggagccuggaguuucugauggg

SEQ ID NO: 182352 - RNA, 22 nt, Human
ggagccaguuuagaccucaguu

SEQ ID NO: 182353 - RNA, 23 nt, Human
ggauccugacauauaccaucacc

SEQ ID NO: 182354 - RNA, 19 nt, Human
gcggcggugccggcuggga

SEQ ID NO: 182355 - RNA, 22 nt, Human
gcgggcgcuguggccccggccu

SEQ ID NO: 182356 - RNA, 22 nt, Human
gcggcuggcuguccaaacuggg

SEQ ID NO: 182357 - RNA, 22 nt, Human
ggcaagcacugggugucuuagc

SEQ ID NO: 182358 - RNA, 22 nt, Human
gcgggccggcaggggaggaguu

SEQ ID NO: 182359 - RNA, 22 nt, Human
gcggcggcggaggcgggggcag

SEQ ID NO: 182360 - RNA, 22 nt, Human
gcggcaguccuuccaguacagg

SEQ ID NO: 182361 - RNA, 22 nt, Human
ggcaaagaguacaucguccugg

SEQ ID NO: 182362 - RNA, 22 nt, Human
ggauuucuucucauaacugaga

SEQ ID NO: 182363 - RNA, 22 nt, Human
ggauggugauguacccagucau

SEQ ID NO: 182364 - RNA, 20 nt, Human
gcgcaguuccgggcgcgucu

SEQ ID NO: 182365 - RNA, 22 nt, Human
gcgcagugagguuaagaaugca

SEQ ID NO: 182366 - RNA, 20 nt, Human
ggagagggaaaggcuguacu

SEQ ID NO: 182367 - RNA, 22 nt, Human
ggagcaagagugagcaagcaga

SEQ ID NO: 182368 - RNA, 22 nt, Human
ggagcagaggaaagaguagcau

SEQ ID NO: 182369 - RNA, 22 nt, Human
ggagcaguggaggggccagggu

SEQ ID NO: 182370 - RNA, 22 nt, Human
ggagauggucacagguaaacau

SEQ ID NO: 182371 - RNA, 22 nt, Human
ggagaugacaucccagcccggc

SEQ ID NO: 182372 - RNA, 22 nt, Human
ggacccagggcuuauucauguu

SEQ ID NO: 182373 - RNA, 23 nt, Human
ggaauuucagaugugaaauaaaa

SEQ ID NO: 182374 - RNA, 22 nt, Human
ggacagacagcauggaaccaua

SEQ ID NO: 182375 - RNA, 22 nt, Human
ggacggggagcuggaaagggga

SEQ ID NO: 182376 - RNA, 23 nt, Human
ggacuaggcaacagaugggacag

SEQ ID NO: 182377 - RNA, 22 nt, Human
ggaagugagcucauuacuuuag

SEQ ID NO: 182378 - RNA, 22 nt, Human
ggaaguuaguucuuggcaaagg

SEQ ID NO: 182379 - RNA, 18 nt, Human
ggaaggugcuggagugca

SEQ ID NO: 182380 - RNA, 20 nt, Human
ggaaguauccacaaauuccu

SEQ ID NO: 182381 - RNA, 22 nt, Human
ggaauaauauuacagauacagu

SEQ ID NO: 182382 - RNA, 21 nt, Human
gccugcuguucacccugccac

SEQ ID NO: 182383 - RNA, 22 nt, Human
gccuggccaaucgccgucuagg

SEQ ID NO: 182384 - RNA, 22 nt, Human
gccuggcagggagauuguaaga

SEQ ID NO: 182385 - RNA, 22 nt, Human
gcugggucucucccugguccug

SEQ ID NO: 182386 - RNA, 22 nt, Human
gcuggguuguucuccuggucca

SEQ ID NO: 182387 - RNA, 22 nt, Human
gcccagccucagggcaucagcu

SEQ ID NO: 182388 - RNA, 19 nt, Human
gcugggauaggauguauuu

SEQ ID NO: 182389 - RNA, 22 nt, Human
ggaagccugggcgcaggcaggg

SEQ ID NO: 182390 - RNA, 22 nt, Human
ggaagcucaauacuuuccucuu

SEQ ID NO: 182391 - RNA, 22 nt, Human
ggaagcuguugugagugcagca

SEQ ID NO: 182392 - RNA, 22 nt, Human
gcccagcuuuuugaggcaggca

SEQ ID NO: 182393 - RNA, 22 nt, Human
gcccagcucucuggccugucuu

SEQ ID NO: 182394 - RNA, 22 nt, Human
ggaagauagaaguucaaaaguu

SEQ ID NO: 182395 - RNA, 22 nt, Human
guguuuauguuuuugcuaggga

SEQ ID NO: 182396 - RNA, 22 nt, Human
guguuuguauccuccauauaac

SEQ ID NO: 182397 - RNA, 22 nt, Human
guguugugauuggucagucacu

SEQ ID NO: 182398 - RNA, 22 nt, Human
guguuggugagcucauuuccac

SEQ ID NO: 182399 - RNA, 22 nt, Human
ggggaauaaacacuuugucacu

SEQ ID NO: 182400 - RNA, 22 nt, Human
guguugaugugucuguauucua

SEQ ID NO: 182401 - RNA, 22 nt, Human
ggggagaugauaagugcauuug

SEQ ID NO: 182402 - RNA, 22 nt, Human
ggggacugccgacagucucaaa

SEQ ID NO: 182403 - RNA, 22 nt, Human
ggggaauuaaaugagaagccuu

SEQ ID NO: 182404 - RNA, 22 nt, Human
ggggcaucguugauugcauggu

SEQ ID NO: 182405 - RNA, 22 nt, Human
guguuuugagaggaugguuuua

SEQ ID NO: 182406 - RNA, 22 nt, Human
ggggcgaguguggaccgcagcc

SEQ ID NO: 182407 - RNA, 22 nt, Human
guuaaaaugauuugugauuuau

SEQ ID NO: 182408 - RNA, 21 nt, Human
guuaccacugaugcaacagga

SEQ ID NO: 182409 - RNA, 23 nt, Human
guuaccgaccugauucggcagcc

SEQ ID NO: 182410 - RNA, 22 nt, Human
ggggcggggagcaugagcuggg

SEQ ID NO: 182411 - RNA, 22 nt, Human
guuaucauccucagaggcaguu

SEQ ID NO: 182412 - RNA, 22 nt, Human
ggggugagaguguuuuaaagca

SEQ ID NO: 182413 - RNA, 22 nt, Human
ggggucugaucccuucuggcuu

SEQ ID NO: 182414 - RNA, 22 nt, Human
gggucagggaggccccaccaug

SEQ ID NO: 182415 - RNA, 22 nt, Human
guucacauccuugugaggauuu

SEQ ID NO: 182416 - RNA, 22 nt, Human
ggguacaccaauggaugccagg

SEQ ID NO: 182417 - RNA, 22 nt, Human
gggucauugcgugacgcgagca

SEQ ID NO: 182418 - RNA, 22 nt, Human
gggggcgcguggagggccgugg

SEQ ID NO: 182419 - RNA, 22 nt, Human
gggggcgccgccgcucaucuca

SEQ ID NO: 182420 - RNA, 22 nt, Human
guuacuacccacccuucucccc

SEQ ID NO: 182421 - RNA, 22 nt, Human
ggggcuuccagcgcccgccggu

SEQ ID NO: 182422 - RNA, 22 nt, Human
gggggagaauaugugaaggggg

SEQ ID NO: 182423 - RNA, 22 nt, Human
gggggagcuacaggucccuugg

SEQ ID NO: 182424 - RNA, 22 nt, Human
ggguggugagagaacuuugcag

SEQ ID NO: 182425 - RNA, 22 nt, Human
ggguggugauacugcuucugcc

SEQ ID NO: 182426 - RNA, 22 nt, Human
guucuguucuucacagguuugu

SEQ ID NO: 182427 - RNA, 22 nt, Human
guucuuagguacucauauuuaa

SEQ ID NO: 182428 - RNA, 22 nt, Human
gggugguuccuggaucugacug

SEQ ID NO: 182429 - RNA, 22 nt, Human
guucucuuaauccuaguuggua

SEQ ID NO: 182430 - RNA, 22 nt, Human
gggugcuucauaggugaugcug

SEQ ID NO: 182431 - RNA, 22 nt, Human
guucuccaggggcuguucaucu

SEQ ID NO: 182432 - RNA, 22 nt, Human
guucucauugugaugcuuaguu

SEQ ID NO: 182433 - RNA, 22 nt, Human
guuccgcugcaaggccaggaaa

SEQ ID NO: 182434 - RNA, 22 nt, Human
guucaccaguagcugggcuguu

SEQ ID NO: 182435 - RNA, 22 nt, Human
ggggugggcuggguguccaagg

SEQ ID NO: 182436 - RNA, 22 nt, Human
guucauuucaagucuaauccau

SEQ ID NO: 182437 - RNA, 22 nt, Human
gggucggcacucuggcagcacc

SEQ ID NO: 182438 - RNA, 22 nt, Human
guucuacaacuucgcuugcaga

SEQ ID NO: 182439 - RNA, 23 nt, Human
guugccuuugcaucuucauccau

SEQ ID NO: 182440 - RNA, 22 nt, Human
guugcaaaugggaagaugguua

SEQ ID NO: 182441 - RNA, 22 nt, Human
guugauuuaaccucaccuuuga

SEQ ID NO: 182442 - RNA, 22 nt, Human
guugauuuaggguuuugguuuu

SEQ ID NO: 182443 - RNA, 22 nt, Human
gguaacagaagagcacuuggca

SEQ ID NO: 182444 - RNA, 22 nt, Human
gguaauguucugaugaauuugu

SEQ ID NO: 182445 - RNA, 22 nt, Human
gguaccuggcccuggggcugcu

SEQ ID NO: 182446 - RNA, 22 nt, Human
gguaaucuccucauugacguua

SEQ ID NO: 182447 - RNA, 20 nt, Human
ggguugagcguggccccucu

SEQ ID NO: 182448 - RNA, 22 nt, Human
ggguguuuuuggugacagggag

SEQ ID NO: 182449 - RNA, 22 nt, Human
ggguuaaauggauggcauuugc

SEQ ID NO: 182450 - RNA, 22 nt, Human
ggguuguagagcuggaagggga

SEQ ID NO: 182451 - RNA, 22 nt, Human
ggguuuccugcucgcggguagc

SEQ ID NO: 182452 - RNA, 22 nt, Human
ggguuuuggggaggaagugagc

SEQ ID NO: 182453 - RNA, 22 nt, Human
guugaacagucacccugggagu

SEQ ID NO: 182454 - RNA, 22 nt, Human
guugagaagaccauuuuguuca

SEQ ID NO: 182455 - RNA, 22 nt, Human
guucuucagcccucagguccua

SEQ ID NO: 182456 - RNA, 22 nt, Human
ggguuuugugauugccucugaa

SEQ ID NO: 182457 - RNA, 22 nt, Human
guucuuuacuucgcaucugcua

SEQ ID NO: 182458 - RNA, 22 nt, Human
guguccuguagaaacuguucca

SEQ ID NO: 182459 - RNA, 22 nt, Human
gggcuggcaguuuucugaguuc

SEQ ID NO: 182460 - RNA, 22 nt, Human
gggcugcuccgcccgcugcgcc

SEQ ID NO: 182461 - RNA, 22 nt, Human
gggcugagagcuggaaucugag

SEQ ID NO: 182462 - RNA, 22 nt, Human
gggcuguaggagcuggaauggg

SEQ ID NO: 182463 - RNA, 22 nt, Human
gggcuguggggccugcagaagg

SEQ ID NO: 182464 - RNA, 22 nt, Human
gugugguguuaagcaaauuaau

SEQ ID NO: 182465 - RNA, 22 nt, Human
gugugucucaguugcuccgaag

SEQ ID NO: 182466 - RNA, 20 nt, Human
gggcuuugagcucagggcuu

SEQ ID NO: 182467 - RNA, 19 nt, Human
guguucuguuauacaguug

SEQ ID NO: 182468 - RNA, 22 nt, Human
gggcuuuuccauuccaggguuc

SEQ ID NO: 182469 - RNA, 22 nt, Human
guguucuuuguagaggaucuug

SEQ ID NO: 182470 - RNA, 22 nt, Human
guguugaaaaguagcacugcuu

SEQ ID NO: 182471 - RNA, 22 nt, Human
gggcgagcgucucagccgggcg

SEQ ID NO: 182472 - RNA, 22 nt, Human
gggcgcaagcaugugucugggu

SEQ ID NO: 182473 - RNA, 22 nt, Human
gggcgccgggagugagagugag

SEQ ID NO: 182474 - RNA, 22 nt, Human
gggcgcgccaggagcugcgcgg

SEQ ID NO: 182475 - RNA, 22 nt, Human
guggugaacauuugcaucugcu

SEQ ID NO: 182476 - RNA, 22 nt, Human
gggcggggcuuccguccuccac

SEQ ID NO: 182477 - RNA, 22 nt, Human
gggcggggggagcuggaaugaa

SEQ ID NO: 182478 - RNA, 22 nt, Human
gggcggccugcucuguggggag

SEQ ID NO: 182479 - RNA, 22 nt, Human
gugguggugaggcaaggggugu

SEQ ID NO: 182480 - RNA, 22 nt, Human
guguaucagaggcuguguuaua

SEQ ID NO: 182481 - RNA, 22 nt, Human
gugguuugcugguguacguuua

SEQ ID NO: 182482 - RNA, 22 nt, Human
gugguuuagccuucauuaaccu

SEQ ID NO: 182483 - RNA, 22 nt, Human
guggggguaggggguuuccugg

SEQ ID NO: 182484 - RNA, 22 nt, Human
guggcuuuguuuccaaaugaaa

SEQ ID NO: 182485 - RNA, 22 nt, Human
gugggagaaugggaggaguaau

SEQ ID NO: 182486 - RNA, 22 nt, Human
gugggauaaccugagauaacau

SEQ ID NO: 182487 - RNA, 22 nt, Human
guggggcgggucccccgccugg

SEQ ID NO: 182488 - RNA, 22 nt, Human
gugggcuuuuuugaaaccugaa

SEQ ID NO: 182489 - RNA, 22 nt, Human
guggcagguguacagcucagcu

SEQ ID NO: 182490 - RNA, 22 nt, Human
guggcagagccuugcggcuuug

SEQ ID NO: 182491 - RNA, 22 nt, Human
guggcagagagcaagugucuga

SEQ ID NO: 182492 - RNA, 22 nt, Human
guggauuucaggcuccccucag

SEQ ID NO: 182493 - RNA, 22 nt, Human
guggauuguaccacgaaaagug

SEQ ID NO: 182494 - RNA, 22 nt, Human
guggcuuaauauuuauagcaga

SEQ ID NO: 182495 - RNA, 22 nt, Human
guggcauggggagcagcuagaa

SEQ ID NO: 182496 - RNA, 22 nt, Human
gggcagagagcuggaacuccuu

SEQ ID NO: 182497 - RNA, 22 nt, Human
gggcacggaaggcgccaggggu

SEQ ID NO: 182498 - RNA, 22 nt, Human
gggcaguuucaugugguucaac

SEQ ID NO: 182499 - RNA, 22 nt, Human
guggaaauuuuaggaucaucuu

SEQ ID NO: 182500 - RNA, 22 nt, Human
guggaaauaugggcaacaaaga

SEQ ID NO: 182501 - RNA, 23 nt, Human
ggccuuuuuaaccgcgagcgaca

SEQ ID NO: 182502 - RNA, 19 nt, Human
gggccucacccacaccucc

SEQ ID NO: 182503 - RNA, 22 nt, Human
guggaguggguuguacucaggg

SEQ ID NO: 182504 - RNA, 22 nt, Human
gggccggagaagguagcugaag

SEQ ID NO: 182505 - RNA, 22 nt, Human
gggccaggaugugguucauuuu

SEQ ID NO: 182506 - RNA, 22 nt, Human
guaguuagaguugugcuggaga

SEQ ID NO: 182507 - RNA, 22 nt, Human
gggcaugcagcaauucuguggu

SEQ ID NO: 182508 - RNA, 22 nt, Human
guggacuagaguaggaguugca

SEQ ID NO: 182509 - RNA, 22 nt, Human
guggagaaagcuggaaucugag

SEQ ID NO: 182510 - RNA, 22 nt, Human
guggagaaauauguucagcuuc

SEQ ID NO: 182511 - RNA, 22 nt, Human
uaagagauuuauugaggacuuc

SEQ ID NO: 182512 - RNA, 22 nt, Human
uaagagcagacacaaccugaga

SEQ ID NO: 182513 - RNA, 22 nt, Human
uaagaggucugaaacgguggga

SEQ ID NO: 182514 - RNA, 22 nt, Human
guaugugucuuagaacuuggga

SEQ ID NO: 182515 - RNA, 22 nt, Human
guaugugugcauacauguacga

SEQ ID NO: 182516 - RNA, 22 nt, Human
guauuauauaaccauugguucu

SEQ ID NO: 182517 - RNA, 22 nt, Human
guauuaagaaaugccugugaaa

SEQ ID NO: 182518 - RNA, 21 nt, Human
uaagccaccaugugaaaccag

SEQ ID NO: 182519 - RNA, 21 nt, Human
guaucuuucuuuuaaaauauc

SEQ ID NO: 182520 - RNA, 22 nt, Human
guaucuuuauuuuaauuaagau

SEQ ID NO: 182521 - RNA, 22 nt, Human
uaagaaacauuuuuaugacagu

SEQ ID NO: 182522 - RNA, 22 nt, Human
guaucaggugugagcauuuuaa

SEQ ID NO: 182523 - RNA, 22 nt, Human
gucaccgguuuuuagguaaaca

SEQ ID NO: 182524 - RNA, 22 nt, Human
gucacaaaugauuuagcaauca

SEQ ID NO: 182525 - RNA, 22 nt, Human
uaagcguuugggaguuaugaac

SEQ ID NO: 182526 - RNA, 22 nt, Human
guauuugcaaucacaaacaaaa

SEQ ID NO: 182527 - RNA, 22 nt, Human
gucagacucuggggccccaggc

SEQ ID NO: 182528 - RNA, 22 nt, Human
gucagacugaguuccuggguac

SEQ ID NO: 182529 - RNA, 22 nt, Human
guaauucugugugaaucuauua

SEQ ID NO: 182530 - RNA, 22 nt, Human
guaaugcuuuuauuucggggaa

SEQ ID NO: 182531 - RNA, 23 nt, Human
uaaauuuuauucugauaacacag

SEQ ID NO: 182532 - RNA, 22 nt, Human
uaaauuggaauaaugagaagug

SEQ ID NO: 182533 - RNA, 22 nt, Human
uaacgcaucuggaaacaggaca

SEQ ID NO: 182534 - RNA, 22 nt, Human
guauauccaauaggugaugaaa

SEQ ID NO: 182535 - RNA, 22 nt, Human
guauauuuaugagcauuagccu

SEQ ID NO: 182536 - RNA, 22 nt, Human
guaguuuuugagcuguaaucuu

SEQ ID NO: 182537 - RNA, 22 nt, Human
guagguggaggcaacacagcca

SEQ ID NO: 182538 - RNA, 22 nt, Human
guaguggaauuuagaguauaau

SEQ ID NO: 182539 - RNA, 22 nt, Human
guagucuuaggaaugauuuugu

SEQ ID NO: 182540 - RNA, 22 nt, Human
guuuuauaacuauagugagaau

SEQ ID NO: 182541 - RNA, 22 nt, Human
gguauccaaauaaagcagguaa

SEQ ID NO: 182542 - RNA, 22 nt, Human
ggucaaauaugaguaauuuccu

SEQ ID NO: 182543 - RNA, 22 nt, Human
ggucauacaaggcacuggugau

SEQ ID NO: 182544 - RNA, 22 nt, Human
gguaugaggaugaggguggcau

SEQ ID NO: 182545 - RNA, 22 nt, Human
ggucauagagcuggaaauuggc

SEQ ID NO: 182546 - RNA, 20 nt, Human
ggucagccaagaaguuaccu

SEQ ID NO: 182547 - RNA, 22 nt, Human
guuuugaugugauuucucaugu

SEQ ID NO: 182548 - RNA, 22 nt, Human
guuuuguagucuggagacuguc

SEQ ID NO: 182549 - RNA, 22 nt, Human
guuuuguucaugaacauugggu

SEQ ID NO: 182550 - RNA, 22 nt, Human
guuuucuuguuaauuuugaacg

SEQ ID NO: 182551 - RNA, 22 nt, Human
guuuugauggaguguguuaaau

SEQ ID NO: 182552 - RNA, 22 nt, Human
gguggcuucuguuugcaagagg

SEQ ID NO: 182553 - RNA, 22 nt, Human
guuuuauguuuuauagacacaa

SEQ ID NO: 182554 - RNA, 22 nt, Human
gguggcagaggaggcgggagag

SEQ ID NO: 182555 - RNA, 22 nt, Human
ggugcuuuucacaagcauggga

SEQ ID NO: 182556 - RNA, 22 nt, Human
gguggcauucaguaaguauaua

SEQ ID NO: 182557 - RNA, 22 nt, Human
uaaauguugcuugugcugcuca

SEQ ID NO: 182558 - RNA, 22 nt, Human
guaaauacuaugagauaaugaa

SEQ ID NO: 182559 - RNA, 22 nt, Human
guaaacugaauuggauacugug

SEQ ID NO: 182560 - RNA, 21 nt, Human
gguuucugcaaaccuuguaca

SEQ ID NO: 182561 - RNA, 22 nt, Human
gguuuauucccacaaaggaagu

SEQ ID NO: 182562 - RNA, 22 nt, Human
uaaagaggagaauuaagucagc

SEQ ID NO: 182563 - RNA, 22 nt, Human
uaaagcacucaaaauuguagcu

SEQ ID NO: 182564 - RNA, 22 nt, Human
gguuccagacaguuauaugggc

SEQ ID NO: 182565 - RNA, 22 nt, Human
uaaacugacagugagggagagu

SEQ ID NO: 182566 - RNA, 22 nt, Human
gguugccuuugcaguuggauca

SEQ ID NO: 182567 - RNA, 22 nt, Human
gguguuccgguucugcucuggg

SEQ ID NO: 182568 - RNA, 22 nt, Human
uaaaaguuagcuaggacaaagu

SEQ ID NO: 182569 - RNA, 22 nt, Human
gguguuaaccagcuaaaguuug

SEQ ID NO: 182570 - RNA, 22 nt, Human
guuuuucuuugauuuagaacca

SEQ ID NO: 182571 - RNA, 22 nt, Human
guuuuucuagaaaucuccuccu

SEQ ID NO: 182572 - RNA, 22 nt, Human
guuuuuacuuccaaugcuauga

SEQ ID NO: 182573 - RNA, 22 nt, Human
uagaggauucuaaaggaagcug

SEQ ID NO: 182574 - RNA, 22 nt, Human
gugauuucagguuuuucauacu

SEQ ID NO: 182575 - RNA, 19 nt, Human
uagagcagcuucagauucc

SEQ ID NO: 182576 - RNA, 22 nt, Human
uagagcucaagaagcaaaagcu

SEQ ID NO: 182577 - RNA, 19 nt, Human
gugaugaugccacuccaac

SEQ ID NO: 182578 - RNA, 22 nt, Human
gugaugaagguggagaaucaga

SEQ ID NO: 182579 - RNA, 22 nt, Human
gugauggucgagcgcuuguugu

SEQ ID NO: 182580 - RNA, 22 nt, Human
gugauggggagagcgcagcuuu

SEQ ID NO: 182581 - RNA, 17 nt, Human
gugagcugagucaggac

SEQ ID NO: 182582 - RNA, 22 nt, Human
uacuuaucuuagggaugcuugc

SEQ ID NO: 182583 - RNA, 22 nt, Human
uagaaauaaacacugcuaccuu

SEQ ID NO: 182584 - RNA, 22 nt, Human
gugaggcccaggugaaauuaac

SEQ ID NO: 182585 - RNA, 22 nt, Human
uagaccugugggggcagcgggc

SEQ ID NO: 182586 - RNA, 22 nt, Human
uagaaugggaggggaaucaucc

SEQ ID NO: 182587 - RNA, 19 nt, Human
uagacagauuuguguuacu

SEQ ID NO: 182588 - RNA, 22 nt, Human
gugaucagaagaaccugccgaa

SEQ ID NO: 182589 - RNA, 19 nt, Human
gugauauuuauuauuuauu

SEQ ID NO: 182590 - RNA, 22 nt, Human
gugcacuugaucuagacagauu

SEQ ID NO: 182591 - RNA, 22 nt, Human
uagaugaacagaaagccacugu

SEQ ID NO: 182592 - RNA, 22 nt, Human
gugccgaugaggccuggcauuc

SEQ ID NO: 182593 - RNA, 22 nt, Human
gugccaccagaugcuguugcua

SEQ ID NO: 182594 - RNA, 22 nt, Human
gugcaucuguaauuacaauggu

SEQ ID NO: 182595 - RNA, 22 nt, Human
gugcauauguguguauacaaac

SEQ ID NO: 182596 - RNA, 22 nt, Human
gugccgcuggagcuggaauuga

SEQ ID NO: 182597 - RNA, 22 nt, Human
gugccugcucauucucaauauu

SEQ ID NO: 182598 - RNA, 20 nt, Human
uagcacuguauccucuucau

SEQ ID NO: 182599 - RNA, 22 nt, Human
uagauuuaaaaagggugggaug

SEQ ID NO: 182600 - RNA, 22 nt, Human
uagcagcacuauuuguuguagu

SEQ ID NO: 182601 - RNA, 22 nt, Human
uagcaggagagaaguuuuaagu

SEQ ID NO: 182602 - RNA, 22 nt, Human
uagcaggaggcaguuccucgcu

SEQ ID NO: 182603 - RNA, 22 nt, Human
uagcauaaaguuucuguguggu

SEQ ID NO: 182604 - RNA, 22 nt, Human
uagcaaugugggugggcuccaa

SEQ ID NO: 182605 - RNA, 20 nt, Human
gugcggcucuaccacucggu

SEQ ID NO: 182606 - RNA, 22 nt, Human
gugcuacacaaauguuaguugu

SEQ ID NO: 182607 - RNA, 22 nt, Human
uacaagcucuuguagggggaaa

SEQ ID NO: 182608 - RNA, 22 nt, Human
uacaccaugcuccagcaggaca

SEQ ID NO: 182609 - RNA, 22 nt, Human
gucugccagauucugcuggauc

SEQ ID NO: 182610 - RNA, 22 nt, Human
gucugcccuuggccugggacuu

SEQ ID NO: 182611 - RNA, 18 nt, Human
uacagauguaugucuaca

SEQ ID NO: 182612 - RNA, 20 nt, Human
uacaaggauguucaucagag

SEQ ID NO: 182613 - RNA, 20 nt, Human
uacaauauucccacuuugcu

SEQ ID NO: 182614 - RNA, 22 nt, Human
gucugaaauaucuuuugucuug

SEQ ID NO: 182615 - RNA, 20 nt, Human
gucagaggacccuagagcga

SEQ ID NO: 182616 - RNA, 23 nt, Human
gucagcuugaccaguggagaguc

SEQ ID NO: 182617 - RNA, 22 nt, Human
uaagugugcauguguauuauau

SEQ ID NO: 182618 - RNA, 21 nt, Human
uaauaauugggggcagggugg

SEQ ID NO: 182619 - RNA, 22 nt, Human
uaauaauuaacagugauggguc

SEQ ID NO: 182620 - RNA, 22 nt, Human
uaauaagugcuggcuguacauc

SEQ ID NO: 182621 - RNA, 22 nt, Human
gucuauuuauagacagauccua

SEQ ID NO: 182622 - RNA, 22 nt, Human
uaauagauagggagaguugcug

SEQ ID NO: 182623 - RNA, 22 nt, Human
uacaaauugccugacggcaggu

SEQ ID NO: 182624 - RNA, 22 nt, Human
uaccauaaagcaggcaaaugag

SEQ ID NO: 182625 - RNA, 20 nt, Human
uacccgcagcugggucuggc

SEQ ID NO: 182626 - RNA, 22 nt, Human
uacccauuuugguucuugaugc

SEQ ID NO: 182627 - RNA, 22 nt, Human
gugaaaauaguaaccuggcuag

SEQ ID NO: 182628 - RNA, 21 nt, Human
uaccacugaaauugaucguuc

SEQ ID NO: 182629 - RNA, 23 nt, Human
uacagccaugucgcugauuuaac

SEQ ID NO: 182630 - RNA, 22 nt, Human
uacagcgaaaauuuagcuugau

SEQ ID NO: 182631 - RNA, 21 nt, Human
uacugugccagggcagcucug

SEQ ID NO: 182632 - RNA, 22 nt, Human
gugaagcacaugggcguugggu

SEQ ID NO: 182633 - RNA, 22 nt, Human
uacuggaugcaacaaagcccag

SEQ ID NO: 182634 - RNA, 22 nt, Human
uacugcaguuccugcugucucc

SEQ ID NO: 182635 - RNA, 22 nt, Human
uacugccauuauccugcugaaa

SEQ ID NO: 182636 - RNA, 22 nt, Human
gugaagaugccucaggugaccc

SEQ ID NO: 182637 - RNA, 22 nt, Human
uacucuggaguugagaugcgag

SEQ ID NO: 182638 - RNA, 22 nt, Human
uacugagcauaaaacccauacu

SEQ ID NO: 182639 - RNA, 22 nt, Human
uacugauggagauaggcuauca

SEQ ID NO: 182640 - RNA, 22 nt, Human
uacugaaagagugguggacucu

SEQ ID NO: 182641 - RNA, 22 nt, Human
ucauugguugcguaauuugauu

SEQ ID NO: 182642 - RNA, 22 nt, Human
uaaugaugaacacuuggaagaa

SEQ ID NO: 182643 - RNA, 22 nt, Human
uaaugcucauuuggcucugcaa

SEQ ID NO: 182644 - RNA, 22 nt, Human
ucauucucucguauucgcgaau

SEQ ID NO: 182645 - RNA, 23 nt, Human
ucauugcucaagauaaugguuga

SEQ ID NO: 182646 - RNA, 22 nt, Human
uaauaaaaauuuaauucacauu

SEQ ID NO: 182647 - RNA, 22 nt, Human
uacaaucaggcucuagcuucuc

SEQ ID NO: 182648 - RNA, 22 nt, Human
uaauuauuaauuuuagguugcu

SEQ ID NO: 182649 - RNA, 22 nt, Human
uaauggagggucugagucuggg

SEQ ID NO: 182650 - RNA, 22 nt, Human
uaagaccuuuuugaaaucacug

SEQ ID NO: 182651 - RNA, 22 nt, Human
ucaucagccaaagaguccuuca

SEQ ID NO: 182652 - RNA, 22 nt, Human
ucaucauccuuuuuugaagagu

SEQ ID NO: 182653 - RNA, 23 nt, Human
uaaagauaguuuaaaggugaguu

SEQ ID NO: 182654 - RNA, 22 nt, Human
ucaggacacuuaauaggaacag

SEQ ID NO: 182655 - RNA, 22 nt, Human
uaaagacaauuucgagcuguag

SEQ ID NO: 182656 - RNA, 22 nt, Human
uaacuuuuuauccuguuaaaug

SEQ ID NO: 182657 - RNA, 22 nt, Human
uaagcacuuuauaugcuuuauc

SEQ ID NO: 182658 - RNA, 23 nt, Human
uaagccugugccugcuaccugcu

SEQ ID NO: 182659 - RNA, 23 nt, Human
uaagccacgugacccuuuauuug

SEQ ID NO: 182660 - RNA, 22 nt, Human
uaagcgagccaguggaaaaagc

SEQ ID NO: 182661 - RNA, 21 nt, Human
ucauccagguccugcuucuuc

SEQ ID NO: 182662 - RNA, 22 nt, Human
uaaguaauugugguuuuugcca

SEQ ID NO: 182663 - RNA, 22 nt, Human
uaaggcuuuggucaccauggag

SEQ ID NO: 182664 - RNA, 22 nt, Human
uacaccuuaagccgcggcuccc

SEQ ID NO: 182665 - RNA, 22 nt, Human
uacagaccaguaguucucagcg

SEQ ID NO: 182666 - RNA, 22 nt, Human
uacagauggacacuguuucaag

SEQ ID NO: 182667 - RNA, 22 nt, Human
uccacagcagagcacgguaccu

SEQ ID NO: 182668 - RNA, 22 nt, Human
uacauaauagcaaggugcuguc

SEQ ID NO: 182669 - RNA, 22 nt, Human
uacagugaggcgagauucacca

SEQ ID NO: 182670 - RNA, 21 nt, Human
uacaucaguuuucuuggcuca

SEQ ID NO: 182671 - RNA, 22 nt, Human
uccaccugucccugcuuccugc

SEQ ID NO: 182672 - RNA, 22 nt, Human
uccaccacgaaacugcagcugc

SEQ ID NO: 182673 - RNA, 22 nt, Human
uccacagugguggaauuguuca

SEQ ID NO: 182674 - RNA, 19 nt, Human
uccaccgcgugcaccucua

SEQ ID NO: 182675 - RNA, 22 nt, Human
uccaccaccaucacagucagac

SEQ ID NO: 182676 - RNA, 22 nt, Human
uacauuccagaaaguuucugua

SEQ ID NO: 182677 - RNA, 22 nt, Human
uacauuugauuuuugcuucuuu

SEQ ID NO: 182678 - RNA, 22 nt, Human
uacauccuuuugaaaucccaga

SEQ ID NO: 182679 - RNA, 20 nt, Human
uccacugagcgucacggcag

SEQ ID NO: 182680 - RNA, 22 nt, Human
uccagaaaucucuguugauugu

SEQ ID NO: 182681 - RNA, 19 nt, Human
uaccagguuggagaggccc

SEQ ID NO: 182682 - RNA, 22 nt, Human
uacugggugagcugggcuggga

SEQ ID NO: 182683 - RNA, 22 nt, Human
uacugguguauuucuucuuauu

SEQ ID NO: 182684 - RNA, 22 nt, Human
uccagugaacaucauggcucca

SEQ ID NO: 182685 - RNA, 20 nt, Human
uccaguuuuggagacauucu

SEQ ID NO: 182686 - RNA, 22 nt, Human
uccauucccugacagccucuuu

SEQ ID NO: 182687 - RNA, 22 nt, Human
uacucauuggagaauuacgagg

SEQ ID NO: 182688 - RNA, 22 nt, Human
uacuauuuugacaugaaauuga

SEQ ID NO: 182689 - RNA, 19 nt, Human
uacccggauagccagguag

SEQ ID NO: 182690 - RNA, 22 nt, Human
uccagguucaguucaucaucua

SEQ ID NO: 182691 - RNA, 22 nt, Human
uccagccauaucuuguagcccu

SEQ ID NO: 182692 - RNA, 22 nt, Human
uaccucauguucaggaggauca

SEQ ID NO: 182693 - RNA, 22 nt, Human
ucgcggccgcuccacaugcaca

SEQ ID NO: 182694 - RNA, 22 nt, Human
ucgcgcgugccacgcgccgcgg

SEQ ID NO: 182695 - RNA, 22 nt, Human
ucgcuauuauuuuagguucuca

SEQ ID NO: 182696 - RNA, 22 nt, Human
ucgaugcuggcgcagguuucac

SEQ ID NO: 182697 - RNA, 22 nt, Human
uaggcaaguggaccagagguuu

SEQ ID NO: 182698 - RNA, 22 nt, Human
ucgcccagguuggagugcagug

SEQ ID NO: 182699 - RNA, 22 nt, Human
ucgccuccucccagaucaacaa

SEQ ID NO: 182700 - RNA, 22 nt, Human
ucgacguuguuuuuucucuguc

SEQ ID NO: 182701 - RNA, 22 nt, Human
uccuuuuuagguuauuguacau

SEQ ID NO: 182702 - RNA, 22 nt, Human
uaggcauguaaaagugaguucg

SEQ ID NO: 182703 - RNA, 22 nt, Human
uaggcaauauuagacuuugucu

SEQ ID NO: 182704 - RNA, 20 nt, Human
ucgcugcaagggaaauggag

SEQ ID NO: 182705 - RNA, 22 nt, Human
uagggggagugugcugaagcca

SEQ ID NO: 182706 - RNA, 22 nt, Human
uaggggaagcauagguuuagaa

SEQ ID NO: 182707 - RNA, 22 nt, Human
ucgcuugaacccaggaagugga

SEQ ID NO: 182708 - RNA, 22 nt, Human
ucguauucagugcaagucaacg

SEQ ID NO: 182709 - RNA, 22 nt, Human
ucgucaaaguaaugucauagca

SEQ ID NO: 182710 - RNA, 22 nt, Human
uaguaauauuccuacauuaugu

SEQ ID NO: 182711 - RNA, 22 nt, Human
uaggucaaggccacuucuugga

SEQ ID NO: 182712 - RNA, 22 nt, Human
ucgugaagaaauguggacuuca

SEQ ID NO: 182713 - RNA, 22 nt, Human
uaguaugaaaauuagcgggagg

SEQ ID NO: 182714 - RNA, 22 nt, Human
uagucuuuguggucuuuagcua

SEQ ID NO: 182715 - RNA, 22 nt, Human
uagugauuuaagaaaggugacu

SEQ ID NO: 182716 - RNA, 22 nt, Human
ucuaauagauuuggaguggaaa

SEQ ID NO: 182717 - RNA, 22 nt, Human
uccuggccuuggggagagaagu

SEQ ID NO: 182718 - RNA, 22 nt, Human
uccuuguuggaauauccuuacc

SEQ ID NO: 182719 - RNA, 22 nt, Human
uccuuuggaaacuggaugucuu

SEQ ID NO: 182720 - RNA, 22 nt, Human
uccuuuauuuaugggcagugua

SEQ ID NO: 182721 - RNA, 22 nt, Human
uagccacuccgcagcaccgggu

SEQ ID NO: 182722 - RNA, 22 nt, Human
uagcgggucacccugcugugaa

SEQ ID NO: 182723 - RNA, 22 nt, Human
uagccuguuuuuaugagaauuu

SEQ ID NO: 182724 - RNA, 22 nt, Human
uccucuucucuagagccggaau

SEQ ID NO: 182725 - RNA, 22 nt, Human
uccugaaugguguaauagguuu

SEQ ID NO: 182726 - RNA, 22 nt, Human
uccugagaagcacuuaauacac

SEQ ID NO: 182727 - RNA, 23 nt, Human
uccugcagauaagcugguugaca

SEQ ID NO: 182728 - RNA, 21 nt, Human
uccugcagggcagcagagugg

SEQ ID NO: 182729 - RNA, 22 nt, Human
uagcauuuagaacaccuugaga

SEQ ID NO: 182730 - RNA, 22 nt, Human
uagcauccugugugaauguauu

SEQ ID NO: 182731 - RNA, 22 nt, Human
uccuacccccuucuccagcucc

SEQ ID NO: 182732 - RNA, 19 nt, Human
uagaggagaauggcaaaga

SEQ ID NO: 182733 - RNA, 22 nt, Human
uccucguccucauccgcgucau

SEQ ID NO: 182734 - RNA, 22 nt, Human
uccucuucaaaauagcucugaa

SEQ ID NO: 182735 - RNA, 16 nt, Human
uccucacuguagccug

SEQ ID NO: 182736 - RNA, 22 nt, Human
uagacuggaagcuccuugaggc

SEQ ID NO: 182737 - RNA, 22 nt, Human
uagagauagccaaguccuucaa

SEQ ID NO: 182738 - RNA, 22 nt, Human
uagaagagcuuccaccuggggc

SEQ ID NO: 182739 - RNA, 22 nt, Human
uagaagaugccuuaaaguugaa

SEQ ID NO: 182740 - RNA, 22 nt, Human
uagacauuuacuuugaaaaaau

SEQ ID NO: 182741 - RNA, 22 nt, Human
ucccagguugaggccuugccug

SEQ ID NO: 182742 - RNA, 22 nt, Human
guuuugugugugugcccacacg

SEQ ID NO: 182743 - RNA, 22 nt, Human
guuuuggagauguccauuuucc

SEQ ID NO: 182744 - RNA, 22 nt, Human
guuuugaagagaagcaagucug

SEQ ID NO: 182745 - RNA, 22 nt, Human
ucagauaauccaauagagagga

SEQ ID NO: 182746 - RNA, 22 nt, Human
ucagagaaguaggcuaauggug

SEQ ID NO: 182747 - RNA, 21 nt, Human
ucagaaucguuccagguagau

SEQ ID NO: 182748 - RNA, 23 nt, Human
ucagaccaaccucuugcuggaac

SEQ ID NO: 182749 - RNA, 22 nt, Human
guuuucuccugcuauacagugc

SEQ ID NO: 182750 - RNA, 22 nt, Human
ucagaaacuaaauguggauuug

SEQ ID NO: 182751 - RNA, 22 nt, Human
guuuuaucuauguaauuauaaa

SEQ ID NO: 182752 - RNA, 22 nt, Human
ucagaacugcggggaagguggg

SEQ ID NO: 182753 - RNA, 22 nt, Human
guuuuaaucuccuuauuccuaa

SEQ ID NO: 182754 - RNA, 23 nt, Human
ucagccgcuggcgaguccacugg

SEQ ID NO: 182755 - RNA, 22 nt, Human
ucagcaaugggauucaggcuuu

SEQ ID NO: 182756 - RNA, 21 nt, Human
uaaaagaugacaagacagcuc

SEQ ID NO: 182757 - RNA, 22 nt, Human
ucagcguuaguuuuucaucuaa

SEQ ID NO: 182758 - RNA, 22 nt, Human
uaaagaagaaaaggcuucaggc

SEQ ID NO: 182759 - RNA, 22 nt, Human
ucagcuucaucuugagcccaca

SEQ ID NO: 182760 - RNA, 22 nt, Human
uaaaccuuauuugaauaccaac

SEQ ID NO: 182761 - RNA, 22 nt, Human
uaaaauaccacauauggugcuc

SEQ ID NO: 182762 - RNA, 22 nt, Human
ucacugaauuucaagcuagugg

SEQ ID NO: 182763 - RNA, 22 nt, Human
ucacugccuagggcuacugugc

SEQ ID NO: 182764 - RNA, 22 nt, Human
ucacucgccuuuucguucgccg

SEQ ID NO: 182765 - RNA, 22 nt, Human
ucaccuuuugaauugcuguugu

SEQ ID NO: 182766 - RNA, 22 nt, Human
ucacuggauucauguuucuuua

SEQ ID NO: 182767 - RNA, 22 nt, Human
guuucuguguugauugugcccu

SEQ ID NO: 182768 - RNA, 22 nt, Human
guuucucuuugguggguugaga

SEQ ID NO: 182769 - RNA, 22 nt, Human
guuugaacagaaggguugauca

SEQ ID NO: 182770 - RNA, 22 nt, Human
guuugcagacuauguaaacuuc

SEQ ID NO: 182771 - RNA, 22 nt, Human
ucaccugccuggguggucaccu

SEQ ID NO: 182772 - RNA, 22 nt, Human
ucaccuggagagcuugcuaaua

SEQ ID NO: 182773 - RNA, 22 nt, Human
guuuccaggcuuugguaugguu

SEQ ID NO: 182774 - RNA, 22 nt, Human
ucaccaugcccuucucugcucu

SEQ ID NO: 182775 - RNA, 22 nt, Human
guuuauucuuuuauuugugaga

SEQ ID NO: 182776 - RNA, 22 nt, Human
guuuaucagagagcagaggugg

SEQ ID NO: 182777 - RNA, 22 nt, Human
ucacccuguggcuauaaggcaa

SEQ ID NO: 182778 - RNA, 22 nt, Human
ucaccgucucaguacggaggga

SEQ ID NO: 182779 - RNA, 22 nt, Human
ucacccagacugucugacucuu

SEQ ID NO: 182780 - RNA, 22 nt, Human
ucacaggagucaaggaauagua

SEQ ID NO: 182781 - RNA, 22 nt, Human
ucaauuggcuacaaauaaugua

SEQ ID NO: 182782 - RNA, 21 nt, Human
ucaagugcccaagguuuguuu

SEQ ID NO: 182783 - RNA, 22 nt, Human
ucacaagaagaaauuaaacugu

SEQ ID NO: 182784 - RNA, 22 nt, Human
ucaauuuauguggcuauucauu

SEQ ID NO: 182785 - RNA, 22 nt, Human
ucacauugcauuuucucauuug

SEQ ID NO: 182786 - RNA, 22 nt, Human
ucacaucugugugauugucauu

SEQ ID NO: 182787 - RNA, 22 nt, Human
guuguuuuuguuaaaacaguga

SEQ ID NO: 182788 - RNA, 22 nt, Human
guuuaagcagauugcuguggug

SEQ ID NO: 182789 - RNA, 22 nt, Human
guuuaaguuaaaauuuaccugc

SEQ ID NO: 182790 - RNA, 22 nt, Human
guugucuggcucugaccauucu

SEQ ID NO: 182791 - RNA, 22 nt, Human
uauuuuuacuguuugaugauuc

SEQ ID NO: 182792 - RNA, 22 nt, Human
guugauauggaaacucuagguu

SEQ ID NO: 182793 - RNA, 22 nt, Human
ucaagggaccaagcauucauua

SEQ ID NO: 182794 - RNA, 22 nt, Human
ucaagguauuauuuuuguggug

SEQ ID NO: 182795 - RNA, 22 nt, Human
guuguugucauuagcuguuuaa

SEQ ID NO: 182796 - RNA, 22 nt, Human
uauaggaugaugucauguugcu

SEQ ID NO: 182797 - RNA, 22 nt, Human
uauauaauacacaaauauguac

SEQ ID NO: 182798 - RNA, 22 nt, Human
uauagcccaaucuggaugcagu

SEQ ID NO: 182799 - RNA, 22 nt, Human
uagcauuuauugggcuagcaaa

SEQ ID NO: 182800 - RNA, 22 nt, Human
uagcauacagauauuuaacucu

SEQ ID NO: 182801 - RNA, 22 nt, Human
gugcucaagacauuaggaauau

SEQ ID NO: 182802 - RNA, 22 nt, Human
uaguuuucaagugaguuggaag

SEQ ID NO: 182803 - RNA, 22 nt, Human
uaguuucuaauguugaaauuau

SEQ ID NO: 182804 - RNA, 22 nt, Human
gugucuuauugauguuggcacu

SEQ ID NO: 182805 - RNA, 22 nt, Human
uaugaccuuaggaagcaagaag

SEQ ID NO: 182806 - RNA, 22 nt, Human
gugugaguggcuaagugugccu

SEQ ID NO: 182807 - RNA, 19 nt, Human
uaugaaguugauaaaaguu

SEQ ID NO: 182808 - RNA, 22 nt, Human
gugucauuggcuucccaagucc

SEQ ID NO: 182809 - RNA, 22 nt, Human
uaugagugccaaguuaccuggg

SEQ ID NO: 182810 - RNA, 22 nt, Human
guguguauguagguauauaugu

SEQ ID NO: 182811 - RNA, 22 nt, Human
guguggcgacucagagcugccu

SEQ ID NO: 182812 - RNA, 22 nt, Human
uaucugaugcaggcucccagga

SEQ ID NO: 182813 - RNA, 22 nt, Human
uaucuccauucuagccccuugu

SEQ ID NO: 182814 - RNA, 22 nt, Human
uaucuguagucucaugguuccu

SEQ ID NO: 182815 - RNA, 22 nt, Human
gugucacuuucaggagcucuaa

SEQ ID NO: 182816 - RNA, 22 nt, Human
uauaugcagauuuucaucaucg

SEQ ID NO: 182817 - RNA, 22 nt, Human
uauaugcacucagguguaugug

SEQ ID NO: 182818 - RNA, 22 nt, Human
uauauauaugcaccacaugugu

SEQ ID NO: 182819 - RNA, 22 nt, Human
uaucaguccaggguuuugugac

SEQ ID NO: 182820 - RNA, 22 nt, Human
uaucaguagaacaauggacauu

SEQ ID NO: 182821 - RNA, 22 nt, Human
uauauuaaagugcuuugcagug

SEQ ID NO: 182822 - RNA, 18 nt, Human
uauuugugugugugugug

SEQ ID NO: 182823 - RNA, 22 nt, Human
uauuucuagggcaugaaaauaa

SEQ ID NO: 182824 - RNA, 22 nt, Human
guugagaaucucuagcuuagga

SEQ ID NO: 182825 - RNA, 22 nt, Human
uauuuugaggugaaagaguuug

SEQ ID NO: 182826 - RNA, 22 nt, Human
guugauaauuaauagcuuuuga

SEQ ID NO: 182827 - RNA, 22 nt, Human
uauuguuuuaagguguauuaau

SEQ ID NO: 182828 - RNA, 22 nt, Human
uauugugaaggccaugugcuaa

SEQ ID NO: 182829 - RNA, 22 nt, Human
guuccucucacaggcuggagcu

SEQ ID NO: 182830 - RNA, 22 nt, Human
uauuguauuagcucuuggagau

SEQ ID NO: 182831 - RNA, 22 nt, Human
uauugauuuuguugcuaccugg

SEQ ID NO: 182832 - RNA, 22 nt, Human
uauuuacuuugaggaaguuguu

SEQ ID NO: 182833 - RNA, 22 nt, Human
uauuuacuguguucaucccucu

SEQ ID NO: 182834 - RNA, 22 nt, Human
uauuuaaagucagcaacuuuuc

SEQ ID NO: 182835 - RNA, 22 nt, Human
uauuuaugcaucacuuuuuucc

SEQ ID NO: 182836 - RNA, 20 nt, Human
uauuucaaugugccaaguuu

SEQ ID NO: 182837 - RNA, 22 nt, Human
uaugggcaagagauaggugguc

SEQ ID NO: 182838 - RNA, 22 nt, Human
guuacagagcugcuaugugugc

SEQ ID NO: 182839 - RNA, 22 nt, Human
uauguuaaauguuugauguuua

SEQ ID NO: 182840 - RNA, 22 nt, Human
uauggcuucucagucaugaaaa

SEQ ID NO: 182841 - RNA, 22 nt, Human
guguguggacgucugagcccag

SEQ ID NO: 182842 - RNA, 22 nt, Human
guguuaggugcauuaaacgugg

SEQ ID NO: 182843 - RNA, 23 nt, Human
guuauugcuggugcuggccagcc

SEQ ID NO: 182844 - RNA, 22 nt, Human
uaugugugugcguguguuuugc

SEQ ID NO: 182845 - RNA, 22 nt, Human
guuagaauggacaaagcugaaa

SEQ ID NO: 182846 - RNA, 22 nt, Human
guuauuuugucuuguucaugaa

SEQ ID NO: 182847 - RNA, 22 nt, Human
guuauuguuauugcguugucga

SEQ ID NO: 182848 - RNA, 22 nt, Human
guuauugggagagggaauggga

SEQ ID NO: 182849 - RNA, 22 nt, Human
uauuaauugugguuauuguauu

SEQ ID NO: 182850 - RNA, 22 nt, Human
guucaaucucucaugcauuuuc

SEQ ID NO: 182851 - RNA, 22 nt, Human
uauucuucaacuuuucuccucu

SEQ ID NO: 182852 - RNA, 18 nt, Human
uauuccucuuccucuauc

SEQ ID NO: 182853 - RNA, 22 nt, Human
guucagauucuuucucuuucac

SEQ ID NO: 182854 - RNA, 22 nt, Human
guuccgcggccucgcgcugagc

SEQ ID NO: 182855 - RNA, 22 nt, Human
ugaagcuagguucaugaggucg

SEQ ID NO: 182856 - RNA, 22 nt, Human
ugaaggaggugaauccaugcau

SEQ ID NO: 182857 - RNA, 22 nt, Human
ucaagcuggaaaugaagaaucu

SEQ ID NO: 182858 - RNA, 22 nt, Human
ucaaggaagggguaggaauaau

SEQ ID NO: 182859 - RNA, 22 nt, Human
ugaaguuuagaaaaagugccuu

SEQ ID NO: 182860 - RNA, 22 nt, Human
ugaauaaauaaacuuuuacuac

SEQ ID NO: 182861 - RNA, 22 nt, Human
ugaaucugagccugcgcaaagu

SEQ ID NO: 182862 - RNA, 22 nt, Human
ugaaucuuguuuacugauuccu

SEQ ID NO: 182863 - RNA, 22 nt, Human
ugaauagcaccuugaguaauga

SEQ ID NO: 182864 - RNA, 22 nt, Human
ugaauaaucuuggguauuaaua

SEQ ID NO: 182865 - RNA, 22 nt, Human
ugaaugcuacccugcuggcucu

SEQ ID NO: 182866 - RNA, 22 nt, Human
ugaauguggucaggaaauuguu

SEQ ID NO: 182867 - RNA, 22 nt, Human
ucaccaggauugggcuguaggc

SEQ ID NO: 182868 - RNA, 22 nt, Human
ucacauggauuaacucauuuau

SEQ ID NO: 182869 - RNA, 22 nt, Human
ucaccauguuuucauaggaaca

SEQ ID NO: 182870 - RNA, 22 nt, Human
ucaccauguacaugaagggcgg

SEQ ID NO: 182871 - RNA, 22 nt, Human
ucacaguucaacuaguucagau

SEQ ID NO: 182872 - RNA, 23 nt, Human
ucacugccaagaaaaguuacaga

SEQ ID NO: 182873 - RNA, 22 nt, Human
ucacugaacucucauagagaaa

SEQ ID NO: 182874 - RNA, 22 nt, Human
ucaccccagccuuaugacucag

SEQ ID NO: 182875 - RNA, 22 nt, Human
ucaccuguuggauguauacugu

SEQ ID NO: 182876 - RNA, 22 nt, Human
ucacucagucugagcaauugcu

SEQ ID NO: 182877 - RNA, 22 nt, Human
ucacuagcaucugaauauuguu

SEQ ID NO: 182878 - RNA, 17 nt, Human
ugacagcuaaggggcuu

SEQ ID NO: 182879 - RNA, 23 nt, Human
ugacagguucuaugguuuccaac

SEQ ID NO: 182880 - RNA, 22 nt, Human
ucagaaggagagacagcgugga

SEQ ID NO: 182881 - RNA, 22 nt, Human
ugacaguuugacugcaaccuuu

SEQ ID NO: 182882 - RNA, 22 nt, Human
ucagagugagcuggggcugcuu

SEQ ID NO: 182883 - RNA, 22 nt, Human
ucagagccagacacacagcaga

SEQ ID NO: 182884 - RNA, 22 nt, Human
ugaauuuuaacauucugcugga

SEQ ID NO: 182885 - RNA, 22 nt, Human
ugaauuuguaggaauucuccau

SEQ ID NO: 182886 - RNA, 22 nt, Human
ucagaacucuagucucagccug

SEQ ID NO: 182887 - RNA, 22 nt, Human
ucacuucuaugaucugucucuu

SEQ ID NO: 182888 - RNA, 22 nt, Human
ucacuguugccacggugauaau

SEQ ID NO: 182889 - RNA, 22 nt, Human
ucacuuccuugcagcuguagaa

SEQ ID NO: 182890 - RNA, 22 nt, Human
ucacuuuacaucuguaaaagga

SEQ ID NO: 182891 - RNA, 19 nt, Human
ucaggaggucgaccuggca

SEQ ID NO: 182892 - RNA, 22 nt, Human
ugacguuugcgccgcgcacgac

SEQ ID NO: 182893 - RNA, 19 nt, Human
ugacuggguucuaggcagg

SEQ ID NO: 182894 - RNA, 22 nt, Human
ucagcguuggccuccuccaggg

SEQ ID NO: 182895 - RNA, 22 nt, Human
ucagcucacaauguugagaaag

SEQ ID NO: 182896 - RNA, 22 nt, Human
ucagcuauccauucuccuauga

SEQ ID NO: 182897 - RNA, 22 nt, Human
ucagcgucuccaaaagagcccg

SEQ ID NO: 182898 - RNA, 22 nt, Human
ucagcugggagaaaguuuuagg

SEQ ID NO: 182899 - RNA, 21 nt, Human
ucaggaagagccaguucaugc

SEQ ID NO: 182900 - RNA, 22 nt, Human
ucagcucaggggauguggggga

SEQ ID NO: 182901 - RNA, 22 nt, Human
ucagcucucucuuggugaucuc

SEQ ID NO: 182902 - RNA, 19 nt, Human
ucagcagauuuugcaaaca

SEQ ID NO: 182903 - RNA, 22 nt, Human
ugacauuugagagagauauaca

SEQ ID NO: 182904 - RNA, 22 nt, Human
ucagauggucauucacuagggu

SEQ ID NO: 182905 - RNA, 22 nt, Human
ucagcacagcugcuuuuacuuc

SEQ ID NO: 182906 - RNA, 22 nt, Human
ucagauagcaagggauaccugu

SEQ ID NO: 182907 - RNA, 22 nt, Human
ugacgggacacaggugccaaca

SEQ ID NO: 182908 - RNA, 22 nt, Human
ugaccuccuaagugacagaauu

SEQ ID NO: 182909 - RNA, 22 nt, Human
ugaccuuuuuaaauuauuuuua

SEQ ID NO: 182910 - RNA, 22 nt, Human
ucagcaggugcuuuguuuacuc

SEQ ID NO: 182911 - RNA, 22 nt, Human
ucagcaguuaagcuucccugcc

SEQ ID NO: 182912 - RNA, 21 nt, Human
ucagccuguccaguguuaacc

SEQ ID NO: 182913 - RNA, 22 nt, Human
uauuugauggaacucuugcuuu

SEQ ID NO: 182914 - RNA, 22 nt, Human
uauuuguauugucuuaucacuu

SEQ ID NO: 182915 - RNA, 22 nt, Human
ucuuuuucccugguuccuuuuu

SEQ ID NO: 182916 - RNA, 22 nt, Human
uauuuguuucuaguggcagcaa

SEQ ID NO: 182917 - RNA, 22 nt, Human
uauuuguuuuuaaugcugggug

SEQ ID NO: 182918 - RNA, 22 nt, Human
uauuucaucugaacuucccaac

SEQ ID NO: 182919 - RNA, 22 nt, Human
uauuucaguuaagaugagguca

SEQ ID NO: 182920 - RNA, 22 nt, Human
uauuuccugcguuucugugagc

SEQ ID NO: 182921 - RNA, 22 nt, Human
uauuucaugagugaauaucuag

SEQ ID NO: 182922 - RNA, 22 nt, Human
ucuuuuaucuguuguguaacaa

SEQ ID NO: 182923 - RNA, 22 nt, Human
uauuuuggaugcauugagaugc

SEQ ID NO: 182924 - RNA, 22 nt, Human
ugaaauguggagaugguaagua

SEQ ID NO: 182925 - RNA, 22 nt, Human
ugaaauugaguaccucuuuaua

SEQ ID NO: 182926 - RNA, 22 nt, Human
ugaaaaauauuuuuagaaauaa

SEQ ID NO: 182927 - RNA, 22 nt, Human
ugaaaaaugcuuuaaugcaugu

SEQ ID NO: 182928 - RNA, 22 nt, Human
ugaaagccuacagcucacuguu

SEQ ID NO: 182929 - RNA, 22 nt, Human
ucaaagaucuuugcuuuugggg

SEQ ID NO: 182930 - RNA, 22 nt, Human
uauuuuuguuuaccaguuaaca

SEQ ID NO: 182931 - RNA, 22 nt, Human
ucaaaaauaagauauucuggac

SEQ ID NO: 182932 - RNA, 22 nt, Human
ugaagccacacuagcuuguccu

SEQ ID NO: 182933 - RNA, 22 nt, Human
ucaacauguuuuuuaaaagaaa

SEQ ID NO: 182934 - RNA, 22 nt, Human
ugaagccaugcuaaauguuaca

SEQ ID NO: 182935 - RNA, 21 nt, Human
ucaaccagguguugaaggcac

SEQ ID NO: 182936 - RNA, 22 nt, Human
ucaaccagcuuaucugcaggau

SEQ ID NO: 182937 - RNA, 22 nt, Human
ugaacagugugagggugugacc

SEQ ID NO: 182938 - RNA, 22 nt, Human
ugaacagacuauucucccaugu

SEQ ID NO: 182939 - RNA, 22 nt, Human
ugaacauuuuugcuugcagcuu

SEQ ID NO: 182940 - RNA, 21 nt, Human
ugaacaccaggagaaaucggu

SEQ ID NO: 182941 - RNA, 22 nt, Human
ugaaauuuuuuggagauaauuu

SEQ ID NO: 182942 - RNA, 22 nt, Human
ugaaccugagggcaaagggaca

SEQ ID NO: 182943 - RNA, 22 nt, Human
ugaacuaauguuguguccuaau

SEQ ID NO: 182944 - RNA, 22 nt, Human
ugaacuguccuuguugucuaga

SEQ ID NO: 182945 - RNA, 22 nt, Human
ugaacuggauuugugagcuccu

SEQ ID NO: 182946 - RNA, 22 nt, Human
uauuuuggcuccugagcucuga

SEQ ID NO: 182947 - RNA, 22 nt, Human
uauuuuuaccuaauuuaugaga

SEQ ID NO: 182948 - RNA, 22 nt, Human
ucuuugcauggacauguguuuu

SEQ ID NO: 182949 - RNA, 19 nt, Human
ucuuugcuuuucuaagagg

SEQ ID NO: 182950 - RNA, 18 nt, Human
uauuuacuguguguuacc

SEQ ID NO: 182951 - RNA, 22 nt, Human
ucuuugcagaauuuaacuuugc

SEQ ID NO: 182952 - RNA, 22 nt, Human
ucuuucugaugggaagggucaa

SEQ ID NO: 182953 - RNA, 22 nt, Human
uauuuacgcaaacaauugugca

SEQ ID NO: 182954 - RNA, 22 nt, Human
ucuuuaaauucuuaugagugaa

SEQ ID NO: 182955 - RNA, 22 nt, Human
ucuuuccagaccagccccagcu

SEQ ID NO: 182956 - RNA, 22 nt, Human
ucuugugagcugagauaaagcc

SEQ ID NO: 182957 - RNA, 19 nt, Human
ucuugcaucuuccuacugu

SEQ ID NO: 182958 - RNA, 22 nt, Human
ucuucuuuccuuuugugcauuu

SEQ ID NO: 182959 - RNA, 22 nt, Human
ucuugauggugauguuguguca

SEQ ID NO: 182960 - RNA, 22 nt, Human
uauuggcucagucagaaguuuu

SEQ ID NO: 182961 - RNA, 22 nt, Human
uauugguagauggagagagaca

SEQ ID NO: 182962 - RNA, 22 nt, Human
uauugaucuuugaaaccuuggu

SEQ ID NO: 182963 - RNA, 22 nt, Human
ucuucuguguguagugguugug

SEQ ID NO: 182964 - RNA, 22 nt, Human
ucuucuauaucuacauaugcaa

SEQ ID NO: 182965 - RNA, 19 nt, Human
ucuuccaucuauccuccuc

SEQ ID NO: 182966 - RNA, 22 nt, Human
ucuuccagauacuuccugacuu

SEQ ID NO: 182967 - RNA, 22 nt, Human
ucuuccauuccccuccuacgcc

SEQ ID NO: 182968 - RNA, 22 nt, Human
ucuacugagugcugagauuuug

SEQ ID NO: 182969 - RNA, 22 nt, Human
ucuacgugacagaacagacuga

SEQ ID NO: 182970 - RNA, 22 nt, Human
uaguggaaccuucuaaaugacg

SEQ ID NO: 182971 - RNA, 22 nt, Human
uagugcuuaaaacagaauuuuc

SEQ ID NO: 182972 - RNA, 22 nt, Human
uagugcuucauucuauugguuu

SEQ ID NO: 182973 - RNA, 22 nt, Human
uagugcuagaagcaaagacaaa

SEQ ID NO: 182974 - RNA, 22 nt, Human
ucaggcgcucuucguggcugcc

SEQ ID NO: 182975 - RNA, 22 nt, Human
ugaccuuaguuuuuucaaugag

SEQ ID NO: 182976 - RNA, 20 nt, Human
ugagaaacaagggcuggucu

SEQ ID NO: 182977 - RNA, 22 nt, Human
ugagggaugccucuccuuccgg

SEQ ID NO: 182978 - RNA, 23 nt, Human
ugaggucuuggaaguucuguuug

SEQ ID NO: 182979 - RNA, 22 nt, Human
ugaggucaggcagggguuuggc

SEQ ID NO: 182980 - RNA, 22 nt, Human
ugagggucgcaagcaccaggcc

SEQ ID NO: 182981 - RNA, 19 nt, Human
ugaguacuaaugagauuga

SEQ ID NO: 182982 - RNA, 22 nt, Human
ugagguugggaggacugccuaa

SEQ ID NO: 182983 - RNA, 20 nt, Human
ugagucagcugcaugggugg

SEQ ID NO: 182984 - RNA, 22 nt, Human
ugaguugcagucaauauugcaa

SEQ ID NO: 182985 - RNA, 22 nt, Human
ugaguuuuggaagauguuacag

SEQ ID NO: 182986 - RNA, 22 nt, Human
ugagugcuuuucgguguaccgu

SEQ ID NO: 182987 - RNA, 22 nt, Human
ugaguguuguaaccauaugauu

SEQ ID NO: 182988 - RNA, 22 nt, Human
ugaguuagcucuauucuuuugg

SEQ ID NO: 182989 - RNA, 22 nt, Human
ucauugugugugcuucuugggc

SEQ ID NO: 182990 - RNA, 22 nt, Human
ucauuguguaguagagguggca

SEQ ID NO: 182991 - RNA, 22 nt, Human
ucauuguuucugcuuuucauga

SEQ ID NO: 182992 - RNA, 22 nt, Human
ucauuguuuacugucuuuuuuc

SEQ ID NO: 182993 - RNA, 20 nt, Human
ucauucagaaucaguaugca

SEQ ID NO: 182994 - RNA, 22 nt, Human
ucauuauuuugauguauuuccu

SEQ ID NO: 182995 - RNA, 22 nt, Human
ucauugguugcauaauuugauc

SEQ ID NO: 182996 - RNA, 20 nt, Human
ugauaggcauugacauaagg

SEQ ID NO: 182997 - RNA, 22 nt, Human
ugauaguaucugauuauuucac

SEQ ID NO: 182998 - RNA, 20 nt, Human
ugauccacucucauugcucu

SEQ ID NO: 182999 - RNA, 22 nt, Human
ucauuagucuuuaauacauaau

SEQ ID NO: 183000 - RNA, 22 nt, Human
ucauuauuuggaauaugggacu

SEQ ID NO: 183001 - RNA, 22 nt, Human
ugaucuuugcuuuuggcuuagu

SEQ ID NO: 183002 - RNA, 22 nt, Human
ucauuuaauuuggaacucagag

SEQ ID NO: 183003 - RNA, 17 nt, Human
ucauuuauccucuuugg

SEQ ID NO: 183004 - RNA, 22 nt, Human
ugaugaucaugcagguugguuu

SEQ ID NO: 183005 - RNA, 19 nt, Human
ugaucuccaguacagacau

SEQ ID NO: 183006 - RNA, 22 nt, Human
ugauggaguauaauaaaaugac

SEQ ID NO: 183007 - RNA, 22 nt, Human
uccaaauagcuggaugauggug

SEQ ID NO: 183008 - RNA, 22 nt, Human
ugaugcuagaacuuccaagaua

SEQ ID NO: 183009 - RNA, 22 nt, Human
uccaggucgggggugggccggc

SEQ ID NO: 183010 - RNA, 22 nt, Human
uccagguggcuuuccuggggga

SEQ ID NO: 183011 - RNA, 22 nt, Human
uccagguccuacuggcccauag

SEQ ID NO: 183012 - RNA, 22 nt, Human
uccagguuuggcuuuauaacuu

SEQ ID NO: 183013 - RNA, 22 nt, Human
uccaggucauucucuccgaccg

SEQ ID NO: 183014 - RNA, 22 nt, Human
uccaguggcaccuuggcccuca

SEQ ID NO: 183015 - RNA, 22 nt, Human
uccagugccagcuguuaaaguu

SEQ ID NO: 183016 - RNA, 22 nt, Human
uccagugguggcucccggaccu

SEQ ID NO: 183017 - RNA, 22 nt, Human
ugcaaaaagagcgaggagcccu

SEQ ID NO: 183018 - RNA, 22 nt, Human
ugauuuguuuaaauugcucguu

SEQ ID NO: 183019 - RNA, 22 nt, Human
ugcaaaaguuuuauacacagau

SEQ ID NO: 183020 - RNA, 23 nt, Human
ugcaaaauuugcagaguucgaug

SEQ ID NO: 183021 - RNA, 22 nt, Human
ugcaaauuuuuuuauuuuuccu

SEQ ID NO: 183022 - RNA, 22 nt, Human
uccaugauauauaugugcacau

SEQ ID NO: 183023 - RNA, 22 nt, Human
uccacgggagcgucggucucgg

SEQ ID NO: 183024 - RNA, 22 nt, Human
ugauguggaucuauaacuguaa

SEQ ID NO: 183025 - RNA, 22 nt, Human
uccacagggaugccugcggcuu

SEQ ID NO: 183026 - RNA, 22 nt, Human
ugauguauaaaaagagugaaau

SEQ ID NO: 183027 - RNA, 22 nt, Human
uccagacucaaaaaccagaugg

SEQ ID NO: 183028 - RNA, 22 nt, Human
uccacuaucagaccuguagucu

SEQ ID NO: 183029 - RNA, 22 nt, Human
ugauuuggcaucaguguauccu

SEQ ID NO: 183030 - RNA, 22 nt, Human
ugauuugauuuguuuaugccug

SEQ ID NO: 183031 - RNA, 22 nt, Human
uccaggcagcugcuugaugaua

SEQ ID NO: 183032 - RNA, 22 nt, Human
ugcacagagggaggcauaaaau

SEQ ID NO: 183033 - RNA, 17 nt, Human
uccauugagacaagaag

SEQ ID NO: 183034 - RNA, 22 nt, Human
ugcaaugagcuucuuugauaaa

SEQ ID NO: 183035 - RNA, 22 nt, Human
ugcaagauccagucuugagaag

SEQ ID NO: 183036 - RNA, 22 nt, Human
ugcaagagcccaaacuauauac

SEQ ID NO: 183037 - RNA, 19 nt, Human
ugcaagcuuuuucuuguua

SEQ ID NO: 183038 - RNA, 22 nt, Human
uccaugcaguagaggcgcuggg

SEQ ID NO: 183039 - RNA, 22 nt, Human
uccaugcgcgauggccuggcuu

SEQ ID NO: 183040 - RNA, 22 nt, Human
uccauguauugcuaacaaauag

SEQ ID NO: 183041 - RNA, 22 nt, Human
ugcagccuuuguccuugggcua

SEQ ID NO: 183042 - RNA, 22 nt, Human
ugcagcgugaggacagcugagc

SEQ ID NO: 183043 - RNA, 18 nt, Human
ugcagcuuugugauuggc

SEQ ID NO: 183044 - RNA, 19 nt, Human
ugcagcuguaugagcuuaa

SEQ ID NO: 183045 - RNA, 22 nt, Human
ugcagaacacaguagacagaac

SEQ ID NO: 183046 - RNA, 22 nt, Human
ugcagacuguuucuugacugaa

SEQ ID NO: 183047 - RNA, 22 nt, Human
ugcagaggagcuggaaggcugg

SEQ ID NO: 183048 - RNA, 22 nt, Human
ugcacgcgcccuucgauggccc

SEQ ID NO: 183049 - RNA, 22 nt, Human
ugcucgggcuccuuugagugag

SEQ ID NO: 183050 - RNA, 23 nt, Human
ugcucgccuucaggacuugggcu

SEQ ID NO: 183051 - RNA, 21 nt, Human
ucgggcggcggcugaggcggc

SEQ ID NO: 183052 - RNA, 22 nt, Human
ucgggcgaauguuguuuuucuc

SEQ ID NO: 183053 - RNA, 22 nt, Human
ugcugaccggccuccccccagc

SEQ ID NO: 183054 - RNA, 22 nt, Human
ucguauaguugcugcagauggu

SEQ ID NO: 183055 - RNA, 23 nt, Human
ucgucgucagccacuaccucccc

SEQ ID NO: 183056 - RNA, 22 nt, Human
ugcucuuucaggcauagaccuu

SEQ ID NO: 183057 - RNA, 22 nt, Human
ugcucugguccucccucggcgc

SEQ ID NO: 183058 - RNA, 22 nt, Human
ucguggaugaagaauagaggcc

SEQ ID NO: 183059 - RNA, 22 nt, Human
ucguguuggaacugcuuuguaa

SEQ ID NO: 183060 - RNA, 22 nt, Human
ucgugacuggacaaacuugggu

SEQ ID NO: 183061 - RNA, 22 nt, Human
ucguuucuuuuucuucccugga

SEQ ID NO: 183062 - RNA, 22 nt, Human
ucuaaagcuccuuccacuaaaa

SEQ ID NO: 183063 - RNA, 22 nt, Human
ucuaaaaauuagaaauuagguc

SEQ ID NO: 183064 - RNA, 22 nt, Human
ugcugcacucacaggaagaguu

SEQ ID NO: 183065 - RNA, 22 nt, Human
ucuaaugcuuccucucauccca

SEQ ID NO: 183066 - RNA, 22 nt, Human
ugcugacuauacauuuagcauu

SEQ ID NO: 183067 - RNA, 22 nt, Human
ugcugcacccuucauuuuccca

SEQ ID NO: 183068 - RNA, 20 nt, Human
ucuaaugaagugagcuuagc

SEQ ID NO: 183069 - RNA, 22 nt, Human
ucuaaucuuugaaaucaggguc

SEQ ID NO: 183070 - RNA, 22 nt, Human
ugcuauccagacacauaugauc

SEQ ID NO: 183071 - RNA, 22 nt, Human
ugcuaaugaauggaggaucuga

SEQ ID NO: 183072 - RNA, 22 nt, Human
ugcuaucuagaaauacuggguu

SEQ ID NO: 183073 - RNA, 20 nt, Human
ugcuaucugcucucccuucu

SEQ ID NO: 183074 - RNA, 22 nt, Human
ucggccggagggggcgggcgca

SEQ ID NO: 183075 - RNA, 22 nt, Human
ucggcgaccugucauggaccaa

SEQ ID NO: 183076 - RNA, 22 nt, Human
ugcucacugcuuguguucaguu

SEQ ID NO: 183077 - RNA, 22 nt, Human
ugcuccguucuucugcuucuug

SEQ ID NO: 183078 - RNA, 22 nt, Human
ugcucagaagacuuacugguua

SEQ ID NO: 183079 - RNA, 22 nt, Human
ugcuauuuuguuuucaguccau

SEQ ID NO: 183080 - RNA, 22 nt, Human
ugcgccaggacacccguggcgg

SEQ ID NO: 183081 - RNA, 22 nt, Human
ucgccauguacaugaagggcgg

SEQ ID NO: 183082 - RNA, 22 nt, Human
ucgaggagagucgccagcugcu

SEQ ID NO: 183083 - RNA, 22 nt, Human
ugccugucuaucuuugucaucu

SEQ ID NO: 183084 - RNA, 22 nt, Human
ucgagcgcucccugugcucucg

SEQ ID NO: 183085 - RNA, 22 nt, Human
ucgauccaggaaggcugguuua

SEQ ID NO: 183086 - RNA, 22 nt, Human
ugcggugcagcccugcccucuc

SEQ ID NO: 183087 - RNA, 22 nt, Human
ugcguggauuuaggagugaggg

SEQ ID NO: 183088 - RNA, 22 nt, Human
ugcguugaggaccgcgagggcg

SEQ ID NO: 183089 - RNA, 22 nt, Human
ugcguuuaguuucaagacacgu

SEQ ID NO: 183090 - RNA, 23 nt, Human
ugcuaaaggcagaauauucaccu

SEQ ID NO: 183091 - RNA, 22 nt, Human
uccguugaggcugccaggcgag

SEQ ID NO: 183092 - RNA, 23 nt, Human
ugcaugagcaucuccaccucagu

SEQ ID NO: 183093 - RNA, 22 nt, Human
ucccuuuuuccugaucugugaa

SEQ ID NO: 183094 - RNA, 22 nt, Human
ucccuuuucauccuaucccagc

SEQ ID NO: 183095 - RNA, 22 nt, Human
ucccuuuuagccccgcccuccu

SEQ ID NO: 183096 - RNA, 22 nt, Human
ucccuucccaccccugccuuuu

SEQ ID NO: 183097 - RNA, 22 nt, Human
ucccuuaacucaaguggugcuc

SEQ ID NO: 183098 - RNA, 22 nt, Human
ugccaauuaccuauuucugaga

SEQ ID NO: 183099 - RNA, 22 nt, Human
ugcauuacuuugauaagcgucu

SEQ ID NO: 183100 - RNA, 22 nt, Human
ugcauguuuuaagugaagcuga

SEQ ID NO: 183101 - RNA, 22 nt, Human
ugccauagaaguccaacccaau

SEQ ID NO: 183102 - RNA, 22 nt, Human
uccucagcaagacgcuggcagc

SEQ ID NO: 183103 - RNA, 22 nt, Human
ugccagauuaugucuccagggc

SEQ ID NO: 183104 - RNA, 23 nt, Human
ugccaggaagaaugaccucugcu

SEQ ID NO: 183105 - RNA, 22 nt, Human
ugccaugguuguacaguagcag

SEQ ID NO: 183106 - RNA, 22 nt, Human
ugccaucuuugccccuauuuua

SEQ ID NO: 183107 - RNA, 22 nt, Human
ugcccugcagacccugcagugu

SEQ ID NO: 183108 - RNA, 22 nt, Human
ugcccugaagcugucaauuuug

SEQ ID NO: 183109 - RNA, 22 nt, Human
uccugggucugugagccauacu

SEQ ID NO: 183110 - RNA, 22 nt, Human
uccuggcuguuagagaggcaag

SEQ ID NO: 183111 - RNA, 22 nt, Human
uccugaaggccugaguuccacc

SEQ ID NO: 183112 - RNA, 22 nt, Human
ugccgccgugggucccgacgcg

SEQ ID NO: 183113 - RNA, 19 nt, Human
uccuuaguugcugccgcua

SEQ ID NO: 183114 - RNA, 22 nt, Human
uccugguaaagaguaucagauu

SEQ ID NO: 183115 - RNA, 22 nt, Human
ugccuggugcggagugaguggc

SEQ ID NO: 183116 - RNA, 22 nt, Human
ugccuguguauuuccggccugc

SEQ ID NO: 183117 - RNA, 22 nt, Human
ucgaaacuucucauuuaucugu

SEQ ID NO: 183118 - RNA, 22 nt, Human
ucuuaaucauucuucacuuccu

SEQ ID NO: 183119 - RNA, 22 nt, Human
ucuuagacagagaagacuauug

SEQ ID NO: 183120 - RNA, 21 nt, Human
ucuuauacagcaauagaucug

SEQ ID NO: 183121 - RNA, 18 nt, Human
uggcaaugccaaaggcuu

SEQ ID NO: 183122 - RNA, 22 nt, Human
ucuuauugguaaugauggcauu

SEQ ID NO: 183123 - RNA, 22 nt, Human
ucuuauugugaugaugaagaac

SEQ ID NO: 183124 - RNA, 22 nt, Human
uggcagaaugaagacuggggcc

SEQ ID NO: 183125 - RNA, 22 nt, Human
uggcacugcccugucucggugg

SEQ ID NO: 183126 - RNA, 22 nt, Human
uggcacguuggauugggaguuc

SEQ ID NO: 183127 - RNA, 22 nt, Human
uggcacugaagcuggaaagccu

SEQ ID NO: 183128 - RNA, 22 nt, Human
uggauuguuuacaucaugucug

SEQ ID NO: 183129 - RNA, 20 nt, Human
uggaugacuucaggcagccu

SEQ ID NO: 183130 - RNA, 22 nt, Human
uggauauagcugaggugucuug

SEQ ID NO: 183131 - RNA, 22 nt, Human
uggaguuuuaaucuguacagaa

SEQ ID NO: 183132 - RNA, 22 nt, Human
uggaugcuccaaguagaccuua

SEQ ID NO: 183133 - RNA, 22 nt, Human
ucuuaaauaugaaaaggauuau

SEQ ID NO: 183134 - RNA, 20 nt, Human
uggagggaggaggggcccaa

SEQ ID NO: 183135 - RNA, 22 nt, Human
uggaguuuauuugaauucuugg

SEQ ID NO: 183136 - RNA, 22 nt, Human
uggcaggggaaaagggguggga

SEQ ID NO: 183137 - RNA, 20 nt, Human
uggcaugcucucuuuuuagg

SEQ ID NO: 183138 - RNA, 22 nt, Human
uggcagccucugguccuuaguu

SEQ ID NO: 183139 - RNA, 22 nt, Human
uggcaguaaagcuggaaaagug

SEQ ID NO: 183140 - RNA, 18 nt, Human
uggcaugcuuugauacau

SEQ ID NO: 183141 - RNA, 22 nt, Human
uggcaugugaauuguuacauug

SEQ ID NO: 183142 - RNA, 22 nt, Human
ucuugcuguggcagaucuggag

SEQ ID NO: 183143 - RNA, 22 nt, Human
uggccaugagaaucuuugcugu

SEQ ID NO: 183144 - RNA, 22 nt, Human
uggccagucuuagcugugccug

SEQ ID NO: 183145 - RNA, 22 nt, Human
ucuucuuugugguugcccaagg

SEQ ID NO: 183146 - RNA, 19 nt, Human
ucuuucauuucuagcucug

SEQ ID NO: 183147 - RNA, 22 nt, Human
uggcccaucagggcaccugaga

SEQ ID NO: 183148 - RNA, 22 nt, Human
ucuuuauuucccuaacuugcua

SEQ ID NO: 183149 - RNA, 22 nt, Human
uggcaguagagcuggaacuuga

SEQ ID NO: 183150 - RNA, 22 nt, Human
ucuugucacagcuugacuccua

SEQ ID NO: 183151 - RNA, 22 nt, Human
ucuuggucccugagcucuuuca

SEQ ID NO: 183152 - RNA, 22 nt, Human
ucuugggcaguccucuacuggu

SEQ ID NO: 183153 - RNA, 20 nt, Human
ucuugucuggcagccuggag

SEQ ID NO: 183154 - RNA, 22 nt, Human
uggagaaauaacauuuggauuc

SEQ ID NO: 183155 - RNA, 21 nt, Human
uggaauuggaaaccauucuau

SEQ ID NO: 183156 - RNA, 21 nt, Human
uggaagggaagucuugguugu

SEQ ID NO: 183157 - RNA, 22 nt, Human
uggaagggagcuggaauuugga

SEQ ID NO: 183158 - RNA, 22 nt, Human
ucuggguaacugaggcuaauau

SEQ ID NO: 183159 - RNA, 22 nt, Human
ucuggggaugagugaugucgua

SEQ ID NO: 183160 - RNA, 22 nt, Human
uggaaggaaauguguaucauaa

SEQ ID NO: 183161 - RNA, 22 nt, Human
ucugggagaguagauaaaggaa

SEQ ID NO: 183162 - RNA, 21 nt, Human
ucuggggacaagguccaggaa

SEQ ID NO: 183163 - RNA, 22 nt, Human
uggaagcccagaaggaagcaga

SEQ ID NO: 183164 - RNA, 22 nt, Human
uggagcugaaguacucucacua

SEQ ID NO: 183165 - RNA, 22 nt, Human
uggagaugcacgagcaggugga

SEQ ID NO: 183166 - RNA, 22 nt, Human
uggagcaagaagggaggcagaa

SEQ ID NO: 183167 - RNA, 22 nt, Human
uggaggaggaugcauuuguugu

SEQ ID NO: 183168 - RNA, 22 nt, Human
uggaggauaacacaagaaguga

SEQ ID NO: 183169 - RNA, 22 nt, Human
uggaggaugacagagaugggcu

SEQ ID NO: 183170 - RNA, 22 nt, Human
uggagcugguucuggggaagcu

SEQ ID NO: 183171 - RNA, 19 nt, Human
ugcugcaggaauucucaag

SEQ ID NO: 183172 - RNA, 22 nt, Human
ugcugccucccaucccucccga

SEQ ID NO: 183173 - RNA, 22 nt, Human
ugcugccucugaauggagcagu

SEQ ID NO: 183174 - RNA, 22 nt, Human
ucuacgugggaguucaggauuc

SEQ ID NO: 183175 - RNA, 22 nt, Human
ucuacuccaucugccagggcuu

SEQ ID NO: 183176 - RNA, 22 nt, Human
uggaaagauuuaaaauaacgag

SEQ ID NO: 183177 - RNA, 22 nt, Human
ucugcagggcccuuggcuccug

SEQ ID NO: 183178 - RNA, 22 nt, Human
uggaaaggcccauaaaaggaua

SEQ ID NO: 183179 - RNA, 22 nt, Human
uggaaauagauguaggaaauug

SEQ ID NO: 183180 - RNA, 22 nt, Human
uggaaauaguugugagucaggc

SEQ ID NO: 183181 - RNA, 22 nt, Human
uggaaagaagacugugguugag

SEQ ID NO: 183182 - RNA, 22 nt, Human
uggaaaguuggaagucucagga

SEQ ID NO: 183183 - RNA, 22 nt, Human
uggaacuagugucugagauggg

SEQ ID NO: 183184 - RNA, 22 nt, Human
uggaacuuccucacuuucccuc

SEQ ID NO: 183185 - RNA, 22 nt, Human
ucuggaaauggaaguaacuaug

SEQ ID NO: 183186 - RNA, 22 nt, Human
ucuggaggucucagggcgggaa

SEQ ID NO: 183187 - RNA, 22 nt, Human
ucugcccguucaaauccuuguu

SEQ ID NO: 183188 - RNA, 22 nt, Human
ucugccuucaggagcagacucu

SEQ ID NO: 183189 - RNA, 17 nt, Human
ucugccaguuuuagaau

SEQ ID NO: 183190 - RNA, 22 nt, Human
uggaacugauuaaaagggcaga

SEQ ID NO: 183191 - RNA, 22 nt, Human
ucugcggccuagcgcccggcgc

SEQ ID NO: 183192 - RNA, 22 nt, Human
uggaaccuggcuucaaagggag

SEQ ID NO: 183193 - RNA, 22 nt, Human
ucugcggccggaauucccuuca

SEQ ID NO: 183194 - RNA, 22 nt, Human
uggggcggaaggaggagaggug

SEQ ID NO: 183195 - RNA, 22 nt, Human
uggggcuccuccuggcaggagg

SEQ ID NO: 183196 - RNA, 22 nt, Human
uggggcuggccaggaggagucu

SEQ ID NO: 183197 - RNA, 22 nt, Human
ugggggaggaggagacagacug

SEQ ID NO: 183198 - RNA, 22 nt, Human
ugaaugaacugaugaacuuaac

SEQ ID NO: 183199 - RNA, 22 nt, Human
ugaaugaagcacuguaauucuc

SEQ ID NO: 183200 - RNA, 22 nt, Human
ugaaugaguucaccgcucaguu

SEQ ID NO: 183201 - RNA, 22 nt, Human
ugaauuacacugggaucagggc

SEQ ID NO: 183202 - RNA, 22 nt, Human
ugaauguguacacgauuguuug

SEQ ID NO: 183203 - RNA, 22 nt, Human
ugaauuauaugguauugaacau

SEQ ID NO: 183204 - RNA, 22 nt, Human
ugaauuucuuuuuaaaauauua

SEQ ID NO: 183205 - RNA, 22 nt, Human
ugacacagaccaaguggugcug

SEQ ID NO: 183206 - RNA, 22 nt, Human
ugacagaaaccaccccccaggu

SEQ ID NO: 183207 - RNA, 22 nt, Human
ugaauuuuggcaauuuucugug

SEQ ID NO: 183208 - RNA, 22 nt, Human
ugacacacagggggauggaguu

SEQ ID NO: 183209 - RNA, 22 nt, Human
ugacagucacagcagaaacucg

SEQ ID NO: 183210 - RNA, 22 nt, Human
ugaaucagaccuucauugggua

SEQ ID NO: 183211 - RNA, 22 nt, Human
ugaaucaaugaauugcacuuca

SEQ ID NO: 183212 - RNA, 21 nt, Human
uggggaugcauugcagaggca

SEQ ID NO: 183213 - RNA, 22 nt, Human
uggggacucacugacuaucuug

SEQ ID NO: 183214 - RNA, 22 nt, Human
ugaauagucaaagcacaagagg

SEQ ID NO: 183215 - RNA, 22 nt, Human
ugggcacacugaaucugcuauu

SEQ ID NO: 183216 - RNA, 23 nt, Human
ugaagugaaauuucacaagggac

SEQ ID NO: 183217 - RNA, 22 nt, Human
ugaagguggcuugcagcuaguc

SEQ ID NO: 183218 - RNA, 22 nt, Human
ugaaggggaaagucuugcuaua

SEQ ID NO: 183219 - RNA, 21 nt, Human
ugaagggugagauauaaguga

SEQ ID NO: 183220 - RNA, 22 nt, Human
ugggcagggagcuggaaccaca

SEQ ID NO: 183221 - RNA, 22 nt, Human
ugggauucucagaaacacagag

SEQ ID NO: 183222 - RNA, 22 nt, Human
ugggauucugaaaauggauuac

SEQ ID NO: 183223 - RNA, 22 nt, Human
ugggauggacuuuagagaaucg

SEQ ID NO: 183224 - RNA, 22 nt, Human
ugaaaggaauuuaaauguuguu

SEQ ID NO: 183225 - RNA, 22 nt, Human
ugaaaugccucuuugguucuaa

SEQ ID NO: 183226 - RNA, 22 nt, Human
uggcuucuggccaggcacagga

SEQ ID NO: 183227 - RNA, 22 nt, Human
uggcuuuucaccugcuccucug

SEQ ID NO: 183228 - RNA, 22 nt, Human
ugaaagcuggcucugcagagug

SEQ ID NO: 183229 - RNA, 22 nt, Human
uggcuguuggagcuggaagaug

SEQ ID NO: 183230 - RNA, 22 nt, Human
uggcugaggcuuuucuuaaaga

SEQ ID NO: 183231 - RNA, 22 nt, Human
uggcugagugaacauguccauu

SEQ ID NO: 183232 - RNA, 22 nt, Human
uggcugaugucuguucuguuau

SEQ ID NO: 183233 - RNA, 22 nt, Human
uggcucuucucaagcauuggcu

SEQ ID NO: 183234 - RNA, 22 nt, Human
uggcugagcugcagcguggcuu

SEQ ID NO: 183235 - RNA, 17 nt, Human
ucuuuuacuuucucucc

SEQ ID NO: 183236 - RNA, 22 nt, Human
ucuuuucagccagcugguagga

SEQ ID NO: 183237 - RNA, 22 nt, Human
ugggagccuuccacugggggaa

SEQ ID NO: 183238 - RNA, 22 nt, Human
ugggagagaaauuuaaguuuuu

SEQ ID NO: 183239 - RNA, 21 nt, Human
ugaagcccugugaggugcuua

SEQ ID NO: 183240 - RNA, 22 nt, Human
ugggauauagaauuggcagagu

SEQ ID NO: 183241 - RNA, 22 nt, Human
ugaagacuucuuuuggucacca

SEQ ID NO: 183242 - RNA, 22 nt, Human
ugaagacaguuuuacucaugag

SEQ ID NO: 183243 - RNA, 22 nt, Human
ugaagaauuccauggcuuccau

SEQ ID NO: 183244 - RNA, 22 nt, Human
ugggaagcugagccucgaugug

SEQ ID NO: 183245 - RNA, 22 nt, Human
ugggaagaguuagagacagcug

SEQ ID NO: 183246 - RNA, 22 nt, Human
ugaacuuacauugaggaauucu

SEQ ID NO: 183247 - RNA, 22 nt, Human
ugaaccgcuucauggugccugu

SEQ ID NO: 183248 - RNA, 22 nt, Human
ugaaccgacaggggaagauugu

SEQ ID NO: 183249 - RNA, 22 nt, Human
ugaaccaugaauuacaggagca

SEQ ID NO: 183250 - RNA, 22 nt, Human
ugggaaacucuaaacuugagua

SEQ ID NO: 183251 - RNA, 22 nt, Human
ugggaagaggaggcagggggca

SEQ ID NO: 183252 - RNA, 22 nt, Human
uggcuuuuuauuccuaugugau

SEQ ID NO: 183253 - RNA, 22 nt, Human
uggcuuuuuucuccccuuggau

SEQ ID NO: 183254 - RNA, 22 nt, Human
uguauaaaauggaaugucagaa

SEQ ID NO: 183255 - RNA, 23 nt, Human
uguauacacccugugcaucuggg

SEQ ID NO: 183256 - RNA, 22 nt, Human
ugauguaggacauuauuauuuc

SEQ ID NO: 183257 - RNA, 22 nt, Human
uguacauuuacaaaagcuuuau

SEQ ID NO: 183258 - RNA, 22 nt, Human
ugauguaaaauaggaaguucua

SEQ ID NO: 183259 - RNA, 22 nt, Human
uguaucuguguguauguguuua

SEQ ID NO: 183260 - RNA, 22 nt, Human
uguauguguuuuauguguguuu

SEQ ID NO: 183261 - RNA, 22 nt, Human
uguauauuuucuguauaaaaua

SEQ ID NO: 183262 - RNA, 22 nt, Human
ugauucacagacuucacaaggc

SEQ ID NO: 183263 - RNA, 22 nt, Human
uguauugaggauucauuuuugu

SEQ ID NO: 183264 - RNA, 22 nt, Human
uguauugugggugucagagugc

SEQ ID NO: 183265 - RNA, 22 nt, Human
ugauguuucugaagggguuacu

SEQ ID NO: 183266 - RNA, 22 nt, Human
uguauaugucugugagcuauua

SEQ ID NO: 183267 - RNA, 22 nt, Human
uguauauguguguagcauguua

SEQ ID NO: 183268 - RNA, 22 nt, Human
ugauucacgcuucucuuuaaac

SEQ ID NO: 183269 - RNA, 22 nt, Human
uguauuugaagaaagagcuucu

SEQ ID NO: 183270 - RNA, 21 nt, Human
ugucagcaacaauacuuucuc

SEQ ID NO: 183271 - RNA, 22 nt, Human
ugauugcucgacacucugcuug

SEQ ID NO: 183272 - RNA, 18 nt, Human
uguauuguucacuucugu

SEQ ID NO: 183273 - RNA, 22 nt, Human
uguauuuauuuuucaacuacca

SEQ ID NO: 183274 - RNA, 19 nt, Human
uguauuuauauuucugugc

SEQ ID NO: 183275 - RNA, 22 nt, Human
ugauugcucagcuagccucuuu

SEQ ID NO: 183276 - RNA, 22 nt, Human
ugcaaauucuuuacucugugau

SEQ ID NO: 183277 - RNA, 21 nt, Human
ugcaacugaaaggaauauggu

SEQ ID NO: 183278 - RNA, 22 nt, Human
ugucugcauucgaguucaugga

SEQ ID NO: 183279 - RNA, 23 nt, Human
ugucugccuaucaugugaaggac

SEQ ID NO: 183280 - RNA, 22 nt, Human
ugcacgcacuugcucuccagcg

SEQ ID NO: 183281 - RNA, 22 nt, Human
ugcacauuucucacaauguaca

SEQ ID NO: 183282 - RNA, 22 nt, Human
ugcaaggcacccacucugcuuu

SEQ ID NO: 183283 - RNA, 22 nt, Human
ugagguauuuggauuuauauuu

SEQ ID NO: 183284 - RNA, 22 nt, Human
uggugugggauccugggaagga

SEQ ID NO: 183285 - RNA, 22 nt, Human
ugguugauuaauuuugccaagc

SEQ ID NO: 183286 - RNA, 22 nt, Human
ugguucugucugugcugggggg

SEQ ID NO: 183287 - RNA, 17 nt, Human
ugguucuuuuccugacc

SEQ ID NO: 183288 - RNA, 22 nt, Human
ugguugguuaaugugcccauuu

SEQ ID NO: 183289 - RNA, 22 nt, Human
ugguugugcucuguuugaaagu

SEQ ID NO: 183290 - RNA, 22 nt, Human
ugguugcaguggugcuuauaca

SEQ ID NO: 183291 - RNA, 22 nt, Human
ugguugggguaacaaaaaggaa

SEQ ID NO: 183292 - RNA, 22 nt, Human
ugguugagguugacucuauaua

SEQ ID NO: 183293 - RNA, 22 nt, Human
ugaguucugacugagcaugggg

SEQ ID NO: 183294 - RNA, 22 nt, Human
ugguugugcuucuuugccucag

SEQ ID NO: 183295 - RNA, 22 nt, Human
ugaguuucuuacucaggagcug

SEQ ID NO: 183296 - RNA, 22 nt, Human
ugaguuuaggccaggauauggu

SEQ ID NO: 183297 - RNA, 22 nt, Human
uguaaagaaagacgcagaguua

SEQ ID NO: 183298 - RNA, 22 nt, Human
uguacauacauagauauacaca

SEQ ID NO: 183299 - RNA, 22 nt, Human
ugaugaugaagaaauauuauca

SEQ ID NO: 183300 - RNA, 22 nt, Human
uguaaaguuuccuauugcccua

SEQ ID NO: 183301 - RNA, 22 nt, Human
uggugacaucuaccuagguaaa

SEQ ID NO: 183302 - RNA, 22 nt, Human
uggucuuuccuucauuguccag

SEQ ID NO: 183303 - RNA, 22 nt, Human
uggucugggaagaucacaauua

SEQ ID NO: 183304 - RNA, 22 nt, Human
ugacauccuacaccccuggguc

SEQ ID NO: 183305 - RNA, 22 nt, Human
ugggguguuacacaacauugag

SEQ ID NO: 183306 - RNA, 22 nt, Human
uggggucuggcauaugguagau

SEQ ID NO: 183307 - RNA, 22 nt, Human
ugacaucagacugugagaagag

SEQ ID NO: 183308 - RNA, 22 nt, Human
ugggggaugacuugcucuuuca

SEQ ID NO: 183309 - RNA, 22 nt, Human
ugggggauucaucucagagcgu

SEQ ID NO: 183310 - RNA, 22 nt, Human
ugguggagucugggggaggcuu

SEQ ID NO: 183311 - RNA, 21 nt, Human
ugaggccugccagucucagaa

SEQ ID NO: 183312 - RNA, 22 nt, Human
ugaggccaagccuccucugcca

SEQ ID NO: 183313 - RNA, 19 nt, Human
ugaggauugagguccagua

SEQ ID NO: 183314 - RNA, 23 nt, Human
uggugcagcgcaggccggguggc

SEQ ID NO: 183315 - RNA, 22 nt, Human
uggugcaggauuuauuuaacua

SEQ ID NO: 183316 - RNA, 22 nt, Human
uggugcacgugggcagucggcc

SEQ ID NO: 183317 - RNA, 22 nt, Human
ugaggaaugugacaaaaccaag

SEQ ID NO: 183318 - RNA, 22 nt, Human
ugaggaagugguuguaugguuu

SEQ ID NO: 183319 - RNA, 22 nt, Human
uguuacugaaugucucugcuuu

SEQ ID NO: 183320 - RNA, 23 nt, Human
uguuaucacauguuccuuuaaau

SEQ ID NO: 183321 - RNA, 22 nt, Human
uguucaguuugcuaucauaauc

SEQ ID NO: 183322 - RNA, 22 nt, Human
uguuccaacuacugaauuggca

SEQ ID NO: 183323 - RNA, 22 nt, Human
uguuccggucuaucgugucaau

SEQ ID NO: 183324 - RNA, 22 nt, Human
uguuccucuuagucuuaugugu

SEQ ID NO: 183325 - RNA, 22 nt, Human
ugccuuguagccaccgggucac

SEQ ID NO: 183326 - RNA, 22 nt, Human
ugccuuuggcuguucugugacc

SEQ ID NO: 183327 - RNA, 22 nt, Human
ugcgccccgcgggccuucgggc

SEQ ID NO: 183328 - RNA, 22 nt, Human
ugccuuuuguguuuggcuaauc

SEQ ID NO: 183329 - RNA, 22 nt, Human
uguuaaaaagucccuguuuugu

SEQ ID NO: 183330 - RNA, 22 nt, Human
uguuaacugccaggacagaucg

SEQ ID NO: 183331 - RNA, 22 nt, Human
uguuaacuuagcugaccuuaaa

SEQ ID NO: 183332 - RNA, 22 nt, Human
ugccugaagccugccccugggu

SEQ ID NO: 183333 - RNA, 22 nt, Human
uguguuacaauaauggcaagua

SEQ ID NO: 183334 - RNA, 22 nt, Human
uguguguucauccccucaacau

SEQ ID NO: 183335 - RNA, 20 nt, Human
ugccuuccgccccgggcacc

SEQ ID NO: 183336 - RNA, 17 nt, Human
ugccuucgucuucaguu

SEQ ID NO: 183337 - RNA, 22 nt, Human
ugccuucugccaaggacggugc

SEQ ID NO: 183338 - RNA, 19 nt, Human
uguguuccauccaccaccc

SEQ ID NO: 183339 - RNA, 22 nt, Human
uguguuccugucuuauucuuau

SEQ ID NO: 183340 - RNA, 21 nt, Human
uguguuuauauguguuuauau

SEQ ID NO: 183341 - RNA, 22 nt, Human
uguguuuaaacuauaugccugc

SEQ ID NO: 183342 - RNA, 22 nt, Human
uguugaugaccacaauuuaugc

SEQ ID NO: 183343 - RNA, 19 nt, Human
uguugcagcuugaucggua

SEQ ID NO: 183344 - RNA, 21 nt, Human
uguugcuugucugagacuaug

SEQ ID NO: 183345 - RNA, 22 nt, Human
uguuggaauaagugcuugaagg

SEQ ID NO: 183346 - RNA, 22 nt, Human
uguugaagcaccucugucuuuc

SEQ ID NO: 183347 - RNA, 22 nt, Human
ugcuaaugagugcugugugaag

SEQ ID NO: 183348 - RNA, 21 nt, Human
ugcuaagugucacaugucugc

SEQ ID NO: 183349 - RNA, 22 nt, Human
uguucugauggauuacaugucu

SEQ ID NO: 183350 - RNA, 22 nt, Human
ugcggugcgcccgggcgagugc

SEQ ID NO: 183351 - RNA, 22 nt, Human
uguucggaaaagggcaagcuau

SEQ ID NO: 183352 - RNA, 21 nt, Human
ugcguaugucuuguauuacuc

SEQ ID NO: 183353 - RNA, 19 nt, Human
uguucuacuugcuaguauu

SEQ ID NO: 183354 - RNA, 22 nt, Human
ugcgcgcaccugcauauauaug

SEQ ID NO: 183355 - RNA, 19 nt, Human
ugcgggcugcggucagggc

SEQ ID NO: 183356 - RNA, 22 nt, Human
ugcggcucaaagggaaggccuu

SEQ ID NO: 183357 - RNA, 23 nt, Human
uguuccugaugccucguccuguc

SEQ ID NO: 183358 - RNA, 22 nt, Human
uguuccuggggaccugccuucc

SEQ ID NO: 183359 - RNA, 22 nt, Human
uguuccacgcguaguuccugcu

SEQ ID NO: 183360 - RNA, 22 nt, Human
ugcgccucugucacucagcauc

SEQ ID NO: 183361 - RNA, 22 nt, Human
ugcauuauaacaauaaggcuua

SEQ ID NO: 183362 - RNA, 22 nt, Human
ugcauaagguuaaauuagcaga

SEQ ID NO: 183363 - RNA, 22 nt, Human
ugcauaaauauuguugggagua

SEQ ID NO: 183364 - RNA, 22 nt, Human
ugcauugccucuauucauuaua

SEQ ID NO: 183365 - RNA, 22 nt, Human
ugcauugccauagcagggggau

SEQ ID NO: 183366 - RNA, 22 nt, Human
ugcauucugggucgcagagugg

SEQ ID NO: 183367 - RNA, 22 nt, Human
ugcauuccagcucccuucuggc

SEQ ID NO: 183368 - RNA, 22 nt, Human
ugugcuaauguuaggauugaau

SEQ ID NO: 183369 - RNA, 22 nt, Human
ugcagguggcagcggggcacca

SEQ ID NO: 183370 - RNA, 22 nt, Human
ugcaggguuucaauacacagga

SEQ ID NO: 183371 - RNA, 22 nt, Human
ugugcagugcguggguguugaa

SEQ ID NO: 183372 - RNA, 22 nt, Human
ugugccuuucacuaugucauuc

SEQ ID NO: 183373 - RNA, 22 nt, Human
ugcaggagaaaguacggagcgu

SEQ ID NO: 183374 - RNA, 22 nt, Human
ugcaggagcccaggaauacuau

SEQ ID NO: 183375 - RNA, 22 nt, Human
ugcaggagcaccagcucacccu

SEQ ID NO: 183376 - RNA, 22 nt, Human
ugugcaguauugaaauauaugu

SEQ ID NO: 183377 - RNA, 20 nt, Human
ugcacggcugugugugugca

SEQ ID NO: 183378 - RNA, 22 nt, Human
ugcacugccuuucuuggcauga

SEQ ID NO: 183379 - RNA, 22 nt, Human
ugugugguaaugagagauccaa

SEQ ID NO: 183380 - RNA, 22 nt, Human
ugccucucuggaucugcuguga

SEQ ID NO: 183381 - RNA, 17 nt, Human
uguguaaguugcauaga

SEQ ID NO: 183382 - RNA, 22 nt, Human
ugugguuggggucagauaggga

SEQ ID NO: 183383 - RNA, 22 nt, Human
ugugguuuguaagcaaagcaaa

SEQ ID NO: 183384 - RNA, 22 nt, Human
uguggugcucagggaggauggg

SEQ ID NO: 183385 - RNA, 22 nt, Human
ugccgggcugagcaagugcugc

SEQ ID NO: 183386 - RNA, 22 nt, Human
ugccuaaaccauuccccuuccu

SEQ ID NO: 183387 - RNA, 22 nt, Human
ugugguagagcuuaaaugaggu

SEQ ID NO: 183388 - RNA, 22 nt, Human
ugugggaucguaaauuugggac

SEQ ID NO: 183389 - RNA, 22 nt, Human
ugccaucaugucagauuuggga

SEQ ID NO: 183390 - RNA, 22 nt, Human
ugcccacuucaaaaucuucauu

SEQ ID NO: 183391 - RNA, 22 nt, Human
ugcauuugcaauggguacacaa

SEQ ID NO: 183392 - RNA, 22 nt, Human
ugcauuuucuaccacacccacu

SEQ ID NO: 183393 - RNA, 22 nt, Human
ugccaacaggcuugccugaugu

SEQ ID NO: 183394 - RNA, 22 nt, Human
ugcauuuuuaauuuggaaaaaa

SEQ ID NO: 183395 - RNA, 22 nt, Human
uugcugggauucauugaagggu

SEQ ID NO: 183396 - RNA, 22 nt, Human
uguggauauauuuuaaaaggaa

SEQ ID NO: 183397 - RNA, 22 nt, Human
uugcuggaguagaaaacuuaac

SEQ ID NO: 183398 - RNA, 22 nt, Human
uugcugcgcugaccuccaguga

SEQ ID NO: 183399 - RNA, 22 nt, Human
uguggccaccagagcugcuauu

SEQ ID NO: 183400 - RNA, 21 nt, Human
uguggccauuugaaaacaggg

SEQ ID NO: 183401 - RNA, 22 nt, Human
uguggcuuaggugagcauguga

SEQ ID NO: 183402 - RNA, 22 nt, Human
uugcugugucauuuguuuaauc

SEQ ID NO: 183403 - RNA, 22 nt, Human
ugugggaucauggaucagggcc

SEQ ID NO: 183404 - RNA, 22 nt, Human
ugugcaucuggaggcaauguuu

SEQ ID NO: 183405 - RNA, 22 nt, Human
ugugccuagauuccaugcacuc

SEQ ID NO: 183406 - RNA, 22 nt, Human
ugugcgcgugugcuuugugugu

SEQ ID NO: 183407 - RNA, 22 nt, Human
ugugcuugucuguuuugauugu

SEQ ID NO: 183408 - RNA, 22 nt, Human
ugugcgucuguguacagaugug

SEQ ID NO: 183409 - RNA, 22 nt, Human
ugugcugcagcgagagcuacga

SEQ ID NO: 183410 - RNA, 22 nt, Human
ugugcuauuuuugcauaugugu

SEQ ID NO: 183411 - RNA, 22 nt, Human
uuggaaauguagaaaagcagau

SEQ ID NO: 183412 - RNA, 19 nt, Human
uuggagcaucccaaaggcu

SEQ ID NO: 183413 - RNA, 20 nt, Human
uuggagaucacguguccagg

SEQ ID NO: 183414 - RNA, 22 nt, Human
uguggugcagcgggaacagcuu

SEQ ID NO: 183415 - RNA, 22 nt, Human
uguguaacaacauaaugguuau

SEQ ID NO: 183416 - RNA, 22 nt, Human
uguguggaggugggugaugucu

SEQ ID NO: 183417 - RNA, 22 nt, Human
ugugugcuaguuuugucaguau

SEQ ID NO: 183418 - RNA, 22 nt, Human
uuggaguucuucaugcucugua

SEQ ID NO: 183419 - RNA, 22 nt, Human
uuggagagggugggcuuugaag

SEQ ID NO: 183420 - RNA, 22 nt, Human
ugugggcugcuguuuccuugua

SEQ ID NO: 183421 - RNA, 22 nt, Human
ugugggcguggguuggggaggg

SEQ ID NO: 183422 - RNA, 22 nt, Human
uguggguggucagcgugugaug

SEQ ID NO: 183423 - RNA, 22 nt, Human
uguggugacuugagcuuccuaa

SEQ ID NO: 183424 - RNA, 22 nt, Human
uguggucuccucucugucuucc

SEQ ID NO: 183425 - RNA, 22 nt, Human
uuggaaaagaaauacucauaua

SEQ ID NO: 183426 - RNA, 22 nt, Human
uugcuugcggccuuugugccuu

SEQ ID NO: 183427 - RNA, 22 nt, Human
uugcuuuuugggguuuacuggg

SEQ ID NO: 183428 - RNA, 23 nt, Human
uugcuuuugccccaaaagaguua

SEQ ID NO: 183429 - RNA, 22 nt, Human
uugcuuugcuucuuuaugguca

SEQ ID NO: 183430 - RNA, 22 nt, Human
uuggcuguguugaaaacgugga

SEQ ID NO: 183431 - RNA, 22 nt, Human
uguucccgaugacaggaccagg

SEQ ID NO: 183432 - RNA, 22 nt, Human
uugggaacaggcuucccacugg

SEQ ID NO: 183433 - RNA, 22 nt, Human
uuggccauuacugagccuggag

SEQ ID NO: 183434 - RNA, 22 nt, Human
uguguguauauauauguaucau

SEQ ID NO: 183435 - RNA, 22 nt, Human
ugugugggcgaagacagccuuu

SEQ ID NO: 183436 - RNA, 22 nt, Human
uugggcuagaaacaacgugggu

SEQ ID NO: 183437 - RNA, 22 nt, Human
uugggcauuucuuauguauuuu

SEQ ID NO: 183438 - RNA, 22 nt, Human
uugggaguaauacugaagagag

SEQ ID NO: 183439 - RNA, 22 nt, Human
uguucuucaaacucaguuccac

SEQ ID NO: 183440 - RNA, 22 nt, Human
uguugaaacagcuauugacuuu

SEQ ID NO: 183441 - RNA, 22 nt, Human
uguugauuaauuuucccaaaca

SEQ ID NO: 183442 - RNA, 22 nt, Human
uguugguuucaagcaggagccu

SEQ ID NO: 183443 - RNA, 21 nt, Human
uguugguugugggaaggagga

SEQ ID NO: 183444 - RNA, 22 nt, Human
uugguguuucacuuccuugucg

SEQ ID NO: 183445 - RNA, 22 nt, Human
uugguugaaauguguucaugcu

SEQ ID NO: 183446 - RNA, 22 nt, Human
uuguacuuguucuguuuccuug

SEQ ID NO: 183447 - RNA, 22 nt, Human
uguuucaugcagcccccuguca

SEQ ID NO: 183448 - RNA, 22 nt, Human
uguugcauguggcuguuugcca

SEQ ID NO: 183449 - RNA, 22 nt, Human
uguugccaucuaaaauguuacu

SEQ ID NO: 183450 - RNA, 22 nt, Human
uuggugaugcccaccuuuucau

SEQ ID NO: 183451 - RNA, 22 nt, Human
uuggugaugcuaggaauguagu

SEQ ID NO: 183452 - RNA, 22 nt, Human
uguuggcagugcuacagucagu

SEQ ID NO: 183453 - RNA, 22 nt, Human
uuggugauugggaauggauggg

SEQ ID NO: 183454 - RNA, 22 nt, Human
uuggugauguagcagcaauugu

SEQ ID NO: 183455 - RNA, 23 nt, Human
ugucacugcggaguggccugcag

SEQ ID NO: 183456 - RNA, 22 nt, Human
ugucacggccggguggcaccga

SEQ ID NO: 183457 - RNA, 21 nt, Human
ugucagaaagccugugacuuu

SEQ ID NO: 183458 - RNA, 22 nt, Human
ugucacuuaagguuggugucuc

SEQ ID NO: 183459 - RNA, 22 nt, Human
uugauggaggaaaaguuggaau

SEQ ID NO: 183460 - RNA, 22 nt, Human
uugauuugcagaagguguagag

SEQ ID NO: 183461 - RNA, 22 nt, Human
ugucaucuuucuaaagcugguc

SEQ ID NO: 183462 - RNA, 22 nt, Human
uguauggguaggaaacagcugg

SEQ ID NO: 183463 - RNA, 22 nt, Human
uguaucucugacacagucucac

SEQ ID NO: 183464 - RNA, 22 nt, Human
uugaguuuacauuguauuagcc

SEQ ID NO: 183465 - RNA, 22 nt, Human
ugucaccucauacaguaccuca

SEQ ID NO: 183466 - RNA, 22 nt, Human
ugucacaccucguuuagcauuc

SEQ ID NO: 183467 - RNA, 22 nt, Human
uguauuuuuucccugaaauaaa

SEQ ID NO: 183468 - RNA, 22 nt, Human
uugcagagaacuaaagggagua

SEQ ID NO: 183469 - RNA, 22 nt, Human
ugucguaaaagggccgcagugg

SEQ ID NO: 183470 - RNA, 22 nt, Human
uguccuuucagagcuccuuuug

SEQ ID NO: 183471 - RNA, 19 nt, Human
ugugaagaccucagugcgg

SEQ ID NO: 183472 - RNA, 22 nt, Human
ugucuuuuaaaaauguguaaaa

SEQ ID NO: 183473 - RNA, 22 nt, Human
ugugauaaaggcccgcagaucc

SEQ ID NO: 183474 - RNA, 22 nt, Human
ugugcagaaggagguucuccgg

SEQ ID NO: 183475 - RNA, 22 nt, Human
ugugaaugacuguguucuuugc

SEQ ID NO: 183476 - RNA, 22 nt, Human
ugucuucuuuucccuuagcccu

SEQ ID NO: 183477 - RNA, 22 nt, Human
ugugaagugaugggugaccgag

SEQ ID NO: 183478 - RNA, 22 nt, Human
ugugacugaaaaugauugagug

SEQ ID NO: 183479 - RNA, 22 nt, Human
ugugaaggaaaguaggagggac

SEQ ID NO: 183480 - RNA, 22 nt, Human
ugugacaugauggcgucaugua

SEQ ID NO: 183481 - RNA, 22 nt, Human
uguaauucuaauccagagcugg

SEQ ID NO: 183482 - RNA, 22 nt, Human
uugaacauuagaauaaguaauu

SEQ ID NO: 183483 - RNA, 22 nt, Human
uugaacucagcuacugguuggu

SEQ ID NO: 183484 - RNA, 22 nt, Human
uguagacaugcuuuucugauga

SEQ ID NO: 183485 - RNA, 22 nt, Human
uugaaaacugucaccuuuauuc

SEQ ID NO: 183486 - RNA, 22 nt, Human
uugaaagaacaauucugugaug

SEQ ID NO: 183487 - RNA, 22 nt, Human
uguaauuugguuagauuucuuu

SEQ ID NO: 183488 - RNA, 22 nt, Human
ugguuuacucuguaaaccagga

SEQ ID NO: 183489 - RNA, 22 nt, Human
uucuuucgaacaagagaaguuc

SEQ ID NO: 183490 - RNA, 21 nt, Human
uucuuugaagacccauuugag

SEQ ID NO: 183491 - RNA, 18 nt, Human
ugguuggugggggugaag

SEQ ID NO: 183492 - RNA, 22 nt, Human
uucuuugcccauguuuccuaag

SEQ ID NO: 183493 - RNA, 22 nt, Human
ugguuuguauauguuugugaga

SEQ ID NO: 183494 - RNA, 21 nt, Human
ugguuuuaucuugguggcugc

SEQ ID NO: 183495 - RNA, 22 nt, Human
uucuuuuuagcugguuguaaga

SEQ ID NO: 183496 - RNA, 23 nt, Human
uguaaaacaccguuauugcaccu

SEQ ID NO: 183497 - RNA, 22 nt, Human
uguaaagguuuuagagcagaga

SEQ ID NO: 183498 - RNA, 22 nt, Human
uucuucauucccuuacuuccga

SEQ ID NO: 183499 - RNA, 22 nt, Human
ugguggaggugggggguauuuu

SEQ ID NO: 183500 - RNA, 22 nt, Human
ugguggcaauuuuuggggucaa

SEQ ID NO: 183501 - RNA, 19 nt, Human
ugguggaggugcaccugac

SEQ ID NO: 183502 - RNA, 22 nt, Human
uucuuccagugaaacgugcauc

SEQ ID NO: 183503 - RNA, 22 nt, Human
uucuuguccacagaagagcuca

SEQ ID NO: 183504 - RNA, 22 nt, Human
uucuugugugaauauaauuaca

SEQ ID NO: 183505 - RNA, 22 nt, Human
uucuugucuuuguuauguagga

SEQ ID NO: 183506 - RNA, 22 nt, Human
ugguggcuuuucguagguucac

SEQ ID NO: 183507 - RNA, 22 nt, Human
uucugaguguugucaccaugug

SEQ ID NO: 183508 - RNA, 20 nt, Human
uucugcagcagguguugaag

SEQ ID NO: 183509 - RNA, 22 nt, Human
uucugaugccuggguugcuucu

SEQ ID NO: 183510 - RNA, 22 nt, Human
uucugaaggcaggggcuaucuu

SEQ ID NO: 183511 - RNA, 22 nt, Human
uucugaaacauugcuauuuucc

SEQ ID NO: 183512 - RNA, 22 nt, Human
uggugcagacaggagccccgcu

SEQ ID NO: 183513 - RNA, 22 nt, Human
uucuguuuauaauuugcaguug

SEQ ID NO: 183514 - RNA, 22 nt, Human
uucuguucugcuuucuccaucc

SEQ ID NO: 183515 - RNA, 22 nt, Human
uucuguguauggaagaaugucc

SEQ ID NO: 183516 - RNA, 22 nt, Human
uucuguuuaaccuggaaagugu

SEQ ID NO: 183517 - RNA, 22 nt, Human
uucugcccuugccagacaagua

SEQ ID NO: 183518 - RNA, 22 nt, Human
uucuguucuuuguccccuuggu

SEQ ID NO: 183519 - RNA, 20 nt, Human
ugcuccaggaacacuggccg

SEQ ID NO: 183520 - RNA, 22 nt, Human
ugcuauucuuggagcugaugga

SEQ ID NO: 183521 - RNA, 22 nt, Human
uuauuccauagaagucaaggaa

SEQ ID NO: 183522 - RNA, 22 nt, Human
uuauuggcagcuccugcacaug

SEQ ID NO: 183523 - RNA, 22 nt, Human
uuauucuuagccucgguauuuc

SEQ ID NO: 183524 - RNA, 22 nt, Human
uggaggagaacugauuuggcuu

SEQ ID NO: 183525 - RNA, 22 nt, Human
uuauuuaaaauguagguuggga

SEQ ID NO: 183526 - RNA, 22 nt, Human
uuauuugguuuuggcuuuagcu

SEQ ID NO: 183527 - RNA, 22 nt, Human
uuauuuuauaaagagaagacuu

SEQ ID NO: 183528 - RNA, 22 nt, Human
uggaggauggaaggaaagcugg

SEQ ID NO: 183529 - RNA, 22 nt, Human
uggaggaggagaacuuggcacu

SEQ ID NO: 183530 - RNA, 22 nt, Human
uggaggcccagcugggggccgg

SEQ ID NO: 183531 - RNA, 22 nt, Human
uuauuuaaguauuuauugaagu

SEQ ID NO: 183532 - RNA, 22 nt, Human
uuauuuuuguaacacuguauag

SEQ ID NO: 183533 - RNA, 21 nt, Human
uggaggcguaaucacuguuga

SEQ ID NO: 183534 - RNA, 22 nt, Human
uuauuuuuguuuguuaagccua

SEQ ID NO: 183535 - RNA, 22 nt, Human
uggagucuugcuuugggagugc

SEQ ID NO: 183536 - RNA, 22 nt, Human
uggaguguuggucccacugagg

SEQ ID NO: 183537 - RNA, 22 nt, Human
uggagucagaaugcgacaggcc

SEQ ID NO: 183538 - RNA, 22 nt, Human
uggagucucacuuccuggaauu

SEQ ID NO: 183539 - RNA, 22 nt, Human
uggagggaagcaaacacuagau

SEQ ID NO: 183540 - RNA, 19 nt, Human
uggaggcggguggcccaga

SEQ ID NO: 183541 - RNA, 22 nt, Human
uggaguagaagggcuccuggaa

SEQ ID NO: 183542 - RNA, 22 nt, Human
uucaaacaguguagaauauaug

SEQ ID NO: 183543 - RNA, 22 nt, Human
uucaaaaugcagaauaguuugg

SEQ ID NO: 183544 - RNA, 22 nt, Human
uggaugagugaauggauaaauc

SEQ ID NO: 183545 - RNA, 20 nt, Human
uucacagaucucuaacugag

SEQ ID NO: 183546 - RNA, 22 nt, Human
uucaauuacaucagaaucuaaa

SEQ ID NO: 183547 - RNA, 21 nt, Human
uggauauugaguaguuucuga

SEQ ID NO: 183548 - RNA, 20 nt, Human
uggaucgaccucacuuccau

SEQ ID NO: 183549 - RNA, 20 nt, Human
uggaucaccauccuguugcu

SEQ ID NO: 183550 - RNA, 22 nt, Human
uggaugacaaccauuggaagag

SEQ ID NO: 183551 - RNA, 22 nt, Human
uggauucucuguagccugguuc

SEQ ID NO: 183552 - RNA, 22 nt, Human
uggauuuuggaauguuucagua

SEQ ID NO: 183553 - RNA, 22 nt, Human
uggaugccauuugauuaaggcu

SEQ ID NO: 183554 - RNA, 22 nt, Human
uggaugccuugggggaggagga

SEQ ID NO: 183555 - RNA, 22 nt, Human
uggcacagcuugucauaaacuc

SEQ ID NO: 183556 - RNA, 22 nt, Human
uggcaaaaccugcaauuacuuu

SEQ ID NO: 183557 - RNA, 15 nt, Human
uggauuugccacaua

SEQ ID NO: 183558 - RNA, 22 nt, Human
uggcagccugcgugaaggagcu

SEQ ID NO: 183559 - RNA, 22 nt, Human
uggcagcauuuuuuccagaaca

SEQ ID NO: 183560 - RNA, 22 nt, Human
uucacuguucuuagagaagacc

SEQ ID NO: 183561 - RNA, 22 nt, Human
uggcacaggcagaaggugccgc

SEQ ID NO: 183562 - RNA, 22 nt, Human
uucacuuuuucucugcuugaga

SEQ ID NO: 183563 - RNA, 22 nt, Human
uucacugugauguuuaagagaa

SEQ ID NO: 183564 - RNA, 22 nt, Human
uucacguuguugaagaaaauac

SEQ ID NO: 183565 - RNA, 22 nt, Human
uucacucagagcaggacagccc

SEQ ID NO: 183566 - RNA, 22 nt, Human
uucaggaaacaaauuugcaguu

SEQ ID NO: 183567 - RNA, 22 nt, Human
uucaggacacauuauuuaugaa

SEQ ID NO: 183568 - RNA, 22 nt, Human
uucagcauggcuguuuucccuu

SEQ ID NO: 183569 - RNA, 20 nt, Human
uucaggaccuuccaguccau

SEQ ID NO: 183570 - RNA, 22 nt, Human
uucaggaucuaggaguauuuuu

SEQ ID NO: 183571 - RNA, 19 nt, Human
uucaggcuuuucauuuuuc

SEQ ID NO: 183572 - RNA, 22 nt, Human
uucagcauaggcugcucuucaa

SEQ ID NO: 183573 - RNA, 21 nt, Human
uggcauacugcuaaaaagugu

SEQ ID NO: 183574 - RNA, 20 nt, Human
uggcaugaaauuuuccaagc

SEQ ID NO: 183575 - RNA, 22 nt, Human
uucagaagguaggaaugucccu

SEQ ID NO: 183576 - RNA, 22 nt, Human
uucagaauuaucauaauuuuga

SEQ ID NO: 183577 - RNA, 22 nt, Human
uucagaacugucuguccuuuuc

SEQ ID NO: 183578 - RNA, 22 nt, Human
uggcagcucauuuggaaaugga

SEQ ID NO: 183579 - RNA, 21 nt, Human
uggcaggcagcuggaagcuug

SEQ ID NO: 183580 - RNA, 22 nt, Human
uucagacugcccauguuugcca

SEQ ID NO: 183581 - RNA, 22 nt, Human
uucagauuuguuuuuguuucug

SEQ ID NO: 183582 - RNA, 22 nt, Human
uggcaguugcaguaacuuguau

SEQ ID NO: 183583 - RNA, 22 nt, Human
uucagcaagugucucuacuguc

SEQ ID NO: 183584 - RNA, 22 nt, Human
uggcagugggaagcuggaaguc

SEQ ID NO: 183585 - RNA, 22 nt, Human
uggccuucagcucuggggugca

SEQ ID NO: 183586 - RNA, 22 nt, Human
uggcgacuggaauuaaucuuuu

SEQ ID NO: 183587 - RNA, 22 nt, Human
uggcgugaagcuggaaggcgga

SEQ ID NO: 183588 - RNA, 22 nt, Human
uggcggagacauggacuucaga

SEQ ID NO: 183589 - RNA, 22 nt, Human
uucauuauuaauaauagcagcu

SEQ ID NO: 183590 - RNA, 23 nt, Human
uggcucugagcuuccugguggcc

SEQ ID NO: 183591 - RNA, 22 nt, Human
uucauauuuaauuggucaucaa

SEQ ID NO: 183592 - RNA, 22 nt, Human
uuccacuguucaguucugguca

SEQ ID NO: 183593 - RNA, 22 nt, Human
uggcucagcgcggccuggucuu

SEQ ID NO: 183594 - RNA, 22 nt, Human
uggcuacguacaauggaacuuu

SEQ ID NO: 183595 - RNA, 22 nt, Human
uggcuacauuuauacucucauu

SEQ ID NO: 183596 - RNA, 22 nt, Human
uuccagguggcuuuccuggggg

SEQ ID NO: 183597 - RNA, 22 nt, Human
uggcuucugguuuauccuuaua

SEQ ID NO: 183598 - RNA, 22 nt, Human
uuccaggacuggguguuugaag

SEQ ID NO: 183599 - RNA, 22 nt, Human
uuccagucugggcucuucacug

SEQ ID NO: 183600 - RNA, 22 nt, Human
uggcuucagacuucugcuacgu

SEQ ID NO: 183601 - RNA, 22 nt, Human
uucaucauuuuccauuccucuu

SEQ ID NO: 183602 - RNA, 22 nt, Human
uucauccucuaguacugaagug

SEQ ID NO: 183603 - RNA, 22 nt, Human
uggccucauggccuuaucuggg

SEQ ID NO: 183604 - RNA, 22 nt, Human
uggccugauuuugcuaagagaa

SEQ ID NO: 183605 - RNA, 22 nt, Human
uucaugcgcuuuucaggagugu

SEQ ID NO: 183606 - RNA, 22 nt, Human
uucaugcaagagugugaggucc

SEQ ID NO: 183607 - RNA, 23 nt, Human
uggccguccccugacucucuggc

SEQ ID NO: 183608 - RNA, 22 nt, Human
uggcccugaaucaaggccagca

SEQ ID NO: 183609 - RNA, 22 nt, Human
uucauaugaauuggguuuuuuu

SEQ ID NO: 183610 - RNA, 22 nt, Human
uucauacucuucccugggcaaa

SEQ ID NO: 183611 - RNA, 22 nt, Human
uucauagaagggaguuuuuccu

SEQ ID NO: 183612 - RNA, 22 nt, Human
uggccaaucagcugugaccugc

SEQ ID NO: 183613 - RNA, 22 nt, Human
uggcccagaucucugaccuuga

SEQ ID NO: 183614 - RNA, 20 nt, Human
uggcccagcacgacgaggac

SEQ ID NO: 183615 - RNA, 22 nt, Human
uucagguuuuaugguaaugcuu

SEQ ID NO: 183616 - RNA, 22 nt, Human
uucaguaugcugaaugauuuuu

SEQ ID NO: 183617 - RNA, 22 nt, Human
uggccaaauuggccugauguau

SEQ ID NO: 183618 - RNA, 22 nt, Human
ugggggagggagaguugauggg

SEQ ID NO: 183619 - RNA, 22 nt, Human
ugggggauauggcuccauacuu

SEQ ID NO: 183620 - RNA, 22 nt, Human
ugggggcacccagccgaugagg

SEQ ID NO: 183621 - RNA, 22 nt, Human
ugggggguuuagaaucugcccu

SEQ ID NO: 183622 - RNA, 22 nt, Human
uggggggacagauggagaggac

SEQ ID NO: 183623 - RNA, 22 nt, Human
uggggaguaggaggggaacaga

SEQ ID NO: 183624 - RNA, 22 nt, Human
uggggcuuucgcggagcgucgg

SEQ ID NO: 183625 - RNA, 18 nt, Human
ugggggacgcuuuuuuuc

SEQ ID NO: 183626 - RNA, 20 nt, Human
uucguuucaguguuggauca

SEQ ID NO: 183627 - RNA, 21 nt, Human
uggguccuuggucuaguuuuc

SEQ ID NO: 183628 - RNA, 20 nt, Human
uucucugcagcaggcggccc

SEQ ID NO: 183629 - RNA, 22 nt, Human
uucucuugccuucucuuuuauc

SEQ ID NO: 183630 - RNA, 20 nt, Human
ugggguucccuuuagggcuu

SEQ ID NO: 183631 - RNA, 22 nt, Human
ugggucagauugagccccuggu

SEQ ID NO: 183632 - RNA, 22 nt, Human
ugggucaguagccuugcagaac

SEQ ID NO: 183633 - RNA, 22 nt, Human
uuccccgagccuggggaagcug

SEQ ID NO: 183634 - RNA, 22 nt, Human
uuccccuucuaauacucaauuu

SEQ ID NO: 183635 - RNA, 22 nt, Human
uuccccuuaagagacaguugga

SEQ ID NO: 183636 - RNA, 22 nt, Human
uucccaggugugagugagguga

SEQ ID NO: 183637 - RNA, 18 nt, Human
uuccauuuuucagucuuc

SEQ ID NO: 183638 - RNA, 22 nt, Human
uuccauuccauaucagguacag

SEQ ID NO: 183639 - RNA, 22 nt, Human
uucccagggaucucuaguauuu

SEQ ID NO: 183640 - RNA, 22 nt, Human
uucccauuccagcucgaucaau

SEQ ID NO: 183641 - RNA, 22 nt, Human
ugggaugagcuauauagaaagu

SEQ ID NO: 183642 - RNA, 20 nt, Human
ugggauggaaucaccugcac

SEQ ID NO: 183643 - RNA, 22 nt, Human
ugggaggcugugggaauggguc

SEQ ID NO: 183644 - RNA, 22 nt, Human
uggcuugacaucaauacuuauu

SEQ ID NO: 183645 - RNA, 22 nt, Human
uggcuuuugaaaaggugaugua

SEQ ID NO: 183646 - RNA, 22 nt, Human
ugggagagauaggcuucuggac

SEQ ID NO: 183647 - RNA, 22 nt, Human
uggggagucccaacgguggaag

SEQ ID NO: 183648 - RNA, 22 nt, Human
uggggagcucagcaccaucagu

SEQ ID NO: 183649 - RNA, 22 nt, Human
uggggcugguaccguaauauau

SEQ ID NO: 183650 - RNA, 22 nt, Human
ugggccgugagacgucucuggg

SEQ ID NO: 183651 - RNA, 22 nt, Human
uggggaagaacuugccauuuca

SEQ ID NO: 183652 - RNA, 22 nt, Human
ugggcuguuucuuaaggauaug

SEQ ID NO: 183653 - RNA, 22 nt, Human
ugggccacguggagucuguagg

SEQ ID NO: 183654 - RNA, 22 nt, Human
ugggccaaaugucugcauaagu

SEQ ID NO: 183655 - RNA, 22 nt, Human
ugggcaguccagcuggaaacgg

SEQ ID NO: 183656 - RNA, 22 nt, Human
ugggcagggauuuggggaaacu

SEQ ID NO: 183657 - RNA, 22 nt, Human
ugggcagagggugaggaaggcg

SEQ ID NO: 183658 - RNA, 22 nt, Human
ugggcaaaugcuuuuuagucaa

SEQ ID NO: 183659 - RNA, 22 nt, Human
uuuauuuuccaugucucuaggu

SEQ ID NO: 183660 - RNA, 22 nt, Human
uuauaaaccgcuaacagcacuu

SEQ ID NO: 183661 - RNA, 19 nt, Human
uuucacaaagagagcguga

SEQ ID NO: 183662 - RNA, 22 nt, Human
uuucacauacaguguauaguag

SEQ ID NO: 183663 - RNA, 22 nt, Human
uuuauugaccugaguaucagca

SEQ ID NO: 183664 - RNA, 22 nt, Human
uuuauugcuaugucuugauugu

SEQ ID NO: 183665 - RNA, 22 nt, Human
uuuauuuacuuucgguucugcu

SEQ ID NO: 183666 - RNA, 19 nt, Human
uuuauuugagacaugccuu

SEQ ID NO: 183667 - RNA, 22 nt, Human
uuaguuauaggugaaucagaga

SEQ ID NO: 183668 - RNA, 22 nt, Human
uuuauuuagguaaacaugaguu

SEQ ID NO: 183669 - RNA, 22 nt, Human
uuuaggucacuccaccgaagag

SEQ ID NO: 183670 - RNA, 22 nt, Human
uuagcacugucugguuaucuug

SEQ ID NO: 183671 - RNA, 21 nt, Human
uuagcaguuguugauuuccag

SEQ ID NO: 183672 - RNA, 22 nt, Human
uuagcagacagauggagagaga

SEQ ID NO: 183673 - RNA, 22 nt, Human
uuagcgcucucuccauucuuaa

SEQ ID NO: 183674 - RNA, 22 nt, Human
uuuauaauuguuauguuaccca

SEQ ID NO: 183675 - RNA, 22 nt, Human
uuuauaauuacguaaaauauuu

SEQ ID NO: 183676 - RNA, 22 nt, Human
uuuaucaggccaucuuaugucu

SEQ ID NO: 183677 - RNA, 22 nt, Human
uuuaucucugcauagaagugau

SEQ ID NO: 183678 - RNA, 22 nt, Human
uguuugaugugcacgugugugu

SEQ ID NO: 183679 - RNA, 21 nt, Human
uguuugcuuuuggagcaacug

SEQ ID NO: 183680 - RNA, 22 nt, Human
uguuugaggugacucuggaaug

SEQ ID NO: 183681 - RNA, 22 nt, Human
uuaccugagcggauuuguugca

SEQ ID NO: 183682 - RNA, 22 nt, Human
uuuacuguuuacagcuaaugca

SEQ ID NO: 183683 - RNA, 22 nt, Human
uuuacucagucugagcaggugu

SEQ ID NO: 183684 - RNA, 22 nt, Human
uuaccgagaacaugacuggaau

SEQ ID NO: 183685 - RNA, 22 nt, Human
uuacccuugaauuugugacaaa

SEQ ID NO: 183686 - RNA, 23 nt, Human
uuacuaugaaaauuccagucacu

SEQ ID NO: 183687 - RNA, 20 nt, Human
uuacugagguauuuuuauca

SEQ ID NO: 183688 - RNA, 22 nt, Human
uuacuggaauauaaagauaaga

SEQ ID NO: 183689 - RNA, 22 nt, Human
uuacuguaggugggugaauuug

SEQ ID NO: 183690 - RNA, 21 nt, Human
uuacuggcagcagaaaccuga

SEQ ID NO: 183691 - RNA, 22 nt, Human
uuagaauggaaucauuugcauu

SEQ ID NO: 183692 - RNA, 22 nt, Human
uuagagaagcacuguaggugaa

SEQ ID NO: 183693 - RNA, 22 nt, Human
uuuagguccguguugcaguugg

SEQ ID NO: 183694 - RNA, 22 nt, Human
uuuagcugugugugucgcucca

SEQ ID NO: 183695 - RNA, 22 nt, Human
uuaugugcuuuuugagcucuaa

SEQ ID NO: 183696 - RNA, 22 nt, Human
uuauuaauacaugcaccugcau

SEQ ID NO: 183697 - RNA, 22 nt, Human
uuauguugauaggaaucugauu

SEQ ID NO: 183698 - RNA, 22 nt, Human
uuuccaguaaguggcaaggagc

SEQ ID NO: 183699 - RNA, 22 nt, Human
uuaugguuuaauauccagcaca

SEQ ID NO: 183700 - RNA, 22 nt, Human
uuuccccugggaacauugauuc

SEQ ID NO: 183701 - RNA, 22 nt, Human
uuauuguagcacuuuggcagug

SEQ ID NO: 183702 - RNA, 22 nt, Human
uuucgggauuucaaagagcaaa

SEQ ID NO: 183703 - RNA, 22 nt, Human
uuucuaaaauuacugcagucgg

SEQ ID NO: 183704 - RNA, 19 nt, Human
uuucucacugagucguuug

SEQ ID NO: 183705 - RNA, 22 nt, Human
uuucucagcauauugccuuuga

SEQ ID NO: 183706 - RNA, 22 nt, Human
uuucucagccuccuugcuggag

SEQ ID NO: 183707 - RNA, 22 nt, Human
uuucuccauuuuguguguucug

SEQ ID NO: 183708 - RNA, 22 nt, Human
uuucuaaguuugaggcgaagca

SEQ ID NO: 183709 - RNA, 22 nt, Human
uuucuauauucaguuucauaaa

SEQ ID NO: 183710 - RNA, 22 nt, Human
uuucagacugcccauguuugcc

SEQ ID NO: 183711 - RNA, 22 nt, Human
uuucagaaauggcacugaaauc

SEQ ID NO: 183712 - RNA, 22 nt, Human
uuucaugauuaacuuagugaau

SEQ ID NO: 183713 - RNA, 22 nt, Human
uuucauagaggcagcggcggau

SEQ ID NO: 183714 - RNA, 22 nt, Human
uuauaagugccucuuuauuuuc

SEQ ID NO: 183715 - RNA, 18 nt, Human
uuauacaauuuuuuuuca

SEQ ID NO: 183716 - RNA, 22 nt, Human
uuauaucagaaggugagauuga

SEQ ID NO: 183717 - RNA, 22 nt, Human
uuucacuucgaucagaguuuuu

SEQ ID NO: 183718 - RNA, 22 nt, Human
uuucacugaguaggagagcacu

SEQ ID NO: 183719 - RNA, 22 nt, Human
uuauggauuagaguuugauucu

SEQ ID NO: 183720 - RNA, 22 nt, Human
uuaugggcgaugcaaaccugau

SEQ ID NO: 183721 - RNA, 20 nt, Human
uuauccccauucuuguucuc

SEQ ID NO: 183722 - RNA, 19 nt, Human
uuauccggacuuaauuuau

SEQ ID NO: 183723 - RNA, 22 nt, Human
uuaucugcccauuguagaauug

SEQ ID NO: 183724 - RNA, 21 nt, Human
uuuccagaggcagccggacuc

SEQ ID NO: 183725 - RNA, 22 nt, Human
uuuccacacucacugcacucau

SEQ ID NO: 183726 - RNA, 22 nt, Human
uuaucaaaaaauaguacuuuga

SEQ ID NO: 183727 - RNA, 22 nt, Human
uucauugcagaauuuggccuca

SEQ ID NO: 183728 - RNA, 22 nt, Human
uucauugauuuccuuggaauaa

SEQ ID NO: 183729 - RNA, 22 nt, Human
uucauugcuacuuaaaauacca

SEQ ID NO: 183730 - RNA, 22 nt, Human
uuugucauuuagcccauggugg

SEQ ID NO: 183731 - RNA, 23 nt, Human
uuugucaucccucucacuuucug

SEQ ID NO: 183732 - RNA, 22 nt, Human
uuccaaaugacaaugggcugua

SEQ ID NO: 183733 - RNA, 22 nt, Human
uuuguauuguuuauuucauuuu

SEQ ID NO: 183734 - RNA, 22 nt, Human
uuuguggugagcagggaacguc

SEQ ID NO: 183735 - RNA, 22 nt, Human
uuugugauaaguggauucaagg

SEQ ID NO: 183736 - RNA, 22 nt, Human
uuuguuaugguuggaagcagga

SEQ ID NO: 183737 - RNA, 22 nt, Human
uuccccaccagagacagagcug

SEQ ID NO: 183738 - RNA, 22 nt, Human
uuccccaugugaugcuauugcu

SEQ ID NO: 183739 - RNA, 22 nt, Human
uuuguguuuugaggucuugcaa

SEQ ID NO: 183740 - RNA, 22 nt, Human
uucaggggcaaauacauuuuga

SEQ ID NO: 183741 - RNA, 22 nt, Human
uucagguacuaagugcugauuc

SEQ ID NO: 183742 - RNA, 22 nt, Human
uucagguuuuuaaguucugccu

SEQ ID NO: 183743 - RNA, 22 nt, Human
uuuggccauuuguaugcaugau

SEQ ID NO: 183744 - RNA, 22 nt, Human
uuuggaugcugucauaugcugc

SEQ ID NO: 183745 - RNA, 22 nt, Human
uuugauuuuguuuauagugccg

SEQ ID NO: 183746 - RNA, 23 nt, Human
uuugcaaauuggacacaaccaca

SEQ ID NO: 183747 - RNA, 22 nt, Human
uucauccucuuuaucuaccugu

SEQ ID NO: 183748 - RNA, 22 nt, Human
uuugggcauuuuuaaggaucuu

SEQ ID NO: 183749 - RNA, 22 nt, Human
uuugggcuuuguuuuaagguau

SEQ ID NO: 183750 - RNA, 22 nt, Human
uucaguguuagaauuccaagaa

SEQ ID NO: 183751 - RNA, 22 nt, Human
uucauacuguuuaaguucuguu

SEQ ID NO: 183752 - RNA, 22 nt, Human
uuauuuuuaggaauguagaggu

SEQ ID NO: 183753 - RNA, 22 nt, Human
uuauuuuguagcucugaucuuu

SEQ ID NO: 183754 - RNA, 22 nt, Human
uuauuuucgugugugugugugu

SEQ ID NO: 183755 - RNA, 22 nt, Human
uuucuuuuucuacaccuuagcu

SEQ ID NO: 183756 - RNA, 18 nt, Human
uuucuuuuauuccagguc

SEQ ID NO: 183757 - RNA, 22 nt, Human
uuugaagaaacagucuuaagag

SEQ ID NO: 183758 - RNA, 22 nt, Human
uuugaaaggagcuuuauccaga

SEQ ID NO: 183759 - RNA, 22 nt, Human
uuugaagaccuuaucucuaaau

SEQ ID NO: 183760 - RNA, 22 nt, Human
uucaaacacugugcaauugggu

SEQ ID NO: 183761 - RNA, 22 nt, Human
uucaaaccuaucuaagaaauag

SEQ ID NO: 183762 - RNA, 22 nt, Human
uucaacaacuugguucaaaugg

SEQ ID NO: 183763 - RNA, 22 nt, Human
uuugacaccaggagagaaaaca

SEQ ID NO: 183764 - RNA, 22 nt, Human
uuugaauauuaugucccacuuu

SEQ ID NO: 183765 - RNA, 21 nt, Human
uuugacagaccagguauaguu

SEQ ID NO: 183766 - RNA, 22 nt, Human
uuugagguuuagcucacuauuu

SEQ ID NO: 183767 - RNA, 20 nt, Human
uuugauugccccucugacuu

SEQ ID NO: 183768 - RNA, 22 nt, Human
uuauuugcccauguuuagcaga

SEQ ID NO: 183769 - RNA, 22 nt, Human
uuucuuugcugguuggcucucc

SEQ ID NO: 183770 - RNA, 22 nt, Human
uuucuugugauuuugaugaacu

SEQ ID NO: 183771 - RNA, 22 nt, Human
uuucuugggaaaugucagaagu

SEQ ID NO: 183772 - RNA, 19 nt, Human
uuucuggguucaccucuug

SEQ ID NO: 183773 - RNA, 22 nt, Human
uuucuggauaagcagggucucu

SEQ ID NO: 183774 - RNA, 22 nt, Human
uuucuguugugaccugacucuu

SEQ ID NO: 183775 - RNA, 22 nt, Human
uuucuguucuguuggauucuuu

SEQ ID NO: 183776 - RNA, 22 nt, Human
uuucucuuguauuugaaucacu

SEQ ID NO: 183777 - RNA, 22 nt, Human
uuucugagccacauauaauuug

SEQ ID NO: 183778 - RNA, 22 nt, Human
uuucugaugaaguagaaagacc

SEQ ID NO: 183779 - RNA, 17 nt, Human
uuucugcaugauuggac

SEQ ID NO: 183780 - RNA, 22 nt, Human
uuucugcauuuguauuggaaaa

SEQ ID NO: 183781 - RNA, 22 nt, Human
uuauuucauguaaaauuuaugu

SEQ ID NO: 183782 - RNA, 22 nt, Human
uuauuucuucucgaagcuuggg

SEQ ID NO: 183783 - RNA, 22 nt, Human
uuauuucaggcauuuguaaaug

SEQ ID NO: 183784 - RNA, 22 nt, Human
uuauuuaagaucuuaauauaua

SEQ ID NO: 183785 - RNA, 22 nt, Human
uuauuguuuggguauaauuuga

SEQ ID NO: 183786 - RNA, 22 nt, Human
uugccuagugguagugacuguu

SEQ ID NO: 183787 - RNA, 22 nt, Human
uugcccuaccccaggccuuuuu

SEQ ID NO: 183788 - RNA, 22 nt, Human
uugccucuaauuagcucuguga

SEQ ID NO: 183789 - RNA, 22 nt, Human
uugccaggggacaucuggagcc

SEQ ID NO: 183790 - RNA, 22 nt, Human
uugccaggagacaucuggagcc

SEQ ID NO: 183791 - RNA, 22 nt, Human
uugcguaucuacauugccugua

SEQ ID NO: 183792 - RNA, 20 nt, Human
uugcggccuaacagccccuu

SEQ ID NO: 183793 - RNA, 22 nt, Human
uugcuaagguuuaacuauugga

SEQ ID NO: 183794 - RNA, 22 nt, Human
uugcguaauuugagauuguaaa

SEQ ID NO: 183795 - RNA, 18 nt, Human
uugcucucucugggggca

SEQ ID NO: 183796 - RNA, 20 nt, Human
uugcucucuuguguugaugu

SEQ ID NO: 183797 - RNA, 22 nt, Human
uugcucaccugagaagaauaga

SEQ ID NO: 183798 - RNA, 20 nt, Human
uugcaugcagccggaugcug

SEQ ID NO: 183799 - RNA, 22 nt, Human
uugcaucagcaggcauaauugg

SEQ ID NO: 183800 - RNA, 22 nt, Human
uugcaagauaguguauuuuuca

SEQ ID NO: 183801 - RNA, 22 nt, Human
uugauuuggaauuuuuagagcu

SEQ ID NO: 183802 - RNA, 22 nt, Human
uugcaagcccugaagggcugga

SEQ ID NO: 183803 - RNA, 22 nt, Human
uugcacagaugcacaugguugc

SEQ ID NO: 183804 - RNA, 22 nt, Human
uugcagaauucuucccacucag

SEQ ID NO: 183805 - RNA, 21 nt, Human
uugcuggagcaauguaaauca

SEQ ID NO: 183806 - RNA, 22 nt, Human
uugcugagcugaaccagccacc

SEQ ID NO: 183807 - RNA, 22 nt, Human
uugcugccagcgcccugcaggg

SEQ ID NO: 183808 - RNA, 22 nt, Human
uugcugaggcuggggagaggug

SEQ ID NO: 183809 - RNA, 22 nt, Human
uugcuugaacccaggaagugga

SEQ ID NO: 183810 - RNA, 22 nt, Human
uugcuuaggccaaauggcgcau

SEQ ID NO: 183811 - RNA, 22 nt, Human
uugcuuucuuuguagguuuucc

SEQ ID NO: 183812 - RNA, 22 nt, Human
uugcugguggcucugauuucau

SEQ ID NO: 183813 - RNA, 22 nt, Human
uuggaagagagauggggagaga

SEQ ID NO: 183814 - RNA, 22 nt, Human
uuggaagugucuaauacaggua

SEQ ID NO: 183815 - RNA, 22 nt, Human
uugcuuuuuuggguuuacuggg

SEQ ID NO: 183816 - RNA, 22 nt, Human
uuggacugggauggccgaggcu

SEQ ID NO: 183817 - RNA, 22 nt, Human
uuggagaaagcugcaggcucug

SEQ ID NO: 183818 - RNA, 22 nt, Human
uuggaagacagccgucuuuauu

SEQ ID NO: 183819 - RNA, 22 nt, Human
uuggaaaugcauuuguuauuau

SEQ ID NO: 183820 - RNA, 23 nt, Human
uugcuugagcccaggaaguggag

SEQ ID NO: 183821 - RNA, 22 nt, Human
uuuaaugaugucuaugccuguu

SEQ ID NO: 183822 - RNA, 22 nt, Human
uuuaaugguuuauggucuaaga

SEQ ID NO: 183823 - RNA, 22 nt, Human
uuuaacccaaauaaccacagga

SEQ ID NO: 183824 - RNA, 22 nt, Human
uuuaaauuucugaaucuugagg

SEQ ID NO: 183825 - RNA, 22 nt, Human
uuuaagguacagcuagcagcau

SEQ ID NO: 183826 - RNA, 22 nt, Human
uuguuuggcaaaugugugugug

SEQ ID NO: 183827 - RNA, 22 nt, Human
uuguuuacuugagcugcacucu

SEQ ID NO: 183828 - RNA, 21 nt, Human
uugugaaaguccaggaacaac

SEQ ID NO: 183829 - RNA, 22 nt, Human
uuguuuuucucuagggaaggcu

SEQ ID NO: 183830 - RNA, 22 nt, Human
uuguuuucuaguguuuugaaua

SEQ ID NO: 183831 - RNA, 22 nt, Human
uuuaaaacagcauuuaaaaggu

SEQ ID NO: 183832 - RNA, 22 nt, Human
uuguaugcugggaagcgggagg

SEQ ID NO: 183833 - RNA, 22 nt, Human
uuguagaucagauggccaguag

SEQ ID NO: 183834 - RNA, 22 nt, Human
uuguauaaagauggcuagaucc

SEQ ID NO: 183835 - RNA, 22 nt, Human
uuggugaugaaagugcugcgcu

SEQ ID NO: 183836 - RNA, 22 nt, Human
uuggucagaugugucuccuccu

SEQ ID NO: 183837 - RNA, 19 nt, Human
uuggugaagguucacugac

SEQ ID NO: 183838 - RNA, 22 nt, Human
uuggcauuccagaugcuuuucu

SEQ ID NO: 183839 - RNA, 22 nt, Human
uuggcagagaacagaaugauuu

SEQ ID NO: 183840 - RNA, 22 nt, Human
uuggcaaagagaugcauaagga

SEQ ID NO: 183841 - RNA, 22 nt, Human
uuggcaaaagauuggguacuua

SEQ ID NO: 183842 - RNA, 22 nt, Human
uuggcaaaaauacuguaggccu

SEQ ID NO: 183843 - RNA, 22 nt, Human
uuggggcugcguguuuccaugu

SEQ ID NO: 183844 - RNA, 22 nt, Human
uuggguaacuucccagaggguc

SEQ ID NO: 183845 - RNA, 22 nt, Human
uucugauacagucccaacacaa

SEQ ID NO: 183846 - RNA, 18 nt, Human
uucugcggugacagauau

SEQ ID NO: 183847 - RNA, 17 nt, Human
uucugcucaggaacaga

SEQ ID NO: 183848 - RNA, 22 nt, Human
uucugaaccauugagcacugcc

SEQ ID NO: 183849 - RNA, 22 nt, Human
uuuuccuguccuugggucugca

SEQ ID NO: 183850 - RNA, 22 nt, Human
uuuucaauuuucauuugcaaga

SEQ ID NO: 183851 - RNA, 22 nt, Human
uuuucaaucaaguuuauuuaua

SEQ ID NO: 183852 - RNA, 22 nt, Human
uucucuggggacugucucuauu

SEQ ID NO: 183853 - RNA, 22 nt, Human
uucucugcgcuccggcccaguu

SEQ ID NO: 183854 - RNA, 22 nt, Human
uuuuggauugcuaacucagggu

SEQ ID NO: 183855 - RNA, 19 nt, Human
uucugguacauacugccug

SEQ ID NO: 183856 - RNA, 22 nt, Human
uucuggacuuccaaauggcuuc

SEQ ID NO: 183857 - RNA, 22 nt, Human
uuuugaugaccauucuucuuuu

SEQ ID NO: 183858 - RNA, 22 nt, Human
uucuggggccgugacgaggggc

SEQ ID NO: 183859 - RNA, 22 nt, Human
uucuggagacccagcaacaggg

SEQ ID NO: 183860 - RNA, 22 nt, Human
uuuugauacaaguuguaaaaaa

SEQ ID NO: 183861 - RNA, 22 nt, Human
uuuuauuuguauguugaaugua

SEQ ID NO: 183862 - RNA, 19 nt, Human
uuuucaacguccgguucau

SEQ ID NO: 183863 - RNA, 22 nt, Human
uuuucaacuuuauuuuccccca

SEQ ID NO: 183864 - RNA, 22 nt, Human
uucuaggagucugguuccugcc

SEQ ID NO: 183865 - RNA, 22 nt, Human
uucuagccauagaaauuagauu

SEQ ID NO: 183866 - RNA, 22 nt, Human
uucucaagccuuccuuucccaa

SEQ ID NO: 183867 - RNA, 20 nt, Human
uucuccacaggguggaggag

SEQ ID NO: 183868 - RNA, 22 nt, Human
uucuccccacuccucccucuga

SEQ ID NO: 183869 - RNA, 22 nt, Human
uucuccugacuggccauucagu

SEQ ID NO: 183870 - RNA, 22 nt, Human
uucguucagcgcuugcgcaugc

SEQ ID NO: 183871 - RNA, 22 nt, Human
uucuaauauuaugauuucuaag

SEQ ID NO: 183872 - RNA, 22 nt, Human
uucuacauugugaaguucuuua

SEQ ID NO: 183873 - RNA, 22 nt, Human
uuuuagccagcaucugggucga

SEQ ID NO: 183874 - RNA, 22 nt, Human
uuuuacgucuuugcugccucgu

SEQ ID NO: 183875 - RNA, 22 nt, Human
uugaaggugggaggauuuauau

SEQ ID NO: 183876 - RNA, 22 nt, Human
uugaaccaggauaaacauagaa

SEQ ID NO: 183877 - RNA, 22 nt, Human
uuuuuguggggggcggugugaa

SEQ ID NO: 183878 - RNA, 22 nt, Human
uuuuuguauaugcuucgaggau

SEQ ID NO: 183879 - RNA, 20 nt, Human
uugaaagucagggcuccagu

SEQ ID NO: 183880 - RNA, 22 nt, Human
uugaaaauuaauagguguacaa

SEQ ID NO: 183881 - RNA, 22 nt, Human
uugaaaaguuuguuacucacau

SEQ ID NO: 183882 - RNA, 22 nt, Human
uuuuuuuguagguguaugaaaa

SEQ ID NO: 183883 - RNA, 22 nt, Human
uugacuauacucuggcggaaaa

SEQ ID NO: 183884 - RNA, 22 nt, Human
uugacucuuucauuuauuauuu

SEQ ID NO: 183885 - RNA, 22 nt, Human
uuuuuuuaaguuuugauuuuag

SEQ ID NO: 183886 - RNA, 22 nt, Human
uuuuuuuagaaagaucauaguu

SEQ ID NO: 183887 - RNA, 19 nt, Human
uugaauguuugauagucuc

SEQ ID NO: 183888 - RNA, 22 nt, Human
uugaaucauauguaauugacuu

SEQ ID NO: 183889 - RNA, 22 nt, Human
uuuuuugguuuggggauuauuu

SEQ ID NO: 183890 - RNA, 22 nt, Human
uugaauggaauuggaaucuuau

SEQ ID NO: 183891 - RNA, 19 nt, Human
uucuguggucccaggccuu

SEQ ID NO: 183892 - RNA, 22 nt, Human
uuuugucagggcaggaggaaga

SEQ ID NO: 183893 - RNA, 22 nt, Human
uuuuguagauuggaaaaucugg

SEQ ID NO: 183894 - RNA, 22 nt, Human
uucuuauuuuucguaaauccug

SEQ ID NO: 183895 - RNA, 22 nt, Human
uuuuguggacugugagggugca

SEQ ID NO: 183896 - RNA, 22 nt, Human
uuuuguuacugauuauuaaaau

SEQ ID NO: 183897 - RNA, 22 nt, Human
uucuugagaacaaauuccugga

SEQ ID NO: 183898 - RNA, 22 nt, Human
uuuuuaagguuuguuuauauau

SEQ ID NO: 183899 - RNA, 22 nt, Human
uuuuuaccugguguccagcuuc

SEQ ID NO: 183900 - RNA, 22 nt, Human
uuuuucuccauuccaggugccu

SEQ ID NO: 183901 - RNA, 22 nt, Human
uuuuucuccucucucuuucauu

SEQ ID NO: 183902 - RNA, 22 nt, Human
uuuuucagacuaauagggcaua

SEQ ID NO: 183903 - RNA, 22 nt, Human
aaaacauuuuacugccaucuca

SEQ ID NO: 183904 - RNA, 22 nt, Human
aaaacauuuaggguuuuuuuua

SEQ ID NO: 183905 - RNA, 22 nt, Human
aaaagacaaggaucuggaguga

SEQ ID NO: 183906 - RNA, 22 nt, Human
aaaaggacaguagccuugaggu

SEQ ID NO: 183907 - RNA, 22 nt, Human
aaaaggauauuuggugcaaagc

SEQ ID NO: 183908 - RNA, 22 nt, Human
aaaagcucucuucuucggcuuu

SEQ ID NO: 183909 - RNA, 22 nt, Human
aaaaguuguaauauuuccuuua

SEQ ID NO: 183910 - RNA, 22 nt, Human
aaaauaaccuucauuugcauug

SEQ ID NO: 183911 - RNA, 22 nt, Human
aaaagggucugacacugcuuga

SEQ ID NO: 183912 - RNA, 22 nt, Human
aaacaccaagagcuagcuauua

SEQ ID NO: 183913 - RNA, 22 nt, Human
aaacagcugcaguacacggccu

SEQ ID NO: 183914 - RNA, 17 nt, Human
aaaaucaaaggaggugc

SEQ ID NO: 183915 - RNA, 22 nt, Human
aaaauauuuaucuagcucuuaa

SEQ ID NO: 183916 - RNA, 22 nt, Human
aaaauuuccuuggaccauuuuu

SEQ ID NO: 183917 - RNA, 22 nt, Human
aaaauauguugagauacugaaa

SEQ ID NO: 183918 - RNA, 22 nt, Human
aaaauauucuauaucaaagaua

SEQ ID NO: 183919 - RNA, 22 nt, Human
aaaagguuauagcuuugccuug

SEQ ID NO: 183920 - RNA, 22 nt, Human
aaaaguauaagugucuccugau

SEQ ID NO: 183921 - RNA, 22 nt, Human
aaaagguauuuagcgauugcau

SEQ ID NO: 183922 - RNA, 22 nt, Human
aaacccaggguuuugucuuccc

SEQ ID NO: 183923 - RNA, 18 nt, Human
aaacccacguauucaggc

SEQ ID NO: 183924 - RNA, 22 nt, Human
aaacaaauccaauaauaaaauu

SEQ ID NO: 183925 - RNA, 22 nt, Human
aaacgcauucuuacaugcuucc

SEQ ID NO: 183926 - RNA, 22 nt, Human
aaaccgguacccuccugccugc

SEQ ID NO: 183927 - RNA, 18 nt, Human
aaacgguuucaugcugua

SEQ ID NO: 183928 - RNA, 22 nt, Human
aaaaugggaaaauuuuagauua

SEQ ID NO: 183929 - RNA, 22 nt, Human
aaacuagaacagagagagaagc

SEQ ID NO: 183930 - RNA, 22 nt, Human
aaagcagucuguuuuaaccuga

SEQ ID NO: 183931 - RNA, 22 nt, Human
aaagaggacgugcuauuuuuua

SEQ ID NO: 183932 - RNA, 22 nt, Human
aaagagggaaggaaggagugaa

SEQ ID NO: 183933 - RNA, 23 nt, Human
aaagaggugaauccaggacaagc

SEQ ID NO: 183934 - RNA, 22 nt, Human
aaagaugaaguucagcgaagaa

SEQ ID NO: 183935 - RNA, 22 nt, Human
aaagaugucauacacauuaaga

SEQ ID NO: 183936 - RNA, 22 nt, Human
aaacgcaauuucuugcauguca

SEQ ID NO: 183937 - RNA, 22 nt, Human
aaacccuagcguuguuuauuga

SEQ ID NO: 183938 - RNA, 22 nt, Human
aaacuuuugaaggaggaaaaag

SEQ ID NO: 183939 - RNA, 22 nt, Human
aaacuuuaucaaguacucuuca

SEQ ID NO: 183940 - RNA, 22 nt, Human
aaagacaauaauucucucuagc

SEQ ID NO: 183941 - RNA, 22 nt, Human
aaagaguuaagagucuuaagcu

SEQ ID NO: 183942 - RNA, 21 nt, Human
aaagaaguuaguucagugguu

SEQ ID NO: 183943 - RNA, 22 nt, Human
aaagaacguuucugggaaucag

SEQ ID NO: 183944 - RNA, 22 nt, Human
aaagagugugcauguaccugug

SEQ ID NO: 183945 - RNA, 22 nt, Human
aaagccaagucugauuuuguug

SEQ ID NO: 183946 - RNA, 22 nt, Human
aaaggucagaugugucgaggag

SEQ ID NO: 183947 - RNA, 22 nt, Human
aaaggugccucuuacaaggcuu

SEQ ID NO: 183948 - RNA, 22 nt, Human
aaaguaaagccuauuuaauaau

SEQ ID NO: 183949 - RNA, 22 nt, Human
aaagcauucuaaccgaucgacg

SEQ ID NO: 183950 - RNA, 22 nt, Human
aaagccaagguccauguacuuu

SEQ ID NO: 183951 - RNA, 22 nt, Human
aaagccagggacagugugcaug

SEQ ID NO: 183952 - RNA, 22 nt, Human
aaagcgagccggcuuggaggga

SEQ ID NO: 183953 - RNA, 22 nt, Human
aaagcuccaaauggguggaagu

SEQ ID NO: 183954 - RNA, 17 nt, Human
aaagccgaucagauguu

SEQ ID NO: 183955 - RNA, 22 nt, Human
aaagcccuccaggguauacauu

SEQ ID NO: 183956 - RNA, 22 nt, Human
aaagcagguugcaauuacagug

SEQ ID NO: 183957 - RNA, 22 nt, Human
aaagcaaauaguugcuuaauau

SEQ ID NO: 183958 - RNA, 22 nt, Human
aaagcaaagaucuguagcccaa

SEQ ID NO: 183959 - RNA, 22 nt, Human
aaagccauaucuauucuauucu

SEQ ID NO: 183960 - RNA, 22 nt, Human
aaagcauuuguuucuccuggaa

SEQ ID NO: 183961 - RNA, 22 nt, Human
aaagaucaguuaacgccaucaa

SEQ ID NO: 183962 - RNA, 20 nt, Human
aaagauacuuuuuguaaugg

SEQ ID NO: 183963 - RNA, 22 nt, Human
aaaguuacacgacuauuuaugu

SEQ ID NO: 183964 - RNA, 22 nt, Human
aaagggaugauuucugaagaua

SEQ ID NO: 183965 - RNA, 22 nt, Human
aaagggcugaaguagucucugu

SEQ ID NO: 183966 - RNA, 22 nt, Human
aaagguggugguuagggaauau

SEQ ID NO: 183967 - RNA, 22 nt, Human
aaaguugcauccuaugaccuca

SEQ ID NO: 183968 - RNA, 22 nt, Human
aaagguguagacucaguuaugc

SEQ ID NO: 183969 - RNA, 22 nt, Human
aaaguuuguacugggaguuacu

SEQ ID NO: 183970 - RNA, 22 nt, Human
aaauaggaguagugauguauua

SEQ ID NO: 183971 - RNA, 22 nt, Human
aaauagucagaaaucaacgugc

SEQ ID NO: 183972 - RNA, 22 nt, Human
aaagucugaaaaaguuuguggg

SEQ ID NO: 183973 - RNA, 22 nt, Human
aaaguguaagucccugguuguc

SEQ ID NO: 183974 - RNA, 22 nt, Human
aaaguguuuaacaaauugcuuu

SEQ ID NO: 183975 - RNA, 22 nt, Human
aaaguuaauucuuguuuuuuau

SEQ ID NO: 183976 - RNA, 22 nt, Human
aaaguagaauaauaaacccuug

SEQ ID NO: 183977 - RNA, 22 nt, Human
aaaguagaugagaauuuuguug

SEQ ID NO: 183978 - RNA, 22 nt, Human
aaagucgugucagaaguuggga

SEQ ID NO: 183979 - RNA, 22 nt, Human
aaagcugaaacgaaaugacaac

SEQ ID NO: 183980 - RNA, 22 nt, Human
aaacccauauaccagcugugcu

SEQ ID NO: 183981 - RNA, 22 nt, Human
aaaggagugaaaugagaggaaa

SEQ ID NO: 183982 - RNA, 22 nt, Human
aaaucauguuaaagagggaguu

SEQ ID NO: 183983 - RNA, 22 nt, Human
aaaucauagccaugaacauuug

SEQ ID NO: 183984 - RNA, 22 nt, Human
aaaucgcuugaacccaggaagu

SEQ ID NO: 183985 - RNA, 22 nt, Human
aaaucugaaggaaacagcuuca

SEQ ID NO: 183986 - RNA, 22 nt, Human
aaauagauuugacuacuuggug

SEQ ID NO: 183987 - RNA, 23 nt, Human
aaauaauaauuucucuguuggga

SEQ ID NO: 183988 - RNA, 22 nt, Human
aaaguuguccuuugugccuuua

SEQ ID NO: 183989 - RNA, 22 nt, Human
aaaucaagucagcugaauucca

SEQ ID NO: 183990 - RNA, 22 nt, Human
aaauauuagacauaccuggaga

SEQ ID NO: 183991 - RNA, 22 nt, Human
aaauaugguaucugccaaacua

SEQ ID NO: 183992 - RNA, 22 nt, Human
aaauauuugaaugguguaagau

SEQ ID NO: 183993 - RNA, 21 nt, Human
aaagugguaaggauuauuuug

SEQ ID NO: 183994 - RNA, 22 nt, Human
aaauauagugacacuuauaguc

SEQ ID NO: 183995 - RNA, 22 nt, Human
aacagguucaagccuugcagca

SEQ ID NO: 183996 - RNA, 22 nt, Human
aacagggcgugaauaaugaaga

SEQ ID NO: 183997 - RNA, 22 nt, Human
aacaaagaaaagcuugagguuu

SEQ ID NO: 183998 - RNA, 22 nt, Human
aacagggcaguuccuuauagug

SEQ ID NO: 183999 - RNA, 19 nt, Human
aacaaaauaguucuaguua

SEQ ID NO: 184000 - RNA, 22 nt, Human
aacaaccuaguaguaucuuuca

SEQ ID NO: 184001 - RNA, 22 nt, Human
aacauuguuuaaguuaaauugu

SEQ ID NO: 184002 - RNA, 22 nt, Human
aacauuuauguuuugaccaagu

SEQ ID NO: 184003 - RNA, 22 nt, Human
aacaaaacauuuuacgaauaua

SEQ ID NO: 184004 - RNA, 21 nt, Human
aacaaaagggaagaacagcug

SEQ ID NO: 184005 - RNA, 22 nt, Human
aacagaauaucaaaagauuaug

SEQ ID NO: 184006 - RNA, 22 nt, Human
aaauuuauaacuuaaagugaau

SEQ ID NO: 184007 - RNA, 22 nt, Human
aaauuagucacaccagugucuu

SEQ ID NO: 184008 - RNA, 22 nt, Human
aaaucaaaagugguuauuuuau

SEQ ID NO: 184009 - RNA, 22 nt, Human
aaauauuaaugaugaagguagu

SEQ ID NO: 184010 - RNA, 22 nt, Human
aaauauugaauuugaggaugua

SEQ ID NO: 184011 - RNA, 22 nt, Human
aaauauauccuucuguccugcc

SEQ ID NO: 184012 - RNA, 22 nt, Human
aaauauauauaauauauauauu

SEQ ID NO: 184013 - RNA, 22 nt, Human
aaaugcucgccagguuuuauua

SEQ ID NO: 184014 - RNA, 22 nt, Human
aaaucugaauuaaaaucugguu

SEQ ID NO: 184015 - RNA, 22 nt, Human
aaaucccacucacgaguuuugc

SEQ ID NO: 184016 - RNA, 22 nt, Human
aaauccaucaaaucuucuagaa

SEQ ID NO: 184017 - RNA, 22 nt, Human
aaauguaaacuguauuuauaaa

SEQ ID NO: 184018 - RNA, 22 nt, Human
aaaugguguucuuuagaugaaa

SEQ ID NO: 184019 - RNA, 22 nt, Human
aaauguauuagccuaugugaga

SEQ ID NO: 184020 - RNA, 22 nt, Human
aagcaaguucuaaaguaauucu

SEQ ID NO: 184021 - RNA, 22 nt, Human
aagcaaagucaucuagaguagu

SEQ ID NO: 184022 - RNA, 22 nt, Human
aagcaaaugguauugguauuau

SEQ ID NO: 184023 - RNA, 22 nt, Human
aagcagugacucucagaggcag

SEQ ID NO: 184024 - RNA, 22 nt, Human
aagcaggaaaugaaaugcuugc

SEQ ID NO: 184025 - RNA, 22 nt, Human
aagccgagggaggugauggaga

SEQ ID NO: 184026 - RNA, 22 nt, Human
aagcaugagguggugagugaca

SEQ ID NO: 184027 - RNA, 22 nt, Human
aagcaugaaauaauguccuugu

SEQ ID NO: 184028 - RNA, 22 nt, Human
aagcgggcagcggccugcgcca

SEQ ID NO: 184029 - RNA, 22 nt, Human
aagcucagcugguggugauugc

SEQ ID NO: 184030 - RNA, 22 nt, Human
aagcugcagacccccugucuca

SEQ ID NO: 184031 - RNA, 22 nt, Human
aagcugccugggaggaagggcu

SEQ ID NO: 184032 - RNA, 22 nt, Human
aagcugaguaggaaugguaggu

SEQ ID NO: 184033 - RNA, 22 nt, Human
aagccuguugacagcugucagu

SEQ ID NO: 184034 - RNA, 18 nt, Human
aagcugcauuauuuuggc

SEQ ID NO: 184035 - RNA, 22 nt, Human
aaggaaaaaauggcuugugaua

SEQ ID NO: 184036 - RNA, 22 nt, Human
aaggaacuucagggcgaaugga

SEQ ID NO: 184037 - RNA, 22 nt, Human
aaggaaaguuaagguaaacucu

SEQ ID NO: 184038 - RNA, 22 nt, Human
aagcucuauaggagauacagua

SEQ ID NO: 184039 - RNA, 22 nt, Human
aagcgcggccgccgcggucgcu

SEQ ID NO: 184040 - RNA, 22 nt, Human
aagcgcaaggugucagcagguu

SEQ ID NO: 184041 - RNA, 22 nt, Human
aaggcgauuuaaagauguuagg

SEQ ID NO: 184042 - RNA, 22 nt, Human
aagccuuagauuggcgaugucg

SEQ ID NO: 184043 - RNA, 22 nt, Human
aagcuguuauuucacagguuca

SEQ ID NO: 184044 - RNA, 20 nt, Human
aagcuguguucaagauggga

SEQ ID NO: 184045 - RNA, 22 nt, Human
aagcuuugggcagaagaggauu

SEQ ID NO: 184046 - RNA, 18 nt, Human
aaggaggaaugaauagca

SEQ ID NO: 184047 - RNA, 22 nt, Human
aaggaggaugaauugucugcaa

SEQ ID NO: 184048 - RNA, 22 nt, Human
aaggaguacagggagggucccu

SEQ ID NO: 184049 - RNA, 22 nt, Human
aaggcagagggaaaacgggaau

SEQ ID NO: 184050 - RNA, 22 nt, Human
aaggauguuuaaacuacuuucc

SEQ ID NO: 184051 - RNA, 22 nt, Human
aaggcaguuaauuuggcuagaa

SEQ ID NO: 184052 - RNA, 22 nt, Human
aaggcaggagaguaggaggugg

SEQ ID NO: 184053 - RNA, 22 nt, Human
aaggcacauauuuuagagucac

SEQ ID NO: 184054 - RNA, 22 nt, Human
aaggcgaggggcacagcugaga

SEQ ID NO: 184055 - RNA, 22 nt, Human
aagaaauacagaaauggcagua

SEQ ID NO: 184056 - RNA, 22 nt, Human
aagaaauagauagaggaauacu

SEQ ID NO: 184057 - RNA, 22 nt, Human
aagaaaggcacaagaaagaaaa

SEQ ID NO: 184058 - RNA, 22 nt, Human
aagaaaggagauauucuuuuag

SEQ ID NO: 184059 - RNA, 22 nt, Human
aagaacaacugcuuuaaaagca

SEQ ID NO: 184060 - RNA, 22 nt, Human
aagaaaagcaucuuuguaguag

SEQ ID NO: 184061 - RNA, 22 nt, Human
aagaaaccauauuaguuccugg

SEQ ID NO: 184062 - RNA, 22 nt, Human
aagaagcuacugucacuaucag

SEQ ID NO: 184063 - RNA, 22 nt, Human
aagaagagaauauauuuacguc

SEQ ID NO: 184064 - RNA, 22 nt, Human
aagagaaacauauggccagauu

SEQ ID NO: 184065 - RNA, 22 nt, Human
aagagaaagggaaaaugguaaa

SEQ ID NO: 184066 - RNA, 22 nt, Human
aagaccacaggaaucaaacagg

SEQ ID NO: 184067 - RNA, 22 nt, Human
aagacccuaccccuggagagga

SEQ ID NO: 184068 - RNA, 21 nt, Human
aagacguaguuggguggacca

SEQ ID NO: 184069 - RNA, 22 nt, Human
aagaaggcggaccagaagggag

SEQ ID NO: 184070 - RNA, 23 nt, Human
aagaaugcuucugaagagcugcc

SEQ ID NO: 184071 - RNA, 22 nt, Human
aagaaugaaaugaaagaacuaa

SEQ ID NO: 184072 - RNA, 20 nt, Human
aagacacuguccccacugga

SEQ ID NO: 184073 - RNA, 23 nt, Human
aagcaacagacuucaucagauau

SEQ ID NO: 184074 - RNA, 21 nt, Human
aagcagcugcagaauuucagu

SEQ ID NO: 184075 - RNA, 22 nt, Human
aagaucugaccgugauggcggc

SEQ ID NO: 184076 - RNA, 22 nt, Human
aagauauauaaggaaguucagu

SEQ ID NO: 184077 - RNA, 22 nt, Human
aagaugaucagagggcaagagg

SEQ ID NO: 184078 - RNA, 22 nt, Human
aagauagaaugauguuggcuca

SEQ ID NO: 184079 - RNA, 22 nt, Human
aagauauauaacccuuucacuu

SEQ ID NO: 184080 - RNA, 22 nt, Human
aagcaaaaucgcaucuggggcc

SEQ ID NO: 184081 - RNA, 22 nt, Human
aagaguggagcuggaaaguggg

SEQ ID NO: 184082 - RNA, 22 nt, Human
aagagugaguagcuugguuggu

SEQ ID NO: 184083 - RNA, 22 nt, Human
aagacagugacagucacaauug

SEQ ID NO: 184084 - RNA, 22 nt, Human
aagaugcaagcauuuugaacug

SEQ ID NO: 184085 - RNA, 22 nt, Human
aagaugaguuacaaaggaguaa

SEQ ID NO: 184086 - RNA, 22 nt, Human
aaggaaaaccugacugaagaac

SEQ ID NO: 184087 - RNA, 22 nt, Human
aaggagaggagucauugggaua

SEQ ID NO: 184088 - RNA, 22 nt, Human
aaggacaaaacagcuguucuaa

SEQ ID NO: 184089 - RNA, 22 nt, Human
aaggcuuguugucacgcucuug

SEQ ID NO: 184090 - RNA, 22 nt, Human
aaggcugugaacuuuucgggaa

SEQ ID NO: 184091 - RNA, 22 nt, Human
aagggaaaagcugaaugagaug

SEQ ID NO: 184092 - RNA, 22 nt, Human
aaggcgguuccgguucgcggcg

SEQ ID NO: 184093 - RNA, 19 nt, Human
aaggcuuucugagugaaaa

SEQ ID NO: 184094 - RNA, 22 nt, Human
aaggggaggccugcgcuuucgg

SEQ ID NO: 184095 - RNA, 22 nt, Human
aaggggauuuaagguaagaaga

SEQ ID NO: 184096 - RNA, 22 nt, Human
aaggugcauuaguuuggagggg

SEQ ID NO: 184097 - RNA, 22 nt, Human
aagggggacaagcauuggcuua

SEQ ID NO: 184098 - RNA, 22 nt, Human
aaggggaauaguaggaccuggg

SEQ ID NO: 184099 - RNA, 22 nt, Human
aagggccuccuggggagccugg

SEQ ID NO: 184100 - RNA, 22 nt, Human
aagggagaguauccagaaacag

SEQ ID NO: 184101 - RNA, 22 nt, Human
aaggcggcggcggcggcugcgg

SEQ ID NO: 184102 - RNA, 22 nt, Human
aagucgccuaaacaaaguaucu

SEQ ID NO: 184103 - RNA, 22 nt, Human
aaguauuccccaaguauucugg

SEQ ID NO: 184104 - RNA, 22 nt, Human
aagucccaucugccuccaugua

SEQ ID NO: 184105 - RNA, 20 nt, Human
aagucuauuuagaguugcuu

SEQ ID NO: 184106 - RNA, 22 nt, Human
aaguagaaaaccgcacuggacu

SEQ ID NO: 184107 - RNA, 23 nt, Human
aaggugaagccaccaggugagga

SEQ ID NO: 184108 - RNA, 22 nt, Human
aagugaagccaauuuuuuuagg

SEQ ID NO: 184109 - RNA, 22 nt, Human
aagugaaaaaagucaguacuga

SEQ ID NO: 184110 - RNA, 22 nt, Human
aagucuuugagaucggacauag

SEQ ID NO: 184111 - RNA, 22 nt, Human
aagucuguucuacagcaccaga

SEQ ID NO: 184112 - RNA, 22 nt, Human
aagugauuuagagagcucuuag

SEQ ID NO: 184113 - RNA, 22 nt, Human
aagugauuuucccaccaucuac

SEQ ID NO: 184114 - RNA, 22 nt, Human
aagugaggagaccucuucuuca

SEQ ID NO: 184115 - RNA, 22 nt, Human
aagugauauaaaucgagaggga

SEQ ID NO: 184116 - RNA, 22 nt, Human
aauaucuagccuuuagcagcuu

SEQ ID NO: 184117 - RNA, 22 nt, Human
aauagcaauuacccuucaacuc

SEQ ID NO: 184118 - RNA, 22 nt, Human
aauaucuugaguuauaaauuca

SEQ ID NO: 184119 - RNA, 22 nt, Human
aauaugaugccaaauugcuaca

SEQ ID NO: 184120 - RNA, 22 nt, Human
aauaugcaaagcguguuaucug

SEQ ID NO: 184121 - RNA, 20 nt, Human
aauagcacagcucaaacauu

SEQ ID NO: 184122 - RNA, 22 nt, Human
aauauuuaaauagaauuacauc

SEQ ID NO: 184123 - RNA, 22 nt, Human
aauagagacaguuuaacaauau

SEQ ID NO: 184124 - RNA, 22 nt, Human
aauaaugguuugauucucacau

SEQ ID NO: 184125 - RNA, 22 nt, Human
aauacaaucagauuaugguagu

SEQ ID NO: 184126 - RNA, 22 nt, Human
aaucacuggcuccucacggcaa

SEQ ID NO: 184127 - RNA, 22 nt, Human
aaucacuuagaacccaggaagu

SEQ ID NO: 184128 - RNA, 22 nt, Human
aaucacuucuuugucuucuuca

SEQ ID NO: 184129 - RNA, 22 nt, Human
aaucauaacaaaagcaauuaua

SEQ ID NO: 184130 - RNA, 22 nt, Human
aauaugccaaauccugucacau

SEQ ID NO: 184131 - RNA, 22 nt, Human
aauauuuugggacugaggaauu

SEQ ID NO: 184132 - RNA, 22 nt, Human
aaucaaauuucuugugguuguu

SEQ ID NO: 184133 - RNA, 19 nt, Human
aaucacaagcaauaggggu

SEQ ID NO: 184134 - RNA, 23 nt, Human
aaucacuggauuugagcaugagg

SEQ ID NO: 184135 - RNA, 22 nt, Human
aauaaagcuugaaagcagggaa

SEQ ID NO: 184136 - RNA, 20 nt, Human
aauaaauauaacccauaauu

SEQ ID NO: 184137 - RNA, 21 nt, Human
aaguuuuggcuguacaguugu

SEQ ID NO: 184138 - RNA, 22 nt, Human
aauaacuuaaugacuguguaca

SEQ ID NO: 184139 - RNA, 22 nt, Human
aauaacuuacucuaugcuuagu

SEQ ID NO: 184140 - RNA, 22 nt, Human
aauaagagaauaaaaucuguua

SEQ ID NO: 184141 - RNA, 22 nt, Human
aagugauuuuccuacuugcuaa

SEQ ID NO: 184142 - RNA, 23 nt, Human
aagugcucaguggacagcauugc

SEQ ID NO: 184143 - RNA, 22 nt, Human
aagugcuggccuacucaaucga

SEQ ID NO: 184144 - RNA, 20 nt, Human
aagugcuguuagcugccuga

SEQ ID NO: 184145 - RNA, 22 nt, Human
aaguuaugauuggcguggacaa

SEQ ID NO: 184146 - RNA, 22 nt, Human
aaguucuuauguucugaugugc

SEQ ID NO: 184147 - RNA, 20 nt, Human
aaguugaaguuacuucaugg

SEQ ID NO: 184148 - RNA, 23 nt, Human
aaguugucauguaaaaugggcua

SEQ ID NO: 184149 - RNA, 22 nt, Human
aaguuuaagguagugaugauga

SEQ ID NO: 184150 - RNA, 22 nt, Human
aaguucuugguuaauuagggaa

SEQ ID NO: 184151 - RNA, 22 nt, Human
acaaggccugagggugacagca

SEQ ID NO: 184152 - RNA, 22 nt, Human
acaagaccagcagggagggugc

SEQ ID NO: 184153 - RNA, 22 nt, Human
acaaggaagaaaacauuacuuu

SEQ ID NO: 184154 - RNA, 22 nt, Human
acaagaaaggucugggaacaau

SEQ ID NO: 184155 - RNA, 21 nt, Human
acaaugaguuugaggcaucag

SEQ ID NO: 184156 - RNA, 22 nt, Human
acaauaauguuuuuagguuauu

SEQ ID NO: 184157 - RNA, 22 nt, Human
acaaugugcuuaugaaggcagu

SEQ ID NO: 184158 - RNA, 22 nt, Human
acaaucagcacugaguuuaucu

SEQ ID NO: 184159 - RNA, 22 nt, Human
acacaagaaugugcacucagcc

SEQ ID NO: 184160 - RNA, 22 nt, Human
acacacaugccuuuccuaagua

SEQ ID NO: 184161 - RNA, 19 nt, Human
acacaccagugccugugac

SEQ ID NO: 184162 - RNA, 20 nt, Human
acacagccuagaguuuggcu

SEQ ID NO: 184163 - RNA, 22 nt, Human
acacgauguuuuaagccccuaa

SEQ ID NO: 184164 - RNA, 20 nt, Human
acacaccugcucagacugag

SEQ ID NO: 184165 - RNA, 21 nt, Human
acacagcuggagcaucccggu

SEQ ID NO: 184166 - RNA, 22 nt, Human
acacgcacaccugugcacucgu

SEQ ID NO: 184167 - RNA, 22 nt, Human
acagacaucaucaacaucuucc

SEQ ID NO: 184168 - RNA, 22 nt, Human
acacgguggccagcaguaggug

SEQ ID NO: 184169 - RNA, 22 nt, Human
acacgugcaggagaauguagug

SEQ ID NO: 184170 - RNA, 22 nt, Human
acacucagaaaggcagagguuc

SEQ ID NO: 184171 - RNA, 22 nt, Human
acagacuuaguauccugcugcu

SEQ ID NO: 184172 - RNA, 22 nt, Human
acagacuugaccuuggagaggc

SEQ ID NO: 184173 - RNA, 23 nt, Human
acagcaagaggaccagaugugag

SEQ ID NO: 184174 - RNA, 23 nt, Human
acagaggcaucagagcagcaggc

SEQ ID NO: 184175 - RNA, 22 nt, Human
acagagguuaggauggguugua

SEQ ID NO: 184176 - RNA, 22 nt, Human
acagaucuauauuauauauaca

SEQ ID NO: 184177 - RNA, 22 nt, Human
acacugguucucuuaacccuau

SEQ ID NO: 184178 - RNA, 22 nt, Human
acagaucugcacagugaacaau

SEQ ID NO: 184179 - RNA, 21 nt, Human
acagaaguggcuuggucucag

SEQ ID NO: 184180 - RNA, 22 nt, Human
acagcagguuauuguuauggca

SEQ ID NO: 184181 - RNA, 22 nt, Human
acagacuuuuagacuuaugagu

SEQ ID NO: 184182 - RNA, 22 nt, Human
acagccacuaugacagauuuag

SEQ ID NO: 184183 - RNA, 20 nt, Human
acagccguaaugguccuugg

SEQ ID NO: 184184 - RNA, 19 nt, Human
acagccuguugguggggcu

SEQ ID NO: 184185 - RNA, 22 nt, Human
acagaugccagcuacaccaccg

SEQ ID NO: 184186 - RNA, 22 nt, Human
acagagggagugacggccaacc

SEQ ID NO: 184187 - RNA, 22 nt, Human
acagcaauccuggcagaggguu

SEQ ID NO: 184188 - RNA, 22 nt, Human
acagcauagaggaaauguggaa

SEQ ID NO: 184189 - RNA, 22 nt, Human
acaggacaaaaaucuggauggc

SEQ ID NO: 184190 - RNA, 22 nt, Human
acaggaaugaagaugagagagu

SEQ ID NO: 184191 - RNA, 22 nt, Human
acagcugagaugcuacuugugg

SEQ ID NO: 184192 - RNA, 22 nt, Human
acagccacccuggaacgguugu

SEQ ID NO: 184193 - RNA, 22 nt, Human
acagcugguugaaggggaccaa

SEQ ID NO: 184194 - RNA, 22 nt, Human
acagcuauuuaaaggcuuuagg

SEQ ID NO: 184195 - RNA, 22 nt, Human
acaggacgugugugcgcaugug

SEQ ID NO: 184196 - RNA, 22 nt, Human
acagcuggaggucugugagcac

SEQ ID NO: 184197 - RNA, 22 nt, Human
acaggcgucgccugcucuugcc

SEQ ID NO: 184198 - RNA, 22 nt, Human
acagucuuggauuccaggaguc

SEQ ID NO: 184199 - RNA, 22 nt, Human
acaggccuggguucaaauuugg

SEQ ID NO: 184200 - RNA, 22 nt, Human
acaggauuuucagggaagguga

SEQ ID NO: 184201 - RNA, 19 nt, Human
acaggaaggaaaauuucaa

SEQ ID NO: 184202 - RNA, 22 nt, Human
acaggaaaugaaaugguaucua

SEQ ID NO: 184203 - RNA, 22 nt, Human
acagguuggagguguggaguca

SEQ ID NO: 184204 - RNA, 22 nt, Human
acagguuucuccccugguuauu

SEQ ID NO: 184205 - RNA, 22 nt, Human
acagguaucccuuucuaccuga

SEQ ID NO: 184206 - RNA, 22 nt, Human
acagguauuaugaagccuauuu

SEQ ID NO: 184207 - RNA, 22 nt, Human
acauaaaccccccuuccccagg

SEQ ID NO: 184208 - RNA, 22 nt, Human
acaggguaagggagggugagug

SEQ ID NO: 184209 - RNA, 22 nt, Human
acauccagcagauuguccagag

SEQ ID NO: 184210 - RNA, 22 nt, Human
acagugguggagggcuguccug

SEQ ID NO: 184211 - RNA, 22 nt, Human
acaguuuuccuugguauagaac

SEQ ID NO: 184212 - RNA, 22 nt, Human
acagugugcaagaaauggggga

SEQ ID NO: 184213 - RNA, 22 nt, Human
acaguuagguccuaaaauucug

SEQ ID NO: 184214 - RNA, 22 nt, Human
acauaaacaugcagccugccaa

SEQ ID NO: 184215 - RNA, 22 nt, Human
acaguuuucugagaaucacagg

SEQ ID NO: 184216 - RNA, 19 nt, Human
acaguucuguggccuguuc

SEQ ID NO: 184217 - RNA, 22 nt, Human
acauaaauagcacugugaauuu

SEQ ID NO: 184218 - RNA, 22 nt, Human
aauggaaaaauccacagggaac

SEQ ID NO: 184219 - RNA, 22 nt, Human
aaugcugugggauagggcuccu

SEQ ID NO: 184220 - RNA, 22 nt, Human
aauggaugauuaaauggaugaa

SEQ ID NO: 184221 - RNA, 22 nt, Human
aauggcaaaaguuucggaaauu

SEQ ID NO: 184222 - RNA, 22 nt, Human
aauggauaacaccgguucuguc

SEQ ID NO: 184223 - RNA, 22 nt, Human
aauggaaaaagaacuguuuaaa

SEQ ID NO: 184224 - RNA, 22 nt, Human
aauggagaaaagacaauguuga

SEQ ID NO: 184225 - RNA, 22 nt, Human
aaucuacaaugaaaaaauguuu

SEQ ID NO: 184226 - RNA, 22 nt, Human
aaugcgcagaguggugugugca

SEQ ID NO: 184227 - RNA, 22 nt, Human
aaugcugaaugcauguuuccau

SEQ ID NO: 184228 - RNA, 22 nt, Human
aaugcuaaagaagaaggaguag

SEQ ID NO: 184229 - RNA, 22 nt, Human
aaucauguguaaugggcagacc

SEQ ID NO: 184230 - RNA, 22 nt, Human
aaucaugagguguuucuuugca

SEQ ID NO: 184231 - RNA, 22 nt, Human
aaucaugguacaaguaagcacg

SEQ ID NO: 184232 - RNA, 22 nt, Human
aaugggauaggucuucaggaau

SEQ ID NO: 184233 - RNA, 22 nt, Human
aauggcuagcauguaaaauauc

SEQ ID NO: 184234 - RNA, 23 nt, Human
aaugggcggaaguguuaaguugc

SEQ ID NO: 184235 - RNA, 23 nt, Human
aaugugaaauugaguuuuuguua

SEQ ID NO: 184236 - RNA, 22 nt, Human
aauguauuuuuaggcagaauau

SEQ ID NO: 184237 - RNA, 22 nt, Human
aaugugugggagaacagucuuu

SEQ ID NO: 184238 - RNA, 22 nt, Human
aauguucauauggguagcagau

SEQ ID NO: 184239 - RNA, 22 nt, Human
aaugugguauuuuggcauucuu

SEQ ID NO: 184240 - RNA, 22 nt, Human
aaugugcugguaacugcuuugc

SEQ ID NO: 184241 - RNA, 22 nt, Human
aaugugcauaacuuuauaaauu

SEQ ID NO: 184242 - RNA, 22 nt, Human
aauguguauguguauauauaug

SEQ ID NO: 184243 - RNA, 22 nt, Human
aauuaaauguuugguuugagcu

SEQ ID NO: 184244 - RNA, 22 nt, Human
aauguuuuucaaguguggagca

SEQ ID NO: 184245 - RNA, 22 nt, Human
aauuauuaagcuuucuccagug

SEQ ID NO: 184246 - RNA, 22 nt, Human
aauuauuaucauuaucuuccug

SEQ ID NO: 184247 - RNA, 22 nt, Human
aauuauuauguggaagacgacg

SEQ ID NO: 184248 - RNA, 22 nt, Human
aauuaacuggguucucagaugc

SEQ ID NO: 184249 - RNA, 22 nt, Human
aauuauguuugcuuuagaugga

SEQ ID NO: 184250 - RNA, 22 nt, Human
acaaaucccuguaaacacagcu

SEQ ID NO: 184251 - RNA, 22 nt, Human
acaaauuuaaauguugucuguu

SEQ ID NO: 184252 - RNA, 22 nt, Human
acaaacugggauaggauccugu

SEQ ID NO: 184253 - RNA, 20 nt, Human
acaaccacugcucacaguuu

SEQ ID NO: 184254 - RNA, 22 nt, Human
acaaagugaaaagcaucgaauu

SEQ ID NO: 184255 - RNA, 22 nt, Human
acaaaaauauuguagaagugcu

SEQ ID NO: 184256 - RNA, 22 nt, Human
aauuugcuccaaugucaguucu

SEQ ID NO: 184257 - RNA, 22 nt, Human
aauuucuuuagagguacugauc

SEQ ID NO: 184258 - RNA, 22 nt, Human
aauuucuuucagcugcuuuaag

SEQ ID NO: 184259 - RNA, 21 nt, Human
acaaaaccuaacuuggcugcu

SEQ ID NO: 184260 - RNA, 18 nt, Human
acaaaaauagugcuuugg

SEQ ID NO: 184261 - RNA, 22 nt, Human
aauuuuauuuuuuccccuagau

SEQ ID NO: 184262 - RNA, 22 nt, Human
aauuuuagcuaaagauccaugg

SEQ ID NO: 184263 - RNA, 22 nt, Human
aauuuuauuagacaggcauaau

SEQ ID NO: 184264 - RNA, 22 nt, Human
aauuucagaccaacgagucagg

SEQ ID NO: 184265 - RNA, 22 nt, Human
aauuucaucugagacugggagc

SEQ ID NO: 184266 - RNA, 20 nt, Human
aauuuagaguuuuaccaagg

SEQ ID NO: 184267 - RNA, 22 nt, Human
aauuuauccuuuugcuaaagca

SEQ ID NO: 184268 - RNA, 22 nt, Human
aauuuaauugguuuuuacuugu

SEQ ID NO: 184269 - RNA, 22 nt, Human
aauugugagaguuagagagcau

SEQ ID NO: 184270 - RNA, 22 nt, Human
aauuuaaguuauugcuaaugug

SEQ ID NO: 184271 - RNA, 22 nt, Human
aauuggagaguugugaaaggau

SEQ ID NO: 184272 - RNA, 22 nt, Human
aaugguccagaaucuuuuggac

SEQ ID NO: 184273 - RNA, 22 nt, Human
aauuauucuugccuagguuuaa

SEQ ID NO: 184274 - RNA, 22 nt, Human
aauuauucucucaacugagaug

SEQ ID NO: 184275 - RNA, 22 nt, Human
aauuauucaugucugggcagcc

SEQ ID NO: 184276 - RNA, 22 nt, Human
aauugccaagaauuagugauac

SEQ ID NO: 184277 - RNA, 22 nt, Human
aauucuuuguuccucugccaag

SEQ ID NO: 184278 - RNA, 21 nt, Human
aauugccuaauauaugggaag

SEQ ID NO: 184279 - RNA, 22 nt, Human
aauugauauuagauuugucuca

SEQ ID NO: 184280 - RNA, 22 nt, Human
agcagcaccuguccucgcugcu

SEQ ID NO: 184281 - RNA, 22 nt, Human
agcagcaggcugggaugagucu

SEQ ID NO: 184282 - RNA, 22 nt, Human
agcagcaggugaccucgaugcc

SEQ ID NO: 184283 - RNA, 22 nt, Human
agcagccgccgccgccgcgcac

SEQ ID NO: 184284 - RNA, 22 nt, Human
agcaggccuuucaccucugucc

SEQ ID NO: 184285 - RNA, 22 nt, Human
agcauaacaaagggcauaauug

SEQ ID NO: 184286 - RNA, 22 nt, Human
agcaggaaggcuagaagcagga

SEQ ID NO: 184287 - RNA, 22 nt, Human
agcagagggucaguuuuuuagu

SEQ ID NO: 184288 - RNA, 22 nt, Human
agcagcugagccccagcuguga

SEQ ID NO: 184289 - RNA, 22 nt, Human
agcagauaaagguugcauuucu

SEQ ID NO: 184290 - RNA, 22 nt, Human
agcacguucuucauuacuucac

SEQ ID NO: 184291 - RNA, 22 nt, Human
agcaauucugaaauuacuugac

SEQ ID NO: 184292 - RNA, 20 nt, Human
agcacaggcagucauucagu

SEQ ID NO: 184293 - RNA, 22 nt, Human
agcagcaaugacaauucaacca

SEQ ID NO: 184294 - RNA, 22 nt, Human
agcagauuguacagugcauuag

SEQ ID NO: 184295 - RNA, 22 nt, Human
agcacgcccaccuccugcggcg

SEQ ID NO: 184296 - RNA, 22 nt, Human
agcaaaauuccaaaaugcuaau

SEQ ID NO: 184297 - RNA, 22 nt, Human
agcaaggguugguuuucugaca

SEQ ID NO: 184298 - RNA, 22 nt, Human
agcaauucagagcauggacuuu

SEQ ID NO: 184299 - RNA, 22 nt, Human
agcacagugccugacauauaug

SEQ ID NO: 184300 - RNA, 22 nt, Human
agcaacauggaguuugugcgca

SEQ ID NO: 184301 - RNA, 22 nt, Human
agcaaauaauugucuuugaggg

SEQ ID NO: 184302 - RNA, 22 nt, Human
agcaauguuggccuauauaccu

SEQ ID NO: 184303 - RNA, 22 nt, Human
agcacucacuagaguuagaacc

SEQ ID NO: 184304 - RNA, 22 nt, Human
agcacuaccggucacggccaug

SEQ ID NO: 184305 - RNA, 22 nt, Human
agcagagaacauucauucaugu

SEQ ID NO: 184306 - RNA, 19 nt, Human
agcgccucuacugcaugga

SEQ ID NO: 184307 - RNA, 22 nt, Human
agcgcucauuuuccuccugcuc

SEQ ID NO: 184308 - RNA, 22 nt, Human
agcgcggccuuacacccagggg

SEQ ID NO: 184309 - RNA, 21 nt, Human
agcgcugcauccaccauggcu

SEQ ID NO: 184310 - RNA, 22 nt, Human
agccugugcuguguuugcucca

SEQ ID NO: 184311 - RNA, 22 nt, Human
agccugugacucugugaaacca

SEQ ID NO: 184312 - RNA, 22 nt, Human
agccugagucugcacauagaac

SEQ ID NO: 184313 - RNA, 22 nt, Human
agccugggucgagagacgagaa

SEQ ID NO: 184314 - RNA, 22 nt, Human
agccugaaccaauauagcagcc

SEQ ID NO: 184315 - RNA, 22 nt, Human
agccuacauuugacuauagucu

SEQ ID NO: 184316 - RNA, 22 nt, Human
agccuauucaucugaucuugaa

SEQ ID NO: 184317 - RNA, 22 nt, Human
agccgcgcuguuccugcugcug

SEQ ID NO: 184318 - RNA, 22 nt, Human
agccgcugaauuugaaacaagc

SEQ ID NO: 184319 - RNA, 22 nt, Human
agccggccucggacagagggag

SEQ ID NO: 184320 - RNA, 22 nt, Human
agcgacuguaagagggccccgg

SEQ ID NO: 184321 - RNA, 21 nt, Human
agccgggacaacguggacccc

SEQ ID NO: 184322 - RNA, 22 nt, Human
agccuaauuuguaggucugugu

SEQ ID NO: 184323 - RNA, 22 nt, Human
agccccggugagggaguccugu

SEQ ID NO: 184324 - RNA, 22 nt, Human
agccauggagauguggguuggg

SEQ ID NO: 184325 - RNA, 22 nt, Human
agccaugcuguuuugccuggga

SEQ ID NO: 184326 - RNA, 22 nt, Human
agcaggguggcaagucuuucug

SEQ ID NO: 184327 - RNA, 22 nt, Human
agcagggagaccaucucuuccu

SEQ ID NO: 184328 - RNA, 22 nt, Human
agcaggggcaggguuuugugcu

SEQ ID NO: 184329 - RNA, 22 nt, Human
agccagugcagcuggaaauuca

SEQ ID NO: 184330 - RNA, 22 nt, Human
agccagugucgugugacaugag

SEQ ID NO: 184331 - RNA, 22 nt, Human
agccaucuggugucaaugauuc

SEQ ID NO: 184332 - RNA, 22 nt, Human
agccacacuuagucacaaagau

SEQ ID NO: 184333 - RNA, 22 nt, Human
agccauggaggaugugcagcau

SEQ ID NO: 184334 - RNA, 23 nt, Human
agcccagcagagaaccuaggucc

SEQ ID NO: 184335 - RNA, 22 nt, Human
agccauggagaacagacuugaa

SEQ ID NO: 184336 - RNA, 22 nt, Human
agauggaguccugaagccagaa

SEQ ID NO: 184337 - RNA, 19 nt, Human
agaucaggauguauuuuug

SEQ ID NO: 184338 - RNA, 21 nt, Human
agaugaggauacugaggccua

SEQ ID NO: 184339 - RNA, 20 nt, Human
agaugcccaacucuguuuug

SEQ ID NO: 184340 - RNA, 22 nt, Human
agauagccagauauaaauaguc

SEQ ID NO: 184341 - RNA, 22 nt, Human
agauaucuuguuggcauaaaug

SEQ ID NO: 184342 - RNA, 22 nt, Human
agauauuauuuucuauuuauca

SEQ ID NO: 184343 - RNA, 22 nt, Human
agauuauuuaagacaggaacca

SEQ ID NO: 184344 - RNA, 22 nt, Human
agauuaagcauuauaauuauaa

SEQ ID NO: 184345 - RNA, 22 nt, Human
agaugaugugugucuucagcua

SEQ ID NO: 184346 - RNA, 23 nt, Human
agaugaugaauaaagagugagga

SEQ ID NO: 184347 - RNA, 22 nt, Human
agaugaguaaauggagucuucc

SEQ ID NO: 184348 - RNA, 22 nt, Human
agaugguucagaauuauaaaga

SEQ ID NO: 184349 - RNA, 22 nt, Human
agauucucccuccuggcgcugu

SEQ ID NO: 184350 - RNA, 22 nt, Human
agauuuuacggaguauuagggu

SEQ ID NO: 184351 - RNA, 22 nt, Human
agauuucaauggauauugcaag

SEQ ID NO: 184352 - RNA, 21 nt, Human
agaugcaguuugcaggugggu

SEQ ID NO: 184353 - RNA, 22 nt, Human
agauggaggaaagcaguuagaa

SEQ ID NO: 184354 - RNA, 22 nt, Human
agauggcuccaguguccagagg

SEQ ID NO: 184355 - RNA, 22 nt, Human
agauggggccugaggacacugu

SEQ ID NO: 184356 - RNA, 19 nt, Human
agauggcaaaaugcaaaga

SEQ ID NO: 184357 - RNA, 22 nt, Human
agauuuucuuuuccaucuuugu

SEQ ID NO: 184358 - RNA, 22 nt, Human
agcaaaguacugagcucaaagg

SEQ ID NO: 184359 - RNA, 22 nt, Human
agcaaagguagcagcucccagg

SEQ ID NO: 184360 - RNA, 22 nt, Human
agcaaagccucuuugaaaaaaa

SEQ ID NO: 184361 - RNA, 22 nt, Human
agaugucauguguugcuccaag

SEQ ID NO: 184362 - RNA, 22 nt, Human
agcaaaacuaaagacacagaca

SEQ ID NO: 184363 - RNA, 22 nt, Human
agauugaacgagcuggcaugga

SEQ ID NO: 184364 - RNA, 22 nt, Human
agauguugucucuuacguuuga

SEQ ID NO: 184365 - RNA, 22 nt, Human
agcaagggucucucauggcuug

SEQ ID NO: 184366 - RNA, 22 nt, Human
agagauuuacaacuugggcuuu

SEQ ID NO: 184367 - RNA, 22 nt, Human
agacagaaaaguugucaaucau

SEQ ID NO: 184368 - RNA, 22 nt, Human
agaccguguguggguugcggug

SEQ ID NO: 184369 - RNA, 22 nt, Human
agacacagcaauaacuacuguu

SEQ ID NO: 184370 - RNA, 22 nt, Human
agacccuugcagucugguuguc

SEQ ID NO: 184371 - RNA, 22 nt, Human
agacgcgcagaaggaagcggcc

SEQ ID NO: 184372 - RNA, 22 nt, Human
agacuauuuugugauaacuaau

SEQ ID NO: 184373 - RNA, 22 nt, Human
agagggagcuccaagaucaagg

SEQ ID NO: 184374 - RNA, 22 nt, Human
agaggugcuuaugcucaugguu

SEQ ID NO: 184375 - RNA, 22 nt, Human
agaggggaaggaugugauguga

SEQ ID NO: 184376 - RNA, 22 nt, Human
agaggcaggcagcagagaagau

SEQ ID NO: 184377 - RNA, 22 nt, Human
agagggagagaccuccgugccu

SEQ ID NO: 184378 - RNA, 22 nt, Human
agagcugggacuuggacucaau

SEQ ID NO: 184379 - RNA, 22 nt, Human
agagcucguggcucauugagga

SEQ ID NO: 184380 - RNA, 22 nt, Human
agagccggagucuucuuguuug

SEQ ID NO: 184381 - RNA, 22 nt, Human
agagcagcuuuucggaaccacu

SEQ ID NO: 184382 - RNA, 22 nt, Human
agagcaucgguggaguccccac

SEQ ID NO: 184383 - RNA, 22 nt, Human
agauauguuaggcuuguucccu

SEQ ID NO: 184384 - RNA, 22 nt, Human
agauaaacaacucuuagcuguu

SEQ ID NO: 184385 - RNA, 22 nt, Human
agauaaaucauuuauuaagcgg

SEQ ID NO: 184386 - RNA, 21 nt, Human
agaguugaaggcaguaaagag

SEQ ID NO: 184387 - RNA, 22 nt, Human
agaguaauguggaguuugugcu

SEQ ID NO: 184388 - RNA, 22 nt, Human
agaguacagaagcauuucagau

SEQ ID NO: 184389 - RNA, 22 nt, Human
agaugaccaguaagugguugaa

SEQ ID NO: 184390 - RNA, 22 nt, Human
agaugacuaacauaguauugcu

SEQ ID NO: 184391 - RNA, 22 nt, Human
agauagaaggauugugacacau

SEQ ID NO: 184392 - RNA, 22 nt, Human
agaucugucaccauccuggagc

SEQ ID NO: 184393 - RNA, 22 nt, Human
agaugaacuuuuuuaaacugga

SEQ ID NO: 184394 - RNA, 17 nt, Human
agaucugaaggagaaca

SEQ ID NO: 184395 - RNA, 22 nt, Human
agauaaucacaaucuagacuuu

SEQ ID NO: 184396 - RNA, 22 nt, Human
agauauucugccuaacagguuu

SEQ ID NO: 184397 - RNA, 21 nt, Human
agaguuuucuccauuucaggc

SEQ ID NO: 184398 - RNA, 22 nt, Human
agaagaucccugugguuacgac

SEQ ID NO: 184399 - RNA, 22 nt, Human
agaagauucagcaguagggugg

SEQ ID NO: 184400 - RNA, 22 nt, Human
agaagaaugguuugaaagauuu

SEQ ID NO: 184401 - RNA, 22 nt, Human
agaagguggaguagaacaagcu

SEQ ID NO: 184402 - RNA, 16 nt, Human
agaaggcuaguaacag

SEQ ID NO: 184403 - RNA, 22 nt, Human
agaagguagaugcaucaggagg

SEQ ID NO: 184404 - RNA, 19 nt, Human
agaacccccuuccucugcu

SEQ ID NO: 184405 - RNA, 22 nt, Human
agaaguguacuuagagaacaua

SEQ ID NO: 184406 - RNA, 22 nt, Human
agaagcaaagcaaacacauucu

SEQ ID NO: 184407 - RNA, 22 nt, Human
agaaggcagaaaagcuuuacaa

SEQ ID NO: 184408 - RNA, 22 nt, Human
agaaggcaucugcucgcuucca

SEQ ID NO: 184409 - RNA, 22 nt, Human
agaagcagaaggaagcagggcc

SEQ ID NO: 184410 - RNA, 22 nt, Human
agaaucagagcagaaucuucau

SEQ ID NO: 184411 - RNA, 22 nt, Human
agaagggcugcuuagaauauac

SEQ ID NO: 184412 - RNA, 21 nt, Human
agaaugaagaagaggucuuug

SEQ ID NO: 184413 - RNA, 22 nt, Human
agaaucugcauuuuaacaagau

SEQ ID NO: 184414 - RNA, 19 nt, Human
agaauuggaaccaugaacc

SEQ ID NO: 184415 - RNA, 22 nt, Human
agaauaagucuaauauauuggu

SEQ ID NO: 184416 - RNA, 22 nt, Human
agaaguuuguuauguaaacaaa

SEQ ID NO: 184417 - RNA, 21 nt, Human
agaaguuauuccauggguguu

SEQ ID NO: 184418 - RNA, 22 nt, Human
agaccccuggggaggauuauag

SEQ ID NO: 184419 - RNA, 22 nt, Human
agaccauagugauguuuacguc

SEQ ID NO: 184420 - RNA, 22 nt, Human
agaccauguuauccuucauuuu

SEQ ID NO: 184421 - RNA, 22 nt, Human
agaauauaguaaauauuuucua

SEQ ID NO: 184422 - RNA, 22 nt, Human
agacccugauucugcuggcggu

SEQ ID NO: 184423 - RNA, 22 nt, Human
agacaaucaacuguugaugccu

SEQ ID NO: 184424 - RNA, 22 nt, Human
agaccauuuuguagccagcaua

SEQ ID NO: 184425 - RNA, 22 nt, Human
agacaagagcugaggacauauu

SEQ ID NO: 184426 - RNA, 22 nt, Human
agaaaaggaagcuuagacugua

SEQ ID NO: 184427 - RNA, 22 nt, Human
agaaaauagguaguagacgggc

SEQ ID NO: 184428 - RNA, 19 nt, Human
agaaacaacauucuggaga

SEQ ID NO: 184429 - RNA, 22 nt, Human
agaaacaagcccuagaaguccu

SEQ ID NO: 184430 - RNA, 22 nt, Human
acuuguaaaauagagauaggga

SEQ ID NO: 184431 - RNA, 22 nt, Human
acuuuaaaucuguugcuuagcu

SEQ ID NO: 184432 - RNA, 22 nt, Human
acuuuauacuagugauaguuug

SEQ ID NO: 184433 - RNA, 22 nt, Human
acuuguuuacaagcaguucuga

SEQ ID NO: 184434 - RNA, 22 nt, Human
acuuuaaauaucauuugguagg

SEQ ID NO: 184435 - RNA, 22 nt, Human
acuuuccuggcuuugcaaggua

SEQ ID NO: 184436 - RNA, 22 nt, Human
acuuugccagcucccugcuggc

SEQ ID NO: 184437 - RNA, 22 nt, Human
acuguugagggaagcagaugaa

SEQ ID NO: 184438 - RNA, 22 nt, Human
acuugcaucuuagagacucacc

SEQ ID NO: 184439 - RNA, 22 nt, Human
acuucaggacggcaguggaggg

SEQ ID NO: 184440 - RNA, 22 nt, Human
acuucaggagcagucucuggaa

SEQ ID NO: 184441 - RNA, 22 nt, Human
acugcucugugguuggaagccu

SEQ ID NO: 184442 - RNA, 22 nt, Human
acuggcgucugucuccccugcc

SEQ ID NO: 184443 - RNA, 22 nt, Human
acuggcauuccuaggggagggg

SEQ ID NO: 184444 - RNA, 23 nt, Human
acuggauuguucuugggcgcuga

SEQ ID NO: 184445 - RNA, 22 nt, Human
acuggauucucuuacacagaug

SEQ ID NO: 184446 - RNA, 22 nt, Human
acuucucuuuucauuaauuuug

SEQ ID NO: 184447 - RNA, 22 nt, Human
acuuccuuccagcaaauggcau

SEQ ID NO: 184448 - RNA, 22 nt, Human
acucugaaaggcuacaaaugcu

SEQ ID NO: 184449 - RNA, 22 nt, Human
acucugagaugugucuugauuc

SEQ ID NO: 184450 - RNA, 18 nt, Human
acucugaagcuaagucac

SEQ ID NO: 184451 - RNA, 22 nt, Human
acucuuauuuugaaguaauaau

SEQ ID NO: 184452 - RNA, 22 nt, Human
acucggcggccucgagugcugg

SEQ ID NO: 184453 - RNA, 23 nt, Human
acucucuguuuggaggcacuggu

SEQ ID NO: 184454 - RNA, 22 nt, Human
acucucaauuaucuggacugaa

SEQ ID NO: 184455 - RNA, 21 nt, Human
acuccagccacugacugucuc

SEQ ID NO: 184456 - RNA, 22 nt, Human
acuccuauuugguagauggaag

SEQ ID NO: 184457 - RNA, 22 nt, Human
acucggaggccaaggccaacgg

SEQ ID NO: 184458 - RNA, 22 nt, Human
acucaucauuuuacggagcagc

SEQ ID NO: 184459 - RNA, 22 nt, Human
acucagucauuuggggaacagu

SEQ ID NO: 184460 - RNA, 22 nt, Human
acucaaacuuuuuguggacauu

SEQ ID NO: 184461 - RNA, 22 nt, Human
acuaugugucuguaucuggugc

SEQ ID NO: 184462 - RNA, 22 nt, Human
acuauugcuuuagggggaaacc

SEQ ID NO: 184463 - RNA, 22 nt, Human
acucagcaccuagaaagugugc

SEQ ID NO: 184464 - RNA, 22 nt, Human
acucuugacuaaugcuaauguc

SEQ ID NO: 184465 - RNA, 22 nt, Human
acugaacuaaagaaaugggcaa

SEQ ID NO: 184466 - RNA, 22 nt, Human
acugaauguucucaaaggggag

SEQ ID NO: 184467 - RNA, 22 nt, Human
acugacuucugguauuuuuagu

SEQ ID NO: 184468 - RNA, 22 nt, Human
acugacucacauuuugguuugc

SEQ ID NO: 184469 - RNA, 22 nt, Human
acugagcaaaacugauccuguu

SEQ ID NO: 184470 - RNA, 22 nt, Human
acugaaaguugaugagucacug

SEQ ID NO: 184471 - RNA, 22 nt, Human
acugaaauggggacaguccuua

SEQ ID NO: 184472 - RNA, 22 nt, Human
acugaaggcuggaccaugcauc

SEQ ID NO: 184473 - RNA, 22 nt, Human
acugcugauuauugaaguagag

SEQ ID NO: 184474 - RNA, 21 nt, Human
acugccaugcaggagccucca

SEQ ID NO: 184475 - RNA, 22 nt, Human
acuggagcccguggaggcgcag

SEQ ID NO: 184476 - RNA, 22 nt, Human
acugcauuaucaccaagaugua

SEQ ID NO: 184477 - RNA, 22 nt, Human
acugauuccaagcuuguggagg

SEQ ID NO: 184478 - RNA, 22 nt, Human
acugaucuguguaauauguuac

SEQ ID NO: 184479 - RNA, 22 nt, Human
acugcagauccucugagaaacc

SEQ ID NO: 184480 - RNA, 22 nt, Human
acugaugacaaugugaguguuc

SEQ ID NO: 184481 - RNA, 22 nt, Human
acugcaggucccaucaccugcg

SEQ ID NO: 184482 - RNA, 22 nt, Human
acuauggaguucagaucuugag

SEQ ID NO: 184483 - RNA, 22 nt, Human
acucacuguuuugaaauugaac

SEQ ID NO: 184484 - RNA, 22 nt, Human
acuaucuauugucuucuucaug

SEQ ID NO: 184485 - RNA, 22 nt, Human
acuagccucauaaaguuugucu

SEQ ID NO: 184486 - RNA, 22 nt, Human
acggguuccuugagggcaggau

SEQ ID NO: 184487 - RNA, 22 nt, Human
acgguuuggggaggaggauccc

SEQ ID NO: 184488 - RNA, 22 nt, Human
acggugagacuggcgaaggaaa

SEQ ID NO: 184489 - RNA, 22 nt, Human
acguccaccccguaccagauca

SEQ ID NO: 184490 - RNA, 22 nt, Human
acgucuacaugcaauucuuaua

SEQ ID NO: 184491 - RNA, 22 nt, Human
acuauacaguauguacgugcac

SEQ ID NO: 184492 - RNA, 22 nt, Human
acgccuugagccuugccugaau

SEQ ID NO: 184493 - RNA, 22 nt, Human
acgcgcuccagcaggugcuuca

SEQ ID NO: 184494 - RNA, 22 nt, Human
acgccaggagcuucuccguuca

SEQ ID NO: 184495 - RNA, 22 nt, Human
acaugacagugacuuuauaaga

SEQ ID NO: 184496 - RNA, 22 nt, Human
acaucuucuauggagguucgga

SEQ ID NO: 184497 - RNA, 21 nt, Human
acaguacuugagaucuuuuga

SEQ ID NO: 184498 - RNA, 21 nt, Human
acaguaugaucaaaugugcca

SEQ ID NO: 184499 - RNA, 22 nt, Human
acaggguauauaggcaaagcua

SEQ ID NO: 184500 - RNA, 22 nt, Human
acgucaucguugucaucgucau

SEQ ID NO: 184501 - RNA, 22 nt, Human
acggagggagagagggaggaga

SEQ ID NO: 184502 - RNA, 22 nt, Human
acggcuugaacgcgccuguggg

SEQ ID NO: 184503 - RNA, 22 nt, Human
acggcggguuccgggccagccc

SEQ ID NO: 184504 - RNA, 22 nt, Human
acgcugagcucauggagaugca

SEQ ID NO: 184505 - RNA, 22 nt, Human
acgcggagccagaggguguggg

SEQ ID NO: 184506 - RNA, 23 nt, Human
acgcagacacauguaugggccuc

SEQ ID NO: 184507 - RNA, 22 nt, Human
acgcuucacaggugcgcauugu

SEQ ID NO: 184508 - RNA, 22 nt, Human
acggccgaugacuccagcaugg

SEQ ID NO: 184509 - RNA, 22 nt, Human
acgcauguacuuguaugcaaug

SEQ ID NO: 184510 - RNA, 20 nt, Human
acgccgcgaggugagcuggu

SEQ ID NO: 184511 - RNA, 20 nt, Human
acgcauguauaugcaucacc

SEQ ID NO: 184512 - RNA, 22 nt, Human
acgccugccuguacuugugggg

SEQ ID NO: 184513 - RNA, 22 nt, Human
acgccggguaaggucauucugc

SEQ ID NO: 184514 - RNA, 22 nt, Human
acgggggagucuuuuacaucau

SEQ ID NO: 184515 - RNA, 22 nt, Human
aggcaguggagcuggaauaggc

SEQ ID NO: 184516 - RNA, 22 nt, Human
aggcaguggcuuuuguuguguu

SEQ ID NO: 184517 - RNA, 22 nt, Human
aggcauguugcuucgggcuuug

SEQ ID NO: 184518 - RNA, 22 nt, Human
aggcaggagcugugguggugag

SEQ ID NO: 184519 - RNA, 22 nt, Human
aggcaggauuugcgaugugguu

SEQ ID NO: 184520 - RNA, 22 nt, Human
aggcaggggagcuggaagggua

SEQ ID NO: 184521 - RNA, 22 nt, Human
aggcaggcucaaugcccagucu

SEQ ID NO: 184522 - RNA, 21 nt, Human
aggcagcgauuuucauauugc

SEQ ID NO: 184523 - RNA, 19 nt, Human
aggcagccccaacuugcau

SEQ ID NO: 184524 - RNA, 22 nt, Human
aggcagagauggcugcagggcc

SEQ ID NO: 184525 - RNA, 22 nt, Human
aggcaagauuaggaccagaaga

SEQ ID NO: 184526 - RNA, 22 nt, Human
aggcaauuauacuagguuuugg

SEQ ID NO: 184527 - RNA, 22 nt, Human
aggcaauuuuuaggguuguugu

SEQ ID NO: 184528 - RNA, 23 nt, Human
aggcagaguccuggggcacagcc

SEQ ID NO: 184529 - RNA, 22 nt, Human
aggcagcagggagggagaaaug

SEQ ID NO: 184530 - RNA, 22 nt, Human
aggcagaugggagcuggaaguu

SEQ ID NO: 184531 - RNA, 22 nt, Human
aggccgcgguggcgaaggcguu

SEQ ID NO: 184532 - RNA, 22 nt, Human
aggcccagcaccagcggucuuc

SEQ ID NO: 184533 - RNA, 22 nt, Human
aggcguggcuucugcuggguug

SEQ ID NO: 184534 - RNA, 19 nt, Human
aggcugccucacccucccu

SEQ ID NO: 184535 - RNA, 22 nt, Human
aggccaggcgccggcgcgagac

SEQ ID NO: 184536 - RNA, 22 nt, Human
aggcauuuucuuguuauuuuua

SEQ ID NO: 184537 - RNA, 22 nt, Human
aggccagggacaaugaggcaga

SEQ ID NO: 184538 - RNA, 22 nt, Human
aggcaucguguuuuucugcuuu

SEQ ID NO: 184539 - RNA, 22 nt, Human
aggcagugguguuugcuggugg

SEQ ID NO: 184540 - RNA, 22 nt, Human
aggcaguguggagggcuguugc

SEQ ID NO: 184541 - RNA, 22 nt, Human
aggcaguguguagcuggaagag

SEQ ID NO: 184542 - RNA, 22 nt, Human
aggcauauaguguuuaaaaaaa

SEQ ID NO: 184543 - RNA, 22 nt, Human
aggccacucagggggccaagau

SEQ ID NO: 184544 - RNA, 21 nt, Human
aggcauuuucuuggagauucu

SEQ ID NO: 184545 - RNA, 22 nt, Human
aggcauuuaucaggaaauguuc

SEQ ID NO: 184546 - RNA, 22 nt, Human
aggcauuuaaagauguaagacu

SEQ ID NO: 184547 - RNA, 22 nt, Human
agcggccucgcugccugcucag

SEQ ID NO: 184548 - RNA, 22 nt, Human
aggaaauaagggcacuucagau

SEQ ID NO: 184549 - RNA, 22 nt, Human
agcggcaggacgucuucuucga

SEQ ID NO: 184550 - RNA, 19 nt, Human
agcggccgccgcgggcgcc

SEQ ID NO: 184551 - RNA, 22 nt, Human
agcgcugugaaggcugggccac

SEQ ID NO: 184552 - RNA, 22 nt, Human
aggaauuugggguuacaugaug

SEQ ID NO: 184553 - RNA, 22 nt, Human
aggaauuucacugcguuuuuua

SEQ ID NO: 184554 - RNA, 22 nt, Human
aggacaaaggaccagaucugga

SEQ ID NO: 184555 - RNA, 22 nt, Human
aggaauguugagacauggcuaa

SEQ ID NO: 184556 - RNA, 22 nt, Human
aggaauugucgucauguauaau

SEQ ID NO: 184557 - RNA, 20 nt, Human
aggaacuggaagggaggaaa

SEQ ID NO: 184558 - RNA, 16 nt, Human
aggagcagaaagcagu

SEQ ID NO: 184559 - RNA, 22 nt, Human
aggaauuuuaauaugcuugucu

SEQ ID NO: 184560 - RNA, 22 nt, Human
aggagcugccggauggggcaug

SEQ ID NO: 184561 - RNA, 22 nt, Human
aggaggcguuugcuaaacgggc

SEQ ID NO: 184562 - RNA, 22 nt, Human
aggcacagaauccagucugcug

SEQ ID NO: 184563 - RNA, 22 nt, Human
aggcaauagagggugaggagga

SEQ ID NO: 184564 - RNA, 23 nt, Human
aggcaagaacggguuguucaccc

SEQ ID NO: 184565 - RNA, 22 nt, Human
aggcaacagacaggcuugguuc

SEQ ID NO: 184566 - RNA, 20 nt, Human
aggauuauguacauggaugc

SEQ ID NO: 184567 - RNA, 20 nt, Human
aggcagacaaggagucuguu

SEQ ID NO: 184568 - RNA, 22 nt, Human
aggauuuagcaugaaaugugaa

SEQ ID NO: 184569 - RNA, 22 nt, Human
aggauuuaauugcauuuuucuc

SEQ ID NO: 184570 - RNA, 22 nt, Human
aggagggcggggcuaaaaggga

SEQ ID NO: 184571 - RNA, 22 nt, Human
aggauugauggcauguuuacug

SEQ ID NO: 184572 - RNA, 22 nt, Human
aggauucuccuguuucccaccc

SEQ ID NO: 184573 - RNA, 22 nt, Human
aggauugaaaaaacacauauau

SEQ ID NO: 184574 - RNA, 22 nt, Human
aggauaaaggucauuauuccca

SEQ ID NO: 184575 - RNA, 22 nt, Human
aggauauguccuuuuuuucccc

SEQ ID NO: 184576 - RNA, 22 nt, Human
aggagggucauguugaagugua

SEQ ID NO: 184577 - RNA, 22 nt, Human
aggauuuauuccagaaaugcaa

SEQ ID NO: 184578 - RNA, 21 nt, Human
aggugguuccaauaaguaggu

SEQ ID NO: 184579 - RNA, 22 nt, Human
agguggugacgaugcuccguac

SEQ ID NO: 184580 - RNA, 22 nt, Human
agguguaauuacucuugcaguu

SEQ ID NO: 184581 - RNA, 22 nt, Human
aggugucauuauagaccagaua

SEQ ID NO: 184582 - RNA, 22 nt, Human
aggugggucgcaggcaucagug

SEQ ID NO: 184583 - RNA, 21 nt, Human
aggugcccaggauuauuuuuu

SEQ ID NO: 184584 - RNA, 22 nt, Human
agguggucuuguggaugccgca

SEQ ID NO: 184585 - RNA, 22 nt, Human
aggugguauuuaaaauuauuug

SEQ ID NO: 184586 - RNA, 22 nt, Human
agguuaugcacugcacaacccu

SEQ ID NO: 184587 - RNA, 22 nt, Human
aggugcccaaaucuucuguuuu

SEQ ID NO: 184588 - RNA, 22 nt, Human
agguggcuaugaggaugcaguc

SEQ ID NO: 184589 - RNA, 22 nt, Human
aggugggaauaauaaucaaagc

SEQ ID NO: 184590 - RNA, 22 nt, Human
aggugauaugggcuucucugag

SEQ ID NO: 184591 - RNA, 19 nt, Human
aggugaugugacucuagaa

SEQ ID NO: 184592 - RNA, 22 nt, Human
agguggcguauguguucguguu

SEQ ID NO: 184593 - RNA, 22 nt, Human
aggugagaaggacuguugcauu

SEQ ID NO: 184594 - RNA, 22 nt, Human
aggucuuuaguggcagagucua

SEQ ID NO: 184595 - RNA, 22 nt, Human
agguuuggaaguggcgauccau

SEQ ID NO: 184596 - RNA, 18 nt, Human
agguugcaucugugcaga

SEQ ID NO: 184597 - RNA, 22 nt, Human
aguaaaggaaggaagggacagc

SEQ ID NO: 184598 - RNA, 22 nt, Human
agguuuauggagcaccacaucu

SEQ ID NO: 184599 - RNA, 21 nt, Human
aguaccugugugccugugugu

SEQ ID NO: 184600 - RNA, 22 nt, Human
aguaauggucucaauaaauucu

SEQ ID NO: 184601 - RNA, 22 nt, Human
aguaauuucuuacggagaccuu

SEQ ID NO: 184602 - RNA, 22 nt, Human
aguaacagguguacagacuauc

SEQ ID NO: 184603 - RNA, 22 nt, Human
agguuuggccuuggggggaguu

SEQ ID NO: 184604 - RNA, 22 nt, Human
aguaacuuaagcaauuguguau

SEQ ID NO: 184605 - RNA, 22 nt, Human
aguaauaaacaacucauuuugg

SEQ ID NO: 184606 - RNA, 22 nt, Human
agggcaguuaugaaugucucca

SEQ ID NO: 184607 - RNA, 22 nt, Human
aggggcaaacuuguucuagggu

SEQ ID NO: 184608 - RNA, 22 nt, Human
aggggcagaggaugauggaaga

SEQ ID NO: 184609 - RNA, 22 nt, Human
agggcccaccuuggugcugagg

SEQ ID NO: 184610 - RNA, 22 nt, Human
agggccggggagggcugugggg

SEQ ID NO: 184611 - RNA, 22 nt, Human
agggcugggcuuggcaggcugg

SEQ ID NO: 184612 - RNA, 22 nt, Human
agggaugugcagggcuugccau

SEQ ID NO: 184613 - RNA, 22 nt, Human
agggcaggguuggugcuggugc

SEQ ID NO: 184614 - RNA, 19 nt, Human
agggaggcaagagaaaugu

SEQ ID NO: 184615 - RNA, 22 nt, Human
agggaugcaguaaaaacuguag

SEQ ID NO: 184616 - RNA, 22 nt, Human
agggcaguuuuacugaaaggug

SEQ ID NO: 184617 - RNA, 22 nt, Human
agggcaugugaaguaaccuagg

SEQ ID NO: 184618 - RNA, 22 nt, Human
agggccaagaaagaguggcuuu

SEQ ID NO: 184619 - RNA, 21 nt, Human
agggccagaucaccaaggagc

SEQ ID NO: 184620 - RNA, 22 nt, Human
agggccagcagcuuggccaacc

SEQ ID NO: 184621 - RNA, 22 nt, Human
agggcaguguggugggacugac

SEQ ID NO: 184622 - RNA, 22 nt, Human
agggaaauaggagaagaaagga

SEQ ID NO: 184623 - RNA, 22 nt, Human
aggcuuaaaugcucauaucagu

SEQ ID NO: 184624 - RNA, 22 nt, Human
aggcuuaacuacaauuuuugcc

SEQ ID NO: 184625 - RNA, 22 nt, Human
aggcuuuugcucuggcuccucu

SEQ ID NO: 184626 - RNA, 22 nt, Human
aggcugucucagccugcuugca

SEQ ID NO: 184627 - RNA, 22 nt, Human
aggcuguagaucuagacaugua

SEQ ID NO: 184628 - RNA, 22 nt, Human
aggguggaggacaggccaguga

SEQ ID NO: 184629 - RNA, 22 nt, Human
aggguggcacucugggggcucc

SEQ ID NO: 184630 - RNA, 22 nt, Human
aggguguuugggagcagaggau

SEQ ID NO: 184631 - RNA, 22 nt, Human
aggggcugagaguuugaugugg

SEQ ID NO: 184632 - RNA, 20 nt, Human
aggggcuguaguuagaugac

SEQ ID NO: 184633 - RNA, 22 nt, Human
aggggcaagucuggccauuucu

SEQ ID NO: 184634 - RNA, 22 nt, Human
agggcuguuggugcccucgagg

SEQ ID NO: 184635 - RNA, 22 nt, Human
agggcuuacaucccacaguuag

SEQ ID NO: 184636 - RNA, 22 nt, Human
aggucgugggugagagagagac

SEQ ID NO: 184637 - RNA, 22 nt, Human
aggucguauaguuaccuccuug

SEQ ID NO: 184638 - RNA, 22 nt, Human
aggucugcccaggaugcugcuu

SEQ ID NO: 184639 - RNA, 22 nt, Human
aggguuaugcuccuucaucuug

SEQ ID NO: 184640 - RNA, 22 nt, Human
aggguuucucuccaguguggac

SEQ ID NO: 184641 - RNA, 22 nt, Human
aggucagacagggugucuuucu

SEQ ID NO: 184642 - RNA, 20 nt, Human
agggguucuguuaugaaaua

SEQ ID NO: 184643 - RNA, 22 nt, Human
aggguaauaacaguauggugau

SEQ ID NO: 184644 - RNA, 22 nt, Human
agggguacuagaggauugagau

SEQ ID NO: 184645 - RNA, 22 nt, Human
agggggaauccugcuuauggau

SEQ ID NO: 184646 - RNA, 22 nt, Human
aggguuaggguggcauggggaa

SEQ ID NO: 184647 - RNA, 22 nt, Human
aguguggcccaugaauuauugg

SEQ ID NO: 184648 - RNA, 22 nt, Human
agugucuuuagucgcugagcaa

SEQ ID NO: 184649 - RNA, 22 nt, Human
aguguccaacucagcuugucaa

SEQ ID NO: 184650 - RNA, 22 nt, Human
agugucugcgggcagaggagcg

SEQ ID NO: 184651 - RNA, 22 nt, Human
aguggggcccaagaaucugcau

SEQ ID NO: 184652 - RNA, 22 nt, Human
aguggguaaggacaggugucug

SEQ ID NO: 184653 - RNA, 22 nt, Human
aguggcuggcaggggagggucc

SEQ ID NO: 184654 - RNA, 22 nt, Human
agugggaaagcugccuuguaga

SEQ ID NO: 184655 - RNA, 19 nt, Human
agugggcaaggaagaugac

SEQ ID NO: 184656 - RNA, 19 nt, Human
agugggauggcuuuuuccc

SEQ ID NO: 184657 - RNA, 22 nt, Human
agugucagcagcuucauugucu

SEQ ID NO: 184658 - RNA, 22 nt, Human
aguguauuugccuauaaaaaug

SEQ ID NO: 184659 - RNA, 22 nt, Human
aguguggccaaugaggaugggc

SEQ ID NO: 184660 - RNA, 22 nt, Human
aguguucaauuugagcucaaag

SEQ ID NO: 184661 - RNA, 23 nt, Human
aguguucagcauguaguaaauac

SEQ ID NO: 184662 - RNA, 22 nt, Human
aguguuuuaugugccaguuuaa

SEQ ID NO: 184663 - RNA, 22 nt, Human
aguuaugcaagcaaguaccacu

SEQ ID NO: 184664 - RNA, 22 nt, Human
aguuauggguauguauuauaau

SEQ ID NO: 184665 - RNA, 22 nt, Human
aguuaaagggggcuacagugug

SEQ ID NO: 184666 - RNA, 22 nt, Human
aguuaaucuuguauuaaugguu

SEQ ID NO: 184667 - RNA, 22 nt, Human
aguguuugggagagggugugag

SEQ ID NO: 184668 - RNA, 22 nt, Human
aguguuuuaagaaaguaauuuu

SEQ ID NO: 184669 - RNA, 17 nt, Human
aguuacugcacuugcca

SEQ ID NO: 184670 - RNA, 22 nt, Human
aguuaauuauagugcuuaauau

SEQ ID NO: 184671 - RNA, 20 nt, Human
aguucagguuauuuuccucc

SEQ ID NO: 184672 - RNA, 22 nt, Human
aguuauuuuucacuauuaggcu

SEQ ID NO: 184673 - RNA, 22 nt, Human
aguucauccucauuuacaagga

SEQ ID NO: 184674 - RNA, 22 nt, Human
aguucaugugguuuaacuuaau

SEQ ID NO: 184675 - RNA, 22 nt, Human
aguucaauuguuuuguaaaagu

SEQ ID NO: 184676 - RNA, 22 nt, Human
aguuauuaagaaaauuuugcca

SEQ ID NO: 184677 - RNA, 21 nt, Human
agugagugacagaagaagguu

SEQ ID NO: 184678 - RNA, 23 nt, Human
agugaugcaguaucugggucugu

SEQ ID NO: 184679 - RNA, 22 nt, Human
agugacuguccuacuuuguaga

SEQ ID NO: 184680 - RNA, 22 nt, Human
agugagaguauuaaugugaacu

SEQ ID NO: 184681 - RNA, 22 nt, Human
agugaagauagagccaggucug

SEQ ID NO: 184682 - RNA, 23 nt, Human
agugaagcugguuagugaugacc

SEQ ID NO: 184683 - RNA, 22 nt, Human
agugaauuagccuauuuguaaa

SEQ ID NO: 184684 - RNA, 22 nt, Human
agugacauuauuuuguguacua

SEQ ID NO: 184685 - RNA, 22 nt, Human
agucugaaccagauggcaaggu

SEQ ID NO: 184686 - RNA, 20 nt, Human
aguacugacaauauucugug

SEQ ID NO: 184687 - RNA, 22 nt, Human
agugaaaacugaaucaccuucc

SEQ ID NO: 184688 - RNA, 22 nt, Human
agugaaagaaaacuguuagaac

SEQ ID NO: 184689 - RNA, 22 nt, Human
agugaaauaugcccauugcugu

SEQ ID NO: 184690 - RNA, 20 nt, Human
agugaguuaucagcuacagu

SEQ ID NO: 184691 - RNA, 22 nt, Human
agugccaucuuuaacuguccca

SEQ ID NO: 184692 - RNA, 22 nt, Human
agugaugauccaaaugaauuga

SEQ ID NO: 184693 - RNA, 22 nt, Human
agugaugcuuuggagaagaucc

SEQ ID NO: 184694 - RNA, 22 nt, Human
agugauguaauggugaauguga

SEQ ID NO: 184695 - RNA, 20 nt, Human
agugauuuguuaguacauug

SEQ ID NO: 184696 - RNA, 21 nt, Human
aguggcacuguuucuucccua

SEQ ID NO: 184697 - RNA, 23 nt, Human
aguggccgaucaucucgggcuug

SEQ ID NO: 184698 - RNA, 22 nt, Human
aguggagguuacagcuguacau

SEQ ID NO: 184699 - RNA, 23 nt, Human
aguggaggucgggguggggagac

SEQ ID NO: 184700 - RNA, 22 nt, Human
agugccuggcugauggguccug

SEQ ID NO: 184701 - RNA, 22 nt, Human
agugccuuaaaggucuugcagc

SEQ ID NO: 184702 - RNA, 22 nt, Human
agugcgagaugaggacagaagc

SEQ ID NO: 184703 - RNA, 22 nt, Human
agugcuuuauguuguugugcaa

SEQ ID NO: 184704 - RNA, 22 nt, Human
aguggcuguuccaggugaggac

SEQ ID NO: 184705 - RNA, 22 nt, Human
aguggcuucucuggggucaaga

SEQ ID NO: 184706 - RNA, 22 nt, Human
aguggugccuaagcgcggaggc

SEQ ID NO: 184707 - RNA, 22 nt, Human
aguggugaucuguuacagucac

SEQ ID NO: 184708 - RNA, 22 nt, Human
aguggcugugaaauacauggga

SEQ ID NO: 184709 - RNA, 22 nt, Human
agugcucagggaaugccacuga

SEQ ID NO: 184710 - RNA, 22 nt, Human
aguucccgcgggagggcgcagg

SEQ ID NO: 184711 - RNA, 22 nt, Human
aguucugggaggugcacgucca

SEQ ID NO: 184712 - RNA, 22 nt, Human
aguugcuaauacaaaaaguccc

SEQ ID NO: 184713 - RNA, 22 nt, Human
aguucccuguuuuuuuccacug

SEQ ID NO: 184714 - RNA, 22 nt, Human
aguucuggcccugaaacaggga

SEQ ID NO: 184715 - RNA, 22 nt, Human
aguucauucuagcugggagcag

SEQ ID NO: 184716 - RNA, 22 nt, Human
aguugcugccagguccugggag

SEQ ID NO: 184717 - RNA, 22 nt, Human
aguugcuucccuauucuuagca

SEQ ID NO: 184718 - RNA, 22 nt, Human
aguugguauuuacugcaguugg

SEQ ID NO: 184719 - RNA, 22 nt, Human
aguugguguuagaguuuuucag

SEQ ID NO: 184720 - RNA, 22 nt, Human
aguugguggaagcuaagcuucu

SEQ ID NO: 184721 - RNA, 22 nt, Human
aguugguucgucucgccuugag

SEQ ID NO: 184722 - RNA, 22 nt, Human
aguuucccucacaggucugcau

SEQ ID NO: 184723 - RNA, 22 nt, Human
aguuugauuugucuaucuucau

SEQ ID NO: 184724 - RNA, 22 nt, Human
aguuucuugaagacugauguuu

SEQ ID NO: 184725 - RNA, 22 nt, Human
aguuuccacuggagacacugug

SEQ ID NO: 184726 - RNA, 22 nt, Human
aguuuacccacuguugaaauua

SEQ ID NO: 184727 - RNA, 23 nt, Human
aguuuacguauucauucuuacuc

SEQ ID NO: 184728 - RNA, 22 nt, Human
aguuuguagguuaggaucagca

SEQ ID NO: 184729 - RNA, 22 nt, Human
aguuguuuuucuuagauuuuag

SEQ ID NO: 184730 - RNA, 22 nt, Human
aguuuaaauuguucuaucagaa

SEQ ID NO: 184731 - RNA, 22 nt, Human
aguugugagaaugaacacugaa

SEQ ID NO: 184732 - RNA, 22 nt, Human
aguuuucugccucuggaugcgu

SEQ ID NO: 184733 - RNA, 22 nt, Human
aguuuuugccucgaauucugcg

SEQ ID NO: 184734 - RNA, 22 nt, Human
aguuucaguuaguugggugaca

SEQ ID NO: 184735 - RNA, 18 nt, Human
aguuuuuuuggcaaaagg

SEQ ID NO: 184736 - RNA, 22 nt, Human
auaaaaaguggcugcuauugga

SEQ ID NO: 184737 - RNA, 22 nt, Human
auaaaucaagggcaguauuucc

SEQ ID NO: 184738 - RNA, 22 nt, Human
auaauugaauaagagcugcagg

SEQ ID NO: 184739 - RNA, 22 nt, Human
auacaaaaaguggugaguguau

SEQ ID NO: 184740 - RNA, 22 nt, Human
auaaauuugacagcucuucaug

SEQ ID NO: 184741 - RNA, 22 nt, Human
auaaccaaaaauaguuuaguac

SEQ ID NO: 184742 - RNA, 22 nt, Human
auaacgaaagcaauuauuuuca

SEQ ID NO: 184743 - RNA, 22 nt, Human
auaagcuucucugcaguucagu

SEQ ID NO: 184744 - RNA, 22 nt, Human
auaaggacuugaauuagacauu

SEQ ID NO: 184745 - RNA, 22 nt, Human
auacaugugugugcauacaugu

SEQ ID NO: 184746 - RNA, 22 nt, Human
auaccaaugacaggaguuaggg

SEQ ID NO: 184747 - RNA, 22 nt, Human
auaccaguagaggacugcccaa

SEQ ID NO: 184748 - RNA, 22 nt, Human
auaagguuuucuuuuguucccu

SEQ ID NO: 184749 - RNA, 22 nt, Human
auaaguuauuuuaguaaaucag

SEQ ID NO: 184750 - RNA, 22 nt, Human
auacaucuuaacgcgcucuugg

SEQ ID NO: 184751 - RNA, 22 nt, Human
auaaaacagaucaggagaauga

SEQ ID NO: 184752 - RNA, 23 nt, Human
auaaugauaaugcuauuuuuugu

SEQ ID NO: 184753 - RNA, 22 nt, Human
auaaugccucauaggguguucc

SEQ ID NO: 184754 - RNA, 22 nt, Human
auaaagggccuuauuuuagcaa

SEQ ID NO: 184755 - RNA, 22 nt, Human
auaaaguaaugcauauaaugug

SEQ ID NO: 184756 - RNA, 22 nt, Human
auaagccugccuuaucuccaga

SEQ ID NO: 184757 - RNA, 22 nt, Human
auaaucuuugaguagaguugag

SEQ ID NO: 184758 - RNA, 22 nt, Human
auaaggcauagugagucaucau

SEQ ID NO: 184759 - RNA, 22 nt, Human
auaaggaaagugagugcuuaaa

SEQ ID NO: 184760 - RNA, 22 nt, Human
auaaauuugccagcauauguuc

SEQ ID NO: 184761 - RNA, 22 nt, Human
auaaauucuaugauggauuggg

SEQ ID NO: 184762 - RNA, 22 nt, Human
auaaaaauguuuuuguguggua

SEQ ID NO: 184763 - RNA, 20 nt, Human
auaaauaggauuuucugaca

SEQ ID NO: 184764 - RNA, 22 nt, Human
auaaaaucugaagcaagaauaa

SEQ ID NO: 184765 - RNA, 22 nt, Human
auaaaagcacaauagaguuaug

SEQ ID NO: 184766 - RNA, 22 nt, Human
aguuuuugagaauucuucugaa

SEQ ID NO: 184767 - RNA, 22 nt, Human
aguuuuuaacgccauguuugaa

SEQ ID NO: 184768 - RNA, 22 nt, Human
aguuuuguuuguuuguuuguua

SEQ ID NO: 184769 - RNA, 22 nt, Human
auugagaugcuuaaaucuucac

SEQ ID NO: 184770 - RNA, 22 nt, Human
auucuuacaaagcagagucugu

SEQ ID NO: 184771 - RNA, 20 nt, Human
auucuguguaaauguccugu

SEQ ID NO: 184772 - RNA, 22 nt, Human
auucuguuuaauacacgaaagg

SEQ ID NO: 184773 - RNA, 22 nt, Human
auucuguuuuaccauuuucuuu

SEQ ID NO: 184774 - RNA, 22 nt, Human
auucucuguacagaagguaccg

SEQ ID NO: 184775 - RNA, 22 nt, Human
auucucugaugcagguggaaga

SEQ ID NO: 184776 - RNA, 22 nt, Human
auucugaagcagaaaaggcaga

SEQ ID NO: 184777 - RNA, 21 nt, Human
auucugaguugucagucuuca

SEQ ID NO: 184778 - RNA, 22 nt, Human
auugauuuugugcuuuccuacg

SEQ ID NO: 184779 - RNA, 22 nt, Human
auugaguacuugcugggcucuc

SEQ ID NO: 184780 - RNA, 22 nt, Human
auugaguauuguaaauaaaaca

SEQ ID NO: 184781 - RNA, 22 nt, Human
auugaugaaaauaguuauuuua

SEQ ID NO: 184782 - RNA, 22 nt, Human
auugaguucaccucuuucagaa

SEQ ID NO: 184783 - RNA, 22 nt, Human
auucuucauguugaagcuguca

SEQ ID NO: 184784 - RNA, 22 nt, Human
auucuuauaaaaaguguugacu

SEQ ID NO: 184785 - RNA, 17 nt, Human
auucuuauacucuguga

SEQ ID NO: 184786 - RNA, 22 nt, Human
auugccauaauagagccaugua

SEQ ID NO: 184787 - RNA, 23 nt, Human
auugccuguagaucuucacuuuc

SEQ ID NO: 184788 - RNA, 22 nt, Human
auucuugauauagauaguuaau

SEQ ID NO: 184789 - RNA, 19 nt, Human
auucuucucuuccugcugu

SEQ ID NO: 184790 - RNA, 22 nt, Human
auucuuuucucuaaaugaugaa

SEQ ID NO: 184791 - RNA, 22 nt, Human
auugaaauuaauuucugcuuuc

SEQ ID NO: 184792 - RNA, 22 nt, Human
auuccaccccauccucccaggu

SEQ ID NO: 184793 - RNA, 22 nt, Human
auucgaucacugccgaggaccu

SEQ ID NO: 184794 - RNA, 22 nt, Human
auuccuguggcuggguaaagua

SEQ ID NO: 184795 - RNA, 22 nt, Human
auucuagaguuucaauccaagg

SEQ ID NO: 184796 - RNA, 22 nt, Human
auucuaugaaugacuguuagau

SEQ ID NO: 184797 - RNA, 22 nt, Human
auucucauguuaccaaauucua

SEQ ID NO: 184798 - RNA, 22 nt, Human
auugaaauuugcuuccucacug

SEQ ID NO: 184799 - RNA, 22 nt, Human
auugaaguguacguuugaucua

SEQ ID NO: 184800 - RNA, 22 nt, Human
auugaauuagauguuguagucc

SEQ ID NO: 184801 - RNA, 22 nt, Human
auugacagaaaauuggauggca

SEQ ID NO: 184802 - RNA, 22 nt, Human
auugagaaaauucgagcaaguu

SEQ ID NO: 184803 - RNA, 22 nt, Human
auucuccucaaaacaucugcug

SEQ ID NO: 184804 - RNA, 22 nt, Human
auucauauagcgcuuacagccu

SEQ ID NO: 184805 - RNA, 18 nt, Human
auucauuugcguuuggcu

SEQ ID NO: 184806 - RNA, 22 nt, Human
auucauucugaccucaagagaa

SEQ ID NO: 184807 - RNA, 19 nt, Human
auucaagugcuuagagauc

SEQ ID NO: 184808 - RNA, 22 nt, Human
auucuguugguuuaauagucaa

SEQ ID NO: 184809 - RNA, 22 nt, Human
auucugcauuucuaaccagguc

SEQ ID NO: 184810 - RNA, 22 nt, Human
auucugcaauaaucaguccuua

SEQ ID NO: 184811 - RNA, 22 nt, Human
auucugcugccuaguuuaugaa

SEQ ID NO: 184812 - RNA, 22 nt, Human
auucuguaggcuuuuguuaaaa

SEQ ID NO: 184813 - RNA, 21 nt, Human
auucugauguuucuauuguuu

SEQ ID NO: 184814 - RNA, 22 nt, Human
auuauugcaagcagugaaggga

SEQ ID NO: 184815 - RNA, 22 nt, Human
auuauucuuugggaaaguugaa

SEQ ID NO: 184816 - RNA, 20 nt, Human
auuauuucuucugcccaaag

SEQ ID NO: 184817 - RNA, 22 nt, Human
auguuguugaacucuuugcaug

SEQ ID NO: 184818 - RNA, 22 nt, Human
auuaaagcuaguugagauuuaa

SEQ ID NO: 184819 - RNA, 22 nt, Human
auuaaauagcagaagaaagaug

SEQ ID NO: 184820 - RNA, 21 nt, Human
auuaagacaauggcaaugggu

SEQ ID NO: 184821 - RNA, 22 nt, Human
auuccguuuuaaaaccuuaagc

SEQ ID NO: 184822 - RNA, 22 nt, Human
auuauaguuuugcccuuaagaa

SEQ ID NO: 184823 - RNA, 22 nt, Human
auucccucaagagacccacagc

SEQ ID NO: 184824 - RNA, 22 nt, Human
auucgcggcuugaucugcuugc

SEQ ID NO: 184825 - RNA, 22 nt, Human
auucuacgcuccgucucuauca

SEQ ID NO: 184826 - RNA, 22 nt, Human
auuaucugacugaguagucugu

SEQ ID NO: 184827 - RNA, 23 nt, Human
auuaugaagaagacucgccuguu

SEQ ID NO: 184828 - RNA, 22 nt, Human
auuaucuauccgccaacaguaa

SEQ ID NO: 184829 - RNA, 22 nt, Human
auuauucaaggugaggguaaaa

SEQ ID NO: 184830 - RNA, 22 nt, Human
auucuacucuuuaaauaugaaa

SEQ ID NO: 184831 - RNA, 22 nt, Human
auuucauccauuaagaguacuc

SEQ ID NO: 184832 - RNA, 22 nt, Human
auuucagcagcccauguuugga

SEQ ID NO: 184833 - RNA, 22 nt, Human
auuucccugcagugcuuaggaa

SEQ ID NO: 184834 - RNA, 22 nt, Human
auuugcauguuuauuucuuaga

SEQ ID NO: 184835 - RNA, 22 nt, Human
auuuacugagguaaauaaacug

SEQ ID NO: 184836 - RNA, 22 nt, Human
auuuaucugcucuucgcguuga

SEQ ID NO: 184837 - RNA, 21 nt, Human
auuggcagaucucuggauugu

SEQ ID NO: 184838 - RNA, 22 nt, Human
auuggagacauuaagucuaaga

SEQ ID NO: 184839 - RNA, 22 nt, Human
auugugaaugccugucagucuu

SEQ ID NO: 184840 - RNA, 22 nt, Human
auuuccagcagcauauuugucu

SEQ ID NO: 184841 - RNA, 22 nt, Human
auugguuucuuguggguuaucc

SEQ ID NO: 184842 - RNA, 19 nt, Human
auugguuugcucgggaaug

SEQ ID NO: 184843 - RNA, 22 nt, Human
auuguuacuggguuaauuugga

SEQ ID NO: 184844 - RNA, 23 nt, Human
auuugcugaucguagaugacuag

SEQ ID NO: 184845 - RNA, 22 nt, Human
auuugacuugguaagacuuaag

SEQ ID NO: 184846 - RNA, 18 nt, Human
auugagcaugacagaccu

SEQ ID NO: 184847 - RNA, 22 nt, Human
auugagacugaaauuacugaag

SEQ ID NO: 184848 - RNA, 22 nt, Human
auuuaagugagucuuuaaaaua

SEQ ID NO: 184849 - RNA, 22 nt, Human
auugagcuguugaagucccaca

SEQ ID NO: 184850 - RNA, 22 nt, Human
auuuaagacuguggugcaguuu

SEQ ID NO: 184851 - RNA, 22 nt, Human
auugaugccugaaaaauaugua

SEQ ID NO: 184852 - RNA, 22 nt, Human
auugcaggucguguggaaguga

SEQ ID NO: 184853 - RNA, 22 nt, Human
auugcauucaugcuccccuuag

SEQ ID NO: 184854 - RNA, 19 nt, Human
auugcaguguaaaacuauu

SEQ ID NO: 184855 - RNA, 22 nt, Human
auuggccaguggacagcgccgu

SEQ ID NO: 184856 - RNA, 22 nt, Human
auucuuuauuuucuguacuugc

SEQ ID NO: 184857 - RNA, 22 nt, Human
auucuuuagaguccuucaaaua

SEQ ID NO: 184858 - RNA, 20 nt, Human
auucuuguuccauuucccag

SEQ ID NO: 184859 - RNA, 22 nt, Human
auugaagcauggagaugaggca

SEQ ID NO: 184860 - RNA, 22 nt, Human
auuguuuugugaaacauaguga

SEQ ID NO: 184861 - RNA, 22 nt, Human
auuguuuccccggaauuauuca

SEQ ID NO: 184862 - RNA, 22 nt, Human
auuucuguaauucugaggagug

SEQ ID NO: 184863 - RNA, 22 nt, Human
auuuugcuuuucuaguggguuu

SEQ ID NO: 184864 - RNA, 17 nt, Human
auuuccgaguuucuuuc

SEQ ID NO: 184865 - RNA, 22 nt, Human
auuuugcaguuuauugccaauc

SEQ ID NO: 184866 - RNA, 22 nt, Human
auuuucuugucucuguuguagg

SEQ ID NO: 184867 - RNA, 22 nt, Human
auuuuauuuugggaucuuuuua

SEQ ID NO: 184868 - RNA, 19 nt, Human
auuuccuggcauauaucac

SEQ ID NO: 184869 - RNA, 22 nt, Human
auuuccugugaacuuuucugau

SEQ ID NO: 184870 - RNA, 22 nt, Human
auuuuuauuugccuaugauaua

SEQ ID NO: 184871 - RNA, 22 nt, Human
auuuuuagucuugcugcaauca

SEQ ID NO: 184872 - RNA, 22 nt, Human
auuuuaccauuaguuuguaaua

SEQ ID NO: 184873 - RNA, 22 nt, Human
auuuuuuuaggcugucagccgc

SEQ ID NO: 184874 - RNA, 22 nt, Human
auuuuuucaugugugguugaga

SEQ ID NO: 184875 - RNA, 23 nt, Human
auuuuuccacacacagacucagu

SEQ ID NO: 184876 - RNA, 22 nt, Human
auuuucauauggguuauuugua

SEQ ID NO: 184877 - RNA, 19 nt, Human
auuuugguucuuuccauuc

SEQ ID NO: 184878 - RNA, 22 nt, Human
auuuuugguuucaccugcacgc

SEQ ID NO: 184879 - RNA, 22 nt, Human
caaauggggaauagaugauggg

SEQ ID NO: 184880 - RNA, 22 nt, Human
caaauguuugguggcauuuugu

SEQ ID NO: 184881 - RNA, 22 nt, Human
caaauuuuuauuuaccaucugc

SEQ ID NO: 184882 - RNA, 22 nt, Human
auuuuuuuuccugucucuuuca

SEQ ID NO: 184883 - RNA, 22 nt, Human
caaaaauacuugccuguaucug

SEQ ID NO: 184884 - RNA, 22 nt, Human
auuuuuuuggucauaugagaua

SEQ ID NO: 184885 - RNA, 22 nt, Human
caaaucagaucagagacaggcu

SEQ ID NO: 184886 - RNA, 22 nt, Human
caaaugaugcauggcuagugag

SEQ ID NO: 184887 - RNA, 22 nt, Human
caaaggaauuacauguuucgga

SEQ ID NO: 184888 - RNA, 22 nt, Human
caaaggaaagagaaaaagucuu

SEQ ID NO: 184889 - RNA, 22 nt, Human
caaaauuguugaugcugcuuug

SEQ ID NO: 184890 - RNA, 22 nt, Human
auuuuguugaaacccuuguugu

SEQ ID NO: 184891 - RNA, 22 nt, Human
auuuuuagagugaaagaauuaa

SEQ ID NO: 184892 - RNA, 22 nt, Human
auacuucaccuaacccaguuuc

SEQ ID NO: 184893 - RNA, 22 nt, Human
auacuuccugcuucccugaucu

SEQ ID NO: 184894 - RNA, 22 nt, Human
aucuccagcagugcuuuugagc

SEQ ID NO: 184895 - RNA, 22 nt, Human
auccuggcuuuccugauuuacu

SEQ ID NO: 184896 - RNA, 22 nt, Human
auccugugggguauugcugcau

SEQ ID NO: 184897 - RNA, 22 nt, Human
auacagccuaguuugaguccca

SEQ ID NO: 184898 - RNA, 22 nt, Human
auacagacacuguagguuauuu

SEQ ID NO: 184899 - RNA, 22 nt, Human
auacacauguuauuguggaagc

SEQ ID NO: 184900 - RNA, 22 nt, Human
aucgcagaguggaaauugauga

SEQ ID NO: 184901 - RNA, 18 nt, Human
auccuuugaucaucuguc

SEQ ID NO: 184902 - RNA, 18 nt, Human
auccuucggccuagugga

SEQ ID NO: 184903 - RNA, 22 nt, Human
aucugcauguggcagguggauu

SEQ ID NO: 184904 - RNA, 22 nt, Human
aucugcugccuaggguuugucu

SEQ ID NO: 184905 - RNA, 22 nt, Human
aucugacaaccuauugacuuga

SEQ ID NO: 184906 - RNA, 22 nt, Human
aucugcuguaguuggugccagu

SEQ ID NO: 184907 - RNA, 22 nt, Human
aucugggaaggggaaaaugcug

SEQ ID NO: 184908 - RNA, 23 nt, Human
aucugagccuggucccacccgcu

SEQ ID NO: 184909 - RNA, 22 nt, Human
aucuggaacuucucugcauuga

SEQ ID NO: 184910 - RNA, 20 nt, Human
aucugguggggaauaacuuc

SEQ ID NO: 184911 - RNA, 22 nt, Human
aucuuggccuucuccuggagug

SEQ ID NO: 184912 - RNA, 22 nt, Human
aucuuugccuuuaugccucuag

SEQ ID NO: 184913 - RNA, 22 nt, Human
aucuugaaacauauaugcauuu

SEQ ID NO: 184914 - RNA, 22 nt, Human
aucuucucucucaucaggauca

SEQ ID NO: 184915 - RNA, 22 nt, Human
aucucagacucuccggguuccg

SEQ ID NO: 184916 - RNA, 22 nt, Human
aucucacuucugucauguggca

SEQ ID NO: 184917 - RNA, 21 nt, Human
aucucaguccugggaaugauu

SEQ ID NO: 184918 - RNA, 22 nt, Human
aucuccaguuagcaguacugau

SEQ ID NO: 184919 - RNA, 22 nt, Human
aucuucaaggacgccaagaucc

SEQ ID NO: 184920 - RNA, 22 nt, Human
aucuucaaagcacaucguuugu

SEQ ID NO: 184921 - RNA, 22 nt, Human
aucuucaggggcaauggagaua

SEQ ID NO: 184922 - RNA, 22 nt, Human
aucuucuauguguaggcauuuu

SEQ ID NO: 184923 - RNA, 22 nt, Human
aucuacuuugggaguuucucuu

SEQ ID NO: 184924 - RNA, 20 nt, Human
aucuuaucuaucuuuuguuc

SEQ ID NO: 184925 - RNA, 22 nt, Human
aucggggaaugaccuuuucauu

SEQ ID NO: 184926 - RNA, 22 nt, Human
augaccauccagaaguccagcu

SEQ ID NO: 184927 - RNA, 22 nt, Human
augacagcucuagcacacagua

SEQ ID NO: 184928 - RNA, 22 nt, Human
aucuuggauccuuugccagcuu

SEQ ID NO: 184929 - RNA, 21 nt, Human
aucugugucauuagguggcag

SEQ ID NO: 184930 - RNA, 19 nt, Human
aucuuucagcagcuccccu

SEQ ID NO: 184931 - RNA, 22 nt, Human
aucuuguuagaaggcaguaggu

SEQ ID NO: 184932 - RNA, 22 nt, Human
aucuuagcucaacucucaccaa

SEQ ID NO: 184933 - RNA, 22 nt, Human
augacuauaaauaggagauugu

SEQ ID NO: 184934 - RNA, 22 nt, Human
augaaggauagggcaaaauuuu

SEQ ID NO: 184935 - RNA, 22 nt, Human
augaaaacggaccagagcuauu

SEQ ID NO: 184936 - RNA, 22 nt, Human
aucuuuuuucacaauuuauuuu

SEQ ID NO: 184937 - RNA, 20 nt, Human
aucugugaugagaacgguuu

SEQ ID NO: 184938 - RNA, 22 nt, Human
aucugugguacaugacggcugc

SEQ ID NO: 184939 - RNA, 22 nt, Human
aucuguggguaaggauaagcau

SEQ ID NO: 184940 - RNA, 22 nt, Human
aucuguuccccuaugcucucua

SEQ ID NO: 184941 - RNA, 22 nt, Human
aucugugauuuuggcaagauuu

SEQ ID NO: 184942 - RNA, 22 nt, Human
augaauuugaacaccagguugg

SEQ ID NO: 184943 - RNA, 22 nt, Human
augaauuaucugguguuggaaa

SEQ ID NO: 184944 - RNA, 20 nt, Human
augaaugcuccccacguuuc

SEQ ID NO: 184945 - RNA, 22 nt, Human
augaacugcaguauaaacuugg

SEQ ID NO: 184946 - RNA, 22 nt, Human
augauaccacucaauagggcau

SEQ ID NO: 184947 - RNA, 22 nt, Human
augcaaaaucuuauuuuuucua

SEQ ID NO: 184948 - RNA, 23 nt, Human
augcaacauugccaguaugggca

SEQ ID NO: 184949 - RNA, 22 nt, Human
aucuuuguaaguaaucaaagcu

SEQ ID NO: 184950 - RNA, 23 nt, Human
augaacgcacugagaucauaauu

SEQ ID NO: 184951 - RNA, 22 nt, Human
augaaacuggagcgccuggagg

SEQ ID NO: 184952 - RNA, 19 nt, Human
augaaauagcauuuucuga

SEQ ID NO: 184953 - RNA, 19 nt, Human
augcaauguuaucaauaac

SEQ ID NO: 184954 - RNA, 21 nt, Human
augagguggcuacuaaagagu

SEQ ID NO: 184955 - RNA, 22 nt, Human
augaggccacaguuauagauuu

SEQ ID NO: 184956 - RNA, 22 nt, Human
augcaccugucuuuuaaggaua

SEQ ID NO: 184957 - RNA, 22 nt, Human
augauuacagcaugauguuuca

SEQ ID NO: 184958 - RNA, 22 nt, Human
augcaguuagguaauagucuca

SEQ ID NO: 184959 - RNA, 22 nt, Human
augcauaucuccuaucuccuca

SEQ ID NO: 184960 - RNA, 22 nt, Human
augaggguggggaaugggccau

SEQ ID NO: 184961 - RNA, 22 nt, Human
augaguuaaguagcccuucaug

SEQ ID NO: 184962 - RNA, 18 nt, Human
augauaauguuugcauca

SEQ ID NO: 184963 - RNA, 22 nt, Human
auguaccgccuuggagaaaugc

SEQ ID NO: 184964 - RNA, 22 nt, Human
augugcucaggucuauaucuca

SEQ ID NO: 184965 - RNA, 22 nt, Human
auguaaugucaaucuucagugg

SEQ ID NO: 184966 - RNA, 22 nt, Human
auguccugacaguccaagggcg

SEQ ID NO: 184967 - RNA, 19 nt, Human
augguauugcuggguuuuu

SEQ ID NO: 184968 - RNA, 22 nt, Human
augggugggagugaaggggcuc

SEQ ID NO: 184969 - RNA, 22 nt, Human
auggugaugaugaugaugauaa

SEQ ID NO: 184970 - RNA, 22 nt, Human
auguccugguccacagaaggga

SEQ ID NO: 184971 - RNA, 22 nt, Human
auggugugugugugugugugug

SEQ ID NO: 184972 - RNA, 22 nt, Human
augggagggagcagugaguguu

SEQ ID NO: 184973 - RNA, 19 nt, Human
augggaagcggccagcgga

SEQ ID NO: 184974 - RNA, 22 nt, Human
augggaauggauugagugggug

SEQ ID NO: 184975 - RNA, 22 nt, Human
auggugaaaugauuugauguca

SEQ ID NO: 184976 - RNA, 22 nt, Human
auggucugcucagucucuugac

SEQ ID NO: 184977 - RNA, 22 nt, Human
augguaaguuuuuaaaaagcgu

SEQ ID NO: 184978 - RNA, 22 nt, Human
augguguaggugaagagaacau

SEQ ID NO: 184979 - RNA, 22 nt, Human
auggggaggcggauggagugcu

SEQ ID NO: 184980 - RNA, 18 nt, Human
augggggaggaggaaagg

SEQ ID NO: 184981 - RNA, 22 nt, Human
auggggaauugaccguggaucu

SEQ ID NO: 184982 - RNA, 22 nt, Human
auggggaucugcaguguugauc

SEQ ID NO: 184983 - RNA, 22 nt, Human
augggagggugaggaggcagcu

SEQ ID NO: 184984 - RNA, 22 nt, Human
augggcauggauggccgagucu

SEQ ID NO: 184985 - RNA, 22 nt, Human
auguguguaugugugcauguau

SEQ ID NO: 184986 - RNA, 22 nt, Human
auguguguaugacugaaucuau

SEQ ID NO: 184987 - RNA, 22 nt, Human
augugucauuauccagaauaac

SEQ ID NO: 184988 - RNA, 23 nt, Human
auguagcugcucccgaugcccuc

SEQ ID NO: 184989 - RNA, 22 nt, Human
augugugugcgagcgugugugu

SEQ ID NO: 184990 - RNA, 22 nt, Human
augugggguaggaggggggaau

SEQ ID NO: 184991 - RNA, 23 nt, Human
augugaggcaaaggcaggcacuc

SEQ ID NO: 184992 - RNA, 22 nt, Human
augugauacuccuucuagugga

SEQ ID NO: 184993 - RNA, 22 nt, Human
auguaugagagauucuuuuauu

SEQ ID NO: 184994 - RNA, 22 nt, Human
auguauguauguauauacacac

SEQ ID NO: 184995 - RNA, 22 nt, Human
auguugcugauccuguggcugu

SEQ ID NO: 184996 - RNA, 22 nt, Human
augugcacuggugugugcguuc

SEQ ID NO: 184997 - RNA, 22 nt, Human
auguuguuuauggguuaucaag

SEQ ID NO: 184998 - RNA, 22 nt, Human
augugccugagggcuccuugug

SEQ ID NO: 184999 - RNA, 22 nt, Human
auuaaagcaugaauaauaugua

SEQ ID NO: 185000 - RNA, 22 nt, Human
auuaaacuaaauuaugaauugg

SEQ ID NO: 185001 - RNA, 22 nt, Human
auuaaaaaaagauaaugaguua

SEQ ID NO: 185002 - RNA, 22 nt, Human
auguuuucuugucuggagaagu

SEQ ID NO: 185003 - RNA, 22 nt, Human
auguuuaauuugaaauuuuauu

SEQ ID NO: 185004 - RNA, 20 nt, Human
augugcuaauauuaauaugu

SEQ ID NO: 185005 - RNA, 22 nt, Human
augugccuuaauauaggcgcug

SEQ ID NO: 185006 - RNA, 22 nt, Human
augauuuguuaacagacuuaau

SEQ ID NO: 185007 - RNA, 22 nt, Human
augcccagaacccccuggaugg

SEQ ID NO: 185008 - RNA, 22 nt, Human
augccacuguuuaugucacuua

SEQ ID NO: 185009 - RNA, 22 nt, Human
augcugccuccucuucagccgc

SEQ ID NO: 185010 - RNA, 22 nt, Human
augcuuuauuggagacagucau

SEQ ID NO: 185011 - RNA, 22 nt, Human
augcccugggagugcuguacca

SEQ ID NO: 185012 - RNA, 22 nt, Human
augcaugaucccgguaugugaa

SEQ ID NO: 185013 - RNA, 22 nt, Human
auggaggagcagaggguuucca

SEQ ID NO: 185014 - RNA, 22 nt, Human
auggagcagagcugaugggccu

SEQ ID NO: 185015 - RNA, 22 nt, Human
auggagcgggaggauggaggag

SEQ ID NO: 185016 - RNA, 22 nt, Human
auggagggguuguugcuugagu

SEQ ID NO: 185017 - RNA, 22 nt, Human
auggaaggggagguagggagga

SEQ ID NO: 185018 - RNA, 22 nt, Human
augcuuucucuucuauuucuca

SEQ ID NO: 185019 - RNA, 22 nt, Human
augggcuuuacccucagagcuu

SEQ ID NO: 185020 - RNA, 22 nt, Human
augggcggugcauuugcacagu

SEQ ID NO: 185021 - RNA, 22 nt, Human
auggggucagagaauggugggu

SEQ ID NO: 185022 - RNA, 22 nt, Human
augggggccagggacccuggca

SEQ ID NO: 185023 - RNA, 22 nt, Human
auggacguuuguguauuaugua

SEQ ID NO: 185024 - RNA, 22 nt, Human
auggaguguggccaggcaguaa

SEQ ID NO: 185025 - RNA, 22 nt, Human
auggagugggaggacaugaagg

SEQ ID NO: 185026 - RNA, 22 nt, Human
auggaggaugugcagcaugggc

SEQ ID NO: 185027 - RNA, 22 nt, Human
auggauggaagcagccugaacu

SEQ ID NO: 185028 - RNA, 22 nt, Human
augggcauacaaaugcuacccu

SEQ ID NO: 185029 - RNA, 22 nt, Human
auggaacauuaaucuucaaaug

SEQ ID NO: 185030 - RNA, 22 nt, Human
auggaacccgggcgucugcucu

SEQ ID NO: 185031 - RNA, 22 nt, Human
auggaagagacaaugcuaucug

SEQ ID NO: 185032 - RNA, 22 nt, Human
auggcagcggagcuggaaauga

SEQ ID NO: 185033 - RNA, 22 nt, Human
auggauuggguugauggcauac

SEQ ID NO: 185034 - RNA, 22 nt, Human
auggcaucuucgguuggacugc

SEQ ID NO: 185035 - RNA, 22 nt, Human
augggaggguagagugaacaga

SEQ ID NO: 185036 - RNA, 20 nt, Human
auggaaacacgcagccccaa

SEQ ID NO: 185037 - RNA, 22 nt, Human
cagguggccggguaggaggugg

SEQ ID NO: 185038 - RNA, 20 nt, Human
cagguugcugcccccgccuc

SEQ ID NO: 185039 - RNA, 22 nt, Human
caggagagucucugucuguacu

SEQ ID NO: 185040 - RNA, 22 nt, Human
cagguggauggcgagcccugca

SEQ ID NO: 185041 - RNA, 19 nt, Human
caggacaguuugccaagaa

SEQ ID NO: 185042 - RNA, 22 nt, Human
caggacacaaaagguggagaag

SEQ ID NO: 185043 - RNA, 22 nt, Human
caggacagaaauaaggaauaua

SEQ ID NO: 185044 - RNA, 22 nt, Human
caggaagucugaauucugagag

SEQ ID NO: 185045 - RNA, 22 nt, Human
caggaacucuucugggugcuug

SEQ ID NO: 185046 - RNA, 22 nt, Human
cagugcuggaggggugcuugca

SEQ ID NO: 185047 - RNA, 22 nt, Human
cagugcucauagcuguuccucc

SEQ ID NO: 185048 - RNA, 22 nt, Human
caggcacagcuaagacuggcca

SEQ ID NO: 185049 - RNA, 22 nt, Human
caguggacacuuccucuacaau

SEQ ID NO: 185050 - RNA, 22 nt, Human
cagucugcuggcuuuuucagca

SEQ ID NO: 185051 - RNA, 22 nt, Human
cagugccggccaggaccuccug

SEQ ID NO: 185052 - RNA, 20 nt, Human
cagugcccguggaaaagaug

SEQ ID NO: 185053 - RNA, 22 nt, Human
cagguuuuccuuuuaaaaggaa

SEQ ID NO: 185054 - RNA, 22 nt, Human
caggcacaagaucggcuagaua

SEQ ID NO: 185055 - RNA, 22 nt, Human
caggauuuaauaagauaguguu

SEQ ID NO: 185056 - RNA, 22 nt, Human
caggaggaggccgggaggaagc

SEQ ID NO: 185057 - RNA, 22 nt, Human
caguucuguaccaggagaagcu

SEQ ID NO: 185058 - RNA, 22 nt, Human
caguugcuauugagagaacaca

SEQ ID NO: 185059 - RNA, 21 nt, Human
caguucuaagugucaucuuuu

SEQ ID NO: 185060 - RNA, 22 nt, Human
caguucacggcugguaugaauu

SEQ ID NO: 185061 - RNA, 22 nt, Human
caguuuccagacauuauugaua

SEQ ID NO: 185062 - RNA, 21 nt, Human
caguuugcuauuuuaguauga

SEQ ID NO: 185063 - RNA, 22 nt, Human
caggggcuccaggugagccugg

SEQ ID NO: 185064 - RNA, 22 nt, Human
caguguuuagcacagugcuugg

SEQ ID NO: 185065 - RNA, 22 nt, Human
caguuaaugauaggaauucggu

SEQ ID NO: 185066 - RNA, 22 nt, Human
cauauacauauacaugcauaca

SEQ ID NO: 185067 - RNA, 22 nt, Human
caggugggauuuugcugcuuga

SEQ ID NO: 185068 - RNA, 22 nt, Human
cauauuaugcauguuguucuuu

SEQ ID NO: 185069 - RNA, 22 nt, Human
cauaucuccagguucugcugga

SEQ ID NO: 185070 - RNA, 22 nt, Human
cauaucuuaaacaucaucucug

SEQ ID NO: 185071 - RNA, 22 nt, Human
caguuuuucaaaauuacaugau

SEQ ID NO: 185072 - RNA, 22 nt, Human
cauaaucaagggguugugaugu

SEQ ID NO: 185073 - RNA, 22 nt, Human
cauaagaauauuuaguggcagc

SEQ ID NO: 185074 - RNA, 22 nt, Human
caggugauuuuguuuucaaaug

SEQ ID NO: 185075 - RNA, 22 nt, Human
caggaacucggagcccaucucu

SEQ ID NO: 185076 - RNA, 22 nt, Human
caggaacagcaccaggagcuag

SEQ ID NO: 185077 - RNA, 22 nt, Human
cagcaugguggagcugcucuuu

SEQ ID NO: 185078 - RNA, 22 nt, Human
cagcauggagacaaagugggca

SEQ ID NO: 185079 - RNA, 22 nt, Human
cagcauugagcacagaaggaaa

SEQ ID NO: 185080 - RNA, 22 nt, Human
caggagaaauucacauuaguga

SEQ ID NO: 185081 - RNA, 21 nt, Human
cagcccccauacccugcccag

SEQ ID NO: 185082 - RNA, 22 nt, Human
cagccgcucaugggcccggagc

SEQ ID NO: 185083 - RNA, 22 nt, Human
cagagcugagucuucaagguug

SEQ ID NO: 185084 - RNA, 22 nt, Human
cagcuucaaaggcccugauggu

SEQ ID NO: 185085 - RNA, 22 nt, Human
cagcuucacuuaaaacaugcaa

SEQ ID NO: 185086 - RNA, 22 nt, Human
cagcuauggaauuggcccagau

SEQ ID NO: 185087 - RNA, 22 nt, Human
cagccuuuucuuaaaaugcaag

SEQ ID NO: 185088 - RNA, 22 nt, Human
cagcgguggcaaggugacugug

SEQ ID NO: 185089 - RNA, 22 nt, Human
cagcuggaggagcagcuuccag

SEQ ID NO: 185090 - RNA, 22 nt, Human
cagcugcgcagcgccgggccug

SEQ ID NO: 185091 - RNA, 22 nt, Human
cagcugcugguguaucgggucc

SEQ ID NO: 185092 - RNA, 22 nt, Human
cagcuguacgugaucuacaugg

SEQ ID NO: 185093 - RNA, 22 nt, Human
cagcuguauuucucugguuaga

SEQ ID NO: 185094 - RNA, 22 nt, Human
caggguuuuauuuggcuuuaaa

SEQ ID NO: 185095 - RNA, 22 nt, Human
caggguuuuaguugcagguuau

SEQ ID NO: 185096 - RNA, 22 nt, Human
caggugcucugauauggggcug

SEQ ID NO: 185097 - RNA, 22 nt, Human
cagcuugcccugauguggaaga

SEQ ID NO: 185098 - RNA, 22 nt, Human
caggcgcugacgggaccgggcu

SEQ ID NO: 185099 - RNA, 20 nt, Human
caggccuucaggauggcugg

SEQ ID NO: 185100 - RNA, 22 nt, Human
cagggaaguauuacauguuucc

SEQ ID NO: 185101 - RNA, 22 nt, Human
cagggacgugagccaugucagu

SEQ ID NO: 185102 - RNA, 22 nt, Human
caggauauguucaagguuuucu

SEQ ID NO: 185103 - RNA, 19 nt, Human
caggauuguuuaaagcuuu

SEQ ID NO: 185104 - RNA, 22 nt, Human
caggaguggugagguuagcaga

SEQ ID NO: 185105 - RNA, 22 nt, Human
cagcuacuaccuguagacaaag

SEQ ID NO: 185106 - RNA, 22 nt, Human
cagaaaacauuguguguauaag

SEQ ID NO: 185107 - RNA, 22 nt, Human
cacuugauugucagaaaaaugg

SEQ ID NO: 185108 - RNA, 22 nt, Human
cacauaguuuaucuucauuuuc

SEQ ID NO: 185109 - RNA, 19 nt, Human
cacagcccucacuuuuagc

SEQ ID NO: 185110 - RNA, 22 nt, Human
cacaguuuuaucuuauacugau

SEQ ID NO: 185111 - RNA, 22 nt, Human
cacagcuggggaagcugaggcc

SEQ ID NO: 185112 - RNA, 22 nt, Human
cagacacgucccuguugaccug

SEQ ID NO: 185113 - RNA, 22 nt, Human
cagacagaaggcuccuugaggu

SEQ ID NO: 185114 - RNA, 22 nt, Human
cagaacugaauaaagccaggau

SEQ ID NO: 185115 - RNA, 17 nt, Human
cacauggagcuuguugc

SEQ ID NO: 185116 - RNA, 22 nt, Human
cacaugugggcacagggcugca

SEQ ID NO: 185117 - RNA, 22 nt, Human
cacauuaagcccaagcauagaa

SEQ ID NO: 185118 - RNA, 22 nt, Human
cacaucugaaggcggcucuagg

SEQ ID NO: 185119 - RNA, 22 nt, Human
cacaucaaacuuacuaagauuu

SEQ ID NO: 185120 - RNA, 22 nt, Human
caccaaaauaucccuuuguaca

SEQ ID NO: 185121 - RNA, 22 nt, Human
cacauuuuccagaagaaucaga

SEQ ID NO: 185122 - RNA, 22 nt, Human
cacaugugugugccuacaugca

SEQ ID NO: 185123 - RNA, 22 nt, Human
cacacagcuagugacaggagaa

SEQ ID NO: 185124 - RNA, 23 nt, Human
cacuggugggguuuaaaagaagc

SEQ ID NO: 185125 - RNA, 22 nt, Human
cacugcugaggcccguguuacu

SEQ ID NO: 185126 - RNA, 22 nt, Human
cacugcguaguggcccgaagcu

SEQ ID NO: 185127 - RNA, 22 nt, Human
cacagaauuaagggagaaauau

SEQ ID NO: 185128 - RNA, 22 nt, Human
cacagauaaggcuuugucccca

SEQ ID NO: 185129 - RNA, 22 nt, Human
cacuuagugcuuuuguguuucu

SEQ ID NO: 185130 - RNA, 22 nt, Human
cacuuaaaauucagggcuuaua

SEQ ID NO: 185131 - RNA, 22 nt, Human
cacugugagugcaagcaggggu

SEQ ID NO: 185132 - RNA, 22 nt, Human
cacagcaggcagaacgugggca

SEQ ID NO: 185133 - RNA, 18 nt, Human
cacagcauccaaguuaug

SEQ ID NO: 185134 - RNA, 22 nt, Human
caaugggagaugcagaacagcu

SEQ ID NO: 185135 - RNA, 22 nt, Human
cacgggcgacgugaucuaggac

SEQ ID NO: 185136 - RNA, 22 nt, Human
cacucuucucucauuuuccuuu

SEQ ID NO: 185137 - RNA, 22 nt, Human
caaagaaccuucgagacagggc

SEQ ID NO: 185138 - RNA, 22 nt, Human
caaacauuuguuggaaccccug

SEQ ID NO: 185139 - RNA, 22 nt, Human
cacugguugccucuuucuguuc

SEQ ID NO: 185140 - RNA, 22 nt, Human
cacuguugaagauacuuccucu

SEQ ID NO: 185141 - RNA, 22 nt, Human
cacugcacuccagccugggcaa

SEQ ID NO: 185142 - RNA, 22 nt, Human
cagagaagaggucuugaccccu

SEQ ID NO: 185143 - RNA, 22 nt, Human
cagacgguuaaacgauuuugcu

SEQ ID NO: 185144 - RNA, 23 nt, Human
cagagaaaauagaauaugcugug

SEQ ID NO: 185145 - RNA, 22 nt, Human
caccgaacuuugcaaaugcaau

SEQ ID NO: 185146 - RNA, 22 nt, Human
cagaccagaaggaagccgacaa

SEQ ID NO: 185147 - RNA, 22 nt, Human
caccuuccgcccacugaccgcc

SEQ ID NO: 185148 - RNA, 22 nt, Human
caccccauccccucccaauucc

SEQ ID NO: 185149 - RNA, 22 nt, Human
cacccugacuggcccugcagga

SEQ ID NO: 185150 - RNA, 22 nt, Human
cacccgacugaggacgccgccc

SEQ ID NO: 185151 - RNA, 20 nt, Human
cacccgguccucagcgacuc

SEQ ID NO: 185152 - RNA, 22 nt, Human
caccagcgacugugaccagcaa

SEQ ID NO: 185153 - RNA, 22 nt, Human
caccaccaguaccaucacacgc

SEQ ID NO: 185154 - RNA, 22 nt, Human
cagcauucuacuuugugaacug

SEQ ID NO: 185155 - RNA, 22 nt, Human
cagaaguugcuugagagagagc

SEQ ID NO: 185156 - RNA, 22 nt, Human
cagcccuggccucuucgcuuuc

SEQ ID NO: 185157 - RNA, 22 nt, Human
cagagaggagcacaaagugaag

SEQ ID NO: 185158 - RNA, 22 nt, Human
cagagagcguccauccggugcc

SEQ ID NO: 185159 - RNA, 22 nt, Human
cagaccuggaaaacaggcuugc

SEQ ID NO: 185160 - RNA, 22 nt, Human
cagccccucuucucuccucgga

SEQ ID NO: 185161 - RNA, 22 nt, Human
cacuguugagcaauguacagug

SEQ ID NO: 185162 - RNA, 22 nt, Human
cacuucaguacuagaggaugaa

SEQ ID NO: 185163 - RNA, 22 nt, Human
cacuuauuuuuccuuugugauu

SEQ ID NO: 185164 - RNA, 22 nt, Human
cagaaagaaguggggauagagg

SEQ ID NO: 185165 - RNA, 22 nt, Human
cagaaagugauuugcuauucca

SEQ ID NO: 185166 - RNA, 22 nt, Human
cagcagaggagguggcagcacc

SEQ ID NO: 185167 - RNA, 22 nt, Human
cagcagccuccccggccgaccu

SEQ ID NO: 185168 - RNA, 22 nt, Human
cagcacuuccuccgugagcccc

SEQ ID NO: 185169 - RNA, 20 nt, Human
cagcagucagcucuccaaug

SEQ ID NO: 185170 - RNA, 22 nt, Human
cagaaauuggcagagaagaccu

SEQ ID NO: 185171 - RNA, 22 nt, Human
cauugcugugggcauuugcugc

SEQ ID NO: 185172 - RNA, 22 nt, Human
cauugcuguuaauugucucuag

SEQ ID NO: 185173 - RNA, 19 nt, Human
ccagaagggcaagcaaagg

SEQ ID NO: 185174 - RNA, 22 nt, Human
ccagaauuugaacccacaaaug

SEQ ID NO: 185175 - RNA, 22 nt, Human
cauugcaaccccaaaaagaaca

SEQ ID NO: 185176 - RNA, 22 nt, Human
cauuccuaccauaucugcucuu

SEQ ID NO: 185177 - RNA, 22 nt, Human
ccagaacguuugugcgaggcag

SEQ ID NO: 185178 - RNA, 22 nt, Human
ccacuuugagaagcugaugaaa

SEQ ID NO: 185179 - RNA, 22 nt, Human
cauugcaaccauuccaaauggc

SEQ ID NO: 185180 - RNA, 22 nt, Human
ccagacuggggauuuugccagg

SEQ ID NO: 185181 - RNA, 22 nt, Human
cauuggcacauguauucugggc

SEQ ID NO: 185182 - RNA, 22 nt, Human
ccagaggcuuaugcagcugcug

SEQ ID NO: 185183 - RNA, 22 nt, Human
ccagagcaccgaaacgagcuuu

SEQ ID NO: 185184 - RNA, 22 nt, Human
cauugggcggggaccucggcug

SEQ ID NO: 185185 - RNA, 22 nt, Human
cauuuagagaagauuacaagga

SEQ ID NO: 185186 - RNA, 22 nt, Human
cauuuaucacuugcuaaacaua

SEQ ID NO: 185187 - RNA, 22 nt, Human
cauuucuggccuggggagcggg

SEQ ID NO: 185188 - RNA, 22 nt, Human
cauuuuccucugcugguguuca

SEQ ID NO: 185189 - RNA, 22 nt, Human
ccagcaugcucagucuaaauug

SEQ ID NO: 185190 - RNA, 22 nt, Human
ccagccacagcuuccagcuccu

SEQ ID NO: 185191 - RNA, 22 nt, Human
ccagccacugacugauuuaaaa

SEQ ID NO: 185192 - RNA, 22 nt, Human
ccagcaucagcucuuggcuggc

SEQ ID NO: 185193 - RNA, 22 nt, Human
ccagcaaguaagucagugucag

SEQ ID NO: 185194 - RNA, 22 nt, Human
ccagcagaagcucccgcugggu

SEQ ID NO: 185195 - RNA, 22 nt, Human
ccagcaggagacuagcaacaua

SEQ ID NO: 185196 - RNA, 22 nt, Human
cauuuuuccucaggcaauuuga

SEQ ID NO: 185197 - RNA, 22 nt, Human
cauuuugguaauguucguuugc

SEQ ID NO: 185198 - RNA, 22 nt, Human
ccaaagaagcaaugagaauagu

SEQ ID NO: 185199 - RNA, 22 nt, Human
ccaggaguccgugggucuugag

SEQ ID NO: 185200 - RNA, 22 nt, Human
ccaggcagaggggucuggagca

SEQ ID NO: 185201 - RNA, 22 nt, Human
ccagcugggucccugcuggggc

SEQ ID NO: 185202 - RNA, 23 nt, Human
ccagcugugccuggcccaggagc

SEQ ID NO: 185203 - RNA, 22 nt, Human
ccaaggcugcagccgugacgcg

SEQ ID NO: 185204 - RNA, 22 nt, Human
ccagucuuggugucuguagcac

SEQ ID NO: 185205 - RNA, 22 nt, Human
ccagugcagacgcggaacuggc

SEQ ID NO: 185206 - RNA, 22 nt, Human
ccaaccaguuucuuggcuuuag

SEQ ID NO: 185207 - RNA, 22 nt, Human
ccagucagccuaguucuucuuu

SEQ ID NO: 185208 - RNA, 22 nt, Human
ccagugcuuccaggaauacggu

SEQ ID NO: 185209 - RNA, 22 nt, Human
ccacagcauugaaaucuauaau

SEQ ID NO: 185210 - RNA, 22 nt, Human
ccaguguguuuuucucugacuc

SEQ ID NO: 185211 - RNA, 22 nt, Human
ccaaggcuggagggcuuaugua

SEQ ID NO: 185212 - RNA, 19 nt, Human
ccaacaguacugaagcacu

SEQ ID NO: 185213 - RNA, 22 nt, Human
ccaaagaauuuggaaaaucuga

SEQ ID NO: 185214 - RNA, 22 nt, Human
ccaaauuaccuucuuggauuca

SEQ ID NO: 185215 - RNA, 22 nt, Human
ccaaccaguuaucuccuaaggu

SEQ ID NO: 185216 - RNA, 22 nt, Human
ccagggcuggguuugucggugu

SEQ ID NO: 185217 - RNA, 22 nt, Human
ccaggggagagucugagucguu

SEQ ID NO: 185218 - RNA, 22 nt, Human
ccagggaagaaagaugaagugc

SEQ ID NO: 185219 - RNA, 22 nt, Human
ccacuuucuaaauuggcgauuu

SEQ ID NO: 185220 - RNA, 22 nt, Human
ccauuucacaucccugacaugu

SEQ ID NO: 185221 - RNA, 22 nt, Human
ccaugggugucuggagcacccu

SEQ ID NO: 185222 - RNA, 22 nt, Human
ccauggauacuaagguauguga

SEQ ID NO: 185223 - RNA, 18 nt, Human
cccaccugcccagguuca

SEQ ID NO: 185224 - RNA, 22 nt, Human
cccacccuacugcuacccagga

SEQ ID NO: 185225 - RNA, 22 nt, Human
cccagaagaguauguguuugcu

SEQ ID NO: 185226 - RNA, 22 nt, Human
cccacgccuucuuucuucaaau

SEQ ID NO: 185227 - RNA, 20 nt, Human
ccagaagagaagaaaaggaa

SEQ ID NO: 185228 - RNA, 22 nt, Human
ccagaacgacgggcagaggcgc

SEQ ID NO: 185229 - RNA, 21 nt, Human
ccacaucaugucaccuccuag

SEQ ID NO: 185230 - RNA, 22 nt, Human
ccaccacauuugccuagacuuu

SEQ ID NO: 185231 - RNA, 22 nt, Human
ccauaaaguaggaaacacuaca

SEQ ID NO: 185232 - RNA, 22 nt, Human
ccaguuguggagaauuguuuga

SEQ ID NO: 185233 - RNA, 22 nt, Human
ccauaaaagagaaucuaaauga

SEQ ID NO: 185234 - RNA, 22 nt, Human
ccaucuuugcucuuuuauugca

SEQ ID NO: 185235 - RNA, 22 nt, Human
ccauggaaaagacgggcaggcc

SEQ ID NO: 185236 - RNA, 22 nt, Human
ccacccacuucucugcccucca

SEQ ID NO: 185237 - RNA, 22 nt, Human
ccaccucuaccuggccggccuu

SEQ ID NO: 185238 - RNA, 22 nt, Human
ccacccugguuacugugccagg

SEQ ID NO: 185239 - RNA, 22 nt, Human
caucaggcugggaacacagauc

SEQ ID NO: 185240 - RNA, 22 nt, Human
caucagucugaaagccagggag

SEQ ID NO: 185241 - RNA, 22 nt, Human
cagguugaaaguggaggagcua

SEQ ID NO: 185242 - RNA, 22 nt, Human
caucaauagguauuugagagac

SEQ ID NO: 185243 - RNA, 22 nt, Human
cauguguauuauucuuguggaa

SEQ ID NO: 185244 - RNA, 22 nt, Human
cauguggaaaugcaugcuuuuu

SEQ ID NO: 185245 - RNA, 22 nt, Human
caugugcaucagccaauuggag

SEQ ID NO: 185246 - RNA, 22 nt, Human
caugugacuuagguuuuaucac

SEQ ID NO: 185247 - RNA, 22 nt, Human
cagguuuuuauuacaacuuuga

SEQ ID NO: 185248 - RNA, 22 nt, Human
cauuauucaggcuuuggaauuu

SEQ ID NO: 185249 - RNA, 22 nt, Human
cauaguuuguucuuuuuuauug

SEQ ID NO: 185250 - RNA, 21 nt, Human
caucaagaucaauggagggcu

SEQ ID NO: 185251 - RNA, 22 nt, Human
caucacggagcaugagaagaca

SEQ ID NO: 185252 - RNA, 22 nt, Human
cauuccaaguauauacaugaua

SEQ ID NO: 185253 - RNA, 22 nt, Human
cauucauaagacuuugcucuug

SEQ ID NO: 185254 - RNA, 22 nt, Human
caucaguaaaguacuuuuaugu

SEQ ID NO: 185255 - RNA, 20 nt, Human
cauuccugaggaauucaugu

SEQ ID NO: 185256 - RNA, 22 nt, Human
cauuccuucucagguacuggca

SEQ ID NO: 185257 - RNA, 22 nt, Human
cauugcugccaaggugagcugg

SEQ ID NO: 185258 - RNA, 22 nt, Human
cauugcaucuuuuauggguaag

SEQ ID NO: 185259 - RNA, 22 nt, Human
caucucagguuuguucugagac

SEQ ID NO: 185260 - RNA, 22 nt, Human
caucgagaauuggcagcuaaag

SEQ ID NO: 185261 - RNA, 22 nt, Human
cauugguacaaaauguacuuug

SEQ ID NO: 185262 - RNA, 22 nt, Human
cauuuaaccccuugguacugaa

SEQ ID NO: 185263 - RNA, 22 nt, Human
cauuuacguaacaguaacgcug

SEQ ID NO: 185264 - RNA, 22 nt, Human
cauuuacauaacaguaacgcug

SEQ ID NO: 185265 - RNA, 22 nt, Human
cauuuucugcaagucugcucaa

SEQ ID NO: 185266 - RNA, 22 nt, Human
cauuugcuuaucacucuucuuu

SEQ ID NO: 185267 - RNA, 22 nt, Human
cauuuuaucagcacacgucacu

SEQ ID NO: 185268 - RNA, 22 nt, Human
caugaggauccuccaggggaaa

SEQ ID NO: 185269 - RNA, 22 nt, Human
cauuugacaauugggauagauc

SEQ ID NO: 185270 - RNA, 23 nt, Human
cauuugauccucacaauaaaugg

SEQ ID NO: 185271 - RNA, 20 nt, Human
caugaguccgugaguggccc

SEQ ID NO: 185272 - RNA, 22 nt, Human
cauuucuugugagccgcauccu

SEQ ID NO: 185273 - RNA, 22 nt, Human
cauugucaaguggccgggucuu

SEQ ID NO: 185274 - RNA, 22 nt, Human
caugaacucucggguuuggaau

SEQ ID NO: 185275 - RNA, 22 nt, Human
caucuuuguuuuggauauaauc

SEQ ID NO: 185276 - RNA, 22 nt, Human
caugaauaauucuuuuucuugg

SEQ ID NO: 185277 - RNA, 22 nt, Human
caugaagugaaaagguuaauuu

SEQ ID NO: 185278 - RNA, 22 nt, Human
caugaugaacugugcuguuagg

SEQ ID NO: 185279 - RNA, 22 nt, Human
caugauaacacuucuguuuaau

SEQ ID NO: 185280 - RNA, 22 nt, Human
caugccugaucagcggccagca

SEQ ID NO: 185281 - RNA, 22 nt, Human
caugcagcagaauaaugacuau

SEQ ID NO: 185282 - RNA, 22 nt, Human
caugcagauugccaggcucccu

SEQ ID NO: 185283 - RNA, 22 nt, Human
caugaugagaguaauaacacag

SEQ ID NO: 185284 - RNA, 22 nt, Human
caugauguuaucaagcacaaag

SEQ ID NO: 185285 - RNA, 22 nt, Human
cauuuuuuuuccccuccuggua

SEQ ID NO: 185286 - RNA, 22 nt, Human
ccaaacauuucaaauuuagaga

SEQ ID NO: 185287 - RNA, 22 nt, Human
cauggcggcgcucucccugccu

SEQ ID NO: 185288 - RNA, 22 nt, Human
cauggcaggugcagauucugug

SEQ ID NO: 185289 - RNA, 22 nt, Human
caugggcucuucuggacugcac

SEQ ID NO: 185290 - RNA, 22 nt, Human
caugcuggcacugaccagccua

SEQ ID NO: 185291 - RNA, 23 nt, Human
cauguacacacagcuguacagug

SEQ ID NO: 185292 - RNA, 22 nt, Human
caugccucuguuuuaguuguug

SEQ ID NO: 185293 - RNA, 22 nt, Human
caugucaagacugaagauccag

SEQ ID NO: 185294 - RNA, 22 nt, Human
ccaaucaacuguguggcuuucu

SEQ ID NO: 185295 - RNA, 22 nt, Human
ccaauguuaggcucugguuuua

SEQ ID NO: 185296 - RNA, 19 nt, Human
ccacacacuggucucuggg

SEQ ID NO: 185297 - RNA, 22 nt, Human
ccaauuuuggaauuauuaggca

SEQ ID NO: 185298 - RNA, 22 nt, Human
caugugguauugugagauccac

SEQ ID NO: 185299 - RNA, 22 nt, Human
cauguguuucuuaagccaggcc

SEQ ID NO: 185300 - RNA, 22 nt, Human
ccacucagaagaaacaagagag

SEQ ID NO: 185301 - RNA, 22 nt, Human
ccaccuggcagcaggcucggca

SEQ ID NO: 185302 - RNA, 20 nt, Human
cauuccaugcaucuuggucc

SEQ ID NO: 185303 - RNA, 22 nt, Human
cauucauagaaucaguuuggga

SEQ ID NO: 185304 - RNA, 22 nt, Human
cauuaccuggggagaggauacc

SEQ ID NO: 185305 - RNA, 22 nt, Human
cauuagugaggggcugccugcu

SEQ ID NO: 185306 - RNA, 22 nt, Human
cauuauacaugaagacucaccc

SEQ ID NO: 185307 - RNA, 22 nt, Human
ccaccacugaggcacaggagcc

SEQ ID NO: 185308 - RNA, 22 nt, Human
ccugugacucugucugaugguc

SEQ ID NO: 185309 - RNA, 22 nt, Human
ccuuaauaguguucuaauguuu

SEQ ID NO: 185310 - RNA, 21 nt, Human
ccugucagcccaacuuuugga

SEQ ID NO: 185311 - RNA, 23 nt, Human
ccuggcugaccugaagguguagu

SEQ ID NO: 185312 - RNA, 22 nt, Human
ccgcggcugcgcggugccccuc

SEQ ID NO: 185313 - RNA, 22 nt, Human
ccuggccacagggcucugcauu

SEQ ID NO: 185314 - RNA, 22 nt, Human
ccgcggauggggagucaccacc

SEQ ID NO: 185315 - RNA, 22 nt, Human
ccuggcauuagaaauuccguca

SEQ ID NO: 185316 - RNA, 19 nt, Human
ccgagcagauugauguuuc

SEQ ID NO: 185317 - RNA, 22 nt, Human
ccgagaucagaguaggauuugg

SEQ ID NO: 185318 - RNA, 22 nt, Human
ccgagcagggcgcccugcccca

SEQ ID NO: 185319 - RNA, 22 nt, Human
ccgcgcccccggcugugccccc

SEQ ID NO: 185320 - RNA, 21 nt, Human
ccuggagacaaagacagggug

SEQ ID NO: 185321 - RNA, 22 nt, Human
ccggcugcugaggcggccccgg

SEQ ID NO: 185322 - RNA, 20 nt, Human
ccuuuuguugcuguuuggau

SEQ ID NO: 185323 - RNA, 22 nt, Human
ccuuuuagagaagugcauccag

SEQ ID NO: 185324 - RNA, 22 nt, Human
ccggcugagccucgccgcggcc

SEQ ID NO: 185325 - RNA, 22 nt, Human
ccggaggaaauugcauugguug

SEQ ID NO: 185326 - RNA, 22 nt, Human
ccuuucuggucucugagagacu

SEQ ID NO: 185327 - RNA, 22 nt, Human
ccuuugcccugagaaauguucc

SEQ ID NO: 185328 - RNA, 22 nt, Human
ccgcucgggugcagagggcaga

SEQ ID NO: 185329 - RNA, 22 nt, Human
ccuuucucuuggauaccgauug

SEQ ID NO: 185330 - RNA, 22 nt, Human
ccggauuugggagccaccaggg

SEQ ID NO: 185331 - RNA, 22 nt, Human
ccuuggcuuaccuucugugugg

SEQ ID NO: 185332 - RNA, 22 nt, Human
ccgcggcuguaguggaggugga

SEQ ID NO: 185333 - RNA, 22 nt, Human
ccgcgggcagggcuucaccuuu

SEQ ID NO: 185334 - RNA, 22 nt, Human
ccuucuguaccaaggccucaug

SEQ ID NO: 185335 - RNA, 22 nt, Human
ccuucugcuggucaucccagug

SEQ ID NO: 185336 - RNA, 18 nt, Human
ccuucaucucugcuucuu

SEQ ID NO: 185337 - RNA, 22 nt, Human
ccugacucugauuucgcugcau

SEQ ID NO: 185338 - RNA, 22 nt, Human
ccugacgcugauauauaguuaa

SEQ ID NO: 185339 - RNA, 22 nt, Human
ccucucugcgaaugcugauagu

SEQ ID NO: 185340 - RNA, 22 nt, Human
cgcccguacuuugccggcauga

SEQ ID NO: 185341 - RNA, 22 nt, Human
cgccgccgccugcccgcgcccc

SEQ ID NO: 185342 - RNA, 22 nt, Human
cgccgugcagucagcccagaag

SEQ ID NO: 185343 - RNA, 21 nt, Human
cgcccggccggaaaccccuuc

SEQ ID NO: 185344 - RNA, 22 nt, Human
cgccgugucuggucuguacguc

SEQ ID NO: 185345 - RNA, 19 nt, Human
cgcugcucccgcuguggcu

SEQ ID NO: 185346 - RNA, 22 nt, Human
cgcugggugguugauguacagc

SEQ ID NO: 185347 - RNA, 22 nt, Human
ccugagccgagcgcucuuucuc

SEQ ID NO: 185348 - RNA, 22 nt, Human
ccugacuugguuuaggagaugg

SEQ ID NO: 185349 - RNA, 22 nt, Human
cgauuccugauaagugaauaag

SEQ ID NO: 185350 - RNA, 21 nt, Human
ccugagccuguuuauccagaa

SEQ ID NO: 185351 - RNA, 22 nt, Human
ccugaggcccuggcugugcuga

SEQ ID NO: 185352 - RNA, 22 nt, Human
cggagggcccucaggacugggu

SEQ ID NO: 185353 - RNA, 22 nt, Human
cggcugcagcggagcaggcugg

SEQ ID NO: 185354 - RNA, 22 nt, Human
cgggacaauagcagugcugaug

SEQ ID NO: 185355 - RNA, 22 nt, Human
cgggaaguaaacauuauuucag

SEQ ID NO: 185356 - RNA, 22 nt, Human
cgggagagacagaggaggcgcc

SEQ ID NO: 185357 - RNA, 22 nt, Human
cgcuuuccaggcacauccucuu

SEQ ID NO: 185358 - RNA, 22 nt, Human
cggaagcacuagacacugacac

SEQ ID NO: 185359 - RNA, 22 nt, Human
ccugccugggcucacuugccag

SEQ ID NO: 185360 - RNA, 19 nt, Human
ccggucaugcauuccuuug

SEQ ID NO: 185361 - RNA, 22 nt, Human
ccgugcaguuucucacacacau

SEQ ID NO: 185362 - RNA, 22 nt, Human
ccgguguggguuucucgguagu

SEQ ID NO: 185363 - RNA, 22 nt, Human
ccuaacagauugggugacaaua

SEQ ID NO: 185364 - RNA, 21 nt, Human
ccguuauucuucccaccccca

SEQ ID NO: 185365 - RNA, 22 nt, Human
cgaacggcagagagcccguccc

SEQ ID NO: 185366 - RNA, 22 nt, Human
cgaaaaagaagugcaccauguu

SEQ ID NO: 185367 - RNA, 22 nt, Human
ccuuuuuagaugugcgaauguu

SEQ ID NO: 185368 - RNA, 22 nt, Human
ccuauauuacaggcuugcucua

SEQ ID NO: 185369 - RNA, 22 nt, Human
ccuccugggccuugcucuguga

SEQ ID NO: 185370 - RNA, 22 nt, Human
ccucccagccuggagaggagcc

SEQ ID NO: 185371 - RNA, 22 nt, Human
ccuccccugccugugcuguugg

SEQ ID NO: 185372 - RNA, 21 nt, Human
ccuccagccagagggucugga

SEQ ID NO: 185373 - RNA, 22 nt, Human
cgaggagguccaggagcaguag

SEQ ID NO: 185374 - RNA, 22 nt, Human
cgaggccgcuucauggcuggca

SEQ ID NO: 185375 - RNA, 22 nt, Human
cgcccccgaucggggccgccgc

SEQ ID NO: 185376 - RNA, 22 nt, Human
cgcacacaaaugcauacgccag

SEQ ID NO: 185377 - RNA, 22 nt, Human
cgagugauuauucuggcugaga

SEQ ID NO: 185378 - RNA, 22 nt, Human
cuacacgauaaauuuuaguggu

SEQ ID NO: 185379 - RNA, 22 nt, Human
cuaccagcacgccuuccucuac

SEQ ID NO: 185380 - RNA, 22 nt, Human
cuacauaaauuuaucacagacu

SEQ ID NO: 185381 - RNA, 18 nt, Human
cuacauucauaggaaagg

SEQ ID NO: 185382 - RNA, 22 nt, Human
cgaggcuugcaaggacgaggag

SEQ ID NO: 185383 - RNA, 22 nt, Human
cuaaagacagcaagacaucauc

SEQ ID NO: 185384 - RNA, 22 nt, Human
cuaaauuuuuuagugaaauagg

SEQ ID NO: 185385 - RNA, 22 nt, Human
cuaaauucuauauccuugcuuc

SEQ ID NO: 185386 - RNA, 22 nt, Human
cgugucauggcggcgcaggugg

SEQ ID NO: 185387 - RNA, 18 nt, Human
cgauguguaugugauuug

SEQ ID NO: 185388 - RNA, 22 nt, Human
cuacuucuguggcucuaagaga

SEQ ID NO: 185389 - RNA, 22 nt, Human
cgaguaauuggaaauuugcuau

SEQ ID NO: 185390 - RNA, 22 nt, Human
cgagguuuaugaguuuguguuc

SEQ ID NO: 185391 - RNA, 22 nt, Human
cgcacuugugagcgacagggcu

SEQ ID NO: 185392 - RNA, 22 nt, Human
cgcacuggagcuggaacgaguc

SEQ ID NO: 185393 - RNA, 22 nt, Human
cuacugacugaccauaguuuca

SEQ ID NO: 185394 - RNA, 22 nt, Human
cgucauguuauggcucauucua

SEQ ID NO: 185395 - RNA, 22 nt, Human
ccuugauaugcuucagagaauu

SEQ ID NO: 185396 - RNA, 22 nt, Human
cgggagcagcucuggggcuggg

SEQ ID NO: 185397 - RNA, 22 nt, Human
cgggaggcggagcuccgcgggg

SEQ ID NO: 185398 - RNA, 22 nt, Human
cgggcacucagggucgaggugg

SEQ ID NO: 185399 - RNA, 22 nt, Human
ccuggcccagcuggaagcggga

SEQ ID NO: 185400 - RNA, 22 nt, Human
ccuucgcuggcaucuccaggua

SEQ ID NO: 185401 - RNA, 19 nt, Human
ccuggccaacgucaacauu

SEQ ID NO: 185402 - RNA, 22 nt, Human
cgucauuuguaaaugaucaaga

SEQ ID NO: 185403 - RNA, 17 nt, Human
ccuuucugaucaucuga

SEQ ID NO: 185404 - RNA, 21 nt, Human
cgucccggcgugagagagcug

SEQ ID NO: 185405 - RNA, 22 nt, Human
cguggcaguagagcuggaacuu

SEQ ID NO: 185406 - RNA, 17 nt, Human
cgugaggaccaggcagc

SEQ ID NO: 185407 - RNA, 22 nt, Human
cgugaucuguuauauagugagc

SEQ ID NO: 185408 - RNA, 22 nt, Human
cucaugaauggcucuuugugcu

SEQ ID NO: 185409 - RNA, 22 nt, Human
cgcuggagagcaagugcgugca

SEQ ID NO: 185410 - RNA, 22 nt, Human
cgcugcugucaucgucuacggu

SEQ ID NO: 185411 - RNA, 20 nt, Human
cucauugcuuucauuuucuu

SEQ ID NO: 185412 - RNA, 22 nt, Human
cucaugagucugucagagucau

SEQ ID NO: 185413 - RNA, 22 nt, Human
cuccaccucagugucaucuucu

SEQ ID NO: 185414 - RNA, 22 nt, Human
cuccagcucgcgagcucugcuc

SEQ ID NO: 185415 - RNA, 22 nt, Human
cuccgccuguccugggcccacg

SEQ ID NO: 185416 - RNA, 22 nt, Human
cucccugagaugcaggagagag

SEQ ID NO: 185417 - RNA, 22 nt, Human
cucccuucaggggaggacuagg

SEQ ID NO: 185418 - RNA, 22 nt, Human
cuccugauuucuaggccuuauc

SEQ ID NO: 185419 - RNA, 22 nt, Human
cggagcgagaaggggaaagccc

SEQ ID NO: 185420 - RNA, 22 nt, Human
cggaggagcugcgcggaggggg

SEQ ID NO: 185421 - RNA, 22 nt, Human
cucuaccugcacaugccugacu

SEQ ID NO: 185422 - RNA, 22 nt, Human
cggagcauacugccuggagaug

SEQ ID NO: 185423 - RNA, 22 nt, Human
cucugauuuuucuaauacuuca

SEQ ID NO: 185424 - RNA, 22 nt, Human
cggcccggccucgcggcgcaug

SEQ ID NO: 185425 - RNA, 22 nt, Human
cucucuccuuagcugcagacca

SEQ ID NO: 185426 - RNA, 22 nt, Human
cggagguccagucacaaguaac

SEQ ID NO: 185427 - RNA, 22 nt, Human
cgcccggcugagacgcucgccc

SEQ ID NO: 185428 - RNA, 22 nt, Human
cuaguucugccauucaguguca

SEQ ID NO: 185429 - RNA, 22 nt, Human
cuagcagaagcuccuugagggu

SEQ ID NO: 185430 - RNA, 22 nt, Human
cuagcaggacucagcagauauu

SEQ ID NO: 185431 - RNA, 22 nt, Human
cuaggcuuucugugugacuaga

SEQ ID NO: 185432 - RNA, 22 nt, Human
cgcgggcuugggcaccugcgga

SEQ ID NO: 185433 - RNA, 22 nt, Human
cgccugucugcauggccacugg

SEQ ID NO: 185434 - RNA, 22 nt, Human
cucagcgagggaaagaggccgc

SEQ ID NO: 185435 - RNA, 22 nt, Human
cucagcgggagucuggccgaac

SEQ ID NO: 185436 - RNA, 22 nt, Human
cucagcaauuaccugugucucu

SEQ ID NO: 185437 - RNA, 22 nt, Human
cucagcaacccacacacggucu

SEQ ID NO: 185438 - RNA, 22 nt, Human
cucacugugggcuaugaauggg

SEQ ID NO: 185439 - RNA, 23 nt, Human
cuggacauucgcaaaguucaucu

SEQ ID NO: 185440 - RNA, 22 nt, Human
cucagcugcuuuguuuugcuuu

SEQ ID NO: 185441 - RNA, 22 nt, Human
cucaggaaaauauugaagaagu

SEQ ID NO: 185442 - RNA, 22 nt, Human
cucaguauugacgaaagagauu

SEQ ID NO: 185443 - RNA, 22 nt, Human
cucaucagagcccuccucuggc

SEQ ID NO: 185444 - RNA, 22 nt, Human
cuauuuucccauaugguugaca

SEQ ID NO: 185445 - RNA, 22 nt, Human
cugcuucacccugccugagaac

SEQ ID NO: 185446 - RNA, 22 nt, Human
cuauuaauggccaggagucaug

SEQ ID NO: 185447 - RNA, 22 nt, Human
cucacugucagcugcagggcuu

SEQ ID NO: 185448 - RNA, 22 nt, Human
cucaccugccuccccgcccucc

SEQ ID NO: 185449 - RNA, 22 nt, Human
cucaauuuuuauugcuuuuuug

SEQ ID NO: 185450 - RNA, 22 nt, Human
cucaagugacucagccugguug

SEQ ID NO: 185451 - RNA, 22 nt, Human
cucaaagcagacuuuucccuuu

SEQ ID NO: 185452 - RNA, 22 nt, Human
cugcuuguguugcucagaguca

SEQ ID NO: 185453 - RNA, 22 nt, Human
cugcuuuggaucucucucugcc

SEQ ID NO: 185454 - RNA, 22 nt, Human
cugggguaucugccacaacucu

SEQ ID NO: 185455 - RNA, 22 nt, Human
cuccuuuuuauaucuuucucug

SEQ ID NO: 185456 - RNA, 22 nt, Human
cugggcuuucaggcccuaaggc

SEQ ID NO: 185457 - RNA, 22 nt, Human
cuggucuugguauucgcagaag

SEQ ID NO: 185458 - RNA, 22 nt, Human
cuggguaaauauguauuccuga

SEQ ID NO: 185459 - RNA, 22 nt, Human
cuggguguggugggugcugccg

SEQ ID NO: 185460 - RNA, 22 nt, Human
cugggugugugugaacagagau

SEQ ID NO: 185461 - RNA, 22 nt, Human
cuccagcagaaagggcgagugg

SEQ ID NO: 185462 - RNA, 22 nt, Human
cuggcggcccgaggcagaggag

SEQ ID NO: 185463 - RNA, 22 nt, Human
cucauugacagagcagcucuac

SEQ ID NO: 185464 - RNA, 22 nt, Human
cugggagggguagccaauccua

SEQ ID NO: 185465 - RNA, 22 nt, Human
cugggaggagacaggggauggg

SEQ ID NO: 185466 - RNA, 22 nt, Human
cugggagaugacucagagcagg

SEQ ID NO: 185467 - RNA, 21 nt, Human
cuggcucgccaugguucuuuu

SEQ ID NO: 185468 - RNA, 22 nt, Human
cuggcuguguguuugugcaucu

SEQ ID NO: 185469 - RNA, 22 nt, Human
cuccgcagcugggguuggcgcu

SEQ ID NO: 185470 - RNA, 22 nt, Human
cuggcuaaugugcugauagcca

SEQ ID NO: 185471 - RNA, 22 nt, Human
cugucacuguuuuaaccaacaa

SEQ ID NO: 185472 - RNA, 22 nt, Human
cuguccugauggugccacuggu

SEQ ID NO: 185473 - RNA, 22 nt, Human
cugucagcaaaucagugucugg

SEQ ID NO: 185474 - RNA, 22 nt, Human
cucuguugucaguggaagcagc

SEQ ID NO: 185475 - RNA, 22 nt, Human
cugguacuggaggaguucagag

SEQ ID NO: 185476 - RNA, 22 nt, Human
cuguaaguggugaaauuaguuu

SEQ ID NO: 185477 - RNA, 22 nt, Human
cucuggacaucugcggugcuuc

SEQ ID NO: 185478 - RNA, 22 nt, Human
cuggugcuguagccugauugag

SEQ ID NO: 185479 - RNA, 22 nt, Human
cuggugggucacgugugggugg

SEQ ID NO: 185480 - RNA, 22 nt, Human
cugugggcucucaugggaccug

SEQ ID NO: 185481 - RNA, 22 nt, Human
cuguguuguuugaguagcuuga

SEQ ID NO: 185482 - RNA, 22 nt, Human
cuguuaauugugaauuuuacau

SEQ ID NO: 185483 - RNA, 22 nt, Human
cuguuaucaggaguuuucacgg

SEQ ID NO: 185484 - RNA, 22 nt, Human
cugugcuguuagcgauuuuuaa

SEQ ID NO: 185485 - RNA, 22 nt, Human
cugaaacucaagauaggaggaa

SEQ ID NO: 185486 - RNA, 20 nt, Human
cucuuuaugagaccacuguc

SEQ ID NO: 185487 - RNA, 22 nt, Human
cucuuucauucuguccuuguuu

SEQ ID NO: 185488 - RNA, 22 nt, Human
cucuuucauucuuagguugccg

SEQ ID NO: 185489 - RNA, 20 nt, Human
cucuuucugcuuuaugccuc

SEQ ID NO: 185490 - RNA, 22 nt, Human
cugugcuguuaagaaauuuagu

SEQ ID NO: 185491 - RNA, 22 nt, Human
cugaaagcaaaguaauucuuaa

SEQ ID NO: 185492 - RNA, 23 nt, Human
cugaaauucagaugcuaaagaua

SEQ ID NO: 185493 - RNA, 22 nt, Human
cugaaagacagccaggcaaagc

SEQ ID NO: 185494 - RNA, 22 nt, Human
cuguucuccacuccugacuucu

SEQ ID NO: 185495 - RNA, 22 nt, Human
cugaagaaagaaaauggccauc

SEQ ID NO: 185496 - RNA, 22 nt, Human
cuguuguguuauuugcagugca

SEQ ID NO: 185497 - RNA, 22 nt, Human
cugagggagacagugcggacua

SEQ ID NO: 185498 - RNA, 22 nt, Human
cuuaagacaggcucaaagauua

SEQ ID NO: 185499 - RNA, 22 nt, Human
cuuacauuuguuuaguguuucc

SEQ ID NO: 185500 - RNA, 22 nt, Human
cugagguagaggaaauguagcu

SEQ ID NO: 185501 - RNA, 22 nt, Human
cuuauuugcccauguuucuuua

SEQ ID NO: 185502 - RNA, 22 nt, Human
cuguuuuugccugugacaaaaa

SEQ ID NO: 185503 - RNA, 22 nt, Human
cuguuucuuugcugucagagag

SEQ ID NO: 185504 - RNA, 22 nt, Human
cugagcaucaaaugggcaauua

SEQ ID NO: 185505 - RNA, 22 nt, Human
cgugcuaccugagcugacagcu

SEQ ID NO: 185506 - RNA, 22 nt, Human
cgugugcguauguguuuguaug

SEQ ID NO: 185507 - RNA, 17 nt, Human
cguuccagaacaaauga

SEQ ID NO: 185508 - RNA, 22 nt, Human
cugaugugcauguggggggaug

SEQ ID NO: 185509 - RNA, 22 nt, Human
cugauuguagccacugugauga

SEQ ID NO: 185510 - RNA, 21 nt, Human
cugcacugugauuuaaaaugu

SEQ ID NO: 185511 - RNA, 22 nt, Human
cugauuucaaauggugcuagau

SEQ ID NO: 185512 - RNA, 22 nt, Human
cugcaucacagcaggaggcaca

SEQ ID NO: 185513 - RNA, 22 nt, Human
cuaaaaauguucuaguaguuca

SEQ ID NO: 185514 - RNA, 20 nt, Human
cuaaaacaggugucuaguga

SEQ ID NO: 185515 - RNA, 22 nt, Human
cuaaaacuuuuccaaauuaugu

SEQ ID NO: 185516 - RNA, 22 nt, Human
cuaaauguuuuaucuuccuggc

SEQ ID NO: 185517 - RNA, 22 nt, Human
cuaaacuucauauguugcuuua

SEQ ID NO: 185518 - RNA, 22 nt, Human
cugauccuauauugguaugagg

SEQ ID NO: 185519 - RNA, 22 nt, Human
cugauaauaaccauuuuaaaau

SEQ ID NO: 185520 - RNA, 22 nt, Human
cugaugcucuggauguagucaa

SEQ ID NO: 185521 - RNA, 22 nt, Human
cugaucuuaaguaacauuauuu

SEQ ID NO: 185522 - RNA, 22 nt, Human
cugauggagagugugauuuggg

SEQ ID NO: 185523 - RNA, 21 nt, Human
cugauguaccucaagccuagu

SEQ ID NO: 185524 - RNA, 22 nt, Human
cgugaaaugcagaaaguugugg

SEQ ID NO: 185525 - RNA, 22 nt, Human
cugaugucaaauuuaucaaagc

SEQ ID NO: 185526 - RNA, 22 nt, Human
cgugaagaaguaauagguggug

SEQ ID NO: 185527 - RNA, 22 nt, Human
cgugccugguggagagcgaggg

SEQ ID NO: 185528 - RNA, 22 nt, Human
cguggaggucgcauauuccucu

SEQ ID NO: 185529 - RNA, 22 nt, Human
cguggccacaguggagcugagc

SEQ ID NO: 185530 - RNA, 22 nt, Human
cucugcuuagacaggcuuuaag

SEQ ID NO: 185531 - RNA, 22 nt, Human
cguauauaaauguauauacaca

SEQ ID NO: 185532 - RNA, 22 nt, Human
cgguggcccauuguacgcagcu

SEQ ID NO: 185533 - RNA, 22 nt, Human
cgguuuuuaaaagucucuucua

SEQ ID NO: 185534 - RNA, 22 nt, Human
cugagcggugagggcauacagc

SEQ ID NO: 185535 - RNA, 22 nt, Human
cugaguuuuucaaaucugaauu

SEQ ID NO: 185536 - RNA, 21 nt, Human
cugcugaaggaaccccaugga

SEQ ID NO: 185537 - RNA, 20 nt, Human
cugcuccauggcaucuuuag

SEQ ID NO: 185538 - RNA, 22 nt, Human
cugcucugagaggcucuuccua

SEQ ID NO: 185539 - RNA, 22 nt, Human
cuaguuuuaagcuccuugaggu

SEQ ID NO: 185540 - RNA, 22 nt, Human
cuaggaugcuguaauggugucu

SEQ ID NO: 185541 - RNA, 22 nt, Human
cugcgguucuguuuaguggcga

SEQ ID NO: 185542 - RNA, 22 nt, Human
cuaggucagaggacacagcuua

SEQ ID NO: 185543 - RNA, 22 nt, Human
cugcuggugcugcccacacggu

SEQ ID NO: 185544 - RNA, 21 nt, Human
cuauaaaaaugguucuuugcg

SEQ ID NO: 185545 - RNA, 22 nt, Human
cuauaauuguacuuguuuuuua

SEQ ID NO: 185546 - RNA, 22 nt, Human
cuauaucuguggauaguguaug

SEQ ID NO: 185547 - RNA, 22 nt, Human
cuaugaaucaauuucugcaguu

SEQ ID NO: 185548 - RNA, 22 nt, Human
cugcugugcagacagacucucu

SEQ ID NO: 185549 - RNA, 22 nt, Human
cuauguuuugcuagugaugggu

SEQ ID NO: 185550 - RNA, 22 nt, Human
cuauguuucagauauauauaua

SEQ ID NO: 185551 - RNA, 22 nt, Human
cugcuguuuuccccaccaucuc

SEQ ID NO: 185552 - RNA, 22 nt, Human
cugccaggagaggccagggccc

SEQ ID NO: 185553 - RNA, 22 nt, Human
cugccaguaucuuuggggcugu

SEQ ID NO: 185554 - RNA, 22 nt, Human
cugcccauggcuccuggcugug

SEQ ID NO: 185555 - RNA, 22 nt, Human
cuacauuuacacaguuaggcuu

SEQ ID NO: 185556 - RNA, 22 nt, Human
cuaagaaggaggaaaagugcca

SEQ ID NO: 185557 - RNA, 18 nt, Human
cuaagaggucguuucuca

SEQ ID NO: 185558 - RNA, 23 nt, Human
cuaagcuugaguauagcuuagga

SEQ ID NO: 185559 - RNA, 22 nt, Human
cuaauaauuuacugagugcuac

SEQ ID NO: 185560 - RNA, 22 nt, Human
cuaaugaaaugauggcuccuac

SEQ ID NO: 185561 - RNA, 22 nt, Human
cuaauugcuggcugcuggcaga

SEQ ID NO: 185562 - RNA, 22 nt, Human
cugccggcugcugcagagaggu

SEQ ID NO: 185563 - RNA, 22 nt, Human
cugccuggggaaugugaggauu

SEQ ID NO: 185564 - RNA, 22 nt, Human
cugccugugcgccaagugcacg

SEQ ID NO: 185565 - RNA, 22 nt, Human
cuacugaugccccgcugugccu

SEQ ID NO: 185566 - RNA, 22 nt, Human
cuacuucucccuagaucagaaa

SEQ ID NO: 185567 - RNA, 22 nt, Human
cuacuuucuucuucagaauugu

SEQ ID NO: 185568 - RNA, 22 nt, Human
cugccuuggcccuaguucaugg

SEQ ID NO: 185569 - RNA, 22 nt, Human
cugcggcaccaaccccuucaug

SEQ ID NO: 185570 - RNA, 22 nt, Human
cugcgcgagcacugccggcggg

SEQ ID NO: 185571 - RNA, 22 nt, Human
cugguuuauuucauaguuuguu

SEQ ID NO: 185572 - RNA, 22 nt, Human
cugguuacuucagaucaguagu

SEQ ID NO: 185573 - RNA, 20 nt, Human
cuggugccuucugcgauuua

SEQ ID NO: 185574 - RNA, 22 nt, Human
gaaaaguauuaugugaggguuc

SEQ ID NO: 185575 - RNA, 22 nt, Human
gaaaagaaggcaggagcccaag

SEQ ID NO: 185576 - RNA, 22 nt, Human
gaaaagaaaggaugguaugugu

SEQ ID NO: 185577 - RNA, 22 nt, Human
gaaaacccuguauguagcguuu

SEQ ID NO: 185578 - RNA, 22 nt, Human
cuggguguuccuuucauuuuaa

SEQ ID NO: 185579 - RNA, 22 nt, Human
cuggucaauaaucauguaguac

SEQ ID NO: 185580 - RNA, 22 nt, Human
cuggguuuggcugugcuugaau

SEQ ID NO: 185581 - RNA, 22 nt, Human
cugguuuuccaauguuuugacu

SEQ ID NO: 185582 - RNA, 22 nt, Human
gaaaauaguucaucacaaugau

SEQ ID NO: 185583 - RNA, 22 nt, Human
cuguccuguggccugcuccggu

SEQ ID NO: 185584 - RNA, 22 nt, Human
cuggugaagccuucggagaccc

SEQ ID NO: 185585 - RNA, 22 nt, Human
cugucucugucucuguuuaucc

SEQ ID NO: 185586 - RNA, 22 nt, Human
gaaaucuggugauuuucuguug

SEQ ID NO: 185587 - RNA, 22 nt, Human
gaaaugaaacacacaugcagcu

SEQ ID NO: 185588 - RNA, 22 nt, Human
gaaagaggcugucagggaaugg

SEQ ID NO: 185589 - RNA, 22 nt, Human
gaaacguuguggaaaauccucu

SEQ ID NO: 185590 - RNA, 22 nt, Human
cugugaaugguggccacgcguu

SEQ ID NO: 185591 - RNA, 21 nt, Human
cugugggaaggccugaggucu

SEQ ID NO: 185592 - RNA, 22 nt, Human
gaacaaggauucccaaagaaga

SEQ ID NO: 185593 - RNA, 20 nt, Human
gaacauaaauaacucuuuac

SEQ ID NO: 185594 - RNA, 22 nt, Human
gaacaguuucccuguagaaaau

SEQ ID NO: 185595 - RNA, 22 nt, Human
cuguuguucacuuugcugguga

SEQ ID NO: 185596 - RNA, 22 nt, Human
gaacuugagugugcuauuucuu

SEQ ID NO: 185597 - RNA, 22 nt, Human
gaagaagagauaauggggagca

SEQ ID NO: 185598 - RNA, 22 nt, Human
gaagaggaagaggagccagagc

SEQ ID NO: 185599 - RNA, 22 nt, Human
gaacggccucguuccucggugu

SEQ ID NO: 185600 - RNA, 22 nt, Human
gaacugaauguguaauguuggc

SEQ ID NO: 185601 - RNA, 22 nt, Human
gaaccuggcagcccuauaucug

SEQ ID NO: 185602 - RNA, 22 nt, Human
gaaccauuuaauggagaugcuc

SEQ ID NO: 185603 - RNA, 22 nt, Human
gaacagauucaucuaguggcua

SEQ ID NO: 185604 - RNA, 22 nt, Human
gaacauuucugcagaugucuga

SEQ ID NO: 185605 - RNA, 22 nt, Human
cugggaugagcuguuuccuggu

SEQ ID NO: 185606 - RNA, 22 nt, Human
cugggacacguugugcuuuaac

SEQ ID NO: 185607 - RNA, 19 nt, Human
cugggacaaugaaagcauc

SEQ ID NO: 185608 - RNA, 22 nt, Human
cugggcaugggaacuucaaggc

SEQ ID NO: 185609 - RNA, 22 nt, Human
cuuuuugcccuugggcuuccug

SEQ ID NO: 185610 - RNA, 22 nt, Human
cugggguaucuggugucuuggu

SEQ ID NO: 185611 - RNA, 22 nt, Human
cugggaguugacgaggcuugua

SEQ ID NO: 185612 - RNA, 22 nt, Human
cugggguuggccagggcccuag

SEQ ID NO: 185613 - RNA, 22 nt, Human
cugggguggugcaggccucaug

SEQ ID NO: 185614 - RNA, 22 nt, Human
cugggggacagagagaggcggu

SEQ ID NO: 185615 - RNA, 22 nt, Human
cuggguaaggaaacuccuuugu

SEQ ID NO: 185616 - RNA, 22 nt, Human
cugggugggcacccagccuggg

SEQ ID NO: 185617 - RNA, 22 nt, Human
cugggugagcuggccagagggu

SEQ ID NO: 185618 - RNA, 22 nt, Human
gaaaaauggguuguuugaagau

SEQ ID NO: 185619 - RNA, 22 nt, Human
gaaaaacucagugggggucuuu

SEQ ID NO: 185620 - RNA, 22 nt, Human
gaaaaaccacaauugguauuuu

SEQ ID NO: 185621 - RNA, 22 nt, Human
gaaaaagagaaggaguucagua

SEQ ID NO: 185622 - RNA, 22 nt, Human
cuuuucauuucauggaauacaa

SEQ ID NO: 185623 - RNA, 21 nt, Human
cuuuucuagucccagccccgc

SEQ ID NO: 185624 - RNA, 22 nt, Human
cuggcgagcugggccuggggga

SEQ ID NO: 185625 - RNA, 21 nt, Human
cugggaacccgaccaaggccu

SEQ ID NO: 185626 - RNA, 22 nt, Human
cugggaaggaagggaaaaacag

SEQ ID NO: 185627 - RNA, 22 nt, Human
cuggcggugaucccgauggugu

SEQ ID NO: 185628 - RNA, 22 nt, Human
cuggcgauugcgagagucgccu

SEQ ID NO: 185629 - RNA, 22 nt, Human
cuggagcuucaggguucucggg

SEQ ID NO: 185630 - RNA, 22 nt, Human
cuucagcgucgucaguguugcu

SEQ ID NO: 185631 - RNA, 22 nt, Human
cuggagcucugggcaucucagg

SEQ ID NO: 185632 - RNA, 20 nt, Human
cuggaguguagcaguggcug

SEQ ID NO: 185633 - RNA, 22 nt, Human
cuggccugugggcugucuccgg

SEQ ID NO: 185634 - RNA, 22 nt, Human
cuggaucgccccgaugugcccc

SEQ ID NO: 185635 - RNA, 22 nt, Human
cuucagagugacucagcaucuu

SEQ ID NO: 185636 - RNA, 22 nt, Human
cugaucccuuuucauuugcagg

SEQ ID NO: 185637 - RNA, 22 nt, Human
cugagguccucagagggaaagg

SEQ ID NO: 185638 - RNA, 22 nt, Human
gacagguagacaugaauauuaa

SEQ ID NO: 185639 - RNA, 22 nt, Human
gacagggacacagccagugagg

SEQ ID NO: 185640 - RNA, 22 nt, Human
gacagcuauggaguucacuucu

SEQ ID NO: 185641 - RNA, 22 nt, Human
cuuucuuuuugguuucccccca

SEQ ID NO: 185642 - RNA, 22 nt, Human
cuuucugauguaaggaacuagg

SEQ ID NO: 185643 - RNA, 22 nt, Human
cuuucuccagagugaagauccu

SEQ ID NO: 185644 - RNA, 22 nt, Human
cuuucucucaaacacacauaca

SEQ ID NO: 185645 - RNA, 22 nt, Human
gacagcguaucaauugaacaua

SEQ ID NO: 185646 - RNA, 22 nt, Human
gacacugccaagugccccgaga

SEQ ID NO: 185647 - RNA, 22 nt, Human
gacagcaggaugugaggggaug

SEQ ID NO: 185648 - RNA, 22 nt, Human
gaccugaccucauuagcaaguu

SEQ ID NO: 185649 - RNA, 22 nt, Human
gaccuccauucugucaugacug

SEQ ID NO: 185650 - RNA, 22 nt, Human
gaccuuucccuaucucacucuc

SEQ ID NO: 185651 - RNA, 22 nt, Human
gaccucauggaguaagugagug

SEQ ID NO: 185652 - RNA, 22 nt, Human
gacccuuugacuugugacauua

SEQ ID NO: 185653 - RNA, 22 nt, Human
gacccugaggauucccugcuga

SEQ ID NO: 185654 - RNA, 21 nt, Human
cuuugccuccagcagccgcag

SEQ ID NO: 185655 - RNA, 22 nt, Human
gacaguggagccacguugggag

SEQ ID NO: 185656 - RNA, 22 nt, Human
gacagugucccucuggggugga

SEQ ID NO: 185657 - RNA, 22 nt, Human
cuuugcaaagagagaaaguggg

SEQ ID NO: 185658 - RNA, 22 nt, Human
cuuuuucaugggugaugagugg

SEQ ID NO: 185659 - RNA, 22 nt, Human
cuuuuggcaucagccucaggaa

SEQ ID NO: 185660 - RNA, 22 nt, Human
gacugacagugguacuguaauu

SEQ ID NO: 185661 - RNA, 22 nt, Human
cuuuugcaauagugacacugau

SEQ ID NO: 185662 - RNA, 22 nt, Human
cuuuuuaaaguaaauggcuaga

SEQ ID NO: 185663 - RNA, 22 nt, Human
cuuuuuuucuccauauuucugg

SEQ ID NO: 185664 - RNA, 22 nt, Human
cuuuuugccuugaagugaccuc

SEQ ID NO: 185665 - RNA, 22 nt, Human
gagaaaaauuucuuugcugcac

SEQ ID NO: 185666 - RNA, 22 nt, Human
gagaacaaggaagagucggcag

SEQ ID NO: 185667 - RNA, 22 nt, Human
gagaaagggagaaaaagaucuu

SEQ ID NO: 185668 - RNA, 22 nt, Human
gagaccuuaagagaugucagcu

SEQ ID NO: 185669 - RNA, 22 nt, Human
gagagagacugggaaaucauca

SEQ ID NO: 185670 - RNA, 22 nt, Human
gagagaaggaagugaauuuccc

SEQ ID NO: 185671 - RNA, 22 nt, Human
gaauggcagaaugaagcagugu

SEQ ID NO: 185672 - RNA, 22 nt, Human
cuugccagggacucagucaggg

SEQ ID NO: 185673 - RNA, 22 nt, Human
cuugccaguguugcagaagcuc

SEQ ID NO: 185674 - RNA, 22 nt, Human
gaauguuaaugcacuucuagcu

SEQ ID NO: 185675 - RNA, 19 nt, Human
gaauggguucuguagggag

SEQ ID NO: 185676 - RNA, 22 nt, Human
cuuggggcuugcuguuguagcc

SEQ ID NO: 185677 - RNA, 22 nt, Human
cuuggcuccuucacagggagau

SEQ ID NO: 185678 - RNA, 23 nt, Human
cuuggcuagccacuuccacgcuc

SEQ ID NO: 185679 - RNA, 22 nt, Human
gaauuacuccaguguguggguu

SEQ ID NO: 185680 - RNA, 22 nt, Human
gaauuagacggcaucacauggg

SEQ ID NO: 185681 - RNA, 22 nt, Human
gaaugggaauuauggugggacu

SEQ ID NO: 185682 - RNA, 22 nt, Human
gaauguuugagugccaugugac

SEQ ID NO: 185683 - RNA, 22 nt, Human
gacacaacuucccucccacauu

SEQ ID NO: 185684 - RNA, 22 nt, Human
gacacaacuauccaguauggga

SEQ ID NO: 185685 - RNA, 22 nt, Human
gacacccgccggcgccugccuc

SEQ ID NO: 185686 - RNA, 22 nt, Human
cuuuaguaaaacguauuuagga

SEQ ID NO: 185687 - RNA, 22 nt, Human
cuuucauuuuugggcaucugag

SEQ ID NO: 185688 - RNA, 22 nt, Human
cuuuauguuggggugucuuagu

SEQ ID NO: 185689 - RNA, 22 nt, Human
gacaagaugacaucauggcuuc

SEQ ID NO: 185690 - RNA, 22 nt, Human
cuugucuaguuccuggugaugu

SEQ ID NO: 185691 - RNA, 22 nt, Human
gaagcaagagggaucaggaucu

SEQ ID NO: 185692 - RNA, 22 nt, Human
gaagauucugacccugacucag

SEQ ID NO: 185693 - RNA, 22 nt, Human
gaagaugacaucggaucugucu

SEQ ID NO: 185694 - RNA, 22 nt, Human
gaagaugcugcuuguucacggg

SEQ ID NO: 185695 - RNA, 22 nt, Human
gaaggugcugaaacagaaauuu

SEQ ID NO: 185696 - RNA, 22 nt, Human
gaaggggacuccauggaaugau

SEQ ID NO: 185697 - RNA, 22 nt, Human
gaaggcuguggcuggucucagu

SEQ ID NO: 185698 - RNA, 22 nt, Human
gaaggcugaauuauuuguuccu

SEQ ID NO: 185699 - RNA, 22 nt, Human
gaagucugacucuuuguaagcu

SEQ ID NO: 185700 - RNA, 22 nt, Human
gaaggggccuggggcaaggcua

SEQ ID NO: 185701 - RNA, 22 nt, Human
gaaguaaaacaguaacuuuguu

SEQ ID NO: 185702 - RNA, 22 nt, Human
cuugcagccuggagcucagccu

SEQ ID NO: 185703 - RNA, 22 nt, Human
cuugcagagcccauggauguca

SEQ ID NO: 185704 - RNA, 22 nt, Human
gaauaagaauccacuucuggca

SEQ ID NO: 185705 - RNA, 22 nt, Human
gaaguucuuagucucauuugca

SEQ ID NO: 185706 - RNA, 22 nt, Human
gaggucagcaagccaugcuugu

SEQ ID NO: 185707 - RNA, 22 nt, Human
gaggucggaagugaggguaacu

SEQ ID NO: 185708 - RNA, 22 nt, Human
gaggucagugugggggcaaggg

SEQ ID NO: 185709 - RNA, 22 nt, Human
gacaccuucuacugacuaugga

SEQ ID NO: 185710 - RNA, 22 nt, Human
gaggguuucagugggacggguu

SEQ ID NO: 185711 - RNA, 22 nt, Human
gaggguuagauuuuaagaaaga

SEQ ID NO: 185712 - RNA, 20 nt, Human
gacaagccacagcucccaga

SEQ ID NO: 185713 - RNA, 22 nt, Human
gagggguuguuaacaaagaaua

SEQ ID NO: 185714 - RNA, 22 nt, Human
gagguuggagggcuggccugca

SEQ ID NO: 185715 - RNA, 19 nt, Human
gaguaaaacuagagagaaa

SEQ ID NO: 185716 - RNA, 22 nt, Human
gagguuauucuucuaucaguau

SEQ ID NO: 185717 - RNA, 22 nt, Human
gaagggucagggcccaggggcc

SEQ ID NO: 185718 - RNA, 22 nt, Human
gacaggaauuaucuaaaguaga

SEQ ID NO: 185719 - RNA, 22 nt, Human
gacaggcagagaggaagagaga

SEQ ID NO: 185720 - RNA, 22 nt, Human
gacagcguguuuugcaugaaca

SEQ ID NO: 185721 - RNA, 22 nt, Human
gaggugauuccucccauguaau

SEQ ID NO: 185722 - RNA, 22 nt, Human
gacagaccucugcugacuggag

SEQ ID NO: 185723 - RNA, 22 nt, Human
gaggugaacccaggugcuucac

SEQ ID NO: 185724 - RNA, 22 nt, Human
gaccugcucagcccuguguguu

SEQ ID NO: 185725 - RNA, 22 nt, Human
gagucaaugugcagugcagccc

SEQ ID NO: 185726 - RNA, 22 nt, Human
gagucaggucaggcuuguagau

SEQ ID NO: 185727 - RNA, 22 nt, Human
gacgacgggccccguggccacc

SEQ ID NO: 185728 - RNA, 22 nt, Human
gacggagugcgcuugcuguuca

SEQ ID NO: 185729 - RNA, 22 nt, Human
gaguggccugccccagccaggc

SEQ ID NO: 185730 - RNA, 22 nt, Human
gaguggcaaagagaacaaagau

SEQ ID NO: 185731 - RNA, 22 nt, Human
gagucuacaugcaggcaauugu

SEQ ID NO: 185732 - RNA, 22 nt, Human
gaguagcaguucauccacaagc

SEQ ID NO: 185733 - RNA, 22 nt, Human
gaguauuacuaaaauucgccua

SEQ ID NO: 185734 - RNA, 22 nt, Human
gacccucucagacuuccaggca

SEQ ID NO: 185735 - RNA, 22 nt, Human
gaccgggcucugcugacggucu

SEQ ID NO: 185736 - RNA, 22 nt, Human
gacccggauguuguacucgagg

SEQ ID NO: 185737 - RNA, 22 nt, Human
gaguaaacagccuucucccagc

SEQ ID NO: 185738 - RNA, 22 nt, Human
gaccacugaaugcacuucuaau

SEQ ID NO: 185739 - RNA, 22 nt, Human
gacuggaaucucugcuuguuaa

SEQ ID NO: 185740 - RNA, 22 nt, Human
gacuggcucuaucaggauaaau

SEQ ID NO: 185741 - RNA, 22 nt, Human
gacuggggcauuagaguagcuu

SEQ ID NO: 185742 - RNA, 22 nt, Human
gacuaaauaaaagccaaacuuc

SEQ ID NO: 185743 - RNA, 22 nt, Human
gagugguaaaguguacugaaua

SEQ ID NO: 185744 - RNA, 22 nt, Human
gaguuauuuuuccuguuuuuua

SEQ ID NO: 185745 - RNA, 22 nt, Human
gaguuaaauagcuuaggauuca

SEQ ID NO: 185746 - RNA, 22 nt, Human
gaguguuugcuguauaauugga

SEQ ID NO: 185747 - RNA, 22 nt, Human
gacuggguaaagcuuauccaaa

SEQ ID NO: 185748 - RNA, 22 nt, Human
gacuguuggcagauguuugagu

SEQ ID NO: 185749 - RNA, 22 nt, Human
gacuuaaccacggucacauggu

SEQ ID NO: 185750 - RNA, 22 nt, Human
gauaaauaguguuuggggacau

SEQ ID NO: 185751 - RNA, 22 nt, Human
gauaagugauucugauucacau

SEQ ID NO: 185752 - RNA, 22 nt, Human
gauaccugccaagcugcacuca

SEQ ID NO: 185753 - RNA, 22 nt, Human
gacuucaagaugaaucuuuggg

SEQ ID NO: 185754 - RNA, 22 nt, Human
gacuugaagcucucugguuuug

SEQ ID NO: 185755 - RNA, 22 nt, Human
gacuucuuaaagaggugaggaa

SEQ ID NO: 185756 - RNA, 22 nt, Human
gauagcacacuuguugcuucug

SEQ ID NO: 185757 - RNA, 22 nt, Human
gauagguacuguaagguccucu

SEQ ID NO: 185758 - RNA, 22 nt, Human
gauauggaaacuugauguugug

SEQ ID NO: 185759 - RNA, 16 nt, Human
gacuuucuacgacucu

SEQ ID NO: 185760 - RNA, 22 nt, Human
gauacuuuguggaauccuggau

SEQ ID NO: 185761 - RNA, 22 nt, Human
gagaaauagauucaugguagau

SEQ ID NO: 185762 - RNA, 22 nt, Human
gagaaagauuguccuucagggg

SEQ ID NO: 185763 - RNA, 22 nt, Human
gagaaaacauacuuaguguccu

SEQ ID NO: 185764 - RNA, 22 nt, Human
gauauuaguuuuggaaggaggg

SEQ ID NO: 185765 - RNA, 22 nt, Human
gagaagugaauaacgaagcagg

SEQ ID NO: 185766 - RNA, 22 nt, Human
gagaaugagucagagcuggcug

SEQ ID NO: 185767 - RNA, 22 nt, Human
gagaaggagcagaaaaucuccu

SEQ ID NO: 185768 - RNA, 22 nt, Human
gauauuuugugaaaaaacaacu

SEQ ID NO: 185769 - RNA, 19 nt, Human
gauauugagcugagaauuc

SEQ ID NO: 185770 - RNA, 22 nt, Human
gauauucauaggcagguauuua

SEQ ID NO: 185771 - RNA, 22 nt, Human
gagaacagauaugaugacuuca

SEQ ID NO: 185772 - RNA, 22 nt, Human
gaucauauccagucaccacuau

SEQ ID NO: 185773 - RNA, 22 nt, Human
gaucacuuugauuagauguccu

SEQ ID NO: 185774 - RNA, 22 nt, Human
gaaaaugcacacauacacaccc

SEQ ID NO: 185775 - RNA, 21 nt, Human
gaaaaucuaaugugacaaugc

SEQ ID NO: 185776 - RNA, 22 nt, Human
gaaacauuuguugaguacuugc

SEQ ID NO: 185777 - RNA, 22 nt, Human
gaaaaguuuaaccuuguacauu

SEQ ID NO: 185778 - RNA, 22 nt, Human
gaaaaucaugaaaguguguugu

SEQ ID NO: 185779 - RNA, 22 nt, Human
gaaaaucaggauggaugugagg

SEQ ID NO: 185780 - RNA, 18 nt, Human
gaagcaacaguucugagu

SEQ ID NO: 185781 - RNA, 22 nt, Human
gaagcaccuggacggugccugg

SEQ ID NO: 185782 - RNA, 22 nt, Human
gaagcagguucuucaggaugaa

SEQ ID NO: 185783 - RNA, 22 nt, Human
gaagcggguucacuggauggcu

SEQ ID NO: 185784 - RNA, 22 nt, Human
gaagcccuggaggggcuggagg

SEQ ID NO: 185785 - RNA, 22 nt, Human
gagccuguuaggcaccuguguu

SEQ ID NO: 185786 - RNA, 22 nt, Human
gagcggcggugagaaguguggg

SEQ ID NO: 185787 - RNA, 22 nt, Human
gagcgcgcaaucucuccagcug

SEQ ID NO: 185788 - RNA, 22 nt, Human
gaagcgugcagguccguauacu

SEQ ID NO: 185789 - RNA, 22 nt, Human
gagcuaauagacagcaacauca

SEQ ID NO: 185790 - RNA, 22 nt, Human
gaagcuccaggaugccugcacu

SEQ ID NO: 185791 - RNA, 22 nt, Human
gaaggaaaagacgugcuaagua

SEQ ID NO: 185792 - RNA, 22 nt, Human
gaaggagaggauugugaggcug

SEQ ID NO: 185793 - RNA, 22 nt, Human
gagcuuuguuccgugguggcac

SEQ ID NO: 185794 - RNA, 22 nt, Human
gagcuggacauacaggaaacca

SEQ ID NO: 185795 - RNA, 22 nt, Human
gagcuuuagcugagaccugcuu

SEQ ID NO: 185796 - RNA, 22 nt, Human
gagcuggagaaacacauaagaa

SEQ ID NO: 185797 - RNA, 22 nt, Human
gaggaagucuuaucuggaugca

SEQ ID NO: 185798 - RNA, 22 nt, Human
gaggaaaauggaguguaauuaa

SEQ ID NO: 185799 - RNA, 22 nt, Human
gaggagcaggcaggaucugguc

SEQ ID NO: 185800 - RNA, 22 nt, Human
gaaguaaugugauugcucaggg

SEQ ID NO: 185801 - RNA, 22 nt, Human
gaggaggagacggaggccuggg

SEQ ID NO: 185802 - RNA, 22 nt, Human
gaggauaaugaaucugaaucau

SEQ ID NO: 185803 - RNA, 22 nt, Human
gaaugcacacgugugugcaugc

SEQ ID NO: 185804 - RNA, 22 nt, Human
gaggcggcgacgcgggcccggg

SEQ ID NO: 185805 - RNA, 22 nt, Human
gaggcggugguggcgagaguca

SEQ ID NO: 185806 - RNA, 22 nt, Human
gaauggaacauagcaacaucuu

SEQ ID NO: 185807 - RNA, 22 nt, Human
gaauggaugcuggucaguuugg

SEQ ID NO: 185808 - RNA, 22 nt, Human
gaggcugguucccuugaucuuu

SEQ ID NO: 185809 - RNA, 22 nt, Human
gaauccccugucggaacagugg

SEQ ID NO: 185810 - RNA, 22 nt, Human
gaggcagaggaaacagcucauu

SEQ ID NO: 185811 - RNA, 22 nt, Human
gaauaauuuugaucagaaggga

SEQ ID NO: 185812 - RNA, 22 nt, Human
gaauacaaauaauaccaaggug

SEQ ID NO: 185813 - RNA, 22 nt, Human
gaaguggggaggagaagacuga

SEQ ID NO: 185814 - RNA, 21 nt, Human
gaaguagcucugagaaaagug

SEQ ID NO: 185815 - RNA, 22 nt, Human
gaaguauuucugaguugcccag

SEQ ID NO: 185816 - RNA, 22 nt, Human
gaagucaggaaggagauugaag

SEQ ID NO: 185817 - RNA, 22 nt, Human
gaauuagguaauagaacuagua

SEQ ID NO: 185818 - RNA, 22 nt, Human
gaggggcaagaaguuggccucu

SEQ ID NO: 185819 - RNA, 22 nt, Human
gaggggaaggguguucaauggg

SEQ ID NO: 185820 - RNA, 22 nt, Human
gacaagaagaacggagguuuca

SEQ ID NO: 185821 - RNA, 22 nt, Human
gaggggcuccagguguugagga

SEQ ID NO: 185822 - RNA, 22 nt, Human
gaggggcugggguugacuccaa

SEQ ID NO: 185823 - RNA, 22 nt, Human
gaaugguuagugaacaaauuug

SEQ ID NO: 185824 - RNA, 22 nt, Human
gaggcuugccacuguccauggc

SEQ ID NO: 185825 - RNA, 22 nt, Human
gagggcugccacguugggcgag

SEQ ID NO: 185826 - RNA, 22 nt, Human
gaggggaaggauuucuucagaa

SEQ ID NO: 185827 - RNA, 22 nt, Human
gaggggaacaggcauucuuaag

SEQ ID NO: 185828 - RNA, 22 nt, Human
gaaugguuauaugauguuuaaa

SEQ ID NO: 185829 - RNA, 22 nt, Human
gaauuacagaguuguuaaguca

SEQ ID NO: 185830 - RNA, 22 nt, Human
uuuguguuacaguccuagaacu

SEQ ID NO: 185831 - RNA, 17 nt, Human
uuugugauggcagaugc

SEQ ID NO: 185832 - RNA, 20 nt, Human
gccugggagaagaucaggga

SEQ ID NO: 185833 - RNA, 22 nt, Human
ggaaucuucagccaugccaaga

SEQ ID NO: 185834 - RNA, 22 nt, Human
ggaauauaaaucagaugcuccg

SEQ ID NO: 185835 - RNA, 22 nt, Human
gccugggauuggggauuuuuug

SEQ ID NO: 185836 - RNA, 22 nt, Human
ggaauccugguguuuucugccu

SEQ ID NO: 185837 - RNA, 22 nt, Human
ggaauuaagaggcuggacaggg

SEQ ID NO: 185838 - RNA, 22 nt, Human
gccugggccgggcgcggccccc

SEQ ID NO: 185839 - RNA, 22 nt, Human
gccugggguuugcggggcugca

SEQ ID NO: 185840 - RNA, 22 nt, Human
gccugggugcugugggguggag

SEQ ID NO: 185841 - RNA, 22 nt, Human
gccuggggaacuugauccuguc

SEQ ID NO: 185842 - RNA, 22 nt, Human
ggacuggugaagccuucggaga

SEQ ID NO: 185843 - RNA, 22 nt, Human
ggaccagagcuaaugcgcgccc

SEQ ID NO: 185844 - RNA, 17 nt, Human
ggacuuucugccugucc

SEQ ID NO: 185845 - RNA, 22 nt, Human
gccuuuuaaggcagagggagau

SEQ ID NO: 185846 - RNA, 18 nt, Human
ggagaagaacagaugugg

SEQ ID NO: 185847 - RNA, 22 nt, Human
ggacauggaaagugugugauuu

SEQ ID NO: 185848 - RNA, 22 nt, Human
gccuucauuggaaucuagcuuc

SEQ ID NO: 185849 - RNA, 22 nt, Human
ggacagagcaacccuacgcagc

SEQ ID NO: 185850 - RNA, 22 nt, Human
ggaggcggaaguccaagcaggu

SEQ ID NO: 185851 - RNA, 22 nt, Human
ggaggagggaguucaggaguau

SEQ ID NO: 185852 - RNA, 22 nt, Human
ggagcugaacccuuaacuggcu

SEQ ID NO: 185853 - RNA, 19 nt, Human
ggaggguguccucaguguc

SEQ ID NO: 185854 - RNA, 22 nt, Human
ggaggccccccaugcagcucca

SEQ ID NO: 185855 - RNA, 22 nt, Human
ggagugaaugguggccguguuu

SEQ ID NO: 185856 - RNA, 22 nt, Human
ggagguaagaggcccugggccg

SEQ ID NO: 185857 - RNA, 22 nt, Human
ggaggucagcuggaggggaggc

SEQ ID NO: 185858 - RNA, 22 nt, Human
ggagacagugacuuagagacug

SEQ ID NO: 185859 - RNA, 22 nt, Human
gcgcucuccugcagacagccuc

SEQ ID NO: 185860 - RNA, 22 nt, Human
gcgcgggugagucacgggcgga

SEQ ID NO: 185861 - RNA, 20 nt, Human
gcgcuucccuacgcucugcu

SEQ ID NO: 185862 - RNA, 22 nt, Human
ggauaaaugaaggcauacagau

SEQ ID NO: 185863 - RNA, 22 nt, Human
ggaguucacagcaauggaacag

SEQ ID NO: 185864 - RNA, 22 nt, Human
ggagugauuugucuugucuggu

SEQ ID NO: 185865 - RNA, 22 nt, Human
ggaguucaaaucuuuuggaucu

SEQ ID NO: 185866 - RNA, 22 nt, Human
ggaguguaagugacucaccugg

SEQ ID NO: 185867 - RNA, 22 nt, Human
ggaguguuaggaaguuguguuu

SEQ ID NO: 185868 - RNA, 22 nt, Human
ggauaauguauuuuaaaauggg

SEQ ID NO: 185869 - RNA, 22 nt, Human
ggauaauugaugauuuauaaga

SEQ ID NO: 185870 - RNA, 22 nt, Human
gcuagaaacuguuuaaucucuu

SEQ ID NO: 185871 - RNA, 22 nt, Human
ggcagcuuucaauaggguuaug

SEQ ID NO: 185872 - RNA, 22 nt, Human
ggcagcgcuuggcugcucgaca

SEQ ID NO: 185873 - RNA, 20 nt, Human
ggcagcaaccauaugcuaca

SEQ ID NO: 185874 - RNA, 22 nt, Human
ggcagcagaacuggcccuguau

SEQ ID NO: 185875 - RNA, 22 nt, Human
gcgugcauguguguaugcgugu

SEQ ID NO: 185876 - RNA, 22 nt, Human
gcguggaugauuuugagucggu

SEQ ID NO: 185877 - RNA, 22 nt, Human
gcguguauuccagaccuuaacg

SEQ ID NO: 185878 - RNA, 22 nt, Human
gcgguuguucugugugcaugga

SEQ ID NO: 185879 - RNA, 22 nt, Human
ggcagguccugaguccugaggc

SEQ ID NO: 185880 - RNA, 22 nt, Human
ggcaguagucagaggguuuuac

SEQ ID NO: 185881 - RNA, 22 nt, Human
ggcagguggcacugcugcuccc

SEQ ID NO: 185882 - RNA, 22 nt, Human
ggcaaggaagaaagcagaaguu

SEQ ID NO: 185883 - RNA, 22 nt, Human
gcuagauugucacuugaguguc

SEQ ID NO: 185884 - RNA, 22 nt, Human
gcucaacuucuaggacuucagg

SEQ ID NO: 185885 - RNA, 22 nt, Human
gcucagccuuuuguucuauuca

SEQ ID NO: 185886 - RNA, 22 nt, Human
gcuccggggguuccagaucauc

SEQ ID NO: 185887 - RNA, 22 nt, Human
gcucgauugucaguguuaggga

SEQ ID NO: 185888 - RNA, 22 nt, Human
gcucggcuggcucaucucaugu

SEQ ID NO: 185889 - RNA, 22 nt, Human
ggcauggugggggaggacuugg

SEQ ID NO: 185890 - RNA, 22 nt, Human
ggcauuccgggguccccuucuc

SEQ ID NO: 185891 - RNA, 22 nt, Human
ggcaguguggauccuggagaag

SEQ ID NO: 185892 - RNA, 22 nt, Human
gcugagcagaacaauuagaaau

SEQ ID NO: 185893 - RNA, 22 nt, Human
gcugagcaaugcacugccgcau

SEQ ID NO: 185894 - RNA, 23 nt, Human
gcugagcaccagccauaucuuuu

SEQ ID NO: 185895 - RNA, 22 nt, Human
gcugacuguagcugggggaaga

SEQ ID NO: 185896 - RNA, 22 nt, Human
gcugacuuauuagaaaaggaca

SEQ ID NO: 185897 - RNA, 22 nt, Human
gcugacucugcuuuuagccucc

SEQ ID NO: 185898 - RNA, 22 nt, Human
gcucugaacugucaugaauugg

SEQ ID NO: 185899 - RNA, 22 nt, Human
gcugacuauaaggcugcucugu

SEQ ID NO: 185900 - RNA, 22 nt, Human
gcaugguuagacaucaauguga

SEQ ID NO: 185901 - RNA, 20 nt, Human
gcauggcuggcugcugucug

SEQ ID NO: 185902 - RNA, 22 nt, Human
gcaugguuuccugcaacguucu

SEQ ID NO: 185903 - RNA, 22 nt, Human
gcccgaccgcgccggcccgcac

SEQ ID NO: 185904 - RNA, 22 nt, Human
gcauugcuauuucuguuagugu

SEQ ID NO: 185905 - RNA, 22 nt, Human
gcccuggcauuucuauucaugu

SEQ ID NO: 185906 - RNA, 22 nt, Human
gcccugccauugaucggcccag

SEQ ID NO: 185907 - RNA, 22 nt, Human
gcugucauggacaugucuguuu

SEQ ID NO: 185908 - RNA, 22 nt, Human
gcugucccccaaagaugcuccu

SEQ ID NO: 185909 - RNA, 22 nt, Human
gcugguggcagagcuccgcggc

SEQ ID NO: 185910 - RNA, 22 nt, Human
gcuggugugagauucucgaggg

SEQ ID NO: 185911 - RNA, 22 nt, Human
gcccguuuagcaaacgccuccu

SEQ ID NO: 185912 - RNA, 22 nt, Human
gcuguacugucugccaagccag

SEQ ID NO: 185913 - RNA, 22 nt, Human
gcuguuggaggaguucagugcu

SEQ ID NO: 185914 - RNA, 22 nt, Human
gcuguugugaggaucagcauau

SEQ ID NO: 185915 - RNA, 22 nt, Human
gcuguugagucagacaaguuuu

SEQ ID NO: 185916 - RNA, 22 nt, Human
gcugugacaagaggcugcuucu

SEQ ID NO: 185917 - RNA, 22 nt, Human
gcuguccugggaacaggcacua

SEQ ID NO: 185918 - RNA, 18 nt, Human
gcuguccgguagcuggug

SEQ ID NO: 185919 - RNA, 20 nt, Human
gcugugccaugacccucgag

SEQ ID NO: 185920 - RNA, 22 nt, Human
gccgcaacggacccugggaguc

SEQ ID NO: 185921 - RNA, 22 nt, Human
gccgcagauucugagacgugua

SEQ ID NO: 185922 - RNA, 22 nt, Human
gcuucugugagugcagaugcug

SEQ ID NO: 185923 - RNA, 22 nt, Human
gcuuccuccaucuggggcuugc

SEQ ID NO: 185924 - RNA, 22 nt, Human
gcuucucacccuuacuaucucu

SEQ ID NO: 185925 - RNA, 22 nt, Human
gcuuauuagguuauuucaagga

SEQ ID NO: 185926 - RNA, 22 nt, Human
ggaaauguguguaagaaaguau

SEQ ID NO: 185927 - RNA, 22 nt, Human
ggaaauauaagcaguuugugug

SEQ ID NO: 185928 - RNA, 22 nt, Human
ggaaagagaaacaugaacuaga

SEQ ID NO: 185929 - RNA, 22 nt, Human
ggaaagaggacaucuuacuucu

SEQ ID NO: 185930 - RNA, 22 nt, Human
gccugcaaagacuuccuucucu

SEQ ID NO: 185931 - RNA, 22 nt, Human
gccugcagccagggaguucucu

SEQ ID NO: 185932 - RNA, 22 nt, Human
ggaacaguacucggaggccaga

SEQ ID NO: 185933 - RNA, 22 nt, Human
gccggcugggggcggagggcag

SEQ ID NO: 185934 - RNA, 22 nt, Human
gccgggagugcagcgggcgcgc

SEQ ID NO: 185935 - RNA, 22 nt, Human
gccgggagaggcggcgcagggg

SEQ ID NO: 185936 - RNA, 20 nt, Human
gccggggcauaggggccguc

SEQ ID NO: 185937 - RNA, 22 nt, Human
gccggguguuccugggaagaug

SEQ ID NO: 185938 - RNA, 22 nt, Human
gccuagaagaaugagcgcaggg

SEQ ID NO: 185939 - RNA, 22 nt, Human
gccuccggagucgcagugucuu

SEQ ID NO: 185940 - RNA, 22 nt, Human
gccuagggacuuugguuuagau

SEQ ID NO: 185941 - RNA, 22 nt, Human
ggaaaaugcugaagcaucugaa

SEQ ID NO: 185942 - RNA, 22 nt, Human
gccucucuggcaaagcggugau

SEQ ID NO: 185943 - RNA, 22 nt, Human
gcuuuugcaaagcuggagaauu

SEQ ID NO: 185944 - RNA, 22 nt, Human
gccggagagccaacaccacgga

SEQ ID NO: 185945 - RNA, 22 nt, Human
ggaaaaucaaaccauuuacagu

SEQ ID NO: 185946 - RNA, 22 nt, Human
ggaaaagccauauuauaggcaa

SEQ ID NO: 185947 - RNA, 22 nt, Human
gcuuuucucccugcuuucuucc

SEQ ID NO: 185948 - RNA, 22 nt, Human
gcuuuguugauggugagucugu

SEQ ID NO: 185949 - RNA, 20 nt, Human
gcuugcgugggaggaggggg

SEQ ID NO: 185950 - RNA, 20 nt, Human
gcuugcggacagguggcuca

SEQ ID NO: 185951 - RNA, 22 nt, Human
gccgcgggucugggucuggcuc

SEQ ID NO: 185952 - RNA, 22 nt, Human
gcccuuuuaucaacuccuagaa

SEQ ID NO: 185953 - RNA, 15 nt, Human
gccgcgcuggggagc

SEQ ID NO: 185954 - RNA, 22 nt, Human
gcuugaggaacucagacuugag

SEQ ID NO: 185955 - RNA, 22 nt, Human
gcuuucacugcaauagaugaau

SEQ ID NO: 185956 - RNA, 22 nt, Human
gcuuucagggucacugucaaca

SEQ ID NO: 185957 - RNA, 22 nt, Human
gcuuuccuggcccugucccugc

SEQ ID NO: 185958 - RNA, 22 nt, Human
gcuugggcugaaggccuggguc

SEQ ID NO: 185959 - RNA, 18 nt, Human
gcuuggguggcuauguuu

SEQ ID NO: 185960 - RNA, 22 nt, Human
gcuuguuuagcauaggucacug

SEQ ID NO: 185961 - RNA, 22 nt, Human
gcuuguuagcaaugcagaaucu

SEQ ID NO: 185962 - RNA, 22 nt, Human
gcagugcugcgacagucgggug

SEQ ID NO: 185963 - RNA, 22 nt, Human
gcagugucacuaguaauagucu

SEQ ID NO: 185964 - RNA, 22 nt, Human
gcuagaaggaagccccugcuga

SEQ ID NO: 185965 - RNA, 20 nt, Human
gcuaggggacuggagggagg

SEQ ID NO: 185966 - RNA, 22 nt, Human
gcauagacaccuuagagcaaua

SEQ ID NO: 185967 - RNA, 22 nt, Human
gcauauuuuaaaguguaaccug

SEQ ID NO: 185968 - RNA, 22 nt, Human
gcauaauauugagaaauuauua

SEQ ID NO: 185969 - RNA, 22 nt, Human
gcauccugacuauggugguggu

SEQ ID NO: 185970 - RNA, 23 nt, Human
gcaucgcaggucuaagauuagcu

SEQ ID NO: 185971 - RNA, 22 nt, Human
gcuccagcuccauaaacauaag

SEQ ID NO: 185972 - RNA, 23 nt, Human
gcucauguugcuucuguucuguc

SEQ ID NO: 185973 - RNA, 22 nt, Human
gcaugcuguuuggaaacgauaa

SEQ ID NO: 185974 - RNA, 22 nt, Human
gcucuagcuggcgcugaccugg

SEQ ID NO: 185975 - RNA, 23 nt, Human
gcugaagcccacucccugggucu

SEQ ID NO: 185976 - RNA, 18 nt, Human
gcugaaauucuaaacaaa

SEQ ID NO: 185977 - RNA, 22 nt, Human
gcaguaaggaggggaaggguuu

SEQ ID NO: 185978 - RNA, 22 nt, Human
gcaguagauccagcagccugca

SEQ ID NO: 185979 - RNA, 23 nt, Human
gcagugacugggauggaaguaga

SEQ ID NO: 185980 - RNA, 22 nt, Human
gcagugccauguggaggaucuc

SEQ ID NO: 185981 - RNA, 22 nt, Human
gcagguggaagcagcagacuca

SEQ ID NO: 185982 - RNA, 22 nt, Human
gcgguuggacguucgccucggg

SEQ ID NO: 185983 - RNA, 22 nt, Human
gcagggcucuggagucaggcug

SEQ ID NO: 185984 - RNA, 22 nt, Human
gcgguuauggcagagauuacag

SEQ ID NO: 185985 - RNA, 19 nt, Human
gcgggcucuccaccccauc

SEQ ID NO: 185986 - RNA, 22 nt, Human
gcgggcuuggcuccagggccca

SEQ ID NO: 185987 - RNA, 23 nt, Human
gcgggcggagccgggaggcgggg

SEQ ID NO: 185988 - RNA, 22 nt, Human
gcaggaagauugcagaaggcug

SEQ ID NO: 185989 - RNA, 22 nt, Human
gcaggccuccccugcuggagcu

SEQ ID NO: 185990 - RNA, 22 nt, Human
gcaggcagauccagaagcacua

SEQ ID NO: 185991 - RNA, 22 nt, Human
gcaggcaggauucagagauaca

SEQ ID NO: 185992 - RNA, 22 nt, Human
gcgcggcgcggguccucggccu

SEQ ID NO: 185993 - RNA, 22 nt, Human
gcgcugagcuuuucuuauugaa

SEQ ID NO: 185994 - RNA, 22 nt, Human
gcagcuuuggagguggaacucu

SEQ ID NO: 185995 - RNA, 22 nt, Human
gcggacaauggaagaugucauu

SEQ ID NO: 185996 - RNA, 22 nt, Human
gcagacuaacuuuugucagccu

SEQ ID NO: 185997 - RNA, 21 nt, Human
gcagaacuaggacuugaacau

SEQ ID NO: 185998 - RNA, 22 nt, Human
gccugcugggcucuuccugcug

SEQ ID NO: 185999 - RNA, 23 nt, Human
gcacuccgagggcacgugucucu

SEQ ID NO: 186000 - RNA, 22 nt, Human
gcagauaguaggagcuaaucuu

SEQ ID NO: 186001 - RNA, 22 nt, Human
gcagauaaaauuuuugauggga

SEQ ID NO: 186002 - RNA, 22 nt, Human
gcagagcacccugcagugguau

SEQ ID NO: 186003 - RNA, 22 nt, Human
gcgcgcucugcgaggacacgcu

SEQ ID NO: 186004 - RNA, 21 nt, Human
gcgcgcucgugcucgacgcgc

SEQ ID NO: 186005 - RNA, 22 nt, Human
gcgccuugccuguccucuaacc

SEQ ID NO: 186006 - RNA, 22 nt, Human
gcgcgccugccucccgcggugc

SEQ ID NO: 186007 - RNA, 22 nt, Human
gcgccgacccucccugccggac

SEQ ID NO: 186008 - RNA, 22 nt, Human
gcagauccaaauauaguucuug

SEQ ID NO: 186009 - RNA, 22 nt, Human
gcgcacaaccccguggcgguga

SEQ ID NO: 186010 - RNA, 22 nt, Human
gcagauuggguacauaaacagu

SEQ ID NO: 186011 - RNA, 22 nt, Human
gccugcaggaaggugugccugu

SEQ ID NO: 186012 - RNA, 22 nt, Human
gccugcacucaaacacucucuu

SEQ ID NO: 186013 - RNA, 22 nt, Human
gcaauaaguuuucucuucuguc

SEQ ID NO: 186014 - RNA, 22 nt, Human
gcaauagccuacaugcgucaga

SEQ ID NO: 186015 - RNA, 22 nt, Human
gcaauuguauugucaagacaug

SEQ ID NO: 186016 - RNA, 22 nt, Human
gcaauuggaaugaauucuauuu

SEQ ID NO: 186017 - RNA, 22 nt, Human
gcacaggcugcacgaccccagc

SEQ ID NO: 186018 - RNA, 22 nt, Human
gcacauaugcuguaagcacaug

SEQ ID NO: 186019 - RNA, 18 nt, Human
gccugccagccgagggac

SEQ ID NO: 186020 - RNA, 22 nt, Human
gccugccucugacuggggcuga

SEQ ID NO: 186021 - RNA, 21 nt, Human
gcacucagucacuacucaaga

SEQ ID NO: 186022 - RNA, 22 nt, Human
gcaccacccaaaggcggggcuc

SEQ ID NO: 186023 - RNA, 18 nt, Human
gccucuguugacagaguu

SEQ ID NO: 186024 - RNA, 22 nt, Human
gauuuugaaccuuauuuggaaa

SEQ ID NO: 186025 - RNA, 22 nt, Human
gccucuuugcucuuugguuguu

SEQ ID NO: 186026 - RNA, 22 nt, Human
gcccuguuuucuggguuccuug

SEQ ID NO: 186027 - RNA, 22 nt, Human
gauuaagauuacauauuuaagu

SEQ ID NO: 186028 - RNA, 22 nt, Human
gauuaagugaauuggagaaaag

SEQ ID NO: 186029 - RNA, 22 nt, Human
gauuaagaaagauagaugugga

SEQ ID NO: 186030 - RNA, 22 nt, Human
gauuaaaggucuugauuauaag

SEQ ID NO: 186031 - RNA, 22 nt, Human
gcagggcucagccgcucccacc

SEQ ID NO: 186032 - RNA, 22 nt, Human
gaucccagaggcggggauagga

SEQ ID NO: 186033 - RNA, 22 nt, Human
gcaggguaggugacagguaguc

SEQ ID NO: 186034 - RNA, 22 nt, Human
gcaggggguaaggggcagggcu

SEQ ID NO: 186035 - RNA, 22 nt, Human
gcaggucacagcugauuggcca

SEQ ID NO: 186036 - RNA, 22 nt, Human
gaucuguccuggcaguuaacac

SEQ ID NO: 186037 - RNA, 22 nt, Human
gaucugguuccaggacauugca

SEQ ID NO: 186038 - RNA, 22 nt, Human
gaucuuacucacuucagcuggc

SEQ ID NO: 186039 - RNA, 22 nt, Human
gaugaagaaacucaaccaagaa

SEQ ID NO: 186040 - RNA, 18 nt, Human
gaugaagaggaagaggag

SEQ ID NO: 186041 - RNA, 22 nt, Human
gaguaucagauuggaguccuca

SEQ ID NO: 186042 - RNA, 22 nt, Human
gaguagccucagucugcaagug

SEQ ID NO: 186043 - RNA, 22 nt, Human
gaguacagaagauaaaggcaca

SEQ ID NO: 186044 - RNA, 22 nt, Human
gaguaaaagaugaggcaguaga

SEQ ID NO: 186045 - RNA, 22 nt, Human
gaguaauuuucuuaaaacauca

SEQ ID NO: 186046 - RNA, 22 nt, Human
gaguaaggaaguguuggccaca

SEQ ID NO: 186047 - RNA, 22 nt, Human
gcaguaaauugagagucauguu

SEQ ID NO: 186048 - RNA, 22 nt, Human
gcaguauuguguguggucaugg

SEQ ID NO: 186049 - RNA, 22 nt, Human
gcagguuguuuaaauuaggauu

SEQ ID NO: 186050 - RNA, 22 nt, Human
gcagucauggguagaacucaag

SEQ ID NO: 186051 - RNA, 22 nt, Human
gcaguccuugcuguguaauaaa

SEQ ID NO: 186052 - RNA, 22 nt, Human
gcagucuacuuaagaaucucag

SEQ ID NO: 186053 - RNA, 22 nt, Human
gcagugacagacaacuguuuga

SEQ ID NO: 186054 - RNA, 22 nt, Human
gcaguugugguuucguuuccuu

SEQ ID NO: 186055 - RNA, 22 nt, Human
gcauaaaggacuauaaggauca

SEQ ID NO: 186056 - RNA, 22 nt, Human
gcauagauauguaaugcaucau

SEQ ID NO: 186057 - RNA, 22 nt, Human
gcaucacacgcacauacacaca

SEQ ID NO: 186058 - RNA, 22 nt, Human
gcauaguuuucauagguguuuu

SEQ ID NO: 186059 - RNA, 22 nt, Human
gaguggugagaauacaacggaa

SEQ ID NO: 186060 - RNA, 22 nt, Human
gagugggugaaugugcucauaa

SEQ ID NO: 186061 - RNA, 22 nt, Human
gagugaucuguaggcagcaugg

SEQ ID NO: 186062 - RNA, 22 nt, Human
gcauccaaggagcagaagugau

SEQ ID NO: 186063 - RNA, 23 nt, Human
gcaguggagcgagaacuuccugu

SEQ ID NO: 186064 - RNA, 22 nt, Human
gaguauuagaagaguaguuauu

SEQ ID NO: 186065 - RNA, 22 nt, Human
gagucaucucuagaaugaugau

SEQ ID NO: 186066 - RNA, 22 nt, Human
gcaguuugugauguggcaguca

SEQ ID NO: 186067 - RNA, 22 nt, Human
gagucaguuguugcaccacuag

SEQ ID NO: 186068 - RNA, 22 nt, Human
gaguauuuaccacuaaaugguu

SEQ ID NO: 186069 - RNA, 22 nt, Human
gagucaauucaccuuggugcuu

SEQ ID NO: 186070 - RNA, 22 nt, Human
gcaucccagaagauucugauuu

SEQ ID NO: 186071 - RNA, 22 nt, Human
gcaucuguuagagugugcaugc

SEQ ID NO: 186072 - RNA, 22 nt, Human
gccacucaguuuaggggcaagc

SEQ ID NO: 186073 - RNA, 23 nt, Human
gccaaacugcccguucucucugc

SEQ ID NO: 186074 - RNA, 22 nt, Human
gccaaccagucgguccaggaag

SEQ ID NO: 186075 - RNA, 22 nt, Human
gccaggcagcagcgaggauggu

SEQ ID NO: 186076 - RNA, 22 nt, Human
gccaggccuggguggagcgcuc

SEQ ID NO: 186077 - RNA, 22 nt, Human
gccaggagaaaaggcgaaugau

SEQ ID NO: 186078 - RNA, 22 nt, Human
gaugcauccuuucugucuucuc

SEQ ID NO: 186079 - RNA, 22 nt, Human
gccagucgucuuuauuacagcu

SEQ ID NO: 186080 - RNA, 22 nt, Human
gauccagauauuugggcuggua

SEQ ID NO: 186081 - RNA, 21 nt, Human
gaucgcaaugugggaaucaug

SEQ ID NO: 186082 - RNA, 23 nt, Human
gccaucugcugggugccccggcc

SEQ ID NO: 186083 - RNA, 22 nt, Human
gccaguggucagugggagggug

SEQ ID NO: 186084 - RNA, 22 nt, Human
gaugguagauauagaaagggga

SEQ ID NO: 186085 - RNA, 22 nt, Human
gcccuguguguuugcacugauu

SEQ ID NO: 186086 - RNA, 22 nt, Human
gcccuggucguggagggcaaca

SEQ ID NO: 186087 - RNA, 22 nt, Human
gcccuguuauagucugaggccu

SEQ ID NO: 186088 - RNA, 22 nt, Human
gauguuuugaaagaagaauaca

SEQ ID NO: 186089 - RNA, 22 nt, Human
gcccugaaggccuccaggacuc

SEQ ID NO: 186090 - RNA, 22 nt, Human
gccccgcgcgcguagcgccgcu

SEQ ID NO: 186091 - RNA, 22 nt, Human
gaugguggaggaaucgcugaag

SEQ ID NO: 186092 - RNA, 22 nt, Human
gcccccgccuugcugggccagg

SEQ ID NO: 186093 - RNA, 22 nt, Human
gaugucccuggaggggacagga

SEQ ID NO: 186094 - RNA, 21 nt, Human
ggcauguagccagcaaaggua

SEQ ID NO: 186095 - RNA, 22 nt, Human
ggcauuccucucuguucaugga

SEQ ID NO: 186096 - RNA, 22 nt, Human
gguggccggcaccccacccucg

SEQ ID NO: 186097 - RNA, 22 nt, Human
gguggccuaacaaugguggcaa

SEQ ID NO: 186098 - RNA, 20 nt, Human
ggcaucugacaacuaguugc

SEQ ID NO: 186099 - RNA, 22 nt, Human
gguggagacucagauuuguugc

SEQ ID NO: 186100 - RNA, 22 nt, Human
gguggcauguaccucacagacu

SEQ ID NO: 186101 - RNA, 22 nt, Human
ggugcuggggaaauuaggguag

SEQ ID NO: 186102 - RNA, 22 nt, Human
ggugaucucagucuagaugguu

SEQ ID NO: 186103 - RNA, 22 nt, Human
ggugaggggauccuguuaccau

SEQ ID NO: 186104 - RNA, 22 nt, Human
ggugaguagaaguaguuggcuu

SEQ ID NO: 186105 - RNA, 22 nt, Human
gguugcggaccagcugggcugc

SEQ ID NO: 186106 - RNA, 22 nt, Human
gguuaacaccacagcugggaca

SEQ ID NO: 186107 - RNA, 22 nt, Human
ggccaauuuccuagacauuagu

SEQ ID NO: 186108 - RNA, 22 nt, Human
ggccacauuccagagggcugaa

SEQ ID NO: 186109 - RNA, 22 nt, Human
ggccaccuaagguugugcauca

SEQ ID NO: 186110 - RNA, 20 nt, Human
ggcauuuuuuaguugagcuu

SEQ ID NO: 186111 - RNA, 19 nt, Human
gguuaccagugugucuggc

SEQ ID NO: 186112 - RNA, 22 nt, Human
gguuauuucugauuauaugaua

SEQ ID NO: 186113 - RNA, 22 nt, Human
ggcauugauggggucuugggga

SEQ ID NO: 186114 - RNA, 22 nt, Human
ggugucucagauuguaaaaugu

SEQ ID NO: 186115 - RNA, 22 nt, Human
gguguggcaguggaccugugaa

SEQ ID NO: 186116 - RNA, 22 nt, Human
ggugugaauagagccuggagca

SEQ ID NO: 186117 - RNA, 22 nt, Human
ggcacuggguugcagagagaga

SEQ ID NO: 186118 - RNA, 22 nt, Human
ggcaauauuauaagggcauuua

SEQ ID NO: 186119 - RNA, 22 nt, Human
ggucaauuuggucaaucguuua

SEQ ID NO: 186120 - RNA, 22 nt, Human
ggcacagcgacuaccaucgaaa

SEQ ID NO: 186121 - RNA, 22 nt, Human
ggcaauuacguauuagucaugu

SEQ ID NO: 186122 - RNA, 22 nt, Human
ggugacuucugaaccuggagug

SEQ ID NO: 186123 - RNA, 22 nt, Human
ggcacaggcugguaccaguuca

SEQ ID NO: 186124 - RNA, 22 nt, Human
ggcacccugcauuggcuugagu

SEQ ID NO: 186125 - RNA, 22 nt, Human
ggugaggagaaacucugccccu

SEQ ID NO: 186126 - RNA, 22 nt, Human
ggcagaaaacaauaaccauuuc

SEQ ID NO: 186127 - RNA, 22 nt, Human
ggcagagguagcuggaaccagg

SEQ ID NO: 186128 - RNA, 22 nt, Human
ggcagauaaacaauguuguaua

SEQ ID NO: 186129 - RNA, 22 nt, Human
ggucgagcagcacccguucggc

SEQ ID NO: 186130 - RNA, 22 nt, Human
gguaagcauuaagugagggaau

SEQ ID NO: 186131 - RNA, 22 nt, Human
ggauggaugugaucugccuccu

SEQ ID NO: 186132 - RNA, 22 nt, Human
ggaugggcuuggggaggucuag

SEQ ID NO: 186133 - RNA, 22 nt, Human
ggaugcguuugaauguguuugu

SEQ ID NO: 186134 - RNA, 23 nt, Human
ggauggacauacguaugcacagg

SEQ ID NO: 186135 - RNA, 22 nt, Human
ggaugauuuucaguuguguggg

SEQ ID NO: 186136 - RNA, 22 nt, Human
ggaugcagcagagaccuggagu

SEQ ID NO: 186137 - RNA, 20 nt, Human
ggagcgggcauuuguguucc

SEQ ID NO: 186138 - RNA, 22 nt, Human
gggguuggaugccuuggaaauu

SEQ ID NO: 186139 - RNA, 22 nt, Human
ggaggaaauccuuaguaaggca

SEQ ID NO: 186140 - RNA, 22 nt, Human
ggagcaucuaccauuucuagau

SEQ ID NO: 186141 - RNA, 22 nt, Human
ggaggaugaggguggugguguu

SEQ ID NO: 186142 - RNA, 22 nt, Human
ggaggccagagaagagccaggc

SEQ ID NO: 186143 - RNA, 22 nt, Human
ggagcuaaggauuuuuauaugu

SEQ ID NO: 186144 - RNA, 23 nt, Human
ggaggcccagaggucggccccac

SEQ ID NO: 186145 - RNA, 22 nt, Human
ggaggccgugcugugcugccag

SEQ ID NO: 186146 - RNA, 22 nt, Human
ggggcuggguuugcgcaggcuc

SEQ ID NO: 186147 - RNA, 19 nt, Human
ggagcagauaaacauacuu

SEQ ID NO: 186148 - RNA, 22 nt, Human
ggagaugucugugccacgucuc

SEQ ID NO: 186149 - RNA, 22 nt, Human
gggggacagugugccuggugug

SEQ ID NO: 186150 - RNA, 22 nt, Human
gggggaggcucggcgccgcggu

SEQ ID NO: 186151 - RNA, 22 nt, Human
gggggcagguuccaggccagcu

SEQ ID NO: 186152 - RNA, 18 nt, Human
gggcuuugggguucuauc

SEQ ID NO: 186153 - RNA, 18 nt, Human
gggcuuuacagaguggag

SEQ ID NO: 186154 - RNA, 22 nt, Human
gggcuuuuccaacacucuggag

SEQ ID NO: 186155 - RNA, 22 nt, Human
ggagguggagcuggaaguucca

SEQ ID NO: 186156 - RNA, 22 nt, Human
ggaggggaguuugccucugggg

SEQ ID NO: 186157 - RNA, 22 nt, Human
ggaggguggaggagggaauuga

SEQ ID NO: 186158 - RNA, 22 nt, Human
ggagugaagacagagugaacuu

SEQ ID NO: 186159 - RNA, 22 nt, Human
ggagucugugucuugaagcagu

SEQ ID NO: 186160 - RNA, 22 nt, Human
ggguuacgaugauuucaugugu

SEQ ID NO: 186161 - RNA, 22 nt, Human
ggguucauuugccggguaguuu

SEQ ID NO: 186162 - RNA, 22 nt, Human
ggguggcaagucuuucugcaac

SEQ ID NO: 186163 - RNA, 22 nt, Human
ggguucugggaggacuagggga

SEQ ID NO: 186164 - RNA, 22 nt, Human
ggguuccuuggaacacuguuug

SEQ ID NO: 186165 - RNA, 22 nt, Human
ggaugaguuguauauaggauuc

SEQ ID NO: 186166 - RNA, 22 nt, Human
ggaucguauuucaguuuuuugg

SEQ ID NO: 186167 - RNA, 22 nt, Human
ggaucgauuccaaauguagauc

SEQ ID NO: 186168 - RNA, 22 nt, Human
ggaucagcgagaagggcugaaa

SEQ ID NO: 186169 - RNA, 22 nt, Human
ggagccuuccgagucccagguu

SEQ ID NO: 186170 - RNA, 22 nt, Human
ggguuguuuguauuucucugaa

SEQ ID NO: 186171 - RNA, 22 nt, Human
ggaucaccagguuuguuguugg

SEQ ID NO: 186172 - RNA, 22 nt, Human
gguaagcacuucauguacauga

SEQ ID NO: 186173 - RNA, 22 nt, Human
gguaagguugggugucagaggg

SEQ ID NO: 186174 - RNA, 22 nt, Human
gguaagcugcuguagggucaga

SEQ ID NO: 186175 - RNA, 22 nt, Human
ggguuuguuccuacuucuacuc

SEQ ID NO: 186176 - RNA, 22 nt, Human
ggguuuuaccagauguguggug

SEQ ID NO: 186177 - RNA, 22 nt, Human
gggagcccuggacgggcgguau

SEQ ID NO: 186178 - RNA, 22 nt, Human
gcuuuugaauacuacaggaguu

SEQ ID NO: 186179 - RNA, 22 nt, Human
gcuuuugagaaaguguuuuccc

SEQ ID NO: 186180 - RNA, 22 nt, Human
gcuuuuuaauuugcuucccugg

SEQ ID NO: 186181 - RNA, 22 nt, Human
gggagauuuguguaggaaaacu

SEQ ID NO: 186182 - RNA, 20 nt, Human
gggacugagccuuguuugug

SEQ ID NO: 186183 - RNA, 22 nt, Human
gcuuucauuauguuguguuuuu

SEQ ID NO: 186184 - RNA, 22 nt, Human
gggcaggcuggguggugguccc

SEQ ID NO: 186185 - RNA, 22 nt, Human
gggcaggacccguuagaguggc

SEQ ID NO: 186186 - RNA, 22 nt, Human
gggcagagggcgagcugggaga

SEQ ID NO: 186187 - RNA, 22 nt, Human
gggcagaaaggaaggcuggggg

SEQ ID NO: 186188 - RNA, 22 nt, Human
ggaaaggggaaaauacagagag

SEQ ID NO: 186189 - RNA, 22 nt, Human
ggaaaggacuggagcccagcgc

SEQ ID NO: 186190 - RNA, 22 nt, Human
ggaaaaauggguggugauauga

SEQ ID NO: 186191 - RNA, 22 nt, Human
ggaaaggaagggaaggagaugc

SEQ ID NO: 186192 - RNA, 22 nt, Human
ggaagaagagggagcuguggga

SEQ ID NO: 186193 - RNA, 22 nt, Human
gggcccggguaggggaagagag

SEQ ID NO: 186194 - RNA, 22 nt, Human
gggccgcagccucuccggccug

SEQ ID NO: 186195 - RNA, 22 nt, Human
ggaagaggaagaugaggcagca

SEQ ID NO: 186196 - RNA, 20 nt, Human
gggccagguggaccaggggc

SEQ ID NO: 186197 - RNA, 22 nt, Human
ggaaguuugagcaucuguuucc

SEQ ID NO: 186198 - RNA, 22 nt, Human
ggaauaaaaggagguggcgaga

SEQ ID NO: 186199 - RNA, 22 nt, Human
ggaauacggguuuauuuagucu

SEQ ID NO: 186200 - RNA, 21 nt, Human
ggaauagcuuaaagugagggg

SEQ ID NO: 186201 - RNA, 22 nt, Human
ggaagcugucugcccggcgcuc

SEQ ID NO: 186202 - RNA, 22 nt, Human
gggccugcgcuggggggagccg

SEQ ID NO: 186203 - RNA, 21 nt, Human
gggccugggccagggccgggu

SEQ ID NO: 186204 - RNA, 22 nt, Human
gggccggcuggggcggggcggg

SEQ ID NO: 186205 - RNA, 22 nt, Human
ggacggcuagcagcagaauuca

SEQ ID NO: 186206 - RNA, 22 nt, Human
ggacugggagaauggaggcaag

SEQ ID NO: 186207 - RNA, 22 nt, Human
ggacuccuguguuuuggcugag

SEQ ID NO: 186208 - RNA, 22 nt, Human
ggaauguuuuccagaccuagau

SEQ ID NO: 186209 - RNA, 22 nt, Human
ggaaugcagugagcauuagaua

SEQ ID NO: 186210 - RNA, 22 nt, Human
gggcuuguuaacuuggcuucca

SEQ ID NO: 186211 - RNA, 22 nt, Human
ggaauugagcaagggguggggc

SEQ ID NO: 186212 - RNA, 22 nt, Human
ggaauuauuuuaaauagacauu

SEQ ID NO: 186213 - RNA, 22 nt, Human
gggaagaacugauuucacacca

SEQ ID NO: 186214 - RNA, 18 nt, Human
gggaagaugccacaguga

SEQ ID NO: 186215 - RNA, 22 nt, Human
gggaagagggagcuggaaugau

SEQ ID NO: 186216 - RNA, 22 nt, Human
gggaacuuugugagacuggaga

SEQ ID NO: 186217 - RNA, 22 nt, Human
gggaacuuggcaggaaaauuau

SEQ ID NO: 186218 - RNA, 22 nt, Human
gcuuauugcuuauagauaggaa

SEQ ID NO: 186219 - RNA, 22 nt, Human
gcuuaggcgcuccuuuucacuc

SEQ ID NO: 186220 - RNA, 22 nt, Human
gcuuaugauguuuacauaaaag

SEQ ID NO: 186221 - RNA, 22 nt, Human
gggacugcgagauucucaaggg

SEQ ID NO: 186222 - RNA, 22 nt, Human
gcuuguauguguauauauacau

SEQ ID NO: 186223 - RNA, 22 nt, Human
gggaauguuaaccuuucuauuu

SEQ ID NO: 186224 - RNA, 22 nt, Human
gggacaggacuccuggggccug

SEQ ID NO: 186225 - RNA, 20 nt, Human
gcuugaauuugauggccaga

SEQ ID NO: 186226 - RNA, 22 nt, Human
gcuucuguuaggauguggcuua

SEQ ID NO: 186227 - RNA, 22 nt, Human
gggaagugagcuggaaucaagg

SEQ ID NO: 186228 - RNA, 22 nt, Human
gcuugcugaacaggaaccuggc

SEQ ID NO: 186229 - RNA, 20 nt, Human
gggaauggauggauugcucc

SEQ ID NO: 186230 - RNA, 22 nt, Human
gggaagugcaguuuucuuuugg

SEQ ID NO: 186231 - RNA, 22 nt, Human
ggccaaagagcacaaugaauag

SEQ ID NO: 186232 - RNA, 22 nt, Human
ggccacgggguuugcugaaacu

SEQ ID NO: 186233 - RNA, 22 nt, Human
gcugagcagcgaaggcacaugc

SEQ ID NO: 186234 - RNA, 22 nt, Human
gcuguguaugaugcaggcaccu

SEQ ID NO: 186235 - RNA, 21 nt, Human
ggccagauucucccauagcug

SEQ ID NO: 186236 - RNA, 22 nt, Human
ggcuuugggaggaugaggcggu

SEQ ID NO: 186237 - RNA, 22 nt, Human
ggcuuuuguuauaaucaggccu

SEQ ID NO: 186238 - RNA, 22 nt, Human
gggaaaaaggaaccuuauuacu

SEQ ID NO: 186239 - RNA, 22 nt, Human
ggcuuuuucccuaggguaagag

SEQ ID NO: 186240 - RNA, 22 nt, Human
gcuguguucauccugcccaggu

SEQ ID NO: 186241 - RNA, 22 nt, Human
ggcuucuuaacauuuggacacc

SEQ ID NO: 186242 - RNA, 19 nt, Human
ggcuuugcccuucgcuccg

SEQ ID NO: 186243 - RNA, 22 nt, Human
gcuguggguuccuccccugucc

SEQ ID NO: 186244 - RNA, 22 nt, Human
ggcuuguaggugauggagaacu

SEQ ID NO: 186245 - RNA, 22 nt, Human
gcuguugcaaucaaggccaugg

SEQ ID NO: 186246 - RNA, 22 nt, Human
gcuguuucuuuggcaaacugau

SEQ ID NO: 186247 - RNA, 22 nt, Human
gcuguuuaaguggaauuuguuu

SEQ ID NO: 186248 - RNA, 22 nt, Human
gcuguuguugcacggaaggugg

SEQ ID NO: 186249 - RNA, 22 nt, Human
gcuuacagauaaugaggagacu

SEQ ID NO: 186250 - RNA, 23 nt, Human
gggaaaucaaaagauauuucuuc

SEQ ID NO: 186251 - RNA, 22 nt, Human
gggaaaucugcuuccuagggcu

SEQ ID NO: 186252 - RNA, 22 nt, Human
gggaacccaaauaggaaaauug

SEQ ID NO: 186253 - RNA, 22 nt, Human
gggaaaugugucuuggcauucu

SEQ ID NO: 186254 - RNA, 22 nt, Human
gcuuacuguuccuguuggugcu

SEQ ID NO: 186255 - RNA, 22 nt, Human
gucugugguccaaaauugccuc

SEQ ID NO: 186256 - RNA, 22 nt, Human
gucuuucuuuuacauauuugug

SEQ ID NO: 186257 - RNA, 22 nt, Human
ggcuggggccuguugaagaugc

SEQ ID NO: 186258 - RNA, 22 nt, Human
gucuuugagccucaguuuccuc

SEQ ID NO: 186259 - RNA, 22 nt, Human
ggcuuacgcgcuaacagugaau

SEQ ID NO: 186260 - RNA, 22 nt, Human
ggcuuaguagggacagaugcac

SEQ ID NO: 186261 - RNA, 22 nt, Human
ggcugugguggacgcgggaaac

SEQ ID NO: 186262 - RNA, 21 nt, Human
ggcuguuaauagugauuagaa

SEQ ID NO: 186263 - RNA, 22 nt, Human
ggcuucucuuggccaugguccc

SEQ ID NO: 186264 - RNA, 22 nt, Human
gugaagcaagggucaccugugg

SEQ ID NO: 186265 - RNA, 22 nt, Human
ggcuuguccuucugguugucuu

SEQ ID NO: 186266 - RNA, 22 nt, Human
gugaaauuguacacucaguacc

SEQ ID NO: 186267 - RNA, 22 nt, Human
ggcuuaugaucugacccaucga

SEQ ID NO: 186268 - RNA, 22 nt, Human
gggaagaagaaaagagguggga

SEQ ID NO: 186269 - RNA, 21 nt, Human
gggaagagaagagaaaggagg

SEQ ID NO: 186270 - RNA, 22 nt, Human
gggaagaaccucugcuaccaau

SEQ ID NO: 186271 - RNA, 22 nt, Human
gugaguguguccgacuccaagg

SEQ ID NO: 186272 - RNA, 22 nt, Human
gugaggugauugcugguguuug

SEQ ID NO: 186273 - RNA, 22 nt, Human
gugaguuuucgugacacuauuu

SEQ ID NO: 186274 - RNA, 22 nt, Human
gugauauaacaauuuagggaau

SEQ ID NO: 186275 - RNA, 22 nt, Human
gugaaggcaugugugcugugcu

SEQ ID NO: 186276 - RNA, 22 nt, Human
gugaagguccugauuugugacc

SEQ ID NO: 186277 - RNA, 22 nt, Human
gugaaggggaagcagggagagg

SEQ ID NO: 186278 - RNA, 20 nt, Human
gugaaguuuucugaagacag

SEQ ID NO: 186279 - RNA, 21 nt, Human
gugaccuguuaugcaaaggca

SEQ ID NO: 186280 - RNA, 22 nt, Human
gggaacuguaguuuacgcugcc

SEQ ID NO: 186281 - RNA, 22 nt, Human
gugacuaugguggagaucagua

SEQ ID NO: 186282 - RNA, 22 nt, Human
gggaaaauguuucugagacaaa

SEQ ID NO: 186283 - RNA, 22 nt, Human
gggaaaaaggaguuagagauaa

SEQ ID NO: 186284 - RNA, 22 nt, Human
gggcaagaagcuggaagcauuc

SEQ ID NO: 186285 - RNA, 22 nt, Human
gggauuaaaaaucaccaaagua

SEQ ID NO: 186286 - RNA, 22 nt, Human
gggaugaaugccuggcuccccc

SEQ ID NO: 186287 - RNA, 22 nt, Human
gugcucgagcugugcgcgcugc

SEQ ID NO: 186288 - RNA, 22 nt, Human
gggauguauguuuguguggaga

SEQ ID NO: 186289 - RNA, 22 nt, Human
gggauggggagcuggaaagggg

SEQ ID NO: 186290 - RNA, 22 nt, Human
gugcucaucuucuguaacuguu

SEQ ID NO: 186291 - RNA, 22 nt, Human
gugccuggugcaggauaaucac

SEQ ID NO: 186292 - RNA, 22 nt, Human
gugcgaaagaagcgacuccagu

SEQ ID NO: 186293 - RNA, 22 nt, Human
gggaggcagacgcuggagccca

SEQ ID NO: 186294 - RNA, 22 nt, Human
gugccgggcugcggcaaggugu

SEQ ID NO: 186295 - RNA, 22 nt, Human
gugcccaguugaggccaggacu

SEQ ID NO: 186296 - RNA, 22 nt, Human
gggagggggauucuggcgagaa

SEQ ID NO: 186297 - RNA, 22 nt, Human
gggaggucgaggcugggccgca

SEQ ID NO: 186298 - RNA, 22 nt, Human
gggaguggagagugaagcuaau

SEQ ID NO: 186299 - RNA, 22 nt, Human
gugccuggaaucuuuucuucac

SEQ ID NO: 186300 - RNA, 22 nt, Human
gugccuuuuucccaguucauug

SEQ ID NO: 186301 - RNA, 22 nt, Human
gggauacuuuguuucccugcca

SEQ ID NO: 186302 - RNA, 20 nt, Human
gggaucgaguaccuccgggu

SEQ ID NO: 186303 - RNA, 22 nt, Human
gggagcucaccaugcucugcau

SEQ ID NO: 186304 - RNA, 22 nt, Human
gggagccagcagggcauggagc

SEQ ID NO: 186305 - RNA, 22 nt, Human
gggaggaagaguaggaauuuga

SEQ ID NO: 186306 - RNA, 22 nt, Human
gugccaaauagcuugauuaaga

SEQ ID NO: 186307 - RNA, 22 nt, Human
gugcagcugggcgcugaccuuc

SEQ ID NO: 186308 - RNA, 22 nt, Human
gugcagcugguggagucugggg

SEQ ID NO: 186309 - RNA, 22 nt, Human
gugauuucaaauauagagugag

SEQ ID NO: 186310 - RNA, 19 nt, Human
gugcacugucacuuugcuc

SEQ ID NO: 186311 - RNA, 22 nt, Human
gugcaaugaguguggcaaagcc

SEQ ID NO: 186312 - RNA, 19 nt, Human
gggagaaaaucuuuauccu

SEQ ID NO: 186313 - RNA, 22 nt, Human
gggacugguuguguguggugug

SEQ ID NO: 186314 - RNA, 22 nt, Human
gugauucaucuggggccuuauu

SEQ ID NO: 186315 - RNA, 22 nt, Human
gggagaaccagccagugcaagg

SEQ ID NO: 186316 - RNA, 22 nt, Human
gggacagcuggggguaaagcau

SEQ ID NO: 186317 - RNA, 22 nt, Human
gggacgggcuagcugccguggc

SEQ ID NO: 186318 - RNA, 22 nt, Human
gggaauuuuaggaugacuccua

SEQ ID NO: 186319 - RNA, 22 nt, Human
gugaugaaggccugcaccuggu

SEQ ID NO: 186320 - RNA, 22 nt, Human
gugaugugugaaggucugcagg

SEQ ID NO: 186321 - RNA, 22 nt, Human
guaugaguggauagauguaucu

SEQ ID NO: 186322 - RNA, 22 nt, Human
ggcgcccucccuguccgucuuc

SEQ ID NO: 186323 - RNA, 22 nt, Human
ggcgccuuguggaaugagagcu

SEQ ID NO: 186324 - RNA, 22 nt, Human
guaucugaaaaagaauucugac

SEQ ID NO: 186325 - RNA, 22 nt, Human
guaucaggacuaaauuauggau

SEQ ID NO: 186326 - RNA, 22 nt, Human
ggcgaggcgggccgcggggucu

SEQ ID NO: 186327 - RNA, 22 nt, Human
gguuugauauguuugugauucu

SEQ ID NO: 186328 - RNA, 22 nt, Human
gguuugggaagaacuauucccu

SEQ ID NO: 186329 - RNA, 22 nt, Human
gguuuguggagcuggaaacacu

SEQ ID NO: 186330 - RNA, 22 nt, Human
gguuuaucuuuacaaaugaaau

SEQ ID NO: 186331 - RNA, 22 nt, Human
ggccagcuuugagcugcaggaa

SEQ ID NO: 186332 - RNA, 22 nt, Human
ggccagucaaggggauccugaa

SEQ ID NO: 186333 - RNA, 22 nt, Human
guauaaauaucuauauuguuac

SEQ ID NO: 186334 - RNA, 22 nt, Human
guauaaagaugccauacuuacu

SEQ ID NO: 186335 - RNA, 22 nt, Human
ggcggugcgaggaugcagggcu

SEQ ID NO: 186336 - RNA, 22 nt, Human
ggcggcugcuccuugcccucgg

SEQ ID NO: 186337 - RNA, 22 nt, Human
gucaguggugcuuaaaguuuca

SEQ ID NO: 186338 - RNA, 22 nt, Human
ggcggcaagggaauggagaaga

SEQ ID NO: 186339 - RNA, 22 nt, Human
gucacuguuucacuguucauua

SEQ ID NO: 186340 - RNA, 22 nt, Human
gucagaagauagaggaaguuug

SEQ ID NO: 186341 - RNA, 22 nt, Human
gucaguccugugccuuuccgga

SEQ ID NO: 186342 - RNA, 22 nt, Human
gucaggugcaccuccaccaaca

SEQ ID NO: 186343 - RNA, 22 nt, Human
gucaggaugagggaugaggagu

SEQ ID NO: 186344 - RNA, 22 nt, Human
gucagauucuuucauuugcuga

SEQ ID NO: 186345 - RNA, 22 nt, Human
guauuuggacugccuguucauu

SEQ ID NO: 186346 - RNA, 22 nt, Human
gucaaugcuuaguuugccugaa

SEQ ID NO: 186347 - RNA, 22 nt, Human
gucaaaguuaacuagcaggugc

SEQ ID NO: 186348 - RNA, 22 nt, Human
gucacucuuuuucagcuagcuc

SEQ ID NO: 186349 - RNA, 22 nt, Human
guauuggcaguauacauagcac

SEQ ID NO: 186350 - RNA, 22 nt, Human
guauucugugugaucaagugau

SEQ ID NO: 186351 - RNA, 22 nt, Human
guauuugacaccagugaauggu

SEQ ID NO: 186352 - RNA, 22 nt, Human
ggcgaguacagacggggccugg

SEQ ID NO: 186353 - RNA, 22 nt, Human
guaugugguaccaugcaacggg

SEQ ID NO: 186354 - RNA, 22 nt, Human
gucccuggucuaccguggcuuc

SEQ ID NO: 186355 - RNA, 22 nt, Human
ggcugcagggaacaggaugggu

SEQ ID NO: 186356 - RNA, 22 nt, Human
guccucgggcucacucccaggg

SEQ ID NO: 186357 - RNA, 22 nt, Human
guccguaauuuuugcuugcaga

SEQ ID NO: 186358 - RNA, 22 nt, Human
guccugauggccauuuuucacu

SEQ ID NO: 186359 - RNA, 22 nt, Human
guccuggugccaccugcgggau

SEQ ID NO: 186360 - RNA, 22 nt, Human
guccuguguaaguacuugcuca

SEQ ID NO: 186361 - RNA, 22 nt, Human
guccuguccuguccuggagaca

SEQ ID NO: 186362 - RNA, 22 nt, Human
guccuggagcagcuggaagaug

SEQ ID NO: 186363 - RNA, 22 nt, Human
ggcuccuuguaugauauuuugu

SEQ ID NO: 186364 - RNA, 22 nt, Human
ggcugcagugcaacucuuucua

SEQ ID NO: 186365 - RNA, 22 nt, Human
ggcuaaucaagaaggcccagug

SEQ ID NO: 186366 - RNA, 22 nt, Human
guccaugugcuaacagugcuua

SEQ ID NO: 186367 - RNA, 22 nt, Human
guccaggucauuuaaaaagucc

SEQ ID NO: 186368 - RNA, 22 nt, Human
guccagaguagucgaguauucu

SEQ ID NO: 186369 - RNA, 22 nt, Human
ggcugcuugauagauaugagua

SEQ ID NO: 186370 - RNA, 20 nt, Human
gucguguauauagcuggggc

SEQ ID NO: 186371 - RNA, 22 nt, Human
gucguucugcuauucuaugagg

SEQ ID NO: 186372 - RNA, 22 nt, Human
gucuauucaucauucaucaaac

SEQ ID NO: 186373 - RNA, 22 nt, Human
ggcugcuggaguugggucucuc

SEQ ID NO: 186374 - RNA, 21 nt, Human
ggcugcucgugaugaacuuca

SEQ ID NO: 186375 - RNA, 22 nt, Human
ggcugcuauuggucuggcuugg

SEQ ID NO: 186376 - RNA, 22 nt, Human
gucgucgcucccaccuuccgcu

SEQ ID NO: 186377 - RNA, 17 nt, Human
ggcugccaggcaacaua

SEQ ID NO: 186378 - RNA, 22 nt, Human
guccuuaaauacgaugaacaug

SEQ ID NO: 186379 - RNA, 22 nt, Human
gucugguggaguuguauauacu

SEQ ID NO: 186380 - RNA, 22 nt, Human
gucuggagccacugcugcugcu

SEQ ID NO: 186381 - RNA, 22 nt, Human
gucugcuuuuaucacaugucau

SEQ ID NO: 186382 - RNA, 22 nt, Human
ggcuggagcaggcugcacagug

SEQ ID NO: 186383 - RNA, 22 nt, Human
ggcuggacuuucugcugggcuc

SEQ ID NO: 186384 - RNA, 22 nt, Human
gucuccugcccacccugguccc

SEQ ID NO: 186385 - RNA, 22 nt, Human
gucugcagcacugugcacgguc

SEQ ID NO: 186386 - RNA, 22 nt, Human
gucugcacgugccagggagggg

SEQ ID NO: 186387 - RNA, 22 nt, Human
gucucuuuugauuuuucacuca

SEQ ID NO: 186388 - RNA, 22 nt, Human
ggugaaggaucccucuuggccu

SEQ ID NO: 186389 - RNA, 22 nt, Human
guuuccaagucucucaacaccc

SEQ ID NO: 186390 - RNA, 18 nt, Human
ggugagggagcuggaagc

SEQ ID NO: 186391 - RNA, 22 nt, Human
ggugauaaaaagcauuuaaauu

SEQ ID NO: 186392 - RNA, 22 nt, Human
guuucuguggacucugcuuagg

SEQ ID NO: 186393 - RNA, 22 nt, Human
guuugagcaaucccucuauccc

SEQ ID NO: 186394 - RNA, 22 nt, Human
guuuggguggcuagagaaagaa

SEQ ID NO: 186395 - RNA, 20 nt, Human
ggucuguuucuucuuuucau

SEQ ID NO: 186396 - RNA, 22 nt, Human
ggucuucauaugccacagaguc

SEQ ID NO: 186397 - RNA, 19 nt, Human
ggucugcggggugaccgug

SEQ ID NO: 186398 - RNA, 22 nt, Human
ggucugcgauggcaagggucuu

SEQ ID NO: 186399 - RNA, 22 nt, Human
guuuaaaagcaaccaacaggcu

SEQ ID NO: 186400 - RNA, 22 nt, Human
ggucugagcaaguuaccauggg

SEQ ID NO: 186401 - RNA, 22 nt, Human
guuuauuucuuaucaucacuau

SEQ ID NO: 186402 - RNA, 22 nt, Human
guuggcgaaggaccuggaggag

SEQ ID NO: 186403 - RNA, 22 nt, Human
guugggauugaaggugccucua

SEQ ID NO: 186404 - RNA, 22 nt, Human
guugggcugaagugugugcuua

SEQ ID NO: 186405 - RNA, 22 nt, Human
guugggguuucaguggcaguca

SEQ ID NO: 186406 - RNA, 22 nt, Human
guuggaaauaucagucacguga

SEQ ID NO: 186407 - RNA, 22 nt, Human
guugcuucuuggcuuuuccaac

SEQ ID NO: 186408 - RNA, 22 nt, Human
gugcugggaggcccaggaugga

SEQ ID NO: 186409 - RNA, 22 nt, Human
gugcuggcaaagagaacaucuu

SEQ ID NO: 186410 - RNA, 22 nt, Human
guuguuuucagcccagcauuag

SEQ ID NO: 186411 - RNA, 22 nt, Human
guuguuaagugcugguuguuag

SEQ ID NO: 186412 - RNA, 22 nt, Human
ggucgguuggagagaucaugaa

SEQ ID NO: 186413 - RNA, 22 nt, Human
ggucgaguuccuuguuuuuuau

SEQ ID NO: 186414 - RNA, 22 nt, Human
ggucggggcuggccggcguggu

SEQ ID NO: 186415 - RNA, 22 nt, Human
ggucgucuguccugucgccgcu

SEQ ID NO: 186416 - RNA, 22 nt, Human
guugugcaaaacaggaaggucu

SEQ ID NO: 186417 - RNA, 19 nt, Human
gguccguuacaggcuuucc

SEQ ID NO: 186418 - RNA, 22 nt, Human
ggucccacgauguaccugucug

SEQ ID NO: 186419 - RNA, 22 nt, Human
gguccgcgcgcagaggcccugg

SEQ ID NO: 186420 - RNA, 22 nt, Human
ggucaucacugagagcagaucc

SEQ ID NO: 186421 - RNA, 21 nt, Human
guugugaccaugggaguugcu

SEQ ID NO: 186422 - RNA, 22 nt, Human
guugucguucccccugcuuaaa

SEQ ID NO: 186423 - RNA, 22 nt, Human
ggugcaaagauggcaguugcaa

SEQ ID NO: 186424 - RNA, 22 nt, Human
ggugcaauaaaguuguagaacc

SEQ ID NO: 186425 - RNA, 22 nt, Human
ggugccugggcacggaaagcau

SEQ ID NO: 186426 - RNA, 22 nt, Human
ggugguucagugguuagggcca

SEQ ID NO: 186427 - RNA, 22 nt, Human
gguggucaggagcgcccguugg

SEQ ID NO: 186428 - RNA, 22 nt, Human
gguguaaucacaagcuggaauu

SEQ ID NO: 186429 - RNA, 22 nt, Human
gguguacgaagaggcgggaguc

SEQ ID NO: 186430 - RNA, 22 nt, Human
gguggggacuuggggucagcgg

SEQ ID NO: 186431 - RNA, 22 nt, Human
gguggguccuuugacagagaug

SEQ ID NO: 186432 - RNA, 22 nt, Human
uaaaaaccuuguauuuaacucu

SEQ ID NO: 186433 - RNA, 22 nt, Human
uaaaaauuagauauguauuuag

SEQ ID NO: 186434 - RNA, 23 nt, Human
guuuuugcugcagcugaagaagg

SEQ ID NO: 186435 - RNA, 22 nt, Human
ggugugugugugugugugugug

SEQ ID NO: 186436 - RNA, 22 nt, Human
uaaaaccauucauugaccuaug

SEQ ID NO: 186437 - RNA, 22 nt, Human
uaaaacuaugcaaccuacuacc

SEQ ID NO: 186438 - RNA, 22 nt, Human
gguugaagcuacuuucuggaug

SEQ ID NO: 186439 - RNA, 22 nt, Human
ggugucagccacuuugucggag

SEQ ID NO: 186440 - RNA, 22 nt, Human
ggugucguuucacaugacccag

SEQ ID NO: 186441 - RNA, 22 nt, Human
uaaacgaagcuucaugcuugaa

SEQ ID NO: 186442 - RNA, 22 nt, Human
uaaaguauucaaguagcuuucu

SEQ ID NO: 186443 - RNA, 22 nt, Human
uaaaaucaugacagauugacau

SEQ ID NO: 186444 - RNA, 22 nt, Human
uaaaaugcucagauaaauauau

SEQ ID NO: 186445 - RNA, 22 nt, Human
gguuugccagugcuggaaugca

SEQ ID NO: 186446 - RNA, 22 nt, Human
gguuucuuuccucucugugccu

SEQ ID NO: 186447 - RNA, 22 nt, Human
gguuuucacgauccucccuuuu

SEQ ID NO: 186448 - RNA, 22 nt, Human
gguuuucagaaugcaguccugu

SEQ ID NO: 186449 - RNA, 22 nt, Human
guacuaguuaaaaauagaauua

SEQ ID NO: 186450 - RNA, 22 nt, Human
guaccuguacauaacuacauau

SEQ ID NO: 186451 - RNA, 22 nt, Human
guacauauggcacaugcuauuu

SEQ ID NO: 186452 - RNA, 22 nt, Human
guaccuuucuaucuagaaggua

SEQ ID NO: 186453 - RNA, 22 nt, Human
uaaauaugcaugugguauucau

SEQ ID NO: 186454 - RNA, 22 nt, Human
guaaccacuaugguuauugauu

SEQ ID NO: 186455 - RNA, 22 nt, Human
gucguuugucaauuuugaugug

SEQ ID NO: 186456 - RNA, 22 nt, Human
gucgagcuggaggagcgaaugg

SEQ ID NO: 186457 - RNA, 22 nt, Human
gucgcuuuccugaggggucuca

SEQ ID NO: 186458 - RNA, 22 nt, Human
gucgagaacauucauuaugcaa

SEQ ID NO: 186459 - RNA, 22 nt, Human
gucuggugguggguguagggca

SEQ ID NO: 186460 - RNA, 22 nt, Human
gucugcucauguuugguuugug

SEQ ID NO: 186461 - RNA, 22 nt, Human
uacaaaauucaaauaauguuug

SEQ ID NO: 186462 - RNA, 22 nt, Human
gugaaaaauggccaucaggaca

SEQ ID NO: 186463 - RNA, 22 nt, Human
uaccgaagcugcuuuugcaugu

SEQ ID NO: 186464 - RNA, 22 nt, Human
gucuguuggcacagggggaggu

SEQ ID NO: 186465 - RNA, 22 nt, Human
gucuugugaagacggcagaaag

SEQ ID NO: 186466 - RNA, 22 nt, Human
gucuucugacacuguuaggagg

SEQ ID NO: 186467 - RNA, 18 nt, Human
gucuguuccuuuaauguc

SEQ ID NO: 186468 - RNA, 22 nt, Human
uacagauaaaaaugcuguucuu

SEQ ID NO: 186469 - RNA, 22 nt, Human
uaccaauuaaauagccaaucua

SEQ ID NO: 186470 - RNA, 22 nt, Human
uacauuguguuaaaacagaaga

SEQ ID NO: 186471 - RNA, 22 nt, Human
uacauggauguuauccuuacug

SEQ ID NO: 186472 - RNA, 23 nt, Human
gugaacaaugcuccaggagauac

SEQ ID NO: 186473 - RNA, 22 nt, Human
uacuucauucaaguucgcuaua

SEQ ID NO: 186474 - RNA, 20 nt, Human
gugaacuggagaacugaugu

SEQ ID NO: 186475 - RNA, 22 nt, Human
uacuucuuuuguaaaguauuga

SEQ ID NO: 186476 - RNA, 22 nt, Human
gugaaacuggaugugaaaacaa

SEQ ID NO: 186477 - RNA, 22 nt, Human
uacuggguguucugagaaaaua

SEQ ID NO: 186478 - RNA, 22 nt, Human
gugaaaugaagugacuggauau

SEQ ID NO: 186479 - RNA, 22 nt, Human
uaccuggauaaauguacaaccg

SEQ ID NO: 186480 - RNA, 22 nt, Human
uaccugguuucuuaaacccaaa

SEQ ID NO: 186481 - RNA, 22 nt, Human
uaccgcagagucauugugagga

SEQ ID NO: 186482 - RNA, 19 nt, Human
gucuuauggauagcuccuc

SEQ ID NO: 186483 - RNA, 22 nt, Human
uacguuuuauaucuuuuggaau

SEQ ID NO: 186484 - RNA, 22 nt, Human
uacuaaacugcauuucuaucua

SEQ ID NO: 186485 - RNA, 22 nt, Human
uacuugcaaggcucuuggaaua

SEQ ID NO: 186486 - RNA, 22 nt, Human
uacuugaacaucacuaagagaa

SEQ ID NO: 186487 - RNA, 22 nt, Human
uacuugaaaugggcaucaagag

SEQ ID NO: 186488 - RNA, 22 nt, Human
uacuuuuuucacuucuagcccc

SEQ ID NO: 186489 - RNA, 22 nt, Human
gugacugagugaagguugggua

SEQ ID NO: 186490 - RNA, 23 nt, Human
gugagaccagagccuauucucag

SEQ ID NO: 186491 - RNA, 23 nt, Human
uacuuuggcuagaguugucucuu

SEQ ID NO: 186492 - RNA, 22 nt, Human
gugaccagacagagucuagccc

SEQ ID NO: 186493 - RNA, 22 nt, Human
gugacugagcuggcaaaguaug

SEQ ID NO: 186494 - RNA, 22 nt, Human
guccuuuuuuuauacccaggcc

SEQ ID NO: 186495 - RNA, 22 nt, Human
uaauuccacacucccgcaagcg

SEQ ID NO: 186496 - RNA, 22 nt, Human
uaauucuucaauccaguguuca

SEQ ID NO: 186497 - RNA, 22 nt, Human
uaauucuacagggaacucugga

SEQ ID NO: 186498 - RNA, 22 nt, Human
guccuucgcggcugaggccauu

SEQ ID NO: 186499 - RNA, 22 nt, Human
guccuguccugcugagcuccug

SEQ ID NO: 186500 - RNA, 22 nt, Human
guccugaaaaaaaucccugagu

SEQ ID NO: 186501 - RNA, 23 nt, Human
gucauuacuguuaccuuauucuu

SEQ ID NO: 186502 - RNA, 22 nt, Human
gucaugaugauacagguggagg

SEQ ID NO: 186503 - RNA, 22 nt, Human
guccaauguggcaccacagggg

SEQ ID NO: 186504 - RNA, 22 nt, Human
guccaguaguguuugcaugugg

SEQ ID NO: 186505 - RNA, 22 nt, Human
guccucgugucuuuuucucuaa

SEQ ID NO: 186506 - RNA, 22 nt, Human
uaauccaaaccaggaauucccu

SEQ ID NO: 186507 - RNA, 22 nt, Human
uaauauaacugccaguuaaggu

SEQ ID NO: 186508 - RNA, 22 nt, Human
gucagugaaccuucaccaaacc

SEQ ID NO: 186509 - RNA, 22 nt, Human
uaagugguagaaagagaaaggu

SEQ ID NO: 186510 - RNA, 22 nt, Human
gucaucugagggacgagauuuc

SEQ ID NO: 186511 - RNA, 22 nt, Human
gucagugcuuuaguucaggaug

SEQ ID NO: 186512 - RNA, 20 nt, Human
gucaucucagggacugucug

SEQ ID NO: 186513 - RNA, 22 nt, Human
uaaggcuguuaggaggauuaaa

SEQ ID NO: 186514 - RNA, 22 nt, Human
uaaggagagaauuuagagguuu

SEQ ID NO: 186515 - RNA, 22 nt, Human
uaagauggaagaaaaggcggau

SEQ ID NO: 186516 - RNA, 22 nt, Human
uaagauuuuuacaaauagagug

SEQ ID NO: 186517 - RNA, 22 nt, Human
guauuaugaaugccgaggcggc

SEQ ID NO: 186518 - RNA, 22 nt, Human
uaagauauugagugguaauuug

SEQ ID NO: 186519 - RNA, 21 nt, Human
uaagaacauuaucuucuuccu

SEQ ID NO: 186520 - RNA, 22 nt, Human
uaacacauagauauuuuaacuu

SEQ ID NO: 186521 - RNA, 22 nt, Human
uaagaaaggggaaguuccucuu

SEQ ID NO: 186522 - RNA, 22 nt, Human
guaugucuuaggguucaguaac

SEQ ID NO: 186523 - RNA, 19 nt, Human
uaagaaucaccaggggugu

SEQ ID NO: 186524 - RNA, 22 nt, Human
uaagacuuuaccaggcucaaau

SEQ ID NO: 186525 - RNA, 22 nt, Human
guauugauuguuuuaaaagauu

SEQ ID NO: 186526 - RNA, 22 nt, Human
guagauaauuuuggaaagcugg

SEQ ID NO: 186527 - RNA, 22 nt, Human
guagaauggggcucucaaagca

SEQ ID NO: 186528 - RNA, 22 nt, Human
guacugguuuucuuacucuggc

SEQ ID NO: 186529 - RNA, 22 nt, Human
guacuuccauccacauauaugu

SEQ ID NO: 186530 - RNA, 22 nt, Human
guggucaagaccgggaauagga

SEQ ID NO: 186531 - RNA, 22 nt, Human
gugguaaagugugccugugguc

SEQ ID NO: 186532 - RNA, 22 nt, Human
gugggugauacugccgugggag

SEQ ID NO: 186533 - RNA, 22 nt, Human
guggguuggguuuuugaaggga

SEQ ID NO: 186534 - RNA, 22 nt, Human
guggugauuugggucuagcuuu

SEQ ID NO: 186535 - RNA, 22 nt, Human
gugguggggaguuggauggaag

SEQ ID NO: 186536 - RNA, 22 nt, Human
guggugggcgugguguaugccu

SEQ ID NO: 186537 - RNA, 22 nt, Human
gugguaagugcuccuauuggcg

SEQ ID NO: 186538 - RNA, 22 nt, Human
gugguuugacccuucagguaaa

SEQ ID NO: 186539 - RNA, 22 nt, Human
guggugguguuggugacaaguu

SEQ ID NO: 186540 - RNA, 21 nt, Human
uaucauuuuuuccccugagau

SEQ ID NO: 186541 - RNA, 22 nt, Human
uaucauuaggagugcugcucgg

SEQ ID NO: 186542 - RNA, 22 nt, Human
uaucauuuuacugugacauuuu

SEQ ID NO: 186543 - RNA, 22 nt, Human
uaugcgguccaucaggggcacu

SEQ ID NO: 186544 - RNA, 22 nt, Human
uaugccaaaaauaaguuuuaug

SEQ ID NO: 186545 - RNA, 22 nt, Human
guguauuucuagaagaaaugaa

SEQ ID NO: 186546 - RNA, 22 nt, Human
guguucccauccacaccaagcc

SEQ ID NO: 186547 - RNA, 22 nt, Human
uauccaucuucuuugagaaugg

SEQ ID NO: 186548 - RNA, 22 nt, Human
uaucuucaauagcccagaugug

SEQ ID NO: 186549 - RNA, 22 nt, Human
uaucuuugccuuggguuuuguu

SEQ ID NO: 186550 - RNA, 22 nt, Human
guguagugugcuguucaguguu

SEQ ID NO: 186551 - RNA, 22 nt, Human
uauguggcaggugggagaucag

SEQ ID NO: 186552 - RNA, 22 nt, Human
guuaaaggaagccauauguucg

SEQ ID NO: 186553 - RNA, 22 nt, Human
uaugugaguaccugucaugugc

SEQ ID NO: 186554 - RNA, 22 nt, Human
guuaaaugcagauucugacuca

SEQ ID NO: 186555 - RNA, 22 nt, Human
guuaguucccaccccuguaaga

SEQ ID NO: 186556 - RNA, 22 nt, Human
guuaggcagugugguauagcag

SEQ ID NO: 186557 - RNA, 22 nt, Human
uauguuuugcaaauaucaaaca

SEQ ID NO: 186558 - RNA, 22 nt, Human
uauguucaauaccagguucuuu

SEQ ID NO: 186559 - RNA, 22 nt, Human
uauguuugcaguucuaggucuu

SEQ ID NO: 186560 - RNA, 22 nt, Human
guguuucccuggcacaagaacc

SEQ ID NO: 186561 - RNA, 23 nt, Human
guguuguugauuuucgaaucuuu

SEQ ID NO: 186562 - RNA, 22 nt, Human
guguuugagagguacaagggaa

SEQ ID NO: 186563 - RNA, 22 nt, Human
uauguauaacuugauaggauga

SEQ ID NO: 186564 - RNA, 22 nt, Human
guucaaggagcagcuugcuaca

SEQ ID NO: 186565 - RNA, 22 nt, Human
guuauuaaauauuuuggugauu

SEQ ID NO: 186566 - RNA, 22 nt, Human
uauuauggguuuuuguguaaau

SEQ ID NO: 186567 - RNA, 19 nt, Human
uauuagccucaucccagcc

SEQ ID NO: 186568 - RNA, 22 nt, Human
guuccugagcaguuccuggcca

SEQ ID NO: 186569 - RNA, 22 nt, Human
guuccucugaaggauuuucaga

SEQ ID NO: 186570 - RNA, 22 nt, Human
guuccucugugguggaggaagg

SEQ ID NO: 186571 - RNA, 22 nt, Human
guucggcuuccuaugucaugag

SEQ ID NO: 186572 - RNA, 22 nt, Human
guuccugugcccuguucuuucc

SEQ ID NO: 186573 - RNA, 16 nt, Human
guuccuguguguacaa

SEQ ID NO: 186574 - RNA, 22 nt, Human
uauuggguagguccuuuggagu

SEQ ID NO: 186575 - RNA, 22 nt, Human
guucgucuguggugugaggugc

SEQ ID NO: 186576 - RNA, 22 nt, Human
guucuacaugacacucaacauu

SEQ ID NO: 186577 - RNA, 22 nt, Human
uauuuuaaaagcauuaauucuu

SEQ ID NO: 186578 - RNA, 22 nt, Human
guucuucucuuguaauggaauc

SEQ ID NO: 186579 - RNA, 22 nt, Human
guucucuccugcuggugaugga

SEQ ID NO: 186580 - RNA, 22 nt, Human
guucugcccaggccuccccaac

SEQ ID NO: 186581 - RNA, 22 nt, Human
guucuguuguugaucuuuggag

SEQ ID NO: 186582 - RNA, 22 nt, Human
guucuggaggagagccuggugu

SEQ ID NO: 186583 - RNA, 22 nt, Human
guugcuggggcugaguccccag

SEQ ID NO: 186584 - RNA, 23 nt, Human
uauuuuccccuguaauauguauu

SEQ ID NO: 186585 - RNA, 22 nt, Human
guugcggaguguagcgaugcuu

SEQ ID NO: 186586 - RNA, 22 nt, Human
guugccugguuucaaaaggaau

SEQ ID NO: 186587 - RNA, 22 nt, Human
uauuuuuuuaacauuuauugua

SEQ ID NO: 186588 - RNA, 22 nt, Human
uauuuuucacagauuggugcuu

SEQ ID NO: 186589 - RNA, 22 nt, Human
uauuuucucugccacacuucca

SEQ ID NO: 186590 - RNA, 22 nt, Human
uauuuuauuuagguuuaguugu

SEQ ID NO: 186591 - RNA, 22 nt, Human
guugggugccagaggcuucacg

SEQ ID NO: 186592 - RNA, 22 nt, Human
guuggugagaguuagggauuua

SEQ ID NO: 186593 - RNA, 22 nt, Human
ucaagaagauaaugucuagggu

SEQ ID NO: 186594 - RNA, 20 nt, Human
guugggagaagugucagcug

SEQ ID NO: 186595 - RNA, 22 nt, Human
ucaaaggcuugugguucuggga

SEQ ID NO: 186596 - RNA, 22 nt, Human
ucaacagaagugauagcuauua

SEQ ID NO: 186597 - RNA, 22 nt, Human
ucaaauaugggccagaggaaau

SEQ ID NO: 186598 - RNA, 22 nt, Human
guggccugacagaucggaacag

SEQ ID NO: 186599 - RNA, 22 nt, Human
guggccuuccuguuccuuugaa

SEQ ID NO: 186600 - RNA, 22 nt, Human
guggcuggguggaacugagucu

SEQ ID NO: 186601 - RNA, 22 nt, Human
guggcgucgaugauggugucau

SEQ ID NO: 186602 - RNA, 18 nt, Human
guggccauugaccagcuu

SEQ ID NO: 186603 - RNA, 22 nt, Human
guggcuugguauuaaggugcca

SEQ ID NO: 186604 - RNA, 22 nt, Human
guggcuuauguccagcagauau

SEQ ID NO: 186605 - RNA, 22 nt, Human
guggcuuucuaccauuaaauug

SEQ ID NO: 186606 - RNA, 22 nt, Human
guggccaaggcagagaaagagc

SEQ ID NO: 186607 - RNA, 22 nt, Human
uaguaauagcuguaaagugugu

SEQ ID NO: 186608 - RNA, 22 nt, Human
uagguggaaccauaugaaauuu

SEQ ID NO: 186609 - RNA, 22 nt, Human
uagguuuugugucagaguagaa

SEQ ID NO: 186610 - RNA, 22 nt, Human
uaggcaguagcuuuggauguca

SEQ ID NO: 186611 - RNA, 22 nt, Human
uaggcagggauuaggguugauu

SEQ ID NO: 186612 - RNA, 22 nt, Human
uaggccugcugaagagcaagcu

SEQ ID NO: 186613 - RNA, 22 nt, Human
uagguaauacuuagaccugauu

SEQ ID NO: 186614 - RNA, 22 nt, Human
uagguauguuaacugugcaauu

SEQ ID NO: 186615 - RNA, 22 nt, Human
guggcaaguuuucugacaagga

SEQ ID NO: 186616 - RNA, 22 nt, Human
guggcaguaaagcuggaaaagu

SEQ ID NO: 186617 - RNA, 20 nt, Human
guggcagugguggcagcagu

SEQ ID NO: 186618 - RNA, 22 nt, Human
uagucggcuaggagggccuucu

SEQ ID NO: 186619 - RNA, 22 nt, Human
uagucucagaauauuugcugau

SEQ ID NO: 186620 - RNA, 22 nt, Human
uagucaauuagaaagaggccuu

SEQ ID NO: 186621 - RNA, 22 nt, Human
uaguauuuguaauuaucaaagc

SEQ ID NO: 186622 - RNA, 22 nt, Human
guggguauauauaugugugcug

SEQ ID NO: 186623 - RNA, 22 nt, Human
gugggugaguggggccgccuga

SEQ ID NO: 186624 - RNA, 22 nt, Human
uaguggaaacagacugagcccg

SEQ ID NO: 186625 - RNA, 22 nt, Human
gugggaaacagccuugcuucua

SEQ ID NO: 186626 - RNA, 22 nt, Human
gugggaguggagcucagcaugu

SEQ ID NO: 186627 - RNA, 18 nt, Human
gugggcacacacucuguu

SEQ ID NO: 186628 - RNA, 22 nt, Human
gugggcacguccuacugucacu

SEQ ID NO: 186629 - RNA, 22 nt, Human
gugggcagauuaauuucucaau

SEQ ID NO: 186630 - RNA, 22 nt, Human
gugggggugaggaauguucuau

SEQ ID NO: 186631 - RNA, 22 nt, Human
gugggggcuaaauugaggggug

SEQ ID NO: 186632 - RNA, 20 nt, Human
uaguaugggagaagaucucc

SEQ ID NO: 186633 - RNA, 21 nt, Human
uaggaacuguucugagugguc

SEQ ID NO: 186634 - RNA, 22 nt, Human
gugcugcaaggauggagaggca

SEQ ID NO: 186635 - RNA, 23 nt, Human
uagcggccaugacgggggucaca

SEQ ID NO: 186636 - RNA, 22 nt, Human
uagcuagacacucagggccuca

SEQ ID NO: 186637 - RNA, 22 nt, Human
uagcucuuaccagugaaguuug

SEQ ID NO: 186638 - RNA, 22 nt, Human
uacuucaguuacaugaagguau

SEQ ID NO: 186639 - RNA, 22 nt, Human
uagcuggaggggcaggaugcug

SEQ ID NO: 186640 - RNA, 22 nt, Human
gugagaggaggcagcuuuuaca

SEQ ID NO: 186641 - RNA, 21 nt, Human
uagaagagggaauuugucuuu

SEQ ID NO: 186642 - RNA, 17 nt, Human
uagccagcuugugauuu

SEQ ID NO: 186643 - RNA, 22 nt, Human
uagcauuucacugaucuucacu

SEQ ID NO: 186644 - RNA, 22 nt, Human
uagccguugggguaacuggaca

SEQ ID NO: 186645 - RNA, 22 nt, Human
uaggauaacaauuuguaguuuc

SEQ ID NO: 186646 - RNA, 22 nt, Human
uaggagcagauggcagcaggug

SEQ ID NO: 186647 - RNA, 22 nt, Human
guggauaaguuguuugaccuac

SEQ ID NO: 186648 - RNA, 22 nt, Human
guggauggagcuggaagccauu

SEQ ID NO: 186649 - RNA, 22 nt, Human
guggagauauuugugauagggg

SEQ ID NO: 186650 - RNA, 22 nt, Human
guggagaagggaccgggaagga

SEQ ID NO: 186651 - RNA, 22 nt, Human
guggagaucuggugcccccugg

SEQ ID NO: 186652 - RNA, 22 nt, Human
guggaggaagaucuuugaugau

SEQ ID NO: 186653 - RNA, 22 nt, Human
gugcuguuagcgguuuauaaca

SEQ ID NO: 186654 - RNA, 22 nt, Human
gugcugcaugagcaucacguag

SEQ ID NO: 186655 - RNA, 22 nt, Human
gugcuuuaccuuauuggucucg

SEQ ID NO: 186656 - RNA, 22 nt, Human
gugcuugaguaaaaauagucuu

SEQ ID NO: 186657 - RNA, 22 nt, Human
gugcugucguggaacugggcug

SEQ ID NO: 186658 - RNA, 22 nt, Human
gugcuuccuguauugauuccau

SEQ ID NO: 186659 - RNA, 22 nt, Human
guggaagggaaaccgcacuggc

SEQ ID NO: 186660 - RNA, 22 nt, Human
guggaagauauuucugguccag

SEQ ID NO: 186661 - RNA, 22 nt, Human
guggaaggaauuaacagacuag

SEQ ID NO: 186662 - RNA, 22 nt, Human
uacgugucacugaugaaguuua

SEQ ID NO: 186663 - RNA, 22 nt, Human
uacuaaagaaugaguuaaguuu

SEQ ID NO: 186664 - RNA, 22 nt, Human
uaccuuuuuauucuuaaggccg

SEQ ID NO: 186665 - RNA, 22 nt, Human
uacguaauagcuuuauuuuggg

SEQ ID NO: 186666 - RNA, 22 nt, Human
uccauggucgauggcugcuggg

SEQ ID NO: 186667 - RNA, 22 nt, Human
uacuagacugagaaucagcuga

SEQ ID NO: 186668 - RNA, 22 nt, Human
uccaggacgccgacgugucggc

SEQ ID NO: 186669 - RNA, 22 nt, Human
uccagguaggagaccaggcugu

SEQ ID NO: 186670 - RNA, 22 nt, Human
uacagcuuccucuaugguggcc

SEQ ID NO: 186671 - RNA, 22 nt, Human
uacaguauuuuuuaagaaaaaa

SEQ ID NO: 186672 - RNA, 21 nt, Human
uacagcucaucaauuacugcu

SEQ ID NO: 186673 - RNA, 22 nt, Human
uccaaugugccuuauuuugagc

SEQ ID NO: 186674 - RNA, 22 nt, Human
uacaggaggaugugcagccagg

SEQ ID NO: 186675 - RNA, 22 nt, Human
uccacaaagucuaugagaguug

SEQ ID NO: 186676 - RNA, 20 nt, Human
uccccuccacuuuccuccua

SEQ ID NO: 186677 - RNA, 22 nt, Human
uccccgcugcgcccgcugcugc

SEQ ID NO: 186678 - RNA, 22 nt, Human
uccccaugaacuuguggcugcu

SEQ ID NO: 186679 - RNA, 22 nt, Human
uccccgcuccguagagaaagag

SEQ ID NO: 186680 - RNA, 22 nt, Human
uacuucccacuggggucuacca

SEQ ID NO: 186681 - RNA, 22 nt, Human
uacugaagaugccaucacaagc

SEQ ID NO: 186682 - RNA, 22 nt, Human
uacugaauuacugcugguaaau

SEQ ID NO: 186683 - RNA, 22 nt, Human
uacugacguaguagaguugcuu

SEQ ID NO: 186684 - RNA, 21 nt, Human
uccccugugccuggcauacag

SEQ ID NO: 186685 - RNA, 22 nt, Human
uccccugccccccauccucugg

SEQ ID NO: 186686 - RNA, 22 nt, Human
uacuuuggugaaauuggaaaua

SEQ ID NO: 186687 - RNA, 22 nt, Human
uacuuuaauugcaaaaauaaau

SEQ ID NO: 186688 - RNA, 22 nt, Human
uacuugucuuuauuuuaaugcu

SEQ ID NO: 186689 - RNA, 22 nt, Human
ucccguuucacuccuugccagc

SEQ ID NO: 186690 - RNA, 22 nt, Human
ucccugagcuguguuuguuggu

SEQ ID NO: 186691 - RNA, 22 nt, Human
ucccugagagacuucuuuggcu

SEQ ID NO: 186692 - RNA, 22 nt, Human
ucccugcagggccauugugcag

SEQ ID NO: 186693 - RNA, 22 nt, Human
ucccugccuccuggcagugcca

SEQ ID NO: 186694 - RNA, 22 nt, Human
ucccugcugggcgaucuucucu

SEQ ID NO: 186695 - RNA, 22 nt, Human
ucccugcgugagaaagcacuua

SEQ ID NO: 186696 - RNA, 21 nt, Human
uccguucgguuaaaaaggccc

SEQ ID NO: 186697 - RNA, 22 nt, Human
uccggcgaccuccagauguucc

SEQ ID NO: 186698 - RNA, 22 nt, Human
uccgaccuuuacuucuugucuc

SEQ ID NO: 186699 - RNA, 22 nt, Human
uagaggcuagugguuaugaccu

SEQ ID NO: 186700 - RNA, 22 nt, Human
uagaguaagugugugcugagcu

SEQ ID NO: 186701 - RNA, 22 nt, Human
ucccuuuuuaauugugucccug

SEQ ID NO: 186702 - RNA, 23 nt, Human
ucccuuuguucuugcuaggaugu

SEQ ID NO: 186703 - RNA, 22 nt, Human
uagaacuguaaauuaucucucc

SEQ ID NO: 186704 - RNA, 22 nt, Human
uagaagagcaugucaaacuaua

SEQ ID NO: 186705 - RNA, 22 nt, Human
uagaacugcucucauacuugcu

SEQ ID NO: 186706 - RNA, 22 nt, Human
uagaagaacaugucaaacuaua

SEQ ID NO: 186707 - RNA, 22 nt, Human
uagaacaaacagcauguuugau

SEQ ID NO: 186708 - RNA, 22 nt, Human
ucccuucagcuccagcucugcu

SEQ ID NO: 186709 - RNA, 22 nt, Human
ucccuguuuccugcgcuccuuc

SEQ ID NO: 186710 - RNA, 22 nt, Human
uagaugguguccagaaagagaa

SEQ ID NO: 186711 - RNA, 22 nt, Human
uccuccuuuccccgcuggagcc

SEQ ID NO: 186712 - RNA, 22 nt, Human
uagcacauaguaggcacaggcu

SEQ ID NO: 186713 - RNA, 22 nt, Human
uccucccugcacucagugaagu

SEQ ID NO: 186714 - RNA, 22 nt, Human
uagcagaacaauagucaaugau

SEQ ID NO: 186715 - RNA, 20 nt, Human
uccugaaauuacgugauuca

SEQ ID NO: 186716 - RNA, 22 nt, Human
uccuugaccuccugacaguaac

SEQ ID NO: 186717 - RNA, 22 nt, Human
uagcguaugcugugugaugaau

SEQ ID NO: 186718 - RNA, 22 nt, Human
uagcguucuugcaugcuaaccu

SEQ ID NO: 186719 - RNA, 22 nt, Human
uccugggcuugcucuuuccauu

SEQ ID NO: 186720 - RNA, 22 nt, Human
uccugcucucuccauuccuucc

SEQ ID NO: 186721 - RNA, 22 nt, Human
uccugcuucaaucugcugcugg

SEQ ID NO: 186722 - RNA, 22 nt, Human
uccuggaagggaugguugagga

SEQ ID NO: 186723 - RNA, 22 nt, Human
ucagguuuaagugacuggaauc

SEQ ID NO: 186724 - RNA, 22 nt, Human
ucaguaagauugauauuucccc

SEQ ID NO: 186725 - RNA, 22 nt, Human
ucagguuuuuaaggagcuagga

SEQ ID NO: 186726 - RNA, 22 nt, Human
ucaguauuagugcauuaucagg

SEQ ID NO: 186727 - RNA, 22 nt, Human
ucagucacugucucagacagga

SEQ ID NO: 186728 - RNA, 22 nt, Human
ucagucacugugaaaugaauuu

SEQ ID NO: 186729 - RNA, 22 nt, Human
uaaaggcaaacucuccaaggau

SEQ ID NO: 186730 - RNA, 22 nt, Human
uaaagugaaguucagaauggcu

SEQ ID NO: 186731 - RNA, 22 nt, Human
uaaaugaaaugaagugaaagcu

SEQ ID NO: 186732 - RNA, 22 nt, Human
uaaaugagcaccucuaguuuug

SEQ ID NO: 186733 - RNA, 22 nt, Human
uaaaugaaaggguuuaauuuau

SEQ ID NO: 186734 - RNA, 21 nt, Human
ucaagcggcagagcaguuauu

SEQ ID NO: 186735 - RNA, 22 nt, Human
ucaagcacugugcaaugagcuu

SEQ ID NO: 186736 - RNA, 22 nt, Human
ucaagagauauaugcugguuua

SEQ ID NO: 186737 - RNA, 22 nt, Human
guugguggaggcgagagaagaa

SEQ ID NO: 186738 - RNA, 22 nt, Human
uaaaggaguguauaauuguagu

SEQ ID NO: 186739 - RNA, 18 nt, Human
ucagggaaacuuugccug

SEQ ID NO: 186740 - RNA, 22 nt, Human
ucaggguacuuguggccaaagu

SEQ ID NO: 186741 - RNA, 22 nt, Human
ucaggaggucugcugcggggug

SEQ ID NO: 186742 - RNA, 22 nt, Human
uaaaggaccuguacuagguuua

SEQ ID NO: 186743 - RNA, 22 nt, Human
ucaggagaguguucaguggagg

SEQ ID NO: 186744 - RNA, 22 nt, Human
uaaauuagauucccagcgcuau

SEQ ID NO: 186745 - RNA, 22 nt, Human
uaaaugcucuuuaaaagugcuu

SEQ ID NO: 186746 - RNA, 22 nt, Human
uaaauguacugaggcaacagga

SEQ ID NO: 186747 - RNA, 22 nt, Human
uaaauuugugaauuagcuauca

SEQ ID NO: 186748 - RNA, 22 nt, Human
ucaguggaacacacagaguggg

SEQ ID NO: 186749 - RNA, 22 nt, Human
ucagucuucaggacuaugaaaa

SEQ ID NO: 186750 - RNA, 22 nt, Human
ucagucugcuauagguauuugu

SEQ ID NO: 186751 - RNA, 22 nt, Human
uaacauuagcuuugcucaugca

SEQ ID NO: 186752 - RNA, 22 nt, Human
uaacaguauacuacaucauauu

SEQ ID NO: 186753 - RNA, 22 nt, Human
uaaccuugaagacugagcugac

SEQ ID NO: 186754 - RNA, 22 nt, Human
uaaccaggaaaaagauaugcau

SEQ ID NO: 186755 - RNA, 18 nt, Human
uaacugguuucuucccau

SEQ ID NO: 186756 - RNA, 22 nt, Human
uaacucugcuguggaaauggga

SEQ ID NO: 186757 - RNA, 22 nt, Human
uaacuuuucuguucaauuuucc

SEQ ID NO: 186758 - RNA, 22 nt, Human
ucaguguccuucguucuuguug

SEQ ID NO: 186759 - RNA, 22 nt, Human
uaaccuuuuuuaaaguuuccug

SEQ ID NO: 186760 - RNA, 22 nt, Human
uaauuucauuuugcaaugaucu

SEQ ID NO: 186761 - RNA, 22 nt, Human
uaauuugauuucucccuggaaa

SEQ ID NO: 186762 - RNA, 22 nt, Human
uaauugaacguucauuuuuaau

SEQ ID NO: 186763 - RNA, 22 nt, Human
uaauuuagugcauuuccuagua

SEQ ID NO: 186764 - RNA, 22 nt, Human
uaauuuugucacagugacaugc

SEQ ID NO: 186765 - RNA, 22 nt, Human
uaauauauuuuuuaagggaugu

SEQ ID NO: 186766 - RNA, 22 nt, Human
uaauaguugaaggucaucacua

SEQ ID NO: 186767 - RNA, 22 nt, Human
uaauauccaguuauuucccuca

SEQ ID NO: 186768 - RNA, 22 nt, Human
uaauaucuuuacacauuuucaa

SEQ ID NO: 186769 - RNA, 22 nt, Human
ucauuuguauucuacaaagcac

SEQ ID NO: 186770 - RNA, 17 nt, Human
ucauuucaguaaaucca

SEQ ID NO: 186771 - RNA, 22 nt, Human
ucauuuaucgcugccuuuuaaa

SEQ ID NO: 186772 - RNA, 18 nt, Human
uccaaaccuuuuacuucc

SEQ ID NO: 186773 - RNA, 22 nt, Human
ucaugagcacaggugcagggac

SEQ ID NO: 186774 - RNA, 22 nt, Human
uaaggaaaugcaaauuuaagaa

SEQ ID NO: 186775 - RNA, 22 nt, Human
uaaguauguuagaaaaucaagu

SEQ ID NO: 186776 - RNA, 22 nt, Human
ucauggcucuaaagacauagau

SEQ ID NO: 186777 - RNA, 22 nt, Human
ucauggguauaauuuuagaugu

SEQ ID NO: 186778 - RNA, 22 nt, Human
ucauuagcuaucagaguggaac

SEQ ID NO: 186779 - RNA, 17 nt, Human
ucaguugugcgagcagc

SEQ ID NO: 186780 - RNA, 22 nt, Human
ucaguuguuggaaguagaugua

SEQ ID NO: 186781 - RNA, 22 nt, Human
ucaguugagguggucuauugcg

SEQ ID NO: 186782 - RNA, 22 nt, Human
ucaguugauggcaguuaauguc

SEQ ID NO: 186783 - RNA, 22 nt, Human
ucaguuacucugauguccugug

SEQ ID NO: 186784 - RNA, 22 nt, Human
ucaucgauggggagcucuacaa

SEQ ID NO: 186785 - RNA, 22 nt, Human
ucauacuuuuuugacccuugug

SEQ ID NO: 186786 - RNA, 21 nt, Human
ucauaauaauuacaugggggg

SEQ ID NO: 186787 - RNA, 22 nt, Human
ucauaaguuguugacuagcaaa

SEQ ID NO: 186788 - RNA, 22 nt, Human
ucauauugguagagauguguaa

SEQ ID NO: 186789 - RNA, 22 nt, Human
ucugggguucuuaauuuggaag

SEQ ID NO: 186790 - RNA, 22 nt, Human
uauguuaauuaccagcacugau

SEQ ID NO: 186791 - RNA, 22 nt, Human
ucuggugcacucugauauuuga

SEQ ID NO: 186792 - RNA, 22 nt, Human
ucugguuaggcuugugaggucc

SEQ ID NO: 186793 - RNA, 22 nt, Human
ucugguuuggguugcuauggcu

SEQ ID NO: 186794 - RNA, 22 nt, Human
ucuguagcuuuagaggacagga

SEQ ID NO: 186795 - RNA, 22 nt, Human
ucuguauuuuuuacacacaugc

SEQ ID NO: 186796 - RNA, 22 nt, Human
uauuaaaagagaaaaagccacc

SEQ ID NO: 186797 - RNA, 22 nt, Human
uauuacugccacaucauuaggu

SEQ ID NO: 186798 - RNA, 22 nt, Human
uauguugucuuguucagccaua

SEQ ID NO: 186799 - RNA, 19 nt, Human
ucuguggccuucccugaug

SEQ ID NO: 186800 - RNA, 22 nt, Human
ucuguggcaaacacagugacca

SEQ ID NO: 186801 - RNA, 22 nt, Human
uauuagggaacugcaagacuaa

SEQ ID NO: 186802 - RNA, 20 nt, Human
ucuguggcagguggcgcuug

SEQ ID NO: 186803 - RNA, 21 nt, Human
ucugugcuuuuuuggcuccua

SEQ ID NO: 186804 - RNA, 21 nt, Human
ucuguuguguguugaggacuu

SEQ ID NO: 186805 - RNA, 22 nt, Human
ucuguuuacaugucagcagcaa

SEQ ID NO: 186806 - RNA, 22 nt, Human
ucuguuuuccaggaaucucaua

SEQ ID NO: 186807 - RNA, 22 nt, Human
ucuguucacaauuacacacacu

SEQ ID NO: 186808 - RNA, 22 nt, Human
ucuguuauaaaucacacugcau

SEQ ID NO: 186809 - RNA, 22 nt, Human
ucuguucaugucuuuuuaagug

SEQ ID NO: 186810 - RNA, 22 nt, Human
ucuguucagaagaggugaaagu

SEQ ID NO: 186811 - RNA, 22 nt, Human
ucuguucucuuguucugacggu

SEQ ID NO: 186812 - RNA, 22 nt, Human
uauuaugguuguagguuaacaa

SEQ ID NO: 186813 - RNA, 22 nt, Human
uauucagugcugguucuuuuuc

SEQ ID NO: 186814 - RNA, 21 nt, Human
uauucgcauuucugucuuuac

SEQ ID NO: 186815 - RNA, 22 nt, Human
uauucauuuuuauuugugacug

SEQ ID NO: 186816 - RNA, 22 nt, Human
uauucccacuccucagcaauuu

SEQ ID NO: 186817 - RNA, 22 nt, Human
ucuguuucaggggucuggaaug

SEQ ID NO: 186818 - RNA, 22 nt, Human
ucuguuuuuaucuauucuguua

SEQ ID NO: 186819 - RNA, 22 nt, Human
ucuucacagaugcauauacuuc

SEQ ID NO: 186820 - RNA, 22 nt, Human
ucuuauucuuuuaaacaacgca

SEQ ID NO: 186821 - RNA, 22 nt, Human
ucugcuuaguuuucuugaacag

SEQ ID NO: 186822 - RNA, 22 nt, Human
uaugguuucuccugcagauuug

SEQ ID NO: 186823 - RNA, 22 nt, Human
uauguaacaccauuuacaaagu

SEQ ID NO: 186824 - RNA, 20 nt, Human
ucugcuugucuucagguucc

SEQ ID NO: 186825 - RNA, 22 nt, Human
ucugcuuuucuuaaggggauca

SEQ ID NO: 186826 - RNA, 22 nt, Human
uaugcuguauucuguauguuag

SEQ ID NO: 186827 - RNA, 22 nt, Human
uauggcuaguguguuuguaaca

SEQ ID NO: 186828 - RNA, 22 nt, Human
uauggacagcuuucuuuguguu

SEQ ID NO: 186829 - RNA, 22 nt, Human
uaugggaaggauuugucuuuca

SEQ ID NO: 186830 - RNA, 22 nt, Human
uaugguuagugcuguagauuau

SEQ ID NO: 186831 - RNA, 21 nt, Human
ucuggccuauaaaguagucgc

SEQ ID NO: 186832 - RNA, 22 nt, Human
ucuggcaguugccgcuucaguc

SEQ ID NO: 186833 - RNA, 22 nt, Human
ucuggcacuugccaguuucuau

SEQ ID NO: 186834 - RNA, 22 nt, Human
uaugugaaauggaauauagaaa

SEQ ID NO: 186835 - RNA, 22 nt, Human
uauguauguauguauguauaug

SEQ ID NO: 186836 - RNA, 22 nt, Human
ucugggccaacccuuccauggg

SEQ ID NO: 186837 - RNA, 20 nt, Human
uaugugcaguuugguuuauc

SEQ ID NO: 186838 - RNA, 22 nt, Human
ucuggcuucaguaggguucacu

SEQ ID NO: 186839 - RNA, 22 nt, Human
ucugggaccuagacccauuguu

SEQ ID NO: 186840 - RNA, 22 nt, Human
ucuggcucuccagugcucuuag

SEQ ID NO: 186841 - RNA, 22 nt, Human
uaugugguuugucauuuaauau

SEQ ID NO: 186842 - RNA, 18 nt, Human
uaugugucuguuacaacu

SEQ ID NO: 186843 - RNA, 22 nt, Human
uaugugugaguauauaugcaca

SEQ ID NO: 186844 - RNA, 22 nt, Human
ucugauucucuuguugaccuag

SEQ ID NO: 186845 - RNA, 17 nt, Human
ucugcagaggcaaaccu

SEQ ID NO: 186846 - RNA, 22 nt, Human
ucugauaaggaaggauuaaaag

SEQ ID NO: 186847 - RNA, 22 nt, Human
ucugaucagaagacaaaugagg

SEQ ID NO: 186848 - RNA, 22 nt, Human
uaugagguuaucuaugucguau

SEQ ID NO: 186849 - RNA, 22 nt, Human
uaugaguauagugcaccauggu

SEQ ID NO: 186850 - RNA, 22 nt, Human
uaugacugcucagugaauggaa

SEQ ID NO: 186851 - RNA, 22 nt, Human
ucugagugggaacucucaugac

SEQ ID NO: 186852 - RNA, 19 nt, Human
uaugacaaguacuaguucu

SEQ ID NO: 186853 - RNA, 22 nt, Human
ucugagugacguccugacagga

SEQ ID NO: 186854 - RNA, 22 nt, Human
uaugaauauaccacaauuuagg

SEQ ID NO: 186855 - RNA, 22 nt, Human
ucugcccaggaggucccauggg

SEQ ID NO: 186856 - RNA, 23 nt, Human
ucugccuccuaauuguugguguc

SEQ ID NO: 186857 - RNA, 22 nt, Human
ucugcaugccucaggaggccug

SEQ ID NO: 186858 - RNA, 22 nt, Human
uaugcuagauggaaaaauauug

SEQ ID NO: 186859 - RNA, 20 nt, Human
uaugcgaagccuuucuggac

SEQ ID NO: 186860 - RNA, 22 nt, Human
ucugcgggccuggcucccagcg

SEQ ID NO: 186861 - RNA, 21 nt, Human
ucugccaguuucucuuacuuu

SEQ ID NO: 186862 - RNA, 22 nt, Human
uaugcacacguguccaugugca

SEQ ID NO: 186863 - RNA, 22 nt, Human
uaugcagauaguuugccauuca

SEQ ID NO: 186864 - RNA, 22 nt, Human
uaugauuuucaugguagaguua

SEQ ID NO: 186865 - RNA, 22 nt, Human
uauauauaauguguacagguga

SEQ ID NO: 186866 - RNA, 22 nt, Human
uauauauacauauagaauaugu

SEQ ID NO: 186867 - RNA, 22 nt, Human
uauaggugagugaagcucagga

SEQ ID NO: 186868 - RNA, 22 nt, Human
uauauacuugaaaauugcugag

SEQ ID NO: 186869 - RNA, 22 nt, Human
uauauacacgcacauauacaua

SEQ ID NO: 186870 - RNA, 22 nt, Human
ucucucugcuguccagcguuau

SEQ ID NO: 186871 - RNA, 22 nt, Human
ucucugcguucaucccaucaca

SEQ ID NO: 186872 - RNA, 22 nt, Human
ucucugaggacagaaaguuugu

SEQ ID NO: 186873 - RNA, 22 nt, Human
ucucugguggcuccaucaguag

SEQ ID NO: 186874 - RNA, 22 nt, Human
ucucuguaguugggcagcugcu

SEQ ID NO: 186875 - RNA, 22 nt, Human
uauccaaaggaacaaucacagc

SEQ ID NO: 186876 - RNA, 22 nt, Human
uauauuuguccuagcuccuagc

SEQ ID NO: 186877 - RNA, 22 nt, Human
uauauguagcucaaaaauuccc

SEQ ID NO: 186878 - RNA, 22 nt, Human
ucugaagagaacucuuaguguu

SEQ ID NO: 186879 - RNA, 22 nt, Human
ucucuuuuuuuaaaacucuaug

SEQ ID NO: 186880 - RNA, 22 nt, Human
ucugaccaggcucuuguagccu

SEQ ID NO: 186881 - RNA, 22 nt, Human
ucugaauauguuuaucaucucu

SEQ ID NO: 186882 - RNA, 22 nt, Human
ucucuucggagagaccuuugga

SEQ ID NO: 186883 - RNA, 22 nt, Human
ucucugugaauggcgucaccug

SEQ ID NO: 186884 - RNA, 23 nt, Human
uaucccauacagagagugguaca

SEQ ID NO: 186885 - RNA, 22 nt, Human
ucugagcaggaaagagcagaga

SEQ ID NO: 186886 - RNA, 22 nt, Human
ucugagagcuguagaagccuau

SEQ ID NO: 186887 - RNA, 22 nt, Human
uaugaaagguuuuuucuugaaa

SEQ ID NO: 186888 - RNA, 22 nt, Human
uaugaaggauacaccucugauu

SEQ ID NO: 186889 - RNA, 22 nt, Human
ucugaggacagugcugugccug

SEQ ID NO: 186890 - RNA, 21 nt, Human
ucugaggagaaacucuuggug

SEQ ID NO: 186891 - RNA, 22 nt, Human
ucugagucgcucccuggaucca

SEQ ID NO: 186892 - RNA, 22 nt, Human
ucugaguagaaucauucauaaa

SEQ ID NO: 186893 - RNA, 22 nt, Human
uaucuguauuguagaacuguug

SEQ ID NO: 186894 - RNA, 22 nt, Human
ucugacugucccguagaggaac

SEQ ID NO: 186895 - RNA, 22 nt, Human
uaucugcuggagguaauuacuc

SEQ ID NO: 186896 - RNA, 22 nt, Human
ucuauuguuauccuuuccauuu

SEQ ID NO: 186897 - RNA, 22 nt, Human
ucuauuauauuuacacgagagu

SEQ ID NO: 186898 - RNA, 22 nt, Human
ucuaugaagucuuccuuuccuc

SEQ ID NO: 186899 - RNA, 20 nt, Human
ucuaggguuugguuaucauc

SEQ ID NO: 186900 - RNA, 22 nt, Human
uaguugaauuuaucaguagcau

SEQ ID NO: 186901 - RNA, 22 nt, Human
ucucaggcuuccuggugcugug

SEQ ID NO: 186902 - RNA, 22 nt, Human
ucucaaagguuuuccucuuuuu

SEQ ID NO: 186903 - RNA, 23 nt, Human
ucucaccaggauaugacugucac

SEQ ID NO: 186904 - RNA, 22 nt, Human
uagcuucacuuuuguugaugcg

SEQ ID NO: 186905 - RNA, 19 nt, Human
uagcuguucuugaguguga

SEQ ID NO: 186906 - RNA, 20 nt, Human
uagcuucaccuagagauagc

SEQ ID NO: 186907 - RNA, 22 nt, Human
uaggaagagauuuucacauggc

SEQ ID NO: 186908 - RNA, 22 nt, Human
ucuaggcugugugugggcaggg

SEQ ID NO: 186909 - RNA, 22 nt, Human
uaguuacuuuugcucuucauua

SEQ ID NO: 186910 - RNA, 22 nt, Human
uaguuauuucugcacuuaauga

SEQ ID NO: 186911 - RNA, 22 nt, Human
uaguucauucucucuauuccug

SEQ ID NO: 186912 - RNA, 22 nt, Human
ucuccuuugaaaguuaggacug

SEQ ID NO: 186913 - RNA, 22 nt, Human
ucuccucuuaaugcacguuucc

SEQ ID NO: 186914 - RNA, 22 nt, Human
ucuccucucugaucuugcuccg

SEQ ID NO: 186915 - RNA, 22 nt, Human
uauaaucuugcccauaguauuu

SEQ ID NO: 186916 - RNA, 22 nt, Human
uauaagaaacaaggcaaauuuu

SEQ ID NO: 186917 - RNA, 22 nt, Human
uauaagaaaagucauuaucaaa

SEQ ID NO: 186918 - RNA, 22 nt, Human
uauacauauacaaaugcacaua

SEQ ID NO: 186919 - RNA, 22 nt, Human
ucuccaccccugggaggcagaa

SEQ ID NO: 186920 - RNA, 22 nt, Human
ucuccaggaaagacacuggacu

SEQ ID NO: 186921 - RNA, 22 nt, Human
ucuccagcugaggccuucuucc

SEQ ID NO: 186922 - RNA, 23 nt, Human
ucuccccuccagcccucccuccu

SEQ ID NO: 186923 - RNA, 21 nt, Human
ucucauuuuaacacagaguug

SEQ ID NO: 186924 - RNA, 20 nt, Human
ucucauuuugauuucgcauu

SEQ ID NO: 186925 - RNA, 22 nt, Human
ucucauacguuuccagguguca

SEQ ID NO: 186926 - RNA, 22 nt, Human
uaguugguggagcgauuugucu

SEQ ID NO: 186927 - RNA, 22 nt, Human
uaguuuuaagcugacauuguuc

SEQ ID NO: 186928 - RNA, 22 nt, Human
uaguuuucuuuuguguuauucu

SEQ ID NO: 186929 - RNA, 18 nt, Human
uauaaacacacuuagguu

SEQ ID NO: 186930 - RNA, 23 nt, Human
uggaagaaaaugguuuggcugug

SEQ ID NO: 186931 - RNA, 22 nt, Human
ucugcacagcucaccucccugg

SEQ ID NO: 186932 - RNA, 22 nt, Human
ucugaucuuucauccuaaaugg

SEQ ID NO: 186933 - RNA, 22 nt, Human
ucugauucauucugguaaaugg

SEQ ID NO: 186934 - RNA, 22 nt, Human
ucugaugaccacaugugggacu

SEQ ID NO: 186935 - RNA, 22 nt, Human
uggaagcuagggguuucuguug

SEQ ID NO: 186936 - RNA, 22 nt, Human
uggaagcuggcugaucugacuu

SEQ ID NO: 186937 - RNA, 22 nt, Human
ucugcuguugaucaugacuagc

SEQ ID NO: 186938 - RNA, 22 nt, Human
ucugcguggcgugguucugugc

SEQ ID NO: 186939 - RNA, 22 nt, Human
ucugcuggugucauuuuugcua

SEQ ID NO: 186940 - RNA, 22 nt, Human
ucugguuccugcauucauucaa

SEQ ID NO: 186941 - RNA, 22 nt, Human
uggaagugucagcaggcugguu

SEQ ID NO: 186942 - RNA, 22 nt, Human
ucugguuucccaguuccuccgu

SEQ ID NO: 186943 - RNA, 22 nt, Human
ucugguagauuauuuagaguac

SEQ ID NO: 186944 - RNA, 17 nt, Human
ucuggguuucugauuua

SEQ ID NO: 186945 - RNA, 22 nt, Human
ucuggucugccgagauccauuu

SEQ ID NO: 186946 - RNA, 22 nt, Human
ucugggucuaucccaugccuuu

SEQ ID NO: 186947 - RNA, 22 nt, Human
ucuggguuuccuucacaagcac

SEQ ID NO: 186948 - RNA, 22 nt, Human
ucuggcucaggagcuguguuca

SEQ ID NO: 186949 - RNA, 22 nt, Human
uggaagugggcaucaccaucca

SEQ ID NO: 186950 - RNA, 22 nt, Human
uggaaguggcaggggagacgua

SEQ ID NO: 186951 - RNA, 22 nt, Human
ucugugugugcauguguguaua

SEQ ID NO: 186952 - RNA, 22 nt, Human
ucuguguguguggcuaaacaag

SEQ ID NO: 186953 - RNA, 22 nt, Human
uggauaugaaacaaaacaagag

SEQ ID NO: 186954 - RNA, 22 nt, Human
uggauauuuuguaugugcguuu

SEQ ID NO: 186955 - RNA, 22 nt, Human
ucuguuuuucagaccuuuuugg

SEQ ID NO: 186956 - RNA, 22 nt, Human
ucuguuuugugcuuuguuuucu

SEQ ID NO: 186957 - RNA, 19 nt, Human
ucuguugcuuuguguccuc

SEQ ID NO: 186958 - RNA, 22 nt, Human
ucuguuguauggcugucuaauu

SEQ ID NO: 186959 - RNA, 22 nt, Human
ucuguaacaucaguguaauuuu

SEQ ID NO: 186960 - RNA, 22 nt, Human
ucugucaguguccucguguggu

SEQ ID NO: 186961 - RNA, 22 nt, Human
ucuguagucuuggagccgcaca

SEQ ID NO: 186962 - RNA, 17 nt, Human
ucuguguccgcucaguc

SEQ ID NO: 186963 - RNA, 22 nt, Human
ucugugcuccuuccuugucauc

SEQ ID NO: 186964 - RNA, 22 nt, Human
ucugucucugucaggcugcugc

SEQ ID NO: 186965 - RNA, 22 nt, Human
uggccccauuuuucuggagccu

SEQ ID NO: 186966 - RNA, 22 nt, Human
uggcauuugagcuggaaggaug

SEQ ID NO: 186967 - RNA, 22 nt, Human
uggcauuuuguagcuguguauc

SEQ ID NO: 186968 - RNA, 22 nt, Human
uggccgaugagcaugcgcugau

SEQ ID NO: 186969 - RNA, 20 nt, Human
uggccgacccugaggaguug

SEQ ID NO: 186970 - RNA, 20 nt, Human
uggcccgcgcuccuccugcu

SEQ ID NO: 186971 - RNA, 21 nt, Human
uggcccgagccgggguuggcu

SEQ ID NO: 186972 - RNA, 22 nt, Human
uggcaucacagacaaggcagca

SEQ ID NO: 186973 - RNA, 22 nt, Human
ucuucuuauuuuaugaucgcuu

SEQ ID NO: 186974 - RNA, 22 nt, Human
ucuugcuguagcuguuucuucu

SEQ ID NO: 186975 - RNA, 22 nt, Human
ucuugcuggagucaaggcuaca

SEQ ID NO: 186976 - RNA, 22 nt, Human
uggcggcggggagguaggcaga

SEQ ID NO: 186977 - RNA, 22 nt, Human
uggcgcgcucgcucucgcugag

SEQ ID NO: 186978 - RNA, 22 nt, Human
uggcgcucacccugcggcccug

SEQ ID NO: 186979 - RNA, 22 nt, Human
uggcgcgcagccugcuggugcu

SEQ ID NO: 186980 - RNA, 22 nt, Human
ucuuuaucugugagcagucucc

SEQ ID NO: 186981 - RNA, 22 nt, Human
ucuuucucuccagccuggaccu

SEQ ID NO: 186982 - RNA, 22 nt, Human
uggcucaggccuacgacgccuu

SEQ ID NO: 186983 - RNA, 22 nt, Human
uggcucacaggaggcagaggug

SEQ ID NO: 186984 - RNA, 22 nt, Human
uggcagugagauuucucuucug

SEQ ID NO: 186985 - RNA, 22 nt, Human
ucuucaugaaauugauugcuua

SEQ ID NO: 186986 - RNA, 22 nt, Human
ucuucuuaggaaagucaggagg

SEQ ID NO: 186987 - RNA, 22 nt, Human
ucuucuuacauuaaguugaaac

SEQ ID NO: 186988 - RNA, 22 nt, Human
ucuucccgggcaucucugcuca

SEQ ID NO: 186989 - RNA, 21 nt, Human
ucuucccaggccuuaaagggc

SEQ ID NO: 186990 - RNA, 22 nt, Human
uggaucaugcgaggccuccccu

SEQ ID NO: 186991 - RNA, 22 nt, Human
uggcaaacacaauauggguaca

SEQ ID NO: 186992 - RNA, 22 nt, Human
uggcaagcuguuggcagauagc

SEQ ID NO: 186993 - RNA, 22 nt, Human
ucuuauuucuuucuuuuccugu

SEQ ID NO: 186994 - RNA, 20 nt, Human
ucuucagcuccaagucuggc

SEQ ID NO: 186995 - RNA, 23 nt, Human
uggcaaacgggaauaaaggaauu

SEQ ID NO: 186996 - RNA, 22 nt, Human
ucuucacugaagcuuugcaucu

SEQ ID NO: 186997 - RNA, 22 nt, Human
ucucugguagcucugugcucug

SEQ ID NO: 186998 - RNA, 19 nt, Human
ucucugguggcuccaucag

SEQ ID NO: 186999 - RNA, 22 nt, Human
ucucuggcuuuuuuuccauuuu

SEQ ID NO: 187000 - RNA, 22 nt, Human
ucucugucucccguguguccgg

SEQ ID NO: 187001 - RNA, 22 nt, Human
ucucuguacauagugaagcccg

SEQ ID NO: 187002 - RNA, 22 nt, Human
ugcuugugcacacacauguuau

SEQ ID NO: 187003 - RNA, 22 nt, Human
ugcuuguuuuguggcuucagcu

SEQ ID NO: 187004 - RNA, 22 nt, Human
ucucuggacggacauuuaaggu

SEQ ID NO: 187005 - RNA, 22 nt, Human
ugcuugcuaucuaaguguuuca

SEQ ID NO: 187006 - RNA, 22 nt, Human
ugcuugaggcuugucaucuaac

SEQ ID NO: 187007 - RNA, 22 nt, Human
ucucucggagcuaccggaaguu

SEQ ID NO: 187008 - RNA, 22 nt, Human
ucucucgguacagcuggcugga

SEQ ID NO: 187009 - RNA, 22 nt, Human
ucucucucucuuccagcauguu

SEQ ID NO: 187010 - RNA, 21 nt, Human
ucucuaucguauaccagccgg

SEQ ID NO: 187011 - RNA, 20 nt, Human
ucucucacccuugcugugca

SEQ ID NO: 187012 - RNA, 22 nt, Human
ugcuucuuugggggugaagaga

SEQ ID NO: 187013 - RNA, 17 nt, Human
ucuccuggcucuaucag

SEQ ID NO: 187014 - RNA, 22 nt, Human
ucucgcuguuccugcuucaggu

SEQ ID NO: 187015 - RNA, 22 nt, Human
ugcuuaucuccuuaguuuuugc

SEQ ID NO: 187016 - RNA, 22 nt, Human
ucucuacuuggcuuguguucac

SEQ ID NO: 187017 - RNA, 21 nt, Human
ugcuuuuguugucagcugcug

SEQ ID NO: 187018 - RNA, 17 nt, Human
ucugaccuuuacuccug

SEQ ID NO: 187019 - RNA, 22 nt, Human
uggaaaagaugucuuccugaau

SEQ ID NO: 187020 - RNA, 22 nt, Human
ucugaguuaaaauuccagaggu

SEQ ID NO: 187021 - RNA, 22 nt, Human
ucugacguugguucugcccuuu

SEQ ID NO: 187022 - RNA, 22 nt, Human
ucugaccccccuugccuccacu

SEQ ID NO: 187023 - RNA, 22 nt, Human
ucugaaaggagaguagggcaga

SEQ ID NO: 187024 - RNA, 22 nt, Human
ucugaaauuuuaguuauagaaa

SEQ ID NO: 187025 - RNA, 18 nt, Human
ucugaaggaaugauucca

SEQ ID NO: 187026 - RNA, 22 nt, Human
ucucuugcuauugcgaacaggu

SEQ ID NO: 187027 - RNA, 20 nt, Human
ucucuuuuucuucuuuucuc

SEQ ID NO: 187028 - RNA, 22 nt, Human
ucucauaucuguacacccuugu

SEQ ID NO: 187029 - RNA, 22 nt, Human
ucucagcuggcugggagcccug

SEQ ID NO: 187030 - RNA, 22 nt, Human
ucucagaaaugacaggagguac

SEQ ID NO: 187031 - RNA, 22 nt, Human
ucucauaauuguuucccagcua

SEQ ID NO: 187032 - RNA, 20 nt, Human
ugcugggccaucuugcaugc

SEQ ID NO: 187033 - RNA, 22 nt, Human
ucucauugugcuuuuuguacug

SEQ ID NO: 187034 - RNA, 22 nt, Human
ugcuggaguggcacuguguggc

SEQ ID NO: 187035 - RNA, 22 nt, Human
ugcugugcuggcggcagaggcc

SEQ ID NO: 187036 - RNA, 22 nt, Human
ucuccucuauuucuguauguau

SEQ ID NO: 187037 - RNA, 18 nt, Human
ucuccgaccccgcggucc

SEQ ID NO: 187038 - RNA, 22 nt, Human
ucucccuuuggauuuguuuugg

SEQ ID NO: 187039 - RNA, 22 nt, Human
ugcuguacaagacccucuguuu

SEQ ID NO: 187040 - RNA, 22 nt, Human
ucucccgcuuccugcuggcugc

SEQ ID NO: 187041 - RNA, 22 nt, Human
ucucccaaaucuuucuagcaca

SEQ ID NO: 187042 - RNA, 22 nt, Human
ucgcuguguccuuuucacuuau

SEQ ID NO: 187043 - RNA, 22 nt, Human
ucgcuucugaguuggugacccc

SEQ ID NO: 187044 - RNA, 22 nt, Human
ucgcuuuaauggucuucacagc

SEQ ID NO: 187045 - RNA, 19 nt, Human
ucggaaugugggaagcaug

SEQ ID NO: 187046 - RNA, 22 nt, Human
ugcggagggagcagucggcugu

SEQ ID NO: 187047 - RNA, 21 nt, Human
ucuagaugggaugaaaggugc

SEQ ID NO: 187048 - RNA, 22 nt, Human
ucgccccccgccucacccucgg

SEQ ID NO: 187049 - RNA, 22 nt, Human
ugcggaaggcagcgcagggugg

SEQ ID NO: 187050 - RNA, 22 nt, Human
ugcgcgccgacggcuccgugac

SEQ ID NO: 187051 - RNA, 22 nt, Human
ucgcucgcuggcuccugcccgc

SEQ ID NO: 187052 - RNA, 22 nt, Human
ugcugcucaagcugcagcaaaa

SEQ ID NO: 187053 - RNA, 22 nt, Human
ucucaaagagcuacuggucuau

SEQ ID NO: 187054 - RNA, 23 nt, Human
uccuccccaccuuuguccccucc

SEQ ID NO: 187055 - RNA, 22 nt, Human
uccucccgaaugaguagaaggg

SEQ ID NO: 187056 - RNA, 22 nt, Human
uccucgccgucacgcagccucu

SEQ ID NO: 187057 - RNA, 18 nt, Human
ugcccaccagaagaggga

SEQ ID NO: 187058 - RNA, 22 nt, Human
uccugcaugcuagugagugcuu

SEQ ID NO: 187059 - RNA, 19 nt, Human
ugccccacccucuauccag

SEQ ID NO: 187060 - RNA, 19 nt, Human
ugccccuucuucauccauc

SEQ ID NO: 187061 - RNA, 22 nt, Human
ugcaucugagcacuacggugga

SEQ ID NO: 187062 - RNA, 22 nt, Human
uccucagcaaacacuucacucu

SEQ ID NO: 187063 - RNA, 22 nt, Human
uccuagaccuacugaaucagac

SEQ ID NO: 187064 - RNA, 22 nt, Human
ugccaaagauagagguuugagu

SEQ ID NO: 187065 - RNA, 22 nt, Human
ugcauuuugaaggaaaaaaaug

SEQ ID NO: 187066 - RNA, 22 nt, Human
ugcauguuauuguggcaagaau

SEQ ID NO: 187067 - RNA, 22 nt, Human
ugcccuagaucacauuacaggu

SEQ ID NO: 187068 - RNA, 21 nt, Human
uccugccuggccuucugacua

SEQ ID NO: 187069 - RNA, 21 nt, Human
uccugccuuaguccagagcag

SEQ ID NO: 187070 - RNA, 22 nt, Human
uccuggccucugagucaagaac

SEQ ID NO: 187071 - RNA, 22 nt, Human
uccuggcgugggcuggcugcag

SEQ ID NO: 187072 - RNA, 22 nt, Human
uccuuguaccauuugcucacag

SEQ ID NO: 187073 - RNA, 22 nt, Human
ugccuaguuuaaaucauuuucu

SEQ ID NO: 187074 - RNA, 20 nt, Human
ugccugagcgcagcuccagg

SEQ ID NO: 187075 - RNA, 22 nt, Human
ugccuguguuugggguggggaa

SEQ ID NO: 187076 - RNA, 22 nt, Human
uccuuucaaauuuauuugacau

SEQ ID NO: 187077 - RNA, 19 nt, Human
ugccuggcaccagcuccac

SEQ ID NO: 187078 - RNA, 22 nt, Human
ugccuggacgacaucacaguga

SEQ ID NO: 187079 - RNA, 22 nt, Human
ugcgccuccugcugccugcccu

SEQ ID NO: 187080 - RNA, 22 nt, Human
ucccugccuuauuuucauaugc

SEQ ID NO: 187081 - RNA, 22 nt, Human
ucccugcaggcauguacucuga

SEQ ID NO: 187082 - RNA, 22 nt, Human
ugcagcaucuccuugugccaug

SEQ ID NO: 187083 - RNA, 18 nt, Human
ugcaggggaggggugaua

SEQ ID NO: 187084 - RNA, 22 nt, Human
ugcagggucuccuguacuuggg

SEQ ID NO: 187085 - RNA, 22 nt, Human
ugcaggaagcucagcggggccg

SEQ ID NO: 187086 - RNA, 22 nt, Human
uccgggagcccccggaggagga

SEQ ID NO: 187087 - RNA, 22 nt, Human
uccgggcagcuccuggagcugu

SEQ ID NO: 187088 - RNA, 22 nt, Human
uccgcguugguuagagagggcu

SEQ ID NO: 187089 - RNA, 22 nt, Human
uccguccacacuuagagaguuu

SEQ ID NO: 187090 - RNA, 18 nt, Human
uccggaggucagaguaaa

SEQ ID NO: 187091 - RNA, 22 nt, Human
ugcaggucuggacccccacuuu

SEQ ID NO: 187092 - RNA, 22 nt, Human
uccgugggucuugaagugucac

SEQ ID NO: 187093 - RNA, 22 nt, Human
uccgugguguuggcucuccggc

SEQ ID NO: 187094 - RNA, 22 nt, Human
ugcagugaugcuucuggcucag

SEQ ID NO: 187095 - RNA, 22 nt, Human
ugcagguuuucagauguguguu

SEQ ID NO: 187096 - RNA, 22 nt, Human
ugcaguugcguuugcauuccau

SEQ ID NO: 187097 - RNA, 22 nt, Human
ugcagugcagcuggaauaucuu

SEQ ID NO: 187098 - RNA, 22 nt, Human
ugcagugcagcuggaaguuggc

SEQ ID NO: 187099 - RNA, 22 nt, Human
ugcauaugcauguaccuguguu

SEQ ID NO: 187100 - RNA, 22 nt, Human
ugcaauggauaucugaacgugg

SEQ ID NO: 187101 - RNA, 22 nt, Human
ucccacagcuuccuagccacag

SEQ ID NO: 187102 - RNA, 22 nt, Human
ucccacgugccaucugcucugu

SEQ ID NO: 187103 - RNA, 22 nt, Human
ucccagcaggcaccgcuucugc

SEQ ID NO: 187104 - RNA, 22 nt, Human
uccccaccuaagauacccaucu

SEQ ID NO: 187105 - RNA, 23 nt, Human
uccccagcugcccgugucccggg

SEQ ID NO: 187106 - RNA, 22 nt, Human
ucccagccugacagugcaucaa

SEQ ID NO: 187107 - RNA, 22 nt, Human
ucccauauuauggggaaaaacu

SEQ ID NO: 187108 - RNA, 22 nt, Human
uccccggagucccuggccaggg

SEQ ID NO: 187109 - RNA, 22 nt, Human
ucccgcccugcguucucccaug

SEQ ID NO: 187110 - RNA, 22 nt, Human
ugauugguauguauguuuguca

SEQ ID NO: 187111 - RNA, 22 nt, Human
ugauuuagguauuuucuuuugu

SEQ ID NO: 187112 - RNA, 23 nt, Human
ucccaacuuugaaauauuccaca

SEQ ID NO: 187113 - RNA, 22 nt, Human
uccagccugaacuuuguccaga

SEQ ID NO: 187114 - RNA, 22 nt, Human
uccagcacacagguggcucuca

SEQ ID NO: 187115 - RNA, 22 nt, Human
uccagcuccugaguucacugcu

SEQ ID NO: 187116 - RNA, 21 nt, Human
uccaggagcacgggacuagga

SEQ ID NO: 187117 - RNA, 22 nt, Human
uccagcuucugccugcugcugc

SEQ ID NO: 187118 - RNA, 22 nt, Human
uccaggagucagacagauggug

SEQ ID NO: 187119 - RNA, 22 nt, Human
uccaggaggacugagggggcug

SEQ ID NO: 187120 - RNA, 22 nt, Human
ugagacugaguuugguuuuguu

SEQ ID NO: 187121 - RNA, 22 nt, Human
ugagagaauuacuaaagggcuu

SEQ ID NO: 187122 - RNA, 22 nt, Human
ugagaggaagggaaagaugauu

SEQ ID NO: 187123 - RNA, 22 nt, Human
ugagagguagaacuuguagugu

SEQ ID NO: 187124 - RNA, 22 nt, Human
ucagucauacuuuaugauugaa

SEQ ID NO: 187125 - RNA, 22 nt, Human
ucagucauguuuaccagacgua

SEQ ID NO: 187126 - RNA, 22 nt, Human
ucuucaucucuaaaaugggaac

SEQ ID NO: 187127 - RNA, 22 nt, Human
ucuucaggaaaaccaaaguugu

SEQ ID NO: 187128 - RNA, 21 nt, Human
ucuuccaacacugacaccaug

SEQ ID NO: 187129 - RNA, 22 nt, Human
ugagaacacuuuucucuuugcu

SEQ ID NO: 187130 - RNA, 22 nt, Human
ucaggucacugauaaaguggaa

SEQ ID NO: 187131 - RNA, 22 nt, Human
ucagguuuaagcuacuggaauc

SEQ ID NO: 187132 - RNA, 22 nt, Human
ugagagacggagccccggcucg

SEQ ID NO: 187133 - RNA, 18 nt, Human
ucaguccuccauagagcu

SEQ ID NO: 187134 - RNA, 22 nt, Human
ucagucucuggggcuucuguuu

SEQ ID NO: 187135 - RNA, 23 nt, Human
ucagugccaaggagaacuuggug

SEQ ID NO: 187136 - RNA, 22 nt, Human
ucagugagauuuuuagcaguag

SEQ ID NO: 187137 - RNA, 22 nt, Human
ucagugauccagauauuugagc

SEQ ID NO: 187138 - RNA, 22 nt, Human
ucagucugguggaugcucauug

SEQ ID NO: 187139 - RNA, 23 nt, Human
ucagugaaggaacaacuaaauag

SEQ ID NO: 187140 - RNA, 22 nt, Human
ugagauuuagaacuggauuuca

SEQ ID NO: 187141 - RNA, 20 nt, Human
ucaguggcauaguugcuaag

SEQ ID NO: 187142 - RNA, 22 nt, Human
ugagccauguucaugaguucau

SEQ ID NO: 187143 - RNA, 22 nt, Human
ugagcuauuucaccauauagau

SEQ ID NO: 187144 - RNA, 21 nt, Human
ugagcccaaagcuguauuggu

SEQ ID NO: 187145 - RNA, 22 nt, Human
ugaggaggugcuaccagcgucu

SEQ ID NO: 187146 - RNA, 22 nt, Human
ugaggaacaugggagaaauguc

SEQ ID NO: 187147 - RNA, 22 nt, Human
ugaggcaguucuuacuuguauu

SEQ ID NO: 187148 - RNA, 22 nt, Human
ugaggaugaggaagaagaagaa

SEQ ID NO: 187149 - RNA, 22 nt, Human
ucaguuuaauuggaucuuuuuc

SEQ ID NO: 187150 - RNA, 19 nt, Human
ucagugggacauuugcuuu

SEQ ID NO: 187151 - RNA, 22 nt, Human
ugagccugaguguguauugaac

SEQ ID NO: 187152 - RNA, 22 nt, Human
ugagccauguucaugagguuca

SEQ ID NO: 187153 - RNA, 22 nt, Human
ucaugccugcgauugucccugg

SEQ ID NO: 187154 - RNA, 22 nt, Human
ucaugcagauaagaauaaguaa

SEQ ID NO: 187155 - RNA, 22 nt, Human
ucaugggcaaacuuggggauca

SEQ ID NO: 187156 - RNA, 22 nt, Human
ucauguauucugggcaggagau

SEQ ID NO: 187157 - RNA, 22 nt, Human
ucaugcagaguagaaagggcaa

SEQ ID NO: 187158 - RNA, 22 nt, Human
ucaugauaauacaggccuucua

SEQ ID NO: 187159 - RNA, 22 nt, Human
ucaugacaacuugcacaguuuu

SEQ ID NO: 187160 - RNA, 22 nt, Human
ugauauaaaagauucuuauuga

SEQ ID NO: 187161 - RNA, 22 nt, Human
ucaucuauaaguagcaucuggg

SEQ ID NO: 187162 - RNA, 22 nt, Human
ucaucggcugucaucuucacgu

SEQ ID NO: 187163 - RNA, 22 nt, Human
ucaucuuucuuuauggaaauac

SEQ ID NO: 187164 - RNA, 22 nt, Human
ucauccugucucuguucggaau

SEQ ID NO: 187165 - RNA, 22 nt, Human
ucauccugaagaaccugcuucc

SEQ ID NO: 187166 - RNA, 22 nt, Human
ucaguuuaucuagcugggggaa

SEQ ID NO: 187167 - RNA, 20 nt, Human
ucaguuucccuauuagguug

SEQ ID NO: 187168 - RNA, 22 nt, Human
ucauaaaaucaguguccauugu

SEQ ID NO: 187169 - RNA, 22 nt, Human
ucauaagucucauauaugucca

SEQ ID NO: 187170 - RNA, 16 nt, Human
ucauaaacugcagcuu

SEQ ID NO: 187171 - RNA, 17 nt, Human
ugaggcugucucccugg

SEQ ID NO: 187172 - RNA, 22 nt, Human
ugaggcuuucacuuggcaaaga

SEQ ID NO: 187173 - RNA, 22 nt, Human
ucauccgcaaccacuuuagccu

SEQ ID NO: 187174 - RNA, 22 nt, Human
ucaucccuuccugcacuauuag

SEQ ID NO: 187175 - RNA, 22 nt, Human
ugaugaugauacauuucuucag

SEQ ID NO: 187176 - RNA, 22 nt, Human
ugaucauguucuccaaaagcgu

SEQ ID NO: 187177 - RNA, 22 nt, Human
ugauggugagaugucccguguu

SEQ ID NO: 187178 - RNA, 22 nt, Human
ugauggaucuguuggcggguuu

SEQ ID NO: 187179 - RNA, 18 nt, Human
ugauggcuaagagccggg

SEQ ID NO: 187180 - RNA, 22 nt, Human
ucauuuuaucaggaauggaauc

SEQ ID NO: 187181 - RNA, 22 nt, Human
ucauuugggauuuuuuauaauu

SEQ ID NO: 187182 - RNA, 22 nt, Human
ugaugaugccaaaauuuggcau

SEQ ID NO: 187183 - RNA, 22 nt, Human
ugaugugugaauucuuaaaugu

SEQ ID NO: 187184 - RNA, 22 nt, Human
ugauuagauacuucagaugaca

SEQ ID NO: 187185 - RNA, 22 nt, Human
ugauuagccguccuuuuauuaa

SEQ ID NO: 187186 - RNA, 20 nt, Human
ugauuauuccaacaagaaug

SEQ ID NO: 187187 - RNA, 22 nt, Human
ugauugaauaauguuaugugaa

SEQ ID NO: 187188 - RNA, 22 nt, Human
ugauugauaaugaagacaguca

SEQ ID NO: 187189 - RNA, 22 nt, Human
uccaccuaagucuccgggagcu

SEQ ID NO: 187190 - RNA, 22 nt, Human
ugauucaguacuuucucuaacu

SEQ ID NO: 187191 - RNA, 22 nt, Human
ugcccagcagggagcuaccugg

SEQ ID NO: 187192 - RNA, 22 nt, Human
ugccccagcacauuuacuaucc

SEQ ID NO: 187193 - RNA, 22 nt, Human
ugccaguaauuguccuguagcu

SEQ ID NO: 187194 - RNA, 22 nt, Human
ugccagucggcacuuuaucugg

SEQ ID NO: 187195 - RNA, 22 nt, Human
ugccagugugccuuccgcucac

SEQ ID NO: 187196 - RNA, 20 nt, Human
ugccagagagcucauacccu

SEQ ID NO: 187197 - RNA, 22 nt, Human
ugcauguuucuguauguuaaug

SEQ ID NO: 187198 - RNA, 22 nt, Human
ugcaugguuauauacuacuagu

SEQ ID NO: 187199 - RNA, 22 nt, Human
ugccagcuccgaggagcugcag

SEQ ID NO: 187200 - RNA, 22 nt, Human
ugccaaugauuccacaauggaa

SEQ ID NO: 187201 - RNA, 21 nt, Human
ugccccucuuuucuuuccuuc

SEQ ID NO: 187202 - RNA, 22 nt, Human
ugccgcuuucuggcccucaguc

SEQ ID NO: 187203 - RNA, 22 nt, Human
ugccgccccggggcccccagcc

SEQ ID NO: 187204 - RNA, 22 nt, Human
ugcccuuucuccagugaccauu

SEQ ID NO: 187205 - RNA, 22 nt, Human
ugcccugucccuagguuugugg

SEQ ID NO: 187206 - RNA, 22 nt, Human
ugccgcaggaggggcgauuucu

SEQ ID NO: 187207 - RNA, 22 nt, Human
ugugucuuuggcgaugucugga

SEQ ID NO: 187208 - RNA, 22 nt, Human
uguguggaaaugcuguauaugu

SEQ ID NO: 187209 - RNA, 22 nt, Human
ugugucgccaacaauugugucu

SEQ ID NO: 187210 - RNA, 22 nt, Human
uguguauguauguauguaugua

SEQ ID NO: 187211 - RNA, 23 nt, Human
ugccggaucuacuuuggguucuc

SEQ ID NO: 187212 - RNA, 22 nt, Human
ugcagcuuuugguuucuagaug

SEQ ID NO: 187213 - RNA, 22 nt, Human
ugcaggaacucgaaaacuauag

SEQ ID NO: 187214 - RNA, 22 nt, Human
ugugcagaaaacacuuaagaac

SEQ ID NO: 187215 - RNA, 22 nt, Human
ugugauuucaaagggugucuuu

SEQ ID NO: 187216 - RNA, 22 nt, Human
ugcagcuucucugcaacaggag

SEQ ID NO: 187217 - RNA, 22 nt, Human
ugugauugucuucugaaaguca

SEQ ID NO: 187218 - RNA, 22 nt, Human
ugugauugcauugcagauuacu

SEQ ID NO: 187219 - RNA, 22 nt, Human
ugugaugagaugaacuguagac

SEQ ID NO: 187220 - RNA, 22 nt, Human
ugugauaauauuauuagagcuc

SEQ ID NO: 187221 - RNA, 17 nt, Human
ugcaugcgucugugaua

SEQ ID NO: 187222 - RNA, 22 nt, Human
ugcaugaucucacuuacaggug

SEQ ID NO: 187223 - RNA, 22 nt, Human
ugcaugacugaucuguuuguca

SEQ ID NO: 187224 - RNA, 22 nt, Human
ugcaugacaauugccgucaagu

SEQ ID NO: 187225 - RNA, 22 nt, Human
ugcaucauuaagguacaguugg

SEQ ID NO: 187226 - RNA, 22 nt, Human
ugugcuugucguggagccaggc

SEQ ID NO: 187227 - RNA, 22 nt, Human
ugugcuggcuucugugagcuga

SEQ ID NO: 187228 - RNA, 22 nt, Human
ugucaucuuggugcugugagag

SEQ ID NO: 187229 - RNA, 21 nt, Human
ugucaucucuaaaaagauugu

SEQ ID NO: 187230 - RNA, 22 nt, Human
ugucauauagaauguucuauga

SEQ ID NO: 187231 - RNA, 22 nt, Human
ugcaacuacccccaggauuuua

SEQ ID NO: 187232 - RNA, 22 nt, Human
ugucacguaaaaacuagauuuc

SEQ ID NO: 187233 - RNA, 20 nt, Human
ugucccuggagagcugcaga

SEQ ID NO: 187234 - RNA, 22 nt, Human
ugucccuggacuccaggagcca

SEQ ID NO: 187235 - RNA, 22 nt, Human
uguccuuuauauguuuuuuagu

SEQ ID NO: 187236 - RNA, 22 nt, Human
ugucauuggugaucugaugccu

SEQ ID NO: 187237 - RNA, 22 nt, Human
ugucauggacuggauuucugcu

SEQ ID NO: 187238 - RNA, 22 nt, Human
ugcaagugccauggauucaggu

SEQ ID NO: 187239 - RNA, 22 nt, Human
ugauuucauaugacagcuuuuu

SEQ ID NO: 187240 - RNA, 22 nt, Human
ugaugccauaguaaaauuugcu

SEQ ID NO: 187241 - RNA, 22 nt, Human
ugucacagugcacagcuaagaa

SEQ ID NO: 187242 - RNA, 22 nt, Human
ugucacagagcgugcaacagaa

SEQ ID NO: 187243 - RNA, 22 nt, Human
ugauuugaaaccuuuggcaaga

SEQ ID NO: 187244 - RNA, 22 nt, Human
ugugaaugacuuuguucuuugc

SEQ ID NO: 187245 - RNA, 23 nt, Human
ugugaauggccuucuuuagaggu

SEQ ID NO: 187246 - RNA, 22 nt, Human
ugugaagcgugugcaggggaca

SEQ ID NO: 187247 - RNA, 22 nt, Human
ugugaagaauuaaugugaauca

SEQ ID NO: 187248 - RNA, 17 nt, Human
ugucuuuuuccuccucc

SEQ ID NO: 187249 - RNA, 22 nt, Human
ugugagucuugcaggucgcuca

SEQ ID NO: 187250 - RNA, 19 nt, Human
ugcagcacuaaaaacuuuc

SEQ ID NO: 187251 - RNA, 22 nt, Human
ugcagcagaauauggcugcagg

SEQ ID NO: 187252 - RNA, 22 nt, Human
ugcagccucacgcauccgcauu

SEQ ID NO: 187253 - RNA, 22 nt, Human
ugcagaauauucuggugacaau

SEQ ID NO: 187254 - RNA, 22 nt, Human
ugucuuucuuucucuugacaga

SEQ ID NO: 187255 - RNA, 22 nt, Human
ugcagagagccagcucucucgg

SEQ ID NO: 187256 - RNA, 22 nt, Human
ugucuuugaccuuaagaaguuu

SEQ ID NO: 187257 - RNA, 23 nt, Human
ugcaaugcagcuagauguaaaau

SEQ ID NO: 187258 - RNA, 21 nt, Human
ugcaaugcauugacagcagca

SEQ ID NO: 187259 - RNA, 22 nt, Human
ugcacacaguucucaggaaaga

SEQ ID NO: 187260 - RNA, 22 nt, Human
ugucugauccuucaggagcccc

SEQ ID NO: 187261 - RNA, 22 nt, Human
ugaggaugagaaggaagagaag

SEQ ID NO: 187262 - RNA, 22 nt, Human
ugaggaggugggcacacagagu

SEQ ID NO: 187263 - RNA, 21 nt, Human
ugguguacauuuccauaguuu

SEQ ID NO: 187264 - RNA, 20 nt, Human
ugguguacauuuccauaguu

SEQ ID NO: 187265 - RNA, 22 nt, Human
ugguggccucaguggcuucugu

SEQ ID NO: 187266 - RNA, 22 nt, Human
uggugguaggggugguuucuga

SEQ ID NO: 187267 - RNA, 22 nt, Human
ugagggaggggaaugugugcag

SEQ ID NO: 187268 - RNA, 20 nt, Human
ugguguccuaugcuugugcu

SEQ ID NO: 187269 - RNA, 22 nt, Human
ugagggaagguugauaauguuc

SEQ ID NO: 187270 - RNA, 20 nt, Human
ugguuaaagugggugagcgg

SEQ ID NO: 187271 - RNA, 22 nt, Human
ugguucggcuguaaguauaucu

SEQ ID NO: 187272 - RNA, 22 nt, Human
ugguucuagaugagaugaugag

SEQ ID NO: 187273 - RNA, 19 nt, Human
ugagauuguaugaggagau

SEQ ID NO: 187274 - RNA, 22 nt, Human
ugagauguaauguaguacuuug

SEQ ID NO: 187275 - RNA, 22 nt, Human
ugagcagagcacuugggaacga

SEQ ID NO: 187276 - RNA, 22 nt, Human
ugagcaaacacagauaggcuua

SEQ ID NO: 187277 - RNA, 22 nt, Human
ugagcagccagucauucaaaaa

SEQ ID NO: 187278 - RNA, 22 nt, Human
uggugcuuuuguggaugcuaac

SEQ ID NO: 187279 - RNA, 19 nt, Human
uggugcgcuguuccugagc

SEQ ID NO: 187280 - RNA, 22 nt, Human
uggugccuuccgagagcuguga

SEQ ID NO: 187281 - RNA, 22 nt, Human
uggucugauggucccaccaccg

SEQ ID NO: 187282 - RNA, 22 nt, Human
uggucggugguguggggaggca

SEQ ID NO: 187283 - RNA, 23 nt, Human
ugguuuucagaagaccuuguuag

SEQ ID NO: 187284 - RNA, 22 nt, Human
ugguuuccugauggacacuugg

SEQ ID NO: 187285 - RNA, 22 nt, Human
ugguuucagacagacucgaacu

SEQ ID NO: 187286 - RNA, 22 nt, Human
ugagugccagugcuugcucuac

SEQ ID NO: 187287 - RNA, 22 nt, Human
ugagugacuguugucaagaugg

SEQ ID NO: 187288 - RNA, 22 nt, Human
ugagucugaagagagaauaagg

SEQ ID NO: 187289 - RNA, 22 nt, Human
ugaguccagaugggccagcagg

SEQ ID NO: 187290 - RNA, 22 nt, Human
ugagggaguguggauacaguag

SEQ ID NO: 187291 - RNA, 20 nt, Human
uguacuauaaaagguugagu

SEQ ID NO: 187292 - RNA, 22 nt, Human
uguagaaguuaauugaugagua

SEQ ID NO: 187293 - RNA, 22 nt, Human
uguacuguuuucuaggcaaaaa

SEQ ID NO: 187294 - RNA, 22 nt, Human
ugaucauugaacaucgaguuaa

SEQ ID NO: 187295 - RNA, 22 nt, Human
ugaugaaguuggaaggaaaguu

SEQ ID NO: 187296 - RNA, 20 nt, Human
ugauaugcgguacagagagg

SEQ ID NO: 187297 - RNA, 22 nt, Human
ugauagcaugcucucaguaaaa

SEQ ID NO: 187298 - RNA, 22 nt, Human
ugauaugguaauaagauauucu

SEQ ID NO: 187299 - RNA, 22 nt, Human
ugaucaacagggcuggaaagag

SEQ ID NO: 187300 - RNA, 22 nt, Human
uguaauguuagaaacaauugcu

SEQ ID NO: 187301 - RNA, 22 nt, Human
ucuuuuuaugucaaaaucgaug

SEQ ID NO: 187302 - RNA, 22 nt, Human
ucuuuugugauuuucugaagca

SEQ ID NO: 187303 - RNA, 22 nt, Human
uggcucaguaaucgagucuccu

SEQ ID NO: 187304 - RNA, 22 nt, Human
ucuuuugaacauccaggauguc

SEQ ID NO: 187305 - RNA, 22 nt, Human
uggguagcucaauagagccaca

SEQ ID NO: 187306 - RNA, 22 nt, Human
ugggucagauacaguguuuggu

SEQ ID NO: 187307 - RNA, 22 nt, Human
ugggugaagaggcuaugcuacu

SEQ ID NO: 187308 - RNA, 22 nt, Human
ugacgcauggccagcucugucu

SEQ ID NO: 187309 - RNA, 22 nt, Human
uggcggcuggacuggggggcca

SEQ ID NO: 187310 - RNA, 22 nt, Human
ugagaaaacaguuuguaauaau

SEQ ID NO: 187311 - RNA, 22 nt, Human
uggguguggaagcagcgugggg

SEQ ID NO: 187312 - RNA, 22 nt, Human
ugacuuuucuccucugaaguuu

SEQ ID NO: 187313 - RNA, 22 nt, Human
ugggugugggguaggguaagag

SEQ ID NO: 187314 - RNA, 22 nt, Human
ugacugguauuuguaaaccaua

SEQ ID NO: 187315 - RNA, 22 nt, Human
uggguguuccuggggugcaagg

SEQ ID NO: 187316 - RNA, 22 nt, Human
uggguguguccauauuuugacu

SEQ ID NO: 187317 - RNA, 22 nt, Human
uggguuaaaaguugaaugaauu

SEQ ID NO: 187318 - RNA, 22 nt, Human
uggguuaaaguuugucacugac

SEQ ID NO: 187319 - RNA, 22 nt, Human
ugggugugcaccuacgaucucu

SEQ ID NO: 187320 - RNA, 22 nt, Human
ugacucugaugcaguguguuua

SEQ ID NO: 187321 - RNA, 22 nt, Human
ugacuaauacagaaacuacaag

SEQ ID NO: 187322 - RNA, 22 nt, Human
ugacugaggaaggugggguggg

SEQ ID NO: 187323 - RNA, 22 nt, Human
ugguauauuugaccauaugugu

SEQ ID NO: 187324 - RNA, 22 nt, Human
ugagacagaccuuggaccaugu

SEQ ID NO: 187325 - RNA, 22 nt, Human
ugagagcuccacaccuugcccu

SEQ ID NO: 187326 - RNA, 22 nt, Human
uggucacgucgggguauugcca

SEQ ID NO: 187327 - RNA, 22 nt, Human
ugguccaaaccagugcuguggu

SEQ ID NO: 187328 - RNA, 22 nt, Human
ugguaaaguguacugaauauga

SEQ ID NO: 187329 - RNA, 22 nt, Human
ugagacaaaguuguuggauguu

SEQ ID NO: 187330 - RNA, 22 nt, Human
uggguuugcuuguucagguucu

SEQ ID NO: 187331 - RNA, 22 nt, Human
ugagaauuuaacuugauuagga

SEQ ID NO: 187332 - RNA, 22 nt, Human
ugagaagucagucuauugugaa

SEQ ID NO: 187333 - RNA, 22 nt, Human
ugguaaaugucuaacaaucacu

SEQ ID NO: 187334 - RNA, 22 nt, Human
ugguauaaaaaaaugaguauaa

SEQ ID NO: 187335 - RNA, 23 nt, Human
uggguuucagugccaaugcugcc

SEQ ID NO: 187336 - RNA, 22 nt, Human
ugagaaauauacaccagacaca

SEQ ID NO: 187337 - RNA, 22 nt, Human
ugagaagaggucuuuugggaug

SEQ ID NO: 187338 - RNA, 22 nt, Human
ugagaacuguuuugguuugggu

SEQ ID NO: 187339 - RNA, 22 nt, Human
ugcuccugaacacagcccuaug

SEQ ID NO: 187340 - RNA, 22 nt, Human
ugcucgauuauuucauuuugca

SEQ ID NO: 187341 - RNA, 22 nt, Human
uguuguucuuuuucuucuuguu

SEQ ID NO: 187342 - RNA, 18 nt, Human
uguugguguucacucacu

SEQ ID NO: 187343 - RNA, 21 nt, Human
uguuggccuucauucucuguc

SEQ ID NO: 187344 - RNA, 22 nt, Human
uguuggauuuugugaaauauga

SEQ ID NO: 187345 - RNA, 22 nt, Human
ugcuccucugcaugucugcggc

SEQ ID NO: 187346 - RNA, 22 nt, Human
uguuggaaucuucuagucuucc

SEQ ID NO: 187347 - RNA, 22 nt, Human
uguguguguccucauuugcaga

SEQ ID NO: 187348 - RNA, 22 nt, Human
uguguguguguguguaauauau

SEQ ID NO: 187349 - RNA, 22 nt, Human
uguguguguauacauguauaua

SEQ ID NO: 187350 - RNA, 21 nt, Human
ugccuggccuuugcuuuuccu

SEQ ID NO: 187351 - RNA, 22 nt, Human
ugcugccgccgccaccgccgcc

SEQ ID NO: 187352 - RNA, 22 nt, Human
uguuugagaauuugcugauguu

SEQ ID NO: 187353 - RNA, 22 nt, Human
ugcugcacuuauggcucugagg

SEQ ID NO: 187354 - RNA, 22 nt, Human
uguuuaucaguagacucaaguu

SEQ ID NO: 187355 - RNA, 22 nt, Human
uguuuagcucugacuaugugau

SEQ ID NO: 187356 - RNA, 20 nt, Human
uguuucccaacaccccaaag

SEQ ID NO: 187357 - RNA, 22 nt, Human
uguuuguuuuguauuuuuaauu

SEQ ID NO: 187358 - RNA, 22 nt, Human
uguuuucuuuccccuucuuuuc

SEQ ID NO: 187359 - RNA, 22 nt, Human
uguuuucuauuaccugagauug

SEQ ID NO: 187360 - RNA, 22 nt, Human
ugcugcggauauacaggaucug

SEQ ID NO: 187361 - RNA, 22 nt, Human
uguuuuuuagagugauacuuuu

SEQ ID NO: 187362 - RNA, 22 nt, Human
uguuuuucaagcauuuauuaau

SEQ ID NO: 187363 - RNA, 22 nt, Human
uguuuuuagcuguuuuuuggau

SEQ ID NO: 187364 - RNA, 22 nt, Human
uguuuucccacugguuuguaca

SEQ ID NO: 187365 - RNA, 22 nt, Human
uuaaacauuuccacuugccagu

SEQ ID NO: 187366 - RNA, 22 nt, Human
uuaaaauuguuaacuuugguga

SEQ ID NO: 187367 - RNA, 22 nt, Human
ugcuggaaggguaguauuaacu

SEQ ID NO: 187368 - RNA, 22 nt, Human
ugcugcuguuuccuacaucuca

SEQ ID NO: 187369 - RNA, 22 nt, Human
ugcugcuguuaucauuuuacca

SEQ ID NO: 187370 - RNA, 22 nt, Human
ugcugcucuucaccauggccuc

SEQ ID NO: 187371 - RNA, 23 nt, Human
ugcugcgggacccgagcgcgcgc

SEQ ID NO: 187372 - RNA, 22 nt, Human
ugcugcggcgcaggcacuccag

SEQ ID NO: 187373 - RNA, 22 nt, Human
uguuuuuucccccccuucuaaa

SEQ ID NO: 187374 - RNA, 23 nt, Human
ugcugcuggaguaucuacaaugc

SEQ ID NO: 187375 - RNA, 22 nt, Human
ugcuggagccauguuuucucua

SEQ ID NO: 187376 - RNA, 22 nt, Human
ugcugggagcugggccucgaca

SEQ ID NO: 187377 - RNA, 22 nt, Human
ugcuggagucucuugacccugg

SEQ ID NO: 187378 - RNA, 22 nt, Human
uuaacggugagacgccccaaau

SEQ ID NO: 187379 - RNA, 22 nt, Human
uuaacgaauugugcauaauucc

SEQ ID NO: 187380 - RNA, 22 nt, Human
ugcugguuucugaguaaccaca

SEQ ID NO: 187381 - RNA, 22 nt, Human
ugcuggugauuaaauccugaag

SEQ ID NO: 187382 - RNA, 22 nt, Human
ugcugugagaccauuuguugag

SEQ ID NO: 187383 - RNA, 22 nt, Human
ugcuugggucuguuuugcaaag

SEQ ID NO: 187384 - RNA, 22 nt, Human
ugcuugaacccaggaaguggag

SEQ ID NO: 187385 - RNA, 22 nt, Human
ugcuugacucagcaucggcaau

SEQ ID NO: 187386 - RNA, 21 nt, Human
uuaauugagggauggggguga

SEQ ID NO: 187387 - RNA, 22 nt, Human
uuaauuguuagauagauuauag

SEQ ID NO: 187388 - RNA, 22 nt, Human
ugcuucuuuccuuggugacuuc

SEQ ID NO: 187389 - RNA, 22 nt, Human
uuaaugcauguaaaugugcaaa

SEQ ID NO: 187390 - RNA, 21 nt, Human
uuaaugcuaugcagaaaaucu

SEQ ID NO: 187391 - RNA, 22 nt, Human
uuaauguuuuagaaugagagug

SEQ ID NO: 187392 - RNA, 22 nt, Human
uuaauguugacacacuagcaca

SEQ ID NO: 187393 - RNA, 20 nt, Human
ugcuguggguaagcuuuaua

SEQ ID NO: 187394 - RNA, 20 nt, Human
ugcugugugucuacuguggg

SEQ ID NO: 187395 - RNA, 22 nt, Human
uuaaguauauccauuugacugg

SEQ ID NO: 187396 - RNA, 22 nt, Human
uuaauacugugucuuuuuuaau

SEQ ID NO: 187397 - RNA, 22 nt, Human
uuaaguccuugguaauuuucuu

SEQ ID NO: 187398 - RNA, 22 nt, Human
ugcuguugacuuuguuguucuu

SEQ ID NO: 187399 - RNA, 22 nt, Human
ugcuucucucuaggaagacgcu

SEQ ID NO: 187400 - RNA, 22 nt, Human
ugcuuaaccagccccuucccuu

SEQ ID NO: 187401 - RNA, 22 nt, Human
ugcuuacauuuugcuggucucc

SEQ ID NO: 187402 - RNA, 22 nt, Human
ugcuuacgcaaccuguguuugg

SEQ ID NO: 187403 - RNA, 22 nt, Human
uuaccugcagagacguggaggc

SEQ ID NO: 187404 - RNA, 22 nt, Human
uuaccuuuucuuguuuacaagu

SEQ ID NO: 187405 - RNA, 22 nt, Human
ugcuuuuggcagcaguguuuau

SEQ ID NO: 187406 - RNA, 22 nt, Human
ugcuuuggcccaacauugaugc

SEQ ID NO: 187407 - RNA, 22 nt, Human
uggaaaacgcaguuuaauuuuu

SEQ ID NO: 187408 - RNA, 22 nt, Human
ugcuuuuguaucagaguauuca

SEQ ID NO: 187409 - RNA, 22 nt, Human
ugcuuucagauaucuguuucaa

SEQ ID NO: 187410 - RNA, 22 nt, Human
ugcuuuccuucccuauguugag

SEQ ID NO: 187411 - RNA, 21 nt, Human
ugcuuucugugcuuuuucugc

SEQ ID NO: 187412 - RNA, 23 nt, Human
ugcuuugauuauuauucccaccu

SEQ ID NO: 187413 - RNA, 22 nt, Human
ugcuuuauucgacaucugguag

SEQ ID NO: 187414 - RNA, 22 nt, Human
ugcuuuaccuuccauuuaagga

SEQ ID NO: 187415 - RNA, 22 nt, Human
uuacaucacuuuacuuaauaau

SEQ ID NO: 187416 - RNA, 22 nt, Human
uuacaugcuugugcagguuuug

SEQ ID NO: 187417 - RNA, 19 nt, Human
uuacaugacauaugaagga

SEQ ID NO: 187418 - RNA, 22 nt, Human
uggaaaauuuagaaagauuuau

SEQ ID NO: 187419 - RNA, 22 nt, Human
uggaaagcagcccugcucccca

SEQ ID NO: 187420 - RNA, 22 nt, Human
uuacuuuuuucccccuuagaug

SEQ ID NO: 187421 - RNA, 22 nt, Human
uggaaauacaagaaguauguca

SEQ ID NO: 187422 - RNA, 22 nt, Human
uuagaaauguccuacuaauaug

SEQ ID NO: 187423 - RNA, 22 nt, Human
uggaaaggaguucuguuuauuu

SEQ ID NO: 187424 - RNA, 22 nt, Human
uuagagaauagacuuuacccug

SEQ ID NO: 187425 - RNA, 22 nt, Human
uggaaaugcuuagaggugaucu

SEQ ID NO: 187426 - RNA, 22 nt, Human
uggaacugguuugcuucagacu

SEQ ID NO: 187427 - RNA, 22 nt, Human
uuagaugugaucagcuggcuua

SEQ ID NO: 187428 - RNA, 22 nt, Human
uuagaugaaaaucggaacaugu

SEQ ID NO: 187429 - RNA, 22 nt, Human
uggaagaaaacuuggaaggcau

SEQ ID NO: 187430 - RNA, 22 nt, Human
uuagaguucaagcuuuaggaaa

SEQ ID NO: 187431 - RNA, 22 nt, Human
uuagauaaaucagcccugagua

SEQ ID NO: 187432 - RNA, 22 nt, Human
uuaggcuaauagagauggaaug

SEQ ID NO: 187433 - RNA, 22 nt, Human
uuaggaauugcuucauguuugg

SEQ ID NO: 187434 - RNA, 22 nt, Human
uuaggagugaguuacuuagggu

SEQ ID NO: 187435 - RNA, 23 nt, Human
uuagcccaggcuggagguagccc

SEQ ID NO: 187436 - RNA, 22 nt, Human
uggaagaagcuacaagcgguga

SEQ ID NO: 187437 - RNA, 22 nt, Human
uuaguauuuuuugaaugaugaa

SEQ ID NO: 187438 - RNA, 22 nt, Human
uggaagaucugguguagcuccu

SEQ ID NO: 187439 - RNA, 22 nt, Human
uggaagaaaugguugagccaug

SEQ ID NO: 187440 - RNA, 22 nt, Human
uuagugucugacgcaggcgcca

SEQ ID NO: 187441 - RNA, 22 nt, Human
uuaguuagucuaugccugacca

SEQ ID NO: 187442 - RNA, 22 nt, Human
uggaagggguuacgcagcagga

SEQ ID NO: 187443 - RNA, 22 nt, Human
uggaaggggccaggcgcggagu

SEQ ID NO: 187444 - RNA, 22 nt, Human
uggaagucuucucucccaugga

SEQ ID NO: 187445 - RNA, 22 nt, Human
uggaaggggagcuggaaagggg

SEQ ID NO: 187446 - RNA, 20 nt, Human
uggaaggaaagguguaucuu

SEQ ID NO: 187447 - RNA, 22 nt, Human
uggagagcaggugaaggaaaga

SEQ ID NO: 187448 - RNA, 21 nt, Human
uggagcagggaggauuugggg

SEQ ID NO: 187449 - RNA, 22 nt, Human
uuaucuguuuuaaugaauaauu

SEQ ID NO: 187450 - RNA, 22 nt, Human
uuaucugugcuuuacugacaga

SEQ ID NO: 187451 - RNA, 22 nt, Human
uggagagcaaugaggggcaggc

SEQ ID NO: 187452 - RNA, 22 nt, Human
uggagagaaguucuauaaauca

SEQ ID NO: 187453 - RNA, 22 nt, Human
uuauauuuuauuuaauuaaaua

SEQ ID NO: 187454 - RNA, 22 nt, Human
uuaucagggaguuguguguucu

SEQ ID NO: 187455 - RNA, 22 nt, Human
uggacuguucauugauacugga

SEQ ID NO: 187456 - RNA, 22 nt, Human
uggagagauagucauucuagag

SEQ ID NO: 187457 - RNA, 22 nt, Human
uggaaugccgggccaggcuccg

SEQ ID NO: 187458 - RNA, 22 nt, Human
uggaauuaucugaagugauuug

SEQ ID NO: 187459 - RNA, 22 nt, Human
uggaaugaaagaaaaauuguag

SEQ ID NO: 187460 - RNA, 22 nt, Human
uggacagugguggggaggagga

SEQ ID NO: 187461 - RNA, 22 nt, Human
uggacagguacuucacauuauu

SEQ ID NO: 187462 - RNA, 22 nt, Human
uuauauuaaaaaucgcuaacag

SEQ ID NO: 187463 - RNA, 22 nt, Human
uuauaguuuucaaggauuggag

SEQ ID NO: 187464 - RNA, 22 nt, Human
uuauacuucugccagaggacaa

SEQ ID NO: 187465 - RNA, 22 nt, Human
uggggcuauggcccgaccacgu

SEQ ID NO: 187466 - RNA, 22 nt, Human
uggggcgccuggcugaggcugc

SEQ ID NO: 187467 - RNA, 22 nt, Human
uggguagggagcuggaauccua

SEQ ID NO: 187468 - RNA, 22 nt, Human
uucuccugcccuuggacuucca

SEQ ID NO: 187469 - RNA, 22 nt, Human
uggguggugaaauggaugggaa

SEQ ID NO: 187470 - RNA, 22 nt, Human
uggguggauucgggaacuuguu

SEQ ID NO: 187471 - RNA, 22 nt, Human
ugggugaugagguccccagccc

SEQ ID NO: 187472 - RNA, 22 nt, Human
uucucuauuugcugcaccucuc

SEQ ID NO: 187473 - RNA, 22 nt, Human
uggguucaaauccugguuccac

SEQ ID NO: 187474 - RNA, 22 nt, Human
uggguucugaucccaggacugc

SEQ ID NO: 187475 - RNA, 20 nt, Human
uggguucaguuguuucuggc

SEQ ID NO: 187476 - RNA, 22 nt, Human
uucugcuuuaaagcucauguuu

SEQ ID NO: 187477 - RNA, 23 nt, Human
uucugcuucccauagcacuuugu

SEQ ID NO: 187478 - RNA, 21 nt, Human
uucugcuguucaccaccaccc

SEQ ID NO: 187479 - RNA, 22 nt, Human
uucugcuagugguauauguuga

SEQ ID NO: 187480 - RNA, 22 nt, Human
ugguaauuuaacaaaauuguca

SEQ ID NO: 187481 - RNA, 22 nt, Human
ugguacaaaaaagauuuuggac

SEQ ID NO: 187482 - RNA, 21 nt, Human
ugguaaggggauccuguuacu

SEQ ID NO: 187483 - RNA, 22 nt, Human
ugguaacgguuuccuugccauu

SEQ ID NO: 187484 - RNA, 22 nt, Human
ugguagacaacagcagugggac

SEQ ID NO: 187485 - RNA, 22 nt, Human
ugguaaguuacaugucugccuc

SEQ ID NO: 187486 - RNA, 22 nt, Human
ugguagcaggugcuaaaggccu

SEQ ID NO: 187487 - RNA, 22 nt, Human
ugguauaaaaauuugugaaugu

SEQ ID NO: 187488 - RNA, 22 nt, Human
ugguccgagaacuguccugguu

SEQ ID NO: 187489 - RNA, 22 nt, Human
uggucacagauuuacaggaaug

SEQ ID NO: 187490 - RNA, 22 nt, Human
ugguaugaaggaggccggcagc

SEQ ID NO: 187491 - RNA, 22 nt, Human
uucuggucucucugaccuagga

SEQ ID NO: 187492 - RNA, 22 nt, Human
uucuguacuagaucuuaucagu

SEQ ID NO: 187493 - RNA, 22 nt, Human
uucuggugauuugccucuuuag

SEQ ID NO: 187494 - RNA, 22 nt, Human
uucugucaguguugguggaaau

SEQ ID NO: 187495 - RNA, 22 nt, Human
uucuggccagggaagagggguc

SEQ ID NO: 187496 - RNA, 22 nt, Human
uucugggguaagcacugaggau

SEQ ID NO: 187497 - RNA, 22 nt, Human
uggagcuggcuuguggaaguug

SEQ ID NO: 187498 - RNA, 22 nt, Human
uuaucuuuuaaaaacacuugug

SEQ ID NO: 187499 - RNA, 22 nt, Human
uuaugccuguuaggcagcaucu

SEQ ID NO: 187500 - RNA, 22 nt, Human
uuaugucauuugaauuaauuuu

SEQ ID NO: 187501 - RNA, 22 nt, Human
uuaugggguuaaauuucuccua

SEQ ID NO: 187502 - RNA, 22 nt, Human
uuccacaugaucauuguaauaa

SEQ ID NO: 187503 - RNA, 22 nt, Human
uuccaugccuaagagccugaag

SEQ ID NO: 187504 - RNA, 22 nt, Human
uucauuuccauuuuauagauaa

SEQ ID NO: 187505 - RNA, 22 nt, Human
uuaugugcuacacauaauuugu

SEQ ID NO: 187506 - RNA, 22 nt, Human
uucauuuuauauuagagcuguu

SEQ ID NO: 187507 - RNA, 22 nt, Human
ugggaaggggagcuggaaagga

SEQ ID NO: 187508 - RNA, 22 nt, Human
ugggaauuuaugagaaaauaua

SEQ ID NO: 187509 - RNA, 22 nt, Human
ugggaagccaguaucagacuaa

SEQ ID NO: 187510 - RNA, 22 nt, Human
ugggaacuggaaaaaaugaagu

SEQ ID NO: 187511 - RNA, 22 nt, Human
ugggaaaauagcuauuuugaaa

SEQ ID NO: 187512 - RNA, 22 nt, Human
ugggaaaauugugauucuuucu

SEQ ID NO: 187513 - RNA, 22 nt, Human
uggcuuauggguccucccucuu

SEQ ID NO: 187514 - RNA, 22 nt, Human
uggcugggagcuggaacugggc

SEQ ID NO: 187515 - RNA, 22 nt, Human
uucgcucuucacacagugcuga

SEQ ID NO: 187516 - RNA, 22 nt, Human
uucggcagaaagucauuugucu

SEQ ID NO: 187517 - RNA, 18 nt, Human
uucgucauggggaucgua

SEQ ID NO: 187518 - RNA, 22 nt, Human
uggggcgcaggcccagcgggcu

SEQ ID NO: 187519 - RNA, 22 nt, Human
uucgucauuaugcagccuguga

SEQ ID NO: 187520 - RNA, 21 nt, Human
uucgaaugggucguugcugcc

SEQ ID NO: 187521 - RNA, 22 nt, Human
ugggacaugaugcauuugaaag

SEQ ID NO: 187522 - RNA, 18 nt, Human
ugggacucugacuugguu

SEQ ID NO: 187523 - RNA, 22 nt, Human
uucccugggggggccgcuuucc

SEQ ID NO: 187524 - RNA, 22 nt, Human
uuccuaagugcugguaugaggc

SEQ ID NO: 187525 - RNA, 22 nt, Human
uuccucauucuggggcauguug

SEQ ID NO: 187526 - RNA, 22 nt, Human
uuccucauuuauaggaaagaga

SEQ ID NO: 187527 - RNA, 22 nt, Human
ugggagagaagcugaggcaggg

SEQ ID NO: 187528 - RNA, 22 nt, Human
uuccugaucuuuucccagaguu

SEQ ID NO: 187529 - RNA, 22 nt, Human
uuccugcuggucaaaguugccu

SEQ ID NO: 187530 - RNA, 21 nt, Human
uuccuccucuggagaagaaga

SEQ ID NO: 187531 - RNA, 21 nt, Human
uugaaguggguagcuggcggg

SEQ ID NO: 187532 - RNA, 22 nt, Human
uugaauaaggcauaaagauacu

SEQ ID NO: 187533 - RNA, 20 nt, Human
uugagccucauggauugucu

SEQ ID NO: 187534 - RNA, 22 nt, Human
uugagcagccauuagcuggggu

SEQ ID NO: 187535 - RNA, 22 nt, Human
ugucacaccuggcgauaauggg

SEQ ID NO: 187536 - RNA, 22 nt, Human
uugaccagaaaaguuaguaauu

SEQ ID NO: 187537 - RNA, 21 nt, Human
uguauacacacauuguaccaa

SEQ ID NO: 187538 - RNA, 22 nt, Human
uugacacauggcuucaauugca

SEQ ID NO: 187539 - RNA, 22 nt, Human
uguccagcuauauguguaugug

SEQ ID NO: 187540 - RNA, 22 nt, Human
ugucauuuauucucuuauucua

SEQ ID NO: 187541 - RNA, 22 nt, Human
uugaugacuaaagaaagcugcu

SEQ ID NO: 187542 - RNA, 22 nt, Human
ugucagacagggcugcagucag

SEQ ID NO: 187543 - RNA, 22 nt, Human
uugaggucuguguaggcagcaa

SEQ ID NO: 187544 - RNA, 22 nt, Human
ugucagccacggugugaccggc

SEQ ID NO: 187545 - RNA, 22 nt, Human
uugaggguggauugucagggga

SEQ ID NO: 187546 - RNA, 22 nt, Human
uugaggaagggaggcaaaacug

SEQ ID NO: 187547 - RNA, 20 nt, Human
uugaggagauauugaauacu

SEQ ID NO: 187548 - RNA, 21 nt, Human
ugucugcaauuccagggaacc

SEQ ID NO: 187549 - RNA, 22 nt, Human
ugucugaauuguaauguugcgu

SEQ ID NO: 187550 - RNA, 21 nt, Human
uugauuuagcagaucuagcug

SEQ ID NO: 187551 - RNA, 22 nt, Human
uugauuggguauaaugacagga

SEQ ID NO: 187552 - RNA, 20 nt, Human
ugucugguaagacgcccauc

SEQ ID NO: 187553 - RNA, 22 nt, Human
ugucugggauguuggcagccac

SEQ ID NO: 187554 - RNA, 20 nt, Human
uugcaaagugaauagcaauu

SEQ ID NO: 187555 - RNA, 22 nt, Human
uugauuuggcguuuuccuccug

SEQ ID NO: 187556 - RNA, 22 nt, Human
ugucugucugccauuuauucuc

SEQ ID NO: 187557 - RNA, 22 nt, Human
ugucuguauuugaggacauugu

SEQ ID NO: 187558 - RNA, 20 nt, Human
ugucugugugugauaauagu

SEQ ID NO: 187559 - RNA, 22 nt, Human
ugucuucagguuccucaccacu

SEQ ID NO: 187560 - RNA, 22 nt, Human
ugucuuaggcuccgccggccca

SEQ ID NO: 187561 - RNA, 22 nt, Human
ugucuuaugcugcauagacuau

SEQ ID NO: 187562 - RNA, 22 nt, Human
uugcaugugugaaaugcacaga

SEQ ID NO: 187563 - RNA, 23 nt, Human
uugcauuaauguggaggcacagg

SEQ ID NO: 187564 - RNA, 22 nt, Human
ugugccuguugguguagacaua

SEQ ID NO: 187565 - RNA, 22 nt, Human
uugcaucaaauauguaccacag

SEQ ID NO: 187566 - RNA, 22 nt, Human
uugcaugauuuaagaauaucug

SEQ ID NO: 187567 - RNA, 22 nt, Human
uugcagcuguugcaaagucucu

SEQ ID NO: 187568 - RNA, 22 nt, Human
ugucuucauuccccaugaaguc

SEQ ID NO: 187569 - RNA, 22 nt, Human
uugcauauguccagccaugcau

SEQ ID NO: 187570 - RNA, 22 nt, Human
uugcagugucaucuagacgugg

SEQ ID NO: 187571 - RNA, 22 nt, Human
uucugugacgcaaagcugggaa

SEQ ID NO: 187572 - RNA, 22 nt, Human
uucugugcugagaaauagagag

SEQ ID NO: 187573 - RNA, 22 nt, Human
ugguccuuuccauuggagacac

SEQ ID NO: 187574 - RNA, 22 nt, Human
uggucuccucuuaauugccuac

SEQ ID NO: 187575 - RNA, 20 nt, Human
uucuguggcccguuuaagug

SEQ ID NO: 187576 - RNA, 22 nt, Human
uggugcucuugauauauaaggc

SEQ ID NO: 187577 - RNA, 22 nt, Human
uggugcucucgauauauaaggc

SEQ ID NO: 187578 - RNA, 22 nt, Human
uucuuaaugcauccuguguuca

SEQ ID NO: 187579 - RNA, 22 nt, Human
ugguuauggaacuggcuauggc

SEQ ID NO: 187580 - RNA, 23 nt, Human
uggugugaggaaggaagacuuua

SEQ ID NO: 187581 - RNA, 22 nt, Human
ugguuauauaaggauuaaauac

SEQ ID NO: 187582 - RNA, 22 nt, Human
ugguuacagaugaagaucggcc

SEQ ID NO: 187583 - RNA, 22 nt, Human
uucuugcuucucugucugccuc

SEQ ID NO: 187584 - RNA, 22 nt, Human
uucuucuucuuccucauccuca

SEQ ID NO: 187585 - RNA, 22 nt, Human
uucuuuuaauagagauccugug

SEQ ID NO: 187586 - RNA, 22 nt, Human
uucuuuguccuagcauucuaca

SEQ ID NO: 187587 - RNA, 22 nt, Human
uucuuuuaauuucugucugcag

SEQ ID NO: 187588 - RNA, 22 nt, Human
uucuuuucuucccuguuuauua

SEQ ID NO: 187589 - RNA, 22 nt, Human
uguaaagugguauuuaauuuua

SEQ ID NO: 187590 - RNA, 22 nt, Human
uguaagaagaaaaccguaugga

SEQ ID NO: 187591 - RNA, 22 nt, Human
uguaaucaugguagaggcaaag

SEQ ID NO: 187592 - RNA, 21 nt, Human
uucuuugcugcuguuuuugua

SEQ ID NO: 187593 - RNA, 22 nt, Human
ugguuuuuuguaggauaaacau

SEQ ID NO: 187594 - RNA, 22 nt, Human
ugguuuucuuaauuagcaguca

SEQ ID NO: 187595 - RNA, 22 nt, Human
ugguucugccacuuuccccuug

SEQ ID NO: 187596 - RNA, 22 nt, Human
uugaaaaaugcccagcagacaa

SEQ ID NO: 187597 - RNA, 22 nt, Human
uguaaauucuauacacuuaaaa

SEQ ID NO: 187598 - RNA, 17 nt, Human
uguaccgaguguguaua

SEQ ID NO: 187599 - RNA, 22 nt, Human
uugaagaagucaaaagcugcag

SEQ ID NO: 187600 - RNA, 22 nt, Human
uugaagccaccacuguaaguca

SEQ ID NO: 187601 - RNA, 22 nt, Human
uguaggcacauguauauauccc

SEQ ID NO: 187602 - RNA, 22 nt, Human
uguagcaauauaucagugcaca

SEQ ID NO: 187603 - RNA, 22 nt, Human
uugaaagucuaagaauagguau

SEQ ID NO: 187604 - RNA, 22 nt, Human
uuuauaaacacaagaugggcuc

SEQ ID NO: 187605 - RNA, 22 nt, Human
uuuaguugcuuuaguugagcug

SEQ ID NO: 187606 - RNA, 22 nt, Human
uuuagugaagcuuugcauuuca

SEQ ID NO: 187607 - RNA, 22 nt, Human
uuaggcugcuuuggaaaacugu

SEQ ID NO: 187608 - RNA, 22 nt, Human
uuaguccuaaauuuagauuuuc

SEQ ID NO: 187609 - RNA, 22 nt, Human
uuuauguuuguuuuugaaauaa

SEQ ID NO: 187610 - RNA, 22 nt, Human
uuuaugucaaaaguaaaaugaa

SEQ ID NO: 187611 - RNA, 22 nt, Human
uuagucauucccucuugauauu

SEQ ID NO: 187612 - RNA, 22 nt, Human
uuacuuucugggauaucaaaug

SEQ ID NO: 187613 - RNA, 22 nt, Human
uuuagagauaaaugcucuccca

SEQ ID NO: 187614 - RNA, 22 nt, Human
uuacuuacagggggucaggcug

SEQ ID NO: 187615 - RNA, 22 nt, Human
uuuagcaaaaaagcucugcgua

SEQ ID NO: 187616 - RNA, 22 nt, Human
uuuagguuguguucuggcaugu

SEQ ID NO: 187617 - RNA, 22 nt, Human
uuagaugcugugauuuuucaaa

SEQ ID NO: 187618 - RNA, 22 nt, Human
uuuaaucaguugguaauauuga

SEQ ID NO: 187619 - RNA, 22 nt, Human
uuuaaucaauaaccuccugggu

SEQ ID NO: 187620 - RNA, 18 nt, Human
uuuaauaagccuguuaug

SEQ ID NO: 187621 - RNA, 20 nt, Human
uuuaacuggccuucuggcuc

SEQ ID NO: 187622 - RNA, 22 nt, Human
uuuaacauaugaaagaauauuu

SEQ ID NO: 187623 - RNA, 22 nt, Human
uuuaauauuacacuuaccuugu

SEQ ID NO: 187624 - RNA, 22 nt, Human
uuuaauauucucuuugaaggaa

SEQ ID NO: 187625 - RNA, 22 nt, Human
uuaccuuggaccggguaucaga

SEQ ID NO: 187626 - RNA, 21 nt, Human
uuacuaagagagcagagggac

SEQ ID NO: 187627 - RNA, 22 nt, Human
uuuaccucguuguguccuuguu

SEQ ID NO: 187628 - RNA, 22 nt, Human
uuuaccuuauguaaauaagagu

SEQ ID NO: 187629 - RNA, 22 nt, Human
uuuaaugucuuuggccuuuaau

SEQ ID NO: 187630 - RNA, 22 nt, Human
uuuaauuauaucugggcaguua

SEQ ID NO: 187631 - RNA, 22 nt, Human
uuuagaaugaaugcaagagaau

SEQ ID NO: 187632 - RNA, 22 nt, Human
uuuacuuuugguaaggucauuu

SEQ ID NO: 187633 - RNA, 22 nt, Human
uuuacuuguuuugcucuuuucc

SEQ ID NO: 187634 - RNA, 22 nt, Human
uuacuguguguaaaauaucuuu

SEQ ID NO: 187635 - RNA, 22 nt, Human
uuaagagaagaguaucuagaac

SEQ ID NO: 187636 - RNA, 23 nt, Human
uuaagacuggcugaacuuaguag

SEQ ID NO: 187637 - RNA, 22 nt, Human
uuaagggauugagauggaauga

SEQ ID NO: 187638 - RNA, 23 nt, Human
uuaaggugccguguaauucaugc

SEQ ID NO: 187639 - RNA, 22 nt, Human
uuaaggcuguggggauuacugc

SEQ ID NO: 187640 - RNA, 22 nt, Human
uuaaaucaggcaucauuucagu

SEQ ID NO: 187641 - RNA, 22 nt, Human
uuaaagaguuuauuacuuguaa

SEQ ID NO: 187642 - RNA, 22 nt, Human
uuguuauuauuauuuucguucu

SEQ ID NO: 187643 - RNA, 22 nt, Human
uuguuccuaguuguccaucaca

SEQ ID NO: 187644 - RNA, 22 nt, Human
uuguuccuuucuucuguagucg

SEQ ID NO: 187645 - RNA, 22 nt, Human
uuaauaaauugugguaccagag

SEQ ID NO: 187646 - RNA, 22 nt, Human
uuaaguauggaggccuaacuga

SEQ ID NO: 187647 - RNA, 22 nt, Human
uuguuuaaagaacuucugacuu

SEQ ID NO: 187648 - RNA, 22 nt, Human
uuguuugcacuuuagagacugu

SEQ ID NO: 187649 - RNA, 22 nt, Human
uuguuucauggggacgacuggc

SEQ ID NO: 187650 - RNA, 22 nt, Human
uuguuucagcuuccuccuccau

SEQ ID NO: 187651 - RNA, 22 nt, Human
uuuaaauaguugguuuuuuugc

SEQ ID NO: 187652 - RNA, 22 nt, Human
uuuaaagucaggcuguaguggu

SEQ ID NO: 187653 - RNA, 22 nt, Human
uuuaaacuaacaguacacguug

SEQ ID NO: 187654 - RNA, 23 nt, Human
uuuaaacaauguggucguggugg

SEQ ID NO: 187655 - RNA, 22 nt, Human
uuuaaaccuaucuaagaaauag

SEQ ID NO: 187656 - RNA, 22 nt, Human
uuuaaaauguuuuauuuauuua

SEQ ID NO: 187657 - RNA, 22 nt, Human
uuuaaaacaguacguuuucuua

SEQ ID NO: 187658 - RNA, 22 nt, Human
uuaauucuugagcugucuuucc

SEQ ID NO: 187659 - RNA, 22 nt, Human
uuuaaaccuuggaagccacaua

SEQ ID NO: 187660 - RNA, 22 nt, Human
uuaauguggaagaguuuggcua

SEQ ID NO: 187661 - RNA, 22 nt, Human
uuaaugcagguacuguuacaau

SEQ ID NO: 187662 - RNA, 22 nt, Human
uuguuuguaaggcucuuagaau

SEQ ID NO: 187663 - RNA, 22 nt, Human
uuguuuuaaaaagaauaacuac

SEQ ID NO: 187664 - RNA, 22 nt, Human
uuaauaaggaccugugacaugc

SEQ ID NO: 187665 - RNA, 22 nt, Human
uuaaucagacauucucaaguuu

SEQ ID NO: 187666 - RNA, 22 nt, Human
uuaauauuuauugguaaucacu

SEQ ID NO: 187667 - RNA, 22 nt, Human
uuaauauuaagauauugagugg

SEQ ID NO: 187668 - RNA, 22 nt, Human
uuguuuucuugaugaaauuauu

SEQ ID NO: 187669 - RNA, 22 nt, Human
uuguuugguugacugauuuacc

SEQ ID NO: 187670 - RNA, 22 nt, Human
uuaaugauuaauguggacccaa

SEQ ID NO: 187671 - RNA, 22 nt, Human
uuguuuuaguagaaguuacaug

SEQ ID NO: 187672 - RNA, 22 nt, Human
uguguguguguguaugugcgug

SEQ ID NO: 187673 - RNA, 22 nt, Human
uguguguaugagcauuuguaug

SEQ ID NO: 187674 - RNA, 22 nt, Human
ugugugcacguacauacuguau

SEQ ID NO: 187675 - RNA, 17 nt, Human
uguguauucuccaggug

SEQ ID NO: 187676 - RNA, 19 nt, Human
uguguguguuuuguuugaa

SEQ ID NO: 187677 - RNA, 22 nt, Human
uguguguguuguaugaaauuuu

SEQ ID NO: 187678 - RNA, 22 nt, Human
uguguguguguguguguuugug

SEQ ID NO: 187679 - RNA, 22 nt, Human
uuggauugugaaaguauucucu

SEQ ID NO: 187680 - RNA, 22 nt, Human
uguguguuguuuugccagaaua

SEQ ID NO: 187681 - RNA, 22 nt, Human
uugcggaucuucauggccucag

SEQ ID NO: 187682 - RNA, 22 nt, Human
uugccuguuugagagcuguguu

SEQ ID NO: 187683 - RNA, 22 nt, Human
uugcggauguccacgucacacu

SEQ ID NO: 187684 - RNA, 21 nt, Human
uguguaccuucuuccgagcuc

SEQ ID NO: 187685 - RNA, 19 nt, Human
uguguaccuaauguuugug

SEQ ID NO: 187686 - RNA, 22 nt, Human
uuggacugguuuacauuucaag

SEQ ID NO: 187687 - RNA, 22 nt, Human
uguuauugccucaugagacucc

SEQ ID NO: 187688 - RNA, 22 nt, Human
uuggcgcuauuauuaccacauu

SEQ ID NO: 187689 - RNA, 22 nt, Human
uguucugaggaggguuucaagg

SEQ ID NO: 187690 - RNA, 20 nt, Human
uuggggacaggagugugaug

SEQ ID NO: 187691 - RNA, 22 nt, Human
uugggagaaaguuaacuuucua

SEQ ID NO: 187692 - RNA, 22 nt, Human
uuggcacagagcugcagccugg

SEQ ID NO: 187693 - RNA, 22 nt, Human
uuggauguggggauggaguggg

SEQ ID NO: 187694 - RNA, 22 nt, Human
uguguucagaagaggcugccgg

SEQ ID NO: 187695 - RNA, 22 nt, Human
uuggcaggcugcauguuuaugu

SEQ ID NO: 187696 - RNA, 22 nt, Human
uguguuucggauagcagauucu

SEQ ID NO: 187697 - RNA, 22 nt, Human
uugucuguacuggcugcaucga

SEQ ID NO: 187698 - RNA, 21 nt, Human
uuguccacacacaccaacugc

SEQ ID NO: 187699 - RNA, 22 nt, Human
uugugacaauacagcauggaga

SEQ ID NO: 187700 - RNA, 21 nt, Human
uguuuuguaauagauacuaug

SEQ ID NO: 187701 - RNA, 22 nt, Human
uugucaugauccuucuguuagg

SEQ ID NO: 187702 - RNA, 22 nt, Human
uugucauuuucuuaauguuccu

SEQ ID NO: 187703 - RNA, 22 nt, Human
uguuuucaucucucacccagaa

SEQ ID NO: 187704 - RNA, 22 nt, Human
uguuuuuauucuuaauguuuca

SEQ ID NO: 187705 - RNA, 23 nt, Human
uugugcggugcuuuggguuuaca

SEQ ID NO: 187706 - RNA, 22 nt, Human
uugugccuuaauauaggcgcug

SEQ ID NO: 187707 - RNA, 22 nt, Human
uugugcauuuuguuuuacuuau

SEQ ID NO: 187708 - RNA, 22 nt, Human
uugugauuaauaacuuuucucu

SEQ ID NO: 187709 - RNA, 22 nt, Human
uuguggacgcaauucaaggaua

SEQ ID NO: 187710 - RNA, 22 nt, Human
uugugcucaguuguggucuauu

SEQ ID NO: 187711 - RNA, 22 nt, Human
uuaaaagaauccuguuauccuc

SEQ ID NO: 187712 - RNA, 22 nt, Human
uguuuaagugguuaaaggauuc

SEQ ID NO: 187713 - RNA, 22 nt, Human
uguuuaaauagaacauacugca

SEQ ID NO: 187714 - RNA, 22 nt, Human
uguuucaguaugauuuucccuc

SEQ ID NO: 187715 - RNA, 22 nt, Human
uugguuuuuugguguaucuuau

SEQ ID NO: 187716 - RNA, 22 nt, Human
uugucagcuagugaugcuguuc

SEQ ID NO: 187717 - RNA, 22 nt, Human
uuguauuguuugcgucuguguu

SEQ ID NO: 187718 - RNA, 22 nt, Human
uugucaggaacuaugauuaugc

SEQ ID NO: 187719 - RNA, 22 nt, Human
uguuuguaugauggcacaucca

SEQ ID NO: 187720 - RNA, 22 nt, Human
uuguauuaauacacuccuuuuc

SEQ ID NO: 187721 - RNA, 22 nt, Human
uuguauguuucugugcacauga

SEQ ID NO: 187722 - RNA, 22 nt, Human
uuguaaguuuuagguguuucaa

SEQ ID NO: 187723 - RNA, 22 nt, Human
uugguauuuguuuaaauuacac

SEQ ID NO: 187724 - RNA, 22 nt, Human
uuggucaagacugauaucaaga

SEQ ID NO: 187725 - RNA, 22 nt, Human
uugguauucaguuggauuugga

SEQ ID NO: 187726 - RNA, 22 nt, Human
uugguuuacucuggggauaucu

SEQ ID NO: 187727 - RNA, 22 nt, Human
uugggagaaauaguugauccgc

SEQ ID NO: 187728 - RNA, 22 nt, Human
uuggggaugccccuacgggcua

SEQ ID NO: 187729 - RNA, 22 nt, Human
uuggggcugcguauuuccaugu

SEQ ID NO: 187730 - RNA, 22 nt, Human
uuggggggucagacuugauaca

SEQ ID NO: 187731 - RNA, 22 nt, Human
uugggucaugggaucccagcau

SEQ ID NO: 187732 - RNA, 22 nt, Human
uucacccaaaucaagcuggccu

SEQ ID NO: 187733 - RNA, 22 nt, Human
uucacccuucucuggcuuucag

SEQ ID NO: 187734 - RNA, 22 nt, Human
uuugaauauacuucaaacaaag

SEQ ID NO: 187735 - RNA, 22 nt, Human
uucaccucuuuuuggggacauc

SEQ ID NO: 187736 - RNA, 22 nt, Human
uucacugacaguauugaggagg

SEQ ID NO: 187737 - RNA, 22 nt, Human
uucacugugauugggguggauu

SEQ ID NO: 187738 - RNA, 22 nt, Human
uuugccaucagaugugguaggu

SEQ ID NO: 187739 - RNA, 22 nt, Human
uucagaauguacugauagaaca

SEQ ID NO: 187740 - RNA, 22 nt, Human
uucacuuuuuccugguccauuu

SEQ ID NO: 187741 - RNA, 22 nt, Human
uucagaaagugaaucuuguuau

SEQ ID NO: 187742 - RNA, 20 nt, Human
uucacagaggacucagguca

SEQ ID NO: 187743 - RNA, 22 nt, Human
uucacaauuuuaaaaaguggaa

SEQ ID NO: 187744 - RNA, 22 nt, Human
uucaaugcaagggaggucugaa

SEQ ID NO: 187745 - RNA, 22 nt, Human
uuaguuacuugacucaagaccc

SEQ ID NO: 187746 - RNA, 22 nt, Human
uuuauucacuuaucaggaacga

SEQ ID NO: 187747 - RNA, 22 nt, Human
uuuauucuuugcuagguuccau

SEQ ID NO: 187748 - RNA, 22 nt, Human
uuuauuuggugguguuacuguu

SEQ ID NO: 187749 - RNA, 22 nt, Human
uuaguuaauaaauauugagugu

SEQ ID NO: 187750 - RNA, 22 nt, Human
uuaguuaccacugcagaucuuu

SEQ ID NO: 187751 - RNA, 22 nt, Human
uuugccccacaggcagcuuugg

SEQ ID NO: 187752 - RNA, 22 nt, Human
uucagaugcuugauuauggcaa

SEQ ID NO: 187753 - RNA, 23 nt, Human
uucagcucuccugaagcaucugu

SEQ ID NO: 187754 - RNA, 22 nt, Human
uucagcacuggacagcgagucu

SEQ ID NO: 187755 - RNA, 22 nt, Human
uuugcuguaaugcaugucagag

SEQ ID NO: 187756 - RNA, 22 nt, Human
uuugcuuugacuuugggaguau

SEQ ID NO: 187757 - RNA, 22 nt, Human
uucagcugcuugccugaaguca

SEQ ID NO: 187758 - RNA, 23 nt, Human
uuugccuaaugaagacuauguca

SEQ ID NO: 187759 - RNA, 22 nt, Human
uuugcuccucuucauuuguauc

SEQ ID NO: 187760 - RNA, 22 nt, Human
uuugcugggaagccuucacucu

SEQ ID NO: 187761 - RNA, 22 nt, Human
uuuggcuuugauccuaggauuc

SEQ ID NO: 187762 - RNA, 22 nt, Human
uuuggcugucauuugaaaaugu

SEQ ID NO: 187763 - RNA, 22 nt, Human
uucaggacuauccaguggucuc

SEQ ID NO: 187764 - RNA, 22 nt, Human
uuuggcgucucucaggagcuca

SEQ ID NO: 187765 - RNA, 22 nt, Human
uucaggugguuuaagaauugga

SEQ ID NO: 187766 - RNA, 22 nt, Human
uucagguuauugaagagcuuuc

SEQ ID NO: 187767 - RNA, 22 nt, Human
uucauauuguggucuugcauuc

SEQ ID NO: 187768 - RNA, 22 nt, Human
uuuguugguugcacuggugggu

SEQ ID NO: 187769 - RNA, 22 nt, Human
uucccggccgccccccgcucgg

SEQ ID NO: 187770 - RNA, 22 nt, Human
uucccuagagagauuuuuauuc

SEQ ID NO: 187771 - RNA, 21 nt, Human
uuuguucacacacagggcagc

SEQ ID NO: 187772 - RNA, 22 nt, Human
uuccauggggcuguugcgcaga

SEQ ID NO: 187773 - RNA, 20 nt, Human
uucaugcagugguugcugug

SEQ ID NO: 187774 - RNA, 22 nt, Human
uucaucuucaaaccccagugcc

SEQ ID NO: 187775 - RNA, 21 nt, Human
uucauucauggcauaauauag

SEQ ID NO: 187776 - RNA, 22 nt, Human
uucaugucuuugauucugauaa

SEQ ID NO: 187777 - RNA, 20 nt, Human
uuugugaggccagagaacag

SEQ ID NO: 187778 - RNA, 22 nt, Human
uucauuagcacauuuccuuggu

SEQ ID NO: 187779 - RNA, 19 nt, Human
uuccacugcuuagcauugc

SEQ ID NO: 187780 - RNA, 22 nt, Human
uuccagauguuuaaguucugcu

SEQ ID NO: 187781 - RNA, 22 nt, Human
uuugugguuuugagagaguugc

SEQ ID NO: 187782 - RNA, 22 nt, Human
uuccagaacaauguggacguau

SEQ ID NO: 187783 - RNA, 22 nt, Human
uuccagcaaagguaguguguua

SEQ ID NO: 187784 - RNA, 22 nt, Human
uuccugacacuggcaggcuucu

SEQ ID NO: 187785 - RNA, 22 nt, Human
uuccucuugaaucugucugacu

SEQ ID NO: 187786 - RNA, 22 nt, Human
uuccucauuuggcacaucugag

SEQ ID NO: 187787 - RNA, 22 nt, Human
uuuguuugcugagugaauucaa

SEQ ID NO: 187788 - RNA, 22 nt, Human
uuuguuuccagccuuuugucuu

SEQ ID NO: 187789 - RNA, 22 nt, Human
uuccuggaguggagggagguga

SEQ ID NO: 187790 - RNA, 21 nt, Human
uuccuggaggcagaaacguga

SEQ ID NO: 187791 - RNA, 19 nt, Human
uuccucaggugugaguuag

SEQ ID NO: 187792 - RNA, 20 nt, Human
uuccuuaucuguaaagugga

SEQ ID NO: 187793 - RNA, 22 nt, Human
uuccuuuaaccaagagcaguac

SEQ ID NO: 187794 - RNA, 22 nt, Human
uuuuaaaguaauugaagcuugu

SEQ ID NO: 187795 - RNA, 19 nt, Human
uuccuuucuauccugggua

SEQ ID NO: 187796 - RNA, 22 nt, Human
uuccuuuuuaauuaaucuaauu

SEQ ID NO: 187797 - RNA, 20 nt, Human
uuccuuucuuucuuuuuuuu

SEQ ID NO: 187798 - RNA, 22 nt, Human
uuccuuuucuucuaccacaugu

SEQ ID NO: 187799 - RNA, 22 nt, Human
uuuuaaauggcuuuuacuuuuc

SEQ ID NO: 187800 - RNA, 22 nt, Human
uucgcggccaggcggggaggcc

SEQ ID NO: 187801 - RNA, 22 nt, Human
uuuuaauaguauaucuagacac

SEQ ID NO: 187802 - RNA, 22 nt, Human
uucuauaagagaugaauacagu

SEQ ID NO: 187803 - RNA, 21 nt, Human
uucuauauugagaauuggcua

SEQ ID NO: 187804 - RNA, 22 nt, Human
uuuuauaauacccuugacuaau

SEQ ID NO: 187805 - RNA, 22 nt, Human
uuuuaucagagcuugcagugug

SEQ ID NO: 187806 - RNA, 22 nt, Human
uuuuaucuuacauggaaucucc

SEQ ID NO: 187807 - RNA, 22 nt, Human
uuuuauguuccugaagcuaucu

SEQ ID NO: 187808 - RNA, 22 nt, Human
uucucugaagagccagcccuua

SEQ ID NO: 187809 - RNA, 22 nt, Human
uucucucaguuaaacuuuguga

SEQ ID NO: 187810 - RNA, 22 nt, Human
uuuuaaucagguauuugaguau

SEQ ID NO: 187811 - RNA, 22 nt, Human
uuuuaauucaacauuugcuuuu

SEQ ID NO: 187812 - RNA, 22 nt, Human
uucgucauuguuguugguuuuc

SEQ ID NO: 187813 - RNA, 22 nt, Human
uucgucaauaugcagccuguga

SEQ ID NO: 187814 - RNA, 22 nt, Human
uucggugagcugcgggcgagga

SEQ ID NO: 187815 - RNA, 22 nt, Human
uuuuacauuuuauucguuuauu

SEQ ID NO: 187816 - RNA, 22 nt, Human
uuuuagccagaguuuaucacag

SEQ ID NO: 187817 - RNA, 22 nt, Human
uuuuagaagcauuuaugagauu

SEQ ID NO: 187818 - RNA, 22 nt, Human
uuuugccuauuguaucaucgua

SEQ ID NO: 187819 - RNA, 22 nt, Human
uuuugcaaauuacuaaauuucu

SEQ ID NO: 187820 - RNA, 22 nt, Human
uucugugacuccucagagauuu

SEQ ID NO: 187821 - RNA, 22 nt, Human
uucuguuuuuauucuaucucug

SEQ ID NO: 187822 - RNA, 22 nt, Human
uuuugcuucuaguauauuuuuu

SEQ ID NO: 187823 - RNA, 22 nt, Human
uuuugggugcaaauuguuuguu

SEQ ID NO: 187824 - RNA, 22 nt, Human
uuuucucacugagagccuugau

SEQ ID NO: 187825 - RNA, 22 nt, Human
uucugagccacaguaaggaucu

SEQ ID NO: 187826 - RNA, 22 nt, Human
uuuuccuugagucggggcacag

SEQ ID NO: 187827 - RNA, 22 nt, Human
uuuucuugagucacuccaguga

SEQ ID NO: 187828 - RNA, 22 nt, Human
uuuucuucucauucugaccuca

SEQ ID NO: 187829 - RNA, 22 nt, Human
uucuggaguuugaagaucaggu

SEQ ID NO: 187830 - RNA, 22 nt, Human
uuuucucuuugcuucucuaaaa

SEQ ID NO: 187831 - RNA, 22 nt, Human
uuuucucucacuucacauauuu

SEQ ID NO: 187832 - RNA, 22 nt, Human
uuuucucaguuuuuuucaaaag

SEQ ID NO: 187833 - RNA, 23 nt, Human
uucuuuccuuaucccauuuacuu

SEQ ID NO: 187834 - RNA, 22 nt, Human
uuuuuaaaauuaggacggcacg

SEQ ID NO: 187835 - RNA, 22 nt, Human
uucuugcuuccggugcuccagg

SEQ ID NO: 187836 - RNA, 22 nt, Human
uucuuggcacagaugagauucu

SEQ ID NO: 187837 - RNA, 22 nt, Human
uuuuguggacugauccgaggac

SEQ ID NO: 187838 - RNA, 22 nt, Human
uucuugcgaaagaaugagcuga

SEQ ID NO: 187839 - RNA, 22 nt, Human
uucuucuguuggcagagcauac

SEQ ID NO: 187840 - RNA, 22 nt, Human
uugaaaaaaucugaggaggacc

SEQ ID NO: 187841 - RNA, 22 nt, Human
uuuuugcuuuuuugucaucuaa

SEQ ID NO: 187842 - RNA, 22 nt, Human
uuuuugcccuaaagaagucauu

SEQ ID NO: 187843 - RNA, 22 nt, Human
uuuuuggacccaucuucuuuuu

SEQ ID NO: 187844 - RNA, 22 nt, Human
uucuuugcucaccugccgcucc

SEQ ID NO: 187845 - RNA, 22 nt, Human
uuuuucuuugcuuuccacuggc

SEQ ID NO: 187846 - RNA, 22 nt, Human
uuuuuauaagauuuaaaaugua

SEQ ID NO: 187847 - RNA, 22 nt, Human
uuuuucugacugcuaacaaaaa

SEQ ID NO: 187848 - RNA, 22 nt, Human
uuuuugaauaagugcaucauca

SEQ ID NO: 187849 - RNA, 22 nt, Human
uuuuucuuugguaacucuuccu

SEQ ID NO: 187850 - RNA, 22 nt, Human
uuuuugggccaaauauauuuac

SEQ ID NO: 187851 - RNA, 22 nt, Human
uugaaaucuucccuccugucug

SEQ ID NO: 187852 - RNA, 22 nt, Human
uugaaaaaauguguuuaaggag

SEQ ID NO: 187853 - RNA, 22 nt, Human
uugaacaguuuugucagguuca

SEQ ID NO: 187854 - RNA, 22 nt, Human
uuuuuuccugguuacagauugu

SEQ ID NO: 187855 - RNA, 22 nt, Human
uuuuuuccagcuucuagaggcc

SEQ ID NO: 187856 - RNA, 22 nt, Human
uugaauuuagguuuaugugaaa

SEQ ID NO: 187857 - RNA, 22 nt, Human
uuuuuuaaucaaguaggaaaca

SEQ ID NO: 187858 - RNA, 22 nt, Human
uugaauaguuuuggauagcaua

SEQ ID NO: 187859 - RNA, 22 nt, Human
uugaugagucacuuucuguaaa

SEQ ID NO: 187860 - RNA, 22 nt, Human
uugaugacauuuagcauaauug

SEQ ID NO: 187861 - RNA, 22 nt, Human
uugauagauuuuagaggcaggc

SEQ ID NO: 187862 - RNA, 22 nt, Human
uuuuuuuccaguuauucauuuu

SEQ ID NO: 187863 - RNA, 22 nt, Human
uugauaacuuagcugggcugcu

SEQ ID NO: 187864 - RNA, 22 nt, Human
uugacguccucgauggggaacu

SEQ ID NO: 187865 - RNA, 22 nt, Human
uugaccauguggcccaggccaa

SEQ ID NO: 187866 - RNA, 22 nt, Human
uugagaugacuuaaaucacugu

SEQ ID NO: 187867 - RNA, 22 nt, Human
uugauucauuuguucccauuuu

SEQ ID NO: 187868 - RNA, 22 nt, Human
uugauuuccauuguccagcauu

SEQ ID NO: 187869 - RNA, 20 nt, Human
uugauucacaaaaagcuuag

SEQ ID NO: 187870 - RNA, 23 nt, Human
uugaucuggaaaauacuuguuug

SEQ ID NO: 187871 - RNA, 22 nt, Human
uugauuaauugaugaaccucuc

SEQ ID NO: 187872 - RNA, 22 nt, Human
uuggaggcagagucuugcugag

SEQ ID NO: 187873 - RNA, 22 nt, Human
uuggauguccucuguggaguau

SEQ ID NO: 187874 - RNA, 22 nt, Human
uuggcuuuucaguuuuaaguua

SEQ ID NO: 187875 - RNA, 21 nt, Human
uuggcuacugcuucagaggga

SEQ ID NO: 187876 - RNA, 22 nt, Human
uuggcguuuccuguucugggug

SEQ ID NO: 187877 - RNA, 22 nt, Human
uuggccugcuccagaacaaggg

SEQ ID NO: 187878 - RNA, 22 nt, Human
uuggccaaggaccuuuuuggag

SEQ ID NO: 187879 - RNA, 22 nt, Human
uuggccuuacgcauggucggca

SEQ ID NO: 187880 - RNA, 22 nt, Human
uuggccuaggcacaggcaggug

SEQ ID NO: 187881 - RNA, 22 nt, Human
uuggccguuucacugggcaguu

SEQ ID NO: 187882 - RNA, 22 nt, Human
uuggcuucuugcuaggaagcug

SEQ ID NO: 187883 - RNA, 22 nt, Human
uugggaaauuugaaaauaaaag

SEQ ID NO: 187884 - RNA, 22 nt, Human
uugggauuggugggguggguuu

SEQ ID NO: 187885 - RNA, 22 nt, Human
uuggggaauuuggggccguccg

SEQ ID NO: 187886 - RNA, 19 nt, Human
uugguuuguugcuuaggug

SEQ ID NO: 187887 - RNA, 22 nt, Human
uugguuuuauucguauuuguau

SEQ ID NO: 187888 - RNA, 22 nt, Human
uuguaauaguguuuuacguugu

SEQ ID NO: 187889 - RNA, 22 nt, Human
uuggggaggaagauagggugaa

SEQ ID NO: 187890 - RNA, 22 nt, Human
uuggggagaagagcuggucagg

SEQ ID NO: 187891 - RNA, 22 nt, Human
uuggggaaaaagaccuaaugac

SEQ ID NO: 187892 - RNA, 22 nt, Human
uugguguaauacaagcaauuug

SEQ ID NO: 187893 - RNA, 22 nt, Human
uugugcauuugcuaugggccau

SEQ ID NO: 187894 - RNA, 22 nt, Human
uugucaguggccugaggacaga

SEQ ID NO: 187895 - RNA, 22 nt, Human
uuucaagccucacugcguuuug

SEQ ID NO: 187896 - RNA, 22 nt, Human
uuucaaguagagggaucgcuag

SEQ ID NO: 187897 - RNA, 22 nt, Human
uuuauuugugguaguguaaucu

SEQ ID NO: 187898 - RNA, 22 nt, Human
uuuauuugggauuucucaucug

SEQ ID NO: 187899 - RNA, 22 nt, Human
uuuauccacucauccaugccuc

SEQ ID NO: 187900 - RNA, 22 nt, Human
uuuaucaucuucugaauuugga

SEQ ID NO: 187901 - RNA, 22 nt, Human
uuuaugauguagccuagagcug

SEQ ID NO: 187902 - RNA, 22 nt, Human
uuuauguugagcaaaauaccac

SEQ ID NO: 187903 - RNA, 22 nt, Human
uuuaugguacaggaaugcuguu

SEQ ID NO: 187904 - RNA, 22 nt, Human
uuuauauauauguaggagcaca

SEQ ID NO: 187905 - RNA, 22 nt, Human
uuuaguauaguaugugcucaaa

SEQ ID NO: 187906 - RNA, 22 nt, Human
uuuagcaaggagaaauaauccu

SEQ ID NO: 187907 - RNA, 22 nt, Human
uuuagcaguuuauuuaaggggg

SEQ ID NO: 187908 - RNA, 22 nt, Human
uuuagauguucccucuacccug

SEQ ID NO: 187909 - RNA, 18 nt, Human
uuuacgaacucacuugag

SEQ ID NO: 187910 - RNA, 22 nt, Human
uuguguugaagugguuagggcg

SEQ ID NO: 187911 - RNA, 22 nt, Human
uuguggcaggauggacagcaga

SEQ ID NO: 187912 - RNA, 22 nt, Human
uuguguuuaaucuguuccacua

SEQ ID NO: 187913 - RNA, 20 nt, Human
uuguuagguucaguguuucc

SEQ ID NO: 187914 - RNA, 23 nt, Human
uugugguuauauuugcccauuuu

SEQ ID NO: 187915 - RNA, 22 nt, Human
uuguucacuaugaagagguugg

SEQ ID NO: 187916 - RNA, 22 nt, Human
uuguugcaagccuggaaucugg

SEQ ID NO: 187917 - RNA, 22 nt, Human
uuuacaaggcaguuauuuuccu

SEQ ID NO: 187918 - RNA, 22 nt, Human
uuuaccugucuguagaacauaa

SEQ ID NO: 187919 - RNA, 22 nt, Human
uuugaugauuuucuagagugua

SEQ ID NO: 187920 - RNA, 22 nt, Human
uuugaugagaaaugacuuaagu

SEQ ID NO: 187921 - RNA, 22 nt, Human
uuugagugcccauguuucccag

SEQ ID NO: 187922 - RNA, 22 nt, Human
uuugagugccucgaguguggga

SEQ ID NO: 187923 - RNA, 22 nt, Human
uuugagaagauaggggaauacu

SEQ ID NO: 187924 - RNA, 22 nt, Human
uuugaagauaaauauggagaaa

SEQ ID NO: 187925 - RNA, 22 nt, Human
uuucuuaguuaaguagguaggc

SEQ ID NO: 187926 - RNA, 23 nt, Human
uuugaaucauuguggggcuuuug

SEQ ID NO: 187927 - RNA, 22 nt, Human
uuugcugaaaaaccacuugagu

SEQ ID NO: 187928 - RNA, 22 nt, Human
uuugccggaucugucuccagcu

SEQ ID NO: 187929 - RNA, 19 nt, Human
uuugccugugguucagaag

SEQ ID NO: 187930 - RNA, 22 nt, Human
uuugcaaaguccauugaaguua

SEQ ID NO: 187931 - RNA, 22 nt, Human
uuugcaggaaauguacugaaug

SEQ ID NO: 187932 - RNA, 22 nt, Human
uuugauuuuuugagcaguguau

SEQ ID NO: 187933 - RNA, 22 nt, Human
uuuggucuggaaucuucagggu

SEQ ID NO: 187934 - RNA, 22 nt, Human
uuuggguuaguuuuccaaucuu

SEQ ID NO: 187935 - RNA, 22 nt, Human
uuuguacuuucuaauguauuua

SEQ ID NO: 187936 - RNA, 22 nt, Human
uuuguaguuguggaugcugaag

SEQ ID NO: 187937 - RNA, 22 nt, Human
uuugucaucuuccauauuugca

SEQ ID NO: 187938 - RNA, 22 nt, Human
uuuguauuucaaggcacucuca

SEQ ID NO: 187939 - RNA, 22 nt, Human
uuugucaggaauugaaaaguuu

SEQ ID NO: 187940 - RNA, 20 nt, Human
uuugucaacugcauccagca

SEQ ID NO: 187941 - RNA, 22 nt, Human
uuugggccugucugccugcuuu

SEQ ID NO: 187942 - RNA, 22 nt, Human
uuuggggcucauuugcuuuugu

SEQ ID NO: 187943 - RNA, 18 nt, Human
uuugggauccucuuuucu

SEQ ID NO: 187944 - RNA, 22 nt, Human
uuuggaggaaugaguuuaauau

SEQ ID NO: 187945 - RNA, 22 nt, Human
uuuggcuaccugggagggaaag

SEQ ID NO: 187946 - RNA, 22 nt, Human
uuuggcuacucuucauugguga

SEQ ID NO: 187947 - RNA, 22 nt, Human
uuuggcaagcagaugaagguag

SEQ ID NO: 187948 - RNA, 22 nt, Human
uuugcuguccaauauucagggu

SEQ ID NO: 187949 - RNA, 22 nt, Human
uuucagugaaugaauggcuaac

SEQ ID NO: 187950 - RNA, 22 nt, Human
uuucagcaugacuguuaucuuu

SEQ ID NO: 187951 - RNA, 22 nt, Human
uuucacagcgucuuucucuugc

SEQ ID NO: 187952 - RNA, 21 nt, Human
uuucauuaguacaucaauuug

SEQ ID NO: 187953 - RNA, 22 nt, Human
uuucauggaggccaggacagag

SEQ ID NO: 187954 - RNA, 21 nt, Human
uuucauaggguuaaaggguua

SEQ ID NO: 187955 - RNA, 22 nt, Human
uuuccagacaugguuuuucaaa

SEQ ID NO: 187956 - RNA, 22 nt, Human
uuucuaaaaccagaguuuauaa

SEQ ID NO: 187957 - RNA, 22 nt, Human
uuucuaacacccuccuuccaga

SEQ ID NO: 187958 - RNA, 22 nt, Human
uuuccugcagacaguuuaagca

SEQ ID NO: 187959 - RNA, 22 nt, Human
uuuccugacuucaccuuuuacc

SEQ ID NO: 187960 - RNA, 22 nt, Human
uuuccuguuuugguuuggagag

SEQ ID NO: 187961 - RNA, 22 nt, Human
uuuccuguccugguacuuggca

SEQ ID NO: 187962 - RNA, 22 nt, Human
uuucgcuuguucggagugcuuu

SEQ ID NO: 187963 - RNA, 22 nt, Human
uuuccuucccuccugggccuuc

SEQ ID NO: 187964 - RNA, 22 nt, Human
uuuccuuuguuuugguauaugu

SEQ ID NO: 187965 - RNA, 22 nt, Human
uuucucugggugaugagguggc

SEQ ID NO: 187966 - RNA, 22 nt, Human
uuucucuccucgaaauucuuau

SEQ ID NO: 187967 - RNA, 22 nt, Human
uuucucuuucaaucugcaguac

SEQ ID NO: 187968 - RNA, 22 nt, Human
uuucuauuuacagugcuaggua

SEQ ID NO: 187969 - RNA, 23 nt, Human
uuucugaguuuuuuaaaagucca

SEQ ID NO: 187970 - RNA, 22 nt, Human
uuucuggacuaaagggagagau

SEQ ID NO: 187971 - RNA, 22 nt, Human
uuucugcuuucuaguugguguu

SEQ ID NO: 187972 - RNA, 22 nt, Human
uuucuggaaacuguaaagagga

SEQ ID NO: 187973 - RNA, 22 nt, Human
uuucuuugggcccuggcagucu

SEQ ID NO: 187974 - RNA, 22 nt, Human
uuucugggggucgugcuggcug

SEQ ID NO: 187975 - RNA, 22 nt, Human
uuucucuuuuugggguggggug

SEQ ID NO: 187976 - RNA, 22 nt, Human
uuucugguuuuauucugggguu

SEQ ID NO: 187977 - RNA, 22 nt, Human
uuucuguuuguaacuccagcaa

SEQ ID NO: 187978 - RNA, 22 nt, Human
uuucugugguggguaguucaga

SEQ ID NO: 187979 - RNA, 22 nt, Human
uuucuuccuucuugaucauuug

SEQ ID NO: 187980 - RNA, 22 nt, Human
uuucuuccaucuggcuuuauuu

SEQ ID NO: 187981 - RNA, 22 nt, Human
uuuugaauaauucagaaacagc

SEQ ID NO: 187982 - RNA, 22 nt, Human
aauauuuaaauagaauuacauc

SEQ ID NO: 187983 - RNA, 23 nt, Human
acaaguguuuccaauauggcugg

SEQ ID NO: 187984 - RNA, 22 nt, Human
agagggagagaccuccgugccu

SEQ ID NO: 187985 - RNA, 22 nt, Human
ugaggaagugguuguaugguuu

SEQ ID NO: 187986 - RNA, 22 nt, Human
aacucaggagagaguaacaggg

SEQ ID NO: 187987 - RNA, 22 nt, Human
uauuuucucugccacacuucca

SEQ ID NO: 187988 - RNA, 22 nt, Human
gaggggaacaggcauucuuaag

SEQ ID NO: 187989 - RNA, 22 nt, Human
auuucacucuuaauugcuuccu

SEQ ID NO: 187990 - RNA, 22 nt, Human
gggagggaggagccccggccau

SEQ ID NO: 187991 - RNA, 22 nt, Human
cagagagcguccauccggugcc

SEQ ID NO: 187992 - RNA, 22 nt, Human
gggugcuucauaggugaugcug

SEQ ID NO: 187993 - RNA, 22 nt, Human
uguccuuuauauguuuuuuagu

SEQ ID NO: 187994 - RNA, 22 nt, Human
ggaauuauuuuaaauagacauu

SEQ ID NO: 187995 - RNA, 22 nt, Human
uggagucuugcuuugggagugc

SEQ ID NO: 187996 - RNA, 22 nt, Human
agagauacugcaggccauaaau

SEQ ID NO: 187997 - RNA, 22 nt, Human
agauggaguccugaagccagaa

SEQ ID NO: 187998 - RNA, 22 nt, Human
uagcacauaguaggcacaggcu

SEQ ID NO: 187999 - RNA, 23 nt, Human
ucagaccaaccucuugcuggaac

SEQ ID NO: 188000 - RNA, 22 nt, Human
ucaguggaacacacagaguggg

SEQ ID NO: 188001 - RNA, 22 nt, Human
agggaguuccgaucugugcacc

SEQ ID NO: 188002 - RNA, 22 nt, Human
aguuucuugaagacugauguuu

SEQ ID NO: 188003 - RNA, 22 nt, Human
cagguugaaaguggaggagcua

SEQ ID NO: 188004 - RNA, 22 nt, Human
caaggaaaugucagaaaggcaa

SEQ ID NO: 188005 - RNA, 20 nt, Human
cuguucucuugccacaugag

SEQ ID NO: 188006 - RNA, 22 nt, Human
auuucauuuuagaaauaagugu

SEQ ID NO: 188007 - RNA, 22 nt, Human
agcaggaaggcuagaagcagga

SEQ ID NO: 188008 - RNA, 20 nt, Human
cauuccaugcaucuuggucc

SEQ ID NO: 188009 - RNA, 22 nt, Human
augauuauuugaaugaagagga

SEQ ID NO: 188010 - RNA, 22 nt, Human
aggcuccucugggggccccgga

SEQ ID NO: 188011 - RNA, 22 nt, Human
ucagaaggagagacagcgugga

SEQ ID NO: 188012 - RNA, 20 nt, Human
gaauucugaagauaauuugg

SEQ ID NO: 188013 - RNA, 22 nt, Human
ggcagucuuucccuugagcucu

SEQ ID NO: 188014 - RNA, 21 nt, Human
ugccuggccuuugcuuuuccu

SEQ ID NO: 188015 - RNA, 22 nt, Human
ucccuugacauuacuugggagg

SEQ ID NO: 188016 - RNA, 22 nt, Human
uuuauuugggauuucucaucug

SEQ ID NO: 188017 - RNA, 22 nt, Human
ggugaguagaaguaguuggcuu

SEQ ID NO: 188018 - RNA, 22 nt, Human
gccugggguuugcggggcugca

SEQ ID NO: 188019 - RNA, 22 nt, Human
ucagccuugguuuugguguugg

SEQ ID NO: 188020 - RNA, 22 nt, Human
cucuucauguuggugcagaagc

SEQ ID NO: 188021 - RNA, 22 nt, Human
uuaucuuuuaaaaacacuugug

SEQ ID NO: 188022 - RNA, 22 nt, Human
aggcaguguggagggcuguugc

SEQ ID NO: 188023 - RNA, 22 nt, Human
cuuuaaaaauguauuuuugugg

SEQ ID NO: 188024 - RNA, 22 nt, Human
gaggggacugucuggcuccgag

SEQ ID NO: 188025 - RNA, 22 nt, Human
agucccugauggacuggaugag

SEQ ID NO: 188026 - RNA, 22 nt, Human
uaaagugaaguucagaauggcu

SEQ ID NO: 188027 - RNA, 22 nt, Human
cucagaauugucaccucaaaaa

SEQ ID NO: 188028 - RNA, 22 nt, Human
uuggaggucucugugguggugg

SEQ ID NO: 188029 - RNA, 22 nt, Human
uccaugaguuuuuuaguuucac

SEQ ID NO: 188030 - RNA, 22 nt, Human
agauucucccuccuggcgcugu

SEQ ID NO: 188031 - RNA, 22 nt, Human
acauucucuuuuagaaagcugu

SEQ ID NO: 188032 - RNA, 22 nt, Human
cagagcugucauuugccaguga

SEQ ID NO: 188033 - RNA, 22 nt, Human
ugggcagggagcuggaaccaca

SEQ ID NO: 188034 - RNA, 22 nt, Human
uuuguuuccagccuuuugucuu

SEQ ID NO: 188035 - RNA, 22 nt, Human
agauggaggaaagcaguuagaa

SEQ ID NO: 188036 - RNA, 22 nt, Human
uuuuccuugagucggggcacag

SEQ ID NO: 188037 - RNA, 22 nt, Human
uauaagaaaagucauuaucaaa

SEQ ID NO: 188038 - RNA, 22 nt, Human
cacugcacuccagccugggcaa

SEQ ID NO: 188039 - RNA, 22 nt, Human
gaggggaauguuccugagcugg

SEQ ID NO: 188040 - RNA, 22 nt, Human
ucaccauguacaugaagggcgg

SEQ ID NO: 188041 - RNA, 22 nt, Human
cagaccagaaggaagccgacaa

SEQ ID NO: 188042 - RNA, 22 nt, Human
gagccucaggguuuuguugaca

SEQ ID NO: 188043 - RNA, 22 nt, Human
ugggggagggagaguugauggg

SEQ ID NO: 188044 - RNA, 22 nt, Human
ggaagauagaaguucaaaaguu

SEQ ID NO: 188045 - RNA, 22 nt, Human
ucucaaagguuuuccucuuuuu

SEQ ID NO: 188046 - RNA, 20 nt, Human
agugauuuguuaguacauug

SEQ ID NO: 188047 - RNA, 22 nt, Human
acauaaaccccccuuccccagg

SEQ ID NO: 188048 - RNA, 19 nt, Human
agcucaggcccaucguccc

SEQ ID NO: 188049 - RNA, 22 nt, Human
gucuuuguaguuuuaauuugag

SEQ ID NO: 188050 - RNA, 22 nt, Human
aagaaauagauagaggaauacu

SEQ ID NO: 188051 - RNA, 22 nt, Human
uuauuuuuguuuguuaagccua

SEQ ID NO: 188052 - RNA, 22 nt, Human
auucuuuauuuucuguacuugc

SEQ ID NO: 188053 - RNA, 22 nt, Human
cucaaagcagacuuuucccuuu

SEQ ID NO: 188054 - RNA, 22 nt, Human
uggcucacuuccguggagaggu

SEQ ID NO: 188055 - RNA, 22 nt, Human
acauauaugugcauacaacuau

SEQ ID NO: 188056 - RNA, 22 nt, Human
uuuuucuuugcuuuccacuggc

SEQ ID NO: 188057 - RNA, 22 nt, Human
uguuuagcucugacuaugugau

SEQ ID NO: 188058 - RNA, 22 nt, Human
ugcugcacccuucauuuuccca

SEQ ID NO: 188059 - RNA, 22 nt, Human
uuuuuaagguuuguuuauauau

SEQ ID NO: 188060 - RNA, 22 nt, Human
uaccuggauaaauguacaaccg

SEQ ID NO: 188061 - RNA, 22 nt, Human
gagggagugggcccgugggcac

SEQ ID NO: 188062 - RNA, 22 nt, Human
agggaggagggacagaaagagg

SEQ ID NO: 188063 - RNA, 22 nt, Human
guuuuucuuugauuuagaacca

SEQ ID NO: 188064 - RNA, 22 nt, Human
aacacuaaaggucaguuagaag

SEQ ID NO: 188065 - RNA, 22 nt, Human
uacaggaggaugugcagccagg

SEQ ID NO: 188066 - RNA, 22 nt, Human
uuuuuuuguagguguaugaaaa

SEQ ID NO: 188067 - RNA, 22 nt, Human
uuauuuaagaucuuaauauaua

SEQ ID NO: 188068 - RNA, 22 nt, Human
aagcccucagagccucuuugac

SEQ ID NO: 188069 - RNA, 22 nt, Human
cuuccuuucagaggaaggccug

SEQ ID NO: 188070 - RNA, 22 nt, Human
aauucuguugguuagaguugga

SEQ ID NO: 188071 - RNA, 18 nt, Human
aguuuuuuuggcaaaagg

SEQ ID NO: 188072 - RNA, 22 nt, Human
uuuucucuuugcuucucuaaaa

SEQ ID NO: 188073 - RNA, 22 nt, Human
uuuauuuacuuucgguucugcu

SEQ ID NO: 188074 - RNA, 22 nt, Human
ggagauggucacagguaaacau

SEQ ID NO: 188075 - RNA, 22 nt, Human
cccuguccuucccuccaucuga

SEQ ID NO: 188076 - RNA, 22 nt, Human
auagagcuggggaagaagcugg

SEQ ID NO: 188077 - RNA, 22 nt, Human
uuuuuuuaaguuuugauuuuag

SEQ ID NO: 188078 - RNA, 22 nt, Human
ggaaauauaagcaguuugugug

SEQ ID NO: 188079 - RNA, 22 nt, Human
cuccaugagccaggagggcuac

SEQ ID NO: 188080 - RNA, 22 nt, Human
cuccuuugagcaaaucuuugau

SEQ ID NO: 188081 - RNA, 22 nt, Human
uguuuuuuagagugauacuuuu

SEQ ID NO: 188082 - RNA, 20 nt, Human
cccuggaaugagaugcauau

SEQ ID NO: 188083 - RNA, 22 nt, Human
uucuuuucuucccuguuuauua

SEQ ID NO: 188084 - RNA, 22 nt, Human
caggaggugugucccaccgggu

SEQ ID NO: 188085 - RNA, 22 nt, Human
gccuggccaaucgccgucuagg

SEQ ID NO: 188086 - RNA, 22 nt, Human
agggaagaggaccagagucucu

SEQ ID NO: 188087 - RNA, 22 nt, Human
aggagguagggugugaaacagc

SEQ ID NO: 188088 - RNA, 22 nt, Human
ugagguauuuggauuuauauuu

SEQ ID NO: 188089 - RNA, 22 nt, Human
auacauauaugcacauuaauau

SEQ ID NO: 188090 - RNA, 22 nt, Human
aaugcuuuuugcgaaaugugca

SEQ ID NO: 188091 - RNA, 22 nt, Human
uguaaauucuauacacuuaaaa

SEQ ID NO: 188092 - RNA, 22 nt, Human
ugggcagggauuuggggaaacu

SEQ ID NO: 188093 - RNA, 22 nt, Human
guguucucagcacccacuucau

SEQ ID NO: 188094 - RNA, 22 nt, Human
auuuuucuuucacauuuucuua

SEQ ID NO: 188095 - RNA, 22 nt, Human
agauauucugccuaacagguuu

SEQ ID NO: 188096 - RNA, 22 nt, Human
auuaauaucaauauauuauaug

SEQ ID NO: 188097 - RNA, 22 nt, Human
aagggagagggagaagguggga

SEQ ID NO: 188098 - RNA, 23 nt, Human
uugcuuuugccccaaaagaguua

SEQ ID NO: 188099 - RNA, 22 nt, Human
aggccaggcgccggcgcgagac

SEQ ID NO: 188100 - RNA, 22 nt, Human
aguaggaauucaaagagacaaa

SEQ ID NO: 188101 - RNA, 22 nt, Human
agacuucucuuggcuauauuau

SEQ ID NO: 188102 - RNA, 22 nt, Human
gugaaaaauggccaucaggaca

SEQ ID NO: 188103 - RNA, 22 nt, Human
uuauuuucgugugugugugugu

SEQ ID NO: 188104 - RNA, 22 nt, Human
uggcaaggccacaggugcaguu

SEQ ID NO: 188105 - RNA, 22 nt, Human
auuuuauuuugggaucuuuuua

SEQ ID NO: 188106 - RNA, 22 nt, Human
auaaggaaagugagugcuuaaa

SEQ ID NO: 188107 - RNA, 22 nt, Human
agugaaauaugcccauugcugu

SEQ ID NO: 188108 - RNA, 22 nt, Human
uggaagugggcaucaccaucca

SEQ ID NO: 188109 - RNA, 22 nt, Human
agugucugcgggcagaggagcg

SEQ ID NO: 188110 - RNA, 21 nt, Human
uccugccuggccuucugacua

SEQ ID NO: 188111 - RNA, 22 nt, Human
gccucucuggcaaagcggugau

SEQ ID NO: 188112 - RNA, 22 nt, Human
gagggcugccacguugggcgag

SEQ ID NO: 188113 - RNA, 22 nt, Human
uuucacuucgaucagaguuuuu

SEQ ID NO: 188114 - RNA, 22 nt, Human
uccaugauauauaugugcacau

SEQ ID NO: 188115 - RNA, 22 nt, Human
aggcagagaggucuuccuggaa

SEQ ID NO: 188116 - RNA, 22 nt, Human
auuuucuugucucuguuguagg

SEQ ID NO: 188117 - RNA, 23 nt, Human
ucucacucauucuccucugucca

SEQ ID NO: 188118 - RNA, 22 nt, Human
acauuucuccuacuuguuauuu

SEQ ID NO: 188119 - RNA, 22 nt, Human
caucucagguuuguucugagac

SEQ ID NO: 188120 - RNA, 22 nt, Human
gaggccagcacccagaugcaug

SEQ ID NO: 188121 - RNA, 22 nt, Human
cuauguuucagauauauauaua

SEQ ID NO: 188122 - RNA, 22 nt, Human
aaggucuucgaaccuuauguua

SEQ ID NO: 188123 - RNA, 22 nt, Human
aaauauuagacauaccuggaga

SEQ ID NO: 188124 - RNA, 22 nt, Human
gaacauauuuagcaccuaauau

SEQ ID NO: 188125 - RNA, 22 nt, Human
auacaucuuaacgcgcucuugg

SEQ ID NO: 188126 - RNA, 22 nt, Human
gauauuuugugaaaaaacaacu

SEQ ID NO: 188127 - RNA, 22 nt, Human
uucacauucauuucuuauguuu

SEQ ID NO: 188128 - RNA, 22 nt, Human
gcucagcuggagagggacgggu

SEQ ID NO: 188129 - RNA, 22 nt, Human
gcauaauauugagaaauuauua

SEQ ID NO: 188130 - RNA, 22 nt, Human
auucuuauaaaaaguguugacu

SEQ ID NO: 188131 - RNA, 22 nt, Human
cuccaggacugaggacagagcu

SEQ ID NO: 188132 - RNA, 22 nt, Human
ggcuagggaucuagaccaggac

SEQ ID NO: 188133 - RNA, 22 nt, Human
guuuggguggcuagagaaagaa

SEQ ID NO: 188134 - RNA, 22 nt, Human
uuucagagaaagcccaaagacu

SEQ ID NO: 188135 - RNA, 22 nt, Human
uggaguuuuaaucuguacagaa

SEQ ID NO: 188136 - RNA, 22 nt, Human
gcagcccucuuggucacuaggc

SEQ ID NO: 188137 - RNA, 22 nt, Human
acuuuaaauaucauuugguagg

SEQ ID NO: 188138 - RNA, 22 nt, Human
cuccuuuuccuacucauacuau

SEQ ID NO: 188139 - RNA, 22 nt, Human
gaggggaaggguguucaauggg

SEQ ID NO: 188140 - RNA, 22 nt, Human
ggcucagaggagcuggaacggu

SEQ ID NO: 188141 - RNA, 22 nt, Human
caaggaaaacagaugaucaaca

SEQ ID NO: 188142 - RNA, 21 nt, Human
gaaaaucuaaugugacaaugc

SEQ ID NO: 188143 - RNA, 22 nt, Human
uauauauaauguguacagguga

SEQ ID NO: 188144 - RNA, 22 nt, Human
auauuuuugcagaauuuuucgu

SEQ ID NO: 188145 - RNA, 22 nt, Human
uucuuuuaauagagauccugug

SEQ ID NO: 188146 - RNA, 17 nt, Human
auucuuauacucuguga

SEQ ID NO: 188147 - RNA, 22 nt, Human
aggcgaagggaccagacgguag

SEQ ID NO: 188148 - RNA, 22 nt, Human
uacuuacacugaagcaaagaua

SEQ ID NO: 188149 - RNA, 21 nt, Human
cuccuguaaaucaccuccgca

SEQ ID NO: 188150 - RNA, 22 nt, Human
ucuugugguggaucccucauuu

SEQ ID NO: 188151 - RNA, 22 nt, Human
cuucuuuucuacuggccuagaa

SEQ ID NO: 188152 - RNA, 19 nt, Human
auguuuccauuucuggaua

SEQ ID NO: 188153 - RNA, 22 nt, Human
ugugucuccacugugcuauuuu

SEQ ID NO: 188154 - RNA, 20 nt, Human
ugccagagagcucauacccu

SEQ ID NO: 188155 - RNA, 22 nt, Human
uuuuuuaaucaaguaggaaaca

SEQ ID NO: 188156 - RNA, 22 nt, Human
cuccugcuuuuucuucuuccga

SEQ ID NO: 188157 - RNA, 22 nt, Human
caaauguuugguggcauuuugu

SEQ ID NO: 188158 - RNA, 22 nt, Human
uaaaugauaguauugaagguag

SEQ ID NO: 188159 - RNA, 20 nt, Human
ggcagagcuaugucuguugc

SEQ ID NO: 188160 - RNA, 22 nt, Human
gauauauuucaaauucuuuugc

SEQ ID NO: 188161 - RNA, 22 nt, Human
caggggcuccaggugagccugg

SEQ ID NO: 188162 - RNA, 22 nt, Human
guucuucagauuccauuucagu

SEQ ID NO: 188163 - RNA, 22 nt, Human
ugagacucuccugugcagccuc

SEQ ID NO: 188164 - RNA, 22 nt, Human
uuuauuuuccaugucucuaggu

SEQ ID NO: 188165 - RNA, 22 nt, Human
agggaaauaggagaagaaagga

SEQ ID NO: 188166 - RNA, 22 nt, Human
uucugggguaagcacugaggau

SEQ ID NO: 188167 - RNA, 22 nt, Human
aucucacuucugucauguggca

SEQ ID NO: 188168 - RNA, 22 nt, Human
uggggcugguaccguaauauau

SEQ ID NO: 188169 - RNA, 22 nt, Human
auucauucugaccucaagagaa

SEQ ID NO: 188170 - RNA, 22 nt, Human
gaauucuaguucuguaucucug

SEQ ID NO: 188171 - RNA, 22 nt, Human
ggacuggugaagccuucggaga

SEQ ID NO: 188172 - RNA, 23 nt, Human
ucugccuccuaauuguugguguc

SEQ ID NO: 188173 - RNA, 22 nt, Human
cauuccuucucagguacuggca

SEQ ID NO: 188174 - RNA, 22 nt, Human
cugaaagacagccaggcaaagc

SEQ ID NO: 188175 - RNA, 22 nt, Human
caucuaaaauaagccuuauaau

SEQ ID NO: 188176 - RNA, 22 nt, Human
acuuuuccuggguagcuccugg

SEQ ID NO: 188177 - RNA, 22 nt, Human
uacaaaugaucaucucuuugaa

SEQ ID NO: 188178 - RNA, 22 nt, Human
ccaggaguccgugggucuugag

SEQ ID NO: 188179 - RNA, 22 nt, Human
aucauguauauuuuugcuauua

SEQ ID NO: 188180 - RNA, 22 nt, Human
auuagugguguauuuggcacua

SEQ ID NO: 188181 - RNA, 22 nt, Human
aaagcugaaacgaaaugacaac

SEQ ID NO: 188182 - RNA, 22 nt, Human
ccucuagaauuaucacuuuuaa

SEQ ID NO: 188183 - RNA, 22 nt, Human
aagagaggaaagggugugaggu

SEQ ID NO: 188184 - RNA, 22 nt, Human
uagcauuuauugggcuagcaaa

SEQ ID NO: 188185 - RNA, 20 nt, Human
agagaacaguuuggucacag

SEQ ID NO: 188186 - RNA, 22 nt, Human
aagcucuuuccacuaaaccacu

SEQ ID NO: 188187 - RNA, 22 nt, Human
uccuuuauuuaugggcagugua

SEQ ID NO: 188188 - RNA, 22 nt, Human
agaugaugugugucuucagcua

SEQ ID NO: 188189 - RNA, 22 nt, Human
gcuuucagggucacugucaaca

SEQ ID NO: 188190 - RNA, 22 nt, Human
uggcucaguaaucgagucuccu

SEQ ID NO: 188191 - RNA, 22 nt, Human
uaaaugaaaggguuuaauuuau

SEQ ID NO: 188192 - RNA, 20 nt, Human
cuggaguguagcaguggcug

SEQ ID NO: 188193 - RNA, 21 nt, Human
uuccuccucuggagaagaaga

SEQ ID NO: 188194 - RNA, 23 nt, Human
gucucacaaccaccugagaaaau

SEQ ID NO: 188195 - RNA, 22 nt, Human
uauaaagaccuuauccuucaua

SEQ ID NO: 188196 - RNA, 22 nt, Human
cccagagggcugaggauaugaa

SEQ ID NO: 188197 - RNA, 22 nt, Human
agggcugcugcuccgggcccag

SEQ ID NO: 188198 - RNA, 22 nt, Human
guuuauuucuuaucaucacuau

SEQ ID NO: 188199 - RNA, 22 nt, Human
aacaguuaagaggaggcagaga

SEQ ID NO: 188200 - RNA, 22 nt, Human
gugggggugaggaauguucuau

SEQ ID NO: 188201 - RNA, 22 nt, Human
gaggaggcuggagaggccagga

SEQ ID NO: 188202 - RNA, 22 nt, Human
uuuuuguuauuuagguguagag

SEQ ID NO: 188203 - RNA, 22 nt, Human
uccaaggacuaaauucuagauu

SEQ ID NO: 188204 - RNA, 22 nt, Human
uauuguuuuaagguguauuaau

SEQ ID NO: 188205 - RNA, 21 nt, Human
ugcuuucugugcuuuuucugc

SEQ ID NO: 188206 - RNA, 22 nt, Human
gggagccucccacugggggaag

SEQ ID NO: 188207 - RNA, 22 nt, Human
augggagggagcagugaguguu

SEQ ID NO: 188208 - RNA, 22 nt, Human
caguggagaccugccugcugga

SEQ ID NO: 188209 - RNA, 22 nt, Human
aggggcugagaguuugaugugg

SEQ ID NO: 188210 - RNA, 22 nt, Human
ccuuuuaucgcgaagaacucca

SEQ ID NO: 188211 - RNA, 22 nt, Human
gugucacuuucaggagcucuaa

SEQ ID NO: 188212 - RNA, 22 nt, Human
aaagggagauaaaguaauuuua

SEQ ID NO: 188213 - RNA, 22 nt, Human
aauguugaaccuuuuuggccug

SEQ ID NO: 188214 - RNA, 23 nt, Human
ucacugccaagaaaaguuacaga

SEQ ID NO: 188215 - RNA, 23 nt, Human
ucuuuccuuucauacagucagcu

SEQ ID NO: 188216 - RNA, 19 nt, Human
acacaccagugccugugac

SEQ ID NO: 188217 - RNA, 22 nt, Human
ccauggaaaagacgggcaggcc

SEQ ID NO: 188218 - RNA, 20 nt, Human
uuggagaucacguguccagg

SEQ ID NO: 188219 - RNA, 19 nt, Human
ucaggaggucgaccuggca

SEQ ID NO: 188220 - RNA, 22 nt, Human
ggcuccaggguaccccuggaug

SEQ ID NO: 188221 - RNA, 22 nt, Human
gggggagcuacaggucccuugg

SEQ ID NO: 188222 - RNA, 22 nt, Human
uuuuccuuaacagagggagaaa

SEQ ID NO: 188223 - RNA, 22 nt, Human
aaggacaccaaacuaauuggga

SEQ ID NO: 188224 - RNA, 22 nt, Human
uucucuuguaaaauuccuuuuu

SEQ ID NO: 188225 - RNA, 19 nt, Human
uuccuuucuauccugggua

SEQ ID NO: 188226 - RNA, 17 nt, Human
ugaggcugucucccugg

SEQ ID NO: 188227 - RNA, 22 nt, Human
uaugggcaagagauaggugguc

SEQ ID NO: 188228 - RNA, 20 nt, Human
uggguucaguuguuucuggc

SEQ ID NO: 188229 - RNA, 22 nt, Human
uucuuaaugcauccuguguuca

SEQ ID NO: 188230 - RNA, 22 nt, Human
cuguuucucugccugcacacau

SEQ ID NO: 188231 - RNA, 20 nt, Human
acacaccugcucagacugag

SEQ ID NO: 188232 - RNA, 22 nt, Human
aguaggauguuuagcccuucuu

SEQ ID NO: 188233 - RNA, 22 nt, Human
ccucccuucccggcauggcucu

SEQ ID NO: 188234 - RNA, 22 nt, Human
uggaagcccagaaggaagcaga

SEQ ID NO: 188235 - RNA, 22 nt, Human
ucauacuuuuuugacccuugug

SEQ ID NO: 188236 - RNA, 22 nt, Human
agccagugucgugugacaugag

SEQ ID NO: 188237 - RNA, 23 nt, Human
ugggagcuauguuuggaaugggg

SEQ ID NO: 188238 - RNA, 22 nt, Human
aucaaaauguguagucuugauc

SEQ ID NO: 188239 - RNA, 22 nt, Human
ggggaaggaaggggagggcacg

SEQ ID NO: 188240 - RNA, 22 nt, Human
augcaaaaucuuauuuuuucua

SEQ ID NO: 188241 - RNA, 22 nt, Human
ucccugcugggcgaucuucucu

SEQ ID NO: 188242 - RNA, 22 nt, Human
gcuucucacccuuacuaucucu

SEQ ID NO: 188243 - RNA, 22 nt, Human
gcacagauaaucugccuuacca

SEQ ID NO: 188244 - RNA, 22 nt, Human
uuuucucaguuuuuuucaaaag

SEQ ID NO: 188245 - RNA, 22 nt, Human
auuuuuaucuaaaauccacuuu

SEQ ID NO: 188246 - RNA, 22 nt, Human
caaaaaauccauagaaagaggu

SEQ ID NO: 188247 - RNA, 22 nt, Human
uauuuaaagucagcaacuuuuc

SEQ ID NO: 188248 - RNA, 22 nt, Human
ccauuucacaucccugacaugu

SEQ ID NO: 188249 - RNA, 22 nt, Human
agugagaguauuaaugugaacu

SEQ ID NO: 188250 - RNA, 22 nt, Human
ggaaggggagcuggaaagggua

SEQ ID NO: 188251 - RNA, 22 nt, Human
aaaauauuuaucuagcucuuaa

SEQ ID NO: 188252 - RNA, 21 nt, Human
auauuguugggguuuucuuuu

SEQ ID NO: 188253 - RNA, 22 nt, Human
cuuuacauuaauuucuacugau

SEQ ID NO: 188254 - RNA, 22 nt, Human
gcuguggaaaaugggucuccaa

SEQ ID NO: 188255 - RNA, 22 nt, Human
gucacuuugcuugcgaugcucc

SEQ ID NO: 188256 - RNA, 22 nt, Human
gucuugugaagacggcagaaag

SEQ ID NO: 188257 - RNA, 22 nt, Human
aauaucuugaguuauaaauuca

SEQ ID NO: 188258 - RNA, 22 nt, Human
uccagcugugcuccaggaggug

SEQ ID NO: 188259 - RNA, 22 nt, Human
ugguugauuaauuuugccaagc

SEQ ID NO: 188260 - RNA, 22 nt, Human
auggauggaagcagccugaacu

SEQ ID NO: 188261 - RNA, 22 nt, Human
uuuaaaacagcauuuaaaaggu

SEQ ID NO: 188262 - RNA, 22 nt, Human
gcugcaggaggugguagggucu

SEQ ID NO: 188263 - RNA, 22 nt, Human
cuggagaacucugugcuucacu

SEQ ID NO: 188264 - RNA, 22 nt, Human
aggcaguggagcuggaauaggc

SEQ ID NO: 188265 - RNA, 22 nt, Human
acaggaaugaagaugagagagu

SEQ ID NO: 188266 - RNA, 22 nt, Human
agcacauguuucuuuugcaauu

SEQ ID NO: 188267 - RNA, 20 nt, Human
uuuuuuaaauagagcuguug

SEQ ID NO: 188268 - RNA, 22 nt, Human
ccccccaaauguuacagugacc

SEQ ID NO: 188269 - RNA, 22 nt, Human
gcuuauuagguuauuucaagga

SEQ ID NO: 188270 - RNA, 22 nt, Human
uuguuuucuaguguuuugaaua

SEQ ID NO: 188271 - RNA, 22 nt, Human
cucaagugacucagccugguug

SEQ ID NO: 188272 - RNA, 22 nt, Human
aagcauuuuagauaaagcauca

SEQ ID NO: 188273 - RNA, 22 nt, Human
aggccccacaaacucgccuuug

SEQ ID NO: 188274 - RNA, 22 nt, Human
uauuucuagggcaugaaaauaa

SEQ ID NO: 188275 - RNA, 22 nt, Human
gggaaauagagcuggaaccuug

SEQ ID NO: 188276 - RNA, 22 nt, Human
cuguccauuuucgugccuccuu

SEQ ID NO: 188277 - RNA, 22 nt, Human
aauaagaguuaagaaguauauu

SEQ ID NO: 188278 - RNA, 22 nt, Human
ucugcaugccucaggaggccug

SEQ ID NO: 188279 - RNA, 22 nt, Human
uagcugucauuggaucagaagg

SEQ ID NO: 188280 - RNA, 22 nt, Human
ugguccuuuccauuggagacac

SEQ ID NO: 188281 - RNA, 23 nt, Human
aaguggugacugugcuacugaga

SEQ ID NO: 188282 - RNA, 22 nt, Human
uacauuccagaaaguuucugua

SEQ ID NO: 188283 - RNA, 22 nt, Human
augcugugccuggaaagcggcu

SEQ ID NO: 188284 - RNA, 22 nt, Human
cuagcacagugcuuggcacaca

SEQ ID NO: 188285 - RNA, 22 nt, Human
augccugcugucaggaacucuu

SEQ ID NO: 188286 - RNA, 22 nt, Human
uuuaaucaguugguaauauuga

SEQ ID NO: 188287 - RNA, 22 nt, Human
cuuucuuuuugguuucccccca

SEQ ID NO: 188288 - RNA, 22 nt, Human
aucuuuguaaguaaucaaagcu

SEQ ID NO: 188289 - RNA, 23 nt, Human
cagagaaaauagaauaugcugug

SEQ ID NO: 188290 - RNA, 21 nt, Human
uaagcuaaacauucaguuaac

SEQ ID NO: 188291 - RNA, 22 nt, Human
agugccaucuuuaacuguccca

SEQ ID NO: 188292 - RNA, 22 nt, Human
agggcugggcuuggcaggcugg

SEQ ID NO: 188293 - RNA, 22 nt, Human
gcaggaagauugcagaaggcug

SEQ ID NO: 188294 - RNA, 22 nt, Human
cuaaaccaauauauuuucuucc

SEQ ID NO: 188295 - RNA, 22 nt, Human
ucuccuuuacuggcuccuuuug

SEQ ID NO: 188296 - RNA, 22 nt, Human
uaguucugaauagcauugaaga

SEQ ID NO: 188297 - RNA, 22 nt, Human
auguguguaugacugaaucuau

SEQ ID NO: 188298 - RNA, 22 nt, Human
ggccugcuaccagcugugaccu

SEQ ID NO: 188299 - RNA, 22 nt, Human
ggugucuuugauguugggcuga

SEQ ID NO: 188300 - RNA, 22 nt, Human
aucguuaugauagagaaagaga

SEQ ID NO: 188301 - RNA, 22 nt, Human
uggggcuggccaggaggagucu

SEQ ID NO: 188302 - RNA, 22 nt, Human
uugucaggaacuaugauuaugc

SEQ ID NO: 188303 - RNA, 22 nt, Human
uucccugugcaguauguuccaa

SEQ ID NO: 188304 - RNA, 22 nt, Human
auccuccuuugcccugagauca

SEQ ID NO: 188305 - RNA, 22 nt, Human
auuuuuauuugccuaugauaua

SEQ ID NO: 188306 - RNA, 22 nt, Human
aggggaggggaguaucaggauu

SEQ ID NO: 188307 - RNA, 22 nt, Human
auuuuagagaaacaaacguagg

SEQ ID NO: 188308 - RNA, 22 nt, Human
uuauuucaggcauuuguaaaug

SEQ ID NO: 188309 - RNA, 22 nt, Human
ccagggcuggaccagugcuugg

SEQ ID NO: 188310 - RNA, 22 nt, Human
uucauaugaauuggguuuuuuu

SEQ ID NO: 188311 - RNA, 23 nt, Human
aggcugcagaagaauagggucau

SEQ ID NO: 188312 - RNA, 22 nt, Human
acugcagauccucugagaaacc

SEQ ID NO: 188313 - RNA, 22 nt, Human
ugugccuguugguguagacaua

SEQ ID NO: 188314 - RNA, 22 nt, Human
ccuuuccucuucaugacuuucu

SEQ ID NO: 188315 - RNA, 22 nt, Human
gacacugccaagugccccgaga

SEQ ID NO: 188316 - RNA, 22 nt, Human
agauuuucuuuuccaucuuugu

SEQ ID NO: 188317 - RNA, 22 nt, Human
uggggagacauggaguaaaaga

SEQ ID NO: 188318 - RNA, 22 nt, Human
uaguauuuguaauuaucaaagc

SEQ ID NO: 188319 - RNA, 22 nt, Human
uccucaaauccuagccucaucg

SEQ ID NO: 188320 - RNA, 22 nt, Human
ugccagcuccgaggagcugcag

SEQ ID NO: 188321 - RNA, 22 nt, Human
augaggaacagcaagaauauuu

SEQ ID NO: 188322 - RNA, 22 nt, Human
uuuaucaggccaucuuaugucu

SEQ ID NO: 188323 - RNA, 22 nt, Human
agcugugaccuucaagagcuac

SEQ ID NO: 188324 - RNA, 22 nt, Human
cugucucugauaagcucgaggg

SEQ ID NO: 188325 - RNA, 20 nt, Human
uaguggaccuugaaggccuc

SEQ ID NO: 188326 - RNA, 22 nt, Human
gccugccucugacuggggcuga

SEQ ID NO: 188327 - RNA, 22 nt, Human
ccuccuuuccuguuuuccugag

SEQ ID NO: 188328 - RNA, 22 nt, Human
uguccuuucagagcuccuuuug

SEQ ID NO: 188329 - RNA, 22 nt, Human
cucucugcugucuuucgggaaa

SEQ ID NO: 188330 - RNA, 21 nt, Human
aggugaaggcgagggggacag

SEQ ID NO: 188331 - RNA, 22 nt, Human
cuccagcucgcgagcucugcuc

SEQ ID NO: 188332 - RNA, 22 nt, Human
uuucuaaaauuacugcagucgg

SEQ ID NO: 188333 - RNA, 22 nt, Human
agggagucuggccgucggcugg

SEQ ID NO: 188334 - RNA, 22 nt, Human
accuccauggcccacaucuagu

SEQ ID NO: 188335 - RNA, 22 nt, Human
ugucccaucacagaggagacua

SEQ ID NO: 188336 - RNA, 22 nt, Human
cugcccgcaugcaggaaugcug

SEQ ID NO: 188337 - RNA, 22 nt, Human
aaauguauuagccuaugugaga

SEQ ID NO: 188338 - RNA, 22 nt, Human
aggggaggcugcgggcugccgu

SEQ ID NO: 188339 - RNA, 22 nt, Human
aagagaaaugcuuuaacuuuau

SEQ ID NO: 188340 - RNA, 22 nt, Human
cauaggcucuucagagaacuga

SEQ ID NO: 188341 - RNA, 22 nt, Human
ugucuuuuaaaaauguguaaaa

SEQ ID NO: 188342 - RNA, 22 nt, Human
gugaaauuguacacucaguacc

SEQ ID NO: 188343 - RNA, 22 nt, Human
cacugguugccucuuucuguuc

SEQ ID NO: 188344 - RNA, 22 nt, Human
uucuauaagagaugaauacagu

SEQ ID NO: 188345 - RNA, 22 nt, Human
gaggcucagagggacuuucaag

SEQ ID NO: 188346 - RNA, 22 nt, Human
cgguuuuuaaaagucucuucua

SEQ ID NO: 188347 - RNA, 22 nt, Human
uauauacacgcacauauacaua

SEQ ID NO: 188348 - RNA, 22 nt, Human
aggguggaggacaggccaguga

SEQ ID NO: 188349 - RNA, 22 nt, Human
guuauuuugucuuguucaugaa

SEQ ID NO: 188350 - RNA, 22 nt, Human
uucucugcgcuccggcccaguu

SEQ ID NO: 188351 - RNA, 22 nt, Human
gcuguguaugaugcaggcaccu

SEQ ID NO: 188352 - RNA, 22 nt, Human
ccuaggcuggcugucuucaggu

SEQ ID NO: 188353 - RNA, 22 nt, Human
auguacugacuguacuuuuaaa

SEQ ID NO: 188354 - RNA, 22 nt, Human
augaaaacggaccagagcuauu

SEQ ID NO: 188355 - RNA, 22 nt, Human
uuccuuuucuucuaccacaugu

SEQ ID NO: 188356 - RNA, 22 nt, Human
ugcccacuucaaaaucuucauu

SEQ ID NO: 188357 - RNA, 22 nt, Human
uuuuuaaaauuaggacggcacg

SEQ ID NO: 188358 - RNA, 22 nt, Human
agagcuccaggguuuuguagug

SEQ ID NO: 188359 - RNA, 22 nt, Human
agagaacaggcagcuggugccg

SEQ ID NO: 188360 - RNA, 22 nt, Human
aguaaaugaaagcaauuuuaga

SEQ ID NO: 188361 - RNA, 22 nt, Human
gcagggcucagccgcucccacc

SEQ ID NO: 188362 - RNA, 20 nt, Human
auucuuguuccauuucccag

SEQ ID NO: 188363 - RNA, 22 nt, Human
uuccuaauugccaugaaguuau

SEQ ID NO: 188364 - RNA, 22 nt, Human
uuguuauaggaucagugucacu

SEQ ID NO: 188365 - RNA, 22 nt, Human
cucagcgagggaaagaggccgc

SEQ ID NO: 188366 - RNA, 22 nt, Human
guggaaggaauuaacagacuag

SEQ ID NO: 188367 - RNA, 22 nt, Human
cacaugugugugccuacaugca

SEQ ID NO: 188368 - RNA, 22 nt, Human
aguuugauuugucuaucuucau

SEQ ID NO: 188369 - RNA, 22 nt, Human
gagugaucuguaggcagcaugg

SEQ ID NO: 188370 - RNA, 22 nt, Human
cuucagagugacucagcaucuu

SEQ ID NO: 188371 - RNA, 22 nt, Human
gaaaagcucuuuagaagagguu

SEQ ID NO: 188372 - RNA, 22 nt, Human
acuauauaaugcacacaguaua

SEQ ID NO: 188373 - RNA, 22 nt, Human
cacacagcuagugacaggagaa

SEQ ID NO: 188374 - RNA, 22 nt, Human
uuuaacauaugaaagaauauuu

SEQ ID NO: 188375 - RNA, 22 nt, Human
uuuguuuuggugucaugcguga

SEQ ID NO: 188376 - RNA, 22 nt, Human
uggagccugauggauaggaacg

SEQ ID NO: 188377 - RNA, 22 nt, Human
ccucuccuugcuccccuuccuu

SEQ ID NO: 188378 - RNA, 19 nt, Human
agagucuccacuccacuug

SEQ ID NO: 188379 - RNA, 22 nt, Human
uucuucuguuggcagagcauac

SEQ ID NO: 188380 - RNA, 22 nt, Human
cggggcuggcguuagggaggca

SEQ ID NO: 188381 - RNA, 20 nt, Human
gccaaggaggagaaacaggc

SEQ ID NO: 188382 - RNA, 17 nt, Human
auucaugaacauguccu

SEQ ID NO: 188383 - RNA, 22 nt, Human
gauuucuucauuuaaaaauauu

SEQ ID NO: 188384 - RNA, 22 nt, Human
cagagccagcuguccuuggcau

SEQ ID NO: 188385 - RNA, 22 nt, Human
gcagaggcugccgugggcagga

SEQ ID NO: 188386 - RNA, 20 nt, Human
ccugggcuccaggagccccg

SEQ ID NO: 188387 - RNA, 22 nt, Human
cugguuuauuucauaguuuguu

SEQ ID NO: 188388 - RNA, 22 nt, Human
uuaccuuggaccggguaucaga

SEQ ID NO: 188389 - RNA, 22 nt, Human
ugguuuuuuguaggauaaacau

SEQ ID NO: 188390 - RNA, 20 nt, Human
gggaauggauggauugcucc

SEQ ID NO: 188391 - RNA, 22 nt, Human
cguggccacaguggagcugagc

SEQ ID NO: 188392 - RNA, 22 nt, Human
uguauaaaauggaaugucagaa

SEQ ID NO: 188393 - RNA, 22 nt, Human
ugggggaggaggagacagacug

SEQ ID NO: 188394 - RNA, 22 nt, Human
acauuccugaagguaaugagaa

SEQ ID NO: 188395 - RNA, 22 nt, Human
gcagguggaagcagcagacuca

SEQ ID NO: 188396 - RNA, 22 nt, Human
agaacauaucuguuuucuaacu

SEQ ID NO: 188397 - RNA, 21 nt, Human
gggagaguagcgguagggagg

SEQ ID NO: 188398 - RNA, 22 nt, Human
ccauuuggccauucaguuguuc

SEQ ID NO: 188399 - RNA, 22 nt, Human
uauauauacauauagaauaugu

SEQ ID NO: 188400 - RNA, 22 nt, Human
uggaggcccagcugggggccgg

SEQ ID NO: 188401 - RNA, 22 nt, Human
ucagucucuggggcuucuguuu

SEQ ID NO: 188402 - RNA, 22 nt, Human
uuauuuuauaaagagaagacuu

SEQ ID NO: 188403 - RNA, 22 nt, Human
auguguuuugaccccugcuaaa

SEQ ID NO: 188404 - RNA, 22 nt, Human
cugaccucuaaguaacagagaa

SEQ ID NO: 188405 - RNA, 22 nt, Human
ccagaugggggcugugggaggg

SEQ ID NO: 188406 - RNA, 19 nt, Human
agugaacuccauaucaggu

SEQ ID NO: 188407 - RNA, 22 nt, Human
gggcugagagcuggaaucugag

SEQ ID NO: 188408 - RNA, 22 nt, Human
agcuugagauaauucaagcuga

SEQ ID NO: 188409 - RNA, 22 nt, Human
ggggaggguuuggaugagaguc

SEQ ID NO: 188410 - RNA, 23 nt, Human
gugugccuuuaucuucuguacuc

SEQ ID NO: 188411 - RNA, 22 nt, Human
auauucaaugaggucauauaag

SEQ ID NO: 188412 - RNA, 22 nt, Human
gguuuucacgauccucccuuuu

SEQ ID NO: 188413 - RNA, 22 nt, Human
auuuccagcagcauauuugucu

SEQ ID NO: 188414 - RNA, 22 nt, Human
uaguuccucuucucagggccau

SEQ ID NO: 188415 - RNA, 21 nt, Human
acuuccacaucacugaguaga

SEQ ID NO: 188416 - RNA, 19 nt, Human
ucagcagauuuugcaaaca

SEQ ID NO: 188417 - RNA, 22 nt, Human
uuauuuuuguaacacuguauag

SEQ ID NO: 188418 - RNA, 22 nt, Human
auguuuucuugucuggagaagu

SEQ ID NO: 188419 - RNA, 22 nt, Human
gugcugggaggcccaggaugga

SEQ ID NO: 188420 - RNA, 22 nt, Human
cacaugugggcacagggcugca

SEQ ID NO: 188421 - RNA, 22 nt, Human
auuuuuagucuugcugcaauca

SEQ ID NO: 188422 - RNA, 22 nt, Human
uuucuaaaaccagaguuuauaa

SEQ ID NO: 188423 - RNA, 22 nt, Human
uccauuuacuauucucauaucg

SEQ ID NO: 188424 - RNA, 22 nt, Human
agugaggggagaaugaggugga

SEQ ID NO: 188425 - RNA, 22 nt, Human
aggauagacuucagaaggcaua

SEQ ID NO: 188426 - RNA, 22 nt, Human
ucucugaggaagcgaucuuuag

SEQ ID NO: 188427 - RNA, 22 nt, Human
aguauuuuaaaauacauuaucc

SEQ ID NO: 188428 - RNA, 22 nt, Human
ucucugaccuccaccccaggag

SEQ ID NO: 188429 - RNA, 22 nt, Human
uccaaggacucuugucagcugu

SEQ ID NO: 188430 - RNA, 22 nt, Human
uucuagcucauggugacagauc

SEQ ID NO: 188431 - RNA, 22 nt, Human
ccaggcuccccaggaggcccuu

SEQ ID NO: 188432 - RNA, 22 nt, Human
gcuucuguuaggauguggcuua

SEQ ID NO: 188433 - RNA, 20 nt, Human
agcauucaacuuucuauguu

SEQ ID NO: 188434 - RNA, 22 nt, Human
ugaauucaaacuuuuuaacaag

SEQ ID NO: 188435 - RNA, 19 nt, Human
cagagacuguaacacuuuu

SEQ ID NO: 188436 - RNA, 22 nt, Human
uaaaacuaugcaaccuacuacc

SEQ ID NO: 188437 - RNA, 22 nt, Human
uguuuucuauuaccugagauug

SEQ ID NO: 188438 - RNA, 22 nt, Human
gauuccuuucgccugccgagcu

SEQ ID NO: 188439 - RNA, 22 nt, Human
uaguuucuaauguugaaauuau

SEQ ID NO: 188440 - RNA, 22 nt, Human
agggcaguuuuacugaaaggug

SEQ ID NO: 188441 - RNA, 22 nt, Human
gcuuccuuagcuuaccaaguau

SEQ ID NO: 188442 - RNA, 22 nt, Human
ucuuucugaugggaagggucaa

SEQ ID NO: 188443 - RNA, 22 nt, Human
cuuucuuucaaguucugcuuua

SEQ ID NO: 188444 - RNA, 22 nt, Human
gcagagcugucuaagucacuuc

SEQ ID NO: 188445 - RNA, 22 nt, Human
gaaggaaaagacgugcuaagua

SEQ ID NO: 188446 - RNA, 22 nt, Human
uucaaaaugcagaauaguuugg

SEQ ID NO: 188447 - RNA, 20 nt, Human
ugcugugugucuacuguggg

SEQ ID NO: 188448 - RNA, 19 nt, Human
aggaaggggauaaguaaca

SEQ ID NO: 188449 - RNA, 22 nt, Human
aaugaauaaauuuuaaagacag

SEQ ID NO: 188450 - RNA, 22 nt, Human
uuccacauucggaauuuucuga

SEQ ID NO: 188451 - RNA, 21 nt, Human
uaaaagaugacaagacagcuc

SEQ ID NO: 188452 - RNA, 22 nt, Human
uauuaauugugguuauuguauu

SEQ ID NO: 188453 - RNA, 22 nt, Human
aucacuagaguuacauugccag

SEQ ID NO: 188454 - RNA, 22 nt, Human
ucucucugcuguccagcguuau

SEQ ID NO: 188455 - RNA, 20 nt, Human
uucacagaggacucagguca

SEQ ID NO: 188456 - RNA, 22 nt, Human
aggcaguguguagcuggaagag

SEQ ID NO: 188457 - RNA, 22 nt, Human
gagcagcucgagaaggaagcag

SEQ ID NO: 188458 - RNA, 22 nt, Human
aaacucaucaguuuagaaaccu

SEQ ID NO: 188459 - RNA, 22 nt, Human
ucacaucugugugauugucauu

SEQ ID NO: 188460 - RNA, 22 nt, Human
uuuucaauuuucauuugcaaga

SEQ ID NO: 188461 - RNA, 17 nt, Human
ccacuagauagguugug

SEQ ID NO: 188462 - RNA, 20 nt, Human
aauagcacagcucaaacauu

SEQ ID NO: 188463 - RNA, 22 nt, Human
guauauuuaugagcauuagccu

SEQ ID NO: 188464 - RNA, 22 nt, Human
cuucucugcugccugccucuuu

SEQ ID NO: 188465 - RNA, 22 nt, Human
aguuuucugccucuggaugcgu

SEQ ID NO: 188466 - RNA, 22 nt, Human
ugugugcuaguuuugucaguau

SEQ ID NO: 188467 - RNA, 22 nt, Human
cuuuuuaaaguaaauggcuaga

SEQ ID NO: 188468 - RNA, 22 nt, Human
aagagaggcccaaguggcuggc

SEQ ID NO: 188469 - RNA, 22 nt, Human
gggcaggggcagugguggcauu

SEQ ID NO: 188470 - RNA, 22 nt, Human
cagcccugagagaaccaucuau

SEQ ID NO: 188471 - RNA, 22 nt, Human
uuauuugcccauguuuagcaga

SEQ ID NO: 188472 - RNA, 22 nt, Human
uucucuugccuucucuuuuauc

SEQ ID NO: 188473 - RNA, 22 nt, Human
agcugaggccccgcagcagggu

SEQ ID NO: 188474 - RNA, 22 nt, Human
aaaggaaacuaugaaucucugg

SEQ ID NO: 188475 - RNA, 22 nt, Human
uaaggaaaugcaaauuuaagaa

SEQ ID NO: 188476 - RNA, 22 nt, Human
auuuuguugaaacccuuguugu

SEQ ID NO: 188477 - RNA, 22 nt, Human
auggaggugagccccccauccu

SEQ ID NO: 188478 - RNA, 22 nt, Human
acuuccuuccagcaaauggcau

SEQ ID NO: 188479 - RNA, 22 nt, Human
uuugcaggaaauguacugaaug

SEQ ID NO: 188480 - RNA, 21 nt, Human
cuauaaaaaugguucuuugcg

SEQ ID NO: 188481 - RNA, 22 nt, Human
uuuuuaaaagaugauuuaauga

SEQ ID NO: 188482 - RNA, 22 nt, Human
uggcucagcgcggccuggucuu

SEQ ID NO: 188483 - RNA, 22 nt, Human
uuuuuauaagauuuaaaaugua

SEQ ID NO: 188484 - RNA, 22 nt, Human
gaggcaggaagggaggguugug

SEQ ID NO: 188485 - RNA, 22 nt, Human
aaauuuuguugaaaaauauuuu

SEQ ID NO: 188486 - RNA, 22 nt, Human
aaaaggaacaauaugguauuuu

SEQ ID NO: 188487 - RNA, 22 nt, Human
cagggacugcaggaggacaggu

SEQ ID NO: 188488 - RNA, 22 nt, Human
uuuucauuguuaguuucuccuu

SEQ ID NO: 188489 - RNA, 22 nt, Human
gggcagagagcuggaacuccuu

SEQ ID NO: 188490 - RNA, 23 nt, Human
caggggacaggugaccugggcuc

SEQ ID NO: 188491 - RNA, 22 nt, Human
aaaugcuuuaauugaguucaug

SEQ ID NO: 188492 - RNA, 22 nt, Human
ggcuagggagacagagggcaug

SEQ ID NO: 188493 - RNA, 22 nt, Human
ggagugaguauguucugaugca

SEQ ID NO: 188494 - RNA, 22 nt, Human
ggcagagguagcuggaaccagg

SEQ ID NO: 188495 - RNA, 22 nt, Human
gaggcuugccacuguccauggc

SEQ ID NO: 188496 - RNA, 22 nt, Human
cuguucuccacuccugacuucu

SEQ ID NO: 188497 - RNA, 22 nt, Human
auagaaauagacaaugcaaaga

SEQ ID NO: 188498 - RNA, 19 nt, Human
ccacacacuggucucuggg

SEQ ID NO: 188499 - RNA, 22 nt, Human
guuaaaaugauuugugauuuau

SEQ ID NO: 188500 - RNA, 22 nt, Human
uuuuaaaguaauugaagcuugu

SEQ ID NO: 188501 - RNA, 22 nt, Human
agagcaucgguggaguccccac

SEQ ID NO: 188502 - RNA, 21 nt, Human
uccugccuuaguccagagcag

SEQ ID NO: 188503 - RNA, 22 nt, Human
caguagcuuuuugcagacaaga

SEQ ID NO: 188504 - RNA, 22 nt, Human
cucugugucugauucugggaag

SEQ ID NO: 188505 - RNA, 22 nt, Human
ucacuuccuugcagcuguagaa

SEQ ID NO: 188506 - RNA, 22 nt, Human
aagugaaaaaagucaguacuga

SEQ ID NO: 188507 - RNA, 22 nt, Human
aucuucaaagcacaucguuugu

SEQ ID NO: 188508 - RNA, 22 nt, Human
cacacaccagaaagccugggac

SEQ ID NO: 188509 - RNA, 22 nt, Human
aaacccaggguuuugucuuccc

SEQ ID NO: 188510 - RNA, 22 nt, Human
guaauucugugugaaucuauua

SEQ ID NO: 188511 - RNA, 22 nt, Human
auagcacuuaauaugaaacagu

SEQ ID NO: 188512 - RNA, 22 nt, Human
auuuuuuuuccugucucuuuca

SEQ ID NO: 188513 - RNA, 22 nt, Human
cagcccuugcgacacccuggcu

SEQ ID NO: 188514 - RNA, 22 nt, Human
cagggggacuuguuagguuuua

SEQ ID NO: 188515 - RNA, 22 nt, Human
caccucagagcuccuucuucuc

SEQ ID NO: 188516 - RNA, 22 nt, Human
uccucccugcacucagugaagu

SEQ ID NO: 188517 - RNA, 22 nt, Human
guuuguuugccagcuuaguaaa

SEQ ID NO: 188518 - RNA, 22 nt, Human
uaguuucuucaacugucccagc

SEQ ID NO: 188519 - RNA, 22 nt, Human
ugcagcuuuugguuucuagaug

SEQ ID NO: 188520 - RNA, 22 nt, Human
caguggacacuuccucuacaau

SEQ ID NO: 188521 - RNA, 22 nt, Human
agucaccuacagcucaugcuuc

SEQ ID NO: 188522 - RNA, 22 nt, Human
uaaaaucaugacagauugacau

SEQ ID NO: 188523 - RNA, 22 nt, Human
gcuggggaucgaaggcagagcc

SEQ ID NO: 188524 - RNA, 22 nt, Human
ucacucuuuaucuuuuaugucu

SEQ ID NO: 188525 - RNA, 22 nt, Human
uuuuacauuuuauucguuuauu

SEQ ID NO: 188526 - RNA, 22 nt, Human
cugcagagaccuaggucagguu

SEQ ID NO: 188527 - RNA, 22 nt, Human
cauaaucaagggguugugaugu

SEQ ID NO: 188528 - RNA, 22 nt, Human
ucuuccuuacucuggauguuau

SEQ ID NO: 188529 - RNA, 22 nt, Human
cguuuugaguagauagccauau

SEQ ID NO: 188530 - RNA, 22 nt, Human
uccuuguuggaauauccuuacc

SEQ ID NO: 188531 - RNA, 22 nt, Human
aacccugaacuuaguucuagga

SEQ ID NO: 188532 - RNA, 20 nt, Human
ugauuauuccaacaagaaug

SEQ ID NO: 188533 - RNA, 21 nt, Human
gggagugaguaaugauggggg

SEQ ID NO: 188534 - RNA, 21 nt, Human
acauccaggguccucacugcc

SEQ ID NO: 188535 - RNA, 22 nt, Human
ucuugccuuuucuagcuucuag

SEQ ID NO: 188536 - RNA, 22 nt, Human
uugcuuucuuuguagguuuucc

SEQ ID NO: 188537 - RNA, 22 nt, Human
ggggcaucguugauugcauggu

SEQ ID NO: 188538 - RNA, 22 nt, Human
ugagggaguguggauacaguag

SEQ ID NO: 188539 - RNA, 22 nt, Human
ccagggcuggaggaggucagga

SEQ ID NO: 188540 - RNA, 22 nt, Human
augcggcugugggggaauggga

SEQ ID NO: 188541 - RNA, 22 nt, Human
cagcucugcugggaggaugcag

SEQ ID NO: 188542 - RNA, 22 nt, Human
cauccagcuccugggggccacc

SEQ ID NO: 188543 - RNA, 22 nt, Human
uucauuagcacauuuccuuggu

SEQ ID NO: 188544 - RNA, 22 nt, Human
caauaccucuuggugauugggc

SEQ ID NO: 188545 - RNA, 22 nt, Human
guucuacaugacacucaacauu

SEQ ID NO: 188546 - RNA, 22 nt, Human
ucuucaucucuaaaaugggaac

SEQ ID NO: 188547 - RNA, 22 nt, Human
caaaacauucagagagcucacu

SEQ ID NO: 188548 - RNA, 22 nt, Human
gcugcuacagagcuggaggggg

SEQ ID NO: 188549 - RNA, 19 nt, Human
agcuccucaccucucgcgg

SEQ ID NO: 188550 - RNA, 22 nt, Human
cuccucccagcccaggcgccac

SEQ ID NO: 188551 - RNA, 22 nt, Human
aaauguuucauucuauuuuuag

SEQ ID NO: 188552 - RNA, 22 nt, Human
gcacccagggcaggaagugagg

SEQ ID NO: 188553 - RNA, 22 nt, Human
uuaacauuguccuuagcagauu

SEQ ID NO: 188554 - RNA, 22 nt, Human
gcccugucagcucucauggaca

SEQ ID NO: 188555 - RNA, 22 nt, Human
aagcugccugggaggaagggcu

SEQ ID NO: 188556 - RNA, 22 nt, Human
gaggggaaggauuucuucagaa

SEQ ID NO: 188557 - RNA, 22 nt, Human
cauggcaggugcagauucugug

SEQ ID NO: 188558 - RNA, 22 nt, Human
cuuggggauuuuaaagaccucu

SEQ ID NO: 188559 - RNA, 22 nt, Human
auucuucauguugaagcuguca

SEQ ID NO: 188560 - RNA, 22 nt, Human
uugaaaauuaauagguguacaa

SEQ ID NO: 188561 - RNA, 22 nt, Human
uuuuauuuguauguugaaugua

SEQ ID NO: 188562 - RNA, 22 nt, Human
agacacagcaauaacuacuguu

SEQ ID NO: 188563 - RNA, 22 nt, Human
aagugauuuucccaccaucuac

SEQ ID NO: 188564 - RNA, 22 nt, Human
aauguaaauaauuguaaaauuu

SEQ ID NO: 188565 - RNA, 22 nt, Human
ggagaggaaguuuaaagaauug

SEQ ID NO: 188566 - RNA, 19 nt, Human
uccuacaugagacagagag

SEQ ID NO: 188567 - RNA, 22 nt, Human
uagcuucccagcuaaccauguc

SEQ ID NO: 188568 - RNA, 22 nt, Human
uuuguuugcugagugaauucaa

SEQ ID NO: 188569 - RNA, 22 nt, Human
uuuuaaaagguugcuguuauaa

SEQ ID NO: 188570 - RNA, 22 nt, Human
gauuuuaaaagauguauaaggu

SEQ ID NO: 188571 - RNA, 22 nt, Human
cacauuaagcccaagcauagaa

SEQ ID NO: 188572 - RNA, 22 nt, Human
cauuccaagaaguaguucugca

SEQ ID NO: 188573 - RNA, 22 nt, Human
cacauuuuccagaagaaucaga

SEQ ID NO: 188574 - RNA, 22 nt, Human
cacugcaaccuccaccucccgg

SEQ ID NO: 188575 - RNA, 22 nt, Human
aaaauauucuauaucaaagaua

SEQ ID NO: 188576 - RNA, 22 nt, Human
ggcucccccauggcugacagac

SEQ ID NO: 188577 - RNA, 22 nt, Human
ggagagcuagugagcuggaggu

SEQ ID NO: 188578 - RNA, 22 nt, Human
uuuccuucccuccugggccuuc

SEQ ID NO: 188579 - RNA, 22 nt, Human
uuuuccuuccugucucuuuauu

SEQ ID NO: 188580 - RNA, 22 nt, Human
ucuggcaguugccgcuucaguc

SEQ ID NO: 188581 - RNA, 22 nt, Human
gugucccaaagauuagaaauca

SEQ ID NO: 188582 - RNA, 22 nt, Human
agggcaguuaugaaugucucca

SEQ ID NO: 188583 - RNA, 22 nt, Human
uuacuuaucugaugugauuuuu

SEQ ID NO: 188584 - RNA, 22 nt, Human
gcucagagaugucugcugccuu

SEQ ID NO: 188585 - RNA, 22 nt, Human
gggggcugugugcccgcucccc

SEQ ID NO: 188586 - RNA, 22 nt, Human
aguuauuuuucacuauuaggcu

SEQ ID NO: 188587 - RNA, 22 nt, Human
gcacaaaagguacuucauguag

SEQ ID NO: 188588 - RNA, 22 nt, Human
uggcaagcuguuggcagauagc

SEQ ID NO: 188589 - RNA, 22 nt, Human
agccccaauuacagcugugcug

SEQ ID NO: 188590 - RNA, 22 nt, Human
gucuccuucauuuacuguuucc

SEQ ID NO: 188591 - RNA, 22 nt, Human
ggcaaggaagaaagcagaaguu

SEQ ID NO: 188592 - RNA, 22 nt, Human
ucccaaguguuuggcgaggaga

SEQ ID NO: 188593 - RNA, 22 nt, Human
uggggggacagauggagaggac

SEQ ID NO: 188594 - RNA, 22 nt, Human
agagacuguaaugagagguaca

SEQ ID NO: 188595 - RNA, 22 nt, Human
cacacgagcccuggagccagca

SEQ ID NO: 188596 - RNA, 22 nt, Human
cuguggcuaggaagcuguggga

SEQ ID NO: 188597 - RNA, 22 nt, Human
auauauguauauaugugugugu

SEQ ID NO: 188598 - RNA, 22 nt, Human
ucucuagaggaauuguucuagg

SEQ ID NO: 188599 - RNA, 22 nt, Human
auaguaaauguuaacagcaaca

SEQ ID NO: 188600 - RNA, 22 nt, Human
uauuuuauuuagguuuaguugu

SEQ ID NO: 188601 - RNA, 18 nt, Human
acaaaaauagugcuuugg

SEQ ID NO: 188602 - RNA, 22 nt, Human
uuuuucuccucucucuuucauu

SEQ ID NO: 188603 - RNA, 22 nt, Human
uauauaauacacaaauauguac

SEQ ID NO: 188604 - RNA, 22 nt, Human
uugguuuacucuggggauaucu

SEQ ID NO: 188605 - RNA, 22 nt, Human
uauuuuuaccuaauuuaugaga

SEQ ID NO: 188606 - RNA, 22 nt, Human
gcugucccccaaagaugcuccu

SEQ ID NO: 188607 - RNA, 22 nt, Human
ucacccagacugucugacucuu

SEQ ID NO: 188608 - RNA, 22 nt, Human
cggggcucugcacaggccagga

SEQ ID NO: 188609 - RNA, 23 nt, Human
aaggugaagccaccaggugagga

SEQ ID NO: 188610 - RNA, 20 nt, Human
uucacagaucucuaacugag

SEQ ID NO: 188611 - RNA, 22 nt, Human
uucaaacaguguagaauauaug

SEQ ID NO: 188612 - RNA, 22 nt, Human
auuuuuuuggucauaugagaua

SEQ ID NO: 188613 - RNA, 22 nt, Human
cuguguguauaauguuugauaa

SEQ ID NO: 188614 - RNA, 22 nt, Human
aaugaaaaucugucaguucaag

SEQ ID NO: 188615 - RNA, 22 nt, Human
auucuguaggcuuuuguuaaaa

SEQ ID NO: 188616 - RNA, 19 nt, Human
ggaggguguccucaguguc

SEQ ID NO: 188617 - RNA, 22 nt, Human
guuuuauguuuuauagacacaa

SEQ ID NO: 188618 - RNA, 22 nt, Human
aaaucauagccaugaacauuug

SEQ ID NO: 188619 - RNA, 22 nt, Human
aaaaacuuaccccagggcaagg

SEQ ID NO: 188620 - RNA, 22 nt, Human
ugaaauuuuuuggagauaauuu

SEQ ID NO: 188621 - RNA, 22 nt, Human
ucaccaugcccuucucugcucu

SEQ ID NO: 188622 - RNA, 22 nt, Human
aagagaaaaaucuuaaucuagu

SEQ ID NO: 188623 - RNA, 20 nt, Human
gacaugagggagcaaagagc

SEQ ID NO: 188624 - RNA, 22 nt, Human
uuauuuuuaggaauguagaggu

SEQ ID NO: 188625 - RNA, 22 nt, Human
auguucucagguuguauuuauu

SEQ ID NO: 188626 - RNA, 22 nt, Human
uucuucgacuguauaaaaguau

SEQ ID NO: 188627 - RNA, 22 nt, Human
uccaggagucagacagauggug

SEQ ID NO: 188628 - RNA, 22 nt, Human
uuuguacuuucuaauguauuua

SEQ ID NO: 188629 - RNA, 22 nt, Human
cucuugugucaccauggauaaa

SEQ ID NO: 188630 - RNA, 22 nt, Human
uguuggaaucuucuagucuucc

SEQ ID NO: 188631 - RNA, 22 nt, Human
gucugcagcacugugcacgguc

SEQ ID NO: 188632 - RNA, 22 nt, Human
ugccuucugccaaggacggugc

SEQ ID NO: 188633 - RNA, 19 nt, Human
ccaguuuuuuaauauucaa

SEQ ID NO: 188634 - RNA, 22 nt, Human
uggggcauacgugaaauaauuu

SEQ ID NO: 188635 - RNA, 22 nt, Human
uucugcuagugguauauguuga

SEQ ID NO: 188636 - RNA, 22 nt, Human
uucacuuuuucucugcuugaga

SEQ ID NO: 188637 - RNA, 22 nt, Human
uuuucacugacuuggucuggaa

SEQ ID NO: 188638 - RNA, 18 nt, Human
aggcuggggaucacaggg

SEQ ID NO: 188639 - RNA, 22 nt, Human
accuggcccugggucuccugac

SEQ ID NO: 188640 - RNA, 22 nt, Human
uggagagcaaugaggggcaggc

SEQ ID NO: 188641 - RNA, 20 nt, Human
gggcucugcauccaucagcc

SEQ ID NO: 188642 - RNA, 17 nt, Human
ugguucuuuuccugacc

SEQ ID NO: 188643 - RNA, 22 nt, Human
cuguggcugcgcccugggggag

SEQ ID NO: 188644 - RNA, 20 nt, Human
ccuuguggaugucuuuuuug

SEQ ID NO: 188645 - RNA, 22 nt, Human
uguguuguuggggauguuuuca

SEQ ID NO: 188646 - RNA, 22 nt, Human
uuuuuuccuguuugucuuuggg

SEQ ID NO: 188647 - RNA, 22 nt, Human
aagcugcagacccccugucuca

SEQ ID NO: 188648 - RNA, 22 nt, Human
uuuugcuucuaguauauuuuuu

SEQ ID NO: 188649 - RNA, 20 nt, Human
cuccuccccucggccccacc

SEQ ID NO: 188650 - RNA, 20 nt, Human
uuccuuucuuucuuuuuuuu

SEQ ID NO: 188651 - RNA, 22 nt, Human
auuaaauagcagaagaaagaug

SEQ ID NO: 188652 - RNA, 22 nt, Human
aauuaaauguuugguuugagcu

SEQ ID NO: 188653 - RNA, 22 nt, Human
gugaucagaagaaccugccgaa

SEQ ID NO: 188654 - RNA, 22 nt, Human
uggccccauuuuucuggagccu

SEQ ID NO: 188655 - RNA, 22 nt, Human
gggggacagugugccuggugug

SEQ ID NO: 188656 - RNA, 22 nt, Human
uggaugccuugggggaggagga

SEQ ID NO: 188657 - RNA, 22 nt, Human
ccaaccaguuucuuggcuuuag

SEQ ID NO: 188658 - RNA, 21 nt, Human
aaguuuuggcuguacaguugu

SEQ ID NO: 188659 - RNA, 22 nt, Human
guuguuuucagcccagcauuag

SEQ ID NO: 188660 - RNA, 20 nt, Human
agucuucaggugugaggauu

SEQ ID NO: 188661 - RNA, 22 nt, Human
guucuguauauauccuagcaaa

SEQ ID NO: 188662 - RNA, 22 nt, Human
acucacuguuuugaaauugaac

SEQ ID NO: 188663 - RNA, 22 nt, Human
agguggucccaauggcugggca

SEQ ID NO: 188664 - RNA, 17 nt, Human
auuguuuuuaauuugca

SEQ ID NO: 188665 - RNA, 22 nt, Human
gcagggcucuggagucaggcug

SEQ ID NO: 188666 - RNA, 22 nt, Human
aggaaauaggaccagacaaagc

SEQ ID NO: 188667 - RNA, 22 nt, Human
uguacauacauagauauacaca

SEQ ID NO: 188668 - RNA, 22 nt, Human
ggcuccagauguccccuggcaa

SEQ ID NO: 188669 - RNA, 21 nt, Human
uccccugugccuggcauacag

SEQ ID NO: 188670 - RNA, 20 nt, Human
aggggcuguaguuagaugac

SEQ ID NO: 188671 - RNA, 22 nt, Human
uuacuuuuuucccccuuagaug

SEQ ID NO: 188672 - RNA, 22 nt, Human
uuuuauaauacccuugacuaau

SEQ ID NO: 188673 - RNA, 23 nt, Human
aacugcaagguugcugggaagua

SEQ ID NO: 188674 - RNA, 22 nt, Human
ccuccuggaguuacuuccaaaa

SEQ ID NO: 188675 - RNA, 22 nt, Human
guccuguguaaguacuugcuca

SEQ ID NO: 188676 - RNA, 22 nt, Human
ucgcccagguuggagugcagug

SEQ ID NO: 188677 - RNA, 22 nt, Human
uuauauuuuauuuaauuaaaua

SEQ ID NO: 188678 - RNA, 22 nt, Human
ggcagggagagcgccgccaugc

SEQ ID NO: 188679 - RNA, 22 nt, Human
ucuuuuaucuguuguguaacaa

SEQ ID NO: 188680 - RNA, 22 nt, Human
uccuuaggaccuagagguagua

SEQ ID NO: 188681 - RNA, 22 nt, Human
ccagcugggucccugcuggggc

SEQ ID NO: 188682 - RNA, 22 nt, Human
gagggugguggcggccggcacc

SEQ ID NO: 188683 - RNA, 22 nt, Human
cacuguugagcaauguacagug

SEQ ID NO: 188684 - RNA, 22 nt, Human
uacauuugauuuuugcuucuuu

SEQ ID NO: 188685 - RNA, 22 nt, Human
ugaaaaauauuuuuagaaauaa

SEQ ID NO: 188686 - RNA, 19 nt, Human
acuggggcaggcugggcuu

SEQ ID NO: 188687 - RNA, 22 nt, Human
auaaaagcacaauagaguuaug

SEQ ID NO: 188688 - RNA, 22 nt, Human
uugauagauuuuagaggcaggc

SEQ ID NO: 188689 - RNA, 22 nt, Human
aauaacuuacucuaugcuuagu

SEQ ID NO: 188690 - RNA, 22 nt, Human
aacugcauaagcuucgggaccu

SEQ ID NO: 188691 - RNA, 22 nt, Human
uuuuuugucuugaagaaauggu

SEQ ID NO: 188692 - RNA, 22 nt, Human
ggagacagugacuuagagacug

SEQ ID NO: 188693 - RNA, 22 nt, Human
gggcaugcagcaauucuguggu

SEQ ID NO: 188694 - RNA, 22 nt, Human
cucagaagaacaaaggcucuac

SEQ ID NO: 188695 - RNA, 22 nt, Human
cuucucuuccuucucauccuca

SEQ ID NO: 188696 - RNA, 22 nt, Human
uggguauauauguugcuacaga

SEQ ID NO: 188697 - RNA, 22 nt, Human
ugccuuuggcuguucugugacc

SEQ ID NO: 188698 - RNA, 22 nt, Human
ggcagaggagcuggaaacaugg

SEQ ID NO: 188699 - RNA, 22 nt, Human
cuucuuucuuuucuucuucucu

SEQ ID NO: 188700 - RNA, 22 nt, Human
cucugcuuguaucacauuugcu

SEQ ID NO: 188701 - RNA, 22 nt, Human
uuaaaagaauccuguuauccuc

SEQ ID NO: 188702 - RNA, 22 nt, Human
gucugcccuuggccugggacuu

SEQ ID NO: 188703 - RNA, 22 nt, Human
ggcucccgugggaugguggagc

SEQ ID NO: 188704 - RNA, 22 nt, Human
cggcugcagcggagcaggcugg

SEQ ID NO: 188705 - RNA, 22 nt, Human
aaaauaaccuucauuugcauug

SEQ ID NO: 188706 - RNA, 22 nt, Human
uuucucuuguauuugaaucacu

SEQ ID NO: 188707 - RNA, 22 nt, Human
aaauagucagaaaucaacgugc

SEQ ID NO: 188708 - RNA, 22 nt, Human
ucauuguuucugcuuuucauga

SEQ ID NO: 188709 - RNA, 22 nt, Human
ccagucuuggugucuguagcac

SEQ ID NO: 188710 - RNA, 22 nt, Human
ccagcaggagacuagcaacaua

SEQ ID NO: 188711 - RNA, 22 nt, Human
aucuucuuucaucagccccuca

SEQ ID NO: 188712 - RNA, 21 nt, Human
aucagaaucucuagauuugga

SEQ ID NO: 188713 - RNA, 22 nt, Human
agucacuguucugucaugucaa

SEQ ID NO: 188714 - RNA, 16 nt, Human
aaguuuuaucuucuca

SEQ ID NO: 188715 - RNA, 21 nt, Human
uuucauuaguacaucaauuug

SEQ ID NO: 188716 - RNA, 22 nt, Human
uagggaggguuugggguggagg

SEQ ID NO: 188717 - RNA, 22 nt, Human
ggcugguggcgggcagcacaga

SEQ ID NO: 188718 - RNA, 22 nt, Human
cccauggaaggguuggcccaga

SEQ ID NO: 188719 - RNA, 22 nt, Human
caggaacagcaccaggagcuag

SEQ ID NO: 188720 - RNA, 22 nt, Human
gcuggaaauaacuuguguagaa

SEQ ID NO: 188721 - RNA, 22 nt, Human
ucuucacagaugcauauacuuc

SEQ ID NO: 188722 - RNA, 22 nt, Human
ggcuuguccuucugguugucuu

SEQ ID NO: 188723 - RNA, 22 nt, Human
cuuuccaugucuucuuucucca

SEQ ID NO: 188724 - RNA, 22 nt, Human
aauaauuuuuuugugauuaugu

SEQ ID NO: 188725 - RNA, 22 nt, Human
agcaauucugaaauuacuugac

SEQ ID NO: 188726 - RNA, 22 nt, Human
ucuugcuguggcagaucuggag

SEQ ID NO: 188727 - RNA, 22 nt, Human
agggcucacuacaacccuggga

SEQ ID NO: 188728 - RNA, 23 nt, Human
uccuccccaccuuuguccccucc

SEQ ID NO: 188729 - RNA, 22 nt, Human
ucuugccccugcuuuggaacaa

SEQ ID NO: 188730 - RNA, 22 nt, Human
aaaacauuuaggguuuuuuuua

SEQ ID NO: 188731 - RNA, 22 nt, Human
cagccuuuucuuaaaaugcaag

SEQ ID NO: 188732 - RNA, 22 nt, Human
cuacuucucccuagaucagaaa

SEQ ID NO: 188733 - RNA, 22 nt, Human
uuccagauguuuaaguucugcu

SEQ ID NO: 188734 - RNA, 22 nt, Human
auuuuacuaugauaguugagaa

SEQ ID NO: 188735 - RNA, 22 nt, Human
gcuguugugaggaucagcauau

SEQ ID NO: 188736 - RNA, 22 nt, Human
agauaaacaacucuuagcuguu

SEQ ID NO: 188737 - RNA, 22 nt, Human
cggggcuccgaagagcucgguu

SEQ ID NO: 188738 - RNA, 22 nt, Human
gcaguuugugauguggcaguca

SEQ ID NO: 188739 - RNA, 22 nt, Human
acuuuauacuagugauaguuug

SEQ ID NO: 188740 - RNA, 18 nt, Human
guucaagcauuuugcucu

SEQ ID NO: 188741 - RNA, 22 nt, Human
augugugugcgagcgugugugu

SEQ ID NO: 188742 - RNA, 22 nt, Human
gggagcucaccaugcucugcau

SEQ ID NO: 188743 - RNA, 21 nt, Human
acaaaaccuaacuuggcugcu

SEQ ID NO: 188744 - RNA, 22 nt, Human
acauuuccaaagaugccaguca

SEQ ID NO: 188745 - RNA, 22 nt, Human
aggaaauaguuuagucccaaaa

SEQ ID NO: 188746 - RNA, 23 nt, Human
agagggaagagcuuagaugggga

SEQ ID NO: 188747 - RNA, 22 nt, Human
acauaaauagcacugugaauuu

SEQ ID NO: 188748 - RNA, 22 nt, Human
cugcugugcagacagacucucu

SEQ ID NO: 188749 - RNA, 22 nt, Human
agagacaggguuuugucguguu

SEQ ID NO: 188750 - RNA, 22 nt, Human
uguuuuuauucuuaauguuuca

SEQ ID NO: 188751 - RNA, 22 nt, Human
aaggugggacugagaggggaca

SEQ ID NO: 188752 - RNA, 22 nt, Human
ggacggggagcuggaaagggga

SEQ ID NO: 188753 - RNA, 22 nt, Human
augugccuuaauauaggcgcug

SEQ ID NO: 188754 - RNA, 22 nt, Human
uaugucuauugacuuaggauuu

SEQ ID NO: 188755 - RNA, 22 nt, Human
uuccuuuuuaauuaaucuaauu

SEQ ID NO: 188756 - RNA, 22 nt, Human
gugugugucuacuuucaucucu

SEQ ID NO: 188757 - RNA, 22 nt, Human
aagugaggagaccucuucuuca

SEQ ID NO: 188758 - RNA, 22 nt, Human
auccuccuggggcagucuuccc

SEQ ID NO: 188759 - RNA, 22 nt, Human
ucacuguuucaccgucugaagg

SEQ ID NO: 188760 - RNA, 20 nt, Human
cagagccaggguuuuguuuu

SEQ ID NO: 188761 - RNA, 22 nt, Human
cucuuucauucuguccuuguuu

SEQ ID NO: 188762 - RNA, 22 nt, Human
uauuucaugagugaauaucuag

SEQ ID NO: 188763 - RNA, 22 nt, Human
gcucucuggccugggaggagga

SEQ ID NO: 188764 - RNA, 22 nt, Human
uagguuuugugucagaguagaa

SEQ ID NO: 188765 - RNA, 22 nt, Human
gggcugcuccgcccgcugcgcc

SEQ ID NO: 188766 - RNA, 22 nt, Human
ugcacacaguucucaggaaaga

SEQ ID NO: 188767 - RNA, 22 nt, Human
ucuuuaucugugagcagucucc

SEQ ID NO: 188768 - RNA, 22 nt, Human
uuguuauuauuauuuucguucu

SEQ ID NO: 188769 - RNA, 22 nt, Human
ggauggugauguacccagucau

SEQ ID NO: 188770 - RNA, 22 nt, Human
aaaauauaaaggauguggguuu

SEQ ID NO: 188771 - RNA, 22 nt, Human
uauguggcaggugggagaucag

SEQ ID NO: 188772 - RNA, 22 nt, Human
uuauuguuuggguauaauuuga

SEQ ID NO: 188773 - RNA, 22 nt, Human
ucucaaagagcuacuggucuau

SEQ ID NO: 188774 - RNA, 22 nt, Human
acagccaacgucuuucuuacuu

SEQ ID NO: 188775 - RNA, 22 nt, Human
uguaaagugguauuuaauuuua

SEQ ID NO: 188776 - RNA, 22 nt, Human
gacauuuauuggauuuuacgag

SEQ ID NO: 188777 - RNA, 22 nt, Human
aaaucuuucacauauuuuuuau

SEQ ID NO: 188778 - RNA, 22 nt, Human
gagaugugguucaaggguguuu

SEQ ID NO: 188779 - RNA, 22 nt, Human
aauucuuuguuccucugccaag

SEQ ID NO: 188780 - RNA, 22 nt, Human
guaaauaucucacgaaugauuc

SEQ ID NO: 188781 - RNA, 22 nt, Human
gagcagacugcacaguucuugc

SEQ ID NO: 188782 - RNA, 22 nt, Human
ugcuuucaaugaauuguauacu

SEQ ID NO: 188783 - RNA, 22 nt, Human
cacaaggagaaauagauauuga

SEQ ID NO: 188784 - RNA, 22 nt, Human
uaugaggagaacauuccugaac

SEQ ID NO: 188785 - RNA, 22 nt, Human
caauggagccaagaggaggaaa

SEQ ID NO: 188786 - RNA, 22 nt, Human
cuggccagccucccagguaccc

SEQ ID NO: 188787 - RNA, 22 nt, Human
uugaaaaaugcccagcagacaa

SEQ ID NO: 188788 - RNA, 22 nt, Human
acaggcgucgccugcucuugcc

SEQ ID NO: 188789 - RNA, 22 nt, Human
ucuuccuuguaagggcuuuaga

SEQ ID NO: 188790 - RNA, 22 nt, Human
uguggccaccagagcugcuauu

SEQ ID NO: 188791 - RNA, 22 nt, Human
ugcagaggagcuggaaggcugg

SEQ ID NO: 188792 - RNA, 20 nt, Human
gaacauaaauaacucuuuac

SEQ ID NO: 188793 - RNA, 22 nt, Human
agagggagagauuggcaaucag

SEQ ID NO: 188794 - RNA, 22 nt, Human
cuugucuaguuccuggugaugu

SEQ ID NO: 188795 - RNA, 22 nt, Human
cauaaauuuuaccuuguaagug

SEQ ID NO: 188796 - RNA, 22 nt, Human
gugugucucaguugcuccgaag

SEQ ID NO: 188797 - RNA, 22 nt, Human
uuuuuuuuacuccggacagcuc

SEQ ID NO: 188798 - RNA, 22 nt, Human
uuauuucauguaaaauuuaugu

SEQ ID NO: 188799 - RNA, 22 nt, Human
uuucagaaauggcacugaaauc

SEQ ID NO: 188800 - RNA, 22 nt, Human
gaauuccaggugagagaaggua

SEQ ID NO: 188801 - RNA, 22 nt, Human
aacgagcugggggggccggggg

SEQ ID NO: 188802 - RNA, 22 nt, Human
uuuccuaggaaaugauugaagu

SEQ ID NO: 188803 - RNA, 22 nt, Human
aaugcuaaagaagaaggaguag

SEQ ID NO: 188804 - RNA, 22 nt, Human
cugccucucaugccugcuugcu

SEQ ID NO: 188805 - RNA, 22 nt, Human
gagggggaaaagggcagcagag

SEQ ID NO: 188806 - RNA, 22 nt, Human
uucuccaccugcuccucccacc

SEQ ID NO: 188807 - RNA, 22 nt, Human
uucuucuuuccuauaauuaauu

SEQ ID NO: 188808 - RNA, 22 nt, Human
agggaugugcagggcuugccau

SEQ ID NO: 188809 - RNA, 22 nt, Human
ucuaaagcuccuuccacuaaaa

SEQ ID NO: 188810 - RNA, 22 nt, Human
uucauuuccauuuuauagauaa

SEQ ID NO: 188811 - RNA, 22 nt, Human
aaucauaacaaaagcaauuaua

SEQ ID NO: 188812 - RNA, 22 nt, Human
cuaaauucuauauccuugcuuc

SEQ ID NO: 188813 - RNA, 22 nt, Human
aaccaggcgagagagcggucag

SEQ ID NO: 188814 - RNA, 21 nt, Human
guucuuaguuauauucucaau

SEQ ID NO: 188815 - RNA, 22 nt, Human
gauguuggugcauucacuucug

SEQ ID NO: 188816 - RNA, 22 nt, Human
ggcuggggccuguugaagaugc

SEQ ID NO: 188817 - RNA, 22 nt, Human
uuauuuaaaauguagguuggga

SEQ ID NO: 188818 - RNA, 22 nt, Human
acuuccuuuuuuggggauagca

SEQ ID NO: 188819 - RNA, 22 nt, Human
guuguuuuuguuaaaacaguga

SEQ ID NO: 188820 - RNA, 22 nt, Human
uaggggguuuuucuagagauug

SEQ ID NO: 188821 - RNA, 22 nt, Human
ucaccauguuuucauaggaaca

SEQ ID NO: 188822 - RNA, 22 nt, Human
uauuuuaaaagcauuaauucuu

SEQ ID NO: 188823 - RNA, 22 nt, Human
ucauuauuuugauguauuuccu

SEQ ID NO: 188824 - RNA, 22 nt, Human
aguuuccacuggagacacugug

SEQ ID NO: 188825 - RNA, 22 nt, Human
uuauuuuguagcucugaucuuu

SEQ ID NO: 188826 - RNA, 22 nt, Human
guuuuaucuauguaauuauaaa

SEQ ID NO: 188827 - RNA, 22 nt, Human
uaaguuguagaacguuuucuua

SEQ ID NO: 188828 - RNA, 22 nt, Human
aauaugaugccaaauugcuaca

SEQ ID NO: 188829 - RNA, 22 nt, Human
guuuaaaagcaaccaacaggcu

SEQ ID NO: 188830 - RNA, 22 nt, Human
cagcuggggagagacauggcag

SEQ ID NO: 188831 - RNA, 22 nt, Human
auauaguacauguauauauaua

SEQ ID NO: 188832 - RNA, 21 nt, Human
cuuugccuccagcagccgcag

SEQ ID NO: 188833 - RNA, 22 nt, Human
ucagcuucaucuugagcccaca

SEQ ID NO: 188834 - RNA, 22 nt, Human
ccugcccaucccaccccagcau

SEQ ID NO: 188835 - RNA, 22 nt, Human
uuuaaauuucugaaucuugagg

SEQ ID NO: 188836 - RNA, 22 nt, Human
aaaacuuucagggauacagaaa

SEQ ID NO: 188837 - RNA, 22 nt, Human
aaauauauauaauauauauauu

SEQ ID NO: 188838 - RNA, 22 nt, Human
cugggggacagagagaggcggu

SEQ ID NO: 188839 - RNA, 22 nt, Human
ccccauggaaaacccaccuagg

SEQ ID NO: 188840 - RNA, 22 nt, Human
uccuuccucuuucaaauuuguu

SEQ ID NO: 188841 - RNA, 22 nt, Human
agggcaggguuggugcuggugc

SEQ ID NO: 188842 - RNA, 22 nt, Human
uaguggaaccuucuaaaugacg

SEQ ID NO: 188843 - RNA, 18 nt, Human
auucauuugcguuuggcu

SEQ ID NO: 188844 - RNA, 22 nt, Human
uucuugugugaauauaauuaca

SEQ ID NO: 188845 - RNA, 22 nt, Human
uggagccuugugagaccacaau

SEQ ID NO: 188846 - RNA, 22 nt, Human
uauuuuuacuguuugaugauuc

SEQ ID NO: 188847 - RNA, 22 nt, Human
uggaaauagauguaggaaauug

SEQ ID NO: 188848 - RNA, 22 nt, Human
ugcaggagcaccagcucacccu

SEQ ID NO: 188849 - RNA, 22 nt, Human
ucauuguuuacugucuuuuuuc

SEQ ID NO: 188850 - RNA, 22 nt, Human
cuccccuuauuccucaacauga

SEQ ID NO: 188851 - RNA, 22 nt, Human
aggcaggggagcuggaagggua

SEQ ID NO: 188852 - RNA, 22 nt, Human
uguuuuuucccccccuucuaaa

SEQ ID NO: 188853 - RNA, 22 nt, Human
ggcucacuguaccugccgccgc

SEQ ID NO: 188854 - RNA, 20 nt, Human
uacaauauucccacuuugcu

SEQ ID NO: 188855 - RNA, 22 nt, Human
cuuuuuuucuccauauuucugg

SEQ ID NO: 188856 - RNA, 22 nt, Human
ugcauucugaacguaaauguga

SEQ ID NO: 188857 - RNA, 22 nt, Human
cucuguguguuugugugugugu

SEQ ID NO: 188858 - RNA, 22 nt, Human
uacuauuuugacaugaaauuga

SEQ ID NO: 188859 - RNA, 21 nt, Human
uccucucuaaguuccgccccg

SEQ ID NO: 188860 - RNA, 17 nt, Human
uuuguuucauacuucau

SEQ ID NO: 188861 - RNA, 22 nt, Human
ugaguucugacugagcaugggg

SEQ ID NO: 188862 - RNA, 19 nt, Human
ucuuugcuuuucuaagagg

SEQ ID NO: 188863 - RNA, 22 nt, Human
uccuuucaaauuuauuugacau

SEQ ID NO: 188864 - RNA, 22 nt, Human
cggugcuuuccauaucagcagc

SEQ ID NO: 188865 - RNA, 22 nt, Human
ggagccucuaaacaguuaucaa

SEQ ID NO: 188866 - RNA, 22 nt, Human
agcuccucagauuuggguggcg

SEQ ID NO: 188867 - RNA, 19 nt, Human
augaaauagcauuuucuga

SEQ ID NO: 188868 - RNA, 22 nt, Human
guacauauccuuuacguuuugu

SEQ ID NO: 188869 - RNA, 22 nt, Human
uguuccucuuagucuuaugugu

SEQ ID NO: 188870 - RNA, 22 nt, Human
ggcugcagugcaacucuuucua

SEQ ID NO: 188871 - RNA, 22 nt, Human
gcucagagaaaacuggggcuug

SEQ ID NO: 188872 - RNA, 22 nt, Human
agcaaggguugguuuucugaca

SEQ ID NO: 188873 - RNA, 22 nt, Human
uucauggauuugugaaauuuag

SEQ ID NO: 188874 - RNA, 22 nt, Human
acuguugagggaagcagaugaa

SEQ ID NO: 188875 - RNA, 22 nt, Human
aaaauacuaggaaaauaaauca

SEQ ID NO: 188876 - RNA, 22 nt, Human
gaggagcugggucagggagaca

SEQ ID NO: 188877 - RNA, 22 nt, Human
uggaaauacaagaaguauguca

SEQ ID NO: 188878 - RNA, 22 nt, Human
gcuguggagaagcugccuaugg

SEQ ID NO: 188879 - RNA, 22 nt, Human
cagcuuguucugaccugugauu

SEQ ID NO: 188880 - RNA, 22 nt, Human
gaggugauuccucccauguaau

SEQ ID NO: 188881 - RNA, 22 nt, Human
cuccuuccuccgcccuuccucg

SEQ ID NO: 188882 - RNA, 22 nt, Human
ggagcucacuacgaaauaagcu

SEQ ID NO: 188883 - RNA, 20 nt, Human
uuggggacaggagugugaug

SEQ ID NO: 188884 - RNA, 22 nt, Human
uccucagcaagacgcuggcagc

SEQ ID NO: 188885 - RNA, 22 nt, Human
uugucuuucguauggaacacua

SEQ ID NO: 188886 - RNA, 22 nt, Human
uagacugugagcuccuugaggg

SEQ ID NO: 188887 - RNA, 22 nt, Human
ucucucucucuuccagcauguu

SEQ ID NO: 188888 - RNA, 22 nt, Human
ucugagugacguccugacagga

SEQ ID NO: 188889 - RNA, 22 nt, Human
gcaggggguaaggggcagggcu

SEQ ID NO: 188890 - RNA, 22 nt, Human
uggguucaaauccugguuccac

SEQ ID NO: 188891 - RNA, 22 nt, Human
caagggcagaggcagggccccg

SEQ ID NO: 188892 - RNA, 22 nt, Human
aggaacaguuucaaagagugaa

SEQ ID NO: 188893 - RNA, 22 nt, Human
cagguggauggcgagcccugca

SEQ ID NO: 188894 - RNA, 22 nt, Human
uucauagaagggaguuuuuccu

SEQ ID NO: 188895 - RNA, 22 nt, Human
aaauguaaacuguauuuauaaa

SEQ ID NO: 188896 - RNA, 22 nt, Human
aaauucuuccaggaggaaauac

SEQ ID NO: 188897 - RNA, 22 nt, Human
uuaaagaguuuauuacuuguaa

SEQ ID NO: 188898 - RNA, 22 nt, Human
gcuguggacacagcucucuuca

SEQ ID NO: 188899 - RNA, 22 nt, Human
agagaaauguacuagucuaacu

SEQ ID NO: 188900 - RNA, 22 nt, Human
guguugaugugucuguauucua

SEQ ID NO: 188901 - RNA, 22 nt, Human
agugccuggcugauggguccug

SEQ ID NO: 188902 - RNA, 22 nt, Human
uauuuuuuuaacauuuauugua

SEQ ID NO: 188903 - RNA, 22 nt, Human
cacacacacacacacucucaca

SEQ ID NO: 188904 - RNA, 22 nt, Human
caaaucuguuaauuucaaguug

SEQ ID NO: 188905 - RNA, 22 nt, Human
ggaggaugaggguggugguguu

SEQ ID NO: 188906 - RNA, 22 nt, Human
cagcuccagcccaggcagcucc

SEQ ID NO: 188907 - RNA, 22 nt, Human
ugugaagaauuaaugugaauca

SEQ ID NO: 188908 - RNA, 22 nt, Human
uguugaaacagcuauugacuuu

SEQ ID NO: 188909 - RNA, 22 nt, Human
aggcucagcaucugauucauau

SEQ ID NO: 188910 - RNA, 22 nt, Human
auuuucauauggguuauuugua

SEQ ID NO: 188911 - RNA, 22 nt, Human
ggcugugguggacgcgggaaac

SEQ ID NO: 188912 - RNA, 22 nt, Human
uggacacugguggauauggaau

SEQ ID NO: 188913 - RNA, 23 nt, Human
uucuuuccuuaucccauuuacuu

SEQ ID NO: 188914 - RNA, 22 nt, Human
auccugugggguauugcugcau

SEQ ID NO: 188915 - RNA, 22 nt, Human
guucucuuaauccuaguuggua

SEQ ID NO: 188916 - RNA, 22 nt, Human
agcaggagagacuggcccaaaa

SEQ ID NO: 188917 - RNA, 18 nt, Human
ggccucagccuggccgga

SEQ ID NO: 188918 - RNA, 22 nt, Human
ucagcucucucuuggugaucuc

SEQ ID NO: 188919 - RNA, 22 nt, Human
ucaucuuucuuuauggaaauac

SEQ ID NO: 188920 - RNA, 22 nt, Human
cucacugucagcugcagggcuu

SEQ ID NO: 188921 - RNA, 22 nt, Human
cuguuaauugugaauuuuacau

SEQ ID NO: 188922 - RNA, 22 nt, Human
aagaggcuacagcccugugucu

SEQ ID NO: 188923 - RNA, 17 nt, Human
ucuguguccgcucaguc

SEQ ID NO: 188924 - RNA, 19 nt, Human
ugccuggcaccagcuccac

SEQ ID NO: 188925 - RNA, 20 nt, Human
acacagccuagaguuuggcu

SEQ ID NO: 188926 - RNA, 22 nt, Human
aauguuuuucaaguguggagca

SEQ ID NO: 188927 - RNA, 22 nt, Human
uuuauuuagguaaacaugaguu

SEQ ID NO: 188928 - RNA, 22 nt, Human
auguuccaugacuaugcaugaa

SEQ ID NO: 188929 - RNA, 22 nt, Human
ucuccaggaaagacacuggacu

SEQ ID NO: 188930 - RNA, 22 nt, Human
gaggagggagcuggaagcucuu

SEQ ID NO: 188931 - RNA, 22 nt, Human
gccccaggggaggugcccugca

SEQ ID NO: 188932 - RNA, 22 nt, Human
uggcucacaggaggcagaggug

SEQ ID NO: 188933 - RNA, 22 nt, Human
ugcuccucugcaugucugcggc

SEQ ID NO: 188934 - RNA, 22 nt, Human
ucccuguggauuaaggagaugu

SEQ ID NO: 188935 - RNA, 22 nt, Human
caaagaugccaaaaggaagaca

SEQ ID NO: 188936 - RNA, 22 nt, Human
aaauauagugacacuuauaguc

SEQ ID NO: 188937 - RNA, 22 nt, Human
uggaagaucugguguagcuccu

SEQ ID NO: 188938 - RNA, 22 nt, Human
aaacuuuugaaggaggaaaaag

SEQ ID NO: 188939 - RNA, 22 nt, Human
cuucuuaaaguugucacagcug

SEQ ID NO: 188940 - RNA, 22 nt, Human
agcgcucauuuuccuccugcuc

SEQ ID NO: 188941 - RNA, 22 nt, Human
uucacuguucuuagagaagacc

SEQ ID NO: 188942 - RNA, 22 nt, Human
aauuauguugaaauaugagaac

SEQ ID NO: 188943 - RNA, 22 nt, Human
uucugcuuuaaagcucauguuu

SEQ ID NO: 188944 - RNA, 22 nt, Human
ggcuggagcaggcugcacagug

SEQ ID NO: 188945 - RNA, 22 nt, Human
ugcuuggagaaucagucccagc

SEQ ID NO: 188946 - RNA, 21 nt, Human
acugggcuagccugacuucug

SEQ ID NO: 188947 - RNA, 22 nt, Human
uauuuuagccaacagaaugaug

SEQ ID NO: 188948 - RNA, 22 nt, Human
guuuuguagucuggagacuguc

SEQ ID NO: 188949 - RNA, 22 nt, Human
aggggcugugucauuuguccua

SEQ ID NO: 188950 - RNA, 22 nt, Human
uuuuacaaugcaaauucuugcu

SEQ ID NO: 188951 - RNA, 22 nt, Human
uuuuccuucugauacuccauuu

SEQ ID NO: 188952 - RNA, 22 nt, Human
ugcugcacucacaggaagaguu

SEQ ID NO: 188953 - RNA, 22 nt, Human
ggcugugaaguacguugaaggu

SEQ ID NO: 188954 - RNA, 20 nt, Human
uggagggaggaggggcccaa

SEQ ID NO: 188955 - RNA, 22 nt, Human
cucuugacagcuuuaguaucau

SEQ ID NO: 188956 - RNA, 22 nt, Human
gaggcaggcggggcccaggugg

SEQ ID NO: 188957 - RNA, 22 nt, Human
caauccccaggucccagaacag

SEQ ID NO: 188958 - RNA, 18 nt, Human
uucucucuggauaguagu

SEQ ID NO: 188959 - RNA, 22 nt, Human
caaggaguuuggggaccaagga

SEQ ID NO: 188960 - RNA, 22 nt, Human
uuucuggacuaaagggagagau

SEQ ID NO: 188961 - RNA, 22 nt, Human
ccucaggaauuuauucuucugu

SEQ ID NO: 188962 - RNA, 22 nt, Human
acaugggggugggacggcagag

SEQ ID NO: 188963 - RNA, 22 nt, Human
aagcucagcugguggugauugc

SEQ ID NO: 188964 - RNA, 22 nt, Human
ugcaggagcccaggaauacuau

SEQ ID NO: 188965 - RNA, 22 nt, Human
guggguauauauaugugugcug

SEQ ID NO: 188966 - RNA, 22 nt, Human
cuccuugguuccggcguuggag

SEQ ID NO: 188967 - RNA, 19 nt, Human
aacaaaauaguucuaguua

SEQ ID NO: 188968 - RNA, 22 nt, Human
ccaaggcuguggggcugugcag

SEQ ID NO: 188969 - RNA, 22 nt, Human
uuuuugaauaagugcaucauca

SEQ ID NO: 188970 - RNA, 21 nt, Human
uguggccauuugaaaacaggg

SEQ ID NO: 188971 - RNA, 22 nt, Human
auuugcuuguucaccaguacuu

SEQ ID NO: 188972 - RNA, 22 nt, Human
gacuggggcauuagaguagcuu

SEQ ID NO: 188973 - RNA, 18 nt, Human
uucaggcucuugcaugaa

SEQ ID NO: 188974 - RNA, 22 nt, Human
auuuauuugaagagccauugca

SEQ ID NO: 188975 - RNA, 22 nt, Human
agggggaauccugcuuauggau

SEQ ID NO: 188976 - RNA, 22 nt, Human
uacaagcucuuguagggggaaa

SEQ ID NO: 188977 - RNA, 22 nt, Human
cuuacauuuguuuaguguuucc

SEQ ID NO: 188978 - RNA, 23 nt, Human
ccagcugugccuggcccaggagc

SEQ ID NO: 188979 - RNA, 18 nt, Human
ggagaagaacagaugugg

SEQ ID NO: 188980 - RNA, 22 nt, Human
auuuucuucauuuugauuguau

SEQ ID NO: 188981 - RNA, 22 nt, Human
uuuuaaauggcuuuuacuuuuc

SEQ ID NO: 188982 - RNA, 22 nt, Human
uguugaagcaccucugucuuuc

SEQ ID NO: 188983 - RNA, 22 nt, Human
uuccuucccccuucuuugccuu

SEQ ID NO: 188984 - RNA, 22 nt, Human
aucuaaaacuacgaauacuacc

SEQ ID NO: 188985 - RNA, 22 nt, Human
uucugugacgcaaagcugggaa

SEQ ID NO: 188986 - RNA, 22 nt, Human
gccaguggucagugggagggug

SEQ ID NO: 188987 - RNA, 22 nt, Human
auuugcauguuuauuucuuaga

SEQ ID NO: 188988 - RNA, 22 nt, Human
auugaaauuugcuuccucacug

SEQ ID NO: 188989 - RNA, 22 nt, Human
uuuuaaauaaacuacacugauu

SEQ ID NO: 188990 - RNA, 22 nt, Human
uacauguggagauaacugaagc

SEQ ID NO: 188991 - RNA, 22 nt, Human
uuucuacauuuguaaccagauu

SEQ ID NO: 188992 - RNA, 22 nt, Human
augaagguggacagauuuuuuu

SEQ ID NO: 188993 - RNA, 22 nt, Human
ugcuuucagauaucuguuucaa

SEQ ID NO: 188994 - RNA, 21 nt, Human
caguuugcuauuuuaguauga

SEQ ID NO: 188995 - RNA, 22 nt, Human
caggccccagggacugggcgcu

SEQ ID NO: 188996 - RNA, 22 nt, Human
uuccacaugaucauuguaauaa

SEQ ID NO: 188997 - RNA, 22 nt, Human
gaauuagguaauagaacuagua

SEQ ID NO: 188998 - RNA, 22 nt, Human
uuucauguuggauacuguuuca

SEQ ID NO: 188999 - RNA, 20 nt, Human
ucucuuuuucuucuuuucuc

SEQ ID NO: 189000 - RNA, 22 nt, Human
aggggaggcugggcuggggggc

SEQ ID NO: 189001 - RNA, 22 nt, Human
ucccaaaacuugaagcaagccu

SEQ ID NO: 189002 - RNA, 22 nt, Human
ggcugggagguggcgaggaggc

SEQ ID NO: 189003 - RNA, 22 nt, Human
ugaaagcuggcucugcagagug

SEQ ID NO: 189004 - RNA, 22 nt, Human
agaucugucaccauccuggagc

SEQ ID NO: 189005 - RNA, 22 nt, Human
uagagaaauuacagcuuucuuu

SEQ ID NO: 189006 - RNA, 22 nt, Human
uaauauauuuuuuaagggaugu

SEQ ID NO: 189007 - RNA, 23 nt, Human
gaugauggcaacuacauccggug

SEQ ID NO: 189008 - RNA, 22 nt, Human
aaauuaaaguuuuauuuagagc

SEQ ID NO: 189009 - RNA, 22 nt, Human
aaggcuguuugagcacuggagc

SEQ ID NO: 189010 - RNA, 22 nt, Human
gugauggucgagcgcuuguugu

SEQ ID NO: 189011 - RNA, 20 nt, Human
agaaggagagaugaggcaaa

SEQ ID NO: 189012 - RNA, 22 nt, Human
ugguucuagaugagaugaugag

SEQ ID NO: 189013 - RNA, 22 nt, Human
aaucacuucuuugucuucuuca

SEQ ID NO: 189014 - RNA, 22 nt, Human
uuuuaaaacaugucaaaaugug

SEQ ID NO: 189015 - RNA, 22 nt, Human
gggauggggagcuggaaagggg

SEQ ID NO: 189016 - RNA, 22 nt, Human
cuucucuuggguguggugucuu

SEQ ID NO: 189017 - RNA, 22 nt, Human
ccuucugcuggucaucccagug

SEQ ID NO: 189018 - RNA, 22 nt, Human
agcagggagacagugcagcauu

SEQ ID NO: 189019 - RNA, 22 nt, Human
uuuugccuauuguaucaucgua

SEQ ID NO: 189020 - RNA, 22 nt, Human
cccagaggcugaguugggagca

SEQ ID NO: 189021 - RNA, 22 nt, Human
cacauguguaccugccucucug

SEQ ID NO: 189022 - RNA, 22 nt, Human
ggcagagcugugcgcccaccca

SEQ ID NO: 189023 - RNA, 22 nt, Human
aggauggauagcaaggaagccg

SEQ ID NO: 189024 - RNA, 22 nt, Human
ggaagcuguugugagugcagca

SEQ ID NO: 189025 - RNA, 22 nt, Human
cagcuccaucuugcuuauacca

SEQ ID NO: 189026 - RNA, 22 nt, Human
ugagagggagacagcucuagca

SEQ ID NO: 189027 - RNA, 22 nt, Human
aggaaauaagggcacuucagau

SEQ ID NO: 189028 - RNA, 22 nt, Human
ggcagggaauucagagggaagg

SEQ ID NO: 189029 - RNA, 19 nt, Human
gauauugagcugagaauuc

SEQ ID NO: 189030 - RNA, 22 nt, Human
ggaggccgugcugugcugccag

SEQ ID NO: 189031 - RNA, 23 nt, Human
uggaaguugagagucugcuuugu

SEQ ID NO: 189032 - RNA, 22 nt, Human
ggaggcccagaaggaagcccag

SEQ ID NO: 189033 - RNA, 18 nt, Human
uauuuacuguguguuacc

SEQ ID NO: 189034 - RNA, 22 nt, Human
uuuuccuucuuccugccuugcc

SEQ ID NO: 189035 - RNA, 22 nt, Human
augaaaacgugugugugugugu

SEQ ID NO: 189036 - RNA, 22 nt, Human
gggcaagaagcuggaagcauuc

SEQ ID NO: 189037 - RNA, 22 nt, Human
uuuguauuguuuauuucauuuu

SEQ ID NO: 189038 - RNA, 22 nt, Human
ugaccucaagcaugcggagggc

SEQ ID NO: 189039 - RNA, 22 nt, Human
ucugaggacagugcugugccug

SEQ ID NO: 189040 - RNA, 21 nt, Human
uuccauggacccugucagugu

SEQ ID NO: 189041 - RNA, 22 nt, Human
cagcuguggagauggggugcau

SEQ ID NO: 189042 - RNA, 22 nt, Human
auggugaugaugaugaugauaa

SEQ ID NO: 189043 - RNA, 22 nt, Human
gguagacugagcuccuugagga

SEQ ID NO: 189044 - RNA, 22 nt, Human
ggcuguggcagcuggaaguggu

SEQ ID NO: 189045 - RNA, 22 nt, Human
uacuuuaauugcaaaaauaaau

SEQ ID NO: 189046 - RNA, 21 nt, Human
ggcugcucgugaugaacuuca

SEQ ID NO: 189047 - RNA, 22 nt, Human
aauauuuugggacugaggaauu

SEQ ID NO: 189048 - RNA, 22 nt, Human
augugagcuggaugaauuuaua

SEQ ID NO: 189049 - RNA, 22 nt, Human
ugagauguaauguaguacuuug

SEQ ID NO: 189050 - RNA, 22 nt, Human
ccuuuccuggaaaugguaaguu

SEQ ID NO: 189051 - RNA, 22 nt, Human
acagagcucccagccaucuccu

SEQ ID NO: 189052 - RNA, 22 nt, Human
ggaggaagagaccagggggcuu

SEQ ID NO: 189053 - RNA, 22 nt, Human
uuuucauagccagaaacugaaa

SEQ ID NO: 189054 - RNA, 22 nt, Human
aucuguuccccuaugcucucua

SEQ ID NO: 189055 - RNA, 22 nt, Human
uuccccaccagagacagagcug

SEQ ID NO: 189056 - RNA, 22 nt, Human
gaguucuagauguauuauuaau

SEQ ID NO: 189057 - RNA, 23 nt, Human
agauaaggaagcauuugagccag

SEQ ID NO: 189058 - RNA, 22 nt, Human
uucuuuguccuagcauucuaca

SEQ ID NO: 189059 - RNA, 22 nt, Human
cuucuuuuggggaugaaaaugg

SEQ ID NO: 189060 - RNA, 22 nt, Human
cagauaagcuauaaguaguacc

SEQ ID NO: 189061 - RNA, 22 nt, Human
uuucacugaguaggagagcacu

SEQ ID NO: 189062 - RNA, 22 nt, Human
gcuuucacugcaauagaugaau

SEQ ID NO: 189063 - RNA, 22 nt, Human
cuauauucuggaauguccauuu

SEQ ID NO: 189064 - RNA, 22 nt, Human
acuggagcccguggaggcgcag

SEQ ID NO: 189065 - RNA, 22 nt, Human
uggcagccugcgugaaggagcu

SEQ ID NO: 189066 - RNA, 22 nt, Human
guuuucuccugcuauacagugc

SEQ ID NO: 189067 - RNA, 22 nt, Human
agcggccucgcugccugcucag

SEQ ID NO: 189068 - RNA, 22 nt, Human
auagggaggcggagggagcugg

SEQ ID NO: 189069 - RNA, 22 nt, Human
uucucagagaaagcuccucaug

SEQ ID NO: 189070 - RNA, 22 nt, Human
aagugugugugcgcaugugcau

SEQ ID NO: 189071 - RNA, 21 nt, Human
auuauagugacuaaauugaua

SEQ ID NO: 189072 - RNA, 22 nt, Human
cugguacuggaggaguucagag

SEQ ID NO: 189073 - RNA, 22 nt, Human
cauggcggcgcucucccugccu

SEQ ID NO: 189074 - RNA, 21 nt, Human
ggccagauucucccauagcug

SEQ ID NO: 189075 - RNA, 22 nt, Human
acuugggaaaugaaaauacaga

SEQ ID NO: 189076 - RNA, 22 nt, Human
ugcuuggauuuccaaaugguuu

SEQ ID NO: 189077 - RNA, 22 nt, Human
uggugccuuccgagagcuguga

SEQ ID NO: 189078 - RNA, 22 nt, Human
uuauaucagaaggugagauuga

SEQ ID NO: 189079 - RNA, 22 nt, Human
uuuauguuuguuuuugaaauaa

SEQ ID NO: 189080 - RNA, 22 nt, Human
auggagguuugucugguuuugu

SEQ ID NO: 189081 - RNA, 22 nt, Human
agauaagaacauuaguaagccg

SEQ ID NO: 189082 - RNA, 22 nt, Human
ugagggaggggaaugugugcag

SEQ ID NO: 189083 - RNA, 22 nt, Human
uuuuguuuacauuaaauuuuga

SEQ ID NO: 189084 - RNA, 22 nt, Human
uaggaagagauuuucacauggc

SEQ ID NO: 189085 - RNA, 22 nt, Human
aggccagggacaaugaggcaga

SEQ ID NO: 189086 - RNA, 22 nt, Human
uugcaagcccugaagggcugga

SEQ ID NO: 189087 - RNA, 22 nt, Human
gggggcagguuccaggccagcu

SEQ ID NO: 189088 - RNA, 22 nt, Human
uggaaaauuuagaaagauuuau

SEQ ID NO: 189089 - RNA, 18 nt, Human
acuguccucaggacguug

SEQ ID NO: 189090 - RNA, 22 nt, Human
agcuuucuauauaugaguugcu

SEQ ID NO: 189091 - RNA, 22 nt, Human
uuaaacauuuccacuugccagu

SEQ ID NO: 189092 - RNA, 22 nt, Human
uuuauaauuacguaaaauauuu

SEQ ID NO: 189093 - RNA, 22 nt, Human
uuggugaugcccaccuuuucau

SEQ ID NO: 189094 - RNA, 22 nt, Human
auuaaacuaaauuaugaauugg

SEQ ID NO: 189095 - RNA, 22 nt, Human
uuuuccuuagaaauacauugau

SEQ ID NO: 189096 - RNA, 16 nt, Human
gaauuccauugcucug

SEQ ID NO: 189097 - RNA, 22 nt, Human
acugucuuguuguaugugagcu

SEQ ID NO: 189098 - RNA, 22 nt, Human
uuaucaaaaaauaguacuuuga

SEQ ID NO: 189099 - RNA, 22 nt, Human
gcugcagggagcuggaaggcuc

SEQ ID NO: 189100 - RNA, 22 nt, Human
auucuuuucucuaaaugaugaa

SEQ ID NO: 189101 - RNA, 21 nt, Human
caguucuaagugucaucuuuu

SEQ ID NO: 189102 - RNA, 22 nt, Human
uaagggagcagaagcugugaaa

SEQ ID NO: 189103 - RNA, 22 nt, Human
uauuaaaagagaaaaagccacc

SEQ ID NO: 189104 - RNA, 22 nt, Human
uuguuuuaguagaaguuacaug

SEQ ID NO: 189105 - RNA, 22 nt, Human
gagggaggugacaaggacauag

SEQ ID NO: 189106 - RNA, 22 nt, Human
ggacauaguugcuauggagagu

SEQ ID NO: 189107 - RNA, 22 nt, Human
gcacuguauuuaaauauuuaaa

SEQ ID NO: 189108 - RNA, 22 nt, Human
uucuucuucuuccucauccuca

SEQ ID NO: 189109 - RNA, 22 nt, Human
guccccugcguguucauccugg

SEQ ID NO: 189110 - RNA, 22 nt, Human
ucuucaugaaauugauugcuua

SEQ ID NO: 189111 - RNA, 22 nt, Human
uguuuucuuuccccuucuuuuc

SEQ ID NO: 189112 - RNA, 22 nt, Human
ccugaagaugguugauccccuu

SEQ ID NO: 189113 - RNA, 20 nt, Human
ucugugugccaucaccuaac

SEQ ID NO: 189114 - RNA, 20 nt, Human
uuguacuuaugugagaagga

SEQ ID NO: 189115 - RNA, 22 nt, Human
gaaggagaggauugugaggcug

SEQ ID NO: 189116 - RNA, 22 nt, Human
cugcaucacagcaggaggcaca

SEQ ID NO: 189117 - RNA, 22 nt, Human
guugagaaucucuagcuuagga

SEQ ID NO: 189118 - RNA, 22 nt, Human
ggcagguggcacugcugcuccc

SEQ ID NO: 189119 - RNA, 22 nt, Human
gaggagcuucagaggaaucuua

SEQ ID NO: 189120 - RNA, 22 nt, Human
uugugugugcccaccuguggcc

SEQ ID NO: 189121 - RNA, 22 nt, Human
uuaggggcuuaggcagaguuug

SEQ ID NO: 189122 - RNA, 22 nt, Human
uguauuuuuucccugaaauaaa

SEQ ID NO: 189123 - RNA, 22 nt, Human
ucuccucucugaucuugcuccg

SEQ ID NO: 189124 - RNA, 22 nt, Human
agucugugguccucuguaucuc

SEQ ID NO: 189125 - RNA, 22 nt, Human
agcacagugccugacauauaug

SEQ ID NO: 189126 - RNA, 22 nt, Human
uacugcaguuccugcugucucc

SEQ ID NO: 189127 - RNA, 22 nt, Human
uggucuuuccuucauuguccag

SEQ ID NO: 189128 - RNA, 22 nt, Human
aacagaauaucaaaagauuaug

SEQ ID NO: 189129 - RNA, 22 nt, Human
uuauuuaaguauuuauugaagu

SEQ ID NO: 189130 - RNA, 22 nt, Human
uucacccuucucuggcuuucag

SEQ ID NO: 189131 - RNA, 22 nt, Human
ggcugcagggaacaggaugggu

SEQ ID NO: 189132 - RNA, 21 nt, Human
ugagcccaaagcuguauuggu

SEQ ID NO: 189133 - RNA, 22 nt, Human
ugcugcacuuauggcucugagg

SEQ ID NO: 189134 - RNA, 22 nt, Human
ugcagcagaauauggcugcagg

SEQ ID NO: 189135 - RNA, 22 nt, Human
acagacuuuuagacuuaugagu

SEQ ID NO: 189136 - RNA, 22 nt, Human
cuccuagagcacaaaaggccau

SEQ ID NO: 189137 - RNA, 22 nt, Human
auuuuugguuucaccugcacgc

SEQ ID NO: 189138 - RNA, 22 nt, Human
caagaaaaaacaugaugagugu

SEQ ID NO: 189139 - RNA, 22 nt, Human
uccuccuggagacuuucucucu

SEQ ID NO: 189140 - RNA, 22 nt, Human
uugccaggagacaucuggagcc

SEQ ID NO: 189141 - RNA, 22 nt, Human
auggaguguggccaggcaguaa

SEQ ID NO: 189142 - RNA, 22 nt, Human
uccauguauugcuaacaaauag

SEQ ID NO: 189143 - RNA, 22 nt, Human
guucaaucucucaugcauuuuc

SEQ ID NO: 189144 - RNA, 22 nt, Human
ugaaguuuagaaaaagugccuu

SEQ ID NO: 189145 - RNA, 21 nt, Human
gcagcucaggauauagacuug

SEQ ID NO: 189146 - RNA, 22 nt, Human
uaggauugguguauguagguuu

SEQ ID NO: 189147 - RNA, 22 nt, Human
aaauauauccuucuguccugcc

SEQ ID NO: 189148 - RNA, 17 nt, Human
ugucuuuuuccuccucc

SEQ ID NO: 189149 - RNA, 22 nt, Human
cuaagguuggcaguggaauugg

SEQ ID NO: 189150 - RNA, 22 nt, Human
auuugccaguuacucacaccac

SEQ ID NO: 189151 - RNA, 22 nt, Human
ggagacagauggcgucucaguu

SEQ ID NO: 189152 - RNA, 22 nt, Human
ugucuuugaccuuaagaaguuu

SEQ ID NO: 189153 - RNA, 20 nt, Human
ucacuguaauugccuacauu

SEQ ID NO: 189154 - RNA, 22 nt, Human
ggaggccagagaagagccaggc

SEQ ID NO: 189155 - RNA, 22 nt, Human
aagacagugacagucacaauug

SEQ ID NO: 189156 - RNA, 22 nt, Human
cucagaugcacacaggugaggg

SEQ ID NO: 189157 - RNA, 22 nt, Human
gaagaaggaagaucaugcuuga

SEQ ID NO: 189158 - RNA, 22 nt, Human
ucccuucccaccccugccuuuu

SEQ ID NO: 189159 - RNA, 22 nt, Human
gaaccauuuaauggagaugcuc

SEQ ID NO: 189160 - RNA, 22 nt, Human
guggggguaggggguuuccugg

SEQ ID NO: 189161 - RNA, 20 nt, Human
uugauucacaaaaagcuuag

SEQ ID NO: 189162 - RNA, 22 nt, Human
uuuacuguuuacagcuaaugca

SEQ ID NO: 189163 - RNA, 22 nt, Human
gucucacuucauuuucuuagcc

SEQ ID NO: 189164 - RNA, 22 nt, Human
gaauauuuaucucagcugcaga

SEQ ID NO: 189165 - RNA, 22 nt, Human
acgugugugugcacguguguau

SEQ ID NO: 189166 - RNA, 22 nt, Human
gggcuguggggccugcagaagg

SEQ ID NO: 189167 - RNA, 22 nt, Human
ccugccagaaaagagggaguuc

SEQ ID NO: 189168 - RNA, 22 nt, Human
gcuuuggcuucuccuggcagga

SEQ ID NO: 189169 - RNA, 22 nt, Human
uauauuaaagugcuuugcagug

SEQ ID NO: 189170 - RNA, 22 nt, Human
uucuuuuaauuucugucugcag

SEQ ID NO: 189171 - RNA, 22 nt, Human
aagaaaccauauuaguuccugg

SEQ ID NO: 189172 - RNA, 22 nt, Human
uucacugugauugggguggauu

SEQ ID NO: 189173 - RNA, 20 nt, Human
cuuauuuuggagaacuuuuc

SEQ ID NO: 189174 - RNA, 22 nt, Human
uucaugucuuugauucugauaa

SEQ ID NO: 189175 - RNA, 22 nt, Human
ugcuuucaaaacucagaggaau

SEQ ID NO: 189176 - RNA, 21 nt, Human
uuccuggaggcagaaacguga

SEQ ID NO: 189177 - RNA, 22 nt, Human
uggggcuccuccuggcaggagg

SEQ ID NO: 189178 - RNA, 22 nt, Human
gaaagugaauguaacauguuau

SEQ ID NO: 189179 - RNA, 22 nt, Human
cauuuugguaauguucguuugc

SEQ ID NO: 189180 - RNA, 22 nt, Human
uaugaauauaccacaauuuagg

SEQ ID NO: 189181 - RNA, 22 nt, Human
ugauucacagacuucacaaggc

SEQ ID NO: 189182 - RNA, 22 nt, Human
acucauuuggauuuuggaguuu

SEQ ID NO: 189183 - RNA, 22 nt, Human
uucuugucuuuguuauguagga

SEQ ID NO: 189184 - RNA, 22 nt, Human
gggagguaaugggggugcaggg

SEQ ID NO: 189185 - RNA, 22 nt, Human
ucagagccagacacacagcaga

SEQ ID NO: 189186 - RNA, 22 nt, Human
ugcucacugcuuguguucaguu

SEQ ID NO: 189187 - RNA, 22 nt, Human
uagcauuuagaacaccuugaga

SEQ ID NO: 189188 - RNA, 22 nt, Human
gagaacagauaugaugacuuca

SEQ ID NO: 189189 - RNA, 22 nt, Human
agcaagggucucucauggcuug

SEQ ID NO: 189190 - RNA, 22 nt, Human
ucaaauaugggccagaggaaau

SEQ ID NO: 189191 - RNA, 22 nt, Human
cuccagagagaaaggaggccgc

SEQ ID NO: 189192 - RNA, 22 nt, Human
auuaaaaaaagauaaugaguua

SEQ ID NO: 189193 - RNA, 22 nt, Human
auaaaaauguuuuuguguggua

SEQ ID NO: 189194 - RNA, 22 nt, Human
cuucuucaucuuuuggaggaac

SEQ ID NO: 189195 - RNA, 22 nt, Human
aagaaggaaggcaagagauggg

SEQ ID NO: 189196 - RNA, 22 nt, Human
cuagcagaagcuccuugagggu

SEQ ID NO: 189197 - RNA, 22 nt, Human
uguguuguuuggggauguccau

SEQ ID NO: 189198 - RNA, 22 nt, Human
gucuuucuuuuacauauuugug

SEQ ID NO: 189199 - RNA, 22 nt, Human
cacagcuggggaagcugaggcc

SEQ ID NO: 189200 - RNA, 22 nt, Human
uacagaccaguaguucucagcg

SEQ ID NO: 189201 - RNA, 22 nt, Human
ggggcucauuugcaggggggag

SEQ ID NO: 189202 - RNA, 22 nt, Human
caggggaagccagcugccaugu

SEQ ID NO: 189203 - RNA, 22 nt, Human
gagaaaaauuucuuugcugcac

SEQ ID NO: 189204 - RNA, 22 nt, Human
gggacugguuguguguggugug

SEQ ID NO: 189205 - RNA, 18 nt, Human
aguaaauguuaaauauug

SEQ ID NO: 189206 - RNA, 22 nt, Human
uguuuccuaagugucucugaag

SEQ ID NO: 189207 - RNA, 21 nt, Human
agaugaggauacugaggccua

SEQ ID NO: 189208 - RNA, 22 nt, Human
uucuaauauuaugauuucuaag

SEQ ID NO: 189209 - RNA, 22 nt, Human
uuggggagaagagcuggucagg

SEQ ID NO: 189210 - RNA, 22 nt, Human
gcccagccucagggcaucagcu

SEQ ID NO: 189211 - RNA, 22 nt, Human
uugccaggggacaucuggagcc

SEQ ID NO: 189212 - RNA, 20 nt, Human
acuagaaagucacugggggg

SEQ ID NO: 189213 - RNA, 22 nt, Human
uucugugacuccucagagauuu

SEQ ID NO: 189214 - RNA, 22 nt, Human
uucagaauuaucauaauuuuga

SEQ ID NO: 189215 - RNA, 22 nt, Human
uaauuccacacucccgcaagcg

SEQ ID NO: 189216 - RNA, 22 nt, Human
ccaggcucaccuggagccccug

SEQ ID NO: 189217 - RNA, 22 nt, Human
ggcugcuauuggucuggcuugg

SEQ ID NO: 189218 - RNA, 22 nt, Human
uuccgcuuucaauggcuuggcu

SEQ ID NO: 189219 - RNA, 22 nt, Human
uggcucaggccuacgacgccuu

SEQ ID NO: 189220 - RNA, 22 nt, Human
acaugugugucugugugugugu

SEQ ID NO: 189221 - RNA, 19 nt, Human
auagcagaagucauuuuca

SEQ ID NO: 189222 - RNA, 22 nt, Human
gcuggccugcgagggcaggcug

SEQ ID NO: 189223 - RNA, 22 nt, Human
cagaaguugcuugagagagagc

SEQ ID NO: 189224 - RNA, 22 nt, Human
uuuacaaggcaguuauuuuccu

SEQ ID NO: 189225 - RNA, 22 nt, Human
uauuuccugcguuucugugagc

SEQ ID NO: 189226 - RNA, 22 nt, Human
augggagggugaggaggcagcu

SEQ ID NO: 189227 - RNA, 20 nt, Human
uccaguuuuggagacauucu

SEQ ID NO: 189228 - RNA, 22 nt, Human
auaaaucaagggcaguauuucc

SEQ ID NO: 189229 - RNA, 18 nt, Human
uucuagaggucucaucca

SEQ ID NO: 189230 - RNA, 20 nt, Human
aauaaauauaacccauaauu

SEQ ID NO: 189231 - RNA, 22 nt, Human
augcuuucucuucuauuucuca

SEQ ID NO: 189232 - RNA, 22 nt, Human
acauuuuaaaaacaguaccugg

SEQ ID NO: 189233 - RNA, 22 nt, Human
acucugcaguaaggaauuguuu

SEQ ID NO: 189234 - RNA, 22 nt, Human
ggaaguggauucagggcugcua

SEQ ID NO: 189235 - RNA, 22 nt, Human
agguuuuugucauuuucuggua

SEQ ID NO: 189236 - RNA, 22 nt, Human
aggugagaacguggaggggcgg

SEQ ID NO: 189237 - RNA, 22 nt, Human
ggugcuucgauagguguccaua

SEQ ID NO: 189238 - RNA, 22 nt, Human
aaauguuugguggauaaaagga

SEQ ID NO: 189239 - RNA, 22 nt, Human
agauaaaucauuuauuaagcgg

SEQ ID NO: 189240 - RNA, 22 nt, Human
cccuguccugcuaggcccuggu

SEQ ID NO: 189241 - RNA, 22 nt, Human
gugcucuagaaauugucagugg

SEQ ID NO: 189242 - RNA, 22 nt, Human
uggcccugaaucaaggccagca

SEQ ID NO: 189243 - RNA, 20 nt, Human
ucagugggaaagugagagug

SEQ ID NO: 189244 - RNA, 22 nt, Human
uguggacaccuauuaccaguga

SEQ ID NO: 189245 - RNA, 22 nt, Human
guguucuuuguagaggaucuug

SEQ ID NO: 189246 - RNA, 22 nt, Human
uagcauuucacugaucuucacu

SEQ ID NO: 189247 - RNA, 22 nt, Human
aaggccuaggaguugacauggg

SEQ ID NO: 189248 - RNA, 22 nt, Human
guuuccaggcuuugguaugguu

SEQ ID NO: 189249 - RNA, 23 nt, Human
uuucugaguuuuuuaaaagucca

SEQ ID NO: 189250 - RNA, 22 nt, Human
aacauuuccggccuuuuguucu

SEQ ID NO: 189251 - RNA, 22 nt, Human
guuuauucuuuuauuugugaga

SEQ ID NO: 189252 - RNA, 22 nt, Human
uaauaaaaauuuaauucacauu

SEQ ID NO: 189253 - RNA, 19 nt, Human
cuuguggcuaugcagauac

SEQ ID NO: 189254 - RNA, 22 nt, Human
auaaaguaaugcauauaaugug

SEQ ID NO: 189255 - RNA, 22 nt, Human
agguggcuaugaggaugcaguc

SEQ ID NO: 189256 - RNA, 22 nt, Human
uuagaaauguccuacuaauaug

SEQ ID NO: 189257 - RNA, 22 nt, Human
uuuccuuuguuuugguauaugu

SEQ ID NO: 189258 - RNA, 17 nt, Human
ucuuuuacuuucucucc

SEQ ID NO: 189259 - RNA, 22 nt, Human
aagaugaguuacaaaggaguaa

SEQ ID NO: 189260 - RNA, 23 nt, Human
cuuauauaaucauuagaaaccau

SEQ ID NO: 189261 - RNA, 22 nt, Human
gaguggccugccccagccaggc

SEQ ID NO: 189262 - RNA, 22 nt, Human
uggagggaagcaaacacuagau

SEQ ID NO: 189263 - RNA, 22 nt, Human
ggggaggugugcaggacaccuc

SEQ ID NO: 189264 - RNA, 22 nt, Human
auguaugagagauucuuuuauu

SEQ ID NO: 189265 - RNA, 18 nt, Human
cccagaggaaugccugga

SEQ ID NO: 189266 - RNA, 17 nt, Human
uuagagcuacauguuga

SEQ ID NO: 189267 - RNA, 22 nt, Human
uuugauuuuguuuauagugccg

SEQ ID NO: 189268 - RNA, 22 nt, Human
gggagggucugagagcugcacc

SEQ ID NO: 189269 - RNA, 22 nt, Human
uaauauaacugccaguuaaggu

SEQ ID NO: 189270 - RNA, 19 nt, Human
agcaucuccacagaaaaag

SEQ ID NO: 189271 - RNA, 23 nt, Human
uuuuccaaaucgacucucuaguu

SEQ ID NO: 189272 - RNA, 22 nt, Human
gugccugcucauucucaauauu

SEQ ID NO: 189273 - RNA, 22 nt, Human
ccagggaggucauagugcuggu

SEQ ID NO: 189274 - RNA, 22 nt, Human
auauuuuacagcucucguugaa

SEQ ID NO: 189275 - RNA, 21 nt, Human
uggcaggcagcuggaagcuug

SEQ ID NO: 189276 - RNA, 22 nt, Human
aaaguaaagccuauuuaauaau

SEQ ID NO: 189277 - RNA, 22 nt, Human
uucucaauggcaacuuguugcu

SEQ ID NO: 189278 - RNA, 22 nt, Human
ugugucuuuggcgaugucugga

SEQ ID NO: 189279 - RNA, 22 nt, Human
aagagggguggucugugaggau

SEQ ID NO: 189280 - RNA, 22 nt, Human
guguuggugagcucauuuccac

SEQ ID NO: 189281 - RNA, 22 nt, Human
uuucuugugauuuugaugaacu

SEQ ID NO: 189282 - RNA, 22 nt, Human
gagcagcugagcuggaaugaga

SEQ ID NO: 189283 - RNA, 19 nt, Human
uagaggagaauggcaaaga

SEQ ID NO: 189284 - RNA, 22 nt, Human
ucuuuuucccugguuccuuuuu

SEQ ID NO: 189285 - RNA, 22 nt, Human
uuuaaaauguuuuauuuauuua

SEQ ID NO: 189286 - RNA, 22 nt, Human
guuuugaugugauuucucaugu

SEQ ID NO: 189287 - RNA, 22 nt, Human
guucuucagcccucagguccua

SEQ ID NO: 189288 - RNA, 22 nt, Human
uuaagagaagaguaucuagaac

SEQ ID NO: 189289 - RNA, 22 nt, Human
auauguuaugccauuuucaagg

SEQ ID NO: 189290 - RNA, 22 nt, Human
guggggguaggggguuuucugg

SEQ ID NO: 189291 - RNA, 22 nt, Human
uuggugauguagcagcaauugu

SEQ ID NO: 189292 - RNA, 22 nt, Human
aaugauuuucugcaaacaguga

SEQ ID NO: 189293 - RNA, 19 nt, Human
caggucuucuuggaggacu

SEQ ID NO: 189294 - RNA, 22 nt, Human
ucgagcucagcagggaggugcg

SEQ ID NO: 189295 - RNA, 22 nt, Human
gaaacauuuguugaguacuugc

SEQ ID NO: 189296 - RNA, 22 nt, Human
aggcauauaguguuuaaaaaaa

SEQ ID NO: 189297 - RNA, 22 nt, Human
caugcuaacacguugcucaccg

SEQ ID NO: 189298 - RNA, 22 nt, Human
gcucagccuuuuguucuauuca

SEQ ID NO: 189299 - RNA, 22 nt, Human
cauuucaaacaguuacagcugc

SEQ ID NO: 189300 - RNA, 22 nt, Human
ccuuucuaacagauuguggauc

SEQ ID NO: 189301 - RNA, 22 nt, Human
ugguggcuuuucguagguucac

SEQ ID NO: 189302 - RNA, 20 nt, Human
ucaucuuucaaauuugugac

SEQ ID NO: 189303 - RNA, 20 nt, Human
uucucugcagcaggcggccc

SEQ ID NO: 189304 - RNA, 22 nt, Human
agcugacagugcauggagggac

SEQ ID NO: 189305 - RNA, 22 nt, Human
gugguuuagccuucauuaaccu

SEQ ID NO: 189306 - RNA, 22 nt, Human
cagaccuggaaaacaggcuugc

SEQ ID NO: 189307 - RNA, 22 nt, Human
uuuuagaagcauuuaugagauu

SEQ ID NO: 189308 - RNA, 22 nt, Human
auuuauuuucccucaaguaccu

SEQ ID NO: 189309 - RNA, 22 nt, Human
cagggcagaguuaagaugcugg

SEQ ID NO: 189310 - RNA, 22 nt, Human
aagccucaugccagauccaggu

SEQ ID NO: 189311 - RNA, 22 nt, Human
ugaauuuuggcaauuuucugug

SEQ ID NO: 189312 - RNA, 22 nt, Human
ucuucaaauacagucauauuga

SEQ ID NO: 189313 - RNA, 22 nt, Human
guuauuguuauugcguugucga

SEQ ID NO: 189314 - RNA, 19 nt, Human
uggugcgcuguuccugagc

SEQ ID NO: 189315 - RNA, 22 nt, Human
uauuuguauugucuuaucacuu

SEQ ID NO: 189316 - RNA, 22 nt, Human
uuuacuuuugguaaggucauuu

SEQ ID NO: 189317 - RNA, 22 nt, Human
aggauggaaguaacuggauaau

SEQ ID NO: 189318 - RNA, 22 nt, Human
auuuaaaaacugguacaacagg

SEQ ID NO: 189319 - RNA, 22 nt, Human
uuugaagaaacagucuuaagag

SEQ ID NO: 189320 - RNA, 22 nt, Human
agauggggccugaggacacugu

SEQ ID NO: 189321 - RNA, 22 nt, Human
aaauauuugaaugguguaagau

SEQ ID NO: 189322 - RNA, 22 nt, Human
cuggaagcgucggaggaagggc

SEQ ID NO: 189323 - RNA, 22 nt, Human
agcaaaauuccaaaaugcuaau

SEQ ID NO: 189324 - RNA, 22 nt, Human
cuccacagccccuccaguggca

SEQ ID NO: 189325 - RNA, 22 nt, Human
auggagugggaggacaugaagg

SEQ ID NO: 189326 - RNA, 22 nt, Human
uggagcugguucuggggaagcu

SEQ ID NO: 189327 - RNA, 22 nt, Human
guuuucuuguuaauuuugaacg

SEQ ID NO: 189328 - RNA, 22 nt, Human
uucacugugauguuuaagagaa

SEQ ID NO: 189329 - RNA, 22 nt, Human
aaggggaauaguaggaccuggg

SEQ ID NO: 189330 - RNA, 22 nt, Human
auuguuuugugaaacauaguga

SEQ ID NO: 189331 - RNA, 22 nt, Human
aaaauaauauuauaccacugcu

SEQ ID NO: 189332 - RNA, 22 nt, Human
ucagcucacaauguugagaaag

SEQ ID NO: 189333 - RNA, 20 nt, Human
cucuuucugcuuuaugccuc

SEQ ID NO: 189334 - RNA, 22 nt, Human
gccagggcucgagcaggccagc

SEQ ID NO: 189335 - RNA, 22 nt, Salmonella enterica enterica serovar Typhi
auggcggcuccgccuuauccgg

SEQ ID NO: 189336 - RNA, 22 nt, Salmonella enterica enterica serovar Typhi
cugauuaucccguguccugucc

SEQ ID NO: 189337 - RNA, 22 nt, Salmonella enterica enterica serovar Typhi
cuguguccugugcgguaaucug

SEQ ID NO: 189338 - RNA, 22 nt, Salmonella enterica enterica serovar Typhi
aggcgaucguugaucauguucc

SEQ ID NO: 189339 - RNA, 22 nt, Salmonella enterica enterica serovar Typhi
ugcugagucucaguuaugugcu

SEQ ID NO: 189340 - RNA, 22 nt, Salmonella enterica enterica serovar Typhi
uucgcgauggugcuggcgaucg

SEQ ID NO: 189341 - RNA, 22 nt, Salmonella enterica enterica serovar Typhi
ccagccagugcgcuaauacuau

SEQ ID NO: 189342 - RNA, 22 nt, Salmonella enterica enterica serovar Typhi
gccguggaaaagcucggggcgu

SEQ ID NO: 189343 - RNA, 22 nt, Salmonella enterica enterica serovar Typhi
auuggacuugccgggauuauuc

SEQ ID NO: 189344 - RNA, 22 nt, Salmonella enterica enterica serovar Typhi
uaguugccgccguuuugccgcu

SEQ ID NO: 189345 - RNA, 23 nt, Salmonella enterica enterica serovar Typhi
uggcugucauagggcugaucgcc

SEQ ID NO: 189346 - RNA, 22 nt, Salmonella enterica enterica serovar Typhi
cguccgaaaaaguguuagaucg

SEQ ID NO: 189347 - RNA, 22 nt, Salmonella enterica enterica serovar Typhi
cgugaacaaacugcuguuucuc

SEQ ID NO: 189348 - RNA, 20 nt, Salmonella enterica enterica serovar Typhi
gcgcacuuuaaucgccauga

SEQ ID NO: 189349 - RNA, 22 nt, Salmonella enterica enterica serovar Typhi
auugcaccaauguggugcuuaa

SEQ ID NO: 189350 - RNA, 22 nt, Salmonella enterica enterica serovar Typhi
auguugagcagcuuucgcuguu

SEQ ID NO: 189351 - RNA, 22 nt, Salmonella enterica enterica serovar Typhi
gcuggcagaagaaauggcagac

SEQ ID NO: 189352 - RNA, 22 nt, Salmonella enterica enterica serovar Typhi
cgugaugaagucgccgcgggcc

SEQ ID NO: 189353 - RNA, 22 nt, Salmonella enterica enterica serovar Typhi
aucaggcgguaguaucagggaa

SEQ ID NO: 189354 - RNA, 22 nt, Salmonella enterica enterica serovar Typhi
ggaaccauuuugacuuuacgaa

SEQ ID NO: 189355 - RNA, 22 nt, Salmonella enterica enterica serovar Typhi
uggcgagagaccuucgcaacug

SEQ ID NO: 189356 - RNA, 18 nt, Salmonella enterica enterica serovar Typhi
acccgcugaugccggugu

SEQ ID NO: 189357 - RNA, 22 nt, Salmonella enterica enterica serovar Typhi
uguaggccggauaagcauuagc

SEQ ID NO: 189358 - RNA, 23 nt, Salmonella enterica enterica serovar Typhi
acgcggaacacguuaaccagcuc

SEQ ID NO: 189359 - RNA, 22 nt, Salmonella enterica enterica serovar Typhi
agaugcggcuucagguuaauuu

SEQ ID NO: 189360 - RNA, 22 nt, Salmonella enterica enterica serovar Typhi
augacgguaacauuuuguuggc

SEQ ID NO: 189361 - RNA, 22 nt, Salmonella enterica enterica serovar Typhi
gcggauuguucagguacaggua

SEQ ID NO: 189362 - RNA, 22 nt, Salmonella enterica enterica serovar Typhi
cuggcggaugcguuagggaugg

SEQ ID NO: 189363 - RNA, 22 nt, Salmonella enterica enterica serovar Typhi
gugguuaacgaggaaaauaaua

SEQ ID NO: 189364 - RNA, 21 nt, Salmonella enterica enterica serovar Typhi
aucgcccuaugaugccgagga

SEQ ID NO: 189365 - RNA, 22 nt, Salmonella enterica enterica serovar Typhi
uaccguucccgccuauuucgau

SEQ ID NO: 189366 - RNA, 22 nt, Salmonella enterica enterica serovar Typhi
uauugucggccuggugcuguug

SEQ ID NO: 189367 - RNA, 22 nt, Salmonella enterica enterica serovar Typhi
cacguuaucuauuuguauggcu

SEQ ID NO: 189368 - RNA, 22 nt, Salmonella enterica enterica serovar Typhi
aaggccaucacuucccggacgu

SEQ ID NO: 189369 - RNA, 22 nt, Salmonella enterica enterica serovar Typhi
aagcugauccugcaaagaagaa

SEQ ID NO: 189370 - RNA, 22 nt, Salmonella enterica enterica serovar Typhi
ugaugcgcuguguucgcguuau

SEQ ID NO: 189371 - RNA, 22 nt, Salmonella enterica enterica serovar Typhi
gaccggaaauagucggcauacg

SEQ ID NO: 189372 - RNA, 22 nt, Salmonella enterica enterica serovar Typhi
gucugcccgcagacauggucgu

SEQ ID NO: 189373 - RNA, 22 nt, Salmonella enterica enterica serovar Typhi
uuaaugguauccaucaugcggu

SEQ ID NO: 189374 - RNA, 22 nt, Salmonella enterica enterica serovar Typhi
gucugcaucccuacgcgggcaa

SEQ ID NO: 189375 - RNA, 21 nt, Salmonella enterica enterica serovar Typhi
uuauccggccuacaaacccaa

SEQ ID NO: 189376 - RNA, 22 nt, Salmonella enterica enterica serovar Typhi
ggcagaccauuuucugcggcgu

SEQ ID NO: 189377 - RNA, 22 nt, Salmonella enterica enterica serovar Typhi
acaguaguuaaauguagaggga

SEQ ID NO: 189378 - RNA, 22 nt, Salmonella enterica enterica serovar Typhi
cgaacguacuaacgucaccggc

SEQ ID NO: 189379 - RNA, 19 nt, Salmonella enterica enterica serovar Typhi
uuugacgauugcuuuacca

SEQ ID NO: 189380 - RNA, 22 nt, Salmonella enterica enterica serovar Typhi
gcaaugacgccggaagugguac

SEQ ID NO: 189381 - RNA, 22 nt, Salmonella enterica enterica serovar Typhi
agugagccgucuggauaucgug

SEQ ID NO: 189382 - RNA, 22 nt, Salmonella enterica enterica serovar Typhi
ugccggaaagacggcagcgcca

SEQ ID NO: 189383 - RNA, 22 nt, Salmonella enterica enterica serovar Typhi
gcucacgguaacucauugcgug

SEQ ID NO: 189384 - RNA, 22 nt, Salmonella enterica enterica serovar Typhi
uaucgccgucgugaugggagcg

SEQ ID NO: 189385 - RNA, 22 nt, Salmonella enterica enterica serovar Typhi
ugguaccguuaugacgaucugc

SEQ ID NO: 189386 - RNA, 22 nt, Salmonella enterica enterica serovar Typhi
acaggcagcuuaaagcgcuguu

SEQ ID NO: 189387 - RNA, 22 nt, Salmonella enterica enterica serovar Typhi
ucgcggcugaggucguuuaugg

SEQ ID NO: 189388 - RNA, 22 nt, Salmonella enterica enterica serovar Typhi
cgcggacuucuaguccggcuug

SEQ ID NO: 189389 - RNA, 22 nt, Salmonella enterica enterica serovar Typhi
uggcgcaguuggaauuccgccg

SEQ ID NO: 189390 - RNA, 22 nt, Salmonella enterica enterica serovar Typhi
uggucagggauauaugccgguu

SEQ ID NO: 189391 - RNA, 22 nt, Salmonella enterica enterica serovar Typhi
guccgcuauuggcacagaccug

SEQ ID NO: 189392 - RNA, 22 nt, Salmonella enterica enterica serovar Typhi
auggcggcuucgccuuauccgg

SEQ ID NO: 189393 - RNA, 22 nt, Salmonella enterica enterica serovar Typhi
augucgcuaaagcccggcacca

SEQ ID NO: 189394 - RNA, 22 nt, Salmonella enterica enterica serovar Typhi
gaucagcuuaaagggauuauca

SEQ ID NO: 189395 - RNA, 22 nt, Salmonella enterica enterica serovar Typhi
cggguugccagcacuacggcag

SEQ ID NO: 189396 - RNA, 22 nt, Salmonella enterica enterica serovar Typhi
gccuucgcgauccagccagacg

SEQ ID NO: 189397 - RNA, 22 nt, Salmonella enterica enterica serovar Typhi
caggcgauuacgcgcgaacgaa

SEQ ID NO: 189398 - RNA, 22 nt, Salmonella enterica enterica serovar Typhi
cuacguuuaccuggccuacaga

SEQ ID NO: 189399 - RNA, 22 nt, Salmonella enterica enterica serovar Typhi
agcaggguuucugaauuugguc

SEQ ID NO: 189400 - RNA, 22 nt, Salmonella enterica enterica serovar Typhi
cuuaccgguaugacgcgcuaaa

SEQ ID NO: 189401 - RNA, 22 nt, Salmonella enterica enterica serovar Typhi
ccugaucccgaugguggauuuu

SEQ ID NO: 189402 - RNA, 22 nt, Salmonella enterica enterica serovar Typhi
gauggcggaggucaggccuucc

SEQ ID NO: 189403 - RNA, 22 nt, Salmonella enterica enterica serovar Typhi
ucacgcuuuuuccugacccuga

SEQ ID NO: 189404 - RNA, 22 nt, Salmonella enterica enterica serovar Typhi
auugccggauggcgccguaggc

SEQ ID NO: 189405 - RNA, 22 nt, Salmonella enterica enterica serovar Typhi
ugaccugcggcaguaucccaga

SEQ ID NO: 189406 - RNA, 22 nt, Salmonella enterica enterica serovar Typhi
gaucgcuaaaacguuuuuaugu

SEQ ID NO: 189407 - RNA, 22 nt, Salmonella enterica enterica serovar Typhi
augugcaguuugcgaucgaauu

SEQ ID NO: 189408 - RNA, 22 nt, Salmonella enterica enterica serovar Typhi
agccggucuguucauucugugu

SEQ ID NO: 189409 - RNA, 22 nt, Salmonella enterica enterica serovar Typhi
augccgcgucgcuuagugauua

SEQ ID NO: 189410 - RNA, 19 nt, Salmonella enterica enterica serovar Typhi
agcaggauaaguucauuag

SEQ ID NO: 189411 - RNA, 22 nt, Salmonella enterica enterica serovar Typhi
acgaugagaaugcugggagaag

SEQ ID NO: 189412 - RNA, 22 nt, Salmonella enterica enterica serovar Typhi
gaagcaacgguaagguagguuu

SEQ ID NO: 189413 - RNA, 22 nt, Salmonella enterica enterica serovar Typhi
uaaauggguaauaaguauugau

SEQ ID NO: 189414 - RNA, 22 nt, Salmonella enterica enterica serovar Typhi
gcgguaauuuaagcggcaaucc

SEQ ID NO: 189415 - RNA, 22 nt, Salmonella enterica enterica serovar Typhi
agcgacuucagugccaguacug

SEQ ID NO: 189416 - RNA, 22 nt, Salmonella enterica enterica serovar Typhi
gguucugacggaaacgacccug

SEQ ID NO: 189417 - RNA, 22 nt, Salmonella enterica enterica serovar Typhi
ugcuggacaccgacgauaacug

SEQ ID NO: 189418 - RNA, 22 nt, Salmonella enterica enterica serovar Typhi
cauuucauuaugaccaaacugg

SEQ ID NO: 189419 - RNA, 22 nt, Salmonella enterica enterica serovar Typhi
ggcgucuuccaguggcacgccg

SEQ ID NO: 189420 - RNA, 22 nt, Salmonella enterica enterica serovar Typhi
aggguaucagcagggcaggcuu

SEQ ID NO: 189421 - RNA, 22 nt, Salmonella enterica enterica serovar Typhi
ccggucucccgauguaccgcac

SEQ ID NO: 189422 - RNA, 22 nt, Salmonella enterica enterica serovar Typhi
caguugacgguuuuucgccagc

SEQ ID NO: 189423 - RNA, 18 nt, Salmonella enterica enterica serovar Typhi
gggcugaugcugugggcg

SEQ ID NO: 189424 - RNA, 22 nt, Salmonella enterica enterica serovar Typhi
cguuacgucuguaucugcaccc

SEQ ID NO: 189425 - RNA, 22 nt, Salmonella enterica enterica serovar Typhi
augggcuaucuggacagauuga

SEQ ID NO: 189426 - RNA, 22 nt, Salmonella enterica enterica serovar Typhi
cgcgcgaacuucuucgauguug

SEQ ID NO: 189427 - RNA, 22 nt, Salmonella enterica enterica serovar Typhi
ucuggcgguucuguacggcgcg

SEQ ID NO: 189428 - RNA, 22 nt, Salmonella enterica enterica serovar Typhi
guaucggccuaaaugaucggca

SEQ ID NO: 189429 - RNA, 22 nt, Salmonella enterica enterica serovar Typhi
gccgaucaauaauagaaacgac

SEQ ID NO: 189430 - RNA, 22 nt, Salmonella enterica enterica serovar Typhi
ugcgucuuauccggccuacgga

SEQ ID NO: 189431 - RNA, 22 nt, Salmonella enterica enterica serovar Typhi
gucugaugagcgccggauucug

SEQ ID NO: 189432 - RNA, 22 nt, Salmonella enterica enterica serovar Typhi
cggacgaacuggugccgcuucc

SEQ ID NO: 189433 - RNA, 23 nt, Salmonella enterica enterica serovar Typhi
cgcuggaugauuuuugucagagc

SEQ ID NO: 189434 - RNA, 22 nt, Salmonella enterica enterica serovar Typhi
cugcuguuucucgugaugaagg

SEQ ID NO: 189435 - RNA, 22 nt, Salmonella enterica enterica serovar Typhi
gaucugguucccgcugugcagc

SEQ ID NO: 189436 - RNA, 22 nt, Salmonella enterica enterica serovar Typhi
acgcgugaguguaccauuucca

SEQ ID NO: 189437 - RNA, 21 nt, Salmonella enterica enterica serovar Typhi
aucgucucgaagcgcacguca

SEQ ID NO: 189438 - RNA, 22 nt, Salmonella enterica enterica serovar Typhi
cgguccuggcgaucaaaaccgu

SEQ ID NO: 189439 - RNA, 22 nt, Salmonella enterica enterica serovar Typhi
gcguucugaucugucugcggac

SEQ ID NO: 189440 - RNA, 22 nt, Salmonella enterica enterica serovar Typhi
ugucggucggguaagcgcuagc

SEQ ID NO: 189441 - RNA, 22 nt, Salmonella enterica enterica serovar Typhi
ccgggucugccagccgccguua

SEQ ID NO: 189442 - RNA, 22 nt, Salmonella enterica enterica serovar Typhi
uaucacagccagaaaagggcua

SEQ ID NO: 189443 - RNA, 16 nt, Salmonella enterica enterica serovar Typhi
cggucugaauacgcau

SEQ ID NO: 189444 - RNA, 22 nt, Salmonella enterica enterica serovar Typhi
uggucacccaggaugucgcauu

SEQ ID NO: 189445 - RNA, 22 nt, Salmonella enterica enterica serovar Typhi
ugauaucuggcccagguccgau

SEQ ID NO: 189446 - RNA, 22 nt, Salmonella enterica enterica serovar Typhi
uuagcgccgguauuuuuggcgg

SEQ ID NO: 189447 - RNA, 22 nt, Salmonella enterica enterica serovar Typhi
cagcgcuacgcgcagauaggca

SEQ ID NO: 189448 - RNA, 20 nt, Salmonella enterica enterica serovar Typhi
guacugaugcuucguccguu

SEQ ID NO: 189449 - RNA, 22 nt, Salmonella enterica enterica serovar Typhi
gauuaucugaaaaauccggccu

SEQ ID NO: 189450 - RNA, 22 nt, Salmonella enterica enterica serovar Typhi
ugcgcuuauccggucuacguaa

SEQ ID NO: 189451 - RNA, 22 nt, Salmonella enterica enterica serovar Typhi
uggcggcaauggcgauagauuu

SEQ ID NO: 189452 - RNA, 22 nt, Salmonella enterica enterica serovar Typhi
uuccaggcuucuauguuggcuu

SEQ ID NO: 189453 - RNA, 22 nt, Salmonella enterica enterica serovar Typhi
gacagcgcuucccugcuggugg

SEQ ID NO: 189454 - RNA, 22 nt, Salmonella enterica enterica serovar Typhi
uaucaagucugaagcgaaaacu

SEQ ID NO: 189455 - RNA, 23 nt, Salmonella enterica enterica serovar Typhi
gccauggcgggacacagucuaug

SEQ ID NO: 189456 - RNA, 20 nt, Salmonella enterica enterica serovar Typhi
ggacggauugaccgucgucg

SEQ ID NO: 189457 - RNA, 22 nt, Salmonella enterica enterica serovar Typhi
cgagugucugagaucagcgugg

SEQ ID NO: 189458 - RNA, 22 nt, Salmonella enterica enterica serovar Typhi
cgcguuguuaacgaaagcgcug

SEQ ID NO: 189459 - RNA, 18 nt, Salmonella enterica enterica serovar Typhi
aacugggcgucaggcaac

SEQ ID NO: 189460 - RNA, 22 nt, Salmonella enterica enterica serovar Typhi
gaugauggcaaugguauuccua

SEQ ID NO: 189461 - RNA, 22 nt, Salmonella enterica enterica serovar Typhi
gcgcuacgauuauccgcccuac

SEQ ID NO: 189462 - RNA, 22 nt, Salmonella enterica enterica serovar Typhi
gacaacuggauagccgugugga

SEQ ID NO: 189463 - RNA, 22 nt, Salmonella enterica enterica serovar Typhi
ucgcuaucaggaugaggaccgc

SEQ ID NO: 189464 - RNA, 22 nt, Salmonella enterica enterica serovar Typhi
guugcagacuguccagacgccc

SEQ ID NO: 189465 - RNA, 22 nt, Salmonella enterica enterica serovar Typhi
aucugcgcaacuggaagcgauc

SEQ ID NO: 189466 - RNA, 22 nt, Salmonella enterica enterica serovar Typhi
ccgagcguugacugcgcguaga

SEQ ID NO: 189467 - RNA, 22 nt, Salmonella enterica enterica serovar Typhi
acuggcuggaaaguaauacagu

SEQ ID NO: 189468 - RNA, 22 nt, Salmonella enterica enterica serovar Typhi
gccgucuuuaacgagguacugg

SEQ ID NO: 189469 - RNA, 22 nt, Salmonella enterica enterica serovar Typhi
cggcuguaugacgcggugcaau

SEQ ID NO: 189470 - RNA, 22 nt, Salmonella enterica enterica serovar Typhi
gcuuugcggaucaggcccccau

SEQ ID NO: 189471 - RNA, 17 nt, Salmonella enterica enterica serovar Typhi
ucugccugauuaucagg

SEQ ID NO: 189472 - RNA, 22 nt, Salmonella enterica enterica serovar Typhi
cacgcgcugcuucaacauugua

SEQ ID NO: 189473 - RNA, 22 nt, Salmonella enterica enterica serovar Typhi
cugcaagcagcucgaugcguuu

SEQ ID NO: 189474 - RNA, 22 nt, Salmonella enterica enterica serovar Typhi
cugcgauagcugcugacguaga

SEQ ID NO: 189475 - RNA, 22 nt, Salmonella enterica enterica serovar Typhi
uuggcaaugaggcuacauuagu

SEQ ID NO: 189476 - RNA, 22 nt, Salmonella enterica enterica serovar Typhi
augucguaugaugcccguguuc

SEQ ID NO: 189477 - RNA, 22 nt, Salmonella enterica enterica serovar Typhi
gaaucgccacgaucucuaucuc

SEQ ID NO: 189478 - RNA, 22 nt, Salmonella enterica enterica serovar Typhi
caucguuuugauaucgaagcgg

SEQ ID NO: 189479 - RNA, 22 nt, Salmonella enterica enterica serovar Typhi
uaagaugagucgugcgggccug

SEQ ID NO: 189480 - RNA, 22 nt, Salmonella enterica enterica serovar Typhi
ugugaccauuaucgggcaauca

SEQ ID NO: 189481 - RNA, 22 nt, Salmonella enterica enterica serovar Typhi
augcgcuuguugcgucaggcua

SEQ ID NO: 189482 - RNA, 21 nt, Salmonella enterica enterica serovar Typhi
gcgugaugugguucagcgcgc

SEQ ID NO: 189483 - RNA, 22 nt, Salmonella enterica enterica serovar Typhi
gccgguuaucaguuuaucggga

SEQ ID NO: 189484 - RNA, 22 nt, Salmonella enterica enterica serovar Typhi
auggugaacggcaggaaauggu

SEQ ID NO: 189485 - RNA, 22 nt, Salmonella enterica enterica serovar Typhi
gcuagcgcuuaccgggccuaca

SEQ ID NO: 189486 - RNA, 22 nt, Salmonella enterica enterica serovar Typhi
acuucuaccaugcgcucgguuu

SEQ ID NO: 189487 - RNA, 22 nt, Salmonella enterica enterica serovar Typhi
augugaauuacguugcgauagg

SEQ ID NO: 189488 - RNA, 22 nt, Salmonella enterica enterica serovar Typhi
aaagcguaggccugauaagcgc

SEQ ID NO: 189489 - RNA, 21 nt, Salmonella enterica enterica serovar Typhi
ccguggcuuuauccgcgucga

SEQ ID NO: 189490 - RNA, 22 nt, Salmonella enterica enterica serovar Typhi
cagaugccugauccagacgaau

SEQ ID NO: 189491 - RNA, 22 nt, Salmonella enterica enterica serovar Typhi
ucccugauaaaacaguaacggc

SEQ ID NO: 189492 - RNA, 22 nt, Salmonella enterica enterica serovar Typhi
aggucgccauccggcaaaaugu

SEQ ID NO: 189493 - RNA, 22 nt, Salmonella enterica enterica serovar Typhi
uggcacugcuccagcuuuaccu

SEQ ID NO: 189494 - RNA, 22 nt, Salmonella enterica enterica serovar Typhi
auggcguuguauuauugagguu

SEQ ID NO: 189495 - RNA, 22 nt, Salmonella enterica enterica serovar Typhi
ugggaucaccuugaucaaguac

SEQ ID NO: 189496 - RNA, 22 nt, Salmonella enterica enterica serovar Typhi
augugcaugacagacgagaaug

SEQ ID NO: 189497 - RNA, 22 nt, Salmonella enterica enterica serovar Typhi
uccggcgucauggggcgcaggc

SEQ ID NO: 189498 - RNA, 22 nt, Salmonella enterica enterica serovar Typhi
gcgaugcgguucaucaacguua

SEQ ID NO: 189499 - RNA, 22 nt, Salmonella enterica enterica serovar Typhi
ucuguaggcccgguaagcguca

SEQ ID NO: 189500 - RNA, 22 nt, Salmonella enterica enterica serovar Typhi
acuuucuggcccacuucgauga

SEQ ID NO: 189501 - RNA, 22 nt, Salmonella enterica enterica serovar Typhi
guaaugaugccuugcugugccg

SEQ ID NO: 189502 - RNA, 22 nt, Salmonella enterica enterica serovar Typhi
uaucguucagcuucuaugcuaa

SEQ ID NO: 189503 - RNA, 22 nt, Salmonella enterica enterica serovar Typhi
gucggaguaggccagauacgcc

SEQ ID NO: 189504 - RNA, 22 nt, Salmonella enterica enterica serovar Typhi
uuggccucagauuaauguuaag

SEQ ID NO: 189505 - RNA, 22 nt, Salmonella enterica enterica serovar Typhi
cagauagcgccggaaaugauug

SEQ ID NO: 189506 - RNA, 22 nt, Salmonella enterica enterica serovar Typhi
guggcggauauggguuaugaca

SEQ ID NO: 189507 - RNA, 18 nt, Salmonella enterica enterica serovar Typhi
gcggauaagcgcagcgcc

SEQ ID NO: 189508 - RNA, 22 nt, Salmonella enterica enterica serovar Typhi
gcgcgguuugaugaucuccacc

SEQ ID NO: 189509 - RNA, 22 nt, Salmonella enterica enterica serovar Typhi
acgguauuucauucacagugug

SEQ ID NO: 189510 - RNA, 22 nt, Salmonella enterica enterica serovar Typhi
gggaaacuggugcgacggcgua

SEQ ID NO: 189511 - RNA, 22 nt, Salmonella enterica enterica serovar Typhi
ucagcgcuuucacuuccugguc

SEQ ID NO: 189512 - RNA, 22 nt, Salmonella enterica enterica serovar Typhi
agcgacagggucuguugugaag

SEQ ID NO: 189513 - RNA, 22 nt, Salmonella enterica enterica serovar Typhi
uuugcuaacuacugucuggcgg

SEQ ID NO: 189514 - RNA, 22 nt, Salmonella enterica enterica serovar Typhi
gcuacgccuuacccgaccuaca

SEQ ID NO: 189515 - RNA, 22 nt, Salmonella enterica enterica serovar Typhi
uaagagauaaagaccgaggcga

SEQ ID NO: 189516 - RNA, 22 nt, Salmonella enterica enterica serovar Typhi
aacuucaccauggaagauuaua

SEQ ID NO: 189517 - RNA, 22 nt, Salmonella enterica enterica serovar Typhi
uuccggcgucauugccguggau

SEQ ID NO: 189518 - RNA, 22 nt, Salmonella enterica enterica serovar Typhi
ggccuacaagaauuuaucgcaa

SEQ ID NO: 189519 - RNA, 23 nt, Salmonella enterica enterica serovar Typhi
agcuuguugaugucgcggcgcgc

SEQ ID NO: 189520 - RNA, 22 nt, Salmonella enterica enterica serovar Typhi
agugauuauuacgcagcauaug

SEQ ID NO: 189521 - RNA, 22 nt, Salmonella enterica enterica serovar Typhi
auccgcguuuauugauaugccg

SEQ ID NO: 189522 - RNA, 22 nt, Salmonella enterica enterica serovar Typhi
augaugaugcugacguuacugc

SEQ ID NO: 189523 - RNA, 22 nt, Salmonella enterica enterica serovar Typhi
aagcuuaauaagacagguucug

SEQ ID NO: 189524 - RNA, 21 nt, Salmonella enterica enterica serovar Typhi
auuagccguuuuuuugcaugg

SEQ ID NO: 189525 - RNA, 22 nt, Salmonella enterica enterica serovar Typhi
agcgaguuuaccccacuuacua

SEQ ID NO: 189526 - RNA, 22 nt, Salmonella enterica enterica serovar Typhi
cagucguaagcgacggcugguu

SEQ ID NO: 189527 - RNA, 22 nt, Salmonella enterica enterica serovar Typhi
caggacugaaggagcugauugu

SEQ ID NO: 189528 - RNA, 21 nt, Salmonella enterica enterica serovar Typhi
ugacgcgcgcccuggcuuauc

SEQ ID NO: 189529 - RNA, 22 nt, Salmonella enterica enterica serovar Typhi
ugccgauuuuggucccggcggc

SEQ ID NO: 189530 - RNA, 22 nt, Salmonella enterica enterica serovar Typhi
gauguauaucguuugcuauaca

SEQ ID NO: 189531 - RNA, 22 nt, Salmonella enterica enterica serovar Typhi
gcgcgauugauaugaauauauu

SEQ ID NO: 189532 - RNA, 22 nt, Salmonella enterica enterica serovar Typhi
cucauuuagcgcucgcguuuug

SEQ ID NO: 189533 - RNA, 21 nt, Salmonella enterica enterica serovar Typhi
gccgaugcaaaugcugccagu

SEQ ID NO: 189534 - RNA, 22 nt, Salmonella enterica enterica serovar Typhi
uuacgcgggcaacgagcacaac

SEQ ID NO: 189535 - RNA, 22 nt, Salmonella enterica enterica serovar Typhi
auggcgauuucauagcccgcuu

SEQ ID NO: 189536 - RNA, 22 nt, Salmonella enterica enterica serovar Typhi
guguuacgccuuauccggccua

SEQ ID NO: 189537 - RNA, 22 nt, Salmonella enterica enterica serovar Typhi
gaaccgugaguucgcggcagua

SEQ ID NO: 189538 - RNA, 22 nt, Salmonella enterica enterica serovar Typhi
aacagaucgacacgcacaauau

SEQ ID NO: 189539 - RNA, 22 nt, Salmonella enterica enterica serovar Typhi
gaugggcuguuuaaggaaaccu

SEQ ID NO: 189540 - RNA, 22 nt, Salmonella enterica enterica serovar Typhi
aaauguacagaauacguggaua

SEQ ID NO: 189541 - RNA, 22 nt, Salmonella enterica enterica serovar Typhi
cgcggauaaaaugacgcuggcg

SEQ ID NO: 189542 - RNA, 22 nt, Salmonella enterica enterica serovar Typhi
cggaggauauuuauuuuaugcg

SEQ ID NO: 189543 - RNA, 22 nt, Salmonella enterica enterica serovar Typhi
ugcuguucgugguauggucaac

SEQ ID NO: 189544 - RNA, 22 nt, Salmonella enterica enterica serovar Typhi
caccgguguccuggcaggaagg

SEQ ID NO: 189545 - RNA, 22 nt, Salmonella enterica enterica serovar Typhi
gcgguugcugcugcgguugaag

SEQ ID NO: 189546 - RNA, 22 nt, Salmonella enterica enterica serovar Typhi
cagcuuccagcagcaguugucg

SEQ ID NO: 189547 - RNA, 22 nt, Salmonella enterica enterica serovar Typhi
cagcgguauugacgugauggcu

SEQ ID NO: 189548 - RNA, 22 nt, Salmonella enterica enterica serovar Typhi
auguggucgauaucuucauuac

SEQ ID NO: 189549 - RNA, 17 nt, Salmonella enterica enterica serovar Typhi
cgcauauucucgaagug

SEQ ID NO: 189550 - RNA, 22 nt, Salmonella enterica enterica serovar Typhi
aucgguugauuaacggugguau

SEQ ID NO: 189551 - RNA, 22 nt, Salmonella enterica enterica serovar Typhi
agcgccgucuacaaaaaagccc

SEQ ID NO: 189552 - RNA, 22 nt, Salmonella enterica enterica serovar Typhi
aucgcucuauaaucguuguaua

SEQ ID NO: 189553 - RNA, 22 nt, Salmonella enterica enterica serovar Typhi
ugcaaccuuuuuaugcgcgguu

SEQ ID NO: 189554 - RNA, 22 nt, Salmonella enterica enterica serovar Typhi
ggcaguugcugagcgcguugau

SEQ ID NO: 189555 - RNA, 22 nt, Salmonella enterica enterica serovar Typhi
acaggccgcgccauccggcacg

SEQ ID NO: 189556 - RNA, 22 nt, Salmonella enterica enterica serovar Typhi
gugguuaaucaacgugacuucg

SEQ ID NO: 189557 - RNA, 22 nt, Salmonella enterica enterica serovar Typhi
auucgcgcaucgcgucgagcag

SEQ ID NO: 189558 - RNA, 22 nt, Salmonella enterica enterica serovar Typhi
aacgccaugaucaucggcaccg

SEQ ID NO: 189559 - RNA, 22 nt, Salmonella enterica enterica serovar Typhi
cgguugaaaccuuacagcgccu

SEQ ID NO: 189560 - RNA, 22 nt, Salmonella enterica enterica serovar Typhi
ccgcgcuuugggggagugcaac

SEQ ID NO: 189561 - RNA, 22 nt, Salmonella enterica enterica serovar Typhi
caacagguucgguuguacaguc

SEQ ID NO: 189562 - RNA, 22 nt, Salmonella enterica enterica serovar Typhi
ugcgcagcgccggagacgaaga

SEQ ID NO: 189563 - RNA, 23 nt, Salmonella enterica enterica serovar Typhi
accugcugauggcggcagccguc

SEQ ID NO: 189564 - RNA, 22 nt, Salmonella enterica enterica serovar Typhi
gcgaauaauggagauauucuga

SEQ ID NO: 189565 - RNA, 22 nt, Salmonella enterica enterica serovar Typhi
auggucgucgucauggugguga

SEQ ID NO: 189566 - RNA, 22 nt, Salmonella enterica enterica serovar Typhi
ucagaccuucuucgauuucgcg

SEQ ID NO: 189567 - RNA, 22 nt, Salmonella enterica enterica serovar Typhi
ucaguaauauugaugagcgcgu

SEQ ID NO: 189568 - RNA, 22 nt, Salmonella enterica enterica serovar Typhi
uuguucaaaguguaguaacguu

SEQ ID NO: 189569 - RNA, 22 nt, Salmonella enterica enterica serovar Typhi
agcggguuuuaccauuaccgau

SEQ ID NO: 189570 - RNA, 22 nt, Salmonella enterica enterica serovar Typhi
caugucgauuuugcgccuaaua

SEQ ID NO: 189571 - RNA, 22 nt, Salmonella enterica enterica serovar Typhi
gcuucguauauggcgcguaucg

SEQ ID NO: 189572 - RNA, 23 nt, Salmonella enterica enterica serovar Typhi
uaacugaggggauuaugaccuuc

SEQ ID NO: 189573 - RNA, 22 nt, Salmonella enterica enterica serovar Typhi
gcaguguuauggguuauuuugu

SEQ ID NO: 189574 - RNA, 22 nt, Salmonella enterica enterica serovar Typhi
acuguucaaucugcgucucgcc

SEQ ID NO: 189575 - RNA, 22 nt, Salmonella enterica enterica serovar Typhi
gcacgcuaugguacggcguguu

SEQ ID NO: 189576 - RNA, 22 nt, Salmonella enterica enterica serovar Typhi
augguucgacgagcgcggcauc

SEQ ID NO: 189577 - RNA, 22 nt, Salmonella enterica enterica serovar Typhi
cugcgucaggguggggcgaaua

SEQ ID NO: 189578 - RNA, 22 nt, Salmonella enterica enterica serovar Typhi
aaccuucagacucaugguagaa

SEQ ID NO: 189579 - RNA, 22 nt, Salmonella enterica enterica serovar Typhi
uugcugauacggcgaaucgcuu

SEQ ID NO: 189580 - RNA, 22 nt, Salmonella enterica enterica serovar Typhi
aguccagggcaaaggugugguu

SEQ ID NO: 189581 - RNA, 22 nt, Salmonella enterica enterica serovar Typhi
gguacugccagaggucugacgg

SEQ ID NO: 189582 - RNA, 22 nt, Salmonella enterica enterica serovar Typhi
gaugcuggauaaauauuucgau

SEQ ID NO: 189583 - RNA, 22 nt, Salmonella enterica enterica serovar Typhi
acagauuaugcgucauucgcua

SEQ ID NO: 189584 - RNA, 22 nt, Salmonella enterica enterica serovar Typhi
aguuccugcgcgccgaugaauc

SEQ ID NO: 189585 - RNA, 22 nt, Salmonella enterica enterica serovar Typhi
aguaauccucugaaacuucggg

SEQ ID NO: 189586 - RNA, 22 nt, Salmonella enterica enterica serovar Typhi
guggaagccggauuacuggcgc

SEQ ID NO: 189587 - RNA, 22 nt, Salmonella enterica enterica serovar Typhi
uugcaccaaaauagugcuucaa

SEQ ID NO: 189588 - RNA, 22 nt, Salmonella enterica enterica serovar Typhi
ugauacugaggauuuucgcguu

SEQ ID NO: 189589 - RNA, 22 nt, Salmonella enterica enterica serovar Typhi
uuuaucugcggggacguuaugg

SEQ ID NO: 189590 - RNA, 20 nt, Salmonella enterica enterica serovar Typhi
auggcguuaucagccgcgcu

SEQ ID NO: 189591 - RNA, 22 nt, Salmonella enterica enterica serovar Typhi
cugcgguucaggccaguuguua

SEQ ID NO: 189592 - RNA, 22 nt, Salmonella enterica enterica serovar Typhi
uugacggcggcuaaaggcguau

SEQ ID NO: 189593 - RNA, 22 nt, Salmonella enterica enterica serovar Typhi
uacaauguugaagcagcgcgug

SEQ ID NO: 189594 - RNA, 22 nt, Salmonella enterica enterica serovar Typhi
gccgccaucagcagguugauca

SEQ ID NO: 189595 - RNA, 20 nt, Salmonella enterica enterica serovar Typhi
ucugaagcagugcgugguaa

SEQ ID NO: 189596 - RNA, 22 nt, Salmonella enterica enterica serovar Typhi
uccgggaucgccuccagcagca

SEQ ID NO: 189597 - RNA, 19 nt, Salmonella enterica enterica serovar Typhi
cgguuacugggauagagac

SEQ ID NO: 189598 - RNA, 22 nt, Salmonella enterica enterica serovar Typhi
uccagcaaaaaucuuucuuugg

SEQ ID NO: 189599 - RNA, 22 nt, Salmonella enterica enterica serovar Typhi
augaccgccggugaaaucgcug

SEQ ID NO: 189600 - RNA, 22 nt, Salmonella enterica enterica serovar Typhi
gucccguuacccuuuuucaggu

SEQ ID NO: 189601 - RNA, 22 nt, Salmonella enterica enterica serovar Typhi
uacgcauauggcggaucuggau

SEQ ID NO: 189602 - RNA, 22 nt, Salmonella enterica enterica serovar Typhi
uucagugguaacggugucauug

SEQ ID NO: 189603 - RNA, 22 nt, Salmonella enterica enterica serovar Typhi
cccuugcgucaugaaaacgacg

SEQ ID NO: 189604 - RNA, 22 nt, Salmonella enterica enterica serovar Typhi
ggcuacaacgccauugccgccg

SEQ ID NO: 189605 - RNA, 19 nt, Salmonella enterica enterica serovar Typhi
agcgcuguacugauugcgu

SEQ ID NO: 189606 - RNA, 22 nt, Salmonella enterica enterica serovar Typhi
agugaucagcguguuuuuguug

SEQ ID NO: 189607 - RNA, 22 nt, Salmonella enterica enterica serovar Typhi
gauggcauuuuugucggcccua

SEQ ID NO: 189608 - RNA, 22 nt, Salmonella enterica enterica serovar Typhi
gcgguagaagacaaugguugaa

SEQ ID NO: 189609 - RNA, 22 nt, Salmonella enterica enterica serovar Typhi
gggacguuauaagcuggcagac

SEQ ID NO: 189610 - RNA, 23 nt, Salmonella enterica enterica serovar Typhi
cgcaauuuacucucagucgcggc

SEQ ID NO: 189611 - RNA, 22 nt, Salmonella enterica enterica serovar Typhi
ugcgccucaaccgcuuucgccu

SEQ ID NO: 189612 - RNA, 18 nt, Salmonella enterica enterica serovar Typhi
uguggcgccugcagcguc

SEQ ID NO: 189613 - RNA, 22 nt, Salmonella enterica enterica serovar Typhi
ccacgauauuaccggucaucau

SEQ ID NO: 189614 - RNA, 23 nt, Salmonella enterica enterica serovar Typhi
ucgugcugccagcggacaaaugu

SEQ ID NO: 189615 - RNA, 22 nt, Salmonella enterica enterica serovar Typhi
aaguucagcuucagaagcugga

SEQ ID NO: 189616 - RNA, 23 nt, Salmonella enterica enterica serovar Typhi
cggcaaauuuuuaccguggaugu

SEQ ID NO: 189617 - RNA, 22 nt, Salmonella enterica enterica serovar Typhi
auucagaugauugcacacgguu

SEQ ID NO: 189618 - RNA, 22 nt, Salmonella enterica enterica serovar Typhi
auugacgauaucggcauugacg

SEQ ID NO: 189619 - RNA, 22 nt, Salmonella enterica enterica serovar Typhi
ugauugaaaaaaccuggcguau

SEQ ID NO: 189620 - RNA, 22 nt, Salmonella enterica enterica serovar Typhi
cucgcggacgucgaggaucugg

SEQ ID NO: 189621 - RNA, 22 nt, Salmonella enterica enterica serovar Typhi
cucaaugcuaacuacgcgaugg

SEQ ID NO: 189622 - RNA, 20 nt, Salmonella enterica enterica serovar Typhi
acauaauccggguaaagacc

SEQ ID NO: 189623 - RNA, 22 nt, Salmonella enterica enterica serovar Typhi
cagccaucacuauggcguaaaa

SEQ ID NO: 189624 - RNA, 22 nt, Salmonella enterica enterica serovar Typhi
aaguggcugggguacgaggauu

SEQ ID NO: 189625 - RNA, 22 nt, Salmonella enterica enterica serovar Typhi
ugcacgucggcgaagcgccaaa

SEQ ID NO: 189626 - RNA, 22 nt, Salmonella enterica enterica serovar Typhi
cucgugaagauuagcagagcgg

SEQ ID NO: 189627 - RNA, 22 nt, Salmonella enterica enterica serovar Typhi
uuuaugcgccgcaaaugccugc

SEQ ID NO: 189628 - RNA, 22 nt, Salmonella enterica enterica serovar Typhi
cauugaguaacaggugaggggc

SEQ ID NO: 189629 - RNA, 21 nt, Salmonella enterica enterica serovar Typhi
aucgccgguuucugccgcggu

SEQ ID NO: 189630 - RNA, 20 nt, Salmonella enterica enterica serovar Typhi
ugugccgauuauucgcgcua

SEQ ID NO: 189631 - RNA, 22 nt, Salmonella enterica enterica serovar Typhi
uuuacgcaucaucgcgcaacgc

SEQ ID NO: 189632 - RNA, 22 nt, Salmonella enterica enterica serovar Typhi
gcgcgguuggccggugaucguu

SEQ ID NO: 189633 - RNA, 22 nt, Salmonella enterica enterica serovar Typhi
aggcgugaguuuucaauaucgg

SEQ ID NO: 189634 - RNA, 22 nt, Salmonella enterica enterica serovar Typhi
gacgaacauuucguucguuaua

SEQ ID NO: 189635 - RNA, 22 nt, Salmonella enterica enterica serovar Typhi
uggcgcugaugaaacgcauucu

SEQ ID NO: 189636 - RNA, 22 nt, Salmonella enterica enterica serovar Typhi
ugucugaacggagaaaaggugc

SEQ ID NO: 189637 - RNA, 22 nt, Salmonella enterica enterica serovar Typhi
aucgcagauagcaaaaaagcgc

SEQ ID NO: 189638 - RNA, 20 nt, Salmonella enterica enterica serovar Typhi
cgauugauaccuaccguuau

SEQ ID NO: 189639 - RNA, 22 nt, Salmonella enterica enterica serovar Typhi
ucugguuaaucgcgcugggugg

SEQ ID NO: 189640 - RNA, 22 nt, Salmonella enterica enterica serovar Typhi
guggcgcuagcgcuuacccgac

SEQ ID NO: 189641 - RNA, 22 nt, Salmonella enterica enterica serovar Typhi
auugagaaucagucuuccggcg

SEQ ID NO: 189642 - RNA, 22 nt, Salmonella enterica enterica serovar Typhi
aguaccggggauuaccgcggcu

SEQ ID NO: 189643 - RNA, 22 nt, Salmonella enterica enterica serovar Typhi
cguguaggccggauuaggcgcu

SEQ ID NO: 189644 - RNA, 22 nt, Salmonella enterica enterica serovar Typhi
ccguugcgcacuuuuuuaaguu

SEQ ID NO: 189645 - RNA, 22 nt, Salmonella enterica enterica serovar Typhi
uggaucugccuauuuugaaaac

SEQ ID NO: 189646 - RNA, 22 nt, Salmonella enterica enterica serovar Typhi
ucacgccgucacgcguguugcc

SEQ ID NO: 189647 - RNA, 22 nt, Salmonella enterica enterica serovar Typhi
cagauaucgcuaacaguauaua

SEQ ID NO: 189648 - RNA, 22 nt, Salmonella enterica enterica serovar Typhi
acaguuugaucgcaaaggcaug

SEQ ID NO: 189649 - RNA, 22 nt, Salmonella enterica enterica serovar Typhi
ggccugauaagcgcagcgccau

SEQ ID NO: 189650 - RNA, 22 nt, Salmonella enterica enterica serovar Typhi
uacgccgcgaccacgccgaucg

SEQ ID NO: 189651 - RNA, 22 nt, Salmonella enterica enterica serovar Typhi
uucuggcucaguaucaggccgc

SEQ ID NO: 189652 - RNA, 22 nt, Salmonella enterica enterica serovar Typhi
cgcgaugauggcauccagaucg

SEQ ID NO: 189653 - RNA, 22 nt, Salmonella enterica enterica serovar Typhi
uggcguucuucggcgacccguc

SEQ ID NO: 189654 - RNA, 22 nt, Salmonella enterica enterica serovar Typhi
uuccgcgauucaggaaguggag

SEQ ID NO: 189655 - RNA, 22 nt, Salmonella enterica enterica serovar Typhi
ucaaucuucauccgcgcgccca

SEQ ID NO: 189656 - RNA, 22 nt, Salmonella enterica enterica serovar Typhi
cgcgcagugaggacauauuugu

SEQ ID NO: 189657 - RNA, 22 nt, Salmonella enterica enterica serovar Typhi
cgcauucagccaacugagcgcu

SEQ ID NO: 189658 - RNA, 22 nt, Salmonella enterica enterica serovar Typhi
gccaccaucgcuuuuaccaucu

SEQ ID NO: 189659 - RNA, 22 nt, Salmonella enterica enterica serovar Typhi
gacaguguaaguaaaccugcua

SEQ ID NO: 189660 - RNA, 22 nt, Salmonella enterica enterica serovar Typhi
aauucgcuccguuaagccuaug

SEQ ID NO: 189661 - RNA, 22 nt, Salmonella enterica enterica serovar Typhi
uggcgcgaucaguucuugcagg

SEQ ID NO: 189662 - RNA, 22 nt, Salmonella enterica enterica serovar Typhi
cgcuaaggccuuauugugccgc

SEQ ID NO: 189663 - RNA, 22 nt, Salmonella enterica enterica serovar Typhi
auaugcguauuuucuggcggag

SEQ ID NO: 189664 - RNA, 18 nt, Salmonella enterica enterica serovar Typhi
aucaggguggauuccggg

SEQ ID NO: 189665 - RNA, 22 nt, Salmonella enterica enterica serovar Typhi
cuccugaaaccguugaugcggc

SEQ ID NO: 189666 - RNA, 22 nt, Salmonella enterica enterica serovar Typhi
guuugacgccgcgcggcagaau

SEQ ID NO: 189667 - RNA, 21 nt, Salmonella enterica enterica serovar Typhi
cgcuauucgcgcuaccuuugg

SEQ ID NO: 189668 - RNA, 22 nt, Salmonella enterica enterica serovar Typhi
caucauccagaucuuucgcgcc

SEQ ID NO: 189669 - RNA, 22 nt, Salmonella enterica enterica serovar Typhi
auacgcaucaggcgcugacgaa

SEQ ID NO: 189670 - RNA, 21 nt, Salmonella enterica enterica serovar Typhi
cguuccaccuuuaucagcagu

SEQ ID NO: 189671 - RNA, 22 nt, Salmonella enterica enterica serovar Typhi
aauguccugacauuaaccggcc

SEQ ID NO: 189672 - RNA, 22 nt, Salmonella enterica enterica serovar Typhi
cugacugcucagccggaagaac

SEQ ID NO: 189673 - RNA, 22 nt, Salmonella enterica enterica serovar Typhi
gauuacccgggagcaauguugu

SEQ ID NO: 189674 - RNA, 22 nt, Salmonella enterica enterica serovar Typhi
gcucugcuugccgcugccgguu

SEQ ID NO: 189675 - RNA, 22 nt, Salmonella enterica enterica serovar Typhi
uaccugugcuggcgcugaccgc

SEQ ID NO: 189676 - RNA, 22 nt, Salmonella enterica enterica serovar Typhi
acuggcaucgccauccacaggu

SEQ ID NO: 189677 - RNA, 22 nt, Salmonella enterica enterica serovar Typhi
accuguuugaacuuaccuggcg

SEQ ID NO: 189678 - RNA, 22 nt, Salmonella enterica enterica serovar Typhi
agcccauguugcugaugagcgu

SEQ ID NO: 189679 - RNA, 22 nt, Salmonella enterica enterica serovar Typhi
uuguucaacagucgguagcuga

SEQ ID NO: 189680 - RNA, 22 nt, Salmonella enterica enterica serovar Typhi
gcgaccguggcggcguaguuau

SEQ ID NO: 189681 - RNA, 22 nt, Salmonella enterica enterica serovar Typhi
cgccauaagccuugcugacugc

SEQ ID NO: 189682 - RNA, 22 nt, Salmonella enterica enterica serovar Typhi
ggcgcgaugcuggcgaaggucu

SEQ ID NO: 189683 - RNA, 22 nt, Salmonella enterica enterica serovar Typhi
gcuggucgagaaugguuugcac

SEQ ID NO: 189684 - RNA, 22 nt, Salmonella enterica enterica serovar Typhi
ugaacggcgcuauugucgggau

SEQ ID NO: 189685 - RNA, 17 nt, Salmonella enterica enterica serovar Typhi
uuuacggcuauaaccag

SEQ ID NO: 189686 - RNA, 22 nt, Salmonella enterica enterica serovar Typhi
augcauaaaagcagcggcuaau

SEQ ID NO: 189687 - RNA, 22 nt, Salmonella enterica enterica serovar Typhi
uucagccguuuucaggacgcug

SEQ ID NO: 189688 - RNA, 22 nt, Salmonella enterica enterica serovar Typhi
agucaggaucugacgagcgcga

SEQ ID NO: 189689 - RNA, 20 nt, Salmonella enterica enterica serovar Typhi
uagucuuccuggcauccagc

SEQ ID NO: 189690 - RNA, 22 nt, Salmonella enterica enterica serovar Typhi
cggcgugacagacaccuaucag

SEQ ID NO: 189691 - RNA, 22 nt, Salmonella enterica enterica serovar Typhi
ucgccggugaugugagcaccgg

SEQ ID NO: 189692 - RNA, 22 nt, Salmonella enterica enterica serovar Typhi
cgcuauccgggauguguugaug

SEQ ID NO: 189693 - RNA, 22 nt, Salmonella enterica enterica serovar Typhi
gccagcguaaauagcccggauc

SEQ ID NO: 189694 - RNA, 22 nt, Salmonella enterica enterica serovar Typhi
aaacgcaucgguaugauugcgc

SEQ ID NO: 189695 - RNA, 22 nt, Salmonella enterica enterica serovar Typhi
auugucugaaaagaggaugcug

SEQ ID NO: 189696 - RNA, 22 nt, Salmonella enterica enterica serovar Typhi
cuggauuaagcgggcugcgugu

SEQ ID NO: 189697 - RNA, 19 nt, Salmonella enterica enterica serovar Typhi
gagauacacagcguuuacc

SEQ ID NO: 189698 - RNA, 20 nt, Salmonella enterica enterica serovar Typhi
auugccgauggugguauaca

SEQ ID NO: 189699 - RNA, 22 nt, Salmonella enterica enterica serovar Typhi
gcgauugacgccgacgcuaaag

SEQ ID NO: 189700 - RNA, 22 nt, Salmonella enterica enterica serovar Typhi
uaaagcaauauucgguuuaacu

SEQ ID NO: 189701 - RNA, 22 nt, Salmonella enterica enterica serovar Typhi
ucagauccagcucuucuucugu

SEQ ID NO: 189702 - RNA, 22 nt, Salmonella enterica enterica serovar Typhi
uaggccggauaaggcguuagcc

SEQ ID NO: 189703 - RNA, 22 nt, Salmonella enterica enterica serovar Typhi
cgcuccugcuccugcuccaucc

SEQ ID NO: 189704 - RNA, 22 nt, Salmonella enterica enterica serovar Typhi
aacagcauaggagcgguugauu

SEQ ID NO: 189705 - RNA, 22 nt, Salmonella enterica enterica serovar Typhi
gauccguuuguuguuucaaaau

SEQ ID NO: 189706 - RNA, 20 nt, Salmonella enterica enterica serovar Typhi
acgccgcacgccgucucagc

SEQ ID NO: 189707 - RNA, 22 nt, Salmonella enterica enterica serovar Typhi
aacgugaugauacagaauggug

SEQ ID NO: 189708 - RNA, 22 nt, Salmonella enterica enterica serovar Typhi
acagcgacauucccgcuucgga

SEQ ID NO: 189709 - RNA, 22 nt, Salmonella enterica enterica serovar Typhi
aacggucaucugcacaaaggcg

SEQ ID NO: 189710 - RNA, 22 nt, Salmonella enterica enterica serovar Typhi
gcugcgucguauuaucccgcca

SEQ ID NO: 189711 - RNA, 22 nt, Salmonella enterica enterica serovar Typhi
ccggcgaagauagcgguacugu

SEQ ID NO: 189712 - RNA, 22 nt, Salmonella enterica enterica serovar Typhi
uggcuaucgccauuacgcauug

SEQ ID NO: 189713 - RNA, 22 nt, Salmonella enterica enterica serovar Typhi
uucugcugcaaaaaacguucgg

SEQ ID NO: 189714 - RNA, 22 nt, Salmonella enterica enterica serovar Typhi
cggcguucgugccaaccacgua

SEQ ID NO: 189715 - RNA, 22 nt, Salmonella enterica enterica serovar Typhi
cagcgaggcaccaucauugaaa

SEQ ID NO: 189716 - RNA, 17 nt, Salmonella enterica enterica serovar Typhi
cgccauuuugcaacugg

SEQ ID NO: 189717 - RNA, 22 nt, Salmonella enterica enterica serovar Typhi
cugccguauaucgcgcugggua

SEQ ID NO: 189718 - RNA, 22 nt, Salmonella enterica enterica serovar Typhi
cgauauucacggcuguuuuuca

SEQ ID NO: 189719 - RNA, 22 nt, Salmonella enterica enterica serovar Typhi
ucgguauggcaugaugcggaau

SEQ ID NO: 189720 - RNA, 22 nt, Salmonella enterica enterica serovar Typhi
ugacgcgccugcgcuaccgcug

SEQ ID NO: 189721 - RNA, 22 nt, Salmonella enterica enterica serovar Typhi
aauguucacugccguuauuaug

SEQ ID NO: 189722 - RNA, 22 nt, Salmonella enterica enterica serovar Typhi
aucugcggcucauuaucgcguu

SEQ ID NO: 189723 - RNA, 22 nt, Salmonella enterica enterica serovar Typhi
ccagcguguugaucucgccguc

SEQ ID NO: 189724 - RNA, 22 nt, Salmonella enterica enterica serovar Typhi
uugccggucauccaagccgcaa

SEQ ID NO: 189725 - RNA, 21 nt, Salmonella enterica enterica serovar Typhi
gaacgggcuuuucagggugua

SEQ ID NO: 189726 - RNA, 22 nt, Salmonella enterica enterica serovar Typhi
cuggcagugcgucugauacugc

SEQ ID NO: 189727 - RNA, 22 nt, Salmonella enterica enterica serovar Typhi
uugaagcacuauuuuggugcaa

SEQ ID NO: 189728 - RNA, 22 nt, Salmonella enterica enterica serovar Typhi
gauagggcgaucgccgguuuug

SEQ ID NO: 189729 - RNA, 22 nt, Salmonella enterica enterica serovar Typhi
gccaucguuuuuguaccguauc

SEQ ID NO: 189730 - RNA, 20 nt, Salmonella enterica enterica serovar Typhi
uugcuggccugcucucuacu

SEQ ID NO: 189731 - RNA, 22 nt, Salmonella enterica enterica serovar Typhi
agaacgcacggucagcauugau

SEQ ID NO: 189732 - RNA, 22 nt, Salmonella enterica enterica serovar Typhi
cgcugauugauuaugauacguu

SEQ ID NO: 189733 - RNA, 22 nt, Salmonella enterica enterica serovar Typhi
aaagcuggguagcgcgcguugc

SEQ ID NO: 189734 - RNA, 19 nt, Salmonella enterica enterica serovar Typhi
gccacggucuugagccagc

SEQ ID NO: 189735 - RNA, 22 nt, Salmonella enterica enterica serovar Typhi
cguugucguaugagcgaucgcu

SEQ ID NO: 189736 - RNA, 22 nt, Salmonella enterica enterica serovar Typhi
uuggcugacgaauauuauuaaa

SEQ ID NO: 189737 - RNA, 22 nt, Salmonella enterica enterica serovar Typhi
uaccacuuccggcccugcaugc

SEQ ID NO: 189738 - RNA, 22 nt, Salmonella enterica enterica serovar Typhi
cagccggaagccgucaacgacg

SEQ ID NO: 189739 - RNA, 22 nt, Salmonella enterica enterica serovar Typhi
gaaugucugaagacagaggagu

SEQ ID NO: 189740 - RNA, 22 nt, Salmonella enterica enterica serovar Typhi
gcuuucaggccuccuggugugg

SEQ ID NO: 189741 - RNA, 22 nt, Salmonella enterica enterica serovar Typhi
cggcgaucgucggcauccagau

SEQ ID NO: 189742 - RNA, 22 nt, Salmonella enterica enterica serovar Typhi
gugccgucgccauuggugucuc

SEQ ID NO: 189743 - RNA, 22 nt, Salmonella enterica enterica serovar Typhi
guauuaccaggaagagcucaau

SEQ ID NO: 189744 - RNA, 22 nt, Salmonella enterica enterica serovar Typhi
agcgguuuuauuuacguugcuc

SEQ ID NO: 189745 - RNA, 22 nt, Salmonella enterica enterica serovar Typhi
uccguaaauuagaagaacguag

SEQ ID NO: 189746 - RNA, 22 nt, Salmonella enterica enterica serovar Typhi
uuaccguuugccaucuggccgc

SEQ ID NO: 189747 - RNA, 22 nt, Salmonella enterica enterica serovar Typhi
ugcuuuaaaugcugcgcuaacu

SEQ ID NO: 189748 - RNA, 22 nt, Salmonella enterica enterica serovar Typhi
auccgaaauccgucuguaucuc

SEQ ID NO: 189749 - RNA, 21 nt, Salmonella enterica enterica serovar Typhi
ugaugaccugccguccaaccc

SEQ ID NO: 189750 - RNA, 22 nt, Salmonella enterica enterica serovar Typhi
aaucucugugcuaucaaauccc

SEQ ID NO: 189751 - RNA, 22 nt, Salmonella enterica enterica serovar Typhi
uuaacguuugucagcgauuuua

SEQ ID NO: 189752 - RNA, 21 nt, Salmonella enterica enterica serovar Typhi
cugacgccgcuguuuucacuc

SEQ ID NO: 189753 - RNA, 22 nt, Salmonella enterica enterica serovar Typhi
ugugaauggaaaaacguacgaa

SEQ ID NO: 189754 - RNA, 22 nt, Salmonella enterica enterica serovar Typhi
acauccgucaacggaaaaacgc

SEQ ID NO: 189755 - RNA, 22 nt, Salmonella enterica enterica serovar Typhi
uggucacggcgauagaaaacgg

SEQ ID NO: 189756 - RNA, 22 nt, Salmonella enterica enterica serovar Typhi
uugaccgugcuggcauucgccg

SEQ ID NO: 189757 - RNA, 22 nt, Salmonella enterica enterica serovar Typhi
cgaguacggaaaaaggguccgc

SEQ ID NO: 189758 - RNA, 23 nt, Salmonella enterica enterica serovar Typhi
acgccgcaggcgauggaucugcu

SEQ ID NO: 189759 - RNA, 22 nt, Salmonella enterica enterica serovar Typhi
ggcgguaaagguaauggauuca

SEQ ID NO: 189760 - RNA, 22 nt, Salmonella enterica enterica serovar Typhi
cuuguaggucggauaaggcgca

SEQ ID NO: 189761 - RNA, 22 nt, Salmonella enterica enterica serovar Typhi
ugccgguugucgaugaagaaca

SEQ ID NO: 189762 - RNA, 22 nt, Salmonella enterica enterica serovar Typhi
cugcguaauggacuauggcgcc

SEQ ID NO: 189763 - RNA, 22 nt, Salmonella enterica enterica serovar Typhi
cuggguuaucgcgcgucguaau

SEQ ID NO: 189764 - RNA, 22 nt, Salmonella enterica enterica serovar Typhi
agauuugcuauauuugcgcccc

SEQ ID NO: 189765 - RNA, 22 nt, Salmonella enterica enterica serovar Typhi
auagagauugggcgcguggaga

SEQ ID NO: 189766 - RNA, 23 nt, Salmonella enterica enterica serovar Typhi
uuaagcaccacauuggugcaaua

SEQ ID NO: 189767 - RNA, 22 nt, Salmonella enterica enterica serovar Typhi
uacugugcgcgcugucggucuu

SEQ ID NO: 189768 - RNA, 22 nt, Salmonella enterica enterica serovar Typhi
uucauuacuuugaauggcggaa

SEQ ID NO: 189769 - RNA, 22 nt, Salmonella enterica enterica serovar Typhi
ggccaucauugaagaacagcug

SEQ ID NO: 189770 - RNA, 22 nt, Salmonella enterica enterica serovar Typhi
aaauguuggcgaccugaugcag

SEQ ID NO: 189771 - RNA, 22 nt, Salmonella enterica enterica serovar Typhi
ccggauauccuggcacugguac

SEQ ID NO: 189772 - RNA, 22 nt, Salmonella enterica enterica serovar Typhi
ugcugccggaaaugucugcgga

SEQ ID NO: 189773 - RNA, 22 nt, Salmonella enterica enterica serovar Typhi
aguuaaugaugaaacuaaggug

SEQ ID NO: 189774 - RNA, 22 nt, Salmonella enterica enterica serovar Typhi
ucaugcgcgccuguuaugcgcu

SEQ ID NO: 189775 - RNA, 22 nt, Salmonella enterica enterica serovar Typhi
cuggcuggagucucagggcgca

SEQ ID NO: 189776 - RNA, 22 nt, Salmonella enterica enterica serovar Typhi
ggacguugaccucgaugguccg

SEQ ID NO: 189777 - RNA, 22 nt, Salmonella enterica enterica serovar Typhi
ccagccaggccucguuuucguc

SEQ ID NO: 189778 - RNA, 22 nt, Salmonella enterica enterica serovar Typhi
cguugucacguggcgauucgaa

SEQ ID NO: 189779 - RNA, 22 nt, Salmonella enterica enterica serovar Typhi
ggucgcuggacgccauccugca

SEQ ID NO: 189780 - RNA, 22 nt, Salmonella enterica enterica serovar Typhi
gcguugaaguucgucauaucgu

SEQ ID NO: 189781 - RNA, 22 nt, Salmonella enterica enterica serovar Typhi
uggccgugguggucgacgauca

SEQ ID NO: 189782 - RNA, 22 nt, Salmonella enterica enterica serovar Typhi
gagauugaauaacaucugucug

SEQ ID NO: 189783 - RNA, 23 nt, Salmonella enterica enterica serovar Typhi
uauggcuauuaggguagacgggu

SEQ ID NO: 189784 - RNA, 22 nt, Salmonella enterica enterica serovar Typhi
caacuuaacgcuggcuacuucu

SEQ ID NO: 189785 - RNA, 22 nt, Salmonella enterica enterica serovar Typhi
augcagaugaggaaaaugcugc

SEQ ID NO: 189786 - RNA, 22 nt, Salmonella enterica enterica serovar Typhi
ggcgauaugugugauagcuauc

SEQ ID NO: 189787 - RNA, 22 nt, Salmonella enterica enterica serovar Typhi
cguuggcgucaucgacauuaac

SEQ ID NO: 189788 - RNA, 22 nt, Salmonella enterica enterica serovar Typhi
cuguguaugauucauccggaga

SEQ ID NO: 189789 - RNA, 22 nt, Salmonella enterica enterica serovar Typhi
auccgcugcgcauugguuuauc

SEQ ID NO: 189790 - RNA, 22 nt, Salmonella enterica enterica serovar Typhi
gugaauaaucacccggcggcgc

SEQ ID NO: 189791 - RNA, 22 nt, Salmonella enterica enterica serovar Typhi
auuccaggaauaaguauccaga

SEQ ID NO: 189792 - RNA, 23 nt, Salmonella enterica enterica serovar Typhi
ucgcucauacacucgguaaugca

SEQ ID NO: 189793 - RNA, 22 nt, Salmonella enterica enterica serovar Typhi
uggaccgcaugggcgcgaacuu

SEQ ID NO: 189794 - RNA, 22 nt, Salmonella enterica enterica serovar Typhi
ugauaagguuggugaccauauu

SEQ ID NO: 189795 - RNA, 22 nt, Salmonella enterica enterica serovar Typhi
gauaacgguagguaucaaucgc

SEQ ID NO: 189796 - RNA, 22 nt, Salmonella enterica enterica serovar Typhi
ucaccgucggcucggcggcgua

SEQ ID NO: 189797 - RNA, 22 nt, Salmonella enterica enterica serovar Typhi
uggucaaacuggcggagacgaa

SEQ ID NO: 189798 - RNA, 22 nt, Salmonella enterica enterica serovar Typhi
cgcucagaaccacggccuacgg

SEQ ID NO: 189799 - RNA, 22 nt, Salmonella enterica enterica serovar Typhi
augccuuauccggccuacaacg

SEQ ID NO: 189800 - RNA, 22 nt, Salmonella enterica enterica serovar Typhi
gccagaccaaaggcgucgccug

SEQ ID NO: 189801 - RNA, 22 nt, Salmonella enterica enterica serovar Typhi
aguccguugaagagaucacugg

SEQ ID NO: 189802 - RNA, 22 nt, Salmonella enterica enterica serovar Typhi
cuguugcacugcggaaaaaguu

SEQ ID NO: 189803 - RNA, 22 nt, Salmonella enterica enterica serovar Typhi
gucgaagaugacggcuucgccg

SEQ ID NO: 189804 - RNA, 22 nt, Salmonella enterica enterica serovar Typhi
acgcaauucuggcuggugacgc

SEQ ID NO: 189805 - RNA, 22 nt, Salmonella enterica enterica serovar Typhi
ucuacgcuuuuuucgcgcaggc

SEQ ID NO: 189806 - RNA, 22 nt, Salmonella enterica enterica serovar Typhi
ggugguaaaacccgaccagaua

SEQ ID NO: 189807 - RNA, 22 nt, Salmonella enterica enterica serovar Typhi
aauuguguuugucgauauucgu

SEQ ID NO: 189808 - RNA, 22 nt, Salmonella enterica enterica serovar Typhi
gugcgcuucuucaccgaacaga

SEQ ID NO: 189809 - RNA, 22 nt, Salmonella enterica enterica serovar Typhi
agcagguuggcgucgcgaagcc

SEQ ID NO: 189810 - RNA, 20 nt, Salmonella enterica enterica serovar Typhi
augcugcugauguucaucau

SEQ ID NO: 189811 - RNA, 18 nt, Salmonella enterica enterica serovar Typhi
uccgcuggacucccugaa

SEQ ID NO: 189812 - RNA, 22 nt, Salmonella enterica enterica serovar Typhi
accgccugguaaucgguuuuca

SEQ ID NO: 189813 - RNA, 20 nt, Salmonella enterica enterica serovar Typhi
cuguaggcccgguaaggcgu

SEQ ID NO: 189814 - RNA, 21 nt, Salmonella enterica enterica serovar Typhi
uucaaggaaauugccgcuugu

SEQ ID NO: 189815 - RNA, 22 nt, Salmonella enterica enterica serovar Typhi
acggucugucccagucggcgcu

SEQ ID NO: 189816 - RNA, 22 nt, Salmonella enterica enterica serovar Typhi
cucauugcggcgaugcgcaggg

SEQ ID NO: 189817 - RNA, 22 nt, Salmonella enterica enterica serovar Typhi
uuguaaaguacuggaauacgcg

SEQ ID NO: 189818 - RNA, 22 nt, Salmonella enterica enterica serovar Typhi
guauagccgaaguugaccgcuu

SEQ ID NO: 189819 - RNA, 22 nt, Salmonella enterica enterica serovar Typhi
augugaaucugaacucggugcu

SEQ ID NO: 189820 - RNA, 22 nt, Salmonella enterica enterica serovar Typhi
uggccuggaguaauucgcugau

SEQ ID NO: 189821 - RNA, 21 nt, Salmonella enterica enterica serovar Typhi
ucauccagccaacaaacucaa

SEQ ID NO: 189822 - RNA, 22 nt, Salmonella enterica enterica serovar Typhi
ugauggucguggaauaugcugc

SEQ ID NO: 189823 - RNA, 22 nt, Salmonella enterica enterica serovar Typhi
uuaucgacaaauugccguuuac

SEQ ID NO: 189824 - RNA, 22 nt, Salmonella enterica enterica serovar Typhi
cgguugaugguuugugcgugcg

SEQ ID NO: 189825 - RNA, 22 nt, Salmonella enterica enterica serovar Typhi
cucaguaagggaauagugugau

SEQ ID NO: 189826 - RNA, 22 nt, Salmonella enterica enterica serovar Typhi
gccugcucaauaugaccgccgc

SEQ ID NO: 189827 - RNA, 22 nt, Salmonella enterica enterica serovar Typhi
uacgaggucaacggcgcggaca

SEQ ID NO: 189828 - RNA, 22 nt, Salmonella enterica enterica serovar Typhi
ugccggauggcgguguaaacgu

SEQ ID NO: 189829 - RNA, 22 nt, Salmonella enterica enterica serovar Typhi
guacucugggggaggguauugc

SEQ ID NO: 189830 - RNA, 22 nt, Salmonella enterica enterica serovar Typhi
ucagcgccugggugucaaucug

SEQ ID NO: 189831 - RNA, 22 nt, Salmonella enterica enterica serovar Typhi
cggagcugauggagcugguggg

SEQ ID NO: 189832 - RNA, 22 nt, Salmonella enterica enterica serovar Typhi
aagucgauuuccgcuuccugcg

SEQ ID NO: 189833 - RNA, 22 nt, Salmonella enterica enterica serovar Typhi
ggcgauuugcggcggcgugaag

SEQ ID NO: 189834 - RNA, 22 nt, Salmonella enterica enterica serovar Typhi
ucugaauuuaaaaauccugaac

SEQ ID NO: 189835 - RNA, 22 nt, Salmonella enterica enterica serovar Typhi
ucgcuggaaaguauucgccagc

SEQ ID NO: 189836 - RNA, 22 nt, Salmonella enterica enterica serovar Typhi
ggcgagguguaagaaagcagaa

SEQ ID NO: 189837 - RNA, 22 nt, Salmonella enterica enterica serovar Typhi
agagcggcuggcgaaacuggcg

SEQ ID NO: 189838 - RNA, 23 nt, Salmonella enterica enterica serovar Typhi
gcuuucgcaggugagcguaugca

SEQ ID NO: 189839 - RNA, 21 nt, Salmonella enterica enterica serovar Typhi
uccagcacuugcuucauugcu

SEQ ID NO: 189840 - RNA, 22 nt, Salmonella enterica enterica serovar Typhi
ucugcguuaguuggcaaaccuu

SEQ ID NO: 189841 - RNA, 22 nt, Salmonella enterica enterica serovar Typhi
gauuaacaucuggacggcuauu

SEQ ID NO: 189842 - RNA, 22 nt, Salmonella enterica enterica serovar Typhi
cagcuaacgguugcauaaucug

SEQ ID NO: 189843 - RNA, 22 nt, Salmonella enterica enterica serovar Typhi
uuccgcacaacaguuugagcua

SEQ ID NO: 189844 - RNA, 22 nt, Salmonella enterica enterica serovar Typhi
caucacggccuuuauuuucgcc

SEQ ID NO: 189845 - RNA, 22 nt, Salmonella enterica enterica serovar Typhi
acggguuauguuaucauuugua

SEQ ID NO: 189846 - RNA, 22 nt, Salmonella enterica enterica serovar Typhi
gaucagcgugcuauuuuuuucg

SEQ ID NO: 189847 - RNA, 22 nt, Salmonella enterica enterica serovar Typhi
uccaugauuuugucuggugcca

SEQ ID NO: 189848 - RNA, 22 nt, Salmonella enterica enterica serovar Typhi
agauagcgccuggcaggaggau

SEQ ID NO: 189849 - RNA, 22 nt, Salmonella enterica enterica serovar Typhi
gugcgaaugcgcgacuugccga

SEQ ID NO: 189850 - RNA, 22 nt, Salmonella enterica enterica serovar Typhi
aacgcgucuuauccggccuaca

SEQ ID NO: 189851 - RNA, 22 nt, Salmonella enterica enterica serovar Typhi
aaucguuggggauaaucuggug

SEQ ID NO: 189852 - RNA, 22 nt, Salmonella enterica enterica serovar Typhi
ugucugucccucggccuugaua

SEQ ID NO: 189853 - RNA, 22 nt, Salmonella enterica enterica serovar Typhi
aacgugaugccauacggcgagu

SEQ ID NO: 189854 - RNA, 22 nt, Salmonella enterica enterica serovar Typhi
aguuaucaacggaagauuagua

SEQ ID NO: 189855 - RNA, 19 nt, Salmonella enterica enterica serovar Typhi
ccguuacuguuuuaucagg

SEQ ID NO: 189856 - RNA, 22 nt, Salmonella enterica enterica serovar Typhi
acgcgugacggcgacuauuuua

SEQ ID NO: 189857 - RNA, 23 nt, Salmonella enterica enterica serovar Typhi
ugacugggacaggggccuguguc

SEQ ID NO: 189858 - RNA, 22 nt, Salmonella enterica enterica serovar Typhi
cgacagauucaggcggugaagg

SEQ ID NO: 189859 - RNA, 22 nt, Salmonella enterica enterica serovar Typhi
aguggaaucagccaggagucgg

SEQ ID NO: 189860 - RNA, 23 nt, Salmonella enterica enterica serovar Typhi
cggucugcaaacaauucccccgg

SEQ ID NO: 189861 - RNA, 22 nt, Salmonella enterica enterica serovar Typhi
aacgaucagcuuuuugccgaaa

SEQ ID NO: 189862 - RNA, 22 nt, Salmonella enterica enterica serovar Typhi
augccgauagcuaacagcagga

SEQ ID NO: 189863 - RNA, 22 nt, Salmonella enterica enterica serovar Typhi
agcgauaaccugcugaugauca

SEQ ID NO: 189864 - RNA, 22 nt, Salmonella enterica enterica serovar Typhi
acuccguuggcucaacgucggc

SEQ ID NO: 189865 - RNA, 22 nt, Salmonella enterica enterica serovar Typhi
gaacauugaugagcaaaacguc

SEQ ID NO: 189866 - RNA, 22 nt, Salmonella enterica enterica serovar Typhi
uagggcuuauccggccugcaaa

SEQ ID NO: 189867 - RNA, 22 nt, Salmonella enterica enterica serovar Typhi
cucgaugccugacuucgacguu

SEQ ID NO: 189868 - RNA, 22 nt, Salmonella enterica enterica serovar Typhi
cucgcugucggcuaccgcguuc

SEQ ID NO: 189869 - RNA, 21 nt, Salmonella enterica enterica serovar Typhi
cagcaguucguuguucggcgc

SEQ ID NO: 189870 - RNA, 22 nt, Salmonella enterica enterica serovar Typhi
cauguuuacucuacuggccgua

SEQ ID NO: 189871 - RNA, 22 nt, Salmonella enterica enterica serovar Typhi
ugcugauauuuuccgccuuuau

SEQ ID NO: 189872 - RNA, 22 nt, Salmonella enterica enterica serovar Typhi
ugacuaauuaucgcccucacua

SEQ ID NO: 189873 - RNA, 22 nt, Salmonella enterica enterica serovar Typhi
uugcgggacagcuugucgauau

SEQ ID NO: 189874 - RNA, 21 nt, Salmonella enterica enterica serovar Typhi
cggucguaugcugugcccggg

SEQ ID NO: 189875 - RNA, 22 nt, Salmonella enterica enterica serovar Typhi
uaguucuucguaagccgucaug

SEQ ID NO: 189876 - RNA, 22 nt, Salmonella enterica enterica serovar Typhi
guuugcaacgguuccgguagua

SEQ ID NO: 189877 - RNA, 22 nt, Salmonella enterica enterica serovar Typhi
cguaccggcaaaacagcgucgc

SEQ ID NO: 189878 - RNA, 22 nt, Salmonella enterica enterica serovar Typhi
augcgccuucuccgccccgguu

SEQ ID NO: 189879 - RNA, 22 nt, Salmonella enterica enterica serovar Typhi
ggcggcuacgcuuauccgcuca

SEQ ID NO: 189880 - RNA, 21 nt, Salmonella enterica enterica serovar Typhi
ugacuuucccgguccgcuggc

SEQ ID NO: 189881 - RNA, 22 nt, Salmonella enterica enterica serovar Typhi
cgucaauaucagcuuucgcguc

SEQ ID NO: 189882 - RNA, 22 nt, Salmonella enterica enterica serovar Typhi
ccguaggccugauaagcgcagc

SEQ ID NO: 189883 - RNA, 22 nt, Salmonella enterica enterica serovar Typhi
ccguucggggaaaagaugauua

SEQ ID NO: 189884 - RNA, 22 nt, Salmonella enterica enterica serovar Typhi
acuggcggauuagcgaaggcac

SEQ ID NO: 189885 - RNA, 22 nt, Salmonella enterica enterica serovar Typhi
ugcgcgaguauuucgaucugcu

SEQ ID NO: 189886 - RNA, 21 nt, Salmonella enterica enterica serovar Typhi
agcuggguggcggugucgccg

SEQ ID NO: 189887 - RNA, 18 nt, Salmonella enterica enterica serovar Typhi
ucgacguguuugucgguc

SEQ ID NO: 189888 - RNA, 22 nt, Salmonella enterica enterica serovar Typhi
uuauccgcaagcugaacgcgcc

SEQ ID NO: 189889 - RNA, 22 nt, Salmonella enterica enterica serovar Typhi
auuuguaguguucaaagagcuc

SEQ ID NO: 189890 - RNA, 22 nt, Salmonella enterica enterica serovar Typhi
guccgacucaaacugaaaucgu

SEQ ID NO: 189891 - RNA, 22 nt, Salmonella enterica enterica serovar Typhi
uaucugcaauaaagguugcccg

SEQ ID NO: 189892 - RNA, 22 nt, Salmonella enterica enterica serovar Typhi
ucagguaaagcgcccguggcga

SEQ ID NO: 189893 - RNA, 22 nt, Salmonella enterica enterica serovar Typhi
acgaaggcgacauuagcagccg

SEQ ID NO: 189894 - RNA, 17 nt, Salmonella enterica enterica serovar Typhi
caucuuugugaacuuua

SEQ ID NO: 189895 - RNA, 22 nt, Salmonella enterica enterica serovar Typhi
ucucguuggugguucuuagcau

SEQ ID NO: 189896 - RNA, 22 nt, Salmonella enterica enterica serovar Typhi
ucgcucaagcuggaugacaauc

SEQ ID NO: 189897 - RNA, 22 nt, Salmonella enterica enterica serovar Typhi
ucgccgacuaauucaggaucaa

SEQ ID NO: 189898 - RNA, 22 nt, Salmonella enterica enterica serovar Typhi
ucacuuuaucgccguggcucau

SEQ ID NO: 189899 - RNA, 22 nt, Salmonella enterica enterica serovar Typhi
uggcgguagcgauaagcgccug

SEQ ID NO: 189900 - RNA, 22 nt, Salmonella enterica enterica serovar Typhi
aucgucaucuuuaccagcgaca

SEQ ID NO: 189901 - RNA, 22 nt, Salmonella enterica enterica serovar Typhi
ugaucaauuucaaagaagcgac

SEQ ID NO: 189902 - RNA, 22 nt, Salmonella enterica enterica serovar Typhi
guuuaucgaaggccagaucguc

SEQ ID NO: 189903 - RNA, 22 nt, Salmonella enterica enterica serovar Typhi
gcguuuccggccuggaugcguu

SEQ ID NO: 189904 - RNA, 22 nt, Salmonella enterica enterica serovar Typhi
ccgggcaacguagagcauuauu

SEQ ID NO: 189905 - RNA, 22 nt, Salmonella enterica enterica serovar Typhi
aguuucucgcugcauauggcgg

SEQ ID NO: 189906 - RNA, 22 nt, Salmonella enterica enterica serovar Typhi
cauaaugaccucuuauuucccg

SEQ ID NO: 189907 - RNA, 22 nt, Salmonella enterica enterica serovar Typhi
gccaggaacagcagcgcuuuaa

SEQ ID NO: 189908 - RNA, 22 nt, Salmonella enterica enterica serovar Typhi
uauccgccccugcgucugcgcg

SEQ ID NO: 189909 - RNA, 21 nt, Salmonella enterica enterica serovar Typhi
ucgccgcagccagcucacgcc

SEQ ID NO: 189910 - RNA, 22 nt, Salmonella enterica enterica serovar Typhi
auauagugucaaacagucucga

SEQ ID NO: 189911 - RNA, 22 nt, Salmonella enterica enterica serovar Typhi
aucaccguauuggcgccgcugg

SEQ ID NO: 189912 - RNA, 22 nt, Salmonella enterica enterica serovar Typhi
ggagccugcaucgucggcgcgc

SEQ ID NO: 189913 - RNA, 22 nt, Salmonella enterica enterica serovar Typhi
acgcaggaucaguugccuucgc

SEQ ID NO: 189914 - RNA, 22 nt, Salmonella enterica enterica serovar Typhi
cagaaccuggcucaucagugau

SEQ ID NO: 189915 - RNA, 22 nt, Salmonella enterica enterica serovar Typhi
cguguugcugcgcuggcugaau

SEQ ID NO: 189916 - RNA, 22 nt, Salmonella enterica enterica serovar Typhi
gucuuaucgauaugcuggaaga

SEQ ID NO: 189917 - RNA, 22 nt, Salmonella enterica enterica serovar Typhi
uugacuuugggucugcgcgucg

SEQ ID NO: 189918 - RNA, 22 nt, Salmonella enterica enterica serovar Typhi
guuggaacgguuaaacugauga

SEQ ID NO: 189919 - RNA, 22 nt, Salmonella enterica enterica serovar Typhi
gcguugcuggaugucgauggcg

SEQ ID NO: 189920 - RNA, 22 nt, Salmonella enterica enterica serovar Typhi
ucauggugauacagggugaaua

SEQ ID NO: 189921 - RNA, 22 nt, Salmonella enterica enterica serovar Typhi
cugugucaguuuauucuuuccu

SEQ ID NO: 189922 - RNA, 22 nt, Salmonella enterica enterica serovar Typhi
ugcaggauggcguccagcgacc

SEQ ID NO: 189923 - RNA, 22 nt, Salmonella enterica enterica serovar Typhi
gcccgauuucagcgccuuucag

SEQ ID NO: 189924 - RNA, 22 nt, Salmonella enterica enterica serovar Typhi
uggacaggacacgggauaauca

SEQ ID NO: 189925 - RNA, 20 nt, Salmonella enterica enterica serovar Typhi
uugaccaucucuuccgcggu

SEQ ID NO: 189926 - RNA, 22 nt, Salmonella enterica enterica serovar Typhi
ugcgcagaucauauucacaugc

SEQ ID NO: 189927 - RNA, 22 nt, Salmonella enterica enterica serovar Typhi
ugccuguaacgacgcgccacau

SEQ ID NO: 189928 - RNA, 22 nt, Salmonella enterica enterica serovar Typhi
aaugguuaccagccgcugcgaa

SEQ ID NO: 189929 - RNA, 22 nt, Salmonella enterica enterica serovar Typhi
aucgccaucuuaugcuuuuucu

SEQ ID NO: 189930 - RNA, 22 nt, Salmonella enterica enterica serovar Typhi
gaggauucacugggaauggaag

SEQ ID NO: 189931 - RNA, 22 nt, Salmonella enterica enterica serovar Typhi
auuucugucaccuguugcuguu

SEQ ID NO: 189932 - RNA, 22 nt, Salmonella enterica enterica serovar Typhi
aaggcguaaaagcgcuucuggc

SEQ ID NO: 189933 - RNA, 22 nt, Salmonella enterica enterica serovar Typhi
cccggaaaccaucauggaugcg

SEQ ID NO: 189934 - RNA, 22 nt, Salmonella enterica enterica serovar Typhi
ggcgagaugaugaaguuuaccg

SEQ ID NO: 189935 - RNA, 22 nt, Salmonella enterica enterica serovar Typhi
cguguaggcccgguaagcgcag

SEQ ID NO: 189936 - RNA, 22 nt, Salmonella enterica enterica serovar Typhi
guugccgcacgggcagaagcag

SEQ ID NO: 189937 - RNA, 22 nt, Salmonella enterica enterica serovar Typhi
uuagccagcucaaaggcguaga

SEQ ID NO: 189938 - RNA, 22 nt, Salmonella enterica enterica serovar Typhi
ugagaagugaaaaucugcauca

SEQ ID NO: 189939 - RNA, 22 nt, Salmonella enterica enterica serovar Typhi
auggaaauugugaauauugacu

SEQ ID NO: 189940 - RNA, 22 nt, Salmonella enterica enterica serovar Typhi
uguaaagcaaaugcuauacaag

SEQ ID NO: 189941 - RNA, 22 nt, Salmonella enterica enterica serovar Typhi
ggcggaauuauugucgucaugc

SEQ ID NO: 189942 - RNA, 22 nt, Salmonella enterica enterica serovar Typhi
agacugcauuucaauggcuucc

SEQ ID NO: 189943 - RNA, 22 nt, Salmonella enterica enterica serovar Typhi
ucagauagauauucgcauccgg

SEQ ID NO: 189944 - RNA, 22 nt, Salmonella enterica enterica serovar Typhi
aucggcgagguucuuuaaugca

SEQ ID NO: 189945 - RNA, 22 nt, Salmonella enterica enterica serovar Typhi
ugaugcagacgacgacaugcgc

SEQ ID NO: 189946 - RNA, 22 nt, Salmonella enterica enterica serovar Typhi
cgggucgaggaucgccauaucc

SEQ ID NO: 189947 - RNA, 22 nt, Salmonella enterica enterica serovar Typhi
guccagcagugguuucauacuc

SEQ ID NO: 189948 - RNA, 22 nt, Salmonella enterica enterica serovar Typhi
guaaagacggcgauaaaagucg

SEQ ID NO: 189949 - RNA, 22 nt, Salmonella enterica enterica serovar Typhi
cauggucgcggcgauuuuauca

SEQ ID NO: 189950 - RNA, 22 nt, Salmonella enterica enterica serovar Typhi
gucuguuauggcuuccagugcg

SEQ ID NO: 189951 - RNA, 22 nt, Salmonella enterica enterica serovar Typhi
cggauguauuugacugcgcgcu

SEQ ID NO: 189952 - RNA, 22 nt, Salmonella enterica enterica serovar Typhi
aucccgcgacgacccguucgau

SEQ ID NO: 189953 - RNA, 22 nt, Salmonella enterica enterica serovar Typhi
gcagcguauucucacguucggg

SEQ ID NO: 189954 - RNA, 22 nt, Salmonella enterica enterica serovar Typhi
ugaccucgauugcuggcgguac

SEQ ID NO: 189955 - RNA, 22 nt, Salmonella enterica enterica serovar Typhi
cuuaugcagaucgccauuggcg

SEQ ID NO: 189956 - RNA, 22 nt, Salmonella enterica enterica serovar Typhi
ccgagccuguucuugcgcggug

SEQ ID NO: 189957 - RNA, 22 nt, Salmonella enterica enterica serovar Typhi
gaagcguaacaagcaggccugg

SEQ ID NO: 189958 - RNA, 22 nt, Salmonella enterica enterica serovar Typhi
ggauaacauaguguaagauccu

SEQ ID NO: 189959 - RNA, 22 nt, Salmonella enterica enterica serovar Typhi
cagaauaucuggugauaagcgg

SEQ ID NO: 189960 - RNA, 22 nt, Salmonella enterica enterica serovar Typhi
gucauggcggcguggcgcugcg

SEQ ID NO: 189961 - RNA, 22 nt, Salmonella enterica enterica serovar Typhi
cuggcguaacgcauuauacuuu

SEQ ID NO: 189962 - RNA, 22 nt, Salmonella enterica enterica serovar Typhi
ugucuguacguuuccauuugag

SEQ ID NO: 189963 - RNA, 22 nt, Salmonella enterica enterica serovar Typhi
gcauuucaccgucgaucguuug

SEQ ID NO: 189964 - RNA, 22 nt, Salmonella enterica enterica serovar Typhi
uaggccugguaagcgaagcgcc

SEQ ID NO: 189965 - RNA, 22 nt, Salmonella enterica enterica serovar Typhi
cccgacgaucggcgguauuggc

SEQ ID NO: 189966 - RNA, 22 nt, Salmonella enterica enterica serovar Typhi
cuuacugucgaaaucauuaaag

SEQ ID NO: 189967 - RNA, 22 nt, Salmonella enterica enterica serovar Typhi
uugcggcugucuucgcggcuca

SEQ ID NO: 189968 - RNA, 22 nt, Salmonella enterica enterica serovar Typhi
ccuguuaaugaaauacuggcgc

SEQ ID NO: 189969 - RNA, 22 nt, Salmonella enterica enterica serovar Typhi
gcauggccaacaccggauggcc

SEQ ID NO: 189970 - RNA, 22 nt, Salmonella enterica enterica serovar Typhi
aauguugauuaucaggggcguc

SEQ ID NO: 189971 - RNA, 22 nt, Salmonella enterica enterica serovar Typhi
agccgguuuuugcugauguggu

SEQ ID NO: 189972 - RNA, 22 nt, Salmonella enterica enterica serovar Typhi
ggcaguggaugaccaugauugu

SEQ ID NO: 189973 - RNA, 22 nt, Salmonella enterica enterica serovar Typhi
gacugguucuucuguuauaggg

SEQ ID NO: 189974 - RNA, 22 nt, Salmonella enterica enterica serovar Typhi
ucgcuucaccuugcugccguug

SEQ ID NO: 189975 - RNA, 22 nt, Salmonella enterica enterica serovar Typhi
aggccgguauuuucuccaucag

SEQ ID NO: 189976 - RNA, 21 nt, Salmonella enterica enterica serovar Typhi
gggauacugguugccguuauc

SEQ ID NO: 189977 - RNA, 22 nt, Salmonella enterica enterica serovar Typhi
gggcugcuauucguggcguuuu

SEQ ID NO: 189978 - RNA, 22 nt, Salmonella enterica enterica serovar Typhi
ggccauuaucgcuacaggcgua

SEQ ID NO: 189979 - RNA, 22 nt, Salmonella enterica enterica serovar Typhi
cggauaagcauagcgccauccg

SEQ ID NO: 189980 - RNA, 21 nt, Salmonella enterica enterica serovar Typhi
ccaggcgaccacgcguaucuu

SEQ ID NO: 189981 - RNA, 22 nt, Salmonella enterica enterica serovar Typhi
gcuauggagccaaagcgcuggu

SEQ ID NO: 189982 - RNA, 22 nt, Salmonella enterica enterica serovar Typhi
ugauggcgcagcgcauugaugu

SEQ ID NO: 189983 - RNA, 22 nt, Salmonella enterica enterica serovar Typhi
gauuuccgcaacguggugcugg

SEQ ID NO: 189984 - RNA, 19 nt, Salmonella enterica enterica serovar Typhi
cagauuguuguuuaucuca

SEQ ID NO: 189985 - RNA, 22 nt, Salmonella enterica enterica serovar Typhi
cagugaggacgcuaaugccgcu

SEQ ID NO: 189986 - RNA, 22 nt, Salmonella enterica enterica serovar Typhi
ugacggagaucguccgcggcgc

SEQ ID NO: 189987 - RNA, 22 nt, Salmonella enterica enterica serovar Typhi
acgucuuaucuggccuacguga

SEQ ID NO: 189988 - RNA, 22 nt, Salmonella enterica enterica serovar Typhi
acaguuccggcacuuucaccga

SEQ ID NO: 189989 - RNA, 22 nt, Salmonella enterica enterica serovar Typhi
ccaugcugugcgucauggcgcu

SEQ ID NO: 189990 - RNA, 22 nt, Salmonella enterica enterica serovar Typhi
agccgcguugaagccuaucccu

SEQ ID NO: 189991 - RNA, 22 nt, Salmonella enterica enterica serovar Typhi
gaugucgauacgcuggcggaua

SEQ ID NO: 189992 - RNA, 22 nt, Salmonella enterica enterica serovar Typhi
uacaucgauuguugcgaauauu

SEQ ID NO: 189993 - RNA, 22 nt, Salmonella enterica enterica serovar Typhi
gguauucgaaauugucuuuauc

SEQ ID NO: 189994 - RNA, 22 nt, Salmonella enterica enterica serovar Typhi
ucugcauccccacgcgggugac

SEQ ID NO: 189995 - RNA, 22 nt, Salmonella enterica enterica serovar Typhi
cacuggaucuugggcugguggu

SEQ ID NO: 189996 - RNA, 22 nt, Salmonella enterica enterica serovar Typhi
ugaaguuuaucaaaggugacgc

SEQ ID NO: 189997 - RNA, 22 nt, Salmonella enterica enterica serovar Typhi
cugcauaagcugauggaugaag

SEQ ID NO: 189998 - RNA, 22 nt, Salmonella enterica enterica serovar Typhi
ucgcgcaaauuauguauaugca

SEQ ID NO: 189999 - RNA, 22 nt, Salmonella enterica enterica serovar Typhi
gcgcggaugauggcgucggccg

SEQ ID NO: 190000 - RNA, 22 nt, Salmonella enterica enterica serovar Typhi
gcugacgcaacguuauccuuca

SEQ ID NO: 190001 - RNA, 22 nt, Salmonella enterica enterica serovar Typhi
gauggugaugaccgucaaugcc

SEQ ID NO: 190002 - RNA, 22 nt, Salmonella enterica enterica serovar Typhi
cgguaguuuuguugccggaugg

SEQ ID NO: 190003 - RNA, 23 nt, Salmonella enterica enterica serovar Typhi
accugcugucgcgauacgguuga

SEQ ID NO: 190004 - RNA, 22 nt, Salmonella enterica enterica serovar Typhi
cuggcugaaaacuugauugcca

SEQ ID NO: 190005 - RNA, 22 nt, Salmonella enterica enterica serovar Typhi
gagcguuuuuaacguugggguu

SEQ ID NO: 190006 - RNA, 21 nt, Salmonella enterica enterica serovar Typhi
auagaacaauuggucauucgu

SEQ ID NO: 190007 - RNA, 22 nt, Salmonella enterica enterica serovar Typhi
uguaggccggacaaggcguuca

SEQ ID NO: 190008 - RNA, 22 nt, Salmonella enterica enterica serovar Typhi
cgcuuuauccuguuugcugaug

SEQ ID NO: 190009 - RNA, 22 nt, Salmonella enterica enterica serovar Typhi
auaaucggcugaccagccugcc

SEQ ID NO: 190010 - RNA, 22 nt, Salmonella enterica enterica serovar Typhi
auuggugacgauagccuguuug

SEQ ID NO: 190011 - RNA, 22 nt, Salmonella enterica enterica serovar Typhi
uggaugaacuuuguaugaucuc

SEQ ID NO: 190012 - RNA, 17 nt, Salmonella enterica enterica serovar Typhi
uuucaccauccgcauuc

SEQ ID NO: 190013 - RNA, 22 nt, Salmonella enterica enterica serovar Typhi
accgugaaaacuucagccagcg

SEQ ID NO: 190014 - RNA, 22 nt, Salmonella enterica enterica serovar Typhi
uugauucgccgcaucgcguaag

SEQ ID NO: 190015 - RNA, 22 nt, Salmonella enterica enterica serovar Typhi
agcaacaucaggcccuguaaag

SEQ ID NO: 190016 - RNA, 22 nt, Salmonella enterica enterica serovar Typhi
ugauuguacgguagguaaucgc

SEQ ID NO: 190017 - RNA, 22 nt, Salmonella enterica enterica serovar Typhi
ucugucauucgacgaaugauua

SEQ ID NO: 190018 - RNA, 19 nt, Salmonella enterica enterica serovar Typhi
ccgcguucauccaugcaga

SEQ ID NO: 190019 - RNA, 22 nt, Salmonella enterica enterica serovar Typhi
ugcccgauaauauuuaccgauu

SEQ ID NO: 190020 - RNA, 22 nt, Salmonella enterica enterica serovar Typhi
guuggauaguggcuucuuccag

SEQ ID NO: 190021 - RNA, 19 nt, Salmonella enterica enterica serovar Typhi
ucuaccauaacggugagau

SEQ ID NO: 190022 - RNA, 22 nt, Salmonella enterica enterica serovar Typhi
ugcucagcaccaccaccugcuc

SEQ ID NO: 190023 - RNA, 22 nt, Salmonella enterica enterica serovar Typhi
ggcauuuaucgauggcgcagga

SEQ ID NO: 190024 - RNA, 22 nt, Salmonella enterica enterica serovar Typhi
aggccggauaagcgaagcgcca

SEQ ID NO: 190025 - RNA, 22 nt, Salmonella enterica enterica serovar Typhi
acaaccugaucgugcugacgcc

SEQ ID NO: 190026 - RNA, 22 nt, Salmonella enterica enterica serovar Typhi
cgccugguuuuauagccgcauu

SEQ ID NO: 190027 - RNA, 22 nt, Salmonella enterica enterica serovar Typhi
uuagccgggcauucaccgcaca

SEQ ID NO: 190028 - RNA, 22 nt, Salmonella enterica enterica serovar Typhi
caggcccugcagccgcaggugg

SEQ ID NO: 190029 - RNA, 22 nt, Salmonella enterica enterica serovar Typhi
ucgcucagcgucugggaggcua

SEQ ID NO: 190030 - RNA, 20 nt, Salmonella enterica enterica serovar Typhi
uggaaucagugugaaagguc

SEQ ID NO: 190031 - RNA, 22 nt, Salmonella enterica enterica serovar Typhi
uaccgcgguggucacggcgauu

SEQ ID NO: 190032 - RNA, 22 nt, Salmonella enterica enterica serovar Typhi
ccugucgguacggcgcgccugc

SEQ ID NO: 190033 - RNA, 22 nt, Salmonella enterica enterica serovar Typhi
acuacgcugaaaaauggacggc

SEQ ID NO: 190034 - RNA, 21 nt, Salmonella enterica enterica serovar Typhi
guugugccgccggcgaagcuu

SEQ ID NO: 190035 - RNA, 22 nt, Salmonella enterica enterica serovar Typhi
cauggagcugaaugcaccauca

SEQ ID NO: 190036 - RNA, 22 nt, Salmonella enterica enterica serovar Typhi
cuggcaaagaaucguacaugcg

SEQ ID NO: 190037 - RNA, 22 nt, Salmonella enterica enterica serovar Typhi
ugcaggucacucuccagcgccc

SEQ ID NO: 190038 - RNA, 19 nt, Salmonella enterica enterica serovar Typhi
ggugcgaugaugcuuggcc

SEQ ID NO: 190039 - RNA, 22 nt, Salmonella enterica enterica serovar Typhi
cggagcauuaauggugucgcgc

SEQ ID NO: 190040 - RNA, 22 nt, Salmonella enterica enterica serovar Typhi
cgucagcgcgugaggcaguuaa

SEQ ID NO: 190041 - RNA, 20 nt, Salmonella enterica enterica serovar Typhi
uguuuacgcgggacauuuua

SEQ ID NO: 190042 - RNA, 22 nt, Salmonella enterica enterica serovar Typhi
cgauuacgcccucuuugauuga

SEQ ID NO: 190043 - RNA, 22 nt, Salmonella enterica enterica serovar Typhi
auucaaucaaauuaagaucaca

SEQ ID NO: 190044 - RNA, 22 nt, Salmonella enterica enterica serovar Typhi
gaacccggcaaguucaacgucu

SEQ ID NO: 190045 - RNA, 22 nt, Salmonella enterica enterica serovar Typhi
cguggaagaagagcuggaucgc

SEQ ID NO: 190046 - RNA, 22 nt, Salmonella enterica enterica serovar Typhi
agcagccgcaaauuaccagcgc

SEQ ID NO: 190047 - RNA, 20 nt, Salmonella enterica enterica serovar Typhi
cauucgugaugucgauagcu

SEQ ID NO: 190048 - RNA, 22 nt, Salmonella enterica enterica serovar Typhi
aaaucgcuauagaugauuucgg

SEQ ID NO: 190049 - RNA, 22 nt, Salmonella enterica enterica serovar Typhi
agguuauugccaaucagcacca

SEQ ID NO: 190050 - RNA, 23 nt, Salmonella enterica enterica serovar Typhi
gcucaucagcgcggguauguuca

SEQ ID NO: 190051 - RNA, 22 nt, Salmonella enterica enterica serovar Typhi
uuugaugaggugcugaucugcc

SEQ ID NO: 190052 - RNA, 22 nt, Salmonella enterica enterica serovar Typhi
aucaguuucaggaugaagaccg

SEQ ID NO: 190053 - RNA, 22 nt, Salmonella enterica enterica serovar Typhi
auaucguaaugcgggcgauacc

SEQ ID NO: 190054 - RNA, 20 nt, Salmonella enterica enterica serovar Typhi
cgguaagcgaagcgccaccg

SEQ ID NO: 190055 - RNA, 22 nt, Salmonella enterica enterica serovar Typhi
ugcagguuccaggucacucgcg

SEQ ID NO: 190056 - RNA, 18 nt, Salmonella enterica enterica serovar Typhi
cuggcaguagugaaagua

SEQ ID NO: 190057 - RNA, 22 nt, Salmonella enterica enterica serovar Typhi
gacuucauggagucgaguugca

SEQ ID NO: 190058 - RNA, 21 nt, Salmonella enterica enterica serovar Typhi
cgcaucagggcuccgguccgu

SEQ ID NO: 190059 - RNA, 22 nt, Salmonella enterica enterica serovar Typhi
aaaugccuuauccggccuacuc

SEQ ID NO: 190060 - RNA, 22 nt, Salmonella enterica enterica serovar Typhi
aagauguucuguucgugauggc

SEQ ID NO: 190061 - RNA, 22 nt, Salmonella enterica enterica serovar Typhi
caauaucuacaaaggucgugua

SEQ ID NO: 190062 - RNA, 21 nt, Salmonella enterica enterica serovar Typhi
cgcucgacaggcuguuaagcc

SEQ ID NO: 190063 - RNA, 22 nt, Salmonella enterica enterica serovar Typhi
uacacgccggauaaggcgcagc

SEQ ID NO: 190064 - RNA, 22 nt, Salmonella enterica enterica serovar Typhi
aagacgcgucgccaucuggcuc

SEQ ID NO: 190065 - RNA, 22 nt, Salmonella enterica enterica serovar Typhi
ucgagcacugcccggcccuaaa

SEQ ID NO: 190066 - RNA, 22 nt, Salmonella enterica enterica serovar Typhi
gugcaggaugacucggcuucgc

SEQ ID NO: 190067 - RNA, 22 nt, Salmonella enterica enterica serovar Typhi
aucgcccgcgauauccuuaccu

SEQ ID NO: 190068 - RNA, 22 nt, Salmonella enterica enterica serovar Typhi
gcgucgcagcuuucauggcgua

SEQ ID NO: 190069 - RNA, 22 nt, Salmonella enterica enterica serovar Typhi
uggcgcaguaucgugaacuggc

SEQ ID NO: 190070 - RNA, 22 nt, Salmonella enterica enterica serovar Typhi
accgucggugauaucgaaucgc

SEQ ID NO: 190071 - RNA, 22 nt, Salmonella enterica enterica serovar Typhi
auggcgccuguucgauaaauca

SEQ ID NO: 190072 - RNA, 22 nt, Salmonella enterica enterica serovar Typhi
aucaaccgucgucugggguuga

SEQ ID NO: 190073 - RNA, 22 nt, Salmonella enterica enterica serovar Typhi
cggcgaguacgauagcgccgau

SEQ ID NO: 190074 - RNA, 22 nt, Salmonella enterica enterica serovar Typhi
ggcucuauuugcgcacgcagau

SEQ ID NO: 190075 - RNA, 23 nt, Salmonella enterica enterica serovar Typhi
ucauggaaauuuuagauaacccg

SEQ ID NO: 190076 - RNA, 22 nt, Salmonella enterica enterica serovar Typhi
caggcaagggaagaagugagga

SEQ ID NO: 190077 - RNA, 22 nt, Salmonella enterica enterica serovar Typhi
ugcugguaugacgcgccguuaa

SEQ ID NO: 190078 - RNA, 22 nt, Salmonella enterica enterica serovar Typhi
auggcgcugcgcuuaucaggcc

SEQ ID NO: 190079 - RNA, 22 nt, Salmonella enterica enterica serovar Typhi
gagugcgggcuggauauggaau

SEQ ID NO: 190080 - RNA, 22 nt, Salmonella enterica enterica serovar Typhi
agcuuuaucucuaaagcgggca

SEQ ID NO: 190081 - RNA, 22 nt, Salmonella enterica enterica serovar Typhi
cgucggcauuaaccaggaugau

SEQ ID NO: 190082 - RNA, 22 nt, Salmonella enterica enterica serovar Typhi
gcucgugcgcauuagucagguu

SEQ ID NO: 190083 - RNA, 22 nt, Salmonella enterica enterica serovar Typhi
accgaacgggaaagugguuaac

SEQ ID NO: 190084 - RNA, 22 nt, Salmonella enterica enterica serovar Typhi
uggaccugcguacuuucucgcu

SEQ ID NO: 190085 - RNA, 22 nt, Salmonella enterica enterica serovar Typhi
ugggcguacucgucuauuaaug

SEQ ID NO: 190086 - RNA, 22 nt, Salmonella enterica enterica serovar Typhi
ccggaaagcuugcuguccauac

SEQ ID NO: 190087 - RNA, 22 nt, Salmonella enterica enterica serovar Typhi
ugguaaagcaaucgucaaaacc

SEQ ID NO: 190088 - RNA, 22 nt, Salmonella enterica enterica serovar Typhi
cuacgcuuaucaggccuacagg

SEQ ID NO: 190089 - RNA, 22 nt, Salmonella enterica enterica serovar Typhi
agcggccugcuggucucauugu

SEQ ID NO: 190090 - RNA, 22 nt, Salmonella enterica enterica serovar Typhi
ugauauagcggguuagccaugu

SEQ ID NO: 190091 - RNA, 19 nt, Salmonella enterica enterica serovar Typhi
ggcugcguggaaaccgcgc

SEQ ID NO: 190092 - RNA, 22 nt, Salmonella enterica enterica serovar Typhi
cgcaggaauacauaggacacca

SEQ ID NO: 190093 - RNA, 22 nt, Salmonella enterica enterica serovar Typhi
guugcggauaauccagcguaaa

SEQ ID NO: 190094 - RNA, 22 nt, Salmonella enterica enterica serovar Typhi
gacgaugggcaaucagccgcuc

SEQ ID NO: 190095 - RNA, 22 nt, Salmonella enterica enterica serovar Typhi
uggcgcuucgcuuauccgaccu

SEQ ID NO: 190096 - RNA, 23 nt, Salmonella enterica enterica serovar Typhi
gucgucugaaggaugaagcguaa

SEQ ID NO: 190097 - RNA, 22 nt, Salmonella enterica enterica serovar Typhi
gaagcagugaugacaccgaggc

SEQ ID NO: 190098 - RNA, 22 nt, Salmonella enterica enterica serovar Typhi
augauaccuuguucugacagca

SEQ ID NO: 190099 - RNA, 22 nt, Salmonella enterica enterica serovar Typhi
ggauacuugaugccuuuauccg

SEQ ID NO: 190100 - RNA, 22 nt, Salmonella enterica enterica serovar Typhi
gugugcaaagacugauagccgu

SEQ ID NO: 190101 - RNA, 22 nt, Salmonella enterica enterica serovar Typhi
uugaugcuggucuacggcugcg

SEQ ID NO: 190102 - RNA, 21 nt, Salmonella enterica enterica serovar Typhi
uacgacgcacuuuaugagguc

SEQ ID NO: 190103 - RNA, 22 nt, Salmonella enterica enterica serovar Typhi
uggcagcuucgccuuauccggc

SEQ ID NO: 190104 - RNA, 22 nt, Salmonella enterica enterica serovar Typhi
uuuccagaugauucagacaggg

SEQ ID NO: 190105 - RNA, 22 nt, Salmonella enterica enterica serovar Typhi
augugcuguucgauguagccaa

SEQ ID NO: 190106 - RNA, 22 nt, Salmonella enterica enterica serovar Typhi
cagacgcugaaacaacgcuggg

SEQ ID NO: 190107 - RNA, 22 nt, Salmonella enterica enterica serovar Typhi
uuaccaccaugaugguaaucau

SEQ ID NO: 190108 - RNA, 22 nt, Salmonella enterica enterica serovar Typhi
agggugaugaucagcgccagac

SEQ ID NO: 190109 - RNA, 22 nt, Salmonella enterica enterica serovar Typhi
uguaggccggauaagacgcguu

SEQ ID NO: 190110 - RNA, 22 nt, Salmonella enterica enterica serovar Typhi
ugcgcaacaguacgaagcgaaa

SEQ ID NO: 190111 - RNA, 22 nt, Salmonella enterica enterica serovar Typhi
guuacugucggcgauauagcgc

SEQ ID NO: 190112 - RNA, 22 nt, Salmonella enterica enterica serovar Typhi
cgacgguuugcaaaugggugau

SEQ ID NO: 190113 - RNA, 22 nt, Salmonella enterica enterica serovar Typhi
cucuugcaggcgccgcuuauug

SEQ ID NO: 190114 - RNA, 22 nt, Salmonella enterica enterica serovar Typhi
ugaacguuuucugagcggucgu

SEQ ID NO: 190115 - RNA, 22 nt, Salmonella enterica enterica serovar Typhi
caucagacaagugaagaagccc

SEQ ID NO: 190116 - RNA, 22 nt, Salmonella enterica enterica serovar Typhi
cagauaguuauucgcaucgcgc

SEQ ID NO: 190117 - RNA, 22 nt, Salmonella enterica enterica serovar Typhi
aggcgcauuuccgguauccaua

SEQ ID NO: 190118 - RNA, 22 nt, Salmonella enterica enterica serovar Typhi
uauagcgaaaccacccugaccg

SEQ ID NO: 190119 - RNA, 22 nt, Salmonella enterica enterica serovar Typhi
gucgaggaaauuaucgcugaaa

SEQ ID NO: 190120 - RNA, 22 nt, Salmonella enterica enterica serovar Typhi
guggcgucguugaccggcggga

SEQ ID NO: 190121 - RNA, 22 nt, Salmonella enterica enterica serovar Typhi
uucagcaugguacguacauauu

SEQ ID NO: 190122 - RNA, 21 nt, Salmonella enterica enterica serovar Typhi
ugauaacggguuaacaggcgu

SEQ ID NO: 190123 - RNA, 22 nt, Salmonella enterica enterica serovar Typhi
uggucgagaggguuucaauauu

SEQ ID NO: 190124 - RNA, 22 nt, Salmonella enterica enterica serovar Typhi
accgcagcagcuugcaguuuau

SEQ ID NO: 190125 - RNA, 22 nt, Salmonella enterica enterica serovar Typhi
ucugauucagggaucggggacg

SEQ ID NO: 190126 - RNA, 22 nt, Salmonella enterica enterica serovar Typhi
aacggauugcuucgcuguuagu

SEQ ID NO: 190127 - RNA, 22 nt, Salmonella enterica enterica serovar Typhi
gccauugugucucugucuccaa

SEQ ID NO: 190128 - RNA, 22 nt, Salmonella enterica enterica serovar Typhi
gcuauuucuggugguucaguau

SEQ ID NO: 190129 - RNA, 19 nt, Salmonella enterica enterica serovar Typhi
aucauccaggcuggacgua

SEQ ID NO: 190130 - RNA, 22 nt, Salmonella enterica enterica serovar Typhi
gaaccggcgugaggcaggucug

SEQ ID NO: 190131 - RNA, 22 nt, Salmonella enterica enterica serovar Typhi
ggcauuggcgcgcagauucgca

SEQ ID NO: 190132 - RNA, 22 nt, Salmonella enterica enterica serovar Typhi
uacuacguugucgacgccgguu

SEQ ID NO: 190133 - RNA, 22 nt, Salmonella enterica enterica serovar Typhi
uaaugccguuaacgguaauuuc

SEQ ID NO: 190134 - RNA, 22 nt, Salmonella enterica enterica serovar Typhi
aaaccguaauauucgccucguu

SEQ ID NO: 190135 - RNA, 22 nt, Salmonella enterica enterica serovar Typhi
guugcgcucaaugaccuggcca

SEQ ID NO: 190136 - RNA, 22 nt, Salmonella enterica enterica serovar Typhi
aucuucaugguuaauggucuga

SEQ ID NO: 190137 - RNA, 22 nt, Salmonella enterica enterica serovar Typhi
uuuacgagaaagagacgcuacg

SEQ ID NO: 190138 - RNA, 22 nt, Salmonella enterica enterica serovar Typhi
ccgcuuaauuuacggcuuccug

SEQ ID NO: 190139 - RNA, 22 nt, Salmonella enterica enterica serovar Typhi
ccggauaaggcgaagcugccau

SEQ ID NO: 190140 - RNA, 22 nt, Salmonella enterica enterica serovar Typhi
uaggccaaccgccauccggcau

SEQ ID NO: 190141 - RNA, 22 nt, Salmonella enterica enterica serovar Typhi
ucuguaggccggauaaggcguu

SEQ ID NO: 190142 - RNA, 22 nt, Salmonella enterica enterica serovar Typhi
uugugccggauggcggcgccug

SEQ ID NO: 190143 - RNA, 22 nt, Salmonella enterica enterica serovar Typhi
ggcugggaugaguucaguauuc

SEQ ID NO: 190144 - RNA, 22 nt, Salmonella enterica enterica serovar Typhi
aggcgcaucagaaaaaccuccg

SEQ ID NO: 190145 - RNA, 22 nt, Salmonella enterica enterica serovar Typhi
cuguuuaucgccagcaugguug

SEQ ID NO: 190146 - RNA, 22 nt, Salmonella enterica enterica serovar Typhi
uaggccugauaagguaaagccg

SEQ ID NO: 190147 - RNA, 22 nt, Salmonella enterica enterica serovar Typhi
gcgacgcaaagaguacuggaug

SEQ ID NO: 190148 - RNA, 22 nt, Salmonella enterica enterica serovar Typhi
guuacgccgccaucaggcaaaa

SEQ ID NO: 190149 - RNA, 22 nt, Salmonella enterica enterica serovar Typhi
cagucgcuggaugacaacgcgc

SEQ ID NO: 190150 - RNA, 22 nt, Salmonella enterica enterica serovar Typhi
ccggauaaggcggagccgccau

SEQ ID NO: 190151 - RNA, 21 nt, Salmonella enterica enterica serovar Typhi
ucauugcugagacaggcucug

SEQ ID NO: 190152 - RNA, 22 nt, Salmonella enterica enterica serovar Typhi
auccucagaugaagcgggcgcu

SEQ ID NO: 190153 - RNA, 22 nt, Salmonella enterica enterica serovar Typhi
ccggccuacucacugcaacgcg

SEQ ID NO: 190154 - RNA, 22 nt, Salmonella enterica enterica serovar Typhi
uaugaguuugucgaugccgaua

SEQ ID NO: 190155 - RNA, 22 nt, Salmonella enterica enterica serovar Typhi
gcgcuauuacgauauucaggag

SEQ ID NO: 190156 - RNA, 22 nt, Salmonella enterica enterica serovar Typhi
ccggauggcguguagcgauccg

SEQ ID NO: 190157 - RNA, 22 nt, Salmonella enterica enterica serovar Typhi
uggaugacaccaugaccuaccg

SEQ ID NO: 190158 - RNA, 22 nt, Salmonella enterica enterica serovar Typhi
gccaguuguuuuagugugguaa

SEQ ID NO: 190159 - RNA, 22 nt, Salmonella enterica enterica serovar Typhi
aucugcuucaugcguuucuuac

SEQ ID NO: 190160 - RNA, 19 nt, Salmonella enterica enterica serovar Typhi
caucagcguauccgugaag

SEQ ID NO: 190161 - RNA, 22 nt, Salmonella enterica enterica serovar Typhi
ugacuaucugcgcuggugcuua

SEQ ID NO: 190162 - RNA, 22 nt, Salmonella enterica enterica serovar Typhi
gauguaggccugauaagcguag

SEQ ID NO: 190163 - RNA, 19 nt, Salmonella enterica enterica serovar Typhi
aagugcgcgccauucgccg

SEQ ID NO: 190164 - RNA, 22 nt, Salmonella enterica enterica serovar Typhi
uggugccgcccgccuggcagaa

SEQ ID NO: 190165 - RNA, 22 nt, Salmonella enterica enterica serovar Typhi
gcguaggcccgccauucggcau

SEQ ID NO: 190166 - RNA, 22 nt, Salmonella enterica enterica serovar Typhi
aucugguugaauuugaucagga

SEQ ID NO: 190167 - RNA, 22 nt, Salmonella enterica enterica serovar Typhi
acgcccauuagcauuccgcccg

SEQ ID NO: 190168 - RNA, 22 nt, Salmonella enterica enterica serovar Typhi
caccgguaucgucaugacaggc

SEQ ID NO: 190169 - RNA, 22 nt, Salmonella enterica enterica serovar Typhi
caucgucgggcacguuuaccuc

SEQ ID NO: 190170 - RNA, 22 nt, Salmonella enterica enterica serovar Typhi
gaucgguuaggccgggcaggua

SEQ ID NO: 190171 - RNA, 22 nt, Salmonella enterica enterica serovar Typhi
ucggcguaguacuuauccugaa

SEQ ID NO: 190172 - RNA, 22 nt, Salmonella enterica enterica serovar Typhi
ccugccgacccggacuggccgg

SEQ ID NO: 190173 - RNA, 22 nt, Salmonella enterica enterica serovar Typhi
gccacgcucagucuucacggau

SEQ ID NO: 190174 - RNA, 22 nt, Salmonella enterica enterica serovar Typhi
uuugcccgguaagacuuccugc

SEQ ID NO: 190175 - RNA, 22 nt, Salmonella enterica enterica serovar Typhi
ugccgucguaccuaaugcuucg

SEQ ID NO: 190176 - RNA, 22 nt, Salmonella enterica enterica serovar Typhi
ggaauauggucugccgcaugug

SEQ ID NO: 190177 - RNA, 22 nt, Salmonella enterica enterica serovar Typhi
uuacacuuaaguuggaugauuu

SEQ ID NO: 190178 - RNA, 22 nt, Salmonella enterica enterica serovar Typhi
agcgcggacgacaguggugucc

SEQ ID NO: 190179 - RNA, 22 nt, Salmonella enterica enterica serovar Typhi
agaugggcaaagccacggugga

SEQ ID NO: 190180 - RNA, 22 nt, Salmonella enterica enterica serovar Typhi
uguucacacuguucaccucugg

SEQ ID NO: 190181 - RNA, 22 nt, Salmonella enterica enterica serovar Typhi
caacaguauuagccacggcauu

SEQ ID NO: 190182 - RNA, 22 nt, Salmonella enterica enterica serovar Typhi
uuaucagucuacaaauuacuuu

SEQ ID NO: 190183 - RNA, 22 nt, Salmonella enterica enterica serovar Typhi
cgccaacgccgugggagguauc

SEQ ID NO: 190184 - RNA, 22 nt, Salmonella enterica enterica serovar Typhi
gaggauuugcacgaugugaaua

SEQ ID NO: 190185 - RNA, 22 nt, Salmonella enterica enterica serovar Typhi
uccgacaugugcugcaaccgcu

SEQ ID NO: 190186 - RNA, 22 nt, Salmonella enterica enterica serovar Typhi
aucaggcagguuugccggauau

SEQ ID NO: 190187 - RNA, 22 nt, Salmonella enterica enterica serovar Typhi
agccagccaguucgaugauuuu

SEQ ID NO: 190188 - RNA, 22 nt, Salmonella enterica enterica serovar Typhi
agagccaguucguucacguguc

SEQ ID NO: 190189 - RNA, 22 nt, Salmonella enterica enterica serovar Typhi
ucgacgcgggcaaagcuggcgu

SEQ ID NO: 190190 - RNA, 22 nt, Salmonella enterica enterica serovar Typhi
uuggccagauacaccggcguca

SEQ ID NO: 190191 - RNA, 22 nt, Salmonella enterica enterica serovar Typhi
cauuggcaauagauaaucgucc

SEQ ID NO: 190192 - RNA, 22 nt, Salmonella enterica enterica serovar Typhi
gauuucgcuggaucgucaggaa

SEQ ID NO: 190193 - RNA, 22 nt, Salmonella enterica enterica serovar Typhi
agcuauucggccagcgccaccg

SEQ ID NO: 190194 - RNA, 22 nt, Salmonella enterica enterica serovar Typhi
ccaggguuugacguuuccacuu

SEQ ID NO: 190195 - RNA, 22 nt, Salmonella enterica enterica serovar Typhi
uuagcguuacgcuacugucucc

SEQ ID NO: 190196 - RNA, 22 nt, Salmonella enterica enterica serovar Typhi
uacguaugggguaugaggcggu

SEQ ID NO: 190197 - RNA, 22 nt, Salmonella enterica enterica serovar Typhi
gcgacgacauuagacauguuca

SEQ ID NO: 190198 - RNA, 22 nt, Salmonella enterica enterica serovar Typhi
aucgccauacggcagacgcgcg

SEQ ID NO: 190199 - RNA, 22 nt, Salmonella enterica enterica serovar Typhi
uccguaaccgucuggcggaguc

SEQ ID NO: 190200 - RNA, 22 nt, Salmonella enterica enterica serovar Typhi
aucguugcauuuauggauaacg

SEQ ID NO: 190201 - RNA, 22 nt, Salmonella enterica enterica serovar Typhi
ugguuuaaaguggcaaugaagg

SEQ ID NO: 190202 - RNA, 22 nt, Salmonella enterica enterica serovar Typhi
uauugcgauaaauucuuguagg

SEQ ID NO: 190203 - RNA, 22 nt, Salmonella enterica enterica serovar Typhi
acguuucucaaccuaugcgauu

SEQ ID NO: 190204 - RNA, 22 nt, Salmonella enterica enterica serovar Typhi
gcugcggauuuuuaacgccugg

SEQ ID NO: 190205 - RNA, 22 nt, Salmonella enterica enterica serovar Typhi
ucggugauggucauaucaccgu

SEQ ID NO: 190206 - RNA, 22 nt, Salmonella enterica enterica serovar Typhi
uucagauacaaaaaacccugcu

SEQ ID NO: 190207 - RNA, 22 nt, Salmonella enterica enterica serovar Typhi
ucgagcguuucgaauacgcugu

SEQ ID NO: 190208 - RNA, 22 nt, Salmonella enterica enterica serovar Typhi
uccggcuuuuggucugcugauc

SEQ ID NO: 190209 - RNA, 22 nt, Salmonella enterica enterica serovar Typhi
gugccggauaacuuccugugcc

SEQ ID NO: 190210 - RNA, 22 nt, Salmonella enterica enterica serovar Typhi
aagugcgagaauaaucuucacg

SEQ ID NO: 190211 - RNA, 22 nt, Salmonella enterica enterica serovar Typhi
cagaugagcuucccgcuauuug

SEQ ID NO: 190212 - RNA, 22 nt, Salmonella enterica enterica serovar Typhi
cuugaucgaugaauucauuuuc

SEQ ID NO: 190213 - RNA, 22 nt, Salmonella enterica enterica serovar Typhi
uggucgacgaugccaucguggu

SEQ ID NO: 190214 - RNA, 22 nt, Salmonella enterica enterica serovar Typhi
caggcgugaaugugucugcgug

SEQ ID NO: 190215 - RNA, 23 nt, Salmonella enterica enterica serovar Typhi
ccugaucgaugaagcgcguacgc

SEQ ID NO: 190216 - RNA, 22 nt, Salmonella enterica enterica serovar Typhi
acugcuugaugaggccgaacgu

SEQ ID NO: 190217 - RNA, 22 nt, Salmonella enterica enterica serovar Typhi
gaaaugguugcuuuugccccug

SEQ ID NO: 190218 - RNA, 21 nt, Salmonella enterica enterica serovar Typhi
ccuggcuggcacccgcaucaa

SEQ ID NO: 190219 - RNA, 22 nt, Salmonella enterica enterica serovar Typhi
acgcuuaucaggccuacagaau

SEQ ID NO: 190220 - RNA, 22 nt, Salmonella enterica enterica serovar Typhi
cauucuuaccucuaugcacaau

SEQ ID NO: 190221 - RNA, 22 nt, Salmonella enterica enterica serovar Typhi
uacaaacggcgguauaacauga

SEQ ID NO: 190222 - RNA, 22 nt, Salmonella enterica enterica serovar Typhi
ugaacuucgcgaacaguacggu

SEQ ID NO: 190223 - RNA, 22 nt, Salmonella enterica enterica serovar Typhi
gcuuucugcgcgcacgccggag

SEQ ID NO: 190224 - RNA, 22 nt, Salmonella enterica enterica serovar Typhi
aacgcgaccaggugauugagca

SEQ ID NO: 190225 - RNA, 22 nt, Salmonella enterica enterica serovar Typhi
gauugcauccggaagaguuagg

SEQ ID NO: 190226 - RNA, 22 nt, Salmonella enterica enterica serovar Typhi
cuggcaggcgggauggacauua

SEQ ID NO: 190227 - RNA, 22 nt, Salmonella enterica enterica serovar Typhi
gcuguagcgccagauggaugug

SEQ ID NO: 190228 - RNA, 22 nt, Salmonella enterica enterica serovar Typhi
acugcugcgguaaugcagagua

SEQ ID NO: 190229 - RNA, 22 nt, Salmonella enterica enterica serovar Typhi
aauagcgaaauguaacguuuug

SEQ ID NO: 190230 - RNA, 22 nt, Salmonella enterica enterica serovar Typhi
gguaaacgcuguguaucucucu

SEQ ID NO: 190231 - RNA, 22 nt, Salmonella enterica enterica serovar Typhi
ccauuggugguacugagcugcu

SEQ ID NO: 190232 - RNA, 22 nt, Salmonella enterica enterica serovar Typhi
cggaacuguuccgucguauucg

SEQ ID NO: 190233 - RNA, 18 nt, Salmonella enterica enterica serovar Typhi
ucaacuucagcagauacc

SEQ ID NO: 190234 - RNA, 22 nt, Salmonella enterica enterica serovar Typhi
agcgcgguaucgcugagcuccu

SEQ ID NO: 190235 - RNA, 22 nt, Salmonella enterica enterica serovar Typhi
ugcuggaagacgcguuuucgua

SEQ ID NO: 190236 - RNA, 22 nt, Salmonella enterica enterica serovar Typhi
gagcugguuaacguguuccgcg

SEQ ID NO: 190237 - RNA, 22 nt, Salmonella enterica enterica serovar Typhi
caaccugggaacaagagccauu

SEQ ID NO: 190238 - RNA, 22 nt, Salmonella enterica enterica serovar Typhi
cagcacgcgcugaaugucgccg

SEQ ID NO: 190239 - RNA, 22 nt, Salmonella enterica enterica serovar Typhi
gaccauccgcacauucaucugc

SEQ ID NO: 190240 - RNA, 22 nt, Salmonella enterica enterica serovar Typhi
gauaccgcuaaucgcgacgguc

SEQ ID NO: 190241 - RNA, 22 nt, Salmonella enterica enterica serovar Typhi
aggaacgccuccugaggcagcu

SEQ ID NO: 190242 - RNA, 22 nt, Salmonella enterica enterica serovar Typhi
ugacgcugaaguugcugccgca

SEQ ID NO: 190243 - RNA, 22 nt, Salmonella enterica enterica serovar Typhi
ucggucauugagaucuguugga

SEQ ID NO: 190244 - RNA, 22 nt, Salmonella enterica enterica serovar Typhi
augcguuauuugaccgccuggg

SEQ ID NO: 190245 - RNA, 22 nt, Salmonella enterica enterica serovar Typhi
auggcagggacgcccggugugu

SEQ ID NO: 190246 - RNA, 22 nt, Salmonella enterica enterica serovar Typhi
ucgacacgguggugaucguucu

SEQ ID NO: 190247 - RNA, 22 nt, Salmonella enterica enterica serovar Typhi
acagagccugucucagcaauga

SEQ ID NO: 190248 - RNA, 22 nt, Salmonella enterica enterica serovar Typhi
uaagaguaggugaguacgccgu

SEQ ID NO: 190249 - RNA, 22 nt, Salmonella enterica enterica serovar Typhi
auccaucugaccuuuguccugu

SEQ ID NO: 190250 - RNA, 22 nt, Salmonella enterica enterica serovar Typhi
auacuuacaugacuaaugagac

SEQ ID NO: 190251 - RNA, 22 nt, Salmonella enterica enterica serovar Typhi
aaugcaguagucgcugcggagg

SEQ ID NO: 190252 - RNA, 22 nt, Salmonella enterica enterica serovar Typhi
cgccagucaggauugcgaggac

SEQ ID NO: 190253 - RNA, 22 nt, Salmonella enterica enterica serovar Typhi
acguggugcgcggcagccguuu

SEQ ID NO: 190254 - RNA, 22 nt, Salmonella enterica enterica serovar Typhi
aucagcguaucuucauuuucgc

SEQ ID NO: 190255 - RNA, 22 nt, Salmonella enterica enterica serovar Typhi
guugcgcuggugguuuacguca

SEQ ID NO: 190256 - RNA, 22 nt, Salmonella enterica enterica serovar Typhi
uugccgucgucagugacguaca

SEQ ID NO: 190257 - RNA, 22 nt, Salmonella enterica enterica serovar Typhi
ggcgcguaaaaaacugucugaa

SEQ ID NO: 190258 - RNA, 22 nt, Salmonella enterica enterica serovar Typhi
gcgcgucagggaagcgagguga

SEQ ID NO: 190259 - RNA, 22 nt, Salmonella enterica enterica serovar Typhi
auggcagcauuaugggcauuaa

SEQ ID NO: 190260 - RNA, 21 nt, Salmonella enterica enterica serovar Typhi
guaucaguaguaccgcaguga

SEQ ID NO: 190261 - RNA, 22 nt, Salmonella enterica enterica serovar Typhi
gcuggacguugggggcuaccgg

SEQ ID NO: 190262 - RNA, 22 nt, Salmonella enterica enterica serovar Typhi
aagaccuugcgggucgugacgu

SEQ ID NO: 190263 - RNA, 20 nt, Salmonella enterica enterica serovar Typhi
uucaggucgaugucaucaau

SEQ ID NO: 190264 - RNA, 22 nt, Salmonella enterica enterica serovar Typhi
ucggcagaaaagucgagcugcg

SEQ ID NO: 190265 - RNA, 22 nt, Salmonella enterica enterica serovar Typhi
cggcgagauugucaucgacccg

SEQ ID NO: 190266 - RNA, 22 nt, Salmonella enterica enterica serovar Typhi
cagaccaguaaauuaaguaagg

SEQ ID NO: 190267 - RNA, 21 nt, Salmonella enterica enterica serovar Typhi
ugucgcaguuaccgccguucc

SEQ ID NO: 190268 - RNA, 22 nt, Salmonella enterica enterica serovar Typhi
gaugaacauacguuuggucacg

SEQ ID NO: 190269 - RNA, 22 nt, Salmonella enterica enterica serovar Typhi
gcuaucaaagaagcgaacaacc

SEQ ID NO: 190270 - RNA, 22 nt, Salmonella enterica enterica serovar Typhi
cgaguguugacugccguuuuag

SEQ ID NO: 190271 - RNA, 22 nt, Salmonella enterica enterica serovar Typhi
auaacgguaaauugauugaucg

SEQ ID NO: 190272 - RNA, 22 nt, Salmonella enterica enterica serovar Typhi
cacaggagauucgucaggcggc

SEQ ID NO: 190273 - RNA, 22 nt, Salmonella enterica enterica serovar Typhi
uccgcaucuucgaagaagaaga

SEQ ID NO: 190274 - RNA, 22 nt, Salmonella enterica enterica serovar Typhi
gcgcaaaucagucauagcggcu

SEQ ID NO: 190275 - RNA, 19 nt, Salmonella enterica enterica serovar Typhi
uccggaugacgaacuggcc

SEQ ID NO: 190276 - RNA, 22 nt, Salmonella enterica enterica serovar Typhi
uauccggcuaauaacgucucaa

SEQ ID NO: 190277 - RNA, 22 nt, Salmonella enterica enterica serovar Typhi
aaccggcuggccuggcgaacga

SEQ ID NO: 190278 - RNA, 22 nt, Salmonella enterica enterica serovar Typhi
cgccaucacguuaauacucaau

SEQ ID NO: 190279 - RNA, 21 nt, Salmonella enterica enterica serovar Typhi
ggccaugacaucuauccuauc

SEQ ID NO: 190280 - RNA, 22 nt, Salmonella enterica enterica serovar Typhi
uaacagccccagcccuggcgua

SEQ ID NO: 190281 - RNA, 22 nt, Salmonella enterica enterica serovar Typhi
gguuucauuuguugccguuaug

SEQ ID NO: 190282 - RNA, 23 nt, Salmonella enterica enterica serovar Typhi
ccgcaacgauugccaguagcggu

SEQ ID NO: 190283 - RNA, 21 nt, Salmonella enterica enterica serovar Typhi
ucugauugacgucaaucuggg

SEQ ID NO: 190284 - RNA, 22 nt, Salmonella enterica enterica serovar Typhi
gcgucauucuuacccggcgaua

SEQ ID NO: 190285 - RNA, 19 nt, Salmonella enterica enterica serovar Typhi
gcggcuuuuguagauauug

SEQ ID NO: 190286 - RNA, 22 nt, Salmonella enterica enterica serovar Typhi
uagccguggcggacaacggcgc

SEQ ID NO: 190287 - RNA, 22 nt, Salmonella enterica enterica serovar Typhi
ucggcguuuaccguaggcgacc

SEQ ID NO: 190288 - RNA, 22 nt, Salmonella enterica enterica serovar Typhi
uuuccgcgacaaauucaucacc

SEQ ID NO: 190289 - RNA, 22 nt, Salmonella enterica enterica serovar Typhi
gucgcugguaaagaugacgaug

SEQ ID NO: 190290 - RNA, 22 nt, Salmonella enterica enterica serovar Typhi
gucggccaguauuugucugcca

SEQ ID NO: 190291 - RNA, 22 nt, Salmonella enterica enterica serovar Typhi
aacuggcgcaaugguuaggaua

SEQ ID NO: 190292 - RNA, 22 nt, Salmonella enterica enterica serovar Typhi
ugcguauuacccgauuagcguu

SEQ ID NO: 190293 - RNA, 22 nt, Salmonella enterica enterica serovar Typhi
agagguucaugaugcgccugca

SEQ ID NO: 190294 - RNA, 22 nt, Salmonella enterica enterica serovar Typhi
uauggcuucccaacggauguug

SEQ ID NO: 190295 - RNA, 22 nt, Salmonella enterica enterica serovar Typhi
gcgcucugucugcggacgucac

SEQ ID NO: 190296 - RNA, 22 nt, Salmonella enterica enterica serovar Typhi
augcugaccgaccagugguacg

SEQ ID NO: 190297 - RNA, 22 nt, Salmonella enterica enterica serovar Typhi
guauggcgugccauuguugccu

SEQ ID NO: 190298 - RNA, 22 nt, Salmonella enterica enterica serovar Typhi
agccgcuauaucugggggcgca

SEQ ID NO: 190299 - RNA, 21 nt, Salmonella enterica enterica serovar Typhi
acguugaccaucgguacgccu

SEQ ID NO: 190300 - RNA, 22 nt, Salmonella enterica enterica serovar Typhi
uauuccggugaucuuugucucc

SEQ ID NO: 190301 - RNA, 22 nt, Salmonella enterica enterica serovar Typhi
uccugaccugaugcgcgagaag

SEQ ID NO: 190302 - RNA, 21 nt, Salmonella enterica enterica serovar Typhi
cuuguuaacaguugcgauggc

SEQ ID NO: 190303 - RNA, 22 nt, Salmonella enterica enterica serovar Typhi
agcaaucgcaagcggaagcgcg

SEQ ID NO: 190304 - RNA, 22 nt, Salmonella enterica enterica serovar Typhi
gccgugauuacggcgguaggua

SEQ ID NO: 190305 - RNA, 22 nt, Salmonella enterica enterica serovar Typhi
ugaagcguucuuguaaaaauga

SEQ ID NO: 190306 - RNA, 22 nt, Salmonella enterica enterica serovar Typhi
ggugcucguugugguccaucug

SEQ ID NO: 190307 - RNA, 22 nt, Salmonella enterica enterica serovar Typhi
cguggcugaaacguauucgccu

SEQ ID NO: 190308 - RNA, 22 nt, Salmonella enterica enterica serovar Typhi
gccaucuugcccgccagcggac

SEQ ID NO: 190309 - RNA, 22 nt, Salmonella enterica enterica serovar Typhi
aaagugguuagaguauuuuucg

SEQ ID NO: 190310 - RNA, 22 nt, Salmonella enterica enterica serovar Typhi
ugcaacgcuuuaugguggcgau

SEQ ID NO: 190311 - RNA, 22 nt, Salmonella enterica enterica serovar Typhi
uuauccgggcauuaaaguuucc

SEQ ID NO: 190312 - RNA, 22 nt, Salmonella enterica enterica serovar Typhi
augcgcuguacaaugucgcgau

SEQ ID NO: 190313 - RNA, 22 nt, Salmonella enterica enterica serovar Typhi
ccugaugcuguugcaugauggu

SEQ ID NO: 190314 - RNA, 22 nt, Salmonella enterica enterica serovar Typhi
augugcgucugcugucggugaa

SEQ ID NO: 190315 - RNA, 23 nt, Salmonella enterica enterica serovar Typhi
ccugaccgcugaccacggcugug

SEQ ID NO: 190316 - RNA, 22 nt, Salmonella enterica enterica serovar Typhi
cgaugcaaaugagcgagagccg

SEQ ID NO: 190317 - RNA, 22 nt, Salmonella enterica enterica serovar Typhi
ucugacugaugggaugcgcuga

SEQ ID NO: 190318 - RNA, 22 nt, Salmonella enterica enterica serovar Typhi
gacugcugaaccagaacgacgu

SEQ ID NO: 190319 - RNA, 22 nt, Salmonella enterica enterica serovar Typhi
aguggcguacaugguggaaggu

SEQ ID NO: 190320 - RNA, 22 nt, Salmonella enterica enterica serovar Typhi
augccgggucggugccuucugc

SEQ ID NO: 190321 - RNA, 19 nt, Salmonella enterica enterica serovar Typhi
cgguaaguuuuauuuccuc

SEQ ID NO: 190322 - RNA, 22 nt, Salmonella enterica enterica serovar Typhi
acagaauggcauccgccugcuc

SEQ ID NO: 190323 - RNA, 22 nt, Salmonella enterica enterica serovar Typhi
gccauugcguuguuagagaagu

SEQ ID NO: 190324 - RNA, 22 nt, Salmonella enterica enterica serovar Typhi
ggcugcugaagguguucugcgc

SEQ ID NO: 190325 - RNA, 22 nt, Salmonella enterica enterica serovar Typhi
ggugcugaaggguucguaguga

SEQ ID NO: 190326 - RNA, 22 nt, Salmonella enterica enterica serovar Typhi
caggaagucacgcugccagcga

SEQ ID NO: 190327 - RNA, 22 nt, Salmonella enterica enterica serovar Typhi
cuccaguuggcugauguuguau

SEQ ID NO: 190328 - RNA, 23 nt, Salmonella enterica enterica serovar Typhi
auccgugacauuacucguuuacc

SEQ ID NO: 190329 - RNA, 22 nt, Salmonella enterica enterica serovar Typhi
cgauaaagcuauguuggaagug

SEQ ID NO: 190330 - RNA, 23 nt, Salmonella enterica enterica serovar Typhi
agccugaguuugcgugagguggc

SEQ ID NO: 190331 - RNA, 22 nt, Salmonella enterica enterica serovar Typhi
aacaggguaaaggaggccggag

SEQ ID NO: 190332 - RNA, 22 nt, Salmonella enterica enterica serovar Typhi
cugcuguacauggcugccgcug

SEQ ID NO: 190333 - RNA, 22 nt, Salmonella enterica enterica serovar Typhi
gcgugaauaauguugcucucua

SEQ ID NO: 190334 - RNA, 22 nt, Salmonella enterica enterica serovar Typhi
auccugaucccguuuaucgugg

SEQ ID NO: 190335 - RNA, 22 nt, Salmonella enterica enterica serovar Typhi
ucuguaggccugauaagcgcag

SEQ ID NO: 190336 - RNA, 22 nt, Salmonella enterica enterica serovar Typhi
acacagagaacuggugaaagcc

SEQ ID NO: 190337 - RNA, 22 nt, Salmonella enterica enterica serovar Typhi
agguucgcggcauguuaaaggg

SEQ ID NO: 190338 - RNA, 22 nt, Salmonella enterica enterica serovar Typhi
ccgaccuggcgucgacggcggc

SEQ ID NO: 190339 - RNA, 22 nt, Salmonella enterica enterica serovar Typhi
ugcugccgcugacgcuggccau

SEQ ID NO: 190340 - RNA, 22 nt, Salmonella enterica enterica serovar Typhi
ugagagauauuggauuuuacuu

SEQ ID NO: 190341 - RNA, 22 nt, Salmonella enterica enterica serovar Typhi
ggcguggacguccuguugaacg

SEQ ID NO: 190342 - RNA, 22 nt, Salmonella enterica enterica serovar Typhi
aagcgucgccgggggauauaac

SEQ ID NO: 190343 - RNA, 22 nt, Salmonella enterica enterica serovar Typhi
cgccgcaagggacggaggucuc

SEQ ID NO: 190344 - RNA, 22 nt, Salmonella enterica enterica serovar Typhi
cauucgcagauacuguguuccc

SEQ ID NO: 190345 - RNA, 22 nt, Salmonella enterica enterica serovar Typhi
gcgcagaauaagguucaacgua

SEQ ID NO: 190346 - RNA, 17 nt, Salmonella enterica enterica serovar Typhi
uccuggaacgccgcauc

SEQ ID NO: 190347 - RNA, 23 nt, Salmonella enterica enterica serovar Typhi
cgcauaucugccuguucugcuau

SEQ ID NO: 190348 - RNA, 22 nt, Salmonella enterica enterica serovar Typhi
gcguugacgagucgcugauucu

SEQ ID NO: 190349 - RNA, 23 nt, Salmonella enterica enterica serovar Typhi
uguugcgcagaucauauucacau

SEQ ID NO: 190350 - RNA, 22 nt, Salmonella enterica enterica serovar Typhi
ggcgcugacguugcgccauacu

SEQ ID NO: 190351 - RNA, 22 nt, Salmonella enterica enterica serovar Typhi
accggcuguugcggcugcugau

SEQ ID NO: 190352 - RNA, 22 nt, Salmonella enterica enterica serovar Typhi
uaucuggcaauuuauugcguug

SEQ ID NO: 190353 - RNA, 22 nt, Salmonella enterica enterica serovar Typhi
uagggccgggcagugcucgaaa

SEQ ID NO: 190354 - RNA, 21 nt, Salmonella enterica enterica serovar Typhi
aucagcaacugaccgagcucg

SEQ ID NO: 190355 - RNA, 22 nt, Salmonella enterica enterica serovar Typhi
caucggcaauaccugguuaaag

SEQ ID NO: 190356 - RNA, 22 nt, Salmonella enterica enterica serovar Typhi
aaggccuuugaccacuauuucg

SEQ ID NO: 190357 - RNA, 22 nt, Salmonella enterica enterica serovar Typhi
uuuacggaucugcaggaucagg

SEQ ID NO: 190358 - RNA, 22 nt, Salmonella enterica enterica serovar Typhi
cgcgaaguaaugccagaagaua

SEQ ID NO: 190359 - RNA, 22 nt, Salmonella enterica enterica serovar Typhi
gcugauuauugacuuucuggcg

SEQ ID NO: 190360 - RNA, 20 nt, Salmonella enterica enterica serovar Typhi
uguccgacuguuaacguaaa

SEQ ID NO: 190361 - RNA, 20 nt, Salmonella enterica enterica serovar Typhi
gaacaucggucaucuccggc

SEQ ID NO: 190362 - RNA, 22 nt, Salmonella enterica enterica serovar Typhi
uaaagcaccgcggccuuuuuug

SEQ ID NO: 190363 - RNA, 19 nt, Salmonella enterica enterica serovar Typhi
aacauucagauuguuggaa

SEQ ID NO: 190364 - RNA, 22 nt, Salmonella enterica enterica serovar Typhi
acaguacuggcacugaagucgc

SEQ ID NO: 190365 - RNA, 20 nt, Salmonella enterica enterica serovar Typhi
gauaaacagcucuucccgcg

SEQ ID NO: 190366 - RNA, 21 nt, Salmonella enterica enterica serovar Typhi
agcgucaauugccaggagcga

SEQ ID NO: 190367 - RNA, 22 nt, Salmonella enterica enterica serovar Typhi
cagguuguugggauguuucaga

SEQ ID NO: 190368 - RNA, 22 nt, Salmonella enterica enterica serovar Typhi
uccgccaggcgcugaacgucgc

SEQ ID NO: 190369 - RNA, 22 nt, Salmonella enterica enterica serovar Typhi
gacgguacguugacuacgccgg

SEQ ID NO: 190370 - RNA, 22 nt, Salmonella enterica enterica serovar Typhi
aggccugauaagcgcagcgcca

SEQ ID NO: 190371 - RNA, 22 nt, Salmonella enterica enterica serovar Typhi
aguaugguaagcagcuaucuuu

SEQ ID NO: 190372 - RNA, 22 nt, Salmonella enterica enterica serovar Typhi
cuggcugcugacgguccuguua

SEQ ID NO: 190373 - RNA, 22 nt, Salmonella enterica enterica serovar Typhi
aaugucgccaucaaaggucagg

SEQ ID NO: 190374 - RNA, 22 nt, Salmonella enterica enterica serovar Typhi
guggcgauaaacagaucgcccg

SEQ ID NO: 190375 - RNA, 22 nt, Salmonella enterica enterica serovar Typhi
aacgcgaagguaaaauuaucgu

SEQ ID NO: 190376 - RNA, 22 nt, Salmonella enterica enterica serovar Typhi
auccggacgacuuacagcgggu

SEQ ID NO: 190377 - RNA, 22 nt, Salmonella enterica enterica serovar Typhi
aagcaacggacaacgagaaucu

SEQ ID NO: 190378 - RNA, 22 nt, Salmonella enterica enterica serovar Typhi
ugccgcauggcgcuacgcuugu

SEQ ID NO: 190379 - RNA, 22 nt, Salmonella enterica enterica serovar Typhi
uggaugaucucaaggcgcugua

SEQ ID NO: 190380 - RNA, 22 nt, Salmonella enterica enterica serovar Typhi
ccgcguaugaagagcggugagc

SEQ ID NO: 190381 - RNA, 23 nt, Salmonella enterica enterica serovar Typhi
gcagauccuggccgggcaguaug

SEQ ID NO: 190382 - RNA, 22 nt, Salmonella enterica enterica serovar Typhi
uuuaggucugugccauagcuau

SEQ ID NO: 190383 - RNA, 22 nt, Salmonella enterica enterica serovar Typhi
agcaguuuaauaagguucuggc

SEQ ID NO: 190384 - RNA, 22 nt, Salmonella enterica enterica serovar Typhi
guaucguccagaaucagcgcuu

SEQ ID NO: 190385 - RNA, 22 nt, Salmonella enterica enterica serovar Typhi
ugccggagaugaccgauguuca

SEQ ID NO: 190386 - RNA, 23 nt, Salmonella enterica enterica serovar Typhi
cguaauguuaacuggggcuuuuc

SEQ ID NO: 190387 - RNA, 22 nt, Salmonella enterica enterica serovar Typhi
gacaacaucccagaaaaugacg

SEQ ID NO: 190388 - RNA, 22 nt, Salmonella enterica enterica serovar Typhi
ucagccgccgacagaugccauu

SEQ ID NO: 190389 - RNA, 22 nt, Salmonella enterica enterica serovar Typhi
cugcauuugaugguaugccagu

SEQ ID NO: 190390 - RNA, 22 nt, Salmonella enterica enterica serovar Typhi
gaguuuaucuucaacagugaaa

SEQ ID NO: 190391 - RNA, 22 nt, Salmonella enterica enterica serovar Typhi
auacagggcggacggguaguaa

SEQ ID NO: 190392 - RNA, 22 nt, Salmonella enterica enterica serovar Typhi
ccggccuacaagauuugcaaua

SEQ ID NO: 190393 - RNA, 22 nt, Salmonella enterica enterica serovar Typhi
ggugaauuccggauuaugaugu

SEQ ID NO: 190394 - RNA, 22 nt, Salmonella enterica enterica serovar Typhi
gccguuuauaaguauuacgaca

SEQ ID NO: 190395 - RNA, 22 nt, Salmonella enterica enterica serovar Typhi
augaugcacaucggcauccauu

SEQ ID NO: 190396 - RNA, 22 nt, Salmonella enterica enterica serovar Typhi
guagaacguggugaugugauuu

SEQ ID NO: 190397 - RNA, 19 nt, Salmonella enterica enterica serovar Typhi
gcccuacguccgcacgcgg

SEQ ID NO: 190398 - RNA, 22 nt, Salmonella enterica enterica serovar Typhi
guugaaaucucugaaggguuag

SEQ ID NO: 190399 - RNA, 22 nt, Salmonella enterica enterica serovar Typhi
ucuuggcgcgcuaauuggucug

SEQ ID NO: 190400 - RNA, 22 nt, Salmonella enterica enterica serovar Typhi
ugucgcagccgauaucgcuaug

SEQ ID NO: 190401 - RNA, 22 nt, Salmonella enterica enterica serovar Typhi
uucuggcgucguuuucgccgcc

SEQ ID NO: 190402 - RNA, 22 nt, Salmonella enterica enterica serovar Typhi
ucggcagcgaaaaauucacugc

SEQ ID NO: 190403 - RNA, 21 nt, Salmonella enterica enterica serovar Typhi
gccugcugauggggaaauuuc

SEQ ID NO: 190404 - RNA, 22 nt, Salmonella enterica enterica serovar Typhi
aagaucggucggcgccuuaugu

SEQ ID NO: 190405 - RNA, 22 nt, Salmonella enterica enterica serovar Typhi
uauaggcgcuaagcugauccgg

SEQ ID NO: 190406 - RNA, 22 nt, Salmonella enterica enterica serovar Typhi
uggcucuuuugcggcguggaau

SEQ ID NO: 190407 - RNA, 22 nt, Salmonella enterica enterica serovar Typhi
gaaguacgcuauaugccgagug

SEQ ID NO: 190408 - RNA, 22 nt, Salmonella enterica enterica serovar Typhi
ggcguugaacgagcaguaucag

SEQ ID NO: 190409 - RNA, 22 nt, Salmonella enterica enterica serovar Typhi
gauuccucaggaguacgccauu

SEQ ID NO: 190410 - RNA, 22 nt, Salmonella enterica enterica serovar Typhi
caucggcuggcggagcgucuuc

SEQ ID NO: 190411 - RNA, 22 nt, Salmonella enterica enterica serovar Typhi
auuagcgcgucguucuuauggu

SEQ ID NO: 190412 - RNA, 21 nt, Salmonella enterica enterica serovar Typhi
gcgcaucggguuauuguucac

SEQ ID NO: 190413 - RNA, 22 nt, Salmonella enterica enterica serovar Typhi
gcgcuuuaacagcagccgaggu

SEQ ID NO: 190414 - RNA, 22 nt, Salmonella enterica enterica serovar Typhi
augacaacauuaaaugggagaa

SEQ ID NO: 190415 - RNA, 22 nt, Salmonella enterica enterica serovar Typhi
uauugugcauagagguaagaau

SEQ ID NO: 190416 - RNA, 22 nt, Salmonella enterica enterica serovar Typhi
aguaagauggggaaagcaugag

SEQ ID NO: 190417 - RNA, 22 nt, Salmonella enterica enterica serovar Typhi
aacgcugugucaugccgguauu

SEQ ID NO: 190418 - RNA, 22 nt, Salmonella enterica enterica serovar Typhi
ugcaucucuugaggcuauguuu

SEQ ID NO: 190419 - RNA, 22 nt, Salmonella enterica enterica serovar Typhi
aucccgccagcgaaagcgucug

SEQ ID NO: 190420 - RNA, 20 nt, Salmonella enterica enterica serovar Typhi
cgucuggcgccgcaggaacu

SEQ ID NO: 190421 - RNA, 22 nt, Salmonella enterica enterica serovar Typhi
uucgugagcuacgucaaaaugu

SEQ ID NO: 190422 - RNA, 22 nt, Salmonella enterica enterica serovar Typhi
ugaccucugaaggacgcgugau

SEQ ID NO: 190423 - RNA, 22 nt, Salmonella enterica enterica serovar Typhi
ggcgacauucagcgcgugcugu

SEQ ID NO: 190424 - RNA, 22 nt, Salmonella enterica enterica serovar Typhi
cuggcuuuucuugggauucagg

SEQ ID NO: 190425 - RNA, 22 nt, Salmonella enterica enterica serovar Typhi
gucgauagcuauuaccgcacau

SEQ ID NO: 190426 - RNA, 22 nt, Salmonella enterica enterica serovar Typhi
gcguaucaucaacccgaugcgc

SEQ ID NO: 190427 - RNA, 22 nt, Salmonella enterica enterica serovar Typhi
cgccugcugaauuugggcgaac

SEQ ID NO: 190428 - RNA, 22 nt, Salmonella enterica enterica serovar Typhi
ucgacgaacugcaagagcggau

SEQ ID NO: 190429 - RNA, 22 nt, Salmonella enterica enterica serovar Typhi
ugcgugacauguucgaacaagc

SEQ ID NO: 190430 - RNA, 22 nt, Salmonella enterica enterica serovar Typhi
ucauuacccgugaugaagaugc

SEQ ID NO: 190431 - RNA, 22 nt, Salmonella enterica enterica serovar Typhi
aauccagaguauuaauuuucgu

SEQ ID NO: 190432 - RNA, 22 nt, Salmonella enterica enterica serovar Typhi
ggcuggauauuauuaagcgcga

SEQ ID NO: 190433 - RNA, 22 nt, Salmonella enterica enterica serovar Typhi
gauugccuguaauaccgccagu

SEQ ID NO: 190434 - RNA, 22 nt, Salmonella enterica enterica serovar Typhi
gggcagcaugauguauccuggc

SEQ ID NO: 190435 - RNA, 22 nt, Salmonella enterica enterica serovar Typhi
uaggccggaugagcguuagcgc

SEQ ID NO: 190436 - RNA, 22 nt, Salmonella enterica enterica serovar Typhi
uuucauuguuguggaaccgcuu

SEQ ID NO: 190437 - RNA, 22 nt, Salmonella enterica enterica serovar Typhi
aaacguacuuugcacggcgcau

SEQ ID NO: 190438 - RNA, 22 nt, Salmonella enterica enterica serovar Typhi
uguuggacgcgccggacguguc

SEQ ID NO: 190439 - RNA, 22 nt, Salmonella enterica enterica serovar Typhi
ggccugauuccccagcauuguu

SEQ ID NO: 190440 - RNA, 22 nt, Salmonella enterica enterica serovar Typhi
gugguaauuagugaggauggcg

SEQ ID NO: 190441 - RNA, 22 nt, Salmonella enterica enterica serovar Typhi
acggucaugaaaaucgugccgc

SEQ ID NO: 190442 - RNA, 18 nt, Salmonella enterica enterica serovar Typhi
uggcagcguucuucacgu

SEQ ID NO: 190443 - RNA, 22 nt, Salmonella enterica enterica serovar Typhi
auuaucgaugaaugccagcgag

SEQ ID NO: 190444 - RNA, 22 nt, Salmonella enterica enterica serovar Typhi
ccggaugaagucguuaauaagu

SEQ ID NO: 190445 - RNA, 22 nt, Salmonella enterica enterica serovar Typhi
cagcguauggcugcaagacggu

SEQ ID NO: 190446 - RNA, 22 nt, Salmonella enterica enterica serovar Typhi
ggugaaacgcugaaugucuccc

SEQ ID NO: 190447 - RNA, 22 nt, Salmonella enterica enterica serovar Typhi
gaaauucccaauccgagcgcgg

SEQ ID NO: 190448 - RNA, 22 nt, Salmonella enterica enterica serovar Typhi
gccguccaccguggcgguggaa

SEQ ID NO: 190449 - RNA, 22 nt, Salmonella enterica enterica serovar Typhi
guaggccggauaaucguagcgc

SEQ ID NO: 190450 - RNA, 22 nt, Salmonella enterica enterica serovar Typhi
ucguuauaccgcugggccgcgc

SEQ ID NO: 190451 - RNA, 22 nt, Salmonella enterica enterica serovar Typhi
ccaagggccggucgaucuguuc

SEQ ID NO: 190452 - RNA, 22 nt, Salmonella enterica enterica serovar Typhi
uuucugcgcgcuguccggcccc

SEQ ID NO: 190453 - RNA, 16 nt, Salmonella enterica enterica serovar Typhi
accguugacggucuua

SEQ ID NO: 190454 - RNA, 21 nt, Salmonella enterica enterica serovar Typhi
gugugccacggcauuccggau

SEQ ID NO: 190455 - RNA, 22 nt, Salmonella enterica enterica serovar Typhi
gcguggaugccccgcugaauau

SEQ ID NO: 190456 - RNA, 22 nt, Salmonella enterica enterica serovar Typhi
gucggguaaggcguagccgcca

SEQ ID NO: 190457 - RNA, 22 nt, Salmonella enterica enterica serovar Typhi
agcaggacuggggccaucagca

SEQ ID NO: 190458 - RNA, 21 nt, Salmonella enterica enterica serovar Typhi
gcacaucgaaucaguguuguu

SEQ ID NO: 190459 - RNA, 22 nt, Salmonella enterica enterica serovar Typhi
uaguacgauggaaggccgcaaa

SEQ ID NO: 190460 - RNA, 19 nt, Salmonella enterica enterica serovar Typhi
auaccguuggccuugaugu

SEQ ID NO: 190461 - RNA, 22 nt, Salmonella enterica enterica serovar Typhi
cagaaacgguguaggccggaua

SEQ ID NO: 190462 - RNA, 22 nt, Salmonella enterica enterica serovar Typhi
gugacgauuauuacugacauuu

SEQ ID NO: 190463 - RNA, 22 nt, Salmonella enterica enterica serovar Typhi
ggauuucaugucgacgcaaggg

SEQ ID NO: 190464 - RNA, 22 nt, Salmonella enterica enterica serovar Typhi
cagacguaaaacacgacuuauu

SEQ ID NO: 190465 - RNA, 22 nt, Salmonella enterica enterica serovar Typhi
cugaccuuugauggcgacauuc

SEQ ID NO: 190466 - RNA, 22 nt, Salmonella enterica enterica serovar Typhi
auagcgacaggaaucuguguga

SEQ ID NO: 190467 - RNA, 22 nt, Salmonella enterica enterica serovar Typhi
cgccagguuuuccaguuuguga

SEQ ID NO: 190468 - RNA, 22 nt, Salmonella enterica enterica serovar Typhi
uucuaacaaaacuaauguugag

SEQ ID NO: 190469 - RNA, 22 nt, Salmonella enterica enterica serovar Typhi
cggauggcgcuaugcuuauccg

SEQ ID NO: 190470 - RNA, 20 nt, Salmonella enterica enterica serovar Typhi
aaugacgggcugguugaccc

SEQ ID NO: 190471 - RNA, 22 nt, Salmonella enterica enterica serovar Typhi
aucagcaagcgcugugcaaguu

SEQ ID NO: 190472 - RNA, 22 nt, Salmonella enterica enterica serovar Typhi
gcuggcaagauggaagguacgu

SEQ ID NO: 190473 - RNA, 22 nt, Salmonella enterica enterica serovar Typhi
uccagcgugccguagcgcugcc

SEQ ID NO: 190474 - RNA, 22 nt, Salmonella enterica enterica serovar Typhi
cucgaugcauccagaaugauuu

SEQ ID NO: 190475 - RNA, 22 nt, Salmonella enterica enterica serovar Typhi
gcgugaaagacuauaucgccau

SEQ ID NO: 190476 - RNA, 22 nt, Salmonella enterica enterica serovar Typhi
caaucugaagucugcgucccgu

SEQ ID NO: 190477 - RNA, 22 nt, Salmonella enterica enterica serovar Typhi
uaacaacggagaacaguaucuu

SEQ ID NO: 190478 - RNA, 22 nt, Salmonella enterica enterica serovar Typhi
ucgcguuuauuaaacaguggca

SEQ ID NO: 190479 - RNA, 22 nt, Salmonella enterica enterica serovar Typhi
uggcggaguacaaauuucgaau

SEQ ID NO: 190480 - RNA, 22 nt, Salmonella enterica enterica serovar Typhi
acaaucagcgugaaacgggggc

SEQ ID NO: 190481 - RNA, 22 nt, Salmonella enterica enterica serovar Typhi
acgaugacuguaauguuucccg

SEQ ID NO: 190482 - RNA, 22 nt, Salmonella enterica enterica serovar Typhi
uuguccgugcugcugguaauca

SEQ ID NO: 190483 - RNA, 22 nt, Salmonella enterica enterica serovar Typhi
auccuucgcugagcguaugauu

SEQ ID NO: 190484 - RNA, 22 nt, Salmonella enterica enterica serovar Typhi
uggcggcaaucggugcugcgau

SEQ ID NO: 190485 - RNA, 22 nt, Salmonella enterica enterica serovar Typhi
gaugccggauggcgguuggccu

SEQ ID NO: 190486 - RNA, 22 nt, Salmonella enterica enterica serovar Typhi
auggcgauauagucuuucacgc

SEQ ID NO: 190487 - RNA, 22 nt, Salmonella enterica enterica serovar Typhi
ugccgggaugggcgacucgauu

SEQ ID NO: 190488 - RNA, 22 nt, Salmonella enterica enterica serovar Typhi
uaaugcuuauccggccuacagg

SEQ ID NO: 190489 - RNA, 22 nt, Salmonella enterica enterica serovar Typhi
gguggacgugcgcggcgauacg

SEQ ID NO: 190490 - RNA, 18 nt, Salmonella enterica enterica serovar Typhi
gucuggagcgauuucgug

SEQ ID NO: 190491 - RNA, 22 nt, Salmonella enterica enterica serovar Typhi
cgcccguagcgaucagcuucug

SEQ ID NO: 190492 - RNA, 22 nt, Salmonella enterica enterica serovar Typhi
ucggugcuaaugcuggcgggca

SEQ ID NO: 190493 - RNA, 22 nt, Salmonella enterica enterica serovar Typhi
uacugguauccagaaacuaucu

SEQ ID NO: 190494 - RNA, 22 nt, Salmonella enterica enterica serovar Typhi
ggcgucagcgguuccgcggcgg

SEQ ID NO: 190495 - RNA, 22 nt, Salmonella enterica enterica serovar Typhi
ccagccagguaaaccgcccguu

SEQ ID NO: 190496 - RNA, 22 nt, Salmonella enterica enterica serovar Typhi
uggcaugugguauugauccuga

SEQ ID NO: 190497 - RNA, 22 nt, Salmonella enterica enterica serovar Typhi
aaaucgcagguaucguuuccuu

SEQ ID NO: 190498 - RNA, 22 nt, Salmonella enterica enterica serovar Typhi
gcagcgguuguuaccaaagccc

SEQ ID NO: 190499 - RNA, 22 nt, Salmonella enterica enterica serovar Typhi
uacgcuccagaccaucaugcau

SEQ ID NO: 190500 - RNA, 22 nt, Salmonella enterica enterica serovar Typhi
aucuugauugcagccagaguuu

SEQ ID NO: 190501 - RNA, 22 nt, Salmonella enterica enterica serovar Typhi
uuacacaugcucgcgcucagca

SEQ ID NO: 190502 - RNA, 22 nt, Salmonella enterica enterica serovar Typhi
cggauuguguccuggaagaagg

SEQ ID NO: 190503 - RNA, 22 nt, Salmonella enterica enterica serovar Typhi
uggcgcugugcuuacccggccu

SEQ ID NO: 190504 - RNA, 22 nt, Salmonella enterica enterica serovar Typhi
cuuaucuguauugaugauaaac

SEQ ID NO: 190505 - RNA, 22 nt, Salmonella enterica enterica serovar Typhi
uggcgcguggccacaucaucaa

SEQ ID NO: 190506 - RNA, 22 nt, Salmonella enterica enterica serovar Typhi
agaggcuaauuaucugccagcc

SEQ ID NO: 190507 - RNA, 22 nt, Salmonella enterica enterica serovar Typhi
cauaccguggugcagggcauug

SEQ ID NO: 190508 - RNA, 22 nt, Salmonella enterica enterica serovar Typhi
ugcgcccugcgccaguuguucc

SEQ ID NO: 190509 - RNA, 22 nt, Salmonella enterica enterica serovar Typhi
uacgcgaacaacuggaggucag

SEQ ID NO: 190510 - RNA, 23 nt, Salmonella enterica enterica serovar Typhi
cgaucaaucaauuuaccguuauu

SEQ ID NO: 190511 - RNA, 22 nt, Salmonella enterica enterica serovar Typhi
ccagcagcaggaugccgaaagc

SEQ ID NO: 190512 - RNA, 22 nt, Salmonella enterica enterica serovar Typhi
aucaugaugaucacggaugccg

SEQ ID NO: 190513 - RNA, 22 nt, Salmonella enterica enterica serovar Typhi
auuauggcgcgggggaaaagau

SEQ ID NO: 190514 - RNA, 22 nt, Salmonella enterica enterica serovar Typhi
agacggcgaaggcguuagguau

SEQ ID NO: 190515 - RNA, 21 nt, Salmonella enterica enterica serovar Typhi
gcacgcaguuccgccaguggg

SEQ ID NO: 190516 - RNA, 22 nt, Salmonella enterica enterica serovar Typhi
gcugauacugcucguucaacgc

SEQ ID NO: 190517 - RNA, 21 nt, Salmonella enterica enterica serovar Typhi
ugcccgcuuuauguagugguu

SEQ ID NO: 190518 - RNA, 22 nt, Salmonella enterica enterica serovar Typhi
gaaauguucgugggugucggcg

SEQ ID NO: 190519 - RNA, 22 nt, Salmonella enterica enterica serovar Typhi
uuuaccguuugauuucaaucgc

SEQ ID NO: 190520 - RNA, 22 nt, Salmonella enterica enterica serovar Typhi
cuggaagaagccacuauccaac

SEQ ID NO: 190521 - RNA, 22 nt, Salmonella enterica enterica serovar Typhi
ucacugcaggacaacaguaaaa

SEQ ID NO: 190522 - RNA, 22 nt, Salmonella enterica enterica serovar Typhi
aauaacgcgugaugcuugucag

SEQ ID NO: 190523 - RNA, 22 nt, Salmonella enterica enterica serovar Typhi
gccgcgaaaugacucgauauuc

SEQ ID NO: 190524 - RNA, 22 nt, Salmonella enterica enterica serovar Typhi
auccggugaugauggcaaccgc

SEQ ID NO: 190525 - RNA, 22 nt, Salmonella enterica enterica serovar Typhi
gggaucaguauaccucgucaga

SEQ ID NO: 190526 - RNA, 22 nt, Salmonella enterica enterica serovar Typhi
ggucacguuuacgcugucgcca

SEQ ID NO: 190527 - RNA, 22 nt, Salmonella enterica enterica serovar Typhi
guuugcaaaaugccguugccga

SEQ ID NO: 190528 - RNA, 22 nt, Salmonella enterica enterica serovar Typhi
gcugaucagcugcauuggguuc

SEQ ID NO: 190529 - RNA, 22 nt, Salmonella enterica enterica serovar Typhi
uuguuccgaucauacggcguuu

SEQ ID NO: 190530 - RNA, 22 nt, Salmonella enterica enterica serovar Typhi
cagaaucgcaaacaacgucuga

SEQ ID NO: 190531 - RNA, 22 nt, Salmonella enterica enterica serovar Typhi
cuucgcgucaugcguuauauca

SEQ ID NO: 190532 - RNA, 22 nt, Salmonella enterica enterica serovar Typhi
guagauuccagccguuugaaug

SEQ ID NO: 190533 - RNA, 22 nt, Salmonella enterica enterica serovar Typhi
uacgacgcacuuuaugaggucc

SEQ ID NO: 190534 - RNA, 22 nt, Salmonella enterica enterica serovar Typhi
gaggcguugaaguucuggaauc

SEQ ID NO: 190535 - RNA, 22 nt, Salmonella enterica enterica serovar Typhi
ccugcguucgucaauauggggg

SEQ ID NO: 190536 - RNA, 22 nt, Salmonella enterica enterica serovar Typhi
uagcaccagcaaaacccgcucc

SEQ ID NO: 190537 - RNA, 22 nt, Salmonella enterica enterica serovar Typhi
acgcucgggaucggcguggucg

SEQ ID NO: 190538 - RNA, 22 nt, Salmonella enterica enterica serovar Typhi
uugccaggccugcggcgcguua

SEQ ID NO: 190539 - RNA, 22 nt, Salmonella enterica enterica serovar Typhi
cauuucugaaagucagagcaca

SEQ ID NO: 190540 - RNA, 22 nt, Salmonella enterica enterica serovar Typhi
gggcuucuuugcguguguggua

SEQ ID NO: 190541 - RNA, 22 nt, Salmonella enterica enterica serovar Typhi
gcugauaagcaggugaucggcc

SEQ ID NO: 190542 - RNA, 22 nt, Salmonella enterica enterica serovar Typhi
caugcgccgagaucggcgaaga

SEQ ID NO: 190543 - RNA, 22 nt, Salmonella enterica enterica serovar Typhi
ucaggguggugauguaguagua

SEQ ID NO: 190544 - RNA, 22 nt, Salmonella enterica enterica serovar Typhi
ugacuuucaggccgcuggccug

SEQ ID NO: 190545 - RNA, 22 nt, Salmonella enterica enterica serovar Typhi
uguaggcagcauaagcguuagc

SEQ ID NO: 190546 - RNA, 18 nt, Salmonella enterica enterica serovar Typhi
gccgucugaagugcuggu

SEQ ID NO: 190547 - RNA, 22 nt, Salmonella enterica enterica serovar Typhi
ccgguagcaaacuggugaacgc

SEQ ID NO: 190548 - RNA, 22 nt, Salmonella enterica enterica serovar Typhi
ccuguugguuuacguuauggcu

SEQ ID NO: 190549 - RNA, 22 nt, Salmonella enterica enterica serovar Typhi
ucugcaaacguaggaaaagggu

SEQ ID NO: 190550 - RNA, 22 nt, Salmonella enterica enterica serovar Typhi
ucccgacaaugucgucgugaua

SEQ ID NO: 190551 - RNA, 21 nt, Salmonella enterica enterica serovar Typhi
gcgguucccaguaccacacca

SEQ ID NO: 190552 - RNA, 20 nt, Salmonella enterica enterica serovar Typhi
uguggaaaaccugguuuauc

SEQ ID NO: 190553 - RNA, 22 nt, Salmonella enterica enterica serovar Typhi
ugaugcagugcgacuggcccau

SEQ ID NO: 190554 - RNA, 21 nt, Salmonella enterica enterica serovar Typhi
ugucugaccauccugaccggu

SEQ ID NO: 190555 - RNA, 19 nt, Salmonella enterica enterica serovar Typhi
cuggcauaguaagaaguau

SEQ ID NO: 190556 - RNA, 22 nt, Salmonella enterica enterica serovar Typhi
ugcguagaauauccgcgcuggu

SEQ ID NO: 190557 - RNA, 22 nt, Salmonella enterica enterica serovar Typhi
uacguuugccgaggugaucgua

SEQ ID NO: 190558 - RNA, 22 nt, Salmonella enterica enterica serovar Typhi
uaaauggugggagugcgccucc

SEQ ID NO: 190559 - RNA, 22 nt, Salmonella enterica enterica serovar Typhi
gaauaacgacgcugugauaccg

SEQ ID NO: 190560 - RNA, 22 nt, Salmonella enterica enterica serovar Typhi
auauggugcgcggcaccacgca

SEQ ID NO: 190561 - RNA, 22 nt, Salmonella enterica enterica serovar Typhi
uggcgcugcgcuuuccggccua

SEQ ID NO: 190562 - RNA, 23 nt, Salmonella enterica enterica serovar Typhi
gaccgugagacggcgcgcuuacg

SEQ ID NO: 190563 - RNA, 22 nt, Salmonella enterica enterica serovar Typhi
uggcgcugucgaucaacuucaa

SEQ ID NO: 190564 - RNA, 22 nt, Salmonella enterica enterica serovar Typhi
ucauuucgaaggccugcagcga

SEQ ID NO: 190565 - RNA, 22 nt, Salmonella enterica enterica serovar Typhi
guagcgggcgguauccggucaa

SEQ ID NO: 190566 - RNA, 22 nt, Salmonella enterica enterica serovar Typhi
gcccgguagguggaugcugagu

SEQ ID NO: 190567 - RNA, 22 nt, Salmonella enterica enterica serovar Typhi
cagcgucagaaauaacugaaga

SEQ ID NO: 190568 - RNA, 22 nt, Salmonella enterica enterica serovar Typhi
gacuuuacuugauuccaacaua

SEQ ID NO: 190569 - RNA, 22 nt, Salmonella enterica enterica serovar Typhi
gcuacaccugugaugcccugaa

SEQ ID NO: 190570 - RNA, 22 nt, Salmonella enterica enterica serovar Typhi
ggcuuacaccugucagcggcga

SEQ ID NO: 190571 - RNA, 22 nt, Salmonella enterica enterica serovar Typhi
gugcgcgugcgcgaugaacauc

SEQ ID NO: 190572 - RNA, 22 nt, Salmonella enterica enterica serovar Typhi
auccggguaacuaugaugagua

SEQ ID NO: 190573 - RNA, 22 nt, Salmonella enterica enterica serovar Typhi
gugcgccauauucucgacuggg

SEQ ID NO: 190574 - RNA, 22 nt, Salmonella enterica enterica serovar Typhi
ggauucugccgaaacugaucgg

SEQ ID NO: 190575 - RNA, 20 nt, Salmonella enterica enterica serovar Typhi
accggcugcgauuacgcugg

SEQ ID NO: 190576 - RNA, 22 nt, Salmonella enterica enterica serovar Typhi
guggcggaggugauucaacgcu

SEQ ID NO: 190577 - RNA, 23 nt, Salmonella enterica enterica serovar Typhi
cguauugagauggcuauaauaga

SEQ ID NO: 190578 - RNA, 22 nt, Salmonella enterica enterica serovar Typhi
auuauggauguccagggcagcg

SEQ ID NO: 190579 - RNA, 22 nt, Salmonella enterica enterica serovar Typhi
ggcaucgaaguccgaucaaccc

SEQ ID NO: 190580 - RNA, 23 nt, Salmonella enterica enterica serovar Typhi
cggcagcaaguauuauggcuggc

SEQ ID NO: 190581 - RNA, 22 nt, Salmonella enterica enterica serovar Typhi
ucggccuggccaggcgcucuau

SEQ ID NO: 190582 - RNA, 22 nt, Salmonella enterica enterica serovar Typhi
ugagaucgauauacggcauauu

SEQ ID NO: 190583 - RNA, 22 nt, Salmonella enterica enterica serovar Typhi
gcgucgcagcgacuggcguauc

SEQ ID NO: 190584 - RNA, 22 nt, Salmonella enterica enterica serovar Typhi
uagcgugauuacgaccggcgag

SEQ ID NO: 190585 - RNA, 22 nt, Salmonella enterica enterica serovar Typhi
auucgcaaugagaguuugguag

SEQ ID NO: 190586 - RNA, 22 nt, Salmonella enterica enterica serovar Typhi
gccauuugccgcugucguuauu

SEQ ID NO: 190587 - RNA, 18 nt, Salmonella enterica enterica serovar Typhi
uuaaccgccgugaauagc

SEQ ID NO: 190588 - RNA, 22 nt, Salmonella enterica enterica serovar Typhi
auccuuaucuggucagcggcga

SEQ ID NO: 190589 - RNA, 22 nt, Salmonella enterica enterica serovar Typhi
gcggauaucgaaguggaucugg

SEQ ID NO: 190590 - RNA, 23 nt, Salmonella enterica enterica serovar Typhi
uauccggccuacagaacugcacg

SEQ ID NO: 190591 - RNA, 22 nt, Salmonella enterica enterica serovar Typhi
ccgacucuaaagcgauugcuca

SEQ ID NO: 190592 - RNA, 22 nt, Salmonella enterica enterica serovar Typhi
uauugcgcgccgaaauuggcca

SEQ ID NO: 190593 - RNA, 22 nt, Salmonella enterica enterica serovar Typhi
uauggcgguugcguggccgccu

SEQ ID NO: 190594 - RNA, 22 nt, Salmonella enterica enterica serovar Typhi
agcgcaccauuuauaaaaagua

SEQ ID NO: 190595 - RNA, 22 nt, Salmonella enterica enterica serovar Typhi
cgucuuauccggccuacgagug

SEQ ID NO: 190596 - RNA, 22 nt, Salmonella enterica enterica serovar Typhi
gagcagguuuuugacgcaaaga

SEQ ID NO: 190597 - RNA, 22 nt, Salmonella enterica enterica serovar Typhi
cgcaggauacgaaacgggugcu

SEQ ID NO: 190598 - RNA, 22 nt, Salmonella enterica enterica serovar Typhi
gcgauugauaucuggaacguga

SEQ ID NO: 190599 - RNA, 22 nt, Salmonella enterica enterica serovar Typhi
guagggcguuacaguaucauac

SEQ ID NO: 190600 - RNA, 22 nt, Salmonella enterica enterica serovar Typhi
gggugacuauggucgcgucuau

SEQ ID NO: 190601 - RNA, 22 nt, Salmonella enterica enterica serovar Typhi
ucguuaaguucauuaaugcguu

SEQ ID NO: 190602 - RNA, 22 nt, Salmonella enterica enterica serovar Typhi
guguaaagcgcauugucugcag

SEQ ID NO: 190603 - RNA, 22 nt, Salmonella enterica enterica serovar Typhi
augagucuuaccgagcgcguug

SEQ ID NO: 190604 - RNA, 22 nt, Salmonella enterica enterica serovar Typhi
augcgucucugaacaggcggcc

SEQ ID NO: 190605 - RNA, 22 nt, Salmonella enterica enterica serovar Typhi
uggcgcuacgcuuaucaggccu

SEQ ID NO: 190606 - RNA, 22 nt, Salmonella enterica enterica serovar Typhi
agccguuuuccgggucgcgcag

SEQ ID NO: 190607 - RNA, 22 nt, Salmonella enterica enterica serovar Typhi
agcagcagcgccuucaguuuga

SEQ ID NO: 190608 - RNA, 22 nt, Salmonella enterica enterica serovar Typhi
agcaugcucuugcaaacugggu

SEQ ID NO: 190609 - RNA, 22 nt, Salmonella enterica enterica serovar Typhi
auaacgauaaucucagggguuu

SEQ ID NO: 190610 - RNA, 22 nt, Salmonella enterica enterica serovar Typhi
uacagaauauccaucagcggcu

SEQ ID NO: 190611 - RNA, 22 nt, Salmonella enterica enterica serovar Typhi
acaucgagauggauuuuugggu

SEQ ID NO: 190612 - RNA, 22 nt, Salmonella enterica enterica serovar Typhi
gccggucuauaaaauugcgcug

SEQ ID NO: 190613 - RNA, 22 nt, Salmonella enterica enterica serovar Typhi
ugcggcaagcuggcgaucguuc

SEQ ID NO: 190614 - RNA, 22 nt, Salmonella enterica enterica serovar Typhi
augcguuucacgccauuuuggg

SEQ ID NO: 190615 - RNA, 22 nt, Salmonella enterica enterica serovar Typhi
agugggcguuuaaucgggaaga

SEQ ID NO: 190616 - RNA, 22 nt, Salmonella enterica enterica serovar Typhi
ugcguggccucgcccagccgca

SEQ ID NO: 190617 - RNA, 22 nt, Salmonella enterica enterica serovar Typhi
cauuaugcgcugguggaugagg

SEQ ID NO: 190618 - RNA, 21 nt, Salmonella enterica enterica serovar Typhi
uggcugcuguucaucugcgug

SEQ ID NO: 190619 - RNA, 22 nt, Salmonella enterica enterica serovar Typhi
ugcaggaugucgcgccggguac

SEQ ID NO: 190620 - RNA, 22 nt, Salmonella enterica enterica serovar Typhi
uaccguguauggaggcgauagc

SEQ ID NO: 190621 - RNA, 22 nt, Salmonella enterica enterica serovar Typhi
ucgaugcugacgguauccugca

SEQ ID NO: 190622 - RNA, 22 nt, Salmonella enterica enterica serovar Typhi
gggauacggugcugguugaaaa

SEQ ID NO: 190623 - RNA, 22 nt, Salmonella enterica enterica serovar Typhi
gugauccgauucgcguuaaugu

SEQ ID NO: 190624 - RNA, 22 nt, Salmonella enterica enterica serovar Typhi
gacgccaugaagcguggguaca

SEQ ID NO: 190625 - RNA, 22 nt, Salmonella enterica enterica serovar Typhi
agcguugaugugcugguuaccg

SEQ ID NO: 190626 - RNA, 22 nt, Salmonella enterica enterica serovar Typhi
gccggaugucaucaccagcggg

SEQ ID NO: 190627 - RNA, 22 nt, Salmonella enterica enterica serovar Typhi
uaggucuggucuaucucuuuuu

SEQ ID NO: 190628 - RNA, 22 nt, Salmonella enterica enterica serovar Typhi
augaccguuuugauaucagugu

SEQ ID NO: 190629 - RNA, 22 nt, Salmonella enterica enterica serovar Typhi
augaucgaaauccgugaagguc

SEQ ID NO: 190630 - RNA, 19 nt, Salmonella enterica enterica serovar Typhi
ucgaacgcugcgaauuuau

SEQ ID NO: 190631 - RNA, 22 nt, Salmonella enterica enterica serovar Typhi
ugugccgccaguacgaugcgca

SEQ ID NO: 190632 - RNA, 22 nt, Salmonella enterica enterica serovar Typhi
acguugaugugaacuauucaga

SEQ ID NO: 190633 - RNA, 19 nt, Salmonella enterica enterica serovar Typhi
aucguuggagagacccgcu

SEQ ID NO: 190634 - RNA, 22 nt, Salmonella enterica enterica serovar Typhi
ugcuggauaaaauuaaggcgau

SEQ ID NO: 190635 - RNA, 22 nt, Salmonella enterica enterica serovar Typhi
ggccaguuuucaugaugcggua

SEQ ID NO: 190636 - RNA, 22 nt, Salmonella enterica enterica serovar Typhi
ugcugucgcucagugguuucgc

SEQ ID NO: 190637 - RNA, 22 nt, Salmonella enterica enterica serovar Typhi
gacguuucgcuuaucaggccua

SEQ ID NO: 190638 - RNA, 22 nt, Salmonella enterica enterica serovar Typhi
gcuaaaggcuugcaagaacugg

SEQ ID NO: 190639 - RNA, 22 nt, Salmonella enterica enterica serovar Typhi
uuacgcgcuuugcguaaggucg

SEQ ID NO: 190640 - RNA, 22 nt, Salmonella enterica enterica serovar Typhi
auaacgauauuucauccccauu

SEQ ID NO: 190641 - RNA, 22 nt, Salmonella enterica enterica serovar Typhi
cgacgccugcuacagcccugua

SEQ ID NO: 190642 - RNA, 22 nt, Salmonella enterica enterica serovar Typhi
uauggaugacugugccugcgcu

SEQ ID NO: 190643 - RNA, 22 nt, Salmonella enterica enterica serovar Typhi
uagcggaaaauugggcuauagc

SEQ ID NO: 190644 - RNA, 22 nt, Salmonella enterica enterica serovar Typhi
ugcugccaucuuuaggcguaau

SEQ ID NO: 190645 - RNA, 22 nt, Salmonella enterica enterica serovar Typhi
gcgcgcaugauuauucccgccg

SEQ ID NO: 190646 - RNA, 22 nt, Salmonella enterica enterica serovar Typhi
gcgauccuguucagggaacuca

SEQ ID NO: 190647 - RNA, 22 nt, Salmonella enterica enterica serovar Typhi
ucuguaucgggaagcggcgcgc

SEQ ID NO: 190648 - RNA, 22 nt, Salmonella enterica enterica serovar Typhi
uuaaucagcaaggcguuggcga

SEQ ID NO: 190649 - RNA, 22 nt, Salmonella enterica enterica serovar Typhi
ugguaucaacgauagcaaauac

SEQ ID NO: 190650 - RNA, 22 nt, Salmonella enterica enterica serovar Typhi
cgcuggaugucaccguacaugc

SEQ ID NO: 190651 - RNA, 22 nt, Salmonella enterica enterica serovar Typhi
acgcccuggaacagcaggcggu

SEQ ID NO: 190652 - RNA, 22 nt, Salmonella enterica enterica serovar Typhi
gccguaacgugcuugcugacgu

SEQ ID NO: 190653 - RNA, 22 nt, Salmonella enterica enterica serovar Typhi
uaucguucguccuggauuaucg

SEQ ID NO: 190654 - RNA, 22 nt, Salmonella enterica enterica serovar Typhi
ucaugccugcgcgccgggcuuu

SEQ ID NO: 190655 - RNA, 20 nt, Salmonella enterica enterica serovar Typhi
gucugcggcgacuggcggcg

SEQ ID NO: 190656 - RNA, 22 nt, Salmonella enterica enterica serovar Typhi
cagcgguagaaaagccagugau

SEQ ID NO: 190657 - RNA, 22 nt, Salmonella enterica enterica serovar Typhi
agacaacggcccuuugcaggcg

SEQ ID NO: 190658 - RNA, 22 nt, Salmonella enterica enterica serovar Typhi
gauaauguguugacggauacug

SEQ ID NO: 190659 - RNA, 22 nt, Salmonella enterica enterica serovar Typhi
cuguucaagcucuauccguggg

SEQ ID NO: 190660 - RNA, 22 nt, Salmonella enterica enterica serovar Typhi
caucuuuaccuuuguguugggc

SEQ ID NO: 190661 - RNA, 22 nt, Salmonella enterica enterica serovar Typhi
gauauugaugccgaugugguga

SEQ ID NO: 190662 - RNA, 22 nt, Salmonella enterica enterica serovar Typhi
cgguuggccggaaacccgcgcg

SEQ ID NO: 190663 - RNA, 22 nt, Salmonella enterica enterica serovar Typhi
uuucaugcauuggacagcacgc

SEQ ID NO: 190664 - RNA, 23 nt, Salmonella enterica enterica serovar Typhi
uugccggcgagaugauggcagga

SEQ ID NO: 190665 - RNA, 22 nt, Salmonella enterica enterica serovar Typhi
ucagaauaucuccauuauucgc

SEQ ID NO: 190666 - RNA, 18 nt, Salmonella enterica enterica serovar Typhi
cgauaucuucugauugga

SEQ ID NO: 190667 - RNA, 20 nt, Salmonella enterica enterica serovar Typhi
acgcugugcacuauggcgcu

SEQ ID NO: 190668 - RNA, 22 nt, Salmonella enterica enterica serovar Typhi
ucacugaugagccagguucugg

SEQ ID NO: 190669 - RNA, 22 nt, Salmonella enterica enterica serovar Typhi
gcgccguuaagguuaaucagag

SEQ ID NO: 190670 - RNA, 21 nt, Salmonella enterica enterica serovar Typhi
uugcccugaccgaauucuuua

SEQ ID NO: 190671 - RNA, 19 nt, Salmonella enterica enterica serovar Typhi
aucgcccaggaugugaugc

SEQ ID NO: 190672 - RNA, 23 nt, Salmonella enterica enterica serovar Typhi
aagcgguuccacaacaaugaaaa

SEQ ID NO: 190673 - RNA, 22 nt, Salmonella enterica enterica serovar Typhi
gagugcggauguucggcuaccu

SEQ ID NO: 190674 - RNA, 22 nt, Salmonella enterica enterica serovar Typhi
gaucaggucgguaaucaauagc

SEQ ID NO: 190675 - RNA, 22 nt, Salmonella enterica enterica serovar Typhi
gcugagccugauuuuaccgcug

SEQ ID NO: 190676 - RNA, 22 nt, Salmonella enterica enterica serovar Typhi
aaguacgcacguucggcagcgc

SEQ ID NO: 190677 - RNA, 22 nt, Salmonella enterica enterica serovar Typhi
ggucauguggguggacgcggua

SEQ ID NO: 190678 - RNA, 22 nt, Salmonella enterica enterica serovar Typhi
ugcgcacguccagaccacggau

SEQ ID NO: 190679 - RNA, 22 nt, Salmonella enterica enterica serovar Typhi
cuucaccaacguggcgugcagg

SEQ ID NO: 190680 - RNA, 22 nt, Salmonella enterica enterica serovar Typhi
augcccgucugggagccgcugc

SEQ ID NO: 190681 - RNA, 20 nt, Salmonella enterica enterica serovar Typhi
cggauggcgacguggcagcg

SEQ ID NO: 190682 - RNA, 22 nt, Salmonella enterica enterica serovar Typhi
cuggcuguagacucgcuuuccc

SEQ ID NO: 190683 - RNA, 22 nt, Salmonella enterica enterica serovar Typhi
ucgccguggcugcuggcgcugg

SEQ ID NO: 190684 - RNA, 22 nt, Salmonella enterica enterica serovar Typhi
uugaggcgcgguuaaccggcgc

SEQ ID NO: 190685 - RNA, 20 nt, Salmonella enterica enterica serovar Typhi
cgaucgcucugcgagacgcu

SEQ ID NO: 190686 - RNA, 19 nt, Salmonella enterica enterica serovar Typhi
gagacggcaaaucaucgac

SEQ ID NO: 190687 - RNA, 22 nt, Salmonella enterica enterica serovar Typhi
caucagcgucaaccguuggcga

SEQ ID NO: 190688 - RNA, 22 nt, Salmonella enterica enterica serovar Typhi
auccgcagauccagcacggccu

SEQ ID NO: 190689 - RNA, 22 nt, Salmonella enterica enterica serovar Typhi
aacgacucgucuaucaccggca

SEQ ID NO: 190690 - RNA, 22 nt, Salmonella enterica enterica serovar Typhi
gccgcguagcguccggcguaau

SEQ ID NO: 190691 - RNA, 22 nt, Salmonella enterica enterica serovar Typhi
cugacggguaguaucgcucuau

SEQ ID NO: 190692 - RNA, 22 nt, Salmonella enterica enterica serovar Typhi
uuccgguauugguaaaucaggu

SEQ ID NO: 190693 - RNA, 22 nt, Salmonella enterica enterica serovar Typhi
uaaagugaaauaauucagucag

SEQ ID NO: 190694 - RNA, 22 nt, Salmonella enterica enterica serovar Typhi
ucugccgguuaugauggcggcg

SEQ ID NO: 190695 - RNA, 22 nt, Salmonella enterica enterica serovar Typhi
ugaagaucagcagcgauuugau

SEQ ID NO: 190696 - RNA, 22 nt, Salmonella enterica enterica serovar Typhi
uuaaucacuuuggcgcugauaa

SEQ ID NO: 190697 - RNA, 22 nt, Salmonella enterica enterica serovar Typhi
acgaauggccgcccguuuuauu

SEQ ID NO: 190698 - RNA, 22 nt, Salmonella enterica enterica serovar Typhi
gccugugggugaauccggacug

SEQ ID NO: 190699 - RNA, 22 nt, Salmonella enterica enterica serovar Typhi
uccgggcucauauuaucaaggu

SEQ ID NO: 190700 - RNA, 22 nt, Salmonella enterica enterica serovar Typhi
guaugcgccuucagaucggagu

SEQ ID NO: 190701 - RNA, 22 nt, Salmonella enterica enterica serovar Typhi
uuacgccaucucuucuggcggc

SEQ ID NO: 190702 - RNA, 21 nt, Salmonella enterica enterica serovar Typhi
gcguuacgccgcgagcuuggc

SEQ ID NO: 190703 - RNA, 22 nt, Salmonella enterica enterica serovar Typhi
ugcugaauccgauaaauggguu

SEQ ID NO: 190704 - RNA, 21 nt, Salmonella enterica enterica serovar Typhi
gccacuggugacgcucaagaa

SEQ ID NO: 190705 - RNA, 22 nt, Salmonella enterica enterica serovar Typhi
ggcgcugugcugguaucuguug

SEQ ID NO: 190706 - RNA, 22 nt, Salmonella enterica enterica serovar Typhi
cggcggaacauucguuggcgua

SEQ ID NO: 190707 - RNA, 22 nt, Salmonella enterica enterica serovar Typhi
acgcuggcuucuggcuguucgg

SEQ ID NO: 190708 - RNA, 20 nt, Salmonella enterica enterica serovar Typhi
aauccggugccuuaccgcuu

SEQ ID NO: 190709 - RNA, 22 nt, Salmonella enterica enterica serovar Typhi
caucgccuuaauuuuauccagc

SEQ ID NO: 190710 - RNA, 22 nt, Salmonella enterica enterica serovar Typhi
gcugaugaccgauaagcugcaa

SEQ ID NO: 190711 - RNA, 22 nt, Salmonella enterica enterica serovar Typhi
cgucaagguaaaacgcagguga

SEQ ID NO: 190712 - RNA, 22 nt, Salmonella enterica enterica serovar Typhi
gcaguagcguuaauugugguua

SEQ ID NO: 190713 - RNA, 23 nt, Salmonella enterica enterica serovar Typhi
aucgucacgauggucguagcugg

SEQ ID NO: 190714 - RNA, 21 nt, Salmonella enterica enterica serovar Typhi
aaccgucuggaugucuaaacu

SEQ ID NO: 190715 - RNA, 22 nt, Salmonella enterica enterica serovar Typhi
ucguucagucccaugugccgga

SEQ ID NO: 190716 - RNA, 21 nt, Salmonella enterica enterica serovar Typhi
gauggcuggaccuucacgccg

SEQ ID NO: 190717 - RNA, 22 nt, Salmonella enterica enterica serovar Typhi
augagcugaccacugacgaaaa

SEQ ID NO: 190718 - RNA, 22 nt, Salmonella enterica enterica serovar Typhi
ggaaucaacgcgaccaggcgcg

SEQ ID NO: 190719 - RNA, 22 nt, Salmonella enterica enterica serovar Typhi
cgcgaugggcguaaacaucaac

SEQ ID NO: 190720 - RNA, 22 nt, Salmonella enterica enterica serovar Typhi
gaugcuggcguugcgaacauuu

SEQ ID NO: 190721 - RNA, 22 nt, Salmonella enterica enterica serovar Typhi
acuacgccgccgauagcaucgg

SEQ ID NO: 190722 - RNA, 22 nt, Salmonella enterica enterica serovar Typhi
ugguacugcagucagcaucauu

SEQ ID NO: 190723 - RNA, 22 nt, Salmonella enterica enterica serovar Typhi
gggcgcauguuuugaguaaaac

SEQ ID NO: 190724 - RNA, 23 nt, Salmonella enterica enterica serovar Typhi
cugcgcauauuacgccggcguuu

SEQ ID NO: 190725 - RNA, 22 nt, Salmonella enterica enterica serovar Typhi
acuggcagucugaguguuaauc

SEQ ID NO: 190726 - RNA, 21 nt, Salmonella enterica enterica serovar Typhi
auaucgagucauuucgcggcg

SEQ ID NO: 190727 - RNA, 22 nt, Salmonella enterica enterica serovar Typhi
agacuuugcugggcggccuccc

SEQ ID NO: 190728 - RNA, 22 nt, Salmonella enterica enterica serovar Typhi
acugcgguacagcagcgcuauc

SEQ ID NO: 190729 - RNA, 22 nt, Salmonella enterica enterica serovar Typhi
gcaauguugcaaccagagcccu

SEQ ID NO: 190730 - RNA, 20 nt, Salmonella enterica enterica serovar Typhi
aucauugcgccgaaccugca

SEQ ID NO: 190731 - RNA, 22 nt, Salmonella enterica enterica serovar Typhi
guugucgcuucgcuuaaaccgc

SEQ ID NO: 190732 - RNA, 22 nt, Salmonella enterica enterica serovar Typhi
auugauguggguaaagugaugg

SEQ ID NO: 190733 - RNA, 22 nt, Salmonella enterica enterica serovar Typhi
augagauuaauacacuggagau

SEQ ID NO: 190734 - RNA, 22 nt, Salmonella enterica enterica serovar Typhi
ugaacgccuuguccggccuaca

SEQ ID NO: 190735 - RNA, 22 nt, Salmonella enterica enterica serovar Typhi
auuuagugaugacaaaggacga

SEQ ID NO: 190736 - RNA, 22 nt, Salmonella enterica enterica serovar Typhi
aucgucaugcuguggcuggucg

SEQ ID NO: 190737 - RNA, 21 nt, Salmonella enterica enterica serovar Typhi
cugcauaaucgcaaagguauc

SEQ ID NO: 190738 - RNA, 22 nt, Salmonella enterica enterica serovar Typhi
caucuucaaaacgcugcaugag

SEQ ID NO: 190739 - RNA, 22 nt, Salmonella enterica enterica serovar Typhi
cgaugauaugccacccgaggau

SEQ ID NO: 190740 - RNA, 22 nt, Salmonella enterica enterica serovar Typhi
aucuggcaugcagggccggaag

SEQ ID NO: 190741 - RNA, 22 nt, Salmonella enterica enterica serovar Typhi
uuugucauuuccgguuugacga

SEQ ID NO: 190742 - RNA, 22 nt, Salmonella enterica enterica serovar Typhi
uccagguuuuugcacaacguuu

SEQ ID NO: 190743 - RNA, 22 nt, Salmonella enterica enterica serovar Typhi
aaucuguugcgucguacuuuuu

SEQ ID NO: 190744 - RNA, 22 nt, Salmonella enterica enterica serovar Typhi
ugcccgucuacgauaaaccgau

SEQ ID NO: 190745 - RNA, 22 nt, Salmonella enterica enterica serovar Typhi
ccggcgauaucguaccggacug

SEQ ID NO: 190746 - RNA, 22 nt, Salmonella enterica enterica serovar Typhi
ucagacguuacgcgcggaguau

SEQ ID NO: 190747 - RNA, 21 nt, Salmonella enterica enterica serovar Typhi
uagcuccauuacgaucaccac

SEQ ID NO: 190748 - RNA, 22 nt, Salmonella enterica enterica serovar Typhi
uacaggauguucggcguaucgu

SEQ ID NO: 190749 - RNA, 22 nt, Salmonella enterica enterica serovar Typhi
cagaacuggguagcggggcuuc

SEQ ID NO: 190750 - RNA, 21 nt, Salmonella enterica enterica serovar Typhi
aucgaaggucacugcaaauug

SEQ ID NO: 190751 - RNA, 22 nt, Salmonella enterica enterica serovar Typhi
uuuaccauuaaaaagugaugug

SEQ ID NO: 190752 - RNA, 22 nt, Salmonella enterica enterica serovar Typhi
gaauggcugccaguugcggcgg

SEQ ID NO: 190753 - RNA, 22 nt, Salmonella enterica enterica serovar Typhi
ugucgcuggaaaaguaucgcga

SEQ ID NO: 190754 - RNA, 22 nt, Salmonella enterica enterica serovar Typhi
agucaauauuuauucauggaau

SEQ ID NO: 190755 - RNA, 22 nt, Salmonella enterica enterica serovar Typhi
gcagcaugauaauucacguugg

SEQ ID NO: 190756 - RNA, 22 nt, Salmonella enterica enterica serovar Typhi
cgcgaaugauuuaggggauaaa

SEQ ID NO: 190757 - RNA, 22 nt, Salmonella enterica enterica serovar Typhi
gugaugauuuccgucacgccug

SEQ ID NO: 190758 - RNA, 22 nt, Salmonella enterica enterica serovar Typhi
cagcgccuuuggaaucgacgau

SEQ ID NO: 190759 - RNA, 22 nt, Salmonella enterica enterica serovar Typhi
uugucaaucgcacgcucugguu

SEQ ID NO: 190760 - RNA, 22 nt, Salmonella enterica enterica serovar Typhi
aacgccugaagucgugacucgg

SEQ ID NO: 190761 - RNA, 22 nt, Salmonella enterica enterica serovar Typhi
aaacgccggcgugaucgucgcu

SEQ ID NO: 190762 - RNA, 22 nt, Salmonella enterica enterica serovar Typhi
uugcaaauuagcuucguccauu

SEQ ID NO: 190763 - RNA, 22 nt, Salmonella enterica enterica serovar Typhi
gggcuuaugcacuaaauaagaa

SEQ ID NO: 190764 - RNA, 22 nt, Salmonella enterica enterica serovar Typhi
uaggccugaaagcggcgcguca

SEQ ID NO: 190765 - RNA, 22 nt, Salmonella enterica enterica serovar Typhi
guugcgccagcccgacguggcc

SEQ ID NO: 190766 - RNA, 22 nt, Salmonella enterica enterica serovar Typhi
uggauaagugaaacgccauccg

SEQ ID NO: 190767 - RNA, 23 nt, Salmonella enterica enterica serovar Typhi
aaugccaaccgcugccgccacuu

SEQ ID NO: 190768 - RNA, 21 nt, Salmonella enterica enterica serovar Typhi
gcgauucgucaauuggcggua

SEQ ID NO: 190769 - RNA, 20 nt, Salmonella enterica enterica serovar Typhi
cgccaaagaaaaacgccugu

SEQ ID NO: 190770 - RNA, 22 nt, Salmonella enterica enterica serovar Typhi
uggauaaagacaauuucgaaua

SEQ ID NO: 190771 - RNA, 22 nt, Salmonella enterica enterica serovar Typhi
gcgcauccuccaguuggcuguu

SEQ ID NO: 190772 - RNA, 22 nt, Salmonella enterica enterica serovar Typhi
cgccguugaguaauacggcucc

SEQ ID NO: 190773 - RNA, 22 nt, Salmonella enterica enterica serovar Typhi
agaugcucuggcugcucacguu

SEQ ID NO: 190774 - RNA, 22 nt, Salmonella enterica enterica serovar Typhi
cggacgauuuuggucgcggcga

SEQ ID NO: 190775 - RNA, 21 nt, Salmonella enterica enterica serovar Typhi
uauggcgaccaccugcuggac

SEQ ID NO: 190776 - RNA, 16 nt, Salmonella enterica enterica serovar Typhi
ugucggcucauucuug

SEQ ID NO: 190777 - RNA, 22 nt, Salmonella enterica enterica serovar Typhi
gaacgugauaagcgcccgugag

SEQ ID NO: 190778 - RNA, 22 nt, Salmonella enterica enterica serovar Typhi
cugaucacuucacuuugcguuc

SEQ ID NO: 190779 - RNA, 22 nt, Salmonella enterica enterica serovar Typhi
cgugccugauggcgcugugcuu

SEQ ID NO: 190780 - RNA, 22 nt, Salmonella enterica enterica serovar Typhi
aucaugagcucgucgauuugcg

SEQ ID NO: 190781 - RNA, 22 nt, Salmonella enterica enterica serovar Typhi
guuacugagaaaucaaaagcga

SEQ ID NO: 190782 - RNA, 20 nt, Salmonella enterica enterica serovar Typhi
ggcuucaucggugaggagau

SEQ ID NO: 190783 - RNA, 22 nt, Salmonella enterica enterica serovar Typhi
acggcuaucagucuuugcacac

SEQ ID NO: 190784 - RNA, 22 nt, Salmonella enterica enterica serovar Typhi
ugcguucgguuauugcggaaga

SEQ ID NO: 190785 - RNA, 22 nt, Salmonella enterica enterica serovar Typhi
guucgcauggucaacuucuauc

SEQ ID NO: 190786 - RNA, 22 nt, Salmonella enterica enterica serovar Typhi
auagguggcguaaaauccgaac

SEQ ID NO: 190787 - RNA, 22 nt, Salmonella enterica enterica serovar Typhi
ugcgucuggacguggugaaccu

SEQ ID NO: 190788 - RNA, 22 nt, Salmonella enterica enterica serovar Typhi
agauuugcuugaguuguuuagc

SEQ ID NO: 190789 - RNA, 22 nt, Salmonella enterica enterica serovar Typhi
auuguuacacgauccccuuuuc

SEQ ID NO: 190790 - RNA, 22 nt, Salmonella enterica enterica serovar Typhi
uccgcaggcguucgaaaagggu

SEQ ID NO: 190791 - RNA, 22 nt, Salmonella enterica enterica serovar Typhi
ugcgcugauggccguguuuuuc

SEQ ID NO: 190792 - RNA, 22 nt, Salmonella enterica enterica serovar Typhi
uuggacguauugcaaaaucgca

SEQ ID NO: 190793 - RNA, 22 nt, Salmonella enterica enterica serovar Typhi
gcaggucagcauagauacgacg

SEQ ID NO: 190794 - RNA, 22 nt, Salmonella enterica enterica serovar Typhi
ugagaauuuucguugcaagggu

SEQ ID NO: 190795 - RNA, 22 nt, Salmonella enterica enterica serovar Typhi
aucguguaaaucguccagcgcc

SEQ ID NO: 190796 - RNA, 22 nt, Salmonella enterica enterica serovar Typhi
aguggucagcauugagcugccg

SEQ ID NO: 190797 - RNA, 22 nt, Salmonella enterica enterica serovar Typhi
auaggccaguacguucgaaucg

SEQ ID NO: 190798 - RNA, 22 nt, Salmonella enterica enterica serovar Typhi
gucguaccacaauuagcguauu

SEQ ID NO: 190799 - RNA, 22 nt, Salmonella enterica enterica serovar Typhi
aauuugcaaauggugaaaugau

SEQ ID NO: 190800 - RNA, 19 nt, Salmonella enterica enterica serovar Typhi
gggcuuaauggcuaucggg

SEQ ID NO: 190801 - RNA, 22 nt, Salmonella enterica enterica serovar Typhi
agcggcaucggccuguuuaucg

SEQ ID NO: 190802 - RNA, 23 nt, Salmonella enterica enterica serovar Typhi
uaucucuggcuuugcggcgaauc

SEQ ID NO: 190803 - RNA, 22 nt, Salmonella enterica enterica serovar Typhi
uuggcgacaaagaaauauuugg

SEQ ID NO: 190804 - RNA, 22 nt, Salmonella enterica enterica serovar Typhi
aucgcuggucaguuugcuguac

SEQ ID NO: 190805 - RNA, 23 nt, Salmonella enterica enterica serovar Typhi
agggcgucuggaugaagcauugu

SEQ ID NO: 190806 - RNA, 22 nt, Salmonella enterica enterica serovar Typhi
cgucaaugaaaugacuuccagc

SEQ ID NO: 190807 - RNA, 22 nt, Salmonella enterica enterica serovar Typhi
ugguccauagacuuuauugucc

SEQ ID NO: 190808 - RNA, 22 nt, Salmonella enterica enterica serovar Typhi
gagcuucaauacggcgaucggc

SEQ ID NO: 190809 - RNA, 22 nt, Salmonella enterica enterica serovar Typhi
ggguauaucugacggagcguga

SEQ ID NO: 190810 - RNA, 22 nt, Salmonella enterica enterica serovar Typhi
uguagcgcgucucaugcguugc

SEQ ID NO: 190811 - RNA, 22 nt, Salmonella enterica enterica serovar Typhi
agauacuguucuccguuguuaa

SEQ ID NO: 190812 - RNA, 22 nt, Salmonella enterica enterica serovar Typhi
gggucuccaccaguugcagcac

SEQ ID NO: 190813 - RNA, 22 nt, Salmonella enterica enterica serovar Typhi
auuggcgcgguacuggaagucg

SEQ ID NO: 190814 - RNA, 22 nt, Salmonella enterica enterica serovar Typhi
gccaggaaguuaugcggguuug

SEQ ID NO: 190815 - RNA, 22 nt, Salmonella enterica enterica serovar Typhi
uugcugaacaguugccgggcga

SEQ ID NO: 190816 - RNA, 22 nt, Salmonella enterica enterica serovar Typhi
ugccgcaagccgcuuucccuga

SEQ ID NO: 190817 - RNA, 22 nt, Salmonella enterica enterica serovar Typhi
cggugaacccugcgcgucagga

SEQ ID NO: 190818 - RNA, 22 nt, Salmonella enterica enterica serovar Typhi
caacggcauaggugugguccug

SEQ ID NO: 190819 - RNA, 22 nt, Salmonella enterica enterica serovar Typhi
guauggacagcaagcuuuccgg

SEQ ID NO: 190820 - RNA, 22 nt, Salmonella enterica enterica serovar Typhi
gcuggaaauacuaucauucuca

SEQ ID NO: 190821 - RNA, 22 nt, Salmonella enterica enterica serovar Typhi
aaucgcccugucauuucaggcg

SEQ ID NO: 190822 - RNA, 22 nt, Salmonella enterica enterica serovar Typhi
ugcgucugccugagcuggugca

SEQ ID NO: 190823 - RNA, 22 nt, Salmonella enterica enterica serovar Typhi
uugcaguuggcuaauaugcugc

SEQ ID NO: 190824 - RNA, 22 nt, Salmonella enterica enterica serovar Typhi
ugcuguuaguguucguuaucgg

SEQ ID NO: 190825 - RNA, 19 nt, Salmonella enterica enterica serovar Typhi
ucuugauccugacguggug

SEQ ID NO: 190826 - RNA, 22 nt, Salmonella enterica enterica serovar Typhi
cucgcugcacuugcucgaucca

SEQ ID NO: 190827 - RNA, 22 nt, Salmonella enterica enterica serovar Typhi
gcgagcaaaguaaggcgaaugg

SEQ ID NO: 190828 - RNA, 22 nt, Salmonella enterica enterica serovar Typhi
ccguggugaucgugacccauaa

SEQ ID NO: 190829 - RNA, 22 nt, Salmonella enterica enterica serovar Typhi
gaugcuggaugaauuacgcagc

SEQ ID NO: 190830 - RNA, 22 nt, Salmonella enterica enterica serovar Typhi
agcuuaucguugcauccaucgc

SEQ ID NO: 190831 - RNA, 22 nt, Salmonella enterica enterica serovar Typhi
auaccgcuuuggcggcgaacug

SEQ ID NO: 190832 - RNA, 22 nt, Salmonella enterica enterica serovar Typhi
acugugguccugcggacgagca

SEQ ID NO: 190833 - RNA, 22 nt, Salmonella enterica enterica serovar Typhi
cuggaguuuauagauuugcccc

SEQ ID NO: 190834 - RNA, 22 nt, Salmonella enterica enterica serovar Typhi
aagucgauuuccgcuuccugcg

SEQ ID NO: 190835 - RNA, 22 nt, Salmonella enterica enterica serovar Typhi
acaguacuggcacugaagucgc

SEQ ID NO: 190836 - RNA, 22 nt, Salmonella enterica enterica serovar Typhi
acaguaguuaaauguagaggga

SEQ ID NO: 190837 - RNA, 22 nt, Salmonella enterica enterica serovar Typhi
acaguuccggcacuuucaccga

SEQ ID NO: 190838 - RNA, 20 nt, Salmonella enterica enterica serovar Typhi
acauaauccggguaaagacc

SEQ ID NO: 190839 - RNA, 22 nt, Salmonella enterica enterica serovar Typhi
acauugagggcgaaaucucaua

SEQ ID NO: 190840 - RNA, 22 nt, Salmonella enterica enterica serovar Typhi
acucuuaacaaauagaaauuac

SEQ ID NO: 190841 - RNA, 22 nt, Salmonella enterica enterica serovar Typhi
acagagccugucucagcaauga

SEQ ID NO: 190842 - RNA, 22 nt, Salmonella enterica enterica serovar Typhi
auugauguggguaaagugaugg

SEQ ID NO: 190843 - RNA, 22 nt, Salmonella enterica enterica serovar Typhi
auuucugucaccuguugcuguu

SEQ ID NO: 190844 - RNA, 22 nt, Salmonella enterica enterica serovar Typhi
caacauagauaugagguucacu

SEQ ID NO: 190845 - RNA, 22 nt, Salmonella enterica enterica serovar Typhi
auggaaauugugaauauugacu

SEQ ID NO: 190846 - RNA, 19 nt, Salmonella enterica enterica serovar Typhi
auguggagcaacuauggga

SEQ ID NO: 190847 - RNA, 22 nt, Salmonella enterica enterica serovar Typhi
auucucgucugucaugcacauc

SEQ ID NO: 190848 - RNA, 22 nt, Salmonella enterica enterica serovar Typhi
auuccaggaauaaguauccaga

SEQ ID NO: 190849 - RNA, 22 nt, Salmonella enterica enterica serovar Typhi
auucaaucaaauuaagaucaca

SEQ ID NO: 190850 - RNA, 22 nt, Salmonella enterica enterica serovar Typhi
cagauaguuauucgcaucgcgc

SEQ ID NO: 190851 - RNA, 22 nt, Salmonella enterica enterica serovar Typhi
cagacgcugaaacaacgcuggg

SEQ ID NO: 190852 - RNA, 19 nt, Salmonella enterica enterica serovar Typhi
cagauuguuguuuaucuca

SEQ ID NO: 190853 - RNA, 22 nt, Salmonella enterica enterica serovar Typhi
cagaccaguaaauuaaguaagg

SEQ ID NO: 190854 - RNA, 18 nt, Salmonella enterica enterica serovar Typhi
aucaggguggauuccggg

SEQ ID NO: 190855 - RNA, 22 nt, Salmonella enterica enterica serovar Typhi
aucaguuucaggaugaagaccg

SEQ ID NO: 190856 - RNA, 22 nt, Salmonella enterica enterica serovar Typhi
auccucagaugaagcgggcgcu

SEQ ID NO: 190857 - RNA, 22 nt, Salmonella enterica enterica serovar Typhi
aucugcuucaugcguuucuuac

SEQ ID NO: 190858 - RNA, 22 nt, Salmonella enterica enterica serovar Typhi
aucuugauugcagccagaguuu

SEQ ID NO: 190859 - RNA, 22 nt, Salmonella enterica enterica serovar Typhi
aucugguugaauuugaucagga

SEQ ID NO: 190860 - RNA, 22 nt, Salmonella enterica enterica serovar Typhi
augccuuauccggccuacaacg

SEQ ID NO: 190861 - RNA, 22 nt, Salmonella enterica enterica serovar Typhi
aguucaaaccguuauuaauuaa

SEQ ID NO: 190862 - RNA, 22 nt, Salmonella enterica enterica serovar Typhi
agugauuauuacgcagcauaug

SEQ ID NO: 190863 - RNA, 22 nt, Salmonella enterica enterica serovar Typhi
aguuaucaacggaagauuagua

SEQ ID NO: 190864 - RNA, 22 nt, Salmonella enterica enterica serovar Typhi
agucaauauuuauucauggaau

SEQ ID NO: 190865 - RNA, 22 nt, Salmonella enterica enterica serovar Typhi
aguggaaucagccaggagucgg

SEQ ID NO: 190866 - RNA, 22 nt, Salmonella enterica enterica serovar Typhi
aguaucuaucgaugcauuaaau

SEQ ID NO: 190867 - RNA, 22 nt, Salmonella enterica enterica serovar Typhi
caggcgugaaugugucugcgug

SEQ ID NO: 190868 - RNA, 22 nt, Salmonella enterica enterica serovar Typhi
cauagcauaacaaagaugcgaa

SEQ ID NO: 190869 - RNA, 22 nt, Salmonella enterica enterica serovar Typhi
cagguuguugggauguuucaga

SEQ ID NO: 190870 - RNA, 22 nt, Salmonella enterica enterica serovar Typhi
cgugccugauggcgcugugcuu

SEQ ID NO: 190871 - RNA, 21 nt, Salmonella enterica enterica serovar Typhi
cguuccaccuuuaucagcagu

SEQ ID NO: 190872 - RNA, 22 nt, Salmonella enterica enterica serovar Typhi
cgcaggauacgaaacgggugcu

SEQ ID NO: 190873 - RNA, 22 nt, Salmonella enterica enterica serovar Typhi
cuccaguuggcugauguuguau

SEQ ID NO: 190874 - RNA, 22 nt, Salmonella enterica enterica serovar Typhi
cuuaucuguauugaugauaaac

SEQ ID NO: 190875 - RNA, 22 nt, Salmonella enterica enterica serovar Typhi
gcuggaaauacuaucauucuca

SEQ ID NO: 190876 - RNA, 22 nt, Salmonella enterica enterica serovar Typhi
ggcugcugaagguguucugcgc

SEQ ID NO: 190877 - RNA, 22 nt, Salmonella enterica enterica serovar Typhi
gggcuucuuugcguguguggua

SEQ ID NO: 190878 - RNA, 22 nt, Salmonella enterica enterica serovar Typhi
gggacguuauaagcuggcagac

SEQ ID NO: 190879 - RNA, 22 nt, Salmonella enterica enterica serovar Typhi
gugccgucgccauuggugucuc

SEQ ID NO: 190880 - RNA, 22 nt, Salmonella enterica enterica serovar Typhi
gugcaggaugacucggcuucgc

SEQ ID NO: 190881 - RNA, 22 nt, Salmonella enterica enterica serovar Typhi
ucagggugauacuggcguugca

SEQ ID NO: 190882 - RNA, 22 nt, Salmonella enterica enterica serovar Typhi
ucaggguggugauguaguagua

SEQ ID NO: 190883 - RNA, 23 nt, Salmonella enterica enterica serovar Typhi
uaacugaggggauuaugaccuuc

SEQ ID NO: 190884 - RNA, 22 nt, Salmonella enterica enterica serovar Typhi
uaacagccccagcccuggcgua

SEQ ID NO: 190885 - RNA, 22 nt, Salmonella enterica enterica serovar Typhi
uaaagugaaauaauucagucag

SEQ ID NO: 190886 - RNA, 22 nt, Salmonella enterica enterica serovar Typhi
uaaugcuuauccggccuacagg

SEQ ID NO: 190887 - RNA, 22 nt, Salmonella enterica enterica serovar Typhi
uguaggccggauaagacgcguu

SEQ ID NO: 190888 - RNA, 22 nt, Salmonella enterica enterica serovar Typhi
uggcacugcuccagcuuuaccu

SEQ ID NO: 190889 - RNA, 22 nt, Salmonella enterica enterica serovar Typhi
ugauugaaaaaaccuggcguau

SEQ ID NO: 190890 - RNA, 22 nt, Salmonella enterica enterica serovar Typhi
ucugcauccccacgcgggugac

SEQ ID NO: 190891 - RNA, 19 nt, Salmonella enterica enterica serovar Typhi
uccggaugacgaacuggcc

SEQ ID NO: 190892 - RNA, 22 nt, Salmonella enterica enterica serovar Typhi
uccagcaaaaaucuuucuuugg

SEQ ID NO: 190893 - RNA, 21 nt, Salmonella enterica enterica serovar Typhi
uccagcacuugcuucauugcu

SEQ ID NO: 190894 - RNA, 22 nt, Salmonella enterica enterica serovar Typhi
agcuuuaucucuaaagcgggca

SEQ ID NO: 190895 - RNA, 22 nt, Salmonella enterica enterica serovar Typhi
agcggccugcuggucucauugu

SEQ ID NO: 190896 - RNA, 22 nt, Salmonella enterica enterica serovar Typhi
agcgaguuuaccccacuuacua

SEQ ID NO: 190897 - RNA, 19 nt, Salmonella enterica enterica serovar Typhi
agcaggauaaguucauuag

SEQ ID NO: 190898 - RNA, 22 nt, Salmonella enterica enterica serovar Typhi
agcaugcucuugcaaacugggu

SEQ ID NO: 190899 - RNA, 22 nt, Salmonella enterica enterica serovar Typhi
agcaguuuaauaagguucuggc

SEQ ID NO: 190900 - RNA, 22 nt, Salmonella enterica enterica serovar Typhi
agccagccaguucgaugauuuu

SEQ ID NO: 190901 - RNA, 22 nt, Salmonella enterica enterica serovar Typhi
aaucucugugcuaucaaauccc

SEQ ID NO: 190902 - RNA, 22 nt, Salmonella enterica enterica serovar Typhi
aaucuguugcgucguacuuuuu

SEQ ID NO: 190903 - RNA, 22 nt, Salmonella enterica enterica serovar Typhi
acgaaggcgacauuagcagccg

SEQ ID NO: 190904 - RNA, 22 nt, Salmonella enterica enterica serovar Typhi
agauuugcuugaguuguuuagc

SEQ ID NO: 190905 - RNA, 22 nt, Salmonella enterica enterica serovar Typhi
agaugcucuggcugcucacguu

SEQ ID NO: 190906 - RNA, 22 nt, Salmonella enterica enterica serovar Typhi
agaugggcaaagccacggugga

SEQ ID NO: 190907 - RNA, 22 nt, Salmonella enterica enterica serovar Typhi
agagccaguucguucacguguc

SEQ ID NO: 190908 - RNA, 22 nt, Salmonella enterica enterica serovar Typhi
agacugcauuucaauggcuucc

SEQ ID NO: 190909 - RNA, 22 nt, Salmonella enterica enterica serovar Typhi
uuuguucaacgacuuguguggc

SEQ ID NO: 190910 - RNA, 22 nt, Salmonella enterica enterica serovar Typhi
uuucauuguuguggaaccgcuu

SEQ ID NO: 190911 - RNA, 22 nt, Salmonella enterica enterica serovar Typhi
uuggccucagauuaauguuaag

SEQ ID NO: 190912 - RNA, 22 nt, Salmonella enterica enterica serovar Typhi
uuggccagauacaccggcguca

SEQ ID NO: 190913 - RNA, 22 nt, Salmonella enterica enterica serovar Typhi
uuuaucugcggggacguuaugg

SEQ ID NO: 190914 - RNA, 22 nt, Salmonella enterica enterica serovar Typhi
uugaugcuggucuacggcugcg

SEQ ID NO: 190915 - RNA, 21 nt, Salmonella enterica enterica serovar Typhi
uugcccugaccgaauucuuua

SEQ ID NO: 190916 - RNA, 22 nt, Salmonella enterica enterica serovar Typhi
uucuaacaaaacuaauguugag

SEQ ID NO: 190917 - RNA, 21 nt, Salmonella enterica enterica serovar Typhi
uucaaggaaauugccgcuugu

SEQ ID NO: 190918 - RNA, 22 nt, Salmonella enterica enterica serovar Typhi
uuaucagucuacaaauuacuuu

SEQ ID NO: 190919 - RNA, 22 nt, Salmonella enterica enterica serovar Typhi
ugcaggauggcguccagcgacc

SEQ ID NO: 190920 - RNA, 22 nt, Salmonella enterica enterica serovar Typhi
ugcaggaugucgcgccggguac

SEQ ID NO: 190921 - RNA, 22 nt, Salmonella enterica enterica serovar Typhi
ugcaucucuugaggcuauguuu

SEQ ID NO: 190922 - RNA, 21 nt, Salmonella enterica enterica serovar Typhi
uagcuccauuacgaucaccac

SEQ ID NO: 190923 - RNA, 22 nt, Salmonella enterica enterica serovar Typhi
guuuaucgaaggccagaucguc

SEQ ID NO: 190924 - RNA, 22 nt, Salmonella enterica enterica serovar Typhi
gucugcccgcagacauggucgu

SEQ ID NO: 190925 - RNA, 22 nt, Salmonella enterica enterica serovar Typhi
gucggccaguauuugucugcca

SEQ ID NO: 190926 - RNA, 22 nt, Salmonella enterica enterica serovar Typhi
gcuuucaggccuccuggugugg

SEQ ID NO: 190927 - RNA, 22 nt, Salmonella enterica enterica serovar Typhi
ggagccugcaucgucggcgcgc

SEQ ID NO: 190928 - RNA, 22 nt, Salmonella enterica enterica serovar Typhi
ccaagggccggucgaucuguuc

SEQ ID NO: 190929 - RNA, 22 nt, Salmonella enterica enterica serovar Typhi
aggccugauaagcgcagcgcca

SEQ ID NO: 190930 - RNA, 22 nt, Salmonella enterica enterica serovar Typhi
aggccggauaagcgaagcgcca

SEQ ID NO: 190931 - RNA, 22 nt, Salmonella enterica enterica serovar Typhi
caucuucaaaacgcugcaugag

SEQ ID NO: 190932 - RNA, 22 nt, Salmonella enterica enterica serovar Typhi
ccagagauugcuaggugacugu

SEQ ID NO: 190933 - RNA, 22 nt, Salmonella enterica enterica serovar Typhi
ccaggguuugacguuuccacuu

SEQ ID NO: 190934 - RNA, 22 nt, Salmonella enterica enterica serovar Typhi
gaucgcuaaaacguuuuuaugu

SEQ ID NO: 190935 - RNA, 22 nt, Salmonella enterica enterica serovar Typhi
gauauugaugccgaugugguga

SEQ ID NO: 190936 - RNA, 22 nt, Salmonella enterica enterica serovar Typhi
gagcuucaauacggcgaucggc

SEQ ID NO: 190937 - RNA, 22 nt, Salmonella enterica enterica serovar Typhi
cuggaguuuauagauuugcccc

SEQ ID NO: 190938 - RNA, 22 nt, Salmonella enterica enterica serovar Typhi
gauggcggaggucaggccuucc

SEQ ID NO: 190939 - RNA, 22 nt, Salmonella enterica enterica serovar Typhi
gaugggcuguuuaaggaaaccu

SEQ ID NO: 190940 - RNA, 22 nt, Salmonella enterica enterica serovar Typhi
gauggugaugaccgucaaugcc

SEQ ID NO: 190941 - RNA, 22 nt, Human
aaaaaauugcuggcagagcugu

SEQ ID NO: 190942 - RNA, 22 nt, Human
aaaaaggagaaagagagggaga

SEQ ID NO: 190943 - RNA, 22 nt, Human
aaaaccugcaagaugaaaucag

SEQ ID NO: 190944 - RNA, 22 nt, Human
aaaagaaugaugggagcugggu

SEQ ID NO: 190945 - RNA, 22 nt, Human
aaaaacuuaccccagggcaagg

SEQ ID NO: 190946 - RNA, 22 nt, Human
aaaaaaacuaauuuuaaaugug

SEQ ID NO: 190947 - RNA, 20 nt, Human
aaaaacaguaaugcugaaga

SEQ ID NO: 190948 - RNA, 22 nt, Human
aaaaauuucuggugaaaugccu

SEQ ID NO: 190949 - RNA, 22 nt, Human
aaaaaguaccacuuggacacuu

SEQ ID NO: 190950 - RNA, 20 nt, Human
aaaaauguguuuauggagau

SEQ ID NO: 190951 - RNA, 23 nt, Human
aaagacuagaagccguggcugca

SEQ ID NO: 190952 - RNA, 22 nt, Human
aaacuugaggcaaugaaggugu

SEQ ID NO: 190953 - RNA, 22 nt, Human
aaacugcuuucucugccuuucc

SEQ ID NO: 190954 - RNA, 22 nt, Human
aaagacagccuguuggcuuucu

SEQ ID NO: 190955 - RNA, 22 nt, Human
aaagaccuucacuuucuggcug

SEQ ID NO: 190956 - RNA, 22 nt, Human
aaagacuaaccaguugucaaaa

SEQ ID NO: 190957 - RNA, 22 nt, Human
aaagagacaacaacaacuucua

SEQ ID NO: 190958 - RNA, 22 nt, Human
aaagaagugucuuacucccucu

SEQ ID NO: 190959 - RNA, 22 nt, Human
aaagagcugccaagguuacagu

SEQ ID NO: 190960 - RNA, 22 nt, Human
aaacuuuugaaggaggaaaaag

SEQ ID NO: 190961 - RNA, 22 nt, Human
aaacucaucaguuuagaaaccu

SEQ ID NO: 190962 - RNA, 22 nt, Human
aaacuagaacagagagagaagc

SEQ ID NO: 190963 - RNA, 22 nt, Human
aaacucaugccagagaacuuaa

SEQ ID NO: 190964 - RNA, 22 nt, Human
aaacugacugaugugaucuuau

SEQ ID NO: 190965 - RNA, 22 nt, Human
aaagaauuucaagauucccaca

SEQ ID NO: 190966 - RNA, 22 nt, Human
aaaauaaccuucauuugcauug

SEQ ID NO: 190967 - RNA, 22 nt, Human
aaaauaauauuauaccacugcu

SEQ ID NO: 190968 - RNA, 22 nt, Human
aaaauauguugagauacugaaa

SEQ ID NO: 190969 - RNA, 22 nt, Human
aaacaaauccaauaauaaaauu

SEQ ID NO: 190970 - RNA, 22 nt, Human
aaacagguuugaacuucuuaac

SEQ ID NO: 190971 - RNA, 22 nt, Human
aaacauaugccuucuuuuguaa

SEQ ID NO: 190972 - RNA, 22 nt, Human
aaacccauauaccagcugugcu

SEQ ID NO: 190973 - RNA, 22 nt, Human
aaacauguagugcaugaggauc

SEQ ID NO: 190974 - RNA, 22 nt, Human
aaaccagaguucauaguauuca

SEQ ID NO: 190975 - RNA, 21 nt, Human
aaacaugcagccugccaauuc

SEQ ID NO: 190976 - RNA, 18 nt, Human
aaacauggcuuaaaggcu

SEQ ID NO: 190977 - RNA, 22 nt, Human
aaaauauaaaggauguggguuu

SEQ ID NO: 190978 - RNA, 22 nt, Human
aaaauacuaggaaaauaaauca

SEQ ID NO: 190979 - RNA, 18 nt, Human
aaacccacguauucaggc

SEQ ID NO: 190980 - RNA, 22 nt, Human
aaacccaggguuuugucuuccc

SEQ ID NO: 190981 - RNA, 21 nt, Human
aauuauuugcauuuuucuugu

SEQ ID NO: 190982 - RNA, 22 nt, Human
aauucaacagucaguuaucuca

SEQ ID NO: 190983 - RNA, 22 nt, Human
aauucagguuauauuugcaacu

SEQ ID NO: 190984 - RNA, 22 nt, Human
aauucaggacaaauguuuucaa

SEQ ID NO: 190985 - RNA, 22 nt, Human
aauuagaagcuguuagcaaaau

SEQ ID NO: 190986 - RNA, 22 nt, Human
aauuauguugaaauaugagaac

SEQ ID NO: 190987 - RNA, 22 nt, Human
aauuauucuugccuagguuuaa

SEQ ID NO: 190988 - RNA, 22 nt, Human
aauuauucucucaacugagaug

SEQ ID NO: 190989 - RNA, 22 nt, Human
aauguuguaaauauucuuugag

SEQ ID NO: 190990 - RNA, 22 nt, Human
aauguuuaguuuuauuuuagua

SEQ ID NO: 190991 - RNA, 22 nt, Human
aauguuuaagcuuuuauuuaca

SEQ ID NO: 190992 - RNA, 22 nt, Human
aauguuuaacuguggucagcag

SEQ ID NO: 190993 - RNA, 22 nt, Human
aauguuugaacuuugcauauuu

SEQ ID NO: 190994 - RNA, 22 nt, Human
aauguugaaccuuuuuggccug

SEQ ID NO: 190995 - RNA, 23 nt, Human
aauguugaggguggguuuuuaac

SEQ ID NO: 190996 - RNA, 22 nt, Human
aauguugacguuggccagggcc

SEQ ID NO: 190997 - RNA, 22 nt, Human
aaugguggaugucuguucugac

SEQ ID NO: 190998 - RNA, 23 nt, Human
aaugggcggaaguguuaaguugc

SEQ ID NO: 190999 - RNA, 22 nt, Human
aauggcuagcauguaaaauauc

SEQ ID NO: 191000 - RNA, 22 nt, Human
aaugggauaggucuucaggaau

SEQ ID NO: 191001 - RNA, 22 nt, Human
aauguaaauaauuguaaaauuu

SEQ ID NO: 191002 - RNA, 22 nt, Human
aauguacucgaaugauguuaag

SEQ ID NO: 191003 - RNA, 22 nt, Human
aaugguccagaaucuuuuggac

SEQ ID NO: 191004 - RNA, 22 nt, Human
aauggcaagccacaugcuuuuc

SEQ ID NO: 191005 - RNA, 22 nt, Human
aauggcagauaauuuuccagau

SEQ ID NO: 191006 - RNA, 22 nt, Human
aauggacuucucugagccuguu

SEQ ID NO: 191007 - RNA, 22 nt, Human
aaugcugaaugcauguuuccau

SEQ ID NO: 191008 - RNA, 22 nt, Human
aaugcuaaagaagaaggaguag

SEQ ID NO: 191009 - RNA, 22 nt, Human
aaugaauaaauuuuaaagacag

SEQ ID NO: 191010 - RNA, 22 nt, Human
aaucugugugugagaaauggca

SEQ ID NO: 191011 - RNA, 22 nt, Human
aaucuuuuugaaggaggagaga

SEQ ID NO: 191012 - RNA, 22 nt, Human
aaucugaccguggagaucucca

SEQ ID NO: 191013 - RNA, 22 nt, Human
aaucugacaaaauauuuccagu

SEQ ID NO: 191014 - RNA, 22 nt, Human
aaucucguuaugaagaugguug

SEQ ID NO: 191015 - RNA, 22 nt, Human
aaucaauuauccauuuguuagu

SEQ ID NO: 191016 - RNA, 19 nt, Human
aaucacaagcaauaggggu

SEQ ID NO: 191017 - RNA, 22 nt, Human
aaucccaguccuccugggggau

SEQ ID NO: 191018 - RNA, 22 nt, Human
aaucauguguaaugggcagacc

SEQ ID NO: 191019 - RNA, 22 nt, Human
aaucgacuguagagacuuggcg

SEQ ID NO: 191020 - RNA, 23 nt, Human
aaugaguugggcagcauacaggc

SEQ ID NO: 191021 - RNA, 22 nt, Human
aaugaguuuguucuauuauuug

SEQ ID NO: 191022 - RNA, 22 nt, Human
aaugacaguggcacagucacuu

SEQ ID NO: 191023 - RNA, 22 nt, Human
aaugaguucaucugaauucugg

SEQ ID NO: 191024 - RNA, 22 nt, Human
aaugagauaagaaaaccuuugc

SEQ ID NO: 191025 - RNA, 22 nt, Human
aaugauuuucugcaaacaguga

SEQ ID NO: 191026 - RNA, 22 nt, Human
aaugcagaugugucuuuaauuu

SEQ ID NO: 191027 - RNA, 22 nt, Human
aaugcauaaugguuugugacaa

SEQ ID NO: 191028 - RNA, 22 nt, Human
aaugccuucauuggcgaagugc

SEQ ID NO: 191029 - RNA, 22 nt, Human
aaugaacuuugaagauggugaa

SEQ ID NO: 191030 - RNA, 22 nt, Human
aaugaguccuuuagugccauug

SEQ ID NO: 191031 - RNA, 22 nt, Human
aaugagauggaggacucuuaau

SEQ ID NO: 191032 - RNA, 22 nt, Human
aaugagaauguaagugaagaga

SEQ ID NO: 191033 - RNA, 22 nt, Human
aaugacagccuauacugucugc

SEQ ID NO: 191034 - RNA, 22 nt, Human
aaugaaaaucugucaguucaag

SEQ ID NO: 191035 - RNA, 22 nt, Human
aaugaaugaaugaaugauuaug

SEQ ID NO: 191036 - RNA, 22 nt, Human
aaugaacuuucaguucagagag

SEQ ID NO: 191037 - RNA, 22 nt, Human
aaugaaacuaguagaaucuuug

SEQ ID NO: 191038 - RNA, 22 nt, Human
aaguugacuguuuuacuuaugu

SEQ ID NO: 191039 - RNA, 22 nt, Human
aaguugaaugucuugcugaaug

SEQ ID NO: 191040 - RNA, 20 nt, Human
aaguugaaguuacuucaugg

SEQ ID NO: 191041 - RNA, 22 nt, Human
aaguguucucuguuuuaucuac

SEQ ID NO: 191042 - RNA, 22 nt, Human
aaguuaugauuggcguggacaa

SEQ ID NO: 191043 - RNA, 22 nt, Human
aagugugugagaaggggucgca

SEQ ID NO: 191044 - RNA, 22 nt, Human
aagugugugugcgcaugugcau

SEQ ID NO: 191045 - RNA, 22 nt, Human
aaguguggguaagcauuucuug

SEQ ID NO: 191046 - RNA, 22 nt, Human
aaguccgggcagcaggaauucu

SEQ ID NO: 191047 - RNA, 22 nt, Human
aagugucucugggaggcccgga

SEQ ID NO: 191048 - RNA, 22 nt, Human
aagugguuuauuguaugguuuu

SEQ ID NO: 191049 - RNA, 18 nt, Human
aaguaguuugagauuguu

SEQ ID NO: 191050 - RNA, 22 nt, Human
aaguagaaaaccgcacuggacu

SEQ ID NO: 191051 - RNA, 23 nt, Human
aaguggugacugugcuacugaga

SEQ ID NO: 191052 - RNA, 22 nt, Human
aagucccaucugccuccaugua

SEQ ID NO: 191053 - RNA, 22 nt, Human
aaguggcccuaauugggccaaa

SEQ ID NO: 191054 - RNA, 17 nt, Human
aagugggcaaagugaga

SEQ ID NO: 191055 - RNA, 22 nt, Human
aaguggugagacccugcugaaa

SEQ ID NO: 191056 - RNA, 22 nt, Human
aauaagacugucauggaguaaa

SEQ ID NO: 191057 - RNA, 22 nt, Human
aauaacuuacucuaugcuuagu

SEQ ID NO: 191058 - RNA, 22 nt, Human
aaguuuaagguagugaugauga

SEQ ID NO: 191059 - RNA, 23 nt, Human
aaguugucauguaaaaugggcua

SEQ ID NO: 191060 - RNA, 22 nt, Human
aauaauacaauuggugucaugu

SEQ ID NO: 191061 - RNA, 22 nt, Human
aauaagaguuaagaaguauauu

SEQ ID NO: 191062 - RNA, 22 nt, Human
aauacaaucagauuaugguagu

SEQ ID NO: 191063 - RNA, 22 nt, Human
aauaauacaugugaugagaauu

SEQ ID NO: 191064 - RNA, 22 nt, Human
aauacagauggcaugugaagau

SEQ ID NO: 191065 - RNA, 22 nt, Human
aauagcacauguugguugagua

SEQ ID NO: 191066 - RNA, 22 nt, Human
aauaggaaggaaauguuuaccu

SEQ ID NO: 191067 - RNA, 22 nt, Human
aauagagacaguuuaacaauau

SEQ ID NO: 191068 - RNA, 22 nt, Human
aauagguaaaugaguaagaaau

SEQ ID NO: 191069 - RNA, 22 nt, Human
aauaguggcuuggacuaaauau

SEQ ID NO: 191070 - RNA, 22 nt, Human
aauauagagcagaucuggcucu

SEQ ID NO: 191071 - RNA, 22 nt, Human
aauauauaugggugcaugucug

SEQ ID NO: 191072 - RNA, 22 nt, Human
aauaugaugccaaauugcuaca

SEQ ID NO: 191073 - RNA, 22 nt, Human
aauaucuagccuuuagcagcuu

SEQ ID NO: 191074 - RNA, 22 nt, Human
aagguguaaguagcugguucau

SEQ ID NO: 191075 - RNA, 22 nt, Human
aaguaaaucuuaugucagggag

SEQ ID NO: 191076 - RNA, 21 nt, Human
aaguaaauuuuuacuuaggcc

SEQ ID NO: 191077 - RNA, 22 nt, Human
aagguuuuguaugaaaucucug

SEQ ID NO: 191078 - RNA, 22 nt, Human
aagguuuuguuuucgguuuuuu

SEQ ID NO: 191079 - RNA, 22 nt, Human
aaggucuucgaaccuuauguua

SEQ ID NO: 191080 - RNA, 22 nt, Human
aagggaaggaugggcauuuaca

SEQ ID NO: 191081 - RNA, 22 nt, Human
aagggggacaagcauuggcuua

SEQ ID NO: 191082 - RNA, 23 nt, Human
aagggcgauuaacauucgcucga

SEQ ID NO: 191083 - RNA, 22 nt, Human
aaggauguuuaaacuacuuucc

SEQ ID NO: 191084 - RNA, 22 nt, Human
aaggcagagggaaaacgggaau

SEQ ID NO: 191085 - RNA, 22 nt, Human
aaggcaggagaguaggaggugg

SEQ ID NO: 191086 - RNA, 22 nt, Human
aaggcgaggggcacagcugaga

SEQ ID NO: 191087 - RNA, 22 nt, Human
aaggcgccacagugauugcaaa

SEQ ID NO: 191088 - RNA, 22 nt, Human
aaggcgguuccgguucgcggcg

SEQ ID NO: 191089 - RNA, 22 nt, Human
aaggcggcggcggcggcugcgg

SEQ ID NO: 191090 - RNA, 22 nt, Human
aaggcgauuuaaagauguuagg

SEQ ID NO: 191091 - RNA, 22 nt, Human
aaggcuguuugagcacuggagc

SEQ ID NO: 191092 - RNA, 22 nt, Human
aaggcuuugugcugaguugucg

SEQ ID NO: 191093 - RNA, 22 nt, Human
aaggaugguaacaguuucauuu

SEQ ID NO: 191094 - RNA, 22 nt, Human
aagccuuagauuggcgaugucg

SEQ ID NO: 191095 - RNA, 22 nt, Human
aaggaggaugaauugucugcaa

SEQ ID NO: 191096 - RNA, 22 nt, Human
aagccuccgugcugcuggaucu

SEQ ID NO: 191097 - RNA, 22 nt, Human
aagccugguuauuugaggaugu

SEQ ID NO: 191098 - RNA, 22 nt, Human
aagccuguugacagcugucagu

SEQ ID NO: 191099 - RNA, 22 nt, Human
aacuacucugggguggcagguu

SEQ ID NO: 191100 - RNA, 22 nt, Human
aacgugcuuuacaaaugaccuu

SEQ ID NO: 191101 - RNA, 22 nt, Human
aacugagugcuacauugugauu

SEQ ID NO: 191102 - RNA, 22 nt, Human
aacugaaguuuucagauuuugc

SEQ ID NO: 191103 - RNA, 22 nt, Human
aacgcagagaguaaugcugaac

SEQ ID NO: 191104 - RNA, 22 nt, Human
aacucgaugcaauucacuuugu

SEQ ID NO: 191105 - RNA, 22 nt, Human
aacgcugugcacuggguccagg

SEQ ID NO: 191106 - RNA, 22 nt, Human
aacuuauacccagggcagaaau

SEQ ID NO: 191107 - RNA, 22 nt, Human
aacuucuggaaacuuccaugug

SEQ ID NO: 191108 - RNA, 22 nt, Human
aacuggguuuaucuaaugugua

SEQ ID NO: 191109 - RNA, 21 nt, Human
aacuauuaauaccauuagcaa

SEQ ID NO: 191110 - RNA, 22 nt, Human
aacuagugucuguaugauaagg

SEQ ID NO: 191111 - RNA, 23 nt, Human
aacucuggcuagcauagaauaga

SEQ ID NO: 191112 - RNA, 22 nt, Human
aacucugcaaugaaaucauguu

SEQ ID NO: 191113 - RNA, 22 nt, Human
aacucugagaaacuugcaguug

SEQ ID NO: 191114 - RNA, 22 nt, Human
aacuuguaaugaaaggcaauag

SEQ ID NO: 191115 - RNA, 22 nt, Human
aagaaaccauauuaguuccugg

SEQ ID NO: 191116 - RNA, 22 nt, Human
aagaaaggcacaagaaagaaaa

SEQ ID NO: 191117 - RNA, 22 nt, Human
aacuugaagacaccccacauuc

SEQ ID NO: 191118 - RNA, 22 nt, Human
aagaaauacagaaauggcagua

SEQ ID NO: 191119 - RNA, 19 nt, Human
aagaacaguucuaauuuca

SEQ ID NO: 191120 - RNA, 22 nt, Human
aagaaauagauagaggaauacu

SEQ ID NO: 191121 - RNA, 21 nt, Human
aacuuucccaauccagauuug

SEQ ID NO: 191122 - RNA, 22 nt, Human
aacuuucagaauccuaugcauu

SEQ ID NO: 191123 - RNA, 22 nt, Human
aacuuucugaaaagcuugauca

SEQ ID NO: 191124 - RNA, 22 nt, Human
aacuuaacucugcaauccagcu

SEQ ID NO: 191125 - RNA, 22 nt, Human
aagaaaagguaaccgcuuaucu

SEQ ID NO: 191126 - RNA, 22 nt, Human
aagaaaagcaucuuuguaguag

SEQ ID NO: 191127 - RNA, 22 nt, Human
aacugguaauuuaguauuacug

SEQ ID NO: 191128 - RNA, 22 nt, Human
aacugggugauucaggcuguuu

SEQ ID NO: 191129 - RNA, 22 nt, Human
aacugcauaagcuucgggaccu

SEQ ID NO: 191130 - RNA, 22 nt, Human
aacuuucuuugcaucuaaguuu

SEQ ID NO: 191131 - RNA, 22 nt, Human
aacuuuuaugaaggaaaucaua

SEQ ID NO: 191132 - RNA, 20 nt, Human
aacuuugagugcaugacuuu

SEQ ID NO: 191133 - RNA, 22 nt, Human
aacuuuuucuuaggggaaagca

SEQ ID NO: 191134 - RNA, 22 nt, Human
aagcauaucaaguuuuaugugc

SEQ ID NO: 191135 - RNA, 22 nt, Human
aagcaugagguggugagugaca

SEQ ID NO: 191136 - RNA, 22 nt, Human
aagcaguuuagucaucgggauu

SEQ ID NO: 191137 - RNA, 22 nt, Human
aagcauuuuagauaaagcauca

SEQ ID NO: 191138 - RNA, 22 nt, Human
aagacccuaccccuggagagga

SEQ ID NO: 191139 - RNA, 22 nt, Human
aagagaaacauauggccagauu

SEQ ID NO: 191140 - RNA, 22 nt, Human
aagagaaaugcuuuaacuuuau

SEQ ID NO: 191141 - RNA, 22 nt, Human
aagagaggcccaaguggcuggc

SEQ ID NO: 191142 - RNA, 21 nt, Human
aagagcgccgggcagggcuga

SEQ ID NO: 191143 - RNA, 22 nt, Human
aagagcuuguuaugcugcucuu

SEQ ID NO: 191144 - RNA, 22 nt, Human
aagcaaguucuaaaguaauucu

SEQ ID NO: 191145 - RNA, 22 nt, Human
aagcaauucacaguucacuuaa

SEQ ID NO: 191146 - RNA, 22 nt, Human
aagcagaaaaacugagcuccaa

SEQ ID NO: 191147 - RNA, 22 nt, Human
aagaugcaagcauuuugaacug

SEQ ID NO: 191148 - RNA, 22 nt, Human
aagagugugagguugugcuuuu

SEQ ID NO: 191149 - RNA, 22 nt, Human
aagauucaguugguuuuggaaa

SEQ ID NO: 191150 - RNA, 22 nt, Human
aagauuuaccacuuuauucaag

SEQ ID NO: 191151 - RNA, 21 nt, Human
aagacguaguuggguggacca

SEQ ID NO: 191152 - RNA, 22 nt, Human
aagagugaguagcuugguuggu

SEQ ID NO: 191153 - RNA, 22 nt, Human
aagaugcuucaugagaguuggg

SEQ ID NO: 191154 - RNA, 22 nt, Human
aagaggaggacgguucccagaa

SEQ ID NO: 191155 - RNA, 22 nt, Human
aagaccacaggaaucaaacagg

SEQ ID NO: 191156 - RNA, 22 nt, Human
aagaggacagucaaauggccgg

SEQ ID NO: 191157 - RNA, 22 nt, Human
aagaggaauaauaaaaauugca

SEQ ID NO: 191158 - RNA, 22 nt, Human
aagacagugacagucacaauug

SEQ ID NO: 191159 - RNA, 22 nt, Human
aagaggauuuuaguuugccaga

SEQ ID NO: 191160 - RNA, 22 nt, Human
aagagaggaaagggugugaggu

SEQ ID NO: 191161 - RNA, 22 nt, Human
aagaagguugaaugacuacuuu

SEQ ID NO: 191162 - RNA, 22 nt, Human
aagagaaagggaaaaugguaaa

SEQ ID NO: 191163 - RNA, 22 nt, Human
aagaaaagaaacauggguaugc

SEQ ID NO: 191164 - RNA, 20 nt, Human
aagacacuguccccacugga

SEQ ID NO: 191165 - RNA, 23 nt, Human
aagaaugcuucugaagagcugcc

SEQ ID NO: 191166 - RNA, 22 nt, Human
aagaaggaaggcaagagauggg

SEQ ID NO: 191167 - RNA, 22 nt, Human
aagaagcuacugucacuaucag

SEQ ID NO: 191168 - RNA, 22 nt, Human
aagaacuagauagugguguaaa

SEQ ID NO: 191169 - RNA, 22 nt, Human
aagaaggcggaccagaagggag

SEQ ID NO: 191170 - RNA, 22 nt, Human
aaccugaggguagacaaguuca

SEQ ID NO: 191171 - RNA, 22 nt, Human
aaccuggaggaccuuaugcuaa

SEQ ID NO: 191172 - RNA, 22 nt, Human
aaccuggguguacauuaugguc

SEQ ID NO: 191173 - RNA, 22 nt, Human
aaccucuuuaaaagggauauug

SEQ ID NO: 191174 - RNA, 22 nt, Human
aaccagaagucaucagagcuga

SEQ ID NO: 191175 - RNA, 22 nt, Human
aaccaggcgagagagcggucag

SEQ ID NO: 191176 - RNA, 22 nt, Human
aacauuguuuaaguuaaauugu

SEQ ID NO: 191177 - RNA, 20 nt, Human
aaccuauuguaauauucuaa

SEQ ID NO: 191178 - RNA, 22 nt, Human
aaccauauugauuauguuuuau

SEQ ID NO: 191179 - RNA, 22 nt, Human
aacaucugagagcccuugugca

SEQ ID NO: 191180 - RNA, 22 nt, Human
aaccguguucgggaacacuugu

SEQ ID NO: 191181 - RNA, 22 nt, Human
aacccguagaucaguucuaggu

SEQ ID NO: 191182 - RNA, 22 nt, Human
aacaucaaaggaagaaugauau

SEQ ID NO: 191183 - RNA, 22 nt, Human
aacaguguaggagcugguuuau

SEQ ID NO: 191184 - RNA, 22 nt, Human
aacaguuaagaggaggcagaga

SEQ ID NO: 191185 - RNA, 22 nt, Human
aaccaaucaaauuggaauugaa

SEQ ID NO: 191186 - RNA, 22 nt, Human
aaccucgggcugcacuuggcac

SEQ ID NO: 191187 - RNA, 22 nt, Human
aacccuaguugauagcuugggu

SEQ ID NO: 191188 - RNA, 22 nt, Human
aaccggauugauccuucuuuga

SEQ ID NO: 191189 - RNA, 22 nt, Human
aacgcaacaacuggagcuguag

SEQ ID NO: 191190 - RNA, 22 nt, Human
aacgccgggacucgcagggagc

SEQ ID NO: 191191 - RNA, 22 nt, Human
aacgauuugaguuaguuuuuag

SEQ ID NO: 191192 - RNA, 22 nt, Human
aacgagcugggggggccggggg

SEQ ID NO: 191193 - RNA, 22 nt, Human
aacccugaacuuaguucuagga

SEQ ID NO: 191194 - RNA, 22 nt, Human
aaccaguacuucucuauucagu

SEQ ID NO: 191195 - RNA, 22 nt, Human
aacgggcacuuuauuuaaaaaa

SEQ ID NO: 191196 - RNA, 22 nt, Human
aacgucugagaccccuccucuc

SEQ ID NO: 191197 - RNA, 22 nt, Human
aaccugagggcaggaccccaua

SEQ ID NO: 191198 - RNA, 22 nt, Human
aaccucuuugugaaugucauga

SEQ ID NO: 191199 - RNA, 22 nt, Human
aacgaugauaaauuguucucug

SEQ ID NO: 191200 - RNA, 22 nt, Human
aaccuuucucccugcacacugg

SEQ ID NO: 191201 - RNA, 22 nt, Human
aaagaggacgugcuauuuuuua

SEQ ID NO: 191202 - RNA, 20 nt, Human
aaagauacuuuuuguaaugg

SEQ ID NO: 191203 - RNA, 22 nt, Human
aaaugcuuuaauugaguucaug

SEQ ID NO: 191204 - RNA, 22 nt, Human
aaagaucaguuaacgccaucaa

SEQ ID NO: 191205 - RNA, 22 nt, Human
aaaugggagucacacagguuua

SEQ ID NO: 191206 - RNA, 22 nt, Human
aaauguaaacuguauuuauaaa

SEQ ID NO: 191207 - RNA, 22 nt, Human
aaaugguguucuuuagaugaaa

SEQ ID NO: 191208 - RNA, 22 nt, Human
aaauguguagaggggagagccg

SEQ ID NO: 191209 - RNA, 22 nt, Human
aaauucagauggcuuucuuuuc

SEQ ID NO: 191210 - RNA, 22 nt, Human
aaauggaaguuuguucucagcc

SEQ ID NO: 191211 - RNA, 22 nt, Human
aaauguuucauucuauuuuuag

SEQ ID NO: 191212 - RNA, 22 nt, Human
aaauuaaaguuuuauuuagagc

SEQ ID NO: 191213 - RNA, 22 nt, Human
aacagaaaucauuuagggcucu

SEQ ID NO: 191214 - RNA, 22 nt, Human
aacaguacaucaugaggucauc

SEQ ID NO: 191215 - RNA, 22 nt, Human
aacagguucaucuuggaagcag

SEQ ID NO: 191216 - RNA, 22 nt, Human
aacaguaugugagauuuacaca

SEQ ID NO: 191217 - RNA, 22 nt, Human
aacacuaaaggucaguuagaag

SEQ ID NO: 191218 - RNA, 22 nt, Human
aacacuguaucagucuucaaua

SEQ ID NO: 191219 - RNA, 22 nt, Human
aacagaauaucaaaagauuaug

SEQ ID NO: 191220 - RNA, 20 nt, Human
aacagcucucgacuuaucuu

SEQ ID NO: 191221 - RNA, 22 nt, Human
aacacugaaaugucuuaagauu

SEQ ID NO: 191222 - RNA, 22 nt, Human
aaauugucuuuaaucaggucau

SEQ ID NO: 191223 - RNA, 22 nt, Human
aaauugcauuuuaaagguagau

SEQ ID NO: 191224 - RNA, 20 nt, Human
aaauugaacaagccaggcug

SEQ ID NO: 191225 - RNA, 22 nt, Human
aacacguuuauccuaagaacuc

SEQ ID NO: 191226 - RNA, 22 nt, Human
aacacaucagcacacuaacgga

SEQ ID NO: 191227 - RNA, 22 nt, Human
aaauucggggaguuuugaggau

SEQ ID NO: 191228 - RNA, 21 nt, Human
aaauuucauauggccaaccua

SEQ ID NO: 191229 - RNA, 22 nt, Human
aaauuuuguugaaaaauauuuu

SEQ ID NO: 191230 - RNA, 22 nt, Human
agucggauuucccagguuauug

SEQ ID NO: 191231 - RNA, 22 nt, Human
agucggggagcgugaccagaga

SEQ ID NO: 191232 - RNA, 22 nt, Human
agucugugguccucuguaucuc

SEQ ID NO: 191233 - RNA, 22 nt, Human
agucuagcuguguuuugagcug

SEQ ID NO: 191234 - RNA, 22 nt, Human
agucuauacuucccaguugaca

SEQ ID NO: 191235 - RNA, 21 nt, Human
agugaagagugggcuugauca

SEQ ID NO: 191236 - RNA, 18 nt, Human
agucauguuuuagucacu

SEQ ID NO: 191237 - RNA, 22 nt, Human
aguccagggcuuagucagcggg

SEQ ID NO: 191238 - RNA, 22 nt, Human
agucggguugcagacacauccu

SEQ ID NO: 191239 - RNA, 22 nt, Human
agucauuugucauuuuuuugag

SEQ ID NO: 191240 - RNA, 22 nt, Human
agucauuugaggcaugauuaug

SEQ ID NO: 191241 - RNA, 22 nt, Human
agucauuguguucaguaaaauc

SEQ ID NO: 191242 - RNA, 22 nt, Human
agucaggacagauuuucugggg

SEQ ID NO: 191243 - RNA, 22 nt, Human
agucaguaucuucugggcggua

SEQ ID NO: 191244 - RNA, 22 nt, Human
agucaguaugacuuauaguucu

SEQ ID NO: 191245 - RNA, 22 nt, Human
agucaguguagaaagcccaggc

SEQ ID NO: 191246 - RNA, 22 nt, Human
agucacuguucugucaugucaa

SEQ ID NO: 191247 - RNA, 22 nt, Human
agucagaaggugucagaucuug

SEQ ID NO: 191248 - RNA, 22 nt, Human
agucaacauuugagaugcaaug

SEQ ID NO: 191249 - RNA, 22 nt, Human
agucaggggaucuagacuugaa

SEQ ID NO: 191250 - RNA, 22 nt, Human
agucagcuugucucuaggguug

SEQ ID NO: 191251 - RNA, 22 nt, Human
agucacuguuuaaucuagcuaa

SEQ ID NO: 191252 - RNA, 22 nt, Human
agucaccuacagcucaugcuuc

SEQ ID NO: 191253 - RNA, 21 nt, Human
agucaagcugccugcuuggca

SEQ ID NO: 191254 - RNA, 22 nt, Human
agucaagguggaccagaaaaau

SEQ ID NO: 191255 - RNA, 22 nt, Human
agucaaaaaaccuagaaacacc

SEQ ID NO: 191256 - RNA, 22 nt, Human
aguauuuaguauucuauauuag

SEQ ID NO: 191257 - RNA, 22 nt, Human
aguauuuuaaaauacauuaucc

SEQ ID NO: 191258 - RNA, 19 nt, Human
aguauuggcagguccugua

SEQ ID NO: 191259 - RNA, 22 nt, Human
aguauuggauauaaucuaggaa

SEQ ID NO: 191260 - RNA, 22 nt, Human
aguauugguaaguguagcaaau

SEQ ID NO: 191261 - RNA, 22 nt, Human
aguauuuucuuuaguuuguuag

SEQ ID NO: 191262 - RNA, 22 nt, Human
aguauggaauuuuuaaugacag

SEQ ID NO: 191263 - RNA, 22 nt, Human
aguaugcuggcaccuuugagug

SEQ ID NO: 191264 - RNA, 22 nt, Human
aguauccauccugcuguuucua

SEQ ID NO: 191265 - RNA, 22 nt, Human
aguaucugccagaaucucaguu

SEQ ID NO: 191266 - RNA, 22 nt, Human
aguauucaguuagugagcuaag

SEQ ID NO: 191267 - RNA, 22 nt, Human
aguaucgcuuuguaucaugagg

SEQ ID NO: 191268 - RNA, 22 nt, Human
aguaagaaagaaugauaggccu

SEQ ID NO: 191269 - RNA, 22 nt, Human
aguaacuuaagcaauuguguau

SEQ ID NO: 191270 - RNA, 22 nt, Human
aguaauaaacaacucauuuugg

SEQ ID NO: 191271 - RNA, 22 nt, Human
agguuuuacuuuuuuuggaggu

SEQ ID NO: 191272 - RNA, 22 nt, Human
aguaacagguguacagacuauc

SEQ ID NO: 191273 - RNA, 22 nt, Human
aguauaagugaugcuaucuucu

SEQ ID NO: 191274 - RNA, 22 nt, Human
aguaauuucuuacggagaccuu

SEQ ID NO: 191275 - RNA, 22 nt, Human
aguauagacaucaaacugaaga

SEQ ID NO: 191276 - RNA, 22 nt, Human
aggugcagcugguggagucugg

SEQ ID NO: 191277 - RNA, 22 nt, Human
aggugcuugcauacugcuugac

SEQ ID NO: 191278 - RNA, 22 nt, Human
aggucuuuaguggcagagucua

SEQ ID NO: 191279 - RNA, 22 nt, Human
agguggucuuguggaugccgca

SEQ ID NO: 191280 - RNA, 22 nt, Human
aggugggucgcaggcaucagug

SEQ ID NO: 191281 - RNA, 22 nt, Human
agguggggacuccaccgaugcu

SEQ ID NO: 191282 - RNA, 22 nt, Human
aggugguauuuaaaauuauuug

SEQ ID NO: 191283 - RNA, 22 nt, Human
agguuuuagagagccaggaugu

SEQ ID NO: 191284 - RNA, 19 nt, Human
aguaaagugguggcauuuu

SEQ ID NO: 191285 - RNA, 22 nt, Human
agguuaaacuuccugcagggcu

SEQ ID NO: 191286 - RNA, 22 nt, Human
aggugugcacccggucgcuucc

SEQ ID NO: 191287 - RNA, 22 nt, Human
agguguaauuacucuugcaguu

SEQ ID NO: 191288 - RNA, 18 nt, Human
agguuguguaaaaagaag

SEQ ID NO: 191289 - RNA, 22 nt, Human
agguuaugcacugcacaacccu

SEQ ID NO: 191290 - RNA, 22 nt, Human
agguuagcuguaugucuguaaa

SEQ ID NO: 191291 - RNA, 20 nt, Human
aggccgcccgcugccgcuuc

SEQ ID NO: 191292 - RNA, 22 nt, Human
aggcccagcaccagcggucuuc

SEQ ID NO: 191293 - RNA, 22 nt, Human
aggaggcucucagguccucccc

SEQ ID NO: 191294 - RNA, 22 nt, Human
aggaggcguuugcuaaacgggc

SEQ ID NO: 191295 - RNA, 22 nt, Human
aggccagugcagcuggaacaga

SEQ ID NO: 191296 - RNA, 22 nt, Human
aggagggcggggcuaaaaggga

SEQ ID NO: 191297 - RNA, 22 nt, Human
aggagggucauguugaagugua

SEQ ID NO: 191298 - RNA, 19 nt, Human
aggagacuacuucuugcug

SEQ ID NO: 191299 - RNA, 22 nt, Human
aggauauguccuuuuuuucccc

SEQ ID NO: 191300 - RNA, 22 nt, Human
aggcgguuggcuuugucugggu

SEQ ID NO: 191301 - RNA, 22 nt, Human
aggcggguuuaggacaaugcuu

SEQ ID NO: 191302 - RNA, 22 nt, Human
aggcguggcuucugcuggguug

SEQ ID NO: 191303 - RNA, 22 nt, Human
aggcugaagcacacucaugcag

SEQ ID NO: 191304 - RNA, 23 nt, Human
aggcugcagaagaauagggucau

SEQ ID NO: 191305 - RNA, 22 nt, Human
aggcugccuaugaaggcagaag

SEQ ID NO: 191306 - RNA, 22 nt, Human
aggccugaggaccagauaaaug

SEQ ID NO: 191307 - RNA, 22 nt, Human
aggccgguggaggagguggagg

SEQ ID NO: 191308 - RNA, 22 nt, Human
aggccgcgguggcgaaggcguu

SEQ ID NO: 191309 - RNA, 22 nt, Human
aggcgagcgcggccggugcccc

SEQ ID NO: 191310 - RNA, 22 nt, Human
aggcgaagggaccagacgguag

SEQ ID NO: 191311 - RNA, 22 nt, Human
agggaggcccagcagacuggcg

SEQ ID NO: 191312 - RNA, 19 nt, Human
agggaggcaagagaaaugu

SEQ ID NO: 191313 - RNA, 22 nt, Human
agggaguuccgaucugugcacc

SEQ ID NO: 191314 - RNA, 22 nt, Human
agggaaauaggagaagaaagga

SEQ ID NO: 191315 - RNA, 22 nt, Human
aggcuucaaggacagcagccac

SEQ ID NO: 191316 - RNA, 22 nt, Human
aggcuuuugcucuggcuccucu

SEQ ID NO: 191317 - RNA, 22 nt, Human
aggcugucucagccugcuugca

SEQ ID NO: 191318 - RNA, 22 nt, Human
aggcuuaaaugcucauaucagu

SEQ ID NO: 191319 - RNA, 22 nt, Human
aggcuguagaucuagacaugua

SEQ ID NO: 191320 - RNA, 18 nt, Human
aggcuggggaucacaggg

SEQ ID NO: 191321 - RNA, 22 nt, Human
agggaagagaaacaaagauuca

SEQ ID NO: 191322 - RNA, 22 nt, Human
agggaaauuaaugugagcaaug

SEQ ID NO: 191323 - RNA, 22 nt, Human
aggccugcuccucuucucaucc

SEQ ID NO: 191324 - RNA, 22 nt, Human
aggccugcccuuggggagccuu

SEQ ID NO: 191325 - RNA, 22 nt, Human
aggccgcuggggcagcgcccga

SEQ ID NO: 191326 - RNA, 23 nt, Human
aggcugccacucagggugaggcu

SEQ ID NO: 191327 - RNA, 19 nt, Human
aggcugccucacccucccu

SEQ ID NO: 191328 - RNA, 22 nt, Human
aggcugggaaguguguccugag

SEQ ID NO: 191329 - RNA, 22 nt, Human
agggcggucccugagacucucc

SEQ ID NO: 191330 - RNA, 20 nt, Human
agggauuugguugguauugu

SEQ ID NO: 191331 - RNA, 22 nt, Human
agggcaguguggugggacugac

SEQ ID NO: 191332 - RNA, 22 nt, Human
agggaugugcagggcuugccau

SEQ ID NO: 191333 - RNA, 22 nt, Human
agggccagcagcuuggccaacc

SEQ ID NO: 191334 - RNA, 22 nt, Human
agggccggggagggcugugggg

SEQ ID NO: 191335 - RNA, 22 nt, Human
agggaagaggaccagagucucu

SEQ ID NO: 191336 - RNA, 22 nt, Human
agggagcagcuagagggggucc

SEQ ID NO: 191337 - RNA, 19 nt, Human
agggagagucccaagagaa

SEQ ID NO: 191338 - RNA, 22 nt, Human
agggaaguucuagggagucugg

SEQ ID NO: 191339 - RNA, 22 nt, Human
agggcguacuuucgccccuccu

SEQ ID NO: 191340 - RNA, 22 nt, Human
agggcgugguggugcuggagca

SEQ ID NO: 191341 - RNA, 22 nt, Human
aggggaagagugagguuuuggu

SEQ ID NO: 191342 - RNA, 22 nt, Human
agggggcaugaaauaaaggaaa

SEQ ID NO: 191343 - RNA, 20 nt, Human
aggggcuguaguuagaugac

SEQ ID NO: 191344 - RNA, 22 nt, Human
aggggcugagaguuugaugugg

SEQ ID NO: 191345 - RNA, 22 nt, Human
aggggagaguuaaugugaaugu

SEQ ID NO: 191346 - RNA, 21 nt, Human
agguagauagccccaggaagg

SEQ ID NO: 191347 - RNA, 22 nt, Human
agguaagaagugagcaaguuua

SEQ ID NO: 191348 - RNA, 22 nt, Human
agguaguagagaacucugcucu

SEQ ID NO: 191349 - RNA, 22 nt, Human
agguaguacuuuuuagagugca

SEQ ID NO: 191350 - RNA, 22 nt, Human
aggguuacuuauuuuggauagu

SEQ ID NO: 191351 - RNA, 22 nt, Human
aggguggaggacaggccaguga

SEQ ID NO: 191352 - RNA, 22 nt, Human
aggguuaggguggcauggggaa

SEQ ID NO: 191353 - RNA, 22 nt, Human
aggguggcuggaguggucuggu

SEQ ID NO: 191354 - RNA, 22 nt, Human
aggggcaaacuuguucuagggu

SEQ ID NO: 191355 - RNA, 22 nt, Human
agggggccucucccgcggcgcc

SEQ ID NO: 191356 - RNA, 22 nt, Human
agggguacuagaggauugagau

SEQ ID NO: 191357 - RNA, 22 nt, Human
agguaugucccccgagugcagc

SEQ ID NO: 191358 - RNA, 22 nt, Human
agguagaaggaccagaauuuau

SEQ ID NO: 191359 - RNA, 22 nt, Human
aggguuucucuccaguguggac

SEQ ID NO: 191360 - RNA, 22 nt, Human
aggguuaugcuccuucaucuug

SEQ ID NO: 191361 - RNA, 22 nt, Human
aggguuuucauauauuauuagu

SEQ ID NO: 191362 - RNA, 22 nt, Human
aggucguauaguuaccuccuug

SEQ ID NO: 191363 - RNA, 22 nt, Human
agguauuuuaugucgugugaug

SEQ ID NO: 191364 - RNA, 20 nt, Human
agcuggcccccgguggccug

SEQ ID NO: 191365 - RNA, 22 nt, Human
agcugugaccaguuacgaaauu

SEQ ID NO: 191366 - RNA, 22 nt, Human
agcugugaccuucaagagcuac

SEQ ID NO: 191367 - RNA, 22 nt, Human
agcuucccaggagaucuccgcc

SEQ ID NO: 191368 - RNA, 22 nt, Human
agcuguugaccuucccuuucag

SEQ ID NO: 191369 - RNA, 22 nt, Human
aggaaauaguuuagucccaaaa

SEQ ID NO: 191370 - RNA, 22 nt, Human
aggaacaguuucaaagagugaa

SEQ ID NO: 191371 - RNA, 22 nt, Human
agcuggauuaaucacagugacu

SEQ ID NO: 191372 - RNA, 22 nt, Human
agcuggaaucucggcaaagcgu

SEQ ID NO: 191373 - RNA, 22 nt, Human
aggaaauaagggcacuucagau

SEQ ID NO: 191374 - RNA, 22 nt, Human
aggaaaguugagcugucuguag

SEQ ID NO: 191375 - RNA, 22 nt, Human
agcuugaaccuaaaacaauaau

SEQ ID NO: 191376 - RNA, 22 nt, Human
agcuugcccuuguaccagccag

SEQ ID NO: 191377 - RNA, 22 nt, Human
agcuuggcaagcacuguuugag

SEQ ID NO: 191378 - RNA, 22 nt, Human
agcuuugcccaaugaguuaugu

SEQ ID NO: 191379 - RNA, 22 nt, Human
aggaaaaugaaggaagugggaa

SEQ ID NO: 191380 - RNA, 22 nt, Human
aggaaaaagaagaaaagaauca

SEQ ID NO: 191381 - RNA, 22 nt, Human
agcuuugcugcuggagaagggu

SEQ ID NO: 191382 - RNA, 22 nt, Human
agcuuugucccaagugcucugg

SEQ ID NO: 191383 - RNA, 22 nt, Human
aggaagaagggacagaauuuug

SEQ ID NO: 191384 - RNA, 19 nt, Human
aggaaggggauaaguaaca

SEQ ID NO: 191385 - RNA, 22 nt, Human
aggaagucucucaaaacuggaa

SEQ ID NO: 191386 - RNA, 22 nt, Human
aggaaaauggaccagaguuguu

SEQ ID NO: 191387 - RNA, 22 nt, Human
aggaaaguugcuuguagugcug

SEQ ID NO: 191388 - RNA, 20 nt, Human
aggaaggagaaucugagcaa

SEQ ID NO: 191389 - RNA, 20 nt, Human
aggaagauccuuucuuuuaa

SEQ ID NO: 191390 - RNA, 22 nt, Human
aggaagagcuggaccagaggac

SEQ ID NO: 191391 - RNA, 22 nt, Human
aggaagccuggaguccugccca

SEQ ID NO: 191392 - RNA, 22 nt, Human
aggacauuugcuuuuuuucuuu

SEQ ID NO: 191393 - RNA, 22 nt, Human
aggacagagggaccagagccca

SEQ ID NO: 191394 - RNA, 22 nt, Human
aggagacaguuuggacguguag

SEQ ID NO: 191395 - RNA, 22 nt, Human
aggagagaacaagaguauccug

SEQ ID NO: 191396 - RNA, 22 nt, Human
aggagaaagaccagccugccga

SEQ ID NO: 191397 - RNA, 23 nt, Human
aggaagucugacacuacagcguu

SEQ ID NO: 191398 - RNA, 22 nt, Human
aggacacuuccugaguggacaa

SEQ ID NO: 191399 - RNA, 22 nt, Human
aggauaaaugggucauuaggca

SEQ ID NO: 191400 - RNA, 22 nt, Human
aggauaaaggucauuauuccca

SEQ ID NO: 191401 - RNA, 22 nt, Human
aggacuggucucuuuucuccaa

SEQ ID NO: 191402 - RNA, 22 nt, Human
agcuuucuauauaugaguugcu

SEQ ID NO: 191403 - RNA, 22 nt, Human
agcugauugucuuuuuaaaagu

SEQ ID NO: 191404 - RNA, 22 nt, Human
agcugaugucucaccuguuaga

SEQ ID NO: 191405 - RNA, 22 nt, Human
agcugcuggcggauguuggacu

SEQ ID NO: 191406 - RNA, 22 nt, Human
agcugcugcaaguggugcuaac

SEQ ID NO: 191407 - RNA, 22 nt, Human
aggaaagacgcauuucuguagg

SEQ ID NO: 191408 - RNA, 22 nt, Human
agcugcuuuacuggucggcugg

SEQ ID NO: 191409 - RNA, 22 nt, Human
agcuguaacagguuaauaugga

SEQ ID NO: 191410 - RNA, 22 nt, Human
agcugugccuauucguggcaag

SEQ ID NO: 191411 - RNA, 22 nt, Human
agcuugauggauugcugaggca

SEQ ID NO: 191412 - RNA, 19 nt, Human
agcuuauuuacugcaggac

SEQ ID NO: 191413 - RNA, 22 nt, Human
agcuucuucugccuugucccug

SEQ ID NO: 191414 - RNA, 22 nt, Human
agcugaggccccgcagcagggu

SEQ ID NO: 191415 - RNA, 22 nt, Human
agcucugugcaggcagaggcau

SEQ ID NO: 191416 - RNA, 22 nt, Human
agcugacagugcauggagggac

SEQ ID NO: 191417 - RNA, 22 nt, Human
agcugcauucguaucauauugu

SEQ ID NO: 191418 - RNA, 19 nt, Human
agcugcugauugguggagg

SEQ ID NO: 191419 - RNA, 22 nt, Human
agcucuccuacucucuuucuag

SEQ ID NO: 191420 - RNA, 22 nt, Human
agcucggcuguccugugccccu

SEQ ID NO: 191421 - RNA, 22 nt, Human
agcucucaccauagugcuuaaa

SEQ ID NO: 191422 - RNA, 19 nt, Human
agcucaggcccaucguccc

SEQ ID NO: 191423 - RNA, 22 nt, Human
agcucagugugucuaugaggua

SEQ ID NO: 191424 - RNA, 19 nt, Human
agcuccucaccucucgcgg

SEQ ID NO: 191425 - RNA, 22 nt, Human
agcucugcuucuugggaagaug

SEQ ID NO: 191426 - RNA, 22 nt, Human
agcucuuccuccauucuggcca

SEQ ID NO: 191427 - RNA, 20 nt, Human
agcugaauaguuuugugaaa

SEQ ID NO: 191428 - RNA, 22 nt, Human
agcuccugcgcacggugcacac

SEQ ID NO: 191429 - RNA, 22 nt, Human
agcguacuugaggcuuggggcc

SEQ ID NO: 191430 - RNA, 22 nt, Human
agcucacucaaguaccuggggu

SEQ ID NO: 191431 - RNA, 22 nt, Human
agcgucaugugaccagcgcgcc

SEQ ID NO: 191432 - RNA, 22 nt, Human
agcuaaauauuuuuccugacac

SEQ ID NO: 191433 - RNA, 22 nt, Human
agcuaaaaugagguuuuuggau

SEQ ID NO: 191434 - RNA, 22 nt, Human
agcguucuguuccaugcuaaca

SEQ ID NO: 191435 - RNA, 22 nt, Human
agcuaauguauguugaaagcac

SEQ ID NO: 191436 - RNA, 22 nt, Human
agcggccucgcugccugcucag

SEQ ID NO: 191437 - RNA, 22 nt, Human
agcgggucaugucggccgccca

SEQ ID NO: 191438 - RNA, 22 nt, Human
agcgccgcugugauuggugagg

SEQ ID NO: 191439 - RNA, 22 nt, Human
agcgacuguaagagggccccgg

SEQ ID NO: 191440 - RNA, 22 nt, Human
agcgcgcggggcugcggcaggg

SEQ ID NO: 191441 - RNA, 22 nt, Human
agcgcggccuuacacccagggg

SEQ ID NO: 191442 - RNA, 19 nt, Human
agcggagguuguauauugu

SEQ ID NO: 191443 - RNA, 22 nt, Human
agcggcgcgucuccgagcugga

SEQ ID NO: 191444 - RNA, 22 nt, Human
agcggcaggacgucuucuucga

SEQ ID NO: 191445 - RNA, 22 nt, Human
agcggcaagguguauguggcag

SEQ ID NO: 191446 - RNA, 22 nt, Human
agcggugacauccuucugugcu

SEQ ID NO: 191447 - RNA, 22 nt, Human
agcguaugaauauuugaagaga

SEQ ID NO: 191448 - RNA, 22 nt, Human
agcggcucaggccccgugggcu

SEQ ID NO: 191449 - RNA, 22 nt, Human
agcgcccguugagucgcgcggu

SEQ ID NO: 191450 - RNA, 22 nt, Human
agcgcaguuaccgcgcggggcu

SEQ ID NO: 191451 - RNA, 22 nt, Human
agcgacuugacagacauguccu

SEQ ID NO: 191452 - RNA, 22 nt, Human
agccuuucugcgcacucuuccg

SEQ ID NO: 191453 - RNA, 22 nt, Human
agccuugcaugauuucauucau

SEQ ID NO: 191454 - RNA, 22 nt, Human
agccugugacucugugaaacca

SEQ ID NO: 191455 - RNA, 22 nt, Human
agccuguuacuguccugugcca

SEQ ID NO: 191456 - RNA, 22 nt, Human
agccgcgcagccucauuaagga

SEQ ID NO: 191457 - RNA, 22 nt, Human
agccgcgcuguuccugcugcug

SEQ ID NO: 191458 - RNA, 22 nt, Human
agcaugucuaacucuucagggu

SEQ ID NO: 191459 - RNA, 22 nt, Human
agcauugguggcauuugcagcu

SEQ ID NO: 191460 - RNA, 22 nt, Human
agcauuucuacugugucagaaa

SEQ ID NO: 191461 - RNA, 22 nt, Human
agcauucuguggucuucuaugg

SEQ ID NO: 191462 - RNA, 22 nt, Human
agcauucagacaucugauggau

SEQ ID NO: 191463 - RNA, 22 nt, Human
agccuggacagcuacggagaac

SEQ ID NO: 191464 - RNA, 22 nt, Human
agcccgggagggcugucuggga

SEQ ID NO: 191465 - RNA, 22 nt, Human
agccacagucuguagccagcuu

SEQ ID NO: 191466 - RNA, 22 nt, Human
agccacacuuagucacaaagau

SEQ ID NO: 191467 - RNA, 19 nt, Human
agcaguggagccaugccug

SEQ ID NO: 191468 - RNA, 18 nt, Human
agcagugcggaucauuuu

SEQ ID NO: 191469 - RNA, 22 nt, Human
agcaguugcuuuguauauuaaa

SEQ ID NO: 191470 - RNA, 21 nt, Human
agcaucugaggcaguuuccua

SEQ ID NO: 191471 - RNA, 21 nt, Human
agccagguuuccuuugaagag

SEQ ID NO: 191472 - RNA, 22 nt, Human
agccacggcaaugauaggcugc

SEQ ID NO: 191473 - RNA, 22 nt, Human
agccagauuuuuugagaggcga

SEQ ID NO: 191474 - RNA, 22 nt, Human
agcaguuuauccucauaaugga

SEQ ID NO: 191475 - RNA, 22 nt, Human
agcaguuagauccugguuagcg

SEQ ID NO: 191476 - RNA, 22 nt, Human
agcauucccuuugcagugucau

SEQ ID NO: 191477 - RNA, 22 nt, Human
agcagggugugggugugagugu

SEQ ID NO: 191478 - RNA, 22 nt, Human
agcauuugcuguucuagaaagu

SEQ ID NO: 191479 - RNA, 22 nt, Human
agcauuuuaaaacuaguuacca

SEQ ID NO: 191480 - RNA, 22 nt, Human
agcaggaggguuuuguagaguc

SEQ ID NO: 191481 - RNA, 22 nt, Human
agcauauaugcaugagugugca

SEQ ID NO: 191482 - RNA, 22 nt, Human
agcaucggacggagcaccugcu

SEQ ID NO: 191483 - RNA, 22 nt, Human
agcaggguggcaagucuuucug

SEQ ID NO: 191484 - RNA, 22 nt, Human
agauaggcuuagccaagcuuuc

SEQ ID NO: 191485 - RNA, 22 nt, Human
agauagccagauauaaauaguc

SEQ ID NO: 191486 - RNA, 22 nt, Human
agcagcaggugaccucgaugcc

SEQ ID NO: 191487 - RNA, 22 nt, Human
agcagccgccgccgccgcgcac

SEQ ID NO: 191488 - RNA, 22 nt, Human
agcacggugguuaagagagugg

SEQ ID NO: 191489 - RNA, 22 nt, Human
agcaggaggagagccuggcggu

SEQ ID NO: 191490 - RNA, 22 nt, Human
agcaggacuugcugagcccucc

SEQ ID NO: 191491 - RNA, 22 nt, Human
agcaggaaggcuagaagcagga

SEQ ID NO: 191492 - RNA, 22 nt, Human
agcagggagacagugcagcauu

SEQ ID NO: 191493 - RNA, 22 nt, Human
agcaggccuuucaccucugucc

SEQ ID NO: 191494 - RNA, 22 nt, Human
agcagguucaagggcaaagcug

SEQ ID NO: 191495 - RNA, 22 nt, Human
agcaggggcaggguuuugugcu

SEQ ID NO: 191496 - RNA, 22 nt, Human
agcagggagaccaucucuuccu

SEQ ID NO: 191497 - RNA, 21 nt, Human
agcagucugcggccggugcgg

SEQ ID NO: 191498 - RNA, 22 nt, Human
agcaggucagugguaaucaaaa

SEQ ID NO: 191499 - RNA, 19 nt, Human
agcagugaaaucuggugag

SEQ ID NO: 191500 - RNA, 22 nt, Human
agcaguucucugucuagcuaga

SEQ ID NO: 191501 - RNA, 22 nt, Human
accggucucaccaaacgcccca

SEQ ID NO: 191502 - RNA, 22 nt, Human
accccuauugcuugugauuaug

SEQ ID NO: 191503 - RNA, 22 nt, Human
accgucagguuagaaugagcac

SEQ ID NO: 191504 - RNA, 22 nt, Human
accgguucccaucuggagaguu

SEQ ID NO: 191505 - RNA, 22 nt, Human
acccuauuaacuacuacguugg

SEQ ID NO: 191506 - RNA, 22 nt, Human
acccggccuacucagugcccag

SEQ ID NO: 191507 - RNA, 22 nt, Human
acccgguuuucccagcaccucc

SEQ ID NO: 191508 - RNA, 22 nt, Human
acccugcacagagggcuuuaua

SEQ ID NO: 191509 - RNA, 22 nt, Human
acccuucugugaccugccuguc

SEQ ID NO: 191510 - RNA, 21 nt, Human
accgucaguacuaguauugac

SEQ ID NO: 191511 - RNA, 22 nt, Human
accgugcccauucauuuacaaa

SEQ ID NO: 191512 - RNA, 22 nt, Human
accccuuaaauuuguuguuuaa

SEQ ID NO: 191513 - RNA, 22 nt, Human
accuauuuauacaacugcacca

SEQ ID NO: 191514 - RNA, 22 nt, Human
accauuauagaggacauuaugu

SEQ ID NO: 191515 - RNA, 22 nt, Human
acccugacggugggcagcuuga

SEQ ID NO: 191516 - RNA, 22 nt, Human
accaguuuuuugaccaugggug

SEQ ID NO: 191517 - RNA, 22 nt, Human
accgauuucaaauggugcuaga

SEQ ID NO: 191518 - RNA, 23 nt, Human
accgccgcugccgccgcccccgc

SEQ ID NO: 191519 - RNA, 21 nt, Human
acccagaauggagccaagccu

SEQ ID NO: 191520 - RNA, 22 nt, Human
accgcuggcacuggggacgggg

SEQ ID NO: 191521 - RNA, 22 nt, Human
accgggcagcucugccccugcc

SEQ ID NO: 191522 - RNA, 22 nt, Human
accucccugaaaaagacagugc

SEQ ID NO: 191523 - RNA, 22 nt, Human
accuggcccugggucuccugac

SEQ ID NO: 191524 - RNA, 21 nt, Human
accugguuuacugaucccagg

SEQ ID NO: 191525 - RNA, 22 nt, Human
accugauuuuauggauuuugag

SEQ ID NO: 191526 - RNA, 22 nt, Human
accugcucucccucucgcaguc

SEQ ID NO: 191527 - RNA, 22 nt, Human
accugagauuuuuacucaguaa

SEQ ID NO: 191528 - RNA, 22 nt, Human
accugaucugagaaguggaggg

SEQ ID NO: 191529 - RNA, 22 nt, Human
accucuuuuugaauauagcauu

SEQ ID NO: 191530 - RNA, 22 nt, Human
accucuuucuauggauuuuuug

SEQ ID NO: 191531 - RNA, 22 nt, Human
accucccgacggcgcgggagaa

SEQ ID NO: 191532 - RNA, 23 nt, Human
accuccuuguugaguggggguga

SEQ ID NO: 191533 - RNA, 22 nt, Human
acccuuucgagauuucugccuu

SEQ ID NO: 191534 - RNA, 22 nt, Human
accucaguucaagggaguuuca

SEQ ID NO: 191535 - RNA, 22 nt, Human
accucauucugcauagaacuuu

SEQ ID NO: 191536 - RNA, 22 nt, Human
accgagcaggguguuugcgcac

SEQ ID NO: 191537 - RNA, 22 nt, Human
accgauguggaaaauuucauuu

SEQ ID NO: 191538 - RNA, 22 nt, Human
acgggugcuuguucccgcugcu

SEQ ID NO: 191539 - RNA, 22 nt, Human
acgggugugauuccuuuugugu

SEQ ID NO: 191540 - RNA, 22 nt, Human
acuaaagcagcucagacgagaa

SEQ ID NO: 191541 - RNA, 22 nt, Human
acgugguaaaagaucuguaaaa

SEQ ID NO: 191542 - RNA, 22 nt, Human
acguuuuagccauguaguuucu

SEQ ID NO: 191543 - RNA, 22 nt, Human
acuaauuguuuaaggauaggaa

SEQ ID NO: 191544 - RNA, 22 nt, Human
acuaaacauaucacugcuuuac

SEQ ID NO: 191545 - RNA, 22 nt, Human
acgcggagccagaggguguggg

SEQ ID NO: 191546 - RNA, 23 nt, Human
acgggaggcggggcagggcugag

SEQ ID NO: 191547 - RNA, 22 nt, Human
acggcuugaacgcgccuguggg

SEQ ID NO: 191548 - RNA, 22 nt, Human
acggcggguuccgggccagccc

SEQ ID NO: 191549 - RNA, 22 nt, Human
acggccgaugacuccagcaugg

SEQ ID NO: 191550 - RNA, 22 nt, Human
accuggaccugccaccuaugag

SEQ ID NO: 191551 - RNA, 22 nt, Human
acgauuugguucagugaagaca

SEQ ID NO: 191552 - RNA, 22 nt, Human
accugcagguguuuccacacuu

SEQ ID NO: 191553 - RNA, 22 nt, Human
accuggauauuuucaguugcau

SEQ ID NO: 191554 - RNA, 21 nt, Human
accuggugaugaaugggaggc

SEQ ID NO: 191555 - RNA, 22 nt, Human
accuguagcccaaucauggcag

SEQ ID NO: 191556 - RNA, 22 nt, Human
accuuaaacagauggcggcugg

SEQ ID NO: 191557 - RNA, 22 nt, Human
accuuaagugauuaugacauau

SEQ ID NO: 191558 - RNA, 22 nt, Human
accuucugaccucucggacuuc

SEQ ID NO: 191559 - RNA, 20 nt, Human
accuucuuugguagacggaa

SEQ ID NO: 191560 - RNA, 19 nt, Human
accuguucaaccucgugcu

SEQ ID NO: 191561 - RNA, 22 nt, Human
acgauaacaauaguagcaugua

SEQ ID NO: 191562 - RNA, 22 nt, Human
acgaagggggcauggugagagu

SEQ ID NO: 191563 - RNA, 22 nt, Human
acgaaugacaugugauuugaaa

SEQ ID NO: 191564 - RNA, 20 nt, Human
acgaacauauugcaggguuu

SEQ ID NO: 191565 - RNA, 22 nt, Human
acgaaauaaaauuaaagcccua

SEQ ID NO: 191566 - RNA, 22 nt, Human
accuuuuauuuucaugcuugcu

SEQ ID NO: 191567 - RNA, 22 nt, Human
accuuuggaggacuagggucau

SEQ ID NO: 191568 - RNA, 22 nt, Human
acaucacuugguuaaugugguc

SEQ ID NO: 191569 - RNA, 22 nt, Human
acauauaugugcauacaacuau

SEQ ID NO: 191570 - RNA, 20 nt, Human
acauggagaagcgagguagg

SEQ ID NO: 191571 - RNA, 22 nt, Human
acauggggaaaaaggccugcuc

SEQ ID NO: 191572 - RNA, 22 nt, Human
acauaaaccccccuuccccagg

SEQ ID NO: 191573 - RNA, 19 nt, Human
acaguucuguggccuguuc

SEQ ID NO: 191574 - RNA, 22 nt, Human
acaguuuucugagaaucacagg

SEQ ID NO: 191575 - RNA, 22 nt, Human
acaguuuuccuugguauagaac

SEQ ID NO: 191576 - RNA, 22 nt, Human
acauggaauuucagaagagcau

SEQ ID NO: 191577 - RNA, 22 nt, Human
acauaaauagcacugugaauuu

SEQ ID NO: 191578 - RNA, 22 nt, Human
acauggaaacacgcagccccaa

SEQ ID NO: 191579 - RNA, 22 nt, Human
aauucugaggccauuuauuucc

SEQ ID NO: 191580 - RNA, 22 nt, Human
aauucgcugcauuccaucuagg

SEQ ID NO: 191581 - RNA, 22 nt, Human
aauugcauucauuuguauauuu

SEQ ID NO: 191582 - RNA, 22 nt, Human
aauucuuuguuccucugccaag

SEQ ID NO: 191583 - RNA, 22 nt, Human
aauugauauuagauuugucuca

SEQ ID NO: 191584 - RNA, 22 nt, Human
acaguguuacuugauaguguau

SEQ ID NO: 191585 - RNA, 22 nt, Human
acauuuccaaagaugccaguca

SEQ ID NO: 191586 - RNA, 22 nt, Human
acauuucuccuacuuguuauuu

SEQ ID NO: 191587 - RNA, 22 nt, Human
acauggaccucagauccuggcc

SEQ ID NO: 191588 - RNA, 22 nt, Human
acauuuuaaaaacaguaccugg

SEQ ID NO: 191589 - RNA, 22 nt, Human
acauuuuaccaucuguggauga

SEQ ID NO: 191590 - RNA, 22 nt, Human
acaugggggugggacggcagag

SEQ ID NO: 191591 - RNA, 22 nt, Human
acauguggaggaggcgagggua

SEQ ID NO: 191592 - RNA, 22 nt, Human
acaucccccuacuuguguccug

SEQ ID NO: 191593 - RNA, 22 nt, Human
acauccaguaucagaagcauca

SEQ ID NO: 191594 - RNA, 21 nt, Human
acauccaggguccucacugcc

SEQ ID NO: 191595 - RNA, 22 nt, Human
acauugguauuaguguggcuga

SEQ ID NO: 191596 - RNA, 22 nt, Human
acauuccugaagguaaugagaa

SEQ ID NO: 191597 - RNA, 22 nt, Human
acauuauuguguagugugggca

SEQ ID NO: 191598 - RNA, 22 nt, Human
acaucuucuauggagguucgga

SEQ ID NO: 191599 - RNA, 22 nt, Human
acauuuugggagaaaguuguua

SEQ ID NO: 191600 - RNA, 22 nt, Human
accagccacccugccgcguccg

SEQ ID NO: 191601 - RNA, 22 nt, Human
accaggcagcaccaaagccggu

SEQ ID NO: 191602 - RNA, 17 nt, Human
accaggggcagcacugc

SEQ ID NO: 191603 - RNA, 22 nt, Human
accaccacauaguaggcacuua

SEQ ID NO: 191604 - RNA, 22 nt, Human
accaggaguuuugaccaggggc

SEQ ID NO: 191605 - RNA, 22 nt, Human
accagcgcguuuucaguuucau

SEQ ID NO: 191606 - RNA, 22 nt, Human
acauuguuuuugugacuucuau

SEQ ID NO: 191607 - RNA, 19 nt, Human
accaaacaguggacggagc

SEQ ID NO: 191608 - RNA, 22 nt, Human
acaugguguggcacuaggggcu

SEQ ID NO: 191609 - RNA, 22 nt, Human
acauggguuaaagaagauggaa

SEQ ID NO: 191610 - RNA, 22 nt, Human
acaugucagaaaauucagaggg

SEQ ID NO: 191611 - RNA, 22 nt, Human
acauugcagcuccuaccuuguc

SEQ ID NO: 191612 - RNA, 22 nt, Human
accaagaguccaagugagguug

SEQ ID NO: 191613 - RNA, 22 nt, Human
accaauguucaaccuugacugc

SEQ ID NO: 191614 - RNA, 22 nt, Human
accaacacgucugaguauuucc

SEQ ID NO: 191615 - RNA, 22 nt, Human
acauuuuuggguugaugucuga

SEQ ID NO: 191616 - RNA, 22 nt, Human
acauuuuguuuauggaaaagau

SEQ ID NO: 191617 - RNA, 22 nt, Human
accaauaaaagcaauucacagu

SEQ ID NO: 191618 - RNA, 22 nt, Human
accaauguuuuauagaaaugcc

SEQ ID NO: 191619 - RNA, 22 nt, Human
accauaugaagaucacacuauc

SEQ ID NO: 191620 - RNA, 22 nt, Human
accauaugaaguugcccauauu

SEQ ID NO: 191621 - RNA, 22 nt, Human
accaguuaaagaauaugaggcc

SEQ ID NO: 191622 - RNA, 22 nt, Human
accaugacugucacauuauuau

SEQ ID NO: 191623 - RNA, 20 nt, Human
acccaaagcucagcgugucc

SEQ ID NO: 191624 - RNA, 22 nt, Human
accagccacacacauuagucac

SEQ ID NO: 191625 - RNA, 22 nt, Human
accacguccugguggcuguugg

SEQ ID NO: 191626 - RNA, 22 nt, Human
accaccacugacaccagcucgg

SEQ ID NO: 191627 - RNA, 22 nt, Human
accagguugagacuucggcuuu

SEQ ID NO: 191628 - RNA, 19 nt, Human
acccaugcucuguggacuu

SEQ ID NO: 191629 - RNA, 18 nt, Human
acccauuauauuuguagc

SEQ ID NO: 191630 - RNA, 22 nt, Human
acccaucauuagucuuucagga

SEQ ID NO: 191631 - RNA, 22 nt, Human
accccagcucugagccacacca

SEQ ID NO: 191632 - RNA, 21 nt, Human
agaggacuuuuuugauguuuu

SEQ ID NO: 191633 - RNA, 22 nt, Human
agagcagauggagcuggaagag

SEQ ID NO: 191634 - RNA, 22 nt, Human
agagcagcaaucuuugaaauua

SEQ ID NO: 191635 - RNA, 22 nt, Human
agaggaauuauugaguuagauu

SEQ ID NO: 191636 - RNA, 22 nt, Human
agagauugagcucagaagaccu

SEQ ID NO: 191637 - RNA, 22 nt, Human
agagauuagagaagaugauaaa

SEQ ID NO: 191638 - RNA, 23 nt, Human
agaggccaacuucuugccccucc

SEQ ID NO: 191639 - RNA, 22 nt, Human
agaggcaugaacucccguagcc

SEQ ID NO: 191640 - RNA, 22 nt, Human
agagggagccugcacagcuuuc

SEQ ID NO: 191641 - RNA, 22 nt, Human
agagggagagaccuccgugccu

SEQ ID NO: 191642 - RNA, 22 nt, Human
agaggugcuuaugcucaugguu

SEQ ID NO: 191643 - RNA, 22 nt, Human
agaguaauguggaguuugugcu

SEQ ID NO: 191644 - RNA, 22 nt, Human
agaggggaaggaugugauguga

SEQ ID NO: 191645 - RNA, 22 nt, Human
agagggagcuccaagaucaagg

SEQ ID NO: 191646 - RNA, 23 nt, Human
agauaaggaagcauuugagccag

SEQ ID NO: 191647 - RNA, 22 nt, Human
agaguggcaccuuaccugagac

SEQ ID NO: 191648 - RNA, 22 nt, Human
agagcagcuuuucggaaccacu

SEQ ID NO: 191649 - RNA, 22 nt, Human
agagccggagucuucuuguuug

SEQ ID NO: 191650 - RNA, 22 nt, Human
agagauggugaugaggaaaaau

SEQ ID NO: 191651 - RNA, 22 nt, Human
agagaauuugggaauauaaauc

SEQ ID NO: 191652 - RNA, 22 nt, Human
agagaagaauccccugguggag

SEQ ID NO: 191653 - RNA, 22 nt, Human
agagacaagggaccucuggaga

SEQ ID NO: 191654 - RNA, 21 nt, Human
agagaccuaagcugagauucc

SEQ ID NO: 191655 - RNA, 22 nt, Human
agagaacaggcagcuggugccg

SEQ ID NO: 191656 - RNA, 22 nt, Human
agagcaauggugcuuuaauucu

SEQ ID NO: 191657 - RNA, 22 nt, Human
agagauuuacaacuugggcuuu

SEQ ID NO: 191658 - RNA, 22 nt, Human
agagaguacuuucaucagggaa

SEQ ID NO: 191659 - RNA, 22 nt, Human
agagaacauuuucaggguuuca

SEQ ID NO: 191660 - RNA, 20 nt, Human
agagaacaguuuggucacag

SEQ ID NO: 191661 - RNA, 22 nt, Human
agacuauuuugugauaacuaau

SEQ ID NO: 191662 - RNA, 19 nt, Human
agacugaagggcccgaguc

SEQ ID NO: 191663 - RNA, 22 nt, Human
agagacaggguuuugucguguu

SEQ ID NO: 191664 - RNA, 22 nt, Human
agagacauagcacaguuuuucg

SEQ ID NO: 191665 - RNA, 22 nt, Human
agagacugauggaucaccaaau

SEQ ID NO: 191666 - RNA, 22 nt, Human
agacuguuuucccaucucuugg

SEQ ID NO: 191667 - RNA, 22 nt, Human
agaccccuguggugaugguggu

SEQ ID NO: 191668 - RNA, 22 nt, Human
agacccugauucugcuggcggu

SEQ ID NO: 191669 - RNA, 22 nt, Human
agacccuugcagucugguuguc

SEQ ID NO: 191670 - RNA, 22 nt, Human
agaccccuggggaggauuauag

SEQ ID NO: 191671 - RNA, 22 nt, Human
agagaaauguacuagucuaacu

SEQ ID NO: 191672 - RNA, 22 nt, Human
agacuuuggcagggccaguggu

SEQ ID NO: 191673 - RNA, 22 nt, Human
agacuuugaaugaugacagcgu

SEQ ID NO: 191674 - RNA, 22 nt, Human
agacgggacagacuuuugagug

SEQ ID NO: 191675 - RNA, 22 nt, Human
agacagcggugcaauaaauggu

SEQ ID NO: 191676 - RNA, 20 nt, Human
agacauugaggagagagcau

SEQ ID NO: 191677 - RNA, 21 nt, Human
agacugaugggaagacucugu

SEQ ID NO: 191678 - RNA, 22 nt, Human
agaccauguuauccuucauuuu

SEQ ID NO: 191679 - RNA, 22 nt, Human
agacuguuccgucagacucagu

SEQ ID NO: 191680 - RNA, 22 nt, Human
agacagaacauaauuaguacug

SEQ ID NO: 191681 - RNA, 22 nt, Human
agaauguaagaaugcaaagauu

SEQ ID NO: 191682 - RNA, 22 nt, Human
agacauauuggcuugcuuuaau

SEQ ID NO: 191683 - RNA, 22 nt, Human
agaaucaggaagacagccuggc

SEQ ID NO: 191684 - RNA, 22 nt, Human
agaaucagagcagaaucuucau

SEQ ID NO: 191685 - RNA, 22 nt, Human
agaacaggaggaagccagcucc

SEQ ID NO: 191686 - RNA, 20 nt, Human
agaaggagagaugaggcaaa

SEQ ID NO: 191687 - RNA, 22 nt, Human
agaacaagaaacccgaaaagug

SEQ ID NO: 191688 - RNA, 22 nt, Human
agaaauuguaauaaaucugguc

SEQ ID NO: 191689 - RNA, 22 nt, Human
acuuuuccuggguagcuccugg

SEQ ID NO: 191690 - RNA, 22 nt, Human
agaaaagagacaauguuuuugg

SEQ ID NO: 191691 - RNA, 22 nt, Human
acuuugucuugaucaaaggugu

SEQ ID NO: 191692 - RNA, 22 nt, Human
acuuuggugcgaagucacuuua

SEQ ID NO: 191693 - RNA, 22 nt, Human
acuuuuaaggggccuugauuua

SEQ ID NO: 191694 - RNA, 22 nt, Human
acuuugccagcucccugcuggc

SEQ ID NO: 191695 - RNA, 22 nt, Human
acuuugugaauagaacuggaug

SEQ ID NO: 191696 - RNA, 21 nt, Human
agaagcggucgaaucgcagac

SEQ ID NO: 191697 - RNA, 22 nt, Human
agaagcauaagggcuuugccag

SEQ ID NO: 191698 - RNA, 22 nt, Human
agaagcaauuggaaaguacagg

SEQ ID NO: 191699 - RNA, 22 nt, Human
agaaauggggugaagcaaaugg

SEQ ID NO: 191700 - RNA, 22 nt, Human
agaagcaaagcaaacacauucu

SEQ ID NO: 191701 - RNA, 22 nt, Human
agaagaaugguuugaaagauuu

SEQ ID NO: 191702 - RNA, 19 nt, Human
agaaacaacauucuggaga

SEQ ID NO: 191703 - RNA, 19 nt, Human
agaaauagccuuccuuguc

SEQ ID NO: 191704 - RNA, 22 nt, Human
acuuuaaaucuguugcuuagcu

SEQ ID NO: 191705 - RNA, 22 nt, Human
acuugaagcaugaaaauaagcc

SEQ ID NO: 191706 - RNA, 22 nt, Human
acuuuuagccuucccacaacag

SEQ ID NO: 191707 - RNA, 22 nt, Human
acuuuuuugccaucccuccagc

SEQ ID NO: 191708 - RNA, 22 nt, Human
acuucucuuuucauuaauuuug

SEQ ID NO: 191709 - RNA, 17 nt, Human
acuuaagacaguggaaa

SEQ ID NO: 191710 - RNA, 22 nt, Human
acuguuauugguguauguggca

SEQ ID NO: 191711 - RNA, 18 nt, Human
acuguccucaggacguug

SEQ ID NO: 191712 - RNA, 22 nt, Human
acugugacugugucuucugggc

SEQ ID NO: 191713 - RNA, 22 nt, Human
acugguagcugauuaaguauag

SEQ ID NO: 191714 - RNA, 22 nt, Human
acuggguuguuugucucaugag

SEQ ID NO: 191715 - RNA, 19 nt, Human
acuggggcaggcugggcuu

SEQ ID NO: 191716 - RNA, 15 nt, Human
acugggaaggaguau

SEQ ID NO: 191717 - RNA, 22 nt, Human
acuggugcucuggccaccgcug

SEQ ID NO: 191718 - RNA, 22 nt, Human
acuggcuuauuguuguggagcu

SEQ ID NO: 191719 - RNA, 22 nt, Human
acuggcgucugucuccccugcc

SEQ ID NO: 191720 - RNA, 22 nt, Human
acugggcaaggauaugaugggu

SEQ ID NO: 191721 - RNA, 22 nt, Human
acugggacuguaugugcuggac

SEQ ID NO: 191722 - RNA, 22 nt, Human
acuggcuuggaaauggguauuu

SEQ ID NO: 191723 - RNA, 22 nt, Human
acugguuucaaguuggacugaa

SEQ ID NO: 191724 - RNA, 22 nt, Human
acugucuuguuguaugugagcu

SEQ ID NO: 191725 - RNA, 22 nt, Human
acuggggauugguucuucaaca

SEQ ID NO: 191726 - RNA, 22 nt, Human
acuggggcaggaaaguaugcug

SEQ ID NO: 191727 - RNA, 22 nt, Human
acugugauguaaagaaauaggc

SEQ ID NO: 191728 - RNA, 22 nt, Human
acugugaagagcauucuggcug

SEQ ID NO: 191729 - RNA, 22 nt, Human
acugucaggauugagucucugg

SEQ ID NO: 191730 - RNA, 22 nt, Human
acugucauuaaugaauguaaua

SEQ ID NO: 191731 - RNA, 22 nt, Human
acugugcccccucuacugcuga

SEQ ID NO: 191732 - RNA, 18 nt, Human
acuguggcucagaguugc

SEQ ID NO: 191733 - RNA, 22 nt, Human
acuguggcugcuacccuggcuc

SEQ ID NO: 191734 - RNA, 22 nt, Human
acuguugagggaagcagaugaa

SEQ ID NO: 191735 - RNA, 22 nt, Human
acuguucacccagcacuagcag

SEQ ID NO: 191736 - RNA, 22 nt, Human
acugcuguugugauggguauuu

SEQ ID NO: 191737 - RNA, 22 nt, Human
acuggauuuugugguguaucuu

SEQ ID NO: 191738 - RNA, 22 nt, Human
acugcaggucccaucaccugcg

SEQ ID NO: 191739 - RNA, 23 nt, Human
acuggauuguucuugggcgcuga

SEQ ID NO: 191740 - RNA, 22 nt, Human
acuggagcccguggaggcgcag

SEQ ID NO: 191741 - RNA, 21 nt, Human
acugggcuagccugacuucug

SEQ ID NO: 191742 - RNA, 22 nt, Human
acuggggaggucuggauggauc

SEQ ID NO: 191743 - RNA, 19 nt, Human
acugggaugggcagugcca

SEQ ID NO: 191744 - RNA, 22 nt, Human
acuggcaugauagaccauaaca

SEQ ID NO: 191745 - RNA, 22 nt, Human
acuacucagcaaacauuugcug

SEQ ID NO: 191746 - RNA, 20 nt, Human
acuaccaugcaauuccgcuu

SEQ ID NO: 191747 - RNA, 22 nt, Human
acuaagcugugugguucacuca

SEQ ID NO: 191748 - RNA, 22 nt, Human
acugauuuuauauauuaccccg

SEQ ID NO: 191749 - RNA, 22 nt, Human
acugcacuccagcccgagcaac

SEQ ID NO: 191750 - RNA, 20 nt, Human
acugcaagagacagaugaaa

SEQ ID NO: 191751 - RNA, 22 nt, Human
acugacucacauuuugguuugc

SEQ ID NO: 191752 - RNA, 22 nt, Human
acugagcaaaacugauccuguu

SEQ ID NO: 191753 - RNA, 21 nt, Human
acugccaugcaggagccucca

SEQ ID NO: 191754 - RNA, 22 nt, Human
ccucucacucccucauggguuc

SEQ ID NO: 191755 - RNA, 22 nt, Human
ccucuaugcccuucuggggguc

SEQ ID NO: 191756 - RNA, 22 nt, Human
cgcacuggagcuggaacgaguc

SEQ ID NO: 191757 - RNA, 22 nt, Human
cgcacaggcacagacacuggga

SEQ ID NO: 191758 - RNA, 22 nt, Human
cgccaaccaggcuguccuccca

SEQ ID NO: 191759 - RNA, 22 nt, Human
cgcacuugugagcgacagggcu

SEQ ID NO: 191760 - RNA, 22 nt, Human
ccugcuggagucuaguuggucu

SEQ ID NO: 191761 - RNA, 21 nt, Human
ccgaggagugcggggagcccc

SEQ ID NO: 191762 - RNA, 22 nt, Human
ccugcugcugaugcuguuucac

SEQ ID NO: 191763 - RNA, 22 nt, Human
ccucaauucgugccucacauug

SEQ ID NO: 191764 - RNA, 22 nt, Human
ccucacaaagaaugucuagaca

SEQ ID NO: 191765 - RNA, 22 nt, Human
cgacaagagaaaugcuuuguuu

SEQ ID NO: 191766 - RNA, 22 nt, Human
ccucaggaauuuauucuucugu

SEQ ID NO: 191767 - RNA, 22 nt, Human
ccgccacggggcaugggaggca

SEQ ID NO: 191768 - RNA, 19 nt, Human
ccugcugaagugaugcagc

SEQ ID NO: 191769 - RNA, 18 nt, Human
ccugcguggauguccucu

SEQ ID NO: 191770 - RNA, 22 nt, Human
cggccuuugcccgucauucugg

SEQ ID NO: 191771 - RNA, 22 nt, Human
cggagguccagucacaaguaac

SEQ ID NO: 191772 - RNA, 22 nt, Human
cggcggcgaaccgaccugggug

SEQ ID NO: 191773 - RNA, 22 nt, Human
ccugccuuccagcucuggggag

SEQ ID NO: 191774 - RNA, 22 nt, Human
cggccgcgggauggcgggcagc

SEQ ID NO: 191775 - RNA, 22 nt, Human
cggcccggccucgcggcgcaug

SEQ ID NO: 191776 - RNA, 22 nt, Human
ccugcucuaauucauucaugcu

SEQ ID NO: 191777 - RNA, 22 nt, Human
cgccuggccccgcagcgcuugu

SEQ ID NO: 191778 - RNA, 22 nt, Human
ccugaagaugguugauccccuu

SEQ ID NO: 191779 - RNA, 22 nt, Human
ccucuuuugaaccaguucuuca

SEQ ID NO: 191780 - RNA, 22 nt, Human
ccugaaaugaguucugcucacu

SEQ ID NO: 191781 - RNA, 22 nt, Human
cgccugucugcauggccacugg

SEQ ID NO: 191782 - RNA, 22 nt, Human
cgcucggcuuucccuccgccgg

SEQ ID NO: 191783 - RNA, 22 nt, Human
cgcucggugagccaguggcgga

SEQ ID NO: 191784 - RNA, 22 nt, Human
cgcucugccugcccuaacuucc

SEQ ID NO: 191785 - RNA, 22 nt, Human
cgacagauuauuuugugacugc

SEQ ID NO: 191786 - RNA, 22 nt, Human
cgaagcuuuuguuggcgugucg

SEQ ID NO: 191787 - RNA, 18 nt, Human
cuaagaggucguuucuca

SEQ ID NO: 191788 - RNA, 22 nt, Human
cuaagaaggaggaaaagugcca

SEQ ID NO: 191789 - RNA, 22 nt, Human
cguuuugaguagauagccauau

SEQ ID NO: 191790 - RNA, 20 nt, Human
cuaaaacaggugucuaguga

SEQ ID NO: 191791 - RNA, 20 nt, Human
cguugccagcccggcccggg

SEQ ID NO: 191792 - RNA, 22 nt, Human
cgugugugugcgugugcgugug

SEQ ID NO: 191793 - RNA, 20 nt, Human
ccuuuuguugcuguuuggau

SEQ ID NO: 191794 - RNA, 22 nt, Human
ccuuuuagagaagugcauccag

SEQ ID NO: 191795 - RNA, 22 nt, Human
ccuuuuaagggagacuagagau

SEQ ID NO: 191796 - RNA, 22 nt, Human
cgugcaggagcuggagguccga

SEQ ID NO: 191797 - RNA, 22 nt, Human
cgugccugguggagagcgaggg

SEQ ID NO: 191798 - RNA, 22 nt, Human
cggugcuuuccauaucagcagc

SEQ ID NO: 191799 - RNA, 22 nt, Human
cguauauaaauguauauacaca

SEQ ID NO: 191800 - RNA, 22 nt, Human
cggucuauuguguaucauuuca

SEQ ID NO: 191801 - RNA, 19 nt, Human
cggugaagagaguuuagau

SEQ ID NO: 191802 - RNA, 22 nt, Human
cgggucgcacaggagaaaggcg

SEQ ID NO: 191803 - RNA, 22 nt, Human
cggucggagagaaugaccugga

SEQ ID NO: 191804 - RNA, 22 nt, Human
cgguggcccauuguacgcagcu

SEQ ID NO: 191805 - RNA, 22 nt, Human
ccuucaguguuacuagaaagcg

SEQ ID NO: 191806 - RNA, 18 nt, Human
ccuucaucucugcuucuu

SEQ ID NO: 191807 - RNA, 19 nt, Human
cgguaugaauguacuaugg

SEQ ID NO: 191808 - RNA, 22 nt, Human
ccuuccaguucuugguuguaau

SEQ ID NO: 191809 - RNA, 22 nt, Human
cggggcgggcgugggaggugga

SEQ ID NO: 191810 - RNA, 22 nt, Human
cggggcucugcacaggccagga

SEQ ID NO: 191811 - RNA, 22 nt, Human
cggggggguuggaaaagggaga

SEQ ID NO: 191812 - RNA, 19 nt, Human
cggggcuugguggguucuc

SEQ ID NO: 191813 - RNA, 22 nt, Human
cggggcuggcguuagggaggca

SEQ ID NO: 191814 - RNA, 22 nt, Human
ccuguguucguccucaccuugc

SEQ ID NO: 191815 - RNA, 22 nt, Human
cggcgccccgcgcgggcggcuc

SEQ ID NO: 191816 - RNA, 22 nt, Human
ccuggcccugcugcuugccagc

SEQ ID NO: 191817 - RNA, 22 nt, Human
ccugggcauuuguuucacaggu

SEQ ID NO: 191818 - RNA, 22 nt, Human
ccugggcauaaaucacuccaag

SEQ ID NO: 191819 - RNA, 22 nt, Human
ccuggggcucugcacagagcag

SEQ ID NO: 191820 - RNA, 22 nt, Human
ccugggcucgcgcacuucaccc

SEQ ID NO: 191821 - RNA, 22 nt, Human
ccugugucaucagcuguggcua

SEQ ID NO: 191822 - RNA, 22 nt, Human
cggggcggcgagcgggccgggc

SEQ ID NO: 191823 - RNA, 22 nt, Human
ccugucuuuucugaucauacua

SEQ ID NO: 191824 - RNA, 22 nt, Human
ccugugcaugccaggguacacc

SEQ ID NO: 191825 - RNA, 22 nt, Human
ccugucugaaggcagggggaug

SEQ ID NO: 191826 - RNA, 22 nt, Human
cuccuuuuccuacucauacuau

SEQ ID NO: 191827 - RNA, 22 nt, Human
cuccuuccuccgcccuuccucg

SEQ ID NO: 191828 - RNA, 22 nt, Human
cuccuuuuugggaccgugcagc

SEQ ID NO: 191829 - RNA, 22 nt, Human
cuccuuuuuauaucuuucucug

SEQ ID NO: 191830 - RNA, 22 nt, Human
cuccuuuuuuuaaagauggauu

SEQ ID NO: 191831 - RNA, 22 nt, Human
cggccuuuggcuucuccugugu

SEQ ID NO: 191832 - RNA, 22 nt, Human
cucggagggcaaguacuggcug

SEQ ID NO: 191833 - RNA, 22 nt, Human
cucccgagccuuacucuguucc

SEQ ID NO: 191834 - RNA, 22 nt, Human
cucaugcugcaaauggcuguuu

SEQ ID NO: 191835 - RNA, 22 nt, Human
cggacugaccugcucggggaga

SEQ ID NO: 191836 - RNA, 22 nt, Human
cggaagcacuagacacugacac

SEQ ID NO: 191837 - RNA, 22 nt, Human
cucagcugauuaauuucauguu

SEQ ID NO: 191838 - RNA, 22 nt, Human
cuccuggagcagcaggcgcagg

SEQ ID NO: 191839 - RNA, 22 nt, Human
cuccccuuauuccucaacauga

SEQ ID NO: 191840 - RNA, 22 nt, Human
cuccccauuuucaugggcaggu

SEQ ID NO: 191841 - RNA, 22 nt, Human
cuccagucccuccuugcccagc

SEQ ID NO: 191842 - RNA, 22 nt, Human
cuccaggcccagggccaagagc

SEQ ID NO: 191843 - RNA, 22 nt, Human
cuccagggcuaccagguuuuag

SEQ ID NO: 191844 - RNA, 22 nt, Human
cuccaugagccaggagggcuac

SEQ ID NO: 191845 - RNA, 22 nt, Human
cucagaauugucaccucaaaaa

SEQ ID NO: 191846 - RNA, 22 nt, Human
cucagaugcacacaggugaggg

SEQ ID NO: 191847 - RNA, 22 nt, Human
cucagcugcuuuguuuugcuuu

SEQ ID NO: 191848 - RNA, 19 nt, Human
cgcugcucccgcuguggcu

SEQ ID NO: 191849 - RNA, 22 nt, Human
cuauugguaucacacugauuuc

SEQ ID NO: 191850 - RNA, 22 nt, Human
cuauuauuauugucguuuuaca

SEQ ID NO: 191851 - RNA, 22 nt, Human
cucaauuuuuauugcuuuuuug

SEQ ID NO: 191852 - RNA, 22 nt, Human
cucacgguuugcaucaagagug

SEQ ID NO: 191853 - RNA, 22 nt, Human
cucacccaaacuauaucuuuaa

SEQ ID NO: 191854 - RNA, 22 nt, Human
cucaccugccuccccgcccucc

SEQ ID NO: 191855 - RNA, 22 nt, Human
cucagaagaacaaaggcucuac

SEQ ID NO: 191856 - RNA, 22 nt, Human
cucacugugggcuaugaauggg

SEQ ID NO: 191857 - RNA, 22 nt, Human
cuaugaaucaauuucugcaguu

SEQ ID NO: 191858 - RNA, 22 nt, Human
cuauaauuguacuuguuuuuua

SEQ ID NO: 191859 - RNA, 22 nt, Human
cuauguuuugcuagugaugggu

SEQ ID NO: 191860 - RNA, 22 nt, Human
cuaauugcuggcugcuggcaga

SEQ ID NO: 191861 - RNA, 21 nt, Human
cuauaaaaaugguucuuugcg

SEQ ID NO: 191862 - RNA, 22 nt, Human
cgaccccugaaaauggcagcca

SEQ ID NO: 191863 - RNA, 22 nt, Human
cgacgacaggcgcccgaggagg

SEQ ID NO: 191864 - RNA, 22 nt, Human
cgacuacuaacuacuguagaaa

SEQ ID NO: 191865 - RNA, 22 nt, Human
cgagaccaggcuuuuuuuagga

SEQ ID NO: 191866 - RNA, 22 nt, Human
cggggucuggaguuguggugug

SEQ ID NO: 191867 - RNA, 22 nt, Human
cggggugugacggugcgggccu

SEQ ID NO: 191868 - RNA, 22 nt, Human
cgggguguggggcgguagugug

SEQ ID NO: 191869 - RNA, 20 nt, Human
cugaauaccacagagccauc

SEQ ID NO: 191870 - RNA, 22 nt, Human
cugaagcugggcacuuccuuuu

SEQ ID NO: 191871 - RNA, 22 nt, Human
cugaaggacacgugaggagcca

SEQ ID NO: 191872 - RNA, 22 nt, Human
cugaauucuuguugucggagca

SEQ ID NO: 191873 - RNA, 22 nt, Human
cugaaagacgaggggaagucgg

SEQ ID NO: 191874 - RNA, 23 nt, Human
cugaaauucagaugcuaaagaua

SEQ ID NO: 191875 - RNA, 22 nt, Human
cugaaagcaaaguaauucuuaa

SEQ ID NO: 191876 - RNA, 22 nt, Human
cggcuucucgggucggauuccg

SEQ ID NO: 191877 - RNA, 22 nt, Human
cgggaaguaaacauuauuucag

SEQ ID NO: 191878 - RNA, 20 nt, Human
cgggacacucaagcucuggg

SEQ ID NO: 191879 - RNA, 22 nt, Human
cggggcaaggggggcuggugga

SEQ ID NO: 191880 - RNA, 22 nt, Human
cgggcacagguugagguagaug

SEQ ID NO: 191881 - RNA, 22 nt, Human
cgggaggcggagcuccgcgggg

SEQ ID NO: 191882 - RNA, 22 nt, Human
cggcugcgguucaccuagggca

SEQ ID NO: 191883 - RNA, 22 nt, Human
cggcuacccaugucauauucgu

SEQ ID NO: 191884 - RNA, 22 nt, Human
cggcgcugguacaguggaagag

SEQ ID NO: 191885 - RNA, 22 nt, Human
cugaaacuauggggaggggagc

SEQ ID NO: 191886 - RNA, 22 nt, Human
cugaaagacagccaggcaaagc

SEQ ID NO: 191887 - RNA, 22 nt, Human
cucuuuguauucuagaagcucu

SEQ ID NO: 191888 - RNA, 20 nt, Human
cucuuucugcuuuaugccuc

SEQ ID NO: 191889 - RNA, 22 nt, Human
cucuugacagcuuuaguaucau

SEQ ID NO: 191890 - RNA, 19 nt, Human
cucuucauuggaggguuga

SEQ ID NO: 191891 - RNA, 20 nt, Human
cucuuuaugagaccacuguc

SEQ ID NO: 191892 - RNA, 22 nt, Human
cucuucauuauucacgcccugu

SEQ ID NO: 191893 - RNA, 22 nt, Human
cucuguguguuugugugugugu

SEQ ID NO: 191894 - RNA, 22 nt, Human
cucugugucugauucugggaag

SEQ ID NO: 191895 - RNA, 22 nt, Human
cucuguugucaguggaagcagc

SEQ ID NO: 191896 - RNA, 22 nt, Human
cucugguuucgcaggaaauaga

SEQ ID NO: 191897 - RNA, 22 nt, Human
cucuguauauugagugcuuacu

SEQ ID NO: 191898 - RNA, 17 nt, Human
cucugggucuccugcuu

SEQ ID NO: 191899 - RNA, 22 nt, Human
cucuccaguuauagcugauuug

SEQ ID NO: 191900 - RNA, 22 nt, Human
cucuccagucauauucucaguc

SEQ ID NO: 191901 - RNA, 18 nt, Human
cucuggacagcaggcauc

SEQ ID NO: 191902 - RNA, 22 nt, Human
cucuggcaacgauggugcuuau

SEQ ID NO: 191903 - RNA, 19 nt, Human
cucuggcuccugggcugcc

SEQ ID NO: 191904 - RNA, 22 nt, Human
cccuuuuuugccauuccuuccu

SEQ ID NO: 191905 - RNA, 21 nt, Human
cccuugccugcacuccucggc

SEQ ID NO: 191906 - RNA, 22 nt, Human
cccuuuucuaauuuagccuguu

SEQ ID NO: 191907 - RNA, 22 nt, Human
ccugcaugacuuugucagaccu

SEQ ID NO: 191908 - RNA, 22 nt, Human
ccugcaguuuuuccaugauaca

SEQ ID NO: 191909 - RNA, 22 nt, Human
ccugcugagccuggugggcagc

SEQ ID NO: 191910 - RNA, 22 nt, Human
ccugcucccccugcaagccuug

SEQ ID NO: 191911 - RNA, 22 nt, Human
ccugcccaucccaccccagcau

SEQ ID NO: 191912 - RNA, 22 nt, Human
ccugccagaaaagagggaguuc

SEQ ID NO: 191913 - RNA, 22 nt, Human
ccugccagccugccaucccaca

SEQ ID NO: 191914 - RNA, 20 nt, Human
cccuggaaugagaugcauau

SEQ ID NO: 191915 - RNA, 22 nt, Human
cccuggacuccauuuucccgua

SEQ ID NO: 191916 - RNA, 17 nt, Human
cccugcauugauccuca

SEQ ID NO: 191917 - RNA, 22 nt, Human
cccuggcucaggcagcuuuguu

SEQ ID NO: 191918 - RNA, 22 nt, Human
ccugacuugguuuaggagaugg

SEQ ID NO: 191919 - RNA, 22 nt, Human
ccugaggcccuggcugugcuga

SEQ ID NO: 191920 - RNA, 22 nt, Human
ccugagccgagcgcucuuucuc

SEQ ID NO: 191921 - RNA, 22 nt, Human
ccugauauggugucauuuaaac

SEQ ID NO: 191922 - RNA, 22 nt, Human
ccugaguucuuauuuccaguca

SEQ ID NO: 191923 - RNA, 22 nt, Human
cccuggucucugacuugauccu

SEQ ID NO: 191924 - RNA, 22 nt, Human
cccuucauguagcugugugucc

SEQ ID NO: 191925 - RNA, 22 nt, Human
ccucuggacuugggacagugag

SEQ ID NO: 191926 - RNA, 22 nt, Human
ccugacagcgugucccuggccc

SEQ ID NO: 191927 - RNA, 22 nt, Human
ccugaauuuaucugaauggugg

SEQ ID NO: 191928 - RNA, 22 nt, Human
cccucucaaucuuuaaaauaca

SEQ ID NO: 191929 - RNA, 22 nt, Human
cccggcucggcuucuuccccac

SEQ ID NO: 191930 - RNA, 22 nt, Human
cccgggcucuggcagaggcggu

SEQ ID NO: 191931 - RNA, 22 nt, Human
cccgguugggguuccagggcgc

SEQ ID NO: 191932 - RNA, 22 nt, Human
cccgguggagaugugggacagg

SEQ ID NO: 191933 - RNA, 22 nt, Human
cccuaaucuuggaaaugccauu

SEQ ID NO: 191934 - RNA, 19 nt, Human
cccucggcuucugguuacu

SEQ ID NO: 191935 - RNA, 22 nt, Human
ccucccagccuggagaggagcc

SEQ ID NO: 191936 - RNA, 19 nt, Human
cccgauggagacuuagcag

SEQ ID NO: 191937 - RNA, 22 nt, Human
cccgaaaauuguuguacugcag

SEQ ID NO: 191938 - RNA, 22 nt, Human
ccucgugcgauaguuaugucag

SEQ ID NO: 191939 - RNA, 22 nt, Human
ccuccuuuccuguuuuccugag

SEQ ID NO: 191940 - RNA, 22 nt, Human
ccucccuucccggcauggcucu

SEQ ID NO: 191941 - RNA, 19 nt, Human
ccuccguguuaccuguccu

SEQ ID NO: 191942 - RNA, 22 nt, Human
cccagcugaacuugcauuccaa

SEQ ID NO: 191943 - RNA, 22 nt, Human
cccagcuggcaaaggcguccuu

SEQ ID NO: 191944 - RNA, 22 nt, Human
cccaggaaugagcaggcagggg

SEQ ID NO: 191945 - RNA, 22 nt, Human
cccagcuuugcggacccgggag

SEQ ID NO: 191946 - RNA, 22 nt, Human
cccagccgcuguggucuagggu

SEQ ID NO: 191947 - RNA, 22 nt, Human
ccggcugcugaggcggccccgg

SEQ ID NO: 191948 - RNA, 22 nt, Human
ccggcggguggagcaugcgcgg

SEQ ID NO: 191949 - RNA, 22 nt, Human
ccggcugagccucgccgcggcc

SEQ ID NO: 191950 - RNA, 22 nt, Human
ccggcggaaacauggcggcgcc

SEQ ID NO: 191951 - RNA, 22 nt, Human
cccagccgaaugcucccuuccc

SEQ ID NO: 191952 - RNA, 22 nt, Human
ccgccucucgcucccagcuugc

SEQ ID NO: 191953 - RNA, 22 nt, Human
ccgcucgggugcagagggcaga

SEQ ID NO: 191954 - RNA, 22 nt, Human
ccgcggauggggagucaccacc

SEQ ID NO: 191955 - RNA, 22 nt, Human
ccggaggaaauugcauugguug

SEQ ID NO: 191956 - RNA, 22 nt, Human
ccgcuggaagcgaguggugggc

SEQ ID NO: 191957 - RNA, 22 nt, Human
cccagcaccauaacucaggccu

SEQ ID NO: 191958 - RNA, 22 nt, Human
cccagaccagagugccuggacg

SEQ ID NO: 191959 - RNA, 22 nt, Human
cccacgccuucuuucuucaaau

SEQ ID NO: 191960 - RNA, 22 nt, Human
ccgugggugggguacgggcugg

SEQ ID NO: 191961 - RNA, 21 nt, Human
ccccuguggagcacauguggc

SEQ ID NO: 191962 - RNA, 22 nt, Human
ccccuuguuuuauucaaauugg

SEQ ID NO: 191963 - RNA, 22 nt, Human
ccuaacagauugggugacaaua

SEQ ID NO: 191964 - RNA, 22 nt, Human
ccuauuuucaaaauuguuuauc

SEQ ID NO: 191965 - RNA, 22 nt, Human
ccuauauuacaggcuugcucua

SEQ ID NO: 191966 - RNA, 22 nt, Human
ccucaucagaaagcagaaagca

SEQ ID NO: 191967 - RNA, 22 nt, Human
ccucaguguguggauguuagag

SEQ ID NO: 191968 - RNA, 22 nt, Human
ccccguggcugggggacagagc

SEQ ID NO: 191969 - RNA, 22 nt, Human
ccccacaugaauacaguguagu

SEQ ID NO: 191970 - RNA, 22 nt, Human
cccauuuuuuggauguguggau

SEQ ID NO: 191971 - RNA, 22 nt, Human
cccagggguugaggccguaggg

SEQ ID NO: 191972 - RNA, 22 nt, Human
cccauauacuuuuucuggucca

SEQ ID NO: 191973 - RNA, 22 nt, Human
ccguaugacuuuuuguuguugu

SEQ ID NO: 191974 - RNA, 22 nt, Human
ccgugcaguuucucacacacau

SEQ ID NO: 191975 - RNA, 22 nt, Human
cccuguccugcuaggcccuggu

SEQ ID NO: 191976 - RNA, 19 nt, Human
ccaguuuuuuaauauucaa

SEQ ID NO: 191977 - RNA, 22 nt, Human
cccugggccccgaacugcugag

SEQ ID NO: 191978 - RNA, 20 nt, Human
cccuggcuggcaucuggacu

SEQ ID NO: 191979 - RNA, 22 nt, Human
cccuccagugucccagugggga

SEQ ID NO: 191980 - RNA, 22 nt, Human
cccgugggaugagaggcccugg

SEQ ID NO: 191981 - RNA, 22 nt, Human
cccguggugggaugacaccaug

SEQ ID NO: 191982 - RNA, 22 nt, Human
ccagggcugcugccugggcugg

SEQ ID NO: 191983 - RNA, 22 nt, Human
ccagguuggccaccuucacggg

SEQ ID NO: 191984 - RNA, 22 nt, Human
ccaggggagagucugagucguu

SEQ ID NO: 191985 - RNA, 22 nt, Human
cccuuuuuuauggaguuggcca

SEQ ID NO: 191986 - RNA, 21 nt, Human
ccgacggcgcagaugccggcc

SEQ ID NO: 191987 - RNA, 22 nt, Human
ccauaaaagagaaucuaaauga

SEQ ID NO: 191988 - RNA, 22 nt, Human
ccaugauguugccuacacugcu

SEQ ID NO: 191989 - RNA, 22 nt, Human
ccauggaugcucagauguuagc

SEQ ID NO: 191990 - RNA, 22 nt, Human
ccaucccugagucacaggaggg

SEQ ID NO: 191991 - RNA, 22 nt, Human
ccgagaucagaguaggauuugg

SEQ ID NO: 191992 - RNA, 22 nt, Human
ccauaaaguaggaaacacuaca

SEQ ID NO: 191993 - RNA, 22 nt, Human
ccgcaccgucugccauacacgc

SEQ ID NO: 191994 - RNA, 22 nt, Human
ccgcagggcccggcgggcucag

SEQ ID NO: 191995 - RNA, 22 nt, Human
ccgauuuaugucucugacuuga

SEQ ID NO: 191996 - RNA, 22 nt, Human
ccgauuuauucugacaguuuau

SEQ ID NO: 191997 - RNA, 22 nt, Human
cccacccuacugcuacccagga

SEQ ID NO: 191998 - RNA, 23 nt, Human
ccaugugcaggguucagcacuua

SEQ ID NO: 191999 - RNA, 22 nt, Human
ccaugugaccugugucaguugc

SEQ ID NO: 192000 - RNA, 22 nt, Human
ccaugggugucuggagcacccu

SEQ ID NO: 192001 - RNA, 23 nt, Human
ccccugcauggcaccacauuccc

SEQ ID NO: 192002 - RNA, 22 nt, Human
ccccugcucagggaggagaccg

SEQ ID NO: 192003 - RNA, 22 nt, Human
ccagcucgaggcaggggcugca

SEQ ID NO: 192004 - RNA, 22 nt, Human
ccagcuuuucagaaucugccug

SEQ ID NO: 192005 - RNA, 22 nt, Human
ccagcugcugcaccgugcaugg

SEQ ID NO: 192006 - RNA, 22 nt, Human
ccagcugggucccugcuggggc

SEQ ID NO: 192007 - RNA, 22 nt, Human
ccagcaugcucagucuaaauug

SEQ ID NO: 192008 - RNA, 22 nt, Human
ccagccugccaagcccagcccu

SEQ ID NO: 192009 - RNA, 22 nt, Human
ccccaggcagcccuccaggagc

SEQ ID NO: 192010 - RNA, 22 nt, Human
cccccauccccugaaggagcug

SEQ ID NO: 192011 - RNA, 22 nt, Human
cccccucuuccccucauugcuu

SEQ ID NO: 192012 - RNA, 22 nt, Human
cccgccggccacaccggccgcc

SEQ ID NO: 192013 - RNA, 22 nt, Human
cccgcucaccccacuccaccag

SEQ ID NO: 192014 - RNA, 22 nt, Human
cccggagcagucgggcuccggg

SEQ ID NO: 192015 - RNA, 22 nt, Human
ccaggaguccgugggucuugag

SEQ ID NO: 192016 - RNA, 22 nt, Human
cccggcgccucguuuccuaguc

SEQ ID NO: 192017 - RNA, 23 nt, Human
cccgggaagugcugcuuaucugg

SEQ ID NO: 192018 - RNA, 22 nt, Human
ccaggcccugcuccucacacca

SEQ ID NO: 192019 - RNA, 22 nt, Human
ccagggcggacaaggucuuuga

SEQ ID NO: 192020 - RNA, 22 nt, Human
caucaaaugcaagagcguucuu

SEQ ID NO: 192021 - RNA, 23 nt, Human
cauguacacacagcuguacagug

SEQ ID NO: 192022 - RNA, 22 nt, Human
cauauuaugcauguuguucuuu

SEQ ID NO: 192023 - RNA, 20 nt, Human
caucaacaccuugucagccu

SEQ ID NO: 192024 - RNA, 22 nt, Human
cauuaccuggggagaggauacc

SEQ ID NO: 192025 - RNA, 22 nt, Human
cccagcccaucauuccugcaaa

SEQ ID NO: 192026 - RNA, 22 nt, Human
cccagccugaucucggccagcu

SEQ ID NO: 192027 - RNA, 22 nt, Human
ccagaggcuuaugcagcugcug

SEQ ID NO: 192028 - RNA, 20 nt, Human
ccccagcauccuuuucaucu

SEQ ID NO: 192029 - RNA, 22 nt, Human
cccaguuguuccuauucuucuu

SEQ ID NO: 192030 - RNA, 22 nt, Human
ccagccacagcuuccagcuccu

SEQ ID NO: 192031 - RNA, 22 nt, Human
ccagcaucagcucuuggcuggc

SEQ ID NO: 192032 - RNA, 22 nt, Human
ccagcaggagacuagcaacaua

SEQ ID NO: 192033 - RNA, 22 nt, Human
cccagcgccugcccuccgccgc

SEQ ID NO: 192034 - RNA, 22 nt, Human
cccaggccguguaaucagcagc

SEQ ID NO: 192035 - RNA, 22 nt, Human
cccaggucgucagcaguguggu

SEQ ID NO: 192036 - RNA, 22 nt, Human
cuguuucuuugcugucagagag

SEQ ID NO: 192037 - RNA, 22 nt, Human
gaacaugaguuuuaugguauuu

SEQ ID NO: 192038 - RNA, 22 nt, Human
gaacugggguagggguagcuuu

SEQ ID NO: 192039 - RNA, 22 nt, Human
cuguuacggaggcuuucuaguu

SEQ ID NO: 192040 - RNA, 20 nt, Human
cuuaugcaaaauguuaggga

SEQ ID NO: 192041 - RNA, 22 nt, Human
cuuauaucaacuggaaaaauua

SEQ ID NO: 192042 - RNA, 22 nt, Human
cuuacauuuguuuaguguuucc

SEQ ID NO: 192043 - RNA, 22 nt, Human
cuuaggcgugugcgggugaggc

SEQ ID NO: 192044 - RNA, 23 nt, Human
cuuauauaaucauuagaaaccau

SEQ ID NO: 192045 - RNA, 20 nt, Human
cuuauuuuggagaacuuuuc

SEQ ID NO: 192046 - RNA, 22 nt, Human
cuuauuugcccauguuucuuua

SEQ ID NO: 192047 - RNA, 22 nt, Human
cuucacugcagucauggcucug

SEQ ID NO: 192048 - RNA, 22 nt, Human
gaaaugucaagauauguuugga

SEQ ID NO: 192049 - RNA, 22 nt, Human
cugugugugcacacguguaugg

SEQ ID NO: 192050 - RNA, 22 nt, Human
cuguguggccuaaguggagaca

SEQ ID NO: 192051 - RNA, 22 nt, Human
gaaauaggcccuuacauggaaa

SEQ ID NO: 192052 - RNA, 22 nt, Human
cugugucucccaaggaggguca

SEQ ID NO: 192053 - RNA, 22 nt, Human
cuguggcuaggaagcuguggga

SEQ ID NO: 192054 - RNA, 22 nt, Human
cugugcuguuagcgauuuuuaa

SEQ ID NO: 192055 - RNA, 22 nt, Human
gaaagcauucuggaggggcaga

SEQ ID NO: 192056 - RNA, 22 nt, Human
cuggccaggugggggguagugg

SEQ ID NO: 192057 - RNA, 22 nt, Human
cuggccagccucccagguaccc

SEQ ID NO: 192058 - RNA, 22 nt, Human
cuuugugcagcagaaaugugug

SEQ ID NO: 192059 - RNA, 22 nt, Human
cuuugcaaagagagaaaguggg

SEQ ID NO: 192060 - RNA, 20 nt, Human
gaauucugaagauaauuugg

SEQ ID NO: 192061 - RNA, 22 nt, Human
cuuggugagcuccuggcgcagc

SEQ ID NO: 192062 - RNA, 22 nt, Human
cuuggguacaguaaagggaggu

SEQ ID NO: 192063 - RNA, 22 nt, Human
gaauccccugucggaacagugg

SEQ ID NO: 192064 - RNA, 22 nt, Human
gaauggagaacccuggacacug

SEQ ID NO: 192065 - RNA, 22 nt, Human
cuugcugggagagcuuuagaga

SEQ ID NO: 192066 - RNA, 22 nt, Human
gaaugacuugcucauucugugu

SEQ ID NO: 192067 - RNA, 22 nt, Human
cuugccuuugaaagcauuucuc

SEQ ID NO: 192068 - RNA, 20 nt, Human
gaaucuggucaaaugucuau

SEQ ID NO: 192069 - RNA, 22 nt, Human
gaauaccauuuacauuugaaaa

SEQ ID NO: 192070 - RNA, 22 nt, Human
gaauagauuagaaagaguaugu

SEQ ID NO: 192071 - RNA, 21 nt, Human
gaaguagcucugagaaaagug

SEQ ID NO: 192072 - RNA, 22 nt, Human
gaauaauuuugaucagaaggga

SEQ ID NO: 192073 - RNA, 22 nt, Human
gaagcucaguugcuuagaucuc

SEQ ID NO: 192074 - RNA, 22 nt, Human
gaagcccuggaggggcuggagg

SEQ ID NO: 192075 - RNA, 22 nt, Human
gaagcggguucacuggauggcu

SEQ ID NO: 192076 - RNA, 22 nt, Human
gaagcgugcagguccguauacu

SEQ ID NO: 192077 - RNA, 22 nt, Human
cuucauuucaggcugaagaaua

SEQ ID NO: 192078 - RNA, 22 nt, Human
gaagcuucucaacugguggaau

SEQ ID NO: 192079 - RNA, 22 nt, Human
cuucauuacagcaaccauuuga

SEQ ID NO: 192080 - RNA, 22 nt, Human
cuucaugucacugucuuaggua

SEQ ID NO: 192081 - RNA, 22 nt, Human
gaaggaagcugucuggaugugu

SEQ ID NO: 192082 - RNA, 22 nt, Human
gaaggagaggauugugaggcug

SEQ ID NO: 192083 - RNA, 22 nt, Human
gaaggauaauuuugcuggaugu

SEQ ID NO: 192084 - RNA, 22 nt, Human
cuucucuugugauguuagcgga

SEQ ID NO: 192085 - RNA, 22 nt, Human
cuuuuucuuaucuuuuucuaug

SEQ ID NO: 192086 - RNA, 22 nt, Human
cuuuuaaucuaauuuuuauauu

SEQ ID NO: 192087 - RNA, 22 nt, Human
gaccuuucccuaucucacucuc

SEQ ID NO: 192088 - RNA, 22 nt, Human
cuuuuaccuuaauuucgacaca

SEQ ID NO: 192089 - RNA, 19 nt, Human
cuuugugguuuucagaacu

SEQ ID NO: 192090 - RNA, 22 nt, Human
gaccaggagauuugagcuaggc

SEQ ID NO: 192091 - RNA, 22 nt, Human
gaccacugaaugcacuucuaau

SEQ ID NO: 192092 - RNA, 22 nt, Human
cuuuacauuaauuucuacugau

SEQ ID NO: 192093 - RNA, 20 nt, Human
cuuguuaaauaugcagguag

SEQ ID NO: 192094 - RNA, 22 nt, Human
gagaauaauaauaggcauggug

SEQ ID NO: 192095 - RNA, 22 nt, Human
gagaagugaauaacgaagcagg

SEQ ID NO: 192096 - RNA, 22 nt, Human
gagaaguagcgucuucccgggg

SEQ ID NO: 192097 - RNA, 22 nt, Human
gagaagguggaccugaaggagc

SEQ ID NO: 192098 - RNA, 22 nt, Human
gaaaaguauuaugugaggguuc

SEQ ID NO: 192099 - RNA, 22 nt, Human
gaaagggggcuuggacacuggc

SEQ ID NO: 192100 - RNA, 22 nt, Human
gaaagcuuggaaacgacuuuau

SEQ ID NO: 192101 - RNA, 22 nt, Human
gaaagagaugucguuugucuuc

SEQ ID NO: 192102 - RNA, 22 nt, Human
gaaacguuguggaaaauccucu

SEQ ID NO: 192103 - RNA, 22 nt, Human
gaaaagaaggcaggagcccaag

SEQ ID NO: 192104 - RNA, 22 nt, Human
gaaaagaaaggaugguaugugu

SEQ ID NO: 192105 - RNA, 22 nt, Human
gaaaaagucuuaaaguaaggca

SEQ ID NO: 192106 - RNA, 22 nt, Human
gacuggucuuuugugauggaug

SEQ ID NO: 192107 - RNA, 22 nt, Human
gacuggcucuaucaggauaaau

SEQ ID NO: 192108 - RNA, 22 nt, Human
gacuggguaaagcuuauccaaa

SEQ ID NO: 192109 - RNA, 22 nt, Human
gaaaaaccacaauugguauuuu

SEQ ID NO: 192110 - RNA, 22 nt, Human
gaaaaagagaaggaguucagua

SEQ ID NO: 192111 - RNA, 22 nt, Human
gagcagggagaggcagagaggc

SEQ ID NO: 192112 - RNA, 22 nt, Human
gagcaggcuggcagggccaggg

SEQ ID NO: 192113 - RNA, 22 nt, Human
gaagaaggaagaucaugcuuga

SEQ ID NO: 192114 - RNA, 22 nt, Human
gaagaggaagaggagccagagc

SEQ ID NO: 192115 - RNA, 22 nt, Human
gaagaugcugcuuguucacggg

SEQ ID NO: 192116 - RNA, 22 nt, Human
gagcaguuagggaccgcaggcu

SEQ ID NO: 192117 - RNA, 22 nt, Human
gagcagacugcacaguucuugc

SEQ ID NO: 192118 - RNA, 22 nt, Human
gaacauuucugcagaugucuga

SEQ ID NO: 192119 - RNA, 22 nt, Human
gagcacauguggagagucuggg

SEQ ID NO: 192120 - RNA, 22 nt, Human
gagcaacacauugaaugaggau

SEQ ID NO: 192121 - RNA, 22 nt, Human
gagcacuucagcauaaaucaca

SEQ ID NO: 192122 - RNA, 22 nt, Human
gagcacugagcuggaauuggag

SEQ ID NO: 192123 - RNA, 22 nt, Human
gaacggccucguuccucggugu

SEQ ID NO: 192124 - RNA, 22 nt, Human
gaaccauuuaauggagaugcuc

SEQ ID NO: 192125 - RNA, 22 nt, Human
gaaccuggcagcccuauaucug

SEQ ID NO: 192126 - RNA, 22 nt, Human
gagcagcucgagaaggaagcag

SEQ ID NO: 192127 - RNA, 22 nt, Human
gagaucuguguuugcugaagcu

SEQ ID NO: 192128 - RNA, 22 nt, Human
gagaguuggaggguauguuagu

SEQ ID NO: 192129 - RNA, 22 nt, Human
gagauggauuuuuuugccaguc

SEQ ID NO: 192130 - RNA, 22 nt, Human
gagagugggagauuuccagcag

SEQ ID NO: 192131 - RNA, 22 nt, Human
gagaugugguucaaggguguuu

SEQ ID NO: 192132 - RNA, 22 nt, Human
gagauuucauuugugaggcuca

SEQ ID NO: 192133 - RNA, 22 nt, Human
gaacaaaagauagcccaaacau

SEQ ID NO: 192134 - RNA, 22 nt, Human
gagauuugaguuccuacugagu

SEQ ID NO: 192135 - RNA, 20 nt, Human
gaacauaaauaacucuuuac

SEQ ID NO: 192136 - RNA, 22 nt, Human
gaacagauucaucuaguggcua

SEQ ID NO: 192137 - RNA, 22 nt, Human
gaacaaggauucccaaagaaga

SEQ ID NO: 192138 - RNA, 22 nt, Human
gaaaugggggcaugcguuacau

SEQ ID NO: 192139 - RNA, 22 nt, Human
gaaaugaaacacacaugcagcu

SEQ ID NO: 192140 - RNA, 22 nt, Human
gagagguuaucugcuaagguag

SEQ ID NO: 192141 - RNA, 22 nt, Human
gaaauagagacaguaagugucu

SEQ ID NO: 192142 - RNA, 22 nt, Human
gaaaucuggugauuuucuguug

SEQ ID NO: 192143 - RNA, 22 nt, Human
gaaagugaauguaacauguuau

SEQ ID NO: 192144 - RNA, 22 nt, Human
gagaggugaagcuaauuaauuu

SEQ ID NO: 192145 - RNA, 22 nt, Human
gagaggguugggaggcagcaga

SEQ ID NO: 192146 - RNA, 22 nt, Human
gagaggcugagcaguccggguu

SEQ ID NO: 192147 - RNA, 22 nt, Human
gagagaguaucugcugguucac

SEQ ID NO: 192148 - RNA, 22 nt, Human
cuugauucauuuaagguuggag

SEQ ID NO: 192149 - RNA, 22 nt, Human
cuugccagggacucagucaggg

SEQ ID NO: 192150 - RNA, 22 nt, Human
cuugcagccuggagcucagccu

SEQ ID NO: 192151 - RNA, 22 nt, Human
cugcccgcaugcaggaaugcug

SEQ ID NO: 192152 - RNA, 22 nt, Human
cugcccauggcuccuggcugug

SEQ ID NO: 192153 - RNA, 22 nt, Human
cuucuugucagugauuucuucc

SEQ ID NO: 192154 - RNA, 22 nt, Human
cuucuucuagaagauggggaag

SEQ ID NO: 192155 - RNA, 22 nt, Human
cuucuuucuuuucuucuucucu

SEQ ID NO: 192156 - RNA, 22 nt, Human
cuucuuuuggggaugaaaaugg

SEQ ID NO: 192157 - RNA, 22 nt, Human
cuucuuuucuacuggccuagaa

SEQ ID NO: 192158 - RNA, 22 nt, Human
cuucugaugugugcucuuaguu

SEQ ID NO: 192159 - RNA, 22 nt, Human
cuucucuuugacaguugggugu

SEQ ID NO: 192160 - RNA, 22 nt, Human
cuucuggaggcucuagaggaga

SEQ ID NO: 192161 - RNA, 22 nt, Human
cuucuggaggcugcagaaaaga

SEQ ID NO: 192162 - RNA, 22 nt, Human
cuucuucaucuuuuggaggaac

SEQ ID NO: 192163 - RNA, 22 nt, Human
cuucuguguggauacagucccu

SEQ ID NO: 192164 - RNA, 22 nt, Human
cuucucuuggguguggugucuu

SEQ ID NO: 192165 - RNA, 22 nt, Human
cugccaguaucuuuggggcugu

SEQ ID NO: 192166 - RNA, 23 nt, Human
cuucggcgcucgcugggcggagg

SEQ ID NO: 192167 - RNA, 22 nt, Human
cugccacuaccaugcuggauga

SEQ ID NO: 192168 - RNA, 22 nt, Human
cugcagagaccuaggucagguu

SEQ ID NO: 192169 - RNA, 22 nt, Human
cugcagauguagcugcuuuccu

SEQ ID NO: 192170 - RNA, 22 nt, Human
cuuccuuucagaggaaggccug

SEQ ID NO: 192171 - RNA, 21 nt, Human
cugcacugugauuuaaaaugu

SEQ ID NO: 192172 - RNA, 20 nt, Human
cugauguucgugcuuccugg

SEQ ID NO: 192173 - RNA, 22 nt, Human
cugauguuuaucucaagaguuc

SEQ ID NO: 192174 - RNA, 19 nt, Human
cuucaguguucaccuggcc

SEQ ID NO: 192175 - RNA, 22 nt, Human
cugaugucaaauuuaucaaagc

SEQ ID NO: 192176 - RNA, 22 nt, Human
cuucaggaccugaagcccaucu

SEQ ID NO: 192177 - RNA, 22 nt, Human
cuucaguuaguuucaugugagc

SEQ ID NO: 192178 - RNA, 22 nt, Human
cuucauaagauuguugugagga

SEQ ID NO: 192179 - RNA, 22 nt, Human
cuucauccguaccacggccaca

SEQ ID NO: 192180 - RNA, 22 nt, Human
cugcacagucauuuccucucaa

SEQ ID NO: 192181 - RNA, 22 nt, Human
cugcacuggguacauagaaaca

SEQ ID NO: 192182 - RNA, 22 nt, Human
cugauuguagccacugugauga

SEQ ID NO: 192183 - RNA, 22 nt, Human
cugauuucaaauggugcuagau

SEQ ID NO: 192184 - RNA, 22 nt, Human
cuuguuuuaaacuguuguggcu

SEQ ID NO: 192185 - RNA, 22 nt, Human
cuuguuaacaauugguaucuuu

SEQ ID NO: 192186 - RNA, 22 nt, Human
cuggaauugcuugagcuaggaa

SEQ ID NO: 192187 - RNA, 22 nt, Human
cuggacucuuuguuuaguucug

SEQ ID NO: 192188 - RNA, 22 nt, Human
cuggagaacucugugcuucacu

SEQ ID NO: 192189 - RNA, 23 nt, Human
cuggacauucgcaaaguucaucu

SEQ ID NO: 192190 - RNA, 22 nt, Human
cuggaagcgucggaggaagggc

SEQ ID NO: 192191 - RNA, 19 nt, Human
cuuguggcuaugcagauac

SEQ ID NO: 192192 - RNA, 22 nt, Human
cugcuuuggaucucucucugcc

SEQ ID NO: 192193 - RNA, 22 nt, Human
cugcuuguguugcucagaguca

SEQ ID NO: 192194 - RNA, 22 nt, Human
cuggaaaaauggauccugucuu

SEQ ID NO: 192195 - RNA, 18 nt, Human
cuuucugcccccauuagc

SEQ ID NO: 192196 - RNA, 22 nt, Human
cuggaugagcuucgugcgcacg

SEQ ID NO: 192197 - RNA, 22 nt, Human
cuuucuuuuugguuucccccca

SEQ ID NO: 192198 - RNA, 22 nt, Human
cuuugauuucucugguccaauc

SEQ ID NO: 192199 - RNA, 22 nt, Human
cuuuagugaguguggagcuaga

SEQ ID NO: 192200 - RNA, 22 nt, Human
cuuuccugaaaucucuucugca

SEQ ID NO: 192201 - RNA, 22 nt, Human
cuuucugauguaaggaacuagg

SEQ ID NO: 192202 - RNA, 22 nt, Human
cuuuaaaaauguauuuuugugg

SEQ ID NO: 192203 - RNA, 22 nt, Human
cuggagaagagguaguauguag

SEQ ID NO: 192204 - RNA, 22 nt, Human
cuggagaucaguuggacaacag

SEQ ID NO: 192205 - RNA, 22 nt, Human
cuuuauguuggggugucuuagu

SEQ ID NO: 192206 - RNA, 22 nt, Human
cuuggcacauuuuguucuucug

SEQ ID NO: 192207 - RNA, 21 nt, Human
cuuggagacucuuggccacau

SEQ ID NO: 192208 - RNA, 22 nt, Human
cuugcuguccgaugggucugua

SEQ ID NO: 192209 - RNA, 22 nt, Human
cugcucugagaggcucuuccua

SEQ ID NO: 192210 - RNA, 22 nt, Human
cugcggcaccaaccccuucaug

SEQ ID NO: 192211 - RNA, 22 nt, Human
cuugucuaguuccuggugaugu

SEQ ID NO: 192212 - RNA, 22 nt, Human
cugcuguuuuccccaccaucuc

SEQ ID NO: 192213 - RNA, 22 nt, Human
cugcugcuugauugcaggaagu

SEQ ID NO: 192214 - RNA, 22 nt, Human
cugcugucuuuauuucacugcu

SEQ ID NO: 192215 - RNA, 22 nt, Human
cuuggcuccuucacagggagau

SEQ ID NO: 192216 - RNA, 23 nt, Human
cuuggcuagccacuuccacgcuc

SEQ ID NO: 192217 - RNA, 22 nt, Human
cuccaucccccugugugucaau

SEQ ID NO: 192218 - RNA, 22 nt, Human
cucccccugccucuccucccug

SEQ ID NO: 192219 - RNA, 22 nt, Human
cuggccuuaucacaaagcuaga

SEQ ID NO: 192220 - RNA, 22 nt, Human
cuccaguugugucuuguaagaa

SEQ ID NO: 192221 - RNA, 22 nt, Human
cugggaaucuagagggcucauu

SEQ ID NO: 192222 - RNA, 21 nt, Human
cugggaacccgaccaaggccu

SEQ ID NO: 192223 - RNA, 22 nt, Human
cuccucccagcccaggcgccac

SEQ ID NO: 192224 - RNA, 22 nt, Human
cuccugauuucuaggccuuauc

SEQ ID NO: 192225 - RNA, 22 nt, Human
cucggaggaccuguuuuaugca

SEQ ID NO: 192226 - RNA, 22 nt, Human
cucuaaauguggucugcagaua

SEQ ID NO: 192227 - RNA, 22 nt, Human
cucuauuuuuucaucuuucagg

SEQ ID NO: 192228 - RNA, 22 nt, Human
cucuauucuaauggauucuggg

SEQ ID NO: 192229 - RNA, 22 nt, Human
cucuaccugcacaugccugacu

SEQ ID NO: 192230 - RNA, 22 nt, Human
cugggagaggaaccucgagggu

SEQ ID NO: 192231 - RNA, 22 nt, Human
cucgccugacucggaugggcug

SEQ ID NO: 192232 - RNA, 22 nt, Human
cugggaccugugugccugggcc

SEQ ID NO: 192233 - RNA, 22 nt, Human
cuccugcuuuuucuucuuccga

SEQ ID NO: 192234 - RNA, 22 nt, Human
cuggcaguguccagcucgugau

SEQ ID NO: 192235 - RNA, 22 nt, Human
cuggcagcucugagucccuucu

SEQ ID NO: 192236 - RNA, 22 nt, Human
cuggccugugggcugucuccgg

SEQ ID NO: 192237 - RNA, 22 nt, Human
cuggcccugucagcacagaauc

SEQ ID NO: 192238 - RNA, 22 nt, Human
cuggaugucugggaggcuuccc

SEQ ID NO: 192239 - RNA, 22 nt, Human
cucaggugagcgagcuaaauua

SEQ ID NO: 192240 - RNA, 22 nt, Human
cuggagucagcaaggacgaggc

SEQ ID NO: 192241 - RNA, 20 nt, Human
cuggaguguagcaguggcug

SEQ ID NO: 192242 - RNA, 22 nt, Human
cuggagaacagagcuguuuaga

SEQ ID NO: 192243 - RNA, 22 nt, Human
cuggaaauggcagaguugcauu

SEQ ID NO: 192244 - RNA, 22 nt, Human
cugacugauuuugcuuuuuaau

SEQ ID NO: 192245 - RNA, 22 nt, Human
cugaccucuaaguaacagagaa

SEQ ID NO: 192246 - RNA, 22 nt, Human
cuggaaagauuuacacggggaa

SEQ ID NO: 192247 - RNA, 22 nt, Human
cugaggaguaguucuggaggac

SEQ ID NO: 192248 - RNA, 22 nt, Human
cugagcggugagggcauacagc

SEQ ID NO: 192249 - RNA, 22 nt, Human
cugagcugcucccgcugcagcg

SEQ ID NO: 192250 - RNA, 22 nt, Human
cugagcuauauauuaugcauag

SEQ ID NO: 192251 - RNA, 22 nt, Human
cugagaucaugggucagguggu

SEQ ID NO: 192252 - RNA, 22 nt, Human
cugacugaggaucaguucauca

SEQ ID NO: 192253 - RNA, 22 nt, Human
cugagaaauacccaagucuggu

SEQ ID NO: 192254 - RNA, 22 nt, Human
cugaaucugccuccgaggguuu

SEQ ID NO: 192255 - RNA, 22 nt, Human
cuguuuggaugccauggucaag

SEQ ID NO: 192256 - RNA, 22 nt, Human
cugacagaucuggaucugaacu

SEQ ID NO: 192257 - RNA, 20 nt, Human
cugaccagcagccugucucc

SEQ ID NO: 192258 - RNA, 22 nt, Human
cugaccugugagcuaugccggc

SEQ ID NO: 192259 - RNA, 22 nt, Human
cugaccgugccgcgguacugcu

SEQ ID NO: 192260 - RNA, 22 nt, Human
cugaaggcuuugaauggaauga

SEQ ID NO: 192261 - RNA, 22 nt, Human
cugaaucaaaugacuuagccau

SEQ ID NO: 192262 - RNA, 22 nt, Human
cuguguuaggaucuugcuggca

SEQ ID NO: 192263 - RNA, 22 nt, Human
cucuucugugggugcuauguca

SEQ ID NO: 192264 - RNA, 22 nt, Human
cucuucauguuggugcagaagc

SEQ ID NO: 192265 - RNA, 22 nt, Human
cugucucugauaagcucgaggg

SEQ ID NO: 192266 - RNA, 22 nt, Human
cucugucuggggaggggagagg

SEQ ID NO: 192267 - RNA, 22 nt, Human
cugugaaugguggccacgcguu

SEQ ID NO: 192268 - RNA, 22 nt, Human
cugucucugucucuguuuaucc

SEQ ID NO: 192269 - RNA, 22 nt, Human
cuguggaaugcaguugcgagca

SEQ ID NO: 192270 - RNA, 22 nt, Human
cucuuuucaaaccuguuuaugg

SEQ ID NO: 192271 - RNA, 22 nt, Human
cucuuuuuccuaugaaaucuau

SEQ ID NO: 192272 - RNA, 22 nt, Human
cucucuuuuuuucccuuguuaa

SEQ ID NO: 192273 - RNA, 22 nt, Human
cucucuccuuagcugcagacca

SEQ ID NO: 192274 - RNA, 20 nt, Human
cucugggaggcuugucaccu

SEQ ID NO: 192275 - RNA, 22 nt, Human
cucuggggaagugcacucgcug

SEQ ID NO: 192276 - RNA, 22 nt, Human
cucugcuuguaucacauuugcu

SEQ ID NO: 192277 - RNA, 22 nt, Human
cuguacuuguuuuaggaugaug

SEQ ID NO: 192278 - RNA, 22 nt, Human
cuguagaugucagguuaaugag

SEQ ID NO: 192279 - RNA, 22 nt, Human
cagcuuuugcagacuucuugcc

SEQ ID NO: 192280 - RNA, 22 nt, Human
caggaaaauaauggugauggga

SEQ ID NO: 192281 - RNA, 22 nt, Human
cagguaguuagaaugaccagga

SEQ ID NO: 192282 - RNA, 22 nt, Human
caggggucccccggcucccugg

SEQ ID NO: 192283 - RNA, 22 nt, Human
caggcacaaugagcgccaucuu

SEQ ID NO: 192284 - RNA, 22 nt, Human
cagggggcagcguagaaaauga

SEQ ID NO: 192285 - RNA, 19 nt, Human
caggggcuuaugcgaccuc

SEQ ID NO: 192286 - RNA, 22 nt, Human
caggggacacuccugcuugggc

SEQ ID NO: 192287 - RNA, 22 nt, Human
caggggaagccagcugccaugu

SEQ ID NO: 192288 - RNA, 22 nt, Human
caggggcuccaggugagccugg

SEQ ID NO: 192289 - RNA, 22 nt, Human
cagcuuauggcuucuccaguag

SEQ ID NO: 192290 - RNA, 22 nt, Human
cagggccaggccucaggggcgc

SEQ ID NO: 192291 - RNA, 22 nt, Human
cagggcuugaaucaaggaaguc

SEQ ID NO: 192292 - RNA, 22 nt, Human
cagcuauuguucuguauaauga

SEQ ID NO: 192293 - RNA, 22 nt, Human
caggacacagacacuaaauaua

SEQ ID NO: 192294 - RNA, 22 nt, Human
caggaagucugaauucugagag

SEQ ID NO: 192295 - RNA, 22 nt, Human
cagcucugcugggaggaugcag

SEQ ID NO: 192296 - RNA, 22 nt, Human
caggagagucucugucuguacu

SEQ ID NO: 192297 - RNA, 21 nt, Human
caggccaaaagguucaacauu

SEQ ID NO: 192298 - RNA, 22 nt, Human
caggaggaaaguuccacucaac

SEQ ID NO: 192299 - RNA, 22 nt, Human
caggccacagcuaaagaggauu

SEQ ID NO: 192300 - RNA, 22 nt, Human
cagggagguuggauuggggccu

SEQ ID NO: 192301 - RNA, 22 nt, Human
caggccagcuggaggggcagcu

SEQ ID NO: 192302 - RNA, 22 nt, Human
caggcagagagggcagugugga

SEQ ID NO: 192303 - RNA, 22 nt, Human
caggcagggagcuggaaaggau

SEQ ID NO: 192304 - RNA, 22 nt, Human
caggcaggagaaaaggcgcggg

SEQ ID NO: 192305 - RNA, 22 nt, Human
cagcccaggcucagauguuggg

SEQ ID NO: 192306 - RNA, 22 nt, Human
cagcuuguucugaccugugauu

SEQ ID NO: 192307 - RNA, 22 nt, Human
cagcuucuccauucuucuggcu

SEQ ID NO: 192308 - RNA, 22 nt, Human
cagcccuguugcgcuuccggcg

SEQ ID NO: 192309 - RNA, 22 nt, Human
cagccgcucaugggcccggagc

SEQ ID NO: 192310 - RNA, 22 nt, Human
caggaagagaacugcucagccu

SEQ ID NO: 192311 - RNA, 22 nt, Human
cagccuuuucuuaaaaugcaag

SEQ ID NO: 192312 - RNA, 20 nt, Human
cagaucuuauguuuuucugu

SEQ ID NO: 192313 - RNA, 22 nt, Human
cagauggagaaagagugaaugg

SEQ ID NO: 192314 - RNA, 22 nt, Human
cagauuuagcacugauaggacu

SEQ ID NO: 192315 - RNA, 22 nt, Human
cagauuuaauaaaaaaugcauc

SEQ ID NO: 192316 - RNA, 19 nt, Human
cagcaaacacuguaaaugg

SEQ ID NO: 192317 - RNA, 22 nt, Human
cagcuguauuucucugguuaga

SEQ ID NO: 192318 - RNA, 22 nt, Human
cagcagccuccccggccgaccu

SEQ ID NO: 192319 - RNA, 22 nt, Human
cagacaaauccuuaugagacug

SEQ ID NO: 192320 - RNA, 22 nt, Human
cagacacgucccuguugaccug

SEQ ID NO: 192321 - RNA, 22 nt, Human
cagcaugcaaguccagaugugg

SEQ ID NO: 192322 - RNA, 22 nt, Human
cagcauggagacaaagugggca

SEQ ID NO: 192323 - RNA, 18 nt, Human
cagcauuagcagcuucca

SEQ ID NO: 192324 - RNA, 23 nt, Human
cagagaaaauagaauaugcugug

SEQ ID NO: 192325 - RNA, 22 nt, Human
cagaguccuguaguauugcugg

SEQ ID NO: 192326 - RNA, 22 nt, Human
cagagaagaggucuugaccccu

SEQ ID NO: 192327 - RNA, 22 nt, Human
cagcuccagcccaggcagcucc

SEQ ID NO: 192328 - RNA, 22 nt, Human
cagcugacaagaguccuuggag

SEQ ID NO: 192329 - RNA, 22 nt, Human
cagcugcgcagcgccgggccug

SEQ ID NO: 192330 - RNA, 22 nt, Human
cagagggagcuaaccagcagcc

SEQ ID NO: 192331 - RNA, 22 nt, Human
cagagguagaaguagauguuug

SEQ ID NO: 192332 - RNA, 22 nt, Human
cagcccaucaaggggauccuga

SEQ ID NO: 192333 - RNA, 22 nt, Human
cagaggcugagcugcgggauga

SEQ ID NO: 192334 - RNA, 22 nt, Human
cagaggaugucuacaccuugag

SEQ ID NO: 192335 - RNA, 22 nt, Human
cagauacaacagcaggaaugaa

SEQ ID NO: 192336 - RNA, 22 nt, Human
cagauaagcuauaaguaguacc

SEQ ID NO: 192337 - RNA, 22 nt, Human
cagaguaaugugauuuccaugu

SEQ ID NO: 192338 - RNA, 21 nt, Human
cagagcuuuggagacggagga

SEQ ID NO: 192339 - RNA, 22 nt, Human
cacuuuuucccccuggugucau

SEQ ID NO: 192340 - RNA, 22 nt, Human
cagaaaaaaaugcagacuagca

SEQ ID NO: 192341 - RNA, 22 nt, Human
cagaugccauagguauaguaua

SEQ ID NO: 192342 - RNA, 22 nt, Human
cagauguuugaaugcuuaccac

SEQ ID NO: 192343 - RNA, 22 nt, Human
cacacacacacacacucucaca

SEQ ID NO: 192344 - RNA, 18 nt, Human
cacgcaacuguaaaaccc

SEQ ID NO: 192345 - RNA, 22 nt, Human
caguaucucuaaaauuacucuu

SEQ ID NO: 192346 - RNA, 22 nt, Human
caguaucucccauucacagugu

SEQ ID NO: 192347 - RNA, 22 nt, Human
caguaguucucauaacucauga

SEQ ID NO: 192348 - RNA, 21 nt, Human
caguagcgcgacaugguuagc

SEQ ID NO: 192349 - RNA, 22 nt, Human
cagguauaugugugucuaauac

SEQ ID NO: 192350 - RNA, 22 nt, Human
caggguuuuauuuggcuuuaaa

SEQ ID NO: 192351 - RNA, 22 nt, Human
caggucauaacuaugcaugaac

SEQ ID NO: 192352 - RNA, 22 nt, Human
caggcacagcuaagacuggcca

SEQ ID NO: 192353 - RNA, 22 nt, Human
cagucaaauuugaaaacuuuga

SEQ ID NO: 192354 - RNA, 22 nt, Human
caguaugagcacagugccugga

SEQ ID NO: 192355 - RNA, 22 nt, Human
caggcagggcugccuucugcuu

SEQ ID NO: 192356 - RNA, 22 nt, Human
cagggccagggcuauggugaag

SEQ ID NO: 192357 - RNA, 22 nt, Human
cagggcuuuuuccuccucuuug

SEQ ID NO: 192358 - RNA, 22 nt, Human
cagggcaucucugaaucuucac

SEQ ID NO: 192359 - RNA, 22 nt, Human
cagggcagaguuaagaugcugg

SEQ ID NO: 192360 - RNA, 22 nt, Human
cagggcacaguuauggaggugg

SEQ ID NO: 192361 - RNA, 17 nt, Human
cagugcuguuuuagaaa

SEQ ID NO: 192362 - RNA, 22 nt, Human
caggccgcccucuccuguuagc

SEQ ID NO: 192363 - RNA, 20 nt, Human
caggccuucaggauggcugg

SEQ ID NO: 192364 - RNA, 22 nt, Human
cauccagggguacccuggagcc

SEQ ID NO: 192365 - RNA, 22 nt, Human
caucgagaauuggcagcuaaag

SEQ ID NO: 192366 - RNA, 22 nt, Human
caguacugucuuccugauggca

SEQ ID NO: 192367 - RNA, 22 nt, Human
cagguuguugacugcauauagg

SEQ ID NO: 192368 - RNA, 20 nt, Human
cagguugcugcccccgccuc

SEQ ID NO: 192369 - RNA, 23 nt, Human
cauauucagaaacaccuaguggu

SEQ ID NO: 192370 - RNA, 22 nt, Human
cagguuucuggaugcagcccca

SEQ ID NO: 192371 - RNA, 22 nt, Human
cagggugaagaugcgccuccug

SEQ ID NO: 192372 - RNA, 22 nt, Human
caggguaguaauuuaauacaag

SEQ ID NO: 192373 - RNA, 22 nt, Human
caggguaccaagcuucgcccuc

SEQ ID NO: 192374 - RNA, 22 nt, Human
cauaccuugguaagagugauca

SEQ ID NO: 192375 - RNA, 22 nt, Human
caggggcuuuccuguuuaugga

SEQ ID NO: 192376 - RNA, 22 nt, Human
cagggguaccuggguuaccugu

SEQ ID NO: 192377 - RNA, 22 nt, Human
cagguauuugaaggcaguggga

SEQ ID NO: 192378 - RNA, 22 nt, Human
caggucagcacuuggaggugca

SEQ ID NO: 192379 - RNA, 22 nt, Human
cauguaaguucacagucgaugu

SEQ ID NO: 192380 - RNA, 22 nt, Human
cauguauguuaguggcugcuuu

SEQ ID NO: 192381 - RNA, 22 nt, Human
caugggaauaaaguuauuucaa

SEQ ID NO: 192382 - RNA, 22 nt, Human
cauggccaaagaauuauauuuu

SEQ ID NO: 192383 - RNA, 22 nt, Human
caugggcucuucuggacugcac

SEQ ID NO: 192384 - RNA, 22 nt, Human
cauaaucaagggguugugaugu

SEQ ID NO: 192385 - RNA, 22 nt, Human
cauagcguuuacauguggauua

SEQ ID NO: 192386 - RNA, 22 nt, Human
cauggcaggugcagauucugug

SEQ ID NO: 192387 - RNA, 22 nt, Human
caguucuguaccaggagaagcu

SEQ ID NO: 192388 - RNA, 22 nt, Human
caugcuaacacguugcucaccg

SEQ ID NO: 192389 - RNA, 22 nt, Human
caguuuuggaagaaacaaggaa

SEQ ID NO: 192390 - RNA, 22 nt, Human
caguuuuauacacugcagcucc

SEQ ID NO: 192391 - RNA, 22 nt, Human
caugcagcagaauaaugacuau

SEQ ID NO: 192392 - RNA, 22 nt, Human
caguuuuucaaaauuacaugau

SEQ ID NO: 192393 - RNA, 22 nt, Human
caguugcagagugauguguuug

SEQ ID NO: 192394 - RNA, 21 nt, Human
caguucuaagugucaucuuuu

SEQ ID NO: 192395 - RNA, 22 nt, Human
caguugcuauugagagaacaca

SEQ ID NO: 192396 - RNA, 21 nt, Human
caguuugcuauuuuaguauga

SEQ ID NO: 192397 - RNA, 22 nt, Human
caguggagaccugccugcugga

SEQ ID NO: 192398 - RNA, 22 nt, Human
caugaggauccuccaggggaaa

SEQ ID NO: 192399 - RNA, 22 nt, Human
caguggacacuuccucuacaau

SEQ ID NO: 192400 - RNA, 22 nt, Human
caugaccauuuggguuugugcg

SEQ ID NO: 192401 - RNA, 20 nt, Human
caugaguccgugaguggccc

SEQ ID NO: 192402 - RNA, 22 nt, Human
cagugguaaaugucguuccugu

SEQ ID NO: 192403 - RNA, 22 nt, Human
caguguuuagcacagugcuugg

SEQ ID NO: 192404 - RNA, 22 nt, Human
caguucacggcugguaugaauu

SEQ ID NO: 192405 - RNA, 22 nt, Human
caugaugacagcauuccuuuua

SEQ ID NO: 192406 - RNA, 22 nt, Human
caugaugaacugugcuguuagg

SEQ ID NO: 192407 - RNA, 20 nt, Human
caugaugcaaacaguaacgu

SEQ ID NO: 192408 - RNA, 22 nt, Human
caugaugagaguaauaacacag

SEQ ID NO: 192409 - RNA, 22 nt, Human
caugauucccacauugcgauca

SEQ ID NO: 192410 - RNA, 22 nt, Human
caugauguuaucaagcacaaag

SEQ ID NO: 192411 - RNA, 22 nt, Human
caugaagugaaaagguuaauuu

SEQ ID NO: 192412 - RNA, 22 nt, Human
caugaacucucggguuuggaau

SEQ ID NO: 192413 - RNA, 22 nt, Human
caugagaguaaccuagagaaga

SEQ ID NO: 192414 - RNA, 22 nt, Human
caugaauaauucuuuuucuugg

SEQ ID NO: 192415 - RNA, 22 nt, Human
cagugcucauagcuguuccucc

SEQ ID NO: 192416 - RNA, 22 nt, Human
cagugcuggaggggugcuugca

SEQ ID NO: 192417 - RNA, 22 nt, Human
caucugcagccucugcauuccc

SEQ ID NO: 192418 - RNA, 22 nt, Human
caguccaugaugacuuuugcuc

SEQ ID NO: 192419 - RNA, 22 nt, Human
cagugccggccaggaccuccug

SEQ ID NO: 192420 - RNA, 22 nt, Human
auuguuuugugaaacauaguga

SEQ ID NO: 192421 - RNA, 17 nt, Human
auuguuuuuaauuugca

SEQ ID NO: 192422 - RNA, 22 nt, Human
auuucacucuuaauugcuuccu

SEQ ID NO: 192423 - RNA, 22 nt, Human
auuuaucugcucuucgcguuga

SEQ ID NO: 192424 - RNA, 22 nt, Human
auuuauuugaagagccauugca

SEQ ID NO: 192425 - RNA, 22 nt, Human
auuucagaguagaucguuauuu

SEQ ID NO: 192426 - RNA, 22 nt, Human
auuuaaaaacugguacaacagg

SEQ ID NO: 192427 - RNA, 22 nt, Human
auuucuguaauucugaggagug

SEQ ID NO: 192428 - RNA, 22 nt, Human
auuuaaagaguaauacaaucca

SEQ ID NO: 192429 - RNA, 22 nt, Human
auuucaacagaguuugaaggca

SEQ ID NO: 192430 - RNA, 22 nt, Human
auuuauuuucccucaaguaccu

SEQ ID NO: 192431 - RNA, 22 nt, Human
auuucagaaugaaaggaaaaau

SEQ ID NO: 192432 - RNA, 22 nt, Human
auuuauccuugggguagagcca

SEQ ID NO: 192433 - RNA, 22 nt, Human
auugaguacuugcugggcucuc

SEQ ID NO: 192434 - RNA, 22 nt, Human
auuuauauauuuuguucuggua

SEQ ID NO: 192435 - RNA, 22 nt, Human
auuuacugagguaaauaaacug

SEQ ID NO: 192436 - RNA, 22 nt, Human
auugaaauuugcuuccucacug

SEQ ID NO: 192437 - RNA, 22 nt, Human
auugaaauuaauuucugcuuuc

SEQ ID NO: 192438 - RNA, 22 nt, Human
auugugaaugccugucagucuu

SEQ ID NO: 192439 - RNA, 22 nt, Human
auuauaauucauuaggcuuagu

SEQ ID NO: 192440 - RNA, 21 nt, Human
auuauagugacuaaauugaua

SEQ ID NO: 192441 - RNA, 22 nt, Human
auuauacauuaggagauugauu

SEQ ID NO: 192442 - RNA, 22 nt, Human
auuacagauuauaaauuugagc

SEQ ID NO: 192443 - RNA, 22 nt, Human
auuaauguguaugauauaaauu

SEQ ID NO: 192444 - RNA, 22 nt, Human
auuacagaagauaugcucaaca

SEQ ID NO: 192445 - RNA, 20 nt, Human
auuaauuuuuagggcucacc

SEQ ID NO: 192446 - RNA, 22 nt, Human
auuuuacuaugauaguugagaa

SEQ ID NO: 192447 - RNA, 22 nt, Human
auuugaaaaucuaugaugugca

SEQ ID NO: 192448 - RNA, 22 nt, Human
auuuaagacuguggugcaguuu

SEQ ID NO: 192449 - RNA, 18 nt, Human
auuuguggggguuauaga

SEQ ID NO: 192450 - RNA, 22 nt, Human
auuugcuuguucaccaguacuu

SEQ ID NO: 192451 - RNA, 22 nt, Human
auuuuuaucuaaaauccacuuu

SEQ ID NO: 192452 - RNA, 22 nt, Human
auuugccaguuacucacaccac

SEQ ID NO: 192453 - RNA, 22 nt, Human
auuugacuugguaagacuuaag

SEQ ID NO: 192454 - RNA, 22 nt, Human
auuuuugguuauaaaauaguuu

SEQ ID NO: 192455 - RNA, 22 nt, Human
auuuuugguuucaccugcacgc

SEQ ID NO: 192456 - RNA, 22 nt, Human
auuuuugugucacaucuaggaa

SEQ ID NO: 192457 - RNA, 22 nt, Human
auuuucgcaccucgcgaguugc

SEQ ID NO: 192458 - RNA, 22 nt, Human
auuuuucucucaugugcaacua

SEQ ID NO: 192459 - RNA, 22 nt, Human
caaagagaugcaccauauuucu

SEQ ID NO: 192460 - RNA, 22 nt, Human
caaagaugccaaaaggaagaca

SEQ ID NO: 192461 - RNA, 22 nt, Human
caaagccuggggagaguaagga

SEQ ID NO: 192462 - RNA, 22 nt, Human
auuuugcuuuucuaguggguuu

SEQ ID NO: 192463 - RNA, 22 nt, Human
caaagaagagauuuacagagcu

SEQ ID NO: 192464 - RNA, 22 nt, Human
auuuugcaguuuauugccaauc

SEQ ID NO: 192465 - RNA, 22 nt, Human
caaaacccaagugcuauugcaa

SEQ ID NO: 192466 - RNA, 22 nt, Human
caaaacauucagagagcucacu

SEQ ID NO: 192467 - RNA, 22 nt, Human
caaaaauacuugccuguaucug

SEQ ID NO: 192468 - RNA, 22 nt, Human
auuuuuuuuccugucucuuuca

SEQ ID NO: 192469 - RNA, 22 nt, Human
caacuucuauucagucugcagu

SEQ ID NO: 192470 - RNA, 22 nt, Human
auuuuuuuaggcugucagccgc

SEQ ID NO: 192471 - RNA, 22 nt, Human
caacaaguugauuucacgcugc

SEQ ID NO: 192472 - RNA, 22 nt, Human
caaauacaaauacgggcagcuu

SEQ ID NO: 192473 - RNA, 22 nt, Human
auuuuucacauuuugggggaca

SEQ ID NO: 192474 - RNA, 22 nt, Human
auuuuuauuugccuaugauaua

SEQ ID NO: 192475 - RNA, 22 nt, Human
caacaagcgcucagagcaaagc

SEQ ID NO: 192476 - RNA, 22 nt, Human
caauugcuuccuucuguaagua

SEQ ID NO: 192477 - RNA, 22 nt, Human
cacaaagugucaggggagagaa

SEQ ID NO: 192478 - RNA, 22 nt, Human
cacaauuuccauugagcagcag

SEQ ID NO: 192479 - RNA, 22 nt, Human
cacaacaaaaaauaaguaugag

SEQ ID NO: 192480 - RNA, 22 nt, Human
caacguggauucuuccaggggc

SEQ ID NO: 192481 - RNA, 22 nt, Human
caaccaguagcugaguucaaaa

SEQ ID NO: 192482 - RNA, 17 nt, Human
caaccaggaaaggaggg

SEQ ID NO: 192483 - RNA, 22 nt, Human
cacaaggagaaauagauauuga

SEQ ID NO: 192484 - RNA, 22 nt, Human
caacacaucaguucagucuuga

SEQ ID NO: 192485 - RNA, 20 nt, Human
caacacugcccauuguuugc

SEQ ID NO: 192486 - RNA, 22 nt, Human
caaaugcaguggucgugcugga

SEQ ID NO: 192487 - RNA, 22 nt, Human
caaauuuuuauuuaccaucugc

SEQ ID NO: 192488 - RNA, 22 nt, Human
caaaucagaucagagacaggcu

SEQ ID NO: 192489 - RNA, 22 nt, Human
caaugaaaauuuaaguugcagc

SEQ ID NO: 192490 - RNA, 22 nt, Human
caauaguaaucaaugcaguuag

SEQ ID NO: 192491 - RNA, 22 nt, Human
caaugcacauggacaucaggcu

SEQ ID NO: 192492 - RNA, 22 nt, Human
caauaauugcuuuccagaguua

SEQ ID NO: 192493 - RNA, 22 nt, Human
caauaccucuuggugauugggc

SEQ ID NO: 192494 - RNA, 22 nt, Human
caaggaguuuggggaccaagga

SEQ ID NO: 192495 - RNA, 22 nt, Human
caagauauguccuguuacuaag

SEQ ID NO: 192496 - RNA, 22 nt, Human
caagagcuuuagaaaugcucau

SEQ ID NO: 192497 - RNA, 22 nt, Human
caagaaaaaacaugaugagugu

SEQ ID NO: 192498 - RNA, 22 nt, Human
caagaugcaagaccagucaggc

SEQ ID NO: 192499 - RNA, 22 nt, Human
caagagguaugagccgggauga

SEQ ID NO: 192500 - RNA, 22 nt, Human
caagcgcgccgcuuccuuccgc

SEQ ID NO: 192501 - RNA, 22 nt, Human
caccgagagccacuuccggaac

SEQ ID NO: 192502 - RNA, 22 nt, Human
cacccugacuggcccugcagga

SEQ ID NO: 192503 - RNA, 22 nt, Human
caccugcaaauuccagauuucu

SEQ ID NO: 192504 - RNA, 22 nt, Human
caccuggaggcagcaccgggcu

SEQ ID NO: 192505 - RNA, 22 nt, Human
caccuuccgcccacugaccgcc

SEQ ID NO: 192506 - RNA, 22 nt, Human
caaguauuuauugaggcccugu

SEQ ID NO: 192507 - RNA, 22 nt, Human
caaguaugagaaagcuauuacc

SEQ ID NO: 192508 - RNA, 22 nt, Human
cacccgacugaggacgccgccc

SEQ ID NO: 192509 - RNA, 22 nt, Human
caccacuuggcccugagguccu

SEQ ID NO: 192510 - RNA, 22 nt, Human
caccagcgacugugaccagcaa

SEQ ID NO: 192511 - RNA, 22 nt, Human
caagguauugaggccagugucc

SEQ ID NO: 192512 - RNA, 22 nt, Human
caaggcuaagcuuuggcuuucu

SEQ ID NO: 192513 - RNA, 22 nt, Human
caaggggagcugguauggaugg

SEQ ID NO: 192514 - RNA, 22 nt, Human
caaggaagguugguugaaggua

SEQ ID NO: 192515 - RNA, 22 nt, Human
caaggaaaacagaugaucaaca

SEQ ID NO: 192516 - RNA, 22 nt, Human
caaggaaaugucagaaaggcaa

SEQ ID NO: 192517 - RNA, 22 nt, Human
cacauuuuccagaagaaucaga

SEQ ID NO: 192518 - RNA, 22 nt, Human
cacauaguuuaucuucauuuuc

SEQ ID NO: 192519 - RNA, 22 nt, Human
cacaucaaacuuacuaagauuu

SEQ ID NO: 192520 - RNA, 22 nt, Human
cacagucugagcccagccuugu

SEQ ID NO: 192521 - RNA, 22 nt, Human
cacagugugguauauuucccaa

SEQ ID NO: 192522 - RNA, 22 nt, Human
cacaguccugcauuuacugccu

SEQ ID NO: 192523 - RNA, 22 nt, Human
caagcagauauuuuagucaaga

SEQ ID NO: 192524 - RNA, 17 nt, Human
cacauggagcuuguugc

SEQ ID NO: 192525 - RNA, 22 nt, Human
cacagccaagacuuggccccau

SEQ ID NO: 192526 - RNA, 22 nt, Human
cacagcaggcagaacgugggca

SEQ ID NO: 192527 - RNA, 18 nt, Human
cacagcauccaaguuaug

SEQ ID NO: 192528 - RNA, 22 nt, Human
caagaaccuagcgaucagguaa

SEQ ID NO: 192529 - RNA, 19 nt, Human
caagagcaaagucuuauga

SEQ ID NO: 192530 - RNA, 22 nt, Human
caagaaguugacagccagguga

SEQ ID NO: 192531 - RNA, 20 nt, Human
cacagcugacgaguauccaa

SEQ ID NO: 192532 - RNA, 19 nt, Human
cacagcccucacuuuuagc

SEQ ID NO: 192533 - RNA, 22 nt, Human
caagagcucccagaccugggca

SEQ ID NO: 192534 - RNA, 22 nt, Human
caagagcgugugcagggcaagu

SEQ ID NO: 192535 - RNA, 22 nt, Human
augcucuuaauugcuagauaag

SEQ ID NO: 192536 - RNA, 22 nt, Human
augcuagaaaauuucauauuau

SEQ ID NO: 192537 - RNA, 22 nt, Human
augcagcggucagaggaacuca

SEQ ID NO: 192538 - RNA, 22 nt, Human
augcagauguagauucugaaau

SEQ ID NO: 192539 - RNA, 22 nt, Human
augcacuaugaugagcuagucu

SEQ ID NO: 192540 - RNA, 22 nt, Human
augcacuacuagaugcaaaagu

SEQ ID NO: 192541 - RNA, 21 nt, Human
augcgcgguggagugagcgaa

SEQ ID NO: 192542 - RNA, 22 nt, Human
augcagagacugugggaaagca

SEQ ID NO: 192543 - RNA, 22 nt, Human
augauaucuuguuuuucaugca

SEQ ID NO: 192544 - RNA, 22 nt, Human
augaugauuauucauuuucugu

SEQ ID NO: 192545 - RNA, 22 nt, Human
augaugaugguuuaacuucagg

SEQ ID NO: 192546 - RNA, 22 nt, Human
augcacaagguagauuauuauu

SEQ ID NO: 192547 - RNA, 23 nt, Human
augcaacauugccaguaugggca

SEQ ID NO: 192548 - RNA, 19 nt, Human
augcaauguuaucaauaac

SEQ ID NO: 192549 - RNA, 22 nt, Human
augcaccugucuuuuaaggaua

SEQ ID NO: 192550 - RNA, 22 nt, Human
augcccugggagugcuguacca

SEQ ID NO: 192551 - RNA, 22 nt, Human
augcuacuugugaaaacccagg

SEQ ID NO: 192552 - RNA, 22 nt, Human
auggagugggaggacaugaagg

SEQ ID NO: 192553 - RNA, 22 nt, Human
augcuacauuuugguuuauaaa

SEQ ID NO: 192554 - RNA, 22 nt, Human
augcuaaucaaacuuucugcag

SEQ ID NO: 192555 - RNA, 22 nt, Human
auggccugaagcuaaccccccu

SEQ ID NO: 192556 - RNA, 22 nt, Human
augcugacaacaaagaaggaag

SEQ ID NO: 192557 - RNA, 22 nt, Human
augcuugaaaguuauuucauuu

SEQ ID NO: 192558 - RNA, 22 nt, Human
augcugcuuguccauuuauuug

SEQ ID NO: 192559 - RNA, 22 nt, Human
augcugcuccuuuucaggcauu

SEQ ID NO: 192560 - RNA, 22 nt, Human
auggccuguuuccucugaaaga

SEQ ID NO: 192561 - RNA, 22 nt, Human
augcauaucuccuaucuccuca

SEQ ID NO: 192562 - RNA, 22 nt, Human
augcaguuagguaauagucuca

SEQ ID NO: 192563 - RNA, 18 nt, Human
augcugacacaaugugga

SEQ ID NO: 192564 - RNA, 22 nt, Human
augcuucuguugcuuaggaggu

SEQ ID NO: 192565 - RNA, 22 nt, Human
augcugugccuggaaagcggcu

SEQ ID NO: 192566 - RNA, 22 nt, Human
augccugcugucaggaacucuu

SEQ ID NO: 192567 - RNA, 22 nt, Human
augccucuugagagccagugcu

SEQ ID NO: 192568 - RNA, 22 nt, Human
augccugggcuuuaggguucuc

SEQ ID NO: 192569 - RNA, 22 nt, Human
augccgggguggcuccagcacc

SEQ ID NO: 192570 - RNA, 22 nt, Human
augcggcugugggggaauggga

SEQ ID NO: 192571 - RNA, 22 nt, Human
augcgcugugcacacucuuaac

SEQ ID NO: 192572 - RNA, 22 nt, Human
augaucaagaauuuuguauucc

SEQ ID NO: 192573 - RNA, 22 nt, Human
augaucacagugucagucauua

SEQ ID NO: 192574 - RNA, 22 nt, Human
augaagguggacagauuuuuuu

SEQ ID NO: 192575 - RNA, 22 nt, Human
augaagugcccugggggccaga

SEQ ID NO: 192576 - RNA, 22 nt, Human
augauuaagguacgucauuucu

SEQ ID NO: 192577 - RNA, 22 nt, Human
augauuacagcaugauguuuca

SEQ ID NO: 192578 - RNA, 22 nt, Human
augauggagaacaaagaaaauc

SEQ ID NO: 192579 - RNA, 22 nt, Human
augacagcuaaggaauguguag

SEQ ID NO: 192580 - RNA, 22 nt, Human
augaauuugaacaccagguugg

SEQ ID NO: 192581 - RNA, 22 nt, Human
augauuuguuaacagacuuaau

SEQ ID NO: 192582 - RNA, 22 nt, Human
augcagaaucucuuuccugagg

SEQ ID NO: 192583 - RNA, 22 nt, Human
augauucuaccaaugccaucuu

SEQ ID NO: 192584 - RNA, 22 nt, Human
augauuauuugaaugaagagga

SEQ ID NO: 192585 - RNA, 22 nt, Human
augacagcucuagcacacagua

SEQ ID NO: 192586 - RNA, 22 nt, Human
augaccauccagaaguccagcu

SEQ ID NO: 192587 - RNA, 19 nt, Human
augagccccaguucguucc

SEQ ID NO: 192588 - RNA, 22 nt, Human
augagaaauaauuguguacuga

SEQ ID NO: 192589 - RNA, 22 nt, Human
aucugucagaccuuggucacag

SEQ ID NO: 192590 - RNA, 22 nt, Human
aucugggaaggggaaaaugcug

SEQ ID NO: 192591 - RNA, 20 nt, Human
aucugguggggaauaacuuc

SEQ ID NO: 192592 - RNA, 22 nt, Human
aucuucaaagcacaucguuugu

SEQ ID NO: 192593 - RNA, 20 nt, Human
aucuuaucuaucuuuuguuc

SEQ ID NO: 192594 - RNA, 22 nt, Human
aucuucaaggacgccaagaucc

SEQ ID NO: 192595 - RNA, 22 nt, Human
aucuucucucucaucaggauca

SEQ ID NO: 192596 - RNA, 22 nt, Human
augaggaacagcaagaauauuu

SEQ ID NO: 192597 - RNA, 22 nt, Human
augacuguuaugaggugggugg

SEQ ID NO: 192598 - RNA, 22 nt, Human
augagaguuagccugcauaguu

SEQ ID NO: 192599 - RNA, 22 nt, Human
augagcuaagcagaaagcacac

SEQ ID NO: 192600 - RNA, 22 nt, Human
aucuauguaucucagaagcuag

SEQ ID NO: 192601 - RNA, 19 nt, Human
augaaauagcauuuucuga

SEQ ID NO: 192602 - RNA, 22 nt, Human
aucugcugcuccuucuucuugc

SEQ ID NO: 192603 - RNA, 22 nt, Human
aucugcugccuaggguuugucu

SEQ ID NO: 192604 - RNA, 23 nt, Human
augaacgcacugagaucauaauu

SEQ ID NO: 192605 - RNA, 22 nt, Human
auuaugcagcugccuccaaggu

SEQ ID NO: 192606 - RNA, 22 nt, Human
auuauucuuugggaaaguugaa

SEQ ID NO: 192607 - RNA, 22 nt, Human
auuauucaaggugaggguaaaa

SEQ ID NO: 192608 - RNA, 22 nt, Human
auuauuugcuuaagcuggucuc

SEQ ID NO: 192609 - RNA, 22 nt, Human
auuaagacugcccauguuuuua

SEQ ID NO: 192610 - RNA, 22 nt, Human
auuaaaaaugagaguagggauu

SEQ ID NO: 192611 - RNA, 22 nt, Human
auuaaagcaugaauaauaugua

SEQ ID NO: 192612 - RNA, 22 nt, Human
auuaguccuaguucauucugag

SEQ ID NO: 192613 - RNA, 22 nt, Human
auuccaccccauccucccaggu

SEQ ID NO: 192614 - RNA, 22 nt, Human
auuccauccuggcuuuuuccug

SEQ ID NO: 192615 - RNA, 22 nt, Human
auuccagggaaauggggaugga

SEQ ID NO: 192616 - RNA, 22 nt, Human
auuaagucugacuggauuguau

SEQ ID NO: 192617 - RNA, 22 nt, Human
auucaguucuaaggucagugcc

SEQ ID NO: 192618 - RNA, 22 nt, Human
auucauauagcgcuuacagccu

SEQ ID NO: 192619 - RNA, 22 nt, Human
auguuugugauugcugaaaaga

SEQ ID NO: 192620 - RNA, 22 nt, Human
auuagugguguauuuggcacua

SEQ ID NO: 192621 - RNA, 22 nt, Human
auuagcaccccuggauguggga

SEQ ID NO: 192622 - RNA, 22 nt, Human
auguuuucauuuagaagcuaau

SEQ ID NO: 192623 - RNA, 22 nt, Human
auguuuugaguuuuuuuacacc

SEQ ID NO: 192624 - RNA, 22 nt, Human
auguuuuaaaaaacaggcuacc

SEQ ID NO: 192625 - RNA, 22 nt, Human
auuaugaauuguguuacgaaga

SEQ ID NO: 192626 - RNA, 22 nt, Human
auuauaguuuugcccuuaagaa

SEQ ID NO: 192627 - RNA, 22 nt, Human
auuaucugacugaguagucugu

SEQ ID NO: 192628 - RNA, 22 nt, Human
auguuuuuugaaaauguauuuu

SEQ ID NO: 192629 - RNA, 22 nt, Human
auuacugaggcaaaguaguuuu

SEQ ID NO: 192630 - RNA, 22 nt, Human
auuaaguuauuaagcuaaauau

SEQ ID NO: 192631 - RNA, 22 nt, Human
auuaauaucaauauauuauaug

SEQ ID NO: 192632 - RNA, 22 nt, Human
auguuuaauuugaaauuuuauu

SEQ ID NO: 192633 - RNA, 19 nt, Human
auguucugaauuacuguaa

SEQ ID NO: 192634 - RNA, 18 nt, Human
auguuccugcaguuauuu

SEQ ID NO: 192635 - RNA, 22 nt, Human
auguucucagguuguauuuauu

SEQ ID NO: 192636 - RNA, 22 nt, Human
auguucccaaaaucccuguaga

SEQ ID NO: 192637 - RNA, 22 nt, Human
augugaaagagguguucagugg

SEQ ID NO: 192638 - RNA, 22 nt, Human
auguccugguccacagaaggga

SEQ ID NO: 192639 - RNA, 22 nt, Human
auguuccaugacuaugcaugaa

SEQ ID NO: 192640 - RNA, 22 nt, Human
auguuagcaucuggcacuaugg

SEQ ID NO: 192641 - RNA, 22 nt, Human
auguauuuauguauguguuaua

SEQ ID NO: 192642 - RNA, 22 nt, Human
auguaaauauuuauauaugcau

SEQ ID NO: 192643 - RNA, 22 nt, Human
augguuuugugaaaaugcuuug

SEQ ID NO: 192644 - RNA, 22 nt, Human
augguuuuguccucuuugguuc

SEQ ID NO: 192645 - RNA, 22 nt, Human
augugccuuaauauaggcgcug

SEQ ID NO: 192646 - RNA, 22 nt, Human
augugcauguauguaucauauu

SEQ ID NO: 192647 - RNA, 22 nt, Human
augugccugagggcuccuugug

SEQ ID NO: 192648 - RNA, 23 nt, Human
augugaggcaaaggcaggcacuc

SEQ ID NO: 192649 - RNA, 22 nt, Human
augugcacuggugugugcguuc

SEQ ID NO: 192650 - RNA, 22 nt, Human
augugauacuccuucuagugga

SEQ ID NO: 192651 - RNA, 22 nt, Human
auguugagaaucucucuucuaa

SEQ ID NO: 192652 - RNA, 22 nt, Human
augugaaccuggguccugggcc

SEQ ID NO: 192653 - RNA, 22 nt, Human
augugggguaggaggggggaau

SEQ ID NO: 192654 - RNA, 22 nt, Human
auguguuuccaacagagaggga

SEQ ID NO: 192655 - RNA, 21 nt, Human
auguguucugauagugcuugc

SEQ ID NO: 192656 - RNA, 22 nt, Human
augugugugcgagcgugugugu

SEQ ID NO: 192657 - RNA, 22 nt, Human
auguguguaugugugcauguau

SEQ ID NO: 192658 - RNA, 22 nt, Human
auggcuguguuguuccucugaa

SEQ ID NO: 192659 - RNA, 22 nt, Human
auggcuucugucuuggaaauuu

SEQ ID NO: 192660 - RNA, 20 nt, Human
auggcgagucagcacaaaac

SEQ ID NO: 192661 - RNA, 22 nt, Human
auggccuuucucaguggugcuu

SEQ ID NO: 192662 - RNA, 22 nt, Human
auggcaucuucgguuggacugc

SEQ ID NO: 192663 - RNA, 22 nt, Human
auggcucugcugggcaaagcaa

SEQ ID NO: 192664 - RNA, 18 nt, Human
auggcuccagugucuucc

SEQ ID NO: 192665 - RNA, 22 nt, Human
augguugugaaagagcaaagac

SEQ ID NO: 192666 - RNA, 22 nt, Human
augguugccugagauaagacug

SEQ ID NO: 192667 - RNA, 22 nt, Human
auguaacauaugugaucgcauu

SEQ ID NO: 192668 - RNA, 22 nt, Human
auguaaugucaaucuucagugg

SEQ ID NO: 192669 - RNA, 22 nt, Human
auguaugagagauucuuuuauu

SEQ ID NO: 192670 - RNA, 22 nt, Human
augguugggggaugucagcagg

SEQ ID NO: 192671 - RNA, 20 nt, Human
augucaggaagggagucagg

SEQ ID NO: 192672 - RNA, 22 nt, Human
augugaaauuugggcucuggga

SEQ ID NO: 192673 - RNA, 22 nt, Human
auauuguagcaucacugucuug

SEQ ID NO: 192674 - RNA, 22 nt, Human
auauugagagagugagguguag

SEQ ID NO: 192675 - RNA, 22 nt, Human
auauugcuuuauucuugaauau

SEQ ID NO: 192676 - RNA, 22 nt, Human
auauguuaugccauuuucaagg

SEQ ID NO: 192677 - RNA, 22 nt, Human
auauuuuacagcucucguugaa

SEQ ID NO: 192678 - RNA, 22 nt, Human
aucaacucacagugugcuggca

SEQ ID NO: 192679 - RNA, 20 nt, Human
aucaagugucuugccaggca

SEQ ID NO: 192680 - RNA, 22 nt, Human
auauuuguacagcuugugaguu

SEQ ID NO: 192681 - RNA, 22 nt, Human
auauuucuacaggcugauuuua

SEQ ID NO: 192682 - RNA, 22 nt, Human
auauuugucuguuuuaguggca

SEQ ID NO: 192683 - RNA, 22 nt, Human
auauuugcccccaugcccuggc

SEQ ID NO: 192684 - RNA, 21 nt, Human
auauuguugggguuuucuuuu

SEQ ID NO: 192685 - RNA, 22 nt, Human
aucaaguuauuaaguagcuuuc

SEQ ID NO: 192686 - RNA, 22 nt, Human
auauuuuugcagaauuuuucgu

SEQ ID NO: 192687 - RNA, 22 nt, Human
aucaaaauguguagucuugauc

SEQ ID NO: 192688 - RNA, 22 nt, Human
aucagaagaaauggaugugacu

SEQ ID NO: 192689 - RNA, 22 nt, Human
aucacaaauggaaucaccuccc

SEQ ID NO: 192690 - RNA, 22 nt, Human
aucagcucuugaugccuuucuu

SEQ ID NO: 192691 - RNA, 20 nt, Human
aucaggagucgcggggagag

SEQ ID NO: 192692 - RNA, 22 nt, Human
aucaaaauuuucagauacuaca

SEQ ID NO: 192693 - RNA, 22 nt, Human
aucaauaaccauagugguuaca

SEQ ID NO: 192694 - RNA, 22 nt, Human
aucagugcacgcgaugggcaga

SEQ ID NO: 192695 - RNA, 22 nt, Human
aucaucccuuucucccagugaa

SEQ ID NO: 192696 - RNA, 22 nt, Human
aucacacaccuguuaaauugug

SEQ ID NO: 192697 - RNA, 22 nt, Human
aucacugcaggcauauaggggu

SEQ ID NO: 192698 - RNA, 21 nt, Human
aucagaaucucuagauuugga

SEQ ID NO: 192699 - RNA, 22 nt, Human
aucaugggauagugggacgagc

SEQ ID NO: 192700 - RNA, 19 nt, Human
aucagcaguuuugccugga

SEQ ID NO: 192701 - RNA, 22 nt, Human
aucagagcuaguacuugcaggu

SEQ ID NO: 192702 - RNA, 17 nt, Human
aucagaggauaggacaa

SEQ ID NO: 192703 - RNA, 22 nt, Human
aucauguuauguacaaauauga

SEQ ID NO: 192704 - RNA, 22 nt, Human
auccaggggucugaauggauau

SEQ ID NO: 192705 - RNA, 22 nt, Human
auccacggucaauuccccaucc

SEQ ID NO: 192706 - RNA, 22 nt, Human
auccacccugcaggccaacucu

SEQ ID NO: 192707 - RNA, 18 nt, Human
auccuucggccuagugga

SEQ ID NO: 192708 - RNA, 20 nt, Human
auccuggucuuuggaagcuu

SEQ ID NO: 192709 - RNA, 22 nt, Human
auccuggcuuuccugauuuacu

SEQ ID NO: 192710 - RNA, 22 nt, Human
auccugugggguauugcugcau

SEQ ID NO: 192711 - RNA, 22 nt, Human
auccugauggaaacugguauga

SEQ ID NO: 192712 - RNA, 22 nt, Human
auccuugacuguagugauauua

SEQ ID NO: 192713 - RNA, 22 nt, Human
auccuucaaaaggaauagcagg

SEQ ID NO: 192714 - RNA, 18 nt, Human
auccuuugaucaucuguc

SEQ ID NO: 192715 - RNA, 22 nt, Human
auccucaaggaauuaaauaggg

SEQ ID NO: 192716 - RNA, 22 nt, Human
auccuccuggggcagucuuccc

SEQ ID NO: 192717 - RNA, 22 nt, Human
auccgugagcgagcgagcaccc

SEQ ID NO: 192718 - RNA, 22 nt, Human
auccuccuuugcccugagauca

SEQ ID NO: 192719 - RNA, 22 nt, Human
aucguuaugauagagaaagaga

SEQ ID NO: 192720 - RNA, 22 nt, Human
aucggucuccuauaauucaaac

SEQ ID NO: 192721 - RNA, 22 nt, Human
aucgcagaguggaaauugauga

SEQ ID NO: 192722 - RNA, 22 nt, Human
aucuaaaacuacgaauacuacc

SEQ ID NO: 192723 - RNA, 22 nt, Human
aucaugcugacacaguuuaucu

SEQ ID NO: 192724 - RNA, 22 nt, Human
aucaugcgguuaaggagugugu

SEQ ID NO: 192725 - RNA, 22 nt, Human
aucaucuaaaauuggcucagau

SEQ ID NO: 192726 - RNA, 22 nt, Human
auccagaaguauuuuggguacu

SEQ ID NO: 192727 - RNA, 22 nt, Human
aucauccuagaaggaagcuagg

SEQ ID NO: 192728 - RNA, 22 nt, Human
aucauuuggaaauuuggccuaa

SEQ ID NO: 192729 - RNA, 22 nt, Human
aucauuuuuauuagcugggguu

SEQ ID NO: 192730 - RNA, 22 nt, Human
aucauuugaacagaauuuguuu

SEQ ID NO: 192731 - RNA, 22 nt, Human
aucauaugugauaccauaauga

SEQ ID NO: 192732 - RNA, 22 nt, Human
aucccuggccacgaagcugccc

SEQ ID NO: 192733 - RNA, 22 nt, Human
auccaggguuggggucacgagu

SEQ ID NO: 192734 - RNA, 22 nt, Human
aucauguauauuuuugcuauua

SEQ ID NO: 192735 - RNA, 22 nt, Human
auccucugcucaugagaaaugu

SEQ ID NO: 192736 - RNA, 22 nt, Human
aucaugugacuagguuuggcca

SEQ ID NO: 192737 - RNA, 20 nt, Human
aucaugugcacugcugacag

SEQ ID NO: 192738 - RNA, 22 nt, Human
aucauuaacagugcagggguag

SEQ ID NO: 192739 - RNA, 23 nt, Human
aucauuucuuagugagucccugc

SEQ ID NO: 192740 - RNA, 22 nt, Human
aucauugcuaguaaggaucuug

SEQ ID NO: 192741 - RNA, 22 nt, Human
aucauugaaaauuuaugcauuu

SEQ ID NO: 192742 - RNA, 22 nt, Human
auauucaaugaggucauauaag

SEQ ID NO: 192743 - RNA, 22 nt, Human
auauuauuaaaauagauggaua

SEQ ID NO: 192744 - RNA, 21 nt, Human
auauugguaucuuuuuaaauc

SEQ ID NO: 192745 - RNA, 22 nt, Human
auauccugguucuaucaaaagg

SEQ ID NO: 192746 - RNA, 22 nt, Human
auaucugaugacgugacuaugu

SEQ ID NO: 192747 - RNA, 22 nt, Human
auauguaguuucagaaguggaa

SEQ ID NO: 192748 - RNA, 21 nt, Human
auauggauauuauuuuguguc

SEQ ID NO: 192749 - RNA, 22 nt, Human
auauggugauuuuaugcaggaa

SEQ ID NO: 192750 - RNA, 22 nt, Human
auauuuguuagcugcuuuggag

SEQ ID NO: 192751 - RNA, 23 nt, Human
auaugucaugcaccagcacuuua

SEQ ID NO: 192752 - RNA, 22 nt, Human
auaucuuguuuuugauuucuug

SEQ ID NO: 192753 - RNA, 22 nt, Human
auaugcagaaaauaaaggaauu

SEQ ID NO: 192754 - RNA, 22 nt, Human
auaugcacauguacauguauau

SEQ ID NO: 192755 - RNA, 22 nt, Human
auauaguacauguauauauaua

SEQ ID NO: 192756 - RNA, 22 nt, Human
auauaguuggguuucauucuac

SEQ ID NO: 192757 - RNA, 22 nt, Human
auagaugaggaaauucaggugc

SEQ ID NO: 192758 - RNA, 22 nt, Human
auagauguauucauuguuuggc

SEQ ID NO: 192759 - RNA, 22 nt, Human
auauaugcaacaagaaagcaua

SEQ ID NO: 192760 - RNA, 22 nt, Human
auauaaugugugcuuuauugaa

SEQ ID NO: 192761 - RNA, 22 nt, Human
auauauguauauacacauauau

SEQ ID NO: 192762 - RNA, 22 nt, Human
auauauguauauaugugugugu

SEQ ID NO: 192763 - RNA, 22 nt, Human
auaggcggagccauaucaucca

SEQ ID NO: 192764 - RNA, 22 nt, Human
auaggcauaacacugauguccu

SEQ ID NO: 192765 - RNA, 22 nt, Human
auaggggagcagccagagaaga

SEQ ID NO: 192766 - RNA, 22 nt, Human
auaguaaauguuaacagcaaca

SEQ ID NO: 192767 - RNA, 22 nt, Human
auaguguguaaagugcagugau

SEQ ID NO: 192768 - RNA, 22 nt, Human
auaugagaggaggagcaucagu

SEQ ID NO: 192769 - RNA, 22 nt, Human
auaugaagaaugaucugaagua

SEQ ID NO: 192770 - RNA, 22 nt, Human
auauaagauaauaacuuuuuua

SEQ ID NO: 192771 - RNA, 22 nt, Human
auauaacccaaggcaggcugug

SEQ ID NO: 192772 - RNA, 22 nt, Human
auaguuuuagauacugagaaaa

SEQ ID NO: 192773 - RNA, 22 nt, Human
auagaguguguguuauguguga

SEQ ID NO: 192774 - RNA, 22 nt, Human
auagaguucucuuuggaggagu

SEQ ID NO: 192775 - RNA, 22 nt, Human
auauaaugcaguaggugauuaa

SEQ ID NO: 192776 - RNA, 23 nt, Human
auagucaggaacuguuggugugu

SEQ ID NO: 192777 - RNA, 22 nt, Human
auagagcuggggaagaagcugg

SEQ ID NO: 192778 - RNA, 22 nt, Human
auagacuagccaaagacuucug

SEQ ID NO: 192779 - RNA, 22 nt, Human
auagacacagcuaugauuugag

SEQ ID NO: 192780 - RNA, 18 nt, Human
auagacaggaaaaaugga

SEQ ID NO: 192781 - RNA, 22 nt, Human
auagggaggcggagggagcugg

SEQ ID NO: 192782 - RNA, 22 nt, Human
auagcaguauuaugagauaacu

SEQ ID NO: 192783 - RNA, 20 nt, Human
auacuuguuuucaggcuuuu

SEQ ID NO: 192784 - RNA, 22 nt, Human
auagcuauuauuauuucuguua

SEQ ID NO: 192785 - RNA, 22 nt, Human
auagcaacucugcuuccuugcc

SEQ ID NO: 192786 - RNA, 22 nt, Human
auaccaguagaggacugcccaa

SEQ ID NO: 192787 - RNA, 22 nt, Human
auaccaaugacaggaguuaggg

SEQ ID NO: 192788 - RNA, 22 nt, Human
auagaaauagacaaugcaaaga

SEQ ID NO: 192789 - RNA, 22 nt, Human
auacuucaccuaacccaguuuc

SEQ ID NO: 192790 - RNA, 21 nt, Human
auacaguucagcuuuuacuau

SEQ ID NO: 192791 - RNA, 19 nt, Human
auagagggaauguuuuccu

SEQ ID NO: 192792 - RNA, 20 nt, Human
auagaguggugugucacauu

SEQ ID NO: 192793 - RNA, 22 nt, Human
auaccaaugaaucccugagaau

SEQ ID NO: 192794 - RNA, 22 nt, Human
auagauugcucauauauuacuu

SEQ ID NO: 192795 - RNA, 22 nt, Human
auagauuuuaucagauuuuauc

SEQ ID NO: 192796 - RNA, 22 nt, Human
auagaugacaguuaggaagcug

SEQ ID NO: 192797 - RNA, 22 nt, Human
agugagcuuuuaaaauuuacca

SEQ ID NO: 192798 - RNA, 22 nt, Human
agugacauuauuuuguguacua

SEQ ID NO: 192799 - RNA, 22 nt, Human
auagaauggcaccagcaucuac

SEQ ID NO: 192800 - RNA, 23 nt, Human
auacuuuuuuucuacguuaucuc

SEQ ID NO: 192801 - RNA, 23 nt, Human
agugaagcugguuagugaugacc

SEQ ID NO: 192802 - RNA, 22 nt, Human
agugacuguccuacuuuguaga

SEQ ID NO: 192803 - RNA, 22 nt, Human
uuuuuuuguagguguaugaaaa

SEQ ID NO: 192804 - RNA, 22 nt, Human
uuuuuuccuguuugucuuuggg

SEQ ID NO: 192805 - RNA, 22 nt, Human
uuuuuugucuugaagaaauggu

SEQ ID NO: 192806 - RNA, 22 nt, Human
uuuuuuguggcuggaagaaaaa

SEQ ID NO: 192807 - RNA, 19 nt, Human
uuuuucccccucuccucag

SEQ ID NO: 192808 - RNA, 22 nt, Human
uuuuucuuugguaacucuuccu

SEQ ID NO: 192809 - RNA, 22 nt, Human
uuuuugaauaagugcaucauca

SEQ ID NO: 192810 - RNA, 22 nt, Human
uuuuucugacugcuaacaaaaa

SEQ ID NO: 192811 - RNA, 22 nt, Human
uuuuuguaaaugaaguuuuauu

SEQ ID NO: 192812 - RNA, 22 nt, Human
uuuuuaaaagaugauuuaauga

SEQ ID NO: 192813 - RNA, 22 nt, Human
uuuuguuacugauuauuaaaau

SEQ ID NO: 192814 - RNA, 22 nt, Human
uuuuuagcauaugucaaaucag

SEQ ID NO: 192815 - RNA, 22 nt, Human
uuuuuaccugguguccagcuuc

SEQ ID NO: 192816 - RNA, 22 nt, Human
uuuuuauaagagcagcagaguu

SEQ ID NO: 192817 - RNA, 22 nt, Human
uuuuuauguaaaauauuaaaag

SEQ ID NO: 192818 - RNA, 22 nt, Human
uuuuucacacuccuuuccaguu

SEQ ID NO: 192819 - RNA, 20 nt, Human
uuuuguccaccugcaggaag

SEQ ID NO: 192820 - RNA, 22 nt, Human
uuuugucuguggaaagcugcua

SEQ ID NO: 192821 - RNA, 18 nt, Human
uuuuguguuuauucugca

SEQ ID NO: 192822 - RNA, 22 nt, Human
uuuuguggacugauccgaggac

SEQ ID NO: 192823 - RNA, 22 nt, Human
uuuuguggacugugagggugca

SEQ ID NO: 192824 - RNA, 22 nt, Human
uuuugguaguccagaguuuagu

SEQ ID NO: 192825 - RNA, 22 nt, Human
uuuugguuugaguauuuuuuuu

SEQ ID NO: 192826 - RNA, 22 nt, Human
uuuuggauugcuaacucagggu

SEQ ID NO: 192827 - RNA, 22 nt, Human
uuuugggugcaaauuguuuguu

SEQ ID NO: 192828 - RNA, 22 nt, Human
uuuuccccuacuaacacugagu

SEQ ID NO: 192829 - RNA, 22 nt, Human
uuuucauagccagaaacugaaa

SEQ ID NO: 192830 - RNA, 22 nt, Human
uuuucauuguuaguuucuccuu

SEQ ID NO: 192831 - RNA, 22 nt, Human
uuuuccuucugauacuccauuu

SEQ ID NO: 192832 - RNA, 22 nt, Human
uuuuccuucuuccugccuugcc

SEQ ID NO: 192833 - RNA, 22 nt, Human
uuuucucacugagagccuugau

SEQ ID NO: 192834 - RNA, 22 nt, Human
uuuucucucacuucacauauuu

SEQ ID NO: 192835 - RNA, 22 nt, Human
uuuucucuuugcuucucuaaaa

SEQ ID NO: 192836 - RNA, 22 nt, Human
uuuucugauccuucuaacuuga

SEQ ID NO: 192837 - RNA, 22 nt, Human
uuuucuuggaguggcuguccuu

SEQ ID NO: 192838 - RNA, 22 nt, Human
uuuugaauaauucagaaacagc

SEQ ID NO: 192839 - RNA, 22 nt, Human
uuuugcaaauuacuaaauuucu

SEQ ID NO: 192840 - RNA, 22 nt, Human
uuuuauaauacccuugacuaau

SEQ ID NO: 192841 - RNA, 22 nt, Human
uuuuaucagagcuugcagugug

SEQ ID NO: 192842 - RNA, 22 nt, Human
uuuuagccagaguuuaucacag

SEQ ID NO: 192843 - RNA, 22 nt, Human
uuuuagccagcaucugggucga

SEQ ID NO: 192844 - RNA, 22 nt, Human
uuuucaauuuucauuugcaaga

SEQ ID NO: 192845 - RNA, 22 nt, Human
uuuucaaucaaguuuauuuaua

SEQ ID NO: 192846 - RNA, 19 nt, Human
uuuucaacguccgguucau

SEQ ID NO: 192847 - RNA, 22 nt, Human
uuuuaucuuacauggaaucucc

SEQ ID NO: 192848 - RNA, 22 nt, Human
uuuuacaaugcaaauucuugcu

SEQ ID NO: 192849 - RNA, 23 nt, Human
uuuuaauaguaugacaugagcug

SEQ ID NO: 192850 - RNA, 22 nt, Human
uuuuaaucagguauuugaguau

SEQ ID NO: 192851 - RNA, 22 nt, Human
uuuuaacuuuaccauuucuuca

SEQ ID NO: 192852 - RNA, 22 nt, Human
uuuuaauaguauaucuagacac

SEQ ID NO: 192853 - RNA, 22 nt, Human
uuuuaaauaaacuacacugauu

SEQ ID NO: 192854 - RNA, 22 nt, Human
uuuuaaaguaauugaagcuugu

SEQ ID NO: 192855 - RNA, 22 nt, Human
uuuuaaaagguugcuguuauaa

SEQ ID NO: 192856 - RNA, 21 nt, Human
uuuguucacacacagggcagc

SEQ ID NO: 192857 - RNA, 22 nt, Human
uuuagagauaaaugcucuccca

SEQ ID NO: 192858 - RNA, 22 nt, Human
uuuaaugucuuggaaaaagacu

SEQ ID NO: 192859 - RNA, 19 nt, Human
uuuaaugugugcugcaauc

SEQ ID NO: 192860 - RNA, 22 nt, Human
uuuguuuccagccuuuugucuu

SEQ ID NO: 192861 - RNA, 22 nt, Human
uuuguuuauuuacuuugggccu

SEQ ID NO: 192862 - RNA, 22 nt, Human
uuuguuuuggugucaugcguga

SEQ ID NO: 192863 - RNA, 23 nt, Human
uuuguugguuuaagaguagcaga

SEQ ID NO: 192864 - RNA, 22 nt, Human
uuuguugguugcacuggugggu

SEQ ID NO: 192865 - RNA, 22 nt, Human
uuuguucuucucaugcacacaa

SEQ ID NO: 192866 - RNA, 22 nt, Human
uuuuucagacuaauagggcaua

SEQ ID NO: 192867 - RNA, 22 nt, Human
uuuuuauaagauuuaaaaugua

SEQ ID NO: 192868 - RNA, 22 nt, Human
uuuuucuccucucucuuucauu

SEQ ID NO: 192869 - RNA, 22 nt, Human
uuuuucuccauuccaggugccu

SEQ ID NO: 192870 - RNA, 21 nt, Human
uuuuucuccagaguuuccacu

SEQ ID NO: 192871 - RNA, 22 nt, Human
uuuuuagcuguuauuguggaag

SEQ ID NO: 192872 - RNA, 22 nt, Human
uuuuuaagguuuguuuauauau

SEQ ID NO: 192873 - RNA, 22 nt, Human
uuuuuaauuuuaagcuauuugu

SEQ ID NO: 192874 - RNA, 22 nt, Human
uucuugagaacaaauuccugga

SEQ ID NO: 192875 - RNA, 21 nt, Human
uuuuguguugcgcacuuugag

SEQ ID NO: 192876 - RNA, 22 nt, Human
uucuuaaugcauccuguguuca

SEQ ID NO: 192877 - RNA, 22 nt, Human
uuuuguagauuggaaaaucugg

SEQ ID NO: 192878 - RNA, 22 nt, Human
uuuugucagggcaggaggaaga

SEQ ID NO: 192879 - RNA, 22 nt, Human
uuuuguagauagggaaacagag

SEQ ID NO: 192880 - RNA, 19 nt, Human
uucuguggucccaggccuu

SEQ ID NO: 192881 - RNA, 22 nt, Human
uucuguguauggaagaaugucc

SEQ ID NO: 192882 - RNA, 22 nt, Human
uugaauggaauuggaaucuuau

SEQ ID NO: 192883 - RNA, 22 nt, Human
uuuuuugguuuggggauuauuu

SEQ ID NO: 192884 - RNA, 22 nt, Human
uuuuuuuagaaagaucauaguu

SEQ ID NO: 192885 - RNA, 22 nt, Human
uuuuuuuaaguuuugauuuuag

SEQ ID NO: 192886 - RNA, 22 nt, Human
uuuuuuguuccuugguuuuugu

SEQ ID NO: 192887 - RNA, 18 nt, Human
uuuuuuguucuguuuugu

SEQ ID NO: 192888 - RNA, 22 nt, Human
uugacucuuucauuuauuauuu

SEQ ID NO: 192889 - RNA, 22 nt, Human
uugacuauacucuggcggaaaa

SEQ ID NO: 192890 - RNA, 22 nt, Human
uuuuuuuuacuccggacagcuc

SEQ ID NO: 192891 - RNA, 22 nt, Human
uugaggucuguguaggcagcaa

SEQ ID NO: 192892 - RNA, 22 nt, Human
uugaggaagggaggcaaaacug

SEQ ID NO: 192893 - RNA, 22 nt, Human
uugaaaaguuuguuacucacau

SEQ ID NO: 192894 - RNA, 22 nt, Human
uugaaaacugucaccuuuauuc

SEQ ID NO: 192895 - RNA, 20 nt, Human
uugaaagucagggcuccagu

SEQ ID NO: 192896 - RNA, 22 nt, Human
uuuuuguauaugcuucgaggau

SEQ ID NO: 192897 - RNA, 22 nt, Human
uuuuuguggggggcggugugaa

SEQ ID NO: 192898 - RNA, 22 nt, Human
uuuuuguuauuuagguguagag

SEQ ID NO: 192899 - RNA, 22 nt, Human
uugaaccaggauaaacauagaa

SEQ ID NO: 192900 - RNA, 22 nt, Human
uugaacucagcuacugguuggu

SEQ ID NO: 192901 - RNA, 22 nt, Human
uuuuuucuggaguuugggguuu

SEQ ID NO: 192902 - RNA, 22 nt, Human
uuuuuucuucucuaucuuaaua

SEQ ID NO: 192903 - RNA, 22 nt, Human
uuuuacgucuuugcugccucgu

SEQ ID NO: 192904 - RNA, 22 nt, Human
uuuuacauuuuauucguuuauu

SEQ ID NO: 192905 - RNA, 22 nt, Human
uuuguucuagauaacugguaau

SEQ ID NO: 192906 - RNA, 22 nt, Human
uuccuaagugcugguaugaggc

SEQ ID NO: 192907 - RNA, 22 nt, Human
uucuacauugugaaguucuuua

SEQ ID NO: 192908 - RNA, 22 nt, Human
uucuaauauuaugauuucuaag

SEQ ID NO: 192909 - RNA, 22 nt, Human
uuuuauaaaaccuguuugaccu

SEQ ID NO: 192910 - RNA, 22 nt, Human
uuuuaguaauacuuuggccuuu

SEQ ID NO: 192911 - RNA, 20 nt, Human
uucguuucaguguuggauca

SEQ ID NO: 192912 - RNA, 22 nt, Human
uucuccugcccuuggacuucca

SEQ ID NO: 192913 - RNA, 22 nt, Human
uucucuauuugcugcaccucuc

SEQ ID NO: 192914 - RNA, 20 nt, Human
uucuccacaggguggaggag

SEQ ID NO: 192915 - RNA, 22 nt, Human
uucuagccauagaaauuagauu

SEQ ID NO: 192916 - RNA, 22 nt, Human
uucuaggagucugguuccugcc

SEQ ID NO: 192917 - RNA, 22 nt, Human
uuuucaacuuuauuuuccccca

SEQ ID NO: 192918 - RNA, 22 nt, Human
uuuuauuuguauguugaaugua

SEQ ID NO: 192919 - RNA, 22 nt, Human
uuuugauacaaguuguaaaaaa

SEQ ID NO: 192920 - RNA, 22 nt, Human
uucuggagacccagcaacaggg

SEQ ID NO: 192921 - RNA, 22 nt, Human
uucuggccagggaagagggguc

SEQ ID NO: 192922 - RNA, 22 nt, Human
uuuugaugaccauucuucuuuu

SEQ ID NO: 192923 - RNA, 22 nt, Human
uucuggacuuccaaauggcuuc

SEQ ID NO: 192924 - RNA, 22 nt, Human
uucugcuuuaaagcucauguuu

SEQ ID NO: 192925 - RNA, 21 nt, Human
uucugcuguucaccaccaccc

SEQ ID NO: 192926 - RNA, 19 nt, Human
uucugguacauacugccug

SEQ ID NO: 192927 - RNA, 22 nt, Human
uucuggugauuugccucuuuag

SEQ ID NO: 192928 - RNA, 22 nt, Human
uucugggguaagcacugaggau

SEQ ID NO: 192929 - RNA, 22 nt, Human
uucuggucucucugaccuagga

SEQ ID NO: 192930 - RNA, 22 nt, Human
uucugucaguguugguggaaau

SEQ ID NO: 192931 - RNA, 22 nt, Human
uucucuggggacugucucuauu

SEQ ID NO: 192932 - RNA, 20 nt, Human
uucucugcagcaggcggccc

SEQ ID NO: 192933 - RNA, 22 nt, Human
uuuucacugacuuggucuggaa

SEQ ID NO: 192934 - RNA, 22 nt, Human
uuuuccuguccuugggucugca

SEQ ID NO: 192935 - RNA, 22 nt, Human
uuuuccuuaacagagggagaaa

SEQ ID NO: 192936 - RNA, 22 nt, Human
uucugaaggcaggggcuaucuu

SEQ ID NO: 192937 - RNA, 18 nt, Human
uucugcggugacagauau

SEQ ID NO: 192938 - RNA, 22 nt, Human
uucugcuagugguauauguuga

SEQ ID NO: 192939 - RNA, 22 nt, Human
uucugauacagucccaacacaa

SEQ ID NO: 192940 - RNA, 22 nt, Human
uucugaguguugucaccaugug

SEQ ID NO: 192941 - RNA, 22 nt, Human
uuggggggucagacuugauaca

SEQ ID NO: 192942 - RNA, 22 nt, Human
uuggggcugcguauuuccaugu

SEQ ID NO: 192943 - RNA, 22 nt, Human
uugguauuuguuuaaauuacac

SEQ ID NO: 192944 - RNA, 22 nt, Human
uuggcagagaacagaaugauuu

SEQ ID NO: 192945 - RNA, 22 nt, Human
uuggcaggcugcauguuuaugu

SEQ ID NO: 192946 - RNA, 22 nt, Human
uuggcauuccagaugcuuuucu

SEQ ID NO: 192947 - RNA, 22 nt, Human
uuggucagaugugucuccuccu

SEQ ID NO: 192948 - RNA, 22 nt, Human
uuggugaugcuaggaauguagu

SEQ ID NO: 192949 - RNA, 22 nt, Human
uuggugaugcccaccuuuucau

SEQ ID NO: 192950 - RNA, 22 nt, Human
uuguacuuguucuguuuccuug

SEQ ID NO: 192951 - RNA, 22 nt, Human
uuguaugcugggaagcgggagg

SEQ ID NO: 192952 - RNA, 21 nt, Human
uuguccacacacaccaacugc

SEQ ID NO: 192953 - RNA, 22 nt, Human
uugucuguacuggcugcaucga

SEQ ID NO: 192954 - RNA, 22 nt, Human
uuuaaaacaguacguuuucuua

SEQ ID NO: 192955 - RNA, 23 nt, Human
uuuaaacaauguggucguggugg

SEQ ID NO: 192956 - RNA, 22 nt, Human
uuguuuucuaguguuuugaaua

SEQ ID NO: 192957 - RNA, 22 nt, Human
uuguuuucuugaugaaauuauu

SEQ ID NO: 192958 - RNA, 22 nt, Human
uuguuuacuugagcugcacucu

SEQ ID NO: 192959 - RNA, 22 nt, Human
uuguuucauggggacgacuggc

SEQ ID NO: 192960 - RNA, 22 nt, Human
uuguuucagcuuccuccuccau

SEQ ID NO: 192961 - RNA, 22 nt, Human
uuguuugcacuuuagagacugu

SEQ ID NO: 192962 - RNA, 22 nt, Human
uuguuugguugacugauuuacc

SEQ ID NO: 192963 - RNA, 20 nt, Human
uuuaacuggccuucuggcuc

SEQ ID NO: 192964 - RNA, 22 nt, Human
uuuaaacuaacaguacacguug

SEQ ID NO: 192965 - RNA, 22 nt, Human
uuuaaaccuuggaagccacaua

SEQ ID NO: 192966 - RNA, 22 nt, Human
uuuaaagucaggcuguaguggu

SEQ ID NO: 192967 - RNA, 22 nt, Human
uuuaacccaaauaaccacagga

SEQ ID NO: 192968 - RNA, 22 nt, Human
uuuaaugguuuauggucuaaga

SEQ ID NO: 192969 - RNA, 22 nt, Human
uuuaaucaguugguaauauuga

SEQ ID NO: 192970 - RNA, 18 nt, Human
uuuaauaagccuguuaug

SEQ ID NO: 192971 - RNA, 23 nt, Human
uugcuugagcccaggaaguggag

SEQ ID NO: 192972 - RNA, 22 nt, Human
uugcuuuuugggguuuacuggg

SEQ ID NO: 192973 - RNA, 22 nt, Human
uuggaagacagccgucuuuauu

SEQ ID NO: 192974 - RNA, 22 nt, Human
uuggagagggugggcuuugaag

SEQ ID NO: 192975 - RNA, 22 nt, Human
uuggacugggauggccgaggcu

SEQ ID NO: 192976 - RNA, 22 nt, Human
uugcuuuuuuggguuuacuggg

SEQ ID NO: 192977 - RNA, 22 nt, Human
uuggaagugucuaauacaggua

SEQ ID NO: 192978 - RNA, 22 nt, Human
uugcugguggcucugauuucau

SEQ ID NO: 192979 - RNA, 22 nt, Human
uugcugugucauuuguuuaauc

SEQ ID NO: 192980 - RNA, 22 nt, Human
uugcuugcggccuuugugccuu

SEQ ID NO: 192981 - RNA, 22 nt, Human
uugcuuaggccaaauggcgcau

SEQ ID NO: 192982 - RNA, 22 nt, Human
uugcuugaacccaggaagugga

SEQ ID NO: 192983 - RNA, 22 nt, Human
uugcugagcugaaccagccacc

SEQ ID NO: 192984 - RNA, 22 nt, Human
uugcuggaguagaaaacuuaac

SEQ ID NO: 192985 - RNA, 22 nt, Human
uugcacagaugcacaugguugc

SEQ ID NO: 192986 - RNA, 22 nt, Human
uugcaagcccugaagggcugga

SEQ ID NO: 192987 - RNA, 20 nt, Human
uugcaaagugaauagcaauu

SEQ ID NO: 192988 - RNA, 22 nt, Human
uugcaugauuuaagaauaucug

SEQ ID NO: 192989 - RNA, 22 nt, Human
uugcaugugugaaaugcacaga

SEQ ID NO: 192990 - RNA, 22 nt, Human
uugcagagaacuaaagggagua

SEQ ID NO: 192991 - RNA, 18 nt, Human
uugcucucucugggggca

SEQ ID NO: 192992 - RNA, 22 nt, Human
uugcguaauuugagauuguaaa

SEQ ID NO: 192993 - RNA, 22 nt, Human
uugcggauguccacgucacacu

SEQ ID NO: 192994 - RNA, 22 nt, Human
uugcuaagguuuaacuauugga

SEQ ID NO: 192995 - RNA, 20 nt, Human
uugcggccuaacagccccuu

SEQ ID NO: 192996 - RNA, 22 nt, Human
uugcguaucuacauugccugua

SEQ ID NO: 192997 - RNA, 22 nt, Human
uugcccuaccccaggccuuuuu

SEQ ID NO: 192998 - RNA, 22 nt, Human
uuauuguuuggguauaauuuga

SEQ ID NO: 192999 - RNA, 22 nt, Human
uuucucuccucgaaauucuuau

SEQ ID NO: 193000 - RNA, 22 nt, Human
uuauuuaagaucuuaauauaua

SEQ ID NO: 193001 - RNA, 22 nt, Human
uuauuucuucucgaagcuuggg

SEQ ID NO: 193002 - RNA, 22 nt, Human
uuauuucauguaaaauuuaugu

SEQ ID NO: 193003 - RNA, 22 nt, Human
uuucugcauuuguauuggaaaa

SEQ ID NO: 193004 - RNA, 22 nt, Human
uuucucuuguauuugaaucacu

SEQ ID NO: 193005 - RNA, 22 nt, Human
uuucucugggugaugagguggc

SEQ ID NO: 193006 - RNA, 22 nt, Human
uuucugugguggguaguucaga

SEQ ID NO: 193007 - RNA, 22 nt, Human
uuugaugauuuucuagagugua

SEQ ID NO: 193008 - RNA, 22 nt, Human
uuugagguuuagcucacuauuu

SEQ ID NO: 193009 - RNA, 22 nt, Human
uuugagugcccauguuucccag

SEQ ID NO: 193010 - RNA, 22 nt, Human
uucacuguucuuagagaagacc

SEQ ID NO: 193011 - RNA, 22 nt, Human
uuugagaagauaggggaauacu

SEQ ID NO: 193012 - RNA, 22 nt, Human
uuugaauauuaugucccacuuu

SEQ ID NO: 193013 - RNA, 23 nt, Human
uuugaaucauuguggggcuuuug

SEQ ID NO: 193014 - RNA, 22 nt, Human
uuugacaccaggagagaaaaca

SEQ ID NO: 193015 - RNA, 22 nt, Human
uucaacaacuugguucaaaugg

SEQ ID NO: 193016 - RNA, 22 nt, Human
uucaaaccuaucuaagaaauag

SEQ ID NO: 193017 - RNA, 22 nt, Human
uucaaacacugugcaauugggu

SEQ ID NO: 193018 - RNA, 22 nt, Human
uucaaacaguguagaauauaug

SEQ ID NO: 193019 - RNA, 22 nt, Human
uucaaaaugcagaauaguuugg

SEQ ID NO: 193020 - RNA, 22 nt, Human
uuugaagaccuuaucucuaaau

SEQ ID NO: 193021 - RNA, 18 nt, Human
uuucuuuuauuccagguc

SEQ ID NO: 193022 - RNA, 22 nt, Human
uuauuuuuguaacacuguauag

SEQ ID NO: 193023 - RNA, 22 nt, Human
uuauuuucgugugugugugugu

SEQ ID NO: 193024 - RNA, 22 nt, Human
uucauacuguuuaaguucuguu

SEQ ID NO: 193025 - RNA, 18 nt, Human
uuugggauccucuuuucu

SEQ ID NO: 193026 - RNA, 22 nt, Human
uucaguguuagaauuccaagaa

SEQ ID NO: 193027 - RNA, 22 nt, Human
uucaguuugaauucuguagaac

SEQ ID NO: 193028 - RNA, 22 nt, Human
uucaguaugcugaaugauuuuu

SEQ ID NO: 193029 - RNA, 22 nt, Human
uuuggggcucauuugcuuuugu

SEQ ID NO: 193030 - RNA, 22 nt, Human
uuuggguuaguuuuccaaucuu

SEQ ID NO: 193031 - RNA, 23 nt, Human
uuugcaaauuggacacaaccaca

SEQ ID NO: 193032 - RNA, 22 nt, Human
uuugcaggaaauguacugaaug

SEQ ID NO: 193033 - RNA, 22 nt, Human
uucagguuuuuaaguucugccu

SEQ ID NO: 193034 - RNA, 22 nt, Human
uucaggaucuaggaguauuuuu

SEQ ID NO: 193035 - RNA, 22 nt, Human
uuuguguuuugaggucuugcaa

SEQ ID NO: 193036 - RNA, 22 nt, Human
uuuguguuuucaggcacauggc

SEQ ID NO: 193037 - RNA, 22 nt, Human
uuccccaccagagacagagcug

SEQ ID NO: 193038 - RNA, 22 nt, Human
uuuguuaugguuggaagcagga

SEQ ID NO: 193039 - RNA, 22 nt, Human
uuccagguggcuuuccuggggg

SEQ ID NO: 193040 - RNA, 22 nt, Human
uuccagucugggcucuucacug

SEQ ID NO: 193041 - RNA, 22 nt, Human
uuuguggugagcagggaacguc

SEQ ID NO: 193042 - RNA, 17 nt, Human
uuugugauggcagaugc

SEQ ID NO: 193043 - RNA, 22 nt, Human
uuuguauuguuuauuucauuuu

SEQ ID NO: 193044 - RNA, 22 nt, Human
uuuguaguuguggaugcugaag

SEQ ID NO: 193045 - RNA, 22 nt, Human
uuccaaaugacaaugggcugua

SEQ ID NO: 193046 - RNA, 22 nt, Human
uucauuuuauauuagagcuguu

SEQ ID NO: 193047 - RNA, 23 nt, Human
uuugucaucccucucacuuucug

SEQ ID NO: 193048 - RNA, 22 nt, Human
uuugucauuuagcccauggugg

SEQ ID NO: 193049 - RNA, 22 nt, Human
uuugucaggaauugaaaaguuu

SEQ ID NO: 193050 - RNA, 20 nt, Human
uuugucaacugcauccagca

SEQ ID NO: 193051 - RNA, 22 nt, Human
uucauugcuacuuaaaauacca

SEQ ID NO: 193052 - RNA, 22 nt, Human
uucauugauuuccuuggaauaa

SEQ ID NO: 193053 - RNA, 22 nt, Human
uuuccacacucacugcacucau

SEQ ID NO: 193054 - RNA, 22 nt, Human
uuauauuuuauuuaauuaaaua

SEQ ID NO: 193055 - RNA, 21 nt, Human
uuucauuaguacaucaauuug

SEQ ID NO: 193056 - RNA, 22 nt, Human
uuucauggaggccaggacagag

SEQ ID NO: 193057 - RNA, 22 nt, Human
uuaucugcccauuguagaauug

SEQ ID NO: 193058 - RNA, 20 nt, Human
uuauccccauucuuguucuc

SEQ ID NO: 193059 - RNA, 22 nt, Human
uuaucugugcuuuacugacaga

SEQ ID NO: 193060 - RNA, 22 nt, Human
uuaucuuuuaaaaacacuugug

SEQ ID NO: 193061 - RNA, 22 nt, Human
uuaugggcgaugcaaaccugau

SEQ ID NO: 193062 - RNA, 22 nt, Human
uuauggauuagaguuugauucu

SEQ ID NO: 193063 - RNA, 22 nt, Human
uuaugccuguuaggcagcaucu

SEQ ID NO: 193064 - RNA, 22 nt, Human
uuaucuguuuuaaugaauaauu

SEQ ID NO: 193065 - RNA, 22 nt, Human
uuucacuucgaucagaguuuuu

SEQ ID NO: 193066 - RNA, 18 nt, Human
uuauacaauuuuuuuuca

SEQ ID NO: 193067 - RNA, 22 nt, Human
uuauacuucugccagaggacaa

SEQ ID NO: 193068 - RNA, 22 nt, Human
uuucagacugcccauguuugcc

SEQ ID NO: 193069 - RNA, 22 nt, Human
uuucuauauucaguuucauaaa

SEQ ID NO: 193070 - RNA, 22 nt, Human
uuucuccauuuuguguguucug

SEQ ID NO: 193071 - RNA, 22 nt, Human
uuucucagccuccuugcuggag

SEQ ID NO: 193072 - RNA, 22 nt, Human
uuucucagcauauugccuuuga

SEQ ID NO: 193073 - RNA, 19 nt, Human
uuucucacugagucguuug

SEQ ID NO: 193074 - RNA, 22 nt, Human
uuucgcuuguucggagugcuuu

SEQ ID NO: 193075 - RNA, 22 nt, Human
uuuccccugggaacauugauuc

SEQ ID NO: 193076 - RNA, 22 nt, Human
uuuccugacuucaccuuuuacc

SEQ ID NO: 193077 - RNA, 22 nt, Human
uuaugguuuaauauccagcaca

SEQ ID NO: 193078 - RNA, 22 nt, Human
uuaugucauuugaauuaauuuu

SEQ ID NO: 193079 - RNA, 22 nt, Human
uuuccaguaaguggcaaggagc

SEQ ID NO: 193080 - RNA, 22 nt, Human
uuaugggguuaaauuucuccua

SEQ ID NO: 193081 - RNA, 22 nt, Human
uuauuaauacaugcaccugcau

SEQ ID NO: 193082 - RNA, 22 nt, Human
uuauucuuagccucgguauuuc

SEQ ID NO: 193083 - RNA, 22 nt, Human
uuauuccauagaagucaaggaa

SEQ ID NO: 193084 - RNA, 22 nt, Human
uuaugugcuuuuugagcucuaa

SEQ ID NO: 193085 - RNA, 22 nt, Human
uuuccuguccugguacuuggca

SEQ ID NO: 193086 - RNA, 22 nt, Human
uuuagguccguguugcaguugg

SEQ ID NO: 193087 - RNA, 22 nt, Human
uuuagcaguuuauuuaaggggg

SEQ ID NO: 193088 - RNA, 22 nt, Human
uuagagaauagacuuuacccug

SEQ ID NO: 193089 - RNA, 22 nt, Human
uuacuggaauauaaagauaaga

SEQ ID NO: 193090 - RNA, 20 nt, Human
uuacugagguauuuuuauca

SEQ ID NO: 193091 - RNA, 22 nt, Human
uuuacucagucugagcaggugu

SEQ ID NO: 193092 - RNA, 22 nt, Human
uuuacuguuuacagcuaaugca

SEQ ID NO: 193093 - RNA, 22 nt, Human
uuaccugagcggauuuguugca

SEQ ID NO: 193094 - RNA, 22 nt, Human
uuguauaaagauggcuagaucc

SEQ ID NO: 193095 - RNA, 22 nt, Human
uuuacaaggcaguuauuuuccu

SEQ ID NO: 193096 - RNA, 22 nt, Human
uguuugagaauuugcugauguu

SEQ ID NO: 193097 - RNA, 22 nt, Human
uuuaucucugcauagaagugau

SEQ ID NO: 193098 - RNA, 22 nt, Human
uuuaucaggccaucuuaugucu

SEQ ID NO: 193099 - RNA, 22 nt, Human
uuuauaauuacguaaaauauuu

SEQ ID NO: 193100 - RNA, 22 nt, Human
uuaggagugaguuacuuagggu

SEQ ID NO: 193101 - RNA, 22 nt, Human
uuagcgcucucuccauucuuaa

SEQ ID NO: 193102 - RNA, 22 nt, Human
uuagcacugucugguuaucuug

SEQ ID NO: 193103 - RNA, 22 nt, Human
uuuaggucacuccaccgaagag

SEQ ID NO: 193104 - RNA, 22 nt, Human
uuuauuuagguaaacaugaguu

SEQ ID NO: 193105 - RNA, 22 nt, Human
uuaguuauaggugaaucagaga

SEQ ID NO: 193106 - RNA, 19 nt, Human
uuuauuugagacaugccuu

SEQ ID NO: 193107 - RNA, 22 nt, Human
uuuauugaccugaguaucagca

SEQ ID NO: 193108 - RNA, 22 nt, Human
uuuauucuuugcuagguuccau

SEQ ID NO: 193109 - RNA, 22 nt, Human
uuucacauacaguguauaguag

SEQ ID NO: 193110 - RNA, 19 nt, Human
uuucacaaagagagcguga

SEQ ID NO: 193111 - RNA, 22 nt, Human
uuucaaguagagggaucgcuag

SEQ ID NO: 193112 - RNA, 22 nt, Human
uuauaaaccgcuaacagcacuu

SEQ ID NO: 193113 - RNA, 22 nt, Human
uuuauuuuccaugucucuaggu

SEQ ID NO: 193114 - RNA, 22 nt, Human
uuucaagccucacugcguuuug

SEQ ID NO: 193115 - RNA, 22 nt, Human
ugggcaaaugcuuuuuagucaa

SEQ ID NO: 193116 - RNA, 22 nt, Human
ugggauggacuuuagagaaucg

SEQ ID NO: 193117 - RNA, 22 nt, Human
ugggauucucagaaacacagag

SEQ ID NO: 193118 - RNA, 22 nt, Human
ugggcagggauuuggggaaacu

SEQ ID NO: 193119 - RNA, 22 nt, Human
ugggcaguccagcuggaaacgg

SEQ ID NO: 193120 - RNA, 22 nt, Human
ugggcagggagcuggaaccaca

SEQ ID NO: 193121 - RNA, 22 nt, Human
ugggccacguggagucuguagg

SEQ ID NO: 193122 - RNA, 22 nt, Human
ugggcuguuucuuaaggauaug

SEQ ID NO: 193123 - RNA, 22 nt, Human
uggggacucacugacuaucuug

SEQ ID NO: 193124 - RNA, 22 nt, Human
ugggccgugagacgucucuggg

SEQ ID NO: 193125 - RNA, 22 nt, Human
uuccuuuuuaauuaaucuaauu

SEQ ID NO: 193126 - RNA, 22 nt, Human
uggggcugguaccguaauauau

SEQ ID NO: 193127 - RNA, 22 nt, Human
uggggagucccaacgguggaag

SEQ ID NO: 193128 - RNA, 22 nt, Human
uggcuuuugaaaaggugaugua

SEQ ID NO: 193129 - RNA, 22 nt, Human
uggcuugacaucaauacuuauu

SEQ ID NO: 193130 - RNA, 22 nt, Human
uggcuuuucaccugcuccucug

SEQ ID NO: 193131 - RNA, 20 nt, Human
ugggauggaaucaccugcac

SEQ ID NO: 193132 - RNA, 22 nt, Human
ugggauauagaauuggcagagu

SEQ ID NO: 193133 - RNA, 22 nt, Human
uuccauuccauaucagguacag

SEQ ID NO: 193134 - RNA, 22 nt, Human
uucccaggugugagugagguga

SEQ ID NO: 193135 - RNA, 22 nt, Human
uuccccuuaagagacaguugga

SEQ ID NO: 193136 - RNA, 22 nt, Human
uuccccuucuaauacucaauuu

SEQ ID NO: 193137 - RNA, 22 nt, Human
uuccccaugugaugcuauugcu

SEQ ID NO: 193138 - RNA, 22 nt, Human
ugggucaguagccuugcagaac

SEQ ID NO: 193139 - RNA, 22 nt, Human
ugggucagauugagccccuggu

SEQ ID NO: 193140 - RNA, 22 nt, Human
ugggucagauacaguguuuggu

SEQ ID NO: 193141 - RNA, 22 nt, Human
uucucuugccuucucuuuuauc

SEQ ID NO: 193142 - RNA, 22 nt, Human
uucucugaagagccagcccuua

SEQ ID NO: 193143 - RNA, 21 nt, Human
uggguccuuggucuaguuuuc

SEQ ID NO: 193144 - RNA, 22 nt, Human
uggguccaggauucuguguuuc

SEQ ID NO: 193145 - RNA, 22 nt, Human
ugggugaagaggcuaugcuacu

SEQ ID NO: 193146 - RNA, 22 nt, Human
uucgucauuguuguugguuuuc

SEQ ID NO: 193147 - RNA, 22 nt, Human
uucguucagcgcuugcgcaugc

SEQ ID NO: 193148 - RNA, 22 nt, Human
uggggcuuucgcggagcgucgg

SEQ ID NO: 193149 - RNA, 22 nt, Human
uggggaguaggaggggaacaga

SEQ ID NO: 193150 - RNA, 22 nt, Human
ugggggcacccagccgaugagg

SEQ ID NO: 193151 - RNA, 22 nt, Human
ugggggauucaucucagagcgu

SEQ ID NO: 193152 - RNA, 22 nt, Human
uggccagucuuagcugugccug

SEQ ID NO: 193153 - RNA, 22 nt, Human
uucagguacuaagugcugauuc

SEQ ID NO: 193154 - RNA, 22 nt, Human
uggcccaucagggcaccugaga

SEQ ID NO: 193155 - RNA, 22 nt, Human
uggccaaucagcugugaccugc

SEQ ID NO: 193156 - RNA, 22 nt, Human
uucauagaagggaguuuuuccu

SEQ ID NO: 193157 - RNA, 22 nt, Human
uucauacucuucccugggcaaa

SEQ ID NO: 193158 - RNA, 22 nt, Human
uucauaugaauuggguuuuuuu

SEQ ID NO: 193159 - RNA, 21 nt, Human
uggcccgagccgggguuggcu

SEQ ID NO: 193160 - RNA, 22 nt, Human
uggccccauuuuucuggagccu

SEQ ID NO: 193161 - RNA, 22 nt, Human
uucauauuguggucuugcauuc

SEQ ID NO: 193162 - RNA, 22 nt, Human
uggcccugaaucaaggccagca

SEQ ID NO: 193163 - RNA, 20 nt, Human
uggccgacccugaggaguug

SEQ ID NO: 193164 - RNA, 23 nt, Human
uggccguccccugacucucuggc

SEQ ID NO: 193165 - RNA, 22 nt, Human
uucaugcgcuuuucaggagugu

SEQ ID NO: 193166 - RNA, 22 nt, Human
uggccucauggccuuaucuggg

SEQ ID NO: 193167 - RNA, 22 nt, Human
uucauccucuaguacugaagug

SEQ ID NO: 193168 - RNA, 22 nt, Human
uggcuacauuuauacucucauu

SEQ ID NO: 193169 - RNA, 22 nt, Human
uggcuacguacaauggaacuuu

SEQ ID NO: 193170 - RNA, 22 nt, Human
uggcucagcgcggccuggucuu

SEQ ID NO: 193171 - RNA, 22 nt, Human
uuccacuguucaguucugguca

SEQ ID NO: 193172 - RNA, 19 nt, Human
uuccacugcuuagcauugc

SEQ ID NO: 193173 - RNA, 22 nt, Human
uggcucuucucaagcauuggcu

SEQ ID NO: 193174 - RNA, 23 nt, Human
uggcucugagcuuccugguggcc

SEQ ID NO: 193175 - RNA, 22 nt, Human
uucauuauuaauaauagcagcu

SEQ ID NO: 193176 - RNA, 22 nt, Human
uucauccucuuuaucuaccugu

SEQ ID NO: 193177 - RNA, 22 nt, Human
uucauugcagaauuuggccuca

SEQ ID NO: 193178 - RNA, 22 nt, Human
uggcggagacauggacuucaga

SEQ ID NO: 193179 - RNA, 22 nt, Human
uggcgcucacccugcggcccug

SEQ ID NO: 193180 - RNA, 22 nt, Human
uggcgugaagcuggaaggcgga

SEQ ID NO: 193181 - RNA, 22 nt, Human
uggcggcuggacuggggggcca

SEQ ID NO: 193182 - RNA, 22 nt, Human
uggcggcggggagguaggcaga

SEQ ID NO: 193183 - RNA, 22 nt, Human
uggcgcgcucgcucucgcugag

SEQ ID NO: 193184 - RNA, 22 nt, Human
uggcgcgcagccugcuggugcu

SEQ ID NO: 193185 - RNA, 22 nt, Human
uggcagugagauuucucuucug

SEQ ID NO: 193186 - RNA, 22 nt, Human
uggcaguaaagcuggaaaagug

SEQ ID NO: 193187 - RNA, 22 nt, Human
uggcaguagagcuggaacuuga

SEQ ID NO: 193188 - RNA, 22 nt, Human
uggcaguugcaguaacuuguau

SEQ ID NO: 193189 - RNA, 22 nt, Human
uggcaucacagacaaggcagca

SEQ ID NO: 193190 - RNA, 22 nt, Human
uucagacugcccauguuugcca

SEQ ID NO: 193191 - RNA, 22 nt, Human
uucagaacugucuguccuuuuc

SEQ ID NO: 193192 - RNA, 22 nt, Human
uucagaauuaucauaauuuuga

SEQ ID NO: 193193 - RNA, 22 nt, Human
uucagaccucaaauccacaugc

SEQ ID NO: 193194 - RNA, 22 nt, Human
uucagaauguacugauagaaca

SEQ ID NO: 193195 - RNA, 20 nt, Human
uggcaugaaauuuuccaagc

SEQ ID NO: 193196 - RNA, 21 nt, Human
uggcauacugcuaaaaagugu

SEQ ID NO: 193197 - RNA, 22 nt, Human
uggcaugugaauuguuacauug

SEQ ID NO: 193198 - RNA, 18 nt, Human
uggcaugcuuugauacau

SEQ ID NO: 193199 - RNA, 22 nt, Human
uucagcauaggcugcucuucaa

SEQ ID NO: 193200 - RNA, 23 nt, Human
uucagcucuccugaagcaucugu

SEQ ID NO: 193201 - RNA, 22 nt, Human
uggcauuugagcuggaaggaug

SEQ ID NO: 193202 - RNA, 19 nt, Human
uucaggcuuuucauuuuuc

SEQ ID NO: 193203 - RNA, 22 nt, Human
uucaggggcaaauacauuuuga

SEQ ID NO: 193204 - RNA, 22 nt, Human
uucaggugguuuaagaauugga

SEQ ID NO: 193205 - RNA, 22 nt, Human
uucagcauggcuguuuucccuu

SEQ ID NO: 193206 - RNA, 22 nt, Human
uucaggacacauuauuuaugaa

SEQ ID NO: 193207 - RNA, 22 nt, Human
uucacugugauguuuaagagaa

SEQ ID NO: 193208 - RNA, 22 nt, Human
uucacugacaguauugaggagg

SEQ ID NO: 193209 - RNA, 22 nt, Human
uucacuuuuucucugcuugaga

SEQ ID NO: 193210 - RNA, 22 nt, Human
uggcacaggcagaaggugccgc

SEQ ID NO: 193211 - RNA, 22 nt, Human
uucacugugauugggguggauu

SEQ ID NO: 193212 - RNA, 22 nt, Human
uucacuuuuuccugguccauuu

SEQ ID NO: 193213 - RNA, 22 nt, Human
uggcagcauuuuuuccagaaca

SEQ ID NO: 193214 - RNA, 22 nt, Human
uggcagccugcgugaaggagcu

SEQ ID NO: 193215 - RNA, 22 nt, Human
uggcacugcccugucucggugg

SEQ ID NO: 193216 - RNA, 22 nt, Human
uggcacguuggauugggaguuc

SEQ ID NO: 193217 - RNA, 15 nt, Human
uggauuugccacaua

SEQ ID NO: 193218 - RNA, 22 nt, Human
uggcaaaaccugcaauuacuuu

SEQ ID NO: 193219 - RNA, 23 nt, Human
uggcaaacgggaauaaaggaauu

SEQ ID NO: 193220 - RNA, 22 nt, Human
uggcacagcuugucauaaacuc

SEQ ID NO: 193221 - RNA, 22 nt, Human
uucacccaaaucaagcuggccu

SEQ ID NO: 193222 - RNA, 22 nt, Human
uggaugccuugggggaggagga

SEQ ID NO: 193223 - RNA, 22 nt, Human
uggaugccauuugauuaaggcu

SEQ ID NO: 193224 - RNA, 22 nt, Human
uggauuguuuacaucaugucug

SEQ ID NO: 193225 - RNA, 20 nt, Human
uggaugacuucaggcagccu

SEQ ID NO: 193226 - RNA, 22 nt, Human
uggauauagcugaggugucuug

SEQ ID NO: 193227 - RNA, 21 nt, Human
uggauauugaguaguuucuga

SEQ ID NO: 193228 - RNA, 22 nt, Human
uucaauuacaucagaaucuaaa

SEQ ID NO: 193229 - RNA, 22 nt, Human
uucaaugcaagggaggucugaa

SEQ ID NO: 193230 - RNA, 20 nt, Human
uucacagaggacucagguca

SEQ ID NO: 193231 - RNA, 22 nt, Human
uucacaauuuuaaaaaguggaa

SEQ ID NO: 193232 - RNA, 22 nt, Human
uggaugagugaauggauaaauc

SEQ ID NO: 193233 - RNA, 22 nt, Human
uggaguagaagggcuccuggaa

SEQ ID NO: 193234 - RNA, 19 nt, Human
uggaggcggguggcccaga

SEQ ID NO: 193235 - RNA, 22 nt, Human
uggagucagaaugcgacaggcc

SEQ ID NO: 193236 - RNA, 22 nt, Human
uggagucuugcuuugggagugc

SEQ ID NO: 193237 - RNA, 22 nt, Human
uuauuuuuguuuguuaagccua

SEQ ID NO: 193238 - RNA, 21 nt, Human
uggaggcguaaucacuguuga

SEQ ID NO: 193239 - RNA, 22 nt, Human
uuauuuuuaggaauguagaggu

SEQ ID NO: 193240 - RNA, 22 nt, Human
uuauuuaaguauuuauugaagu

SEQ ID NO: 193241 - RNA, 22 nt, Human
uggaggcccagcugggggccgg

SEQ ID NO: 193242 - RNA, 22 nt, Human
uggaggauggaaggaaagcugg

SEQ ID NO: 193243 - RNA, 22 nt, Human
uggaggauaacacaagaaguga

SEQ ID NO: 193244 - RNA, 22 nt, Human
uuauuuuauaaagagaagacuu

SEQ ID NO: 193245 - RNA, 22 nt, Human
uuauuugguuuuggcuuuagcu

SEQ ID NO: 193246 - RNA, 22 nt, Human
uuauuuuguagcucugaucuuu

SEQ ID NO: 193247 - RNA, 22 nt, Human
uuauuucaggcauuuguaaaug

SEQ ID NO: 193248 - RNA, 22 nt, Human
uuauuugcccauguuuagcaga

SEQ ID NO: 193249 - RNA, 22 nt, Human
uuauuuaaaauguagguuggga

SEQ ID NO: 193250 - RNA, 22 nt, Human
uuauuguagcacuuuggcagug

SEQ ID NO: 193251 - RNA, 22 nt, Human
uggagcugguucuggggaagcu

SEQ ID NO: 193252 - RNA, 22 nt, Human
uuauuggcagcuccugcacaug

SEQ ID NO: 193253 - RNA, 22 nt, Human
ugcuauucuuggagcugaugga

SEQ ID NO: 193254 - RNA, 22 nt, Human
ugcuauuuuguuuucaguccau

SEQ ID NO: 193255 - RNA, 22 nt, Human
uuauguugauaggaaucugauu

SEQ ID NO: 193256 - RNA, 22 nt, Human
ugcucacugcuuguguucaguu

SEQ ID NO: 193257 - RNA, 22 nt, Human
uucuguucuuuguccccuuggu

SEQ ID NO: 193258 - RNA, 22 nt, Human
uucugcccuugccagacaagua

SEQ ID NO: 193259 - RNA, 22 nt, Human
uucuguuuaaccuggaaagugu

SEQ ID NO: 193260 - RNA, 22 nt, Human
uucuguucugcuuucuccaucc

SEQ ID NO: 193261 - RNA, 22 nt, Human
uucuguuuauaauuugcaguug

SEQ ID NO: 193262 - RNA, 22 nt, Human
uggugcaggauuuauuuaacua

SEQ ID NO: 193263 - RNA, 23 nt, Human
uggugcagcgcaggccggguggc

SEQ ID NO: 193264 - RNA, 22 nt, Human
uucugaaacauugcuauuuucc

SEQ ID NO: 193265 - RNA, 22 nt, Human
uucucugcgcuccggcccaguu

SEQ ID NO: 193266 - RNA, 22 nt, Human
uucugaaccauugagcacugcc

SEQ ID NO: 193267 - RNA, 22 nt, Human
uucugaugccuggguugcuucu

SEQ ID NO: 193268 - RNA, 20 nt, Human
uucugcagcagguguugaag

SEQ ID NO: 193269 - RNA, 22 nt, Human
ugguggcuuuucguagguucac

SEQ ID NO: 193270 - RNA, 22 nt, Human
uggugguaggggugguuucuga

SEQ ID NO: 193271 - RNA, 21 nt, Human
ugguguacauuuccauaguuu

SEQ ID NO: 193272 - RNA, 22 nt, Human
uucuugugugaauauaauuaca

SEQ ID NO: 193273 - RNA, 22 nt, Human
uucuuguccacagaagagcuca

SEQ ID NO: 193274 - RNA, 22 nt, Human
uucuuggcacagaugagauucu

SEQ ID NO: 193275 - RNA, 20 nt, Human
ugguguacauuuccauaguu

SEQ ID NO: 193276 - RNA, 22 nt, Human
uucuuccagugaaacgugcauc

SEQ ID NO: 193277 - RNA, 19 nt, Human
ugguggaggugcaccugac

SEQ ID NO: 193278 - RNA, 22 nt, Human
ugguggcaauuuuuggggucaa

SEQ ID NO: 193279 - RNA, 22 nt, Human
ugguggaggugggggguauuuu

SEQ ID NO: 193280 - RNA, 22 nt, Human
uguaaagguuuuagagcagaga

SEQ ID NO: 193281 - RNA, 22 nt, Human
uguaaagaaagacgcagaguua

SEQ ID NO: 193282 - RNA, 23 nt, Human
uguaaaacaccguuauugcaccu

SEQ ID NO: 193283 - RNA, 22 nt, Human
uucuuuuuagcugguuguaaga

SEQ ID NO: 193284 - RNA, 22 nt, Human
uucuuuucuucccuguuuauua

SEQ ID NO: 193285 - RNA, 22 nt, Human
ugguuuguauauguuugugaga

SEQ ID NO: 193286 - RNA, 21 nt, Human
uucuuugaagacccauuugag

SEQ ID NO: 193287 - RNA, 22 nt, Human
uucuuucgaacaagagaaguuc

SEQ ID NO: 193288 - RNA, 22 nt, Human
ugguuuacucuguaaaccagga

SEQ ID NO: 193289 - RNA, 22 nt, Human
ugguugugcucuguuugaaagu

SEQ ID NO: 193290 - RNA, 22 nt, Human
ugguuucagacagacucgaacu

SEQ ID NO: 193291 - RNA, 22 nt, Human
ugguugugcuucuuugccucag

SEQ ID NO: 193292 - RNA, 22 nt, Human
ugguugguuaaugugcccauuu

SEQ ID NO: 193293 - RNA, 22 nt, Human
uguaauguuagaaacaauugcu

SEQ ID NO: 193294 - RNA, 22 nt, Human
uugaaaucuucccuccugucug

SEQ ID NO: 193295 - RNA, 22 nt, Human
uugaaagaacaauucugugaug

SEQ ID NO: 193296 - RNA, 22 nt, Human
uugaaaauuaauagguguacaa

SEQ ID NO: 193297 - RNA, 22 nt, Human
uguagacaugcuuuucugauga

SEQ ID NO: 193298 - RNA, 22 nt, Human
uguauaugucugugagcuauua

SEQ ID NO: 193299 - RNA, 22 nt, Human
uguaauucuaauccagagcugg

SEQ ID NO: 193300 - RNA, 22 nt, Human
ugugacaugauggcgucaugua

SEQ ID NO: 193301 - RNA, 20 nt, Human
uugcaugcagccggaugcug

SEQ ID NO: 193302 - RNA, 22 nt, Human
ugucuucuuuucccuuagcccu

SEQ ID NO: 193303 - RNA, 22 nt, Human
ugugaagcgugugcaggggaca

SEQ ID NO: 193304 - RNA, 22 nt, Human
ugugaaugacuguguucuuugc

SEQ ID NO: 193305 - RNA, 23 nt, Human
ugugaauggccuucuuuagaggu

SEQ ID NO: 193306 - RNA, 22 nt, Human
uugccucuaauuagcucuguga

SEQ ID NO: 193307 - RNA, 22 nt, Human
uugccuagugguagugacuguu

SEQ ID NO: 193308 - RNA, 22 nt, Human
ugugauaaaggcccgcagaucc

SEQ ID NO: 193309 - RNA, 22 nt, Human
ugugaugagaugaacuguagac

SEQ ID NO: 193310 - RNA, 22 nt, Human
ugugauugcauugcagauuacu

SEQ ID NO: 193311 - RNA, 17 nt, Human
ugucuuuuuccuccucc

SEQ ID NO: 193312 - RNA, 19 nt, Human
ugugaagaccucagugcgg

SEQ ID NO: 193313 - RNA, 22 nt, Human
ugucuuucuuucucuugacaga

SEQ ID NO: 193314 - RNA, 22 nt, Human
uguccuuucagagcuccuuuug

SEQ ID NO: 193315 - RNA, 22 nt, Human
uugcaagauaguguauuuuuca

SEQ ID NO: 193316 - RNA, 22 nt, Human
uugcagaauucuucccacucag

SEQ ID NO: 193317 - RNA, 22 nt, Human
uguauuuuuucccugaaauaaa

SEQ ID NO: 193318 - RNA, 19 nt, Human
uguauuuauauuucugugc

SEQ ID NO: 193319 - RNA, 22 nt, Human
ugucacagugcacagcuaagaa

SEQ ID NO: 193320 - RNA, 22 nt, Human
ugucaccucauacaguaccuca

SEQ ID NO: 193321 - RNA, 22 nt, Human
uugaguuuacauuguauuagcc

SEQ ID NO: 193322 - RNA, 22 nt, Human
ugucacagagcgugcaacagaa

SEQ ID NO: 193323 - RNA, 22 nt, Human
uguauauuuucuguauaaaaua

SEQ ID NO: 193324 - RNA, 22 nt, Human
uguauauguguguagcauguua

SEQ ID NO: 193325 - RNA, 22 nt, Human
uguauggguaggaaacagcugg

SEQ ID NO: 193326 - RNA, 19 nt, Human
uugaauguuugauagucuc

SEQ ID NO: 193327 - RNA, 22 nt, Human
uguauugugggugucagagugc

SEQ ID NO: 193328 - RNA, 22 nt, Human
ugucaucuuggugcugugagag

SEQ ID NO: 193329 - RNA, 21 nt, Human
uugauuuagcagaucuagcug

SEQ ID NO: 193330 - RNA, 22 nt, Human
uugauuuccauuguccagcauu

SEQ ID NO: 193331 - RNA, 22 nt, Human
uugauuuggaauuuuuagagcu

SEQ ID NO: 193332 - RNA, 22 nt, Human
uugauuaauugaugaaccucuc

SEQ ID NO: 193333 - RNA, 21 nt, Human
ugucaucucuaaaaagauugu

SEQ ID NO: 193334 - RNA, 22 nt, Human
ugucacggccggguggcaccga

SEQ ID NO: 193335 - RNA, 22 nt, Human
uuggugauugggaauggauggg

SEQ ID NO: 193336 - RNA, 22 nt, Human
uguuggcagugcuacagucagu

SEQ ID NO: 193337 - RNA, 22 nt, Human
uuggugaugaaagugcugcgcu

SEQ ID NO: 193338 - RNA, 21 nt, Human
uguugcuugucugagacuaug

SEQ ID NO: 193339 - RNA, 22 nt, Human
uguugcauguggcuguuugcca

SEQ ID NO: 193340 - RNA, 19 nt, Human
uguugcagcuugaucggua

SEQ ID NO: 193341 - RNA, 19 nt, Human
uuggugaagguucacugac

SEQ ID NO: 193342 - RNA, 22 nt, Human
uguuggauuuugugaaauauga

SEQ ID NO: 193343 - RNA, 22 nt, Human
uguuggaauaagugcuugaagg

SEQ ID NO: 193344 - RNA, 22 nt, Human
uguuggaaucuucuagucuucc

SEQ ID NO: 193345 - RNA, 22 nt, Human
uguuucaugcagcccccuguca

SEQ ID NO: 193346 - RNA, 22 nt, Human
uugguugaaauguguucaugcu

SEQ ID NO: 193347 - RNA, 22 nt, Human
uuguaauaguguuuuacguugu

SEQ ID NO: 193348 - RNA, 22 nt, Human
uugguguaauacaagcaauuug

SEQ ID NO: 193349 - RNA, 21 nt, Human
uguugguugugggaaggagga

SEQ ID NO: 193350 - RNA, 22 nt, Human
uguugguuucaagcaggagccu

SEQ ID NO: 193351 - RNA, 22 nt, Human
uguugaugaccacaauuuaugc

SEQ ID NO: 193352 - RNA, 22 nt, Human
uugggaguaauacugaagagag

SEQ ID NO: 193353 - RNA, 22 nt, Human
uugggagaaauaguugauccgc

SEQ ID NO: 193354 - RNA, 22 nt, Human
uugggcauuucuuauguauuuu

SEQ ID NO: 193355 - RNA, 22 nt, Human
ugugugggcgaagacagccuuu

SEQ ID NO: 193356 - RNA, 22 nt, Human
uguguguauauauauguaucau

SEQ ID NO: 193357 - RNA, 22 nt, Human
uuggccuaggcacaggcaggug

SEQ ID NO: 193358 - RNA, 22 nt, Human
uuggccguuucacugggcaguu

SEQ ID NO: 193359 - RNA, 22 nt, Human
uguuaacugccaggacagaucg

SEQ ID NO: 193360 - RNA, 22 nt, Human
uugggaacaggcuucccacugg

SEQ ID NO: 193361 - RNA, 22 nt, Human
uuggcuguguugaaaacgugga

SEQ ID NO: 193362 - RNA, 22 nt, Human
uguuaacuuagcugaccuuaaa

SEQ ID NO: 193363 - RNA, 22 nt, Human
uugcuuugcuucuuuaugguca

SEQ ID NO: 193364 - RNA, 23 nt, Human
uugcuuuugccccaaaagaguua

SEQ ID NO: 193365 - RNA, 22 nt, Human
uugcuuucuuuguagguuuucc

SEQ ID NO: 193366 - RNA, 22 nt, Human
uuggaaaagaaauacucauaua

SEQ ID NO: 193367 - RNA, 22 nt, Human
uguggucuccucucugucuucc

SEQ ID NO: 193368 - RNA, 22 nt, Human
uguggugacuugagcuuccuaa

SEQ ID NO: 193369 - RNA, 22 nt, Human
uuggaaaugcauuuguuauuau

SEQ ID NO: 193370 - RNA, 22 nt, Human
uuggaguucuucaugcucugua

SEQ ID NO: 193371 - RNA, 22 nt, Human
uguguggaggugggugaugucu

SEQ ID NO: 193372 - RNA, 22 nt, Human
ugugugguaaugagagauccaa

SEQ ID NO: 193373 - RNA, 22 nt, Human
uguguaacaacauaaugguuau

SEQ ID NO: 193374 - RNA, 22 nt, Human
uguggugcucagggaggauggg

SEQ ID NO: 193375 - RNA, 22 nt, Human
ugugguuuguaagcaaagcaaa

SEQ ID NO: 193376 - RNA, 20 nt, Human
uuggagaucacguguccagg

SEQ ID NO: 193377 - RNA, 19 nt, Human
uuggagcaucccaaaggcu

SEQ ID NO: 193378 - RNA, 22 nt, Human
ugugcuaauguuaggauugaau

SEQ ID NO: 193379 - RNA, 22 nt, Human
ugugcuugucuguuuugauugu

SEQ ID NO: 193380 - RNA, 22 nt, Human
ugugcuggcuucugugagcuga

SEQ ID NO: 193381 - RNA, 22 nt, Human
ugugccuuucacuaugucauuc

SEQ ID NO: 193382 - RNA, 20 nt, Human
uugcucucuuguguugaugu

SEQ ID NO: 193383 - RNA, 22 nt, Human
uugcucaccugagaagaauaga

SEQ ID NO: 193384 - RNA, 22 nt, Human
ugugcaucuggaggcaauguuu

SEQ ID NO: 193385 - RNA, 22 nt, Human
ugugcaguauugaaauauaugu

SEQ ID NO: 193386 - RNA, 22 nt, Human
ugugggaucauggaucagggcc

SEQ ID NO: 193387 - RNA, 22 nt, Human
ugugggaucguaaauuugggac

SEQ ID NO: 193388 - RNA, 22 nt, Human
uguggcuuaggugagcauguga

SEQ ID NO: 193389 - RNA, 21 nt, Human
uguggccauuugaaaacaggg

SEQ ID NO: 193390 - RNA, 22 nt, Human
uguggccaccagagcugcuauu

SEQ ID NO: 193391 - RNA, 22 nt, Human
uugcugcgcugaccuccaguga

SEQ ID NO: 193392 - RNA, 22 nt, Human
uugcugccagcgcccugcaggg

SEQ ID NO: 193393 - RNA, 21 nt, Human
uugcuggagcaauguaaauca

SEQ ID NO: 193394 - RNA, 22 nt, Human
uugcugaggcuggggagaggug

SEQ ID NO: 193395 - RNA, 22 nt, Human
uugcugggauucauugaagggu

SEQ ID NO: 193396 - RNA, 22 nt, Human
ugcauuuuuaauuuggaaaaaa

SEQ ID NO: 193397 - RNA, 22 nt, Human
ugccaaagauagagguuugagu

SEQ ID NO: 193398 - RNA, 22 nt, Human
ugccauagaaguccaacccaau

SEQ ID NO: 193399 - RNA, 22 nt, Human
ugcauuuucuaccacacccacu

SEQ ID NO: 193400 - RNA, 22 nt, Human
ugcauuuugaaggaaaaaaaug

SEQ ID NO: 193401 - RNA, 22 nt, Human
ugcauuugcaauggguacacaa

SEQ ID NO: 193402 - RNA, 22 nt, Human
ugcccacuucaaaaucuucauu

SEQ ID NO: 193403 - RNA, 18 nt, Human
ugcccaccagaagaggga

SEQ ID NO: 193404 - RNA, 22 nt, Human
ugugggcguggguuggggaggg

SEQ ID NO: 193405 - RNA, 22 nt, Human
ugccaucuuugccccuauuuua

SEQ ID NO: 193406 - RNA, 22 nt, Human
ugugggcugcuguuuccuugua

SEQ ID NO: 193407 - RNA, 22 nt, Human
uguggguggucagcgugugaug

SEQ ID NO: 193408 - RNA, 22 nt, Human
ugugguagagcuuaaaugaggu

SEQ ID NO: 193409 - RNA, 22 nt, Human
ugccuaaaccauuccccuuccu

SEQ ID NO: 193410 - RNA, 22 nt, Human
ugccgggcugagcaagugcugc

SEQ ID NO: 193411 - RNA, 22 nt, Human
ugugguuggggucagauaggga

SEQ ID NO: 193412 - RNA, 17 nt, Human
uguguaaguugcauaga

SEQ ID NO: 193413 - RNA, 22 nt, Human
ugcacugccuuucuuggcauga

SEQ ID NO: 193414 - RNA, 22 nt, Human
ugugcagaaaacacuuaagaac

SEQ ID NO: 193415 - RNA, 22 nt, Human
ugugcgcgugugcuuugugugu

SEQ ID NO: 193416 - RNA, 22 nt, Human
ugugcgucuguguacagaugug

SEQ ID NO: 193417 - RNA, 22 nt, Human
ugugccuguugguguagacaua

SEQ ID NO: 193418 - RNA, 22 nt, Human
ugugcagugcguggguguugaa

SEQ ID NO: 193419 - RNA, 22 nt, Human
ugugcagaaggagguucuccgg

SEQ ID NO: 193420 - RNA, 22 nt, Human
ugcaggucuggacccccacuuu

SEQ ID NO: 193421 - RNA, 22 nt, Human
ugcagguggcagcggggcacca

SEQ ID NO: 193422 - RNA, 22 nt, Human
ugcagggucuccuguacuuggg

SEQ ID NO: 193423 - RNA, 22 nt, Human
ugcaguugcguuugcauuccau

SEQ ID NO: 193424 - RNA, 22 nt, Human
ugcagguuuucagauguguguu

SEQ ID NO: 193425 - RNA, 22 nt, Human
ugcauuccagcucccuucuggc

SEQ ID NO: 193426 - RNA, 22 nt, Human
ugcauucugggucgcagagugg

SEQ ID NO: 193427 - RNA, 22 nt, Human
ugcauugccauagcagggggau

SEQ ID NO: 193428 - RNA, 22 nt, Human
ugcauaagguuaaauuagcaga

SEQ ID NO: 193429 - RNA, 22 nt, Human
ugcauuauaacaauaaggcuua

SEQ ID NO: 193430 - RNA, 22 nt, Human
ugcauaugcauguaccuguguu

SEQ ID NO: 193431 - RNA, 22 nt, Human
ugcgccucugucacucagcauc

SEQ ID NO: 193432 - RNA, 22 nt, Human
ugcgccuccugcugccugcccu

SEQ ID NO: 193433 - RNA, 22 nt, Human
uguuccuggggaccugccuucc

SEQ ID NO: 193434 - RNA, 23 nt, Human
uguuccugaugccucguccuguc

SEQ ID NO: 193435 - RNA, 19 nt, Human
ugcgggcugcggucagggc

SEQ ID NO: 193436 - RNA, 22 nt, Human
ugcgcgccgacggcuccgugac

SEQ ID NO: 193437 - RNA, 22 nt, Human
uguucggaaaagggcaagcuau

SEQ ID NO: 193438 - RNA, 22 nt, Human
ugcggugcagcccugcccucuc

SEQ ID NO: 193439 - RNA, 22 nt, Human
ugcggagggagcagucggcugu

SEQ ID NO: 193440 - RNA, 22 nt, Human
uguucugauggauuacaugucu

SEQ ID NO: 193441 - RNA, 22 nt, Human
uguucugaggaggguuucaagg

SEQ ID NO: 193442 - RNA, 22 nt, Human
uguugaaacagcuauugacuuu

SEQ ID NO: 193443 - RNA, 21 nt, Human
ugcuaagugucacaugucugc

SEQ ID NO: 193444 - RNA, 22 nt, Human
ugcguuuaguuucaagacacgu

SEQ ID NO: 193445 - RNA, 22 nt, Human
ugcuaaugaauggaggaucuga

SEQ ID NO: 193446 - RNA, 22 nt, Human
uguugaagcaccucugucuuuc

SEQ ID NO: 193447 - RNA, 22 nt, Human
ugcguggauuuaggagugaggg

SEQ ID NO: 193448 - RNA, 23 nt, Human
ugcuaaaggcagaauauucaccu

SEQ ID NO: 193449 - RNA, 22 nt, Human
uguugccaucuaaaauguuacu

SEQ ID NO: 193450 - RNA, 22 nt, Human
uguugauuaauuuucccaaaca

SEQ ID NO: 193451 - RNA, 21 nt, Human
uguguuuauauguguuuauau

SEQ ID NO: 193452 - RNA, 22 nt, Human
uguguuccugucuuauucuuau

SEQ ID NO: 193453 - RNA, 19 nt, Human
uguguuccauccaccaccc

SEQ ID NO: 193454 - RNA, 22 nt, Human
ugccuucugccaaggacggugc

SEQ ID NO: 193455 - RNA, 20 nt, Human
ugccuuccgccccgggcacc

SEQ ID NO: 193456 - RNA, 22 nt, Human
uguguuucggauagcagauucu

SEQ ID NO: 193457 - RNA, 22 nt, Human
uguguguguuguaugaaauuuu

SEQ ID NO: 193458 - RNA, 22 nt, Human
ugccugaagccugccccugggu

SEQ ID NO: 193459 - RNA, 20 nt, Human
ugccugagcgcagcuccagg

SEQ ID NO: 193460 - RNA, 19 nt, Human
ugccuggcaccagcuccac

SEQ ID NO: 193461 - RNA, 22 nt, Human
uguguguguguguguguuugug

SEQ ID NO: 193462 - RNA, 22 nt, Human
ugccuggacgacaucacaguga

SEQ ID NO: 193463 - RNA, 22 nt, Human
uguuaaaaagucccuguuuugu

SEQ ID NO: 193464 - RNA, 22 nt, Human
ugccuuuuguguuuggcuaauc

SEQ ID NO: 193465 - RNA, 22 nt, Human
ugcgccccgcgggccuucgggc

SEQ ID NO: 193466 - RNA, 22 nt, Human
ugccuuguagccaccgggucac

SEQ ID NO: 193467 - RNA, 22 nt, Human
uguuccggucuaucgugucaau

SEQ ID NO: 193468 - RNA, 22 nt, Human
uguucccgaugacaggaccagg

SEQ ID NO: 193469 - RNA, 22 nt, Human
uguuauugccucaugagacucc

SEQ ID NO: 193470 - RNA, 22 nt, Human
uguuacugaaugucucugcuuu

SEQ ID NO: 193471 - RNA, 22 nt, Human
ugaggaagugguuguaugguuu

SEQ ID NO: 193472 - RNA, 21 nt, Human
ugagcccaaagcuguauuggu

SEQ ID NO: 193473 - RNA, 22 nt, Human
ugagcuauuucaccauauagau

SEQ ID NO: 193474 - RNA, 22 nt, Human
ugaggaacaugggagaaauguc

SEQ ID NO: 193475 - RNA, 19 nt, Human
ugaggauugagguccagua

SEQ ID NO: 193476 - RNA, 22 nt, Human
uggugcagacaggagccccgcu

SEQ ID NO: 193477 - RNA, 22 nt, Human
ugaggccaagccuccucugcca

SEQ ID NO: 193478 - RNA, 22 nt, Human
ugguggagucugggggaggcuu

SEQ ID NO: 193479 - RNA, 22 nt, Human
uggggggacagauggagaggac

SEQ ID NO: 193480 - RNA, 22 nt, Human
ugggggaugacuugcucuuuca

SEQ ID NO: 193481 - RNA, 22 nt, Human
ugggggauauggcuccauacuu

SEQ ID NO: 193482 - RNA, 22 nt, Human
ugacaucagacugugagaagag

SEQ ID NO: 193483 - RNA, 22 nt, Human
uggggucuggcauaugguagau

SEQ ID NO: 193484 - RNA, 22 nt, Human
ugggggguuuagaaucugcccu

SEQ ID NO: 193485 - RNA, 22 nt, Human
ugggguguuacacaacauugag

SEQ ID NO: 193486 - RNA, 20 nt, Human
ugggguucccuuuagggcuu

SEQ ID NO: 193487 - RNA, 22 nt, Human
uggucugggaagaucacaauua

SEQ ID NO: 193488 - RNA, 22 nt, Human
uggugacaucuaccuagguaaa

SEQ ID NO: 193489 - RNA, 22 nt, Human
ugagccugaguguguauugaac

SEQ ID NO: 193490 - RNA, 22 nt, Human
uguaaaguuuccuauugcccua

SEQ ID NO: 193491 - RNA, 22 nt, Human
uguaaauucuauacacuuaaaa

SEQ ID NO: 193492 - RNA, 22 nt, Human
uguaaagugguauuuaauuuua

SEQ ID NO: 193493 - RNA, 22 nt, Human
ugaugaugauacauuucuucag

SEQ ID NO: 193494 - RNA, 22 nt, Human
uguaauuugguuagauuucuuu

SEQ ID NO: 193495 - RNA, 22 nt, Human
ugaguugcagucaauauugcaa

SEQ ID NO: 193496 - RNA, 22 nt, Human
ugaguuucuuacucaggagcug

SEQ ID NO: 193497 - RNA, 22 nt, Human
ugaguguuguaaccauaugauu

SEQ ID NO: 193498 - RNA, 20 nt, Human
ugguguccuaugcuugugcu

SEQ ID NO: 193499 - RNA, 18 nt, Human
ugguuggugggggugaag

SEQ ID NO: 193500 - RNA, 22 nt, Human
ugguugauuaauuuugccaagc

SEQ ID NO: 193501 - RNA, 22 nt, Human
ugcaaggcacccacucugcuuu

SEQ ID NO: 193502 - RNA, 22 nt, Human
ugcacagagggaggcauaaaau

SEQ ID NO: 193503 - RNA, 22 nt, Human
ugcacauuucucacaauguaca

SEQ ID NO: 193504 - RNA, 23 nt, Human
ugucugccuaucaugugaaggac

SEQ ID NO: 193505 - RNA, 22 nt, Human
ugucugcauucgaguucaugga

SEQ ID NO: 193506 - RNA, 22 nt, Human
ugcacgcgcccuucgauggccc

SEQ ID NO: 193507 - RNA, 22 nt, Human
ugucugggauguuggcagccac

SEQ ID NO: 193508 - RNA, 22 nt, Human
ugucugucugccauuuauucuc

SEQ ID NO: 193509 - RNA, 22 nt, Human
ugucuguauuugaggacauugu

SEQ ID NO: 193510 - RNA, 21 nt, Human
ugcaacugaaaggaauauggu

SEQ ID NO: 193511 - RNA, 22 nt, Human
ugcaagagcccaaacuauauac

SEQ ID NO: 193512 - RNA, 22 nt, Human
ugcaaauucuuuacucugugau

SEQ ID NO: 193513 - RNA, 22 nt, Human
uguccagcuauauguguaugug

SEQ ID NO: 193514 - RNA, 22 nt, Human
uguauuuauuuuucaacuacca

SEQ ID NO: 193515 - RNA, 18 nt, Human
uguauuguucacuucugu

SEQ ID NO: 193516 - RNA, 21 nt, Human
ugucagcaacaauacuuucuc

SEQ ID NO: 193517 - RNA, 22 nt, Human
ugucagacagggcugcagucag

SEQ ID NO: 193518 - RNA, 22 nt, Human
ugauuuguuuaaauugcucguu

SEQ ID NO: 193519 - RNA, 22 nt, Human
ugcaaaaguuuuauacacagau

SEQ ID NO: 193520 - RNA, 22 nt, Human
uguauuugaagaaagagcuucu

SEQ ID NO: 193521 - RNA, 22 nt, Human
ugucacaccucguuuagcauuc

SEQ ID NO: 193522 - RNA, 20 nt, Human
ugauuauuccaacaagaaug

SEQ ID NO: 193523 - RNA, 22 nt, Human
ugauuagauacuucagaugaca

SEQ ID NO: 193524 - RNA, 22 nt, Human
ugauguggaucuauaacuguaa

SEQ ID NO: 193525 - RNA, 22 nt, Human
uguauugaggauucauuuuugu

SEQ ID NO: 193526 - RNA, 22 nt, Human
ugauucaguacuuucucuaacu

SEQ ID NO: 193527 - RNA, 22 nt, Human
uguaucucugacacagucucac

SEQ ID NO: 193528 - RNA, 22 nt, Human
uguauguguuuuauguguguuu

SEQ ID NO: 193529 - RNA, 22 nt, Human
uguaucuguguguauguguuua

SEQ ID NO: 193530 - RNA, 17 nt, Human
uguaccgaguguguaua

SEQ ID NO: 193531 - RNA, 18 nt, Human
ugauggcuaagagccggg

SEQ ID NO: 193532 - RNA, 22 nt, Human
ugauguaggacauuauuauuuc

SEQ ID NO: 193533 - RNA, 22 nt, Human
uguauaaaauggaaugucagaa

SEQ ID NO: 193534 - RNA, 21 nt, Human
uguauacacacauuguaccaa

SEQ ID NO: 193535 - RNA, 22 nt, Human
uguaggcacauguauauauccc

SEQ ID NO: 193536 - RNA, 22 nt, Human
uggcuuuuuucuccccuuggau

SEQ ID NO: 193537 - RNA, 22 nt, Human
ugggaaaauagcuauuuugaaa

SEQ ID NO: 193538 - RNA, 22 nt, Human
ugggaaaauugugauucuuucu

SEQ ID NO: 193539 - RNA, 22 nt, Human
ugggaagaggaggcagggggca

SEQ ID NO: 193540 - RNA, 22 nt, Human
ugaacagugugagggugugacc

SEQ ID NO: 193541 - RNA, 22 nt, Human
ugaacuuacauugaggaauucu

SEQ ID NO: 193542 - RNA, 22 nt, Human
ugggaagcugagccucgaugug

SEQ ID NO: 193543 - RNA, 22 nt, Human
ugaagacuucuuuuggucacca

SEQ ID NO: 193544 - RNA, 22 nt, Human
ugaagccacacuagcuuguccu

SEQ ID NO: 193545 - RNA, 22 nt, Human
ugggaugagcuauauagaaagu

SEQ ID NO: 193546 - RNA, 21 nt, Human
ugaagcccugugaggugcuua

SEQ ID NO: 193547 - RNA, 22 nt, Human
ugggagagaaauuuaaguuuuu

SEQ ID NO: 193548 - RNA, 22 nt, Human
ugggaagccaguaucagacuaa

SEQ ID NO: 193549 - RNA, 22 nt, Human
ugggaauuuaugagaaaauaua

SEQ ID NO: 193550 - RNA, 22 nt, Human
ugggagccuuccacugggggaa

SEQ ID NO: 193551 - RNA, 22 nt, Human
ugggagagaagcugaggcaggg

SEQ ID NO: 193552 - RNA, 22 nt, Human
ugggagagauaggcuucuggac

SEQ ID NO: 193553 - RNA, 17 nt, Human
ucuuuuacuuucucucc

SEQ ID NO: 193554 - RNA, 22 nt, Human
uggccugauuuugcuaagagaa

SEQ ID NO: 193555 - RNA, 19 nt, Human
ucuuugcuuuucuaagagg

SEQ ID NO: 193556 - RNA, 22 nt, Human
uggcugagugaacauguccauu

SEQ ID NO: 193557 - RNA, 22 nt, Human
uggcugaggcuuuucuuaaaga

SEQ ID NO: 193558 - RNA, 22 nt, Human
ugaaagcuggcucugcagagug

SEQ ID NO: 193559 - RNA, 22 nt, Human
uggcuuauggguccucccucuu

SEQ ID NO: 193560 - RNA, 22 nt, Human
uggcuugagcugggcccaccug

SEQ ID NO: 193561 - RNA, 22 nt, Human
uggcuucuggccaggcacagga

SEQ ID NO: 193562 - RNA, 22 nt, Human
uggcuucagacuucugcuacgu

SEQ ID NO: 193563 - RNA, 22 nt, Human
uggcuucugguuuauccuuaua

SEQ ID NO: 193564 - RNA, 22 nt, Human
ugaaauguggagaugguaagua

SEQ ID NO: 193565 - RNA, 22 nt, Human
ugaaauugaguaccucuuuaua

SEQ ID NO: 193566 - RNA, 22 nt, Human
ugggaggcugugggaauggguc

SEQ ID NO: 193567 - RNA, 22 nt, Human
ugaaggccagggauuugcagcc

SEQ ID NO: 193568 - RNA, 22 nt, Human
ugaaggaggugaauccaugcau

SEQ ID NO: 193569 - RNA, 22 nt, Human
ugaagcuagguucaugaggucg

SEQ ID NO: 193570 - RNA, 22 nt, Human
ugggcagagggugaggaaggcg

SEQ ID NO: 193571 - RNA, 21 nt, Human
ugaagggugagauauaaguga

SEQ ID NO: 193572 - RNA, 23 nt, Human
ugaagugaaauuucacaagggac

SEQ ID NO: 193573 - RNA, 22 nt, Human
ugaauagcaccuugaguaauga

SEQ ID NO: 193574 - RNA, 22 nt, Human
ugaauaaauaaacuuuuacuac

SEQ ID NO: 193575 - RNA, 22 nt, Human
ugggccaaaugucugcauaagu

SEQ ID NO: 193576 - RNA, 22 nt, Human
ugaaguuuagaaaaagugccuu

SEQ ID NO: 193577 - RNA, 22 nt, Human
uggggagcucagcaccaucagu

SEQ ID NO: 193578 - RNA, 21 nt, Human
uggggaugcauugcagaggca

SEQ ID NO: 193579 - RNA, 22 nt, Human
ugaaucaaugaauugcacuuca

SEQ ID NO: 193580 - RNA, 22 nt, Human
uggggaagaacuugccauuuca

SEQ ID NO: 193581 - RNA, 23 nt, Human
ugacagguucuaugguuuccaac

SEQ ID NO: 193582 - RNA, 22 nt, Human
ugaauuuuaacauucugcugga

SEQ ID NO: 193583 - RNA, 22 nt, Human
ugaauuauaugguauugaacau

SEQ ID NO: 193584 - RNA, 22 nt, Human
ugaauuacacugggaucagggc

SEQ ID NO: 193585 - RNA, 22 nt, Human
ugaaugaguucaccgcucaguu

SEQ ID NO: 193586 - RNA, 22 nt, Human
ugggggaggaggagacagacug

SEQ ID NO: 193587 - RNA, 22 nt, Human
ugggggagggagaguugauggg

SEQ ID NO: 193588 - RNA, 22 nt, Human
uggggcuggccaggaggagucu

SEQ ID NO: 193589 - RNA, 18 nt, Human
ugggggacgcuuuuuuuc

SEQ ID NO: 193590 - RNA, 22 nt, Human
uggggcuccuccuggcaggagg

SEQ ID NO: 193591 - RNA, 22 nt, Human
uggggcgcaggcccagcgggcu

SEQ ID NO: 193592 - RNA, 22 nt, Human
uggggcuauggcccgaccacgu

SEQ ID NO: 193593 - RNA, 22 nt, Human
uggggcggaaggaggagaggug

SEQ ID NO: 193594 - RNA, 22 nt, Human
ucugcggccggaauucccuuca

SEQ ID NO: 193595 - RNA, 22 nt, Human
uggaaccuggcuucaaagggag

SEQ ID NO: 193596 - RNA, 22 nt, Human
ucugcggccuagcgcccggcgc

SEQ ID NO: 193597 - RNA, 22 nt, Human
uggaacugauuaaaagggcaga

SEQ ID NO: 193598 - RNA, 17 nt, Human
ucugccaguuuuagaau

SEQ ID NO: 193599 - RNA, 22 nt, Human
ucugcaugccucaggaggccug

SEQ ID NO: 193600 - RNA, 22 nt, Human
uggaagaaaugguugagccaug

SEQ ID NO: 193601 - RNA, 22 nt, Human
uggaacuuccucacuuucccuc

SEQ ID NO: 193602 - RNA, 22 nt, Human
ucugcuuuucuuaaggggauca

SEQ ID NO: 193603 - RNA, 22 nt, Human
uggaaaguuggaagucucagga

SEQ ID NO: 193604 - RNA, 22 nt, Human
uggaaaggaguucuguuuauuu

SEQ ID NO: 193605 - RNA, 22 nt, Human
uggaaauaguugugagucaggc

SEQ ID NO: 193606 - RNA, 22 nt, Human
uggaaauagauguaggaaauug

SEQ ID NO: 193607 - RNA, 22 nt, Human
ucuacuccaucugccagggcuu

SEQ ID NO: 193608 - RNA, 22 nt, Human
ucuacgugacagaacagacuga

SEQ ID NO: 193609 - RNA, 22 nt, Human
ugcugccucugaauggagcagu

SEQ ID NO: 193610 - RNA, 22 nt, Human
ugcugccucccaucccucccga

SEQ ID NO: 193611 - RNA, 19 nt, Human
ugcugcaggaauucucaag

SEQ ID NO: 193612 - RNA, 22 nt, Human
uggagcuggcuuguggaaguug

SEQ ID NO: 193613 - RNA, 22 nt, Human
uggaggagaacugauuuggcuu

SEQ ID NO: 193614 - RNA, 22 nt, Human
uggaggaggagaacuuggcacu

SEQ ID NO: 193615 - RNA, 22 nt, Human
uggaggaugacagagaugggcu

SEQ ID NO: 193616 - RNA, 22 nt, Human
uggaggaggaugcauuuguugu

SEQ ID NO: 193617 - RNA, 22 nt, Human
uggagcaagaagggaggcagaa

SEQ ID NO: 193618 - RNA, 22 nt, Human
uggagaugcacgagcaggugga

SEQ ID NO: 193619 - RNA, 21 nt, Human
uggagcagggaggauuugggg

SEQ ID NO: 193620 - RNA, 22 nt, Human
uggagagcaaugaggggcaggc

SEQ ID NO: 193621 - RNA, 22 nt, Human
uggagagcaggugaaggaaaga

SEQ ID NO: 193622 - RNA, 22 nt, Human
uggagcugaaguacucucacua

SEQ ID NO: 193623 - RNA, 22 nt, Human
uggaagcccagaaggaagcaga

SEQ ID NO: 193624 - RNA, 22 nt, Human
uggaagaucugguguagcuccu

SEQ ID NO: 193625 - RNA, 21 nt, Human
ucuggggacaagguccaggaa

SEQ ID NO: 193626 - RNA, 22 nt, Human
ucugggagaguagauaaaggaa

SEQ ID NO: 193627 - RNA, 22 nt, Human
ucugggccaacccuuccauggg

SEQ ID NO: 193628 - RNA, 22 nt, Human
uggaaggaaauguguaucauaa

SEQ ID NO: 193629 - RNA, 22 nt, Human
ucugggguucuuaauuuggaag

SEQ ID NO: 193630 - RNA, 22 nt, Human
ucuggguaacugaggcuaauau

SEQ ID NO: 193631 - RNA, 22 nt, Human
uggaaugccgggccaggcuccg

SEQ ID NO: 193632 - RNA, 21 nt, Human
uggaauuggaaaccauucuau

SEQ ID NO: 193633 - RNA, 22 nt, Human
uggagaaauaacauuuggauuc

SEQ ID NO: 193634 - RNA, 22 nt, Human
uggacuguucauugauacugga

SEQ ID NO: 193635 - RNA, 22 nt, Human
uggagagaaguucuauaaauca

SEQ ID NO: 193636 - RNA, 22 nt, Human
ucugguuuggguugcuauggcu

SEQ ID NO: 193637 - RNA, 20 nt, Human
ucuugucuggcagccuggag

SEQ ID NO: 193638 - RNA, 22 nt, Human
uggcccagaucucugaccuuga

SEQ ID NO: 193639 - RNA, 22 nt, Human
ucuuuaaauucuuaugagugaa

SEQ ID NO: 193640 - RNA, 22 nt, Human
ucuugggcaguccucuacuggu

SEQ ID NO: 193641 - RNA, 20 nt, Human
uggcccagcacgacgaggac

SEQ ID NO: 193642 - RNA, 22 nt, Human
ucuuuccagaccagccccagcu

SEQ ID NO: 193643 - RNA, 22 nt, Human
ucuucuuugugguugcccaagg

SEQ ID NO: 193644 - RNA, 19 nt, Human
ucuugcaucuuccuacugu

SEQ ID NO: 193645 - RNA, 22 nt, Human
ucuugauggugauguuguguca

SEQ ID NO: 193646 - RNA, 22 nt, Human
uggccaugagaaucuuugcugu

SEQ ID NO: 193647 - RNA, 22 nt, Human
ucuucuuuccuuuugugcauuu

SEQ ID NO: 193648 - RNA, 22 nt, Human
uggcagccucugguccuuaguu

SEQ ID NO: 193649 - RNA, 20 nt, Human
uggcaugcucucuuuuuagg

SEQ ID NO: 193650 - RNA, 22 nt, Human
uggcaggggaaaagggguggga

SEQ ID NO: 193651 - RNA, 21 nt, Human
uggcaggcagcuggaagcuug

SEQ ID NO: 193652 - RNA, 22 nt, Human
uggcagcucauuuggaaaugga

SEQ ID NO: 193653 - RNA, 22 nt, Human
uggaguuuauuugaauucuugg

SEQ ID NO: 193654 - RNA, 22 nt, Human
ucuguucucuuguucugacggu

SEQ ID NO: 193655 - RNA, 22 nt, Human
uggagucucacuuccuggaauu

SEQ ID NO: 193656 - RNA, 20 nt, Human
uggagggaggaggggcccaa

SEQ ID NO: 193657 - RNA, 22 nt, Human
ucuguucaugucuuuuuaagug

SEQ ID NO: 193658 - RNA, 22 nt, Human
uggagggaagcaaacacuagau

SEQ ID NO: 193659 - RNA, 22 nt, Human
ucuguuuuucagaccuuuuugg

SEQ ID NO: 193660 - RNA, 22 nt, Human
uggaugcuccaaguagaccuua

SEQ ID NO: 193661 - RNA, 22 nt, Human
uggaguuuuaaucuguacagaa

SEQ ID NO: 193662 - RNA, 22 nt, Human
uggcacugaagcuggaaagccu

SEQ ID NO: 193663 - RNA, 22 nt, Human
uggcagaaugaagacuggggcc

SEQ ID NO: 193664 - RNA, 18 nt, Human
uggcaaugccaaaggcuu

SEQ ID NO: 193665 - RNA, 22 nt, Human
uggauucucuguagccugguuc

SEQ ID NO: 193666 - RNA, 22 nt, Human
ucuuagacagagaagacuauug

SEQ ID NO: 193667 - RNA, 22 nt, Human
ucgaaacuucucauuuaucugu

SEQ ID NO: 193668 - RNA, 21 nt, Human
ugccuggccuuugcuuuuccu

SEQ ID NO: 193669 - RNA, 22 nt, Human
ugccuguguauuuccggccugc

SEQ ID NO: 193670 - RNA, 19 nt, Human
uccuuaguugcugccgcua

SEQ ID NO: 193671 - RNA, 22 nt, Human
ugccgccgugggucccgacgcg

SEQ ID NO: 193672 - RNA, 22 nt, Human
ugccgccccggggcccccagcc

SEQ ID NO: 193673 - RNA, 22 nt, Human
uccuggcuguuagagaggcaag

SEQ ID NO: 193674 - RNA, 21 nt, Human
uccugcagggcagcagagugg

SEQ ID NO: 193675 - RNA, 22 nt, Human
uccugggucugugagccauacu

SEQ ID NO: 193676 - RNA, 22 nt, Human
ugccaucaugucagauuuggga

SEQ ID NO: 193677 - RNA, 22 nt, Human
ugccaugguuguacaguagcag

SEQ ID NO: 193678 - RNA, 22 nt, Human
uccucuucaaaauagcucugaa

SEQ ID NO: 193679 - RNA, 22 nt, Human
ugccagauuaugucuccagggc

SEQ ID NO: 193680 - RNA, 20 nt, Human
ugccagagagcucauacccu

SEQ ID NO: 193681 - RNA, 22 nt, Human
uccucagcaagacgcuggcagc

SEQ ID NO: 193682 - RNA, 22 nt, Human
ugcauguuuuaagugaagcuga

SEQ ID NO: 193683 - RNA, 22 nt, Human
ucccuuaacucaaguggugcuc

SEQ ID NO: 193684 - RNA, 22 nt, Human
ucccuucccaccccugccuuuu

SEQ ID NO: 193685 - RNA, 22 nt, Human
ucccuucagcuccagcucugcu

SEQ ID NO: 193686 - RNA, 23 nt, Human
ucccuuuguucuugcuaggaugu

SEQ ID NO: 193687 - RNA, 22 nt, Human
ugcaugacugaucuguuuguca

SEQ ID NO: 193688 - RNA, 22 nt, Human
ugcaugacaauugccgucaagu

SEQ ID NO: 193689 - RNA, 22 nt, Human
uccguugaggcugccaggcgag

SEQ ID NO: 193690 - RNA, 22 nt, Human
ugcguugaggaccgcgagggcg

SEQ ID NO: 193691 - RNA, 22 nt, Human
ugcggugcgcccgggcgagugc

SEQ ID NO: 193692 - RNA, 21 nt, Human
ugcguaugucuuguauuacuc

SEQ ID NO: 193693 - RNA, 22 nt, Human
ucgauccaggaaggcugguuua

SEQ ID NO: 193694 - RNA, 22 nt, Human
ucgaugcuggcgcagguuucac

SEQ ID NO: 193695 - RNA, 22 nt, Human
ucgaggagagucgccagcugcu

SEQ ID NO: 193696 - RNA, 22 nt, Human
ugcgccaggacacccguggcgg

SEQ ID NO: 193697 - RNA, 22 nt, Human
ugcggcucaaagggaaggccuu

SEQ ID NO: 193698 - RNA, 22 nt, Human
ugcuccguucuucugcuucuug

SEQ ID NO: 193699 - RNA, 22 nt, Human
ucggccggagggggcgggcgca

SEQ ID NO: 193700 - RNA, 20 nt, Human
ugcuaucugcucucccuucu

SEQ ID NO: 193701 - RNA, 22 nt, Human
ugcuaucuagaaauacuggguu

SEQ ID NO: 193702 - RNA, 22 nt, Human
ugcuaaugagugcugugugaag

SEQ ID NO: 193703 - RNA, 22 nt, Human
ugcuauccagacacauaugauc

SEQ ID NO: 193704 - RNA, 22 nt, Human
ucuaaucuuugaaaucaggguc

SEQ ID NO: 193705 - RNA, 22 nt, Human
ucuaauagauuuggaguggaaa

SEQ ID NO: 193706 - RNA, 20 nt, Human
ucuaaugaagugagcuuagc

SEQ ID NO: 193707 - RNA, 22 nt, Human
ugcugcacccuucauuuuccca

SEQ ID NO: 193708 - RNA, 22 nt, Human
ugcugacuauacauuuagcauu

SEQ ID NO: 193709 - RNA, 22 nt, Human
ucuaaugcuuccucucauccca

SEQ ID NO: 193710 - RNA, 22 nt, Human
ugcugcacuuauggcucugagg

SEQ ID NO: 193711 - RNA, 22 nt, Human
ucuaaagcuccuuccacuaaaa

SEQ ID NO: 193712 - RNA, 22 nt, Human
ucguuucuuuuucuucccugga

SEQ ID NO: 193713 - RNA, 22 nt, Human
ucgugacuggacaaacuugggu

SEQ ID NO: 193714 - RNA, 22 nt, Human
ucgugaagaaauguggacuuca

SEQ ID NO: 193715 - RNA, 22 nt, Human
ugcucugguccucccucggcgc

SEQ ID NO: 193716 - RNA, 23 nt, Human
ucgucgucagccacuaccucccc

SEQ ID NO: 193717 - RNA, 22 nt, Human
ucguauaguugcugcagauggu

SEQ ID NO: 193718 - RNA, 22 nt, Human
ucgggcgaauguuguuuuucuc

SEQ ID NO: 193719 - RNA, 22 nt, Human
ugcucgggcuccuuugagugag

SEQ ID NO: 193720 - RNA, 22 nt, Human
ugcacgcacuugcucuccagcg

SEQ ID NO: 193721 - RNA, 19 nt, Human
ugcagcuguaugagcuuaa

SEQ ID NO: 193722 - RNA, 22 nt, Human
ugcagcgugaggacagcugagc

SEQ ID NO: 193723 - RNA, 22 nt, Human
ugcagccuuuguccuugggcua

SEQ ID NO: 193724 - RNA, 22 nt, Human
ugcagccucacgcauccgcauu

SEQ ID NO: 193725 - RNA, 22 nt, Human
ugcagcagaauauggcugcagg

SEQ ID NO: 193726 - RNA, 22 nt, Human
uccauguauugcuaacaaauag

SEQ ID NO: 193727 - RNA, 22 nt, Human
ugcaacuacccccaggauuuua

SEQ ID NO: 193728 - RNA, 22 nt, Human
uccaugcaguagaggcgcuggg

SEQ ID NO: 193729 - RNA, 22 nt, Human
uccauggucgauggcugcuggg

SEQ ID NO: 193730 - RNA, 19 nt, Human
ugcaagcuuuuucuuguua

SEQ ID NO: 193731 - RNA, 22 nt, Human
ugcaagauccagucuugagaag

SEQ ID NO: 193732 - RNA, 22 nt, Human
ugcaagugccauggauucaggu

SEQ ID NO: 193733 - RNA, 21 nt, Human
ugcaaugcauugacagcagca

SEQ ID NO: 193734 - RNA, 22 nt, Human
uccaggcagcugcuugaugaua

SEQ ID NO: 193735 - RNA, 22 nt, Human
ugauucacgcuucucuuuaaac

SEQ ID NO: 193736 - RNA, 22 nt, Human
uccacuaucagaccuguagucu

SEQ ID NO: 193737 - RNA, 22 nt, Human
uccaccuaagucuccgggagcu

SEQ ID NO: 193738 - RNA, 22 nt, Human
uccagacucaaaaaccagaugg

SEQ ID NO: 193739 - RNA, 22 nt, Human
ugauguauaaaaagagugaaau

SEQ ID NO: 193740 - RNA, 22 nt, Human
uccacagggaugccugcggcuu

SEQ ID NO: 193741 - RNA, 22 nt, Human
uccacagugguggaauuguuca

SEQ ID NO: 193742 - RNA, 22 nt, Human
uccaccaccaucacagucagac

SEQ ID NO: 193743 - RNA, 22 nt, Human
uccaccugucccugcuuccugc

SEQ ID NO: 193744 - RNA, 20 nt, Human
uccacugagcgucacggcag

SEQ ID NO: 193745 - RNA, 22 nt, Human
uccaugauauauaugugcacau

SEQ ID NO: 193746 - RNA, 23 nt, Human
ugcaaaauuugcagaguucgaug

SEQ ID NO: 193747 - RNA, 22 nt, Human
ugcaaaaagagcgaggagcccu

SEQ ID NO: 193748 - RNA, 22 nt, Human
uccagugguggcucccggaccu

SEQ ID NO: 193749 - RNA, 22 nt, Human
ugauuuggcaucaguguauccu

SEQ ID NO: 193750 - RNA, 22 nt, Human
uccaguggcaccuuggcccuca

SEQ ID NO: 193751 - RNA, 22 nt, Human
uccagguuuggcuuuauaacuu

SEQ ID NO: 193752 - RNA, 22 nt, Human
uccagguccuacuggcccauag

SEQ ID NO: 193753 - RNA, 22 nt, Human
uccagguggcuuuccuggggga

SEQ ID NO: 193754 - RNA, 22 nt, Human
uccaggucgggggugggccggc

SEQ ID NO: 193755 - RNA, 22 nt, Human
ugaugcuagaacuuccaagaua

SEQ ID NO: 193756 - RNA, 22 nt, Human
uccaaugugccuuauuuugagc

SEQ ID NO: 193757 - RNA, 19 nt, Human
ugaucuccaguacagacau

SEQ ID NO: 193758 - RNA, 22 nt, Human
ugaugaucaugcagguugguuu

SEQ ID NO: 193759 - RNA, 17 nt, Human
ucauuuauccucuuugg

SEQ ID NO: 193760 - RNA, 17 nt, Human
ucauuucaguaaaucca

SEQ ID NO: 193761 - RNA, 22 nt, Human
ucauuauuuggaauaugggacu

SEQ ID NO: 193762 - RNA, 22 nt, Human
ucauuagcuaucagaguggaac

SEQ ID NO: 193763 - RNA, 20 nt, Human
ugauccacucucauugcucu

SEQ ID NO: 193764 - RNA, 22 nt, Human
ugaucauugaacaucgaguuaa

SEQ ID NO: 193765 - RNA, 20 nt, Human
ugauaggcauugacauaagg

SEQ ID NO: 193766 - RNA, 23 nt, Human
ucauugcucaagauaaugguuga

SEQ ID NO: 193767 - RNA, 22 nt, Human
ucauuauuuugauguauuuccu

SEQ ID NO: 193768 - RNA, 22 nt, Human
ucauuguuuacugucuuuuuuc

SEQ ID NO: 193769 - RNA, 22 nt, Human
ucauuguuucugcuuuucauga

SEQ ID NO: 193770 - RNA, 22 nt, Human
ucauuguguaguagagguggca

SEQ ID NO: 193771 - RNA, 22 nt, Human
ucauugugugugcuucuugggc

SEQ ID NO: 193772 - RNA, 22 nt, Human
ucauucucucguauucgcgaau

SEQ ID NO: 193773 - RNA, 22 nt, Human
ucauugguugcguaauuugauu

SEQ ID NO: 193774 - RNA, 22 nt, Human
ugaguuagcucuauucuuuugg

SEQ ID NO: 193775 - RNA, 22 nt, Human
ugagugcuuuucgguguaccgu

SEQ ID NO: 193776 - RNA, 22 nt, Human
ugaguccagaugggccagcagg

SEQ ID NO: 193777 - RNA, 22 nt, Human
ugagugacuguugucaagaugg

SEQ ID NO: 193778 - RNA, 22 nt, Human
ugaguuuuggaagauguuacag

SEQ ID NO: 193779 - RNA, 22 nt, Human
ugaguucugacugagcaugggg

SEQ ID NO: 193780 - RNA, 22 nt, Human
ucaugacaacuugcacaguuuu

SEQ ID NO: 193781 - RNA, 22 nt, Human
ugaguuuaggccaggauauggu

SEQ ID NO: 193782 - RNA, 19 nt, Human
ugaguacuaaugagauuga

SEQ ID NO: 193783 - RNA, 22 nt, Human
ugagggucgcaagcaccaggcc

SEQ ID NO: 193784 - RNA, 22 nt, Human
ugaggucaggcagggguuuggc

SEQ ID NO: 193785 - RNA, 23 nt, Human
ugaggucuuggaaguucuguuug

SEQ ID NO: 193786 - RNA, 22 nt, Human
ugagguauuuggauuuauauuu

SEQ ID NO: 193787 - RNA, 22 nt, Human
ugagggaugccucuccuuccgg

SEQ ID NO: 193788 - RNA, 22 nt, Human
ugagggauuucuggccuuaacu

SEQ ID NO: 193789 - RNA, 22 nt, Human
ugagggaguguggauacaguag

SEQ ID NO: 193790 - RNA, 22 nt, Human
ugaggcuuucacuuggcaaaga

SEQ ID NO: 193791 - RNA, 22 nt, Human
ucaggcgcucuucguggcugcc

SEQ ID NO: 193792 - RNA, 22 nt, Human
uagugcuagaagcaaagacaaa

SEQ ID NO: 193793 - RNA, 22 nt, Human
uagugcuucauucuauugguuu

SEQ ID NO: 193794 - RNA, 22 nt, Human
uagugcuuaaaacagaauuuuc

SEQ ID NO: 193795 - RNA, 22 nt, Human
uaguggaaccuucuaaaugacg

SEQ ID NO: 193796 - RNA, 22 nt, Human
ucuacugagugcugagauuuug

SEQ ID NO: 193797 - RNA, 22 nt, Human
ucuuccagauacuuccugacuu

SEQ ID NO: 193798 - RNA, 22 nt, Human
ucuacgugggaguucaggauuc

SEQ ID NO: 193799 - RNA, 21 nt, Human
ucuagaugggaugaaaggugc

SEQ ID NO: 193800 - RNA, 21 nt, Human
ucuucccaggccuuaaagggc

SEQ ID NO: 193801 - RNA, 22 nt, Human
ucuucccgggcaucucugcuca

SEQ ID NO: 193802 - RNA, 22 nt, Human
ucuucuuaggaaagucaggagg

SEQ ID NO: 193803 - RNA, 22 nt, Human
uauucuucaacuuuucuccucu

SEQ ID NO: 193804 - RNA, 22 nt, Human
uauugguagauggagagagaca

SEQ ID NO: 193805 - RNA, 22 nt, Human
uauuguauuagcucuuggagau

SEQ ID NO: 193806 - RNA, 22 nt, Human
uauugauuuuguugcuaccugg

SEQ ID NO: 193807 - RNA, 22 nt, Human
ucuugcuggagucaaggcuaca

SEQ ID NO: 193808 - RNA, 22 nt, Human
ucuugugagcugagauaaagcc

SEQ ID NO: 193809 - RNA, 22 nt, Human
ucuugucacagcuugacuccua

SEQ ID NO: 193810 - RNA, 22 nt, Human
ucuugcuguggcagaucuggag

SEQ ID NO: 193811 - RNA, 22 nt, Human
ucuuggucccugagcucuuuca

SEQ ID NO: 193812 - RNA, 22 nt, Human
ucuuucucuccagccuggaccu

SEQ ID NO: 193813 - RNA, 22 nt, Human
ucuuuauuucccuaacuugcua

SEQ ID NO: 193814 - RNA, 22 nt, Human
ucuuuaucugugagcagucucc

SEQ ID NO: 193815 - RNA, 19 nt, Human
ucuuucauuucuagcucug

SEQ ID NO: 193816 - RNA, 22 nt, Human
uauuguuuuaagguguauuaau

SEQ ID NO: 193817 - RNA, 22 nt, Human
ucuuucugaugggaagggucaa

SEQ ID NO: 193818 - RNA, 22 nt, Human
ucuuugcagaauuuaacuuugc

SEQ ID NO: 193819 - RNA, 22 nt, Human
uauuuacuguguucaucccucu

SEQ ID NO: 193820 - RNA, 22 nt, Human
ucuuugcauggacauguguuuu

SEQ ID NO: 193821 - RNA, 20 nt, Human
uauuucaaugugccaaguuu

SEQ ID NO: 193822 - RNA, 22 nt, Human
uauuuaugcaucacuuuuuucc

SEQ ID NO: 193823 - RNA, 22 nt, Human
uauuuuggcuccugagcucuga

SEQ ID NO: 193824 - RNA, 22 nt, Human
ugaagaauuccauggcuuccau

SEQ ID NO: 193825 - RNA, 22 nt, Human
ugaacuggauuugugagcuccu

SEQ ID NO: 193826 - RNA, 22 nt, Human
ugaacuguccuuguugucuaga

SEQ ID NO: 193827 - RNA, 22 nt, Human
ugaacuaauguuguguccuaau

SEQ ID NO: 193828 - RNA, 22 nt, Human
ugaaccugagggcaaagggaca

SEQ ID NO: 193829 - RNA, 22 nt, Human
ugaaccaugaauuacaggagca

SEQ ID NO: 193830 - RNA, 22 nt, Human
ugaaccgacaggggaagauugu

SEQ ID NO: 193831 - RNA, 22 nt, Human
uauuggguagguccuuuggagu

SEQ ID NO: 193832 - RNA, 22 nt, Human
ugaaccgcuucauggugccugu

SEQ ID NO: 193833 - RNA, 22 nt, Human
ugaaauuuuuuggagauaauuu

SEQ ID NO: 193834 - RNA, 21 nt, Human
ugaacaccaggagaaaucggu

SEQ ID NO: 193835 - RNA, 22 nt, Human
ugaacauuuuugcuugcagcuu

SEQ ID NO: 193836 - RNA, 22 nt, Human
ugaacagacuauucucccaugu

SEQ ID NO: 193837 - RNA, 21 nt, Human
ucaaccagguguugaaggcac

SEQ ID NO: 193838 - RNA, 22 nt, Human
ugaagacaguuuuacucaugag

SEQ ID NO: 193839 - RNA, 22 nt, Human
ugaagccaugcuaaauguuaca

SEQ ID NO: 193840 - RNA, 22 nt, Human
ucaacauguuuuuuaaaagaaa

SEQ ID NO: 193841 - RNA, 22 nt, Human
ucaaaaauaagauauucuggac

SEQ ID NO: 193842 - RNA, 22 nt, Human
uauuuuuguuuaccaguuaaca

SEQ ID NO: 193843 - RNA, 22 nt, Human
uauuuuucacagauuggugcuu

SEQ ID NO: 193844 - RNA, 22 nt, Human
ucaaagaucuuugcuuuugggg

SEQ ID NO: 193845 - RNA, 22 nt, Human
ucaaauaugggccagaggaaau

SEQ ID NO: 193846 - RNA, 22 nt, Human
ugaaaggaauuuaaauguuguu

SEQ ID NO: 193847 - RNA, 22 nt, Human
ugaaaugccucuuugguucuaa

SEQ ID NO: 193848 - RNA, 22 nt, Human
uauuuucucugccacacuucca

SEQ ID NO: 193849 - RNA, 22 nt, Human
uauuuugaggugaaagaguuug

SEQ ID NO: 193850 - RNA, 22 nt, Human
uauuuuauuuagguuuaguugu

SEQ ID NO: 193851 - RNA, 23 nt, Human
uauuuuccccuguaauauguauu

SEQ ID NO: 193852 - RNA, 22 nt, Human
ucuuuuaucuguuguguaacaa

SEQ ID NO: 193853 - RNA, 22 nt, Human
ucuuuucagccagcugguagga

SEQ ID NO: 193854 - RNA, 22 nt, Human
uauuucaugagugaauaucuag

SEQ ID NO: 193855 - RNA, 22 nt, Human
uauuuacuuugaggaaguuguu

SEQ ID NO: 193856 - RNA, 22 nt, Human
uauuucaucugaacuucccaac

SEQ ID NO: 193857 - RNA, 22 nt, Human
uauuuguuuuuaaugcugggug

SEQ ID NO: 193858 - RNA, 22 nt, Human
ucuuuuuaugucaaaaucgaug

SEQ ID NO: 193859 - RNA, 22 nt, Human
uauuuguauugucuuaucacuu

SEQ ID NO: 193860 - RNA, 22 nt, Human
uauuugauggaacucuugcuuu

SEQ ID NO: 193861 - RNA, 21 nt, Human
ucagccuguccaguguuaacc

SEQ ID NO: 193862 - RNA, 23 nt, Human
ucagccgcuggcgaguccacugg

SEQ ID NO: 193863 - RNA, 22 nt, Human
ugaccuuuuuaaauuauuuuua

SEQ ID NO: 193864 - RNA, 22 nt, Human
ugaccuccuaagugacagaauu

SEQ ID NO: 193865 - RNA, 22 nt, Human
ugacgcauggccagcucugucu

SEQ ID NO: 193866 - RNA, 22 nt, Human
ucagcaaugggauucaggcuuu

SEQ ID NO: 193867 - RNA, 22 nt, Human
ugacauuugagagagauauaca

SEQ ID NO: 193868 - RNA, 22 nt, Human
ucagcgucuccaaaagagcccg

SEQ ID NO: 193869 - RNA, 22 nt, Human
ucagcguuggccuccuccaggg

SEQ ID NO: 193870 - RNA, 22 nt, Human
ugacugguauuuguaaaccaua

SEQ ID NO: 193871 - RNA, 22 nt, Human
ugacguuugcgccgcgcacgac

SEQ ID NO: 193872 - RNA, 22 nt, Human
ucaggaggucugcugcggggug

SEQ ID NO: 193873 - RNA, 22 nt, Human
ucaggacacuuaauaggaacag

SEQ ID NO: 193874 - RNA, 22 nt, Human
ucagcuucaucuugagcccaca

SEQ ID NO: 193875 - RNA, 22 nt, Human
ucacuuccuugcagcuguagaa

SEQ ID NO: 193876 - RNA, 22 nt, Human
ucagaacucuagucucagccug

SEQ ID NO: 193877 - RNA, 22 nt, Human
ugacacacagggggauggaguu

SEQ ID NO: 193878 - RNA, 22 nt, Human
ugacacagaccaaguggugcug

SEQ ID NO: 193879 - RNA, 22 nt, Human
ugacagaaaccaccccccaggu

SEQ ID NO: 193880 - RNA, 22 nt, Human
ugaauuuguaggaauucuccau

SEQ ID NO: 193881 - RNA, 22 nt, Human
ugaauuucuuuuuaaaauauua

SEQ ID NO: 193882 - RNA, 22 nt, Human
ugaauuuuggcaauuuucugug

SEQ ID NO: 193883 - RNA, 22 nt, Human
ucagagccagacacacagcaga

SEQ ID NO: 193884 - RNA, 22 nt, Human
ucagagugagcuggggcugcuu

SEQ ID NO: 193885 - RNA, 22 nt, Human
ucagaacugcggggaagguggg

SEQ ID NO: 193886 - RNA, 22 nt, Human
ugacaguuugacugcaaccuuu

SEQ ID NO: 193887 - RNA, 22 nt, Human
ugacauccuacaccccuggguc

SEQ ID NO: 193888 - RNA, 22 nt, Human
ucagaaggagagacagcgugga

SEQ ID NO: 193889 - RNA, 21 nt, Human
ucagaaucguuccagguagau

SEQ ID NO: 193890 - RNA, 17 nt, Human
ugacagcuaaggggcuu

SEQ ID NO: 193891 - RNA, 22 nt, Human
ugacagucacagcagaaacucg

SEQ ID NO: 193892 - RNA, 22 nt, Human
ucacuagcaucugaauauuguu

SEQ ID NO: 193893 - RNA, 22 nt, Human
ucacucgccuuuucguucgccg

SEQ ID NO: 193894 - RNA, 22 nt, Human
ucaccuguuggauguauacugu

SEQ ID NO: 193895 - RNA, 22 nt, Human
ucaccuuuugaauugcuguugu

SEQ ID NO: 193896 - RNA, 22 nt, Human
ucaccugccuggguggucaccu

SEQ ID NO: 193897 - RNA, 22 nt, Human
ucacugaacucucauagagaaa

SEQ ID NO: 193898 - RNA, 22 nt, Human
ucacugccuagggcuacugugc

SEQ ID NO: 193899 - RNA, 22 nt, Human
ucacaguucaacuaguucagau

SEQ ID NO: 193900 - RNA, 22 nt, Human
ugaaucagaccuucauugggua

SEQ ID NO: 193901 - RNA, 22 nt, Human
ucaccauguuuucauaggaaca

SEQ ID NO: 193902 - RNA, 22 nt, Human
ucacauugcauuuucucauuug

SEQ ID NO: 193903 - RNA, 22 nt, Human
ucacauggauuaacucauuuau

SEQ ID NO: 193904 - RNA, 22 nt, Human
ugaauguggucaggaaauuguu

SEQ ID NO: 193905 - RNA, 22 nt, Human
ugaauguguacacgauuguuug

SEQ ID NO: 193906 - RNA, 22 nt, Human
ugaaugcuacccugcuggcucu

SEQ ID NO: 193907 - RNA, 22 nt, Human
ugaaugaagcacuguaauucuc

SEQ ID NO: 193908 - RNA, 22 nt, Human
ucacccuguggcuauaaggcaa

SEQ ID NO: 193909 - RNA, 22 nt, Human
ugaauaaucuuggguauuaaua

SEQ ID NO: 193910 - RNA, 22 nt, Human
ucaagggaccaagcauucauua

SEQ ID NO: 193911 - RNA, 22 nt, Human
ucaagguauuauuuuuguggug

SEQ ID NO: 193912 - RNA, 22 nt, Human
ucaauuggcuacaaauaaugua

SEQ ID NO: 193913 - RNA, 22 nt, Human
ucaauuuauguggcuauucauu

SEQ ID NO: 193914 - RNA, 22 nt, Human
ucacaagaagaaauuaaacugu

SEQ ID NO: 193915 - RNA, 22 nt, Human
ugaaucuuguuuacugauuccu

SEQ ID NO: 193916 - RNA, 22 nt, Human
ugaauagucaaagcacaagagg

SEQ ID NO: 193917 - RNA, 22 nt, Human
ugaaugaacugaugaacuuaac

SEQ ID NO: 193918 - RNA, 22 nt, Human
ugaaucugagccugcgcaaagu

SEQ ID NO: 193919 - RNA, 22 nt, Human
ugaagguggcuugcagcuaguc

SEQ ID NO: 193920 - RNA, 22 nt, Human
ugaaggggaaagucuugcuaua

SEQ ID NO: 193921 - RNA, 22 nt, Human
ucaagcuggaaaugaagaaucu

SEQ ID NO: 193922 - RNA, 22 nt, Human
ucaagagauauaugcugguuua

SEQ ID NO: 193923 - RNA, 22 nt, Human
ucaagaagauaaugucuagggu

SEQ ID NO: 193924 - RNA, 22 nt, Human
guuccgcggccucgcgcugagc

SEQ ID NO: 193925 - RNA, 22 nt, Human
guucagauucuuucucuuucac

SEQ ID NO: 193926 - RNA, 18 nt, Human
uauuccucuuccucuauc

SEQ ID NO: 193927 - RNA, 22 nt, Human
guucaaucucucaugcauuuuc

SEQ ID NO: 193928 - RNA, 22 nt, Human
uauuaauugugguuauuguauu

SEQ ID NO: 193929 - RNA, 22 nt, Human
guuagaauggacaaagcugaaa

SEQ ID NO: 193930 - RNA, 22 nt, Human
uauguuaauuaccagcacugau

SEQ ID NO: 193931 - RNA, 23 nt, Human
guuauugcuggugcuggccagcc

SEQ ID NO: 193932 - RNA, 22 nt, Human
guguguggacgucugagcccag

SEQ ID NO: 193933 - RNA, 22 nt, Human
uauggcuucucagucaugaaaa

SEQ ID NO: 193934 - RNA, 22 nt, Human
uaugguuagugcuguagauuau

SEQ ID NO: 193935 - RNA, 22 nt, Human
uauguuaaauguuugauguuua

SEQ ID NO: 193936 - RNA, 22 nt, Human
uaugugugaguauauaugcaca

SEQ ID NO: 193937 - RNA, 18 nt, Human
uaugugucuguuacaacu

SEQ ID NO: 193938 - RNA, 22 nt, Human
uaugggcaagagauaggugguc

SEQ ID NO: 193939 - RNA, 22 nt, Human
uaugguuucuccugcagauuug

SEQ ID NO: 193940 - RNA, 22 nt, Human
uauuucaguuaagaugagguca

SEQ ID NO: 193941 - RNA, 22 nt, Human
uauuuaaagucagcaacuuuuc

SEQ ID NO: 193942 - RNA, 22 nt, Human
uauuuacgcaaacaauugugca

SEQ ID NO: 193943 - RNA, 18 nt, Human
uauuuacuguguguuacc

SEQ ID NO: 193944 - RNA, 22 nt, Human
uauugaucuuugaaaccuuggu

SEQ ID NO: 193945 - RNA, 22 nt, Human
uauuggcucagucagaaguuuu

SEQ ID NO: 193946 - RNA, 22 nt, Human
guuccucucacaggcuggagcu

SEQ ID NO: 193947 - RNA, 22 nt, Human
uauugugaaggccaugugcuaa

SEQ ID NO: 193948 - RNA, 22 nt, Human
guugauaauuaauagcuuuuga

SEQ ID NO: 193949 - RNA, 22 nt, Human
guugagacugaaguucugaaag

SEQ ID NO: 193950 - RNA, 22 nt, Human
guugauuuaaccucaccuuuga

SEQ ID NO: 193951 - RNA, 22 nt, Human
uauuuuggaugcauugagaugc

SEQ ID NO: 193952 - RNA, 22 nt, Human
guugagaagaccauuuuguuca

SEQ ID NO: 193953 - RNA, 22 nt, Human
uauuucuagggcaugaaaauaa

SEQ ID NO: 193954 - RNA, 18 nt, Human
uauuugugugugugugug

SEQ ID NO: 193955 - RNA, 22 nt, Human
uauuuguuucuaguggcagcaa

SEQ ID NO: 193956 - RNA, 22 nt, Human
uauauuaaagugcuuugcagug

SEQ ID NO: 193957 - RNA, 22 nt, Human
uaucaguagaacaauggacauu

SEQ ID NO: 193958 - RNA, 22 nt, Human
uauauauaugcaccacaugugu

SEQ ID NO: 193959 - RNA, 22 nt, Human
uauaugcacucagguguaugug

SEQ ID NO: 193960 - RNA, 22 nt, Human
gugucacuuucaggagcucuaa

SEQ ID NO: 193961 - RNA, 22 nt, Human
uaucuguauuguagaacuguug

SEQ ID NO: 193962 - RNA, 22 nt, Human
uaucuccauucuagccccuugu

SEQ ID NO: 193963 - RNA, 22 nt, Human
uaucugaugcaggcucccagga

SEQ ID NO: 193964 - RNA, 23 nt, Human
uaucccauacagagagugguaca

SEQ ID NO: 193965 - RNA, 22 nt, Human
guguggcgacucagagcugccu

SEQ ID NO: 193966 - RNA, 22 nt, Human
guguguauguagguauauaugu

SEQ ID NO: 193967 - RNA, 22 nt, Human
uaugaguauagugcaccauggu

SEQ ID NO: 193968 - RNA, 22 nt, Human
uaugagguuaucuaugucguau

SEQ ID NO: 193969 - RNA, 22 nt, Human
uaugauuuucaugguagaguua

SEQ ID NO: 193970 - RNA, 22 nt, Human
gugucauuggcuucccaagucc

SEQ ID NO: 193971 - RNA, 22 nt, Human
guguccuguagaaacuguucca

SEQ ID NO: 193972 - RNA, 22 nt, Human
gugugaguggcuaagugugccu

SEQ ID NO: 193973 - RNA, 22 nt, Human
uaugaccuuaggaagcaagaag

SEQ ID NO: 193974 - RNA, 22 nt, Human
gugucuuauugauguuggcacu

SEQ ID NO: 193975 - RNA, 22 nt, Human
uaugacugcucagugaauggaa

SEQ ID NO: 193976 - RNA, 19 nt, Human
uaugacaaguacuaguucu

SEQ ID NO: 193977 - RNA, 22 nt, Human
uaguuuuaagcugacauuguuc

SEQ ID NO: 193978 - RNA, 22 nt, Human
uaguuuucaagugaguuggaag

SEQ ID NO: 193979 - RNA, 22 nt, Human
uaguuuucuuuuguguuauucu

SEQ ID NO: 193980 - RNA, 22 nt, Human
uaguucauucucucuauuccug

SEQ ID NO: 193981 - RNA, 22 nt, Human
uaguugguggagcgauuugucu

SEQ ID NO: 193982 - RNA, 22 nt, Human
gugcucaagacauuaggaauau

SEQ ID NO: 193983 - RNA, 22 nt, Human
uagcauacagauauuuaacucu

SEQ ID NO: 193984 - RNA, 22 nt, Human
uagcauccugugugaauguauu

SEQ ID NO: 193985 - RNA, 22 nt, Human
uauaggaugaugucauguugcu

SEQ ID NO: 193986 - RNA, 22 nt, Human
uauauacuugaaaauugcugag

SEQ ID NO: 193987 - RNA, 22 nt, Human
uauaaucuugcccauaguauuu

SEQ ID NO: 193988 - RNA, 22 nt, Human
uauaagaaaagucauuaucaaa

SEQ ID NO: 193989 - RNA, 22 nt, Human
guuguugucauuagcuguuuaa

SEQ ID NO: 193990 - RNA, 21 nt, Human
guugugaccaugggaguugcu

SEQ ID NO: 193991 - RNA, 22 nt, Human
ucaaggaagggguaggaauaau

SEQ ID NO: 193992 - RNA, 22 nt, Human
guugauauggaaacucuagguu

SEQ ID NO: 193993 - RNA, 22 nt, Human
uauuuuuaccuaauuuaugaga

SEQ ID NO: 193994 - RNA, 22 nt, Human
uauuuuuacuguuugaugauuc

SEQ ID NO: 193995 - RNA, 22 nt, Human
guugucuggcucugaccauucu

SEQ ID NO: 193996 - RNA, 22 nt, Human
guugucguucccccugcuuaaa

SEQ ID NO: 193997 - RNA, 22 nt, Human
guuuaaguuaaaauuuaccugc

SEQ ID NO: 193998 - RNA, 22 nt, Human
guuuaagcagauugcuguggug

SEQ ID NO: 193999 - RNA, 22 nt, Human
guuuaaaagcaaccaacaggcu

SEQ ID NO: 194000 - RNA, 22 nt, Human
guuguuuuuguuaaaacaguga

SEQ ID NO: 194001 - RNA, 22 nt, Human
ucaccaggauugggcuguaggc

SEQ ID NO: 194002 - RNA, 22 nt, Human
ucacaucugugugauugucauu

SEQ ID NO: 194003 - RNA, 21 nt, Human
ucaagugcccaagguuuguuu

SEQ ID NO: 194004 - RNA, 22 nt, Human
ucaaguccuuggcauaggauaa

SEQ ID NO: 194005 - RNA, 22 nt, Human
ucacaggagucaaggaauagua

SEQ ID NO: 194006 - RNA, 22 nt, Human
ucacagguuuaguccagcaguc

SEQ ID NO: 194007 - RNA, 22 nt, Human
ucacccagacugucugacucuu

SEQ ID NO: 194008 - RNA, 22 nt, Human
ucaccccagccuuaugacucag

SEQ ID NO: 194009 - RNA, 22 nt, Human
ucaccgucucaguacggaggga

SEQ ID NO: 194010 - RNA, 22 nt, Human
guuuaucagagagcagaggugg

SEQ ID NO: 194011 - RNA, 22 nt, Human
ucaccaugcccuucucugcucu

SEQ ID NO: 194012 - RNA, 22 nt, Human
ucaccauguacaugaagggcgg

SEQ ID NO: 194013 - RNA, 22 nt, Human
ucaccuggagagcuugcuaaua

SEQ ID NO: 194014 - RNA, 22 nt, Human
guuucuguguugauugugcccu

SEQ ID NO: 194015 - RNA, 22 nt, Human
ucacuggauucauguuucuuua

SEQ ID NO: 194016 - RNA, 22 nt, Human
ucacuguugccacggugauaau

SEQ ID NO: 194017 - RNA, 22 nt, Human
ucacuuuacaucuguaaaagga

SEQ ID NO: 194018 - RNA, 22 nt, Human
ucacuucuaugaucugucucuu

SEQ ID NO: 194019 - RNA, 23 nt, Human
ucacugccaagaaaaguuacaga

SEQ ID NO: 194020 - RNA, 22 nt, Human
ucacugaauuucaagcuagugg

SEQ ID NO: 194021 - RNA, 22 nt, Human
ucacucagucugagcaauugcu

SEQ ID NO: 194022 - RNA, 22 nt, Human
uaaaauaccacauauggugcuc

SEQ ID NO: 194023 - RNA, 22 nt, Human
uaaaaguuagcuaggacaaagu

SEQ ID NO: 194024 - RNA, 22 nt, Human
uaaaaugcucagauaaauauau

SEQ ID NO: 194025 - RNA, 22 nt, Human
uaaaccuuauuugaauaccaac

SEQ ID NO: 194026 - RNA, 22 nt, Human
ucagcucucucuuggugaucuc

SEQ ID NO: 194027 - RNA, 21 nt, Human
ucaggaagagccaguucaugc

SEQ ID NO: 194028 - RNA, 22 nt, Human
ucagcugggagaaaguuuuagg

SEQ ID NO: 194029 - RNA, 22 nt, Human
ucagcguuaguuuuucaucuaa

SEQ ID NO: 194030 - RNA, 22 nt, Human
ucagcuauccauucuccuauga

SEQ ID NO: 194031 - RNA, 22 nt, Human
ucagcucaggggauguggggga

SEQ ID NO: 194032 - RNA, 22 nt, Human
ucagcucacaauguugagaaag

SEQ ID NO: 194033 - RNA, 21 nt, Human
uaaaagaugacaagacagcuc

SEQ ID NO: 194034 - RNA, 22 nt, Human
uaaaaccauucauugaccuaug

SEQ ID NO: 194035 - RNA, 23 nt, Human
guuuuugcugcagcugaagaagg

SEQ ID NO: 194036 - RNA, 22 nt, Human
uaaaaaccuuguauuuaacucu

SEQ ID NO: 194037 - RNA, 22 nt, Human
ucagauagcaagggauaccugu

SEQ ID NO: 194038 - RNA, 19 nt, Human
ucagcagauuuugcaaaca

SEQ ID NO: 194039 - RNA, 22 nt, Human
ucagauggucauucacuagggu

SEQ ID NO: 194040 - RNA, 22 nt, Human
ucagcacagcugcuuuuacuuc

SEQ ID NO: 194041 - RNA, 22 nt, Human
ucagcaguuaagcuucccugcc

SEQ ID NO: 194042 - RNA, 22 nt, Human
ucagcaggugcuuuguuuacuc

SEQ ID NO: 194043 - RNA, 22 nt, Human
guuuuaaucuccuuauuccuaa

SEQ ID NO: 194044 - RNA, 22 nt, Human
guuuuaucuauguaauuauaaa

SEQ ID NO: 194045 - RNA, 22 nt, Human
ucagaaacuaaauguggauuug

SEQ ID NO: 194046 - RNA, 22 nt, Human
guuuucuccugcuauacagugc

SEQ ID NO: 194047 - RNA, 23 nt, Human
ucagaccaaccucuugcuggaac

SEQ ID NO: 194048 - RNA, 22 nt, Human
ucagagaaguaggcuaauggug

SEQ ID NO: 194049 - RNA, 22 nt, Human
ucagauaauccaauagagagga

SEQ ID NO: 194050 - RNA, 22 nt, Human
guuuuggagauguccauuuucc

SEQ ID NO: 194051 - RNA, 22 nt, Human
guuuuuacuuccaaugcuauga

SEQ ID NO: 194052 - RNA, 22 nt, Human
guuuuguucaugaacauugggu

SEQ ID NO: 194053 - RNA, 22 nt, Human
ucccagccugacagugcaucaa

SEQ ID NO: 194054 - RNA, 22 nt, Human
ucccagcaggcaccgcuucugc

SEQ ID NO: 194055 - RNA, 22 nt, Human
uacuucauucaaguucgcuaua

SEQ ID NO: 194056 - RNA, 22 nt, Human
uacuuaucuuagggaugcuugc

SEQ ID NO: 194057 - RNA, 22 nt, Human
uacuucaguuacaugaagguau

SEQ ID NO: 194058 - RNA, 22 nt, Human
uagacauuuacuuugaaaaaau

SEQ ID NO: 194059 - RNA, 19 nt, Human
uagacagauuuguguuacu

SEQ ID NO: 194060 - RNA, 21 nt, Human
uagaagagggaauuugucuuu

SEQ ID NO: 194061 - RNA, 22 nt, Human
uagagcucaagaagcaaaagcu

SEQ ID NO: 194062 - RNA, 19 nt, Human
uagagcagcuucagauucc

SEQ ID NO: 194063 - RNA, 22 nt, Human
uagacuggaagcuccuugaggc

SEQ ID NO: 194064 - RNA, 22 nt, Human
uagaccugugggggcagcgggc

SEQ ID NO: 194065 - RNA, 22 nt, Human
uccucguccucauccgcgucau

SEQ ID NO: 194066 - RNA, 22 nt, Human
uagcauaaaguuucuguguggu

SEQ ID NO: 194067 - RNA, 22 nt, Human
uccugcaugcuagugagugcuu

SEQ ID NO: 194068 - RNA, 22 nt, Human
uagcauuuagaacaccuugaga

SEQ ID NO: 194069 - RNA, 22 nt, Human
uagcauuuauugggcuagcaaa

SEQ ID NO: 194070 - RNA, 23 nt, Human
uccugcagauaagcugguugaca

SEQ ID NO: 194071 - RNA, 22 nt, Human
uccugagaagcacuuaauacac

SEQ ID NO: 194072 - RNA, 22 nt, Human
uccugaaugguguaauagguuu

SEQ ID NO: 194073 - RNA, 22 nt, Human
uagcaaugugggugggcuccaa

SEQ ID NO: 194074 - RNA, 22 nt, Human
uagauuuaaaaagggugggaug

SEQ ID NO: 194075 - RNA, 22 nt, Human
uagccuguuuuuaugagaauuu

SEQ ID NO: 194076 - RNA, 22 nt, Human
uagcgggucacccugcugugaa

SEQ ID NO: 194077 - RNA, 22 nt, Human
uagccguugggguaacuggaca

SEQ ID NO: 194078 - RNA, 22 nt, Human
uccuuuggaaacuggaugucuu

SEQ ID NO: 194079 - RNA, 22 nt, Human
uagucuuuguggucuuuagcua

SEQ ID NO: 194080 - RNA, 22 nt, Human
ucguggaugaagaauagaggcc

SEQ ID NO: 194081 - RNA, 22 nt, Human
ucuaaaaauuagaaauuagguc

SEQ ID NO: 194082 - RNA, 22 nt, Human
uaguauuuguaauuaucaaagc

SEQ ID NO: 194083 - RNA, 22 nt, Human
uagucggcuaggagggccuucu

SEQ ID NO: 194084 - RNA, 22 nt, Human
ucguguuggaacugcuuuguaa

SEQ ID NO: 194085 - RNA, 22 nt, Human
uaggucaaggccacuucuugga

SEQ ID NO: 194086 - RNA, 22 nt, Human
uagguauguuaacugugcaauu

SEQ ID NO: 194087 - RNA, 22 nt, Human
uaguaauagcuguaaagugugu

SEQ ID NO: 194088 - RNA, 22 nt, Human
uagguggaaccauaugaaauuu

SEQ ID NO: 194089 - RNA, 22 nt, Human
uagguuuugugucagaguagaa

SEQ ID NO: 194090 - RNA, 22 nt, Human
uaguaauauuccuacauuaugu

SEQ ID NO: 194091 - RNA, 22 nt, Human
ucgucaaaguaaugucauagca

SEQ ID NO: 194092 - RNA, 22 nt, Human
ucguauucagugcaagucaacg

SEQ ID NO: 194093 - RNA, 21 nt, Human
ucgggcggcggcugaggcggc

SEQ ID NO: 194094 - RNA, 22 nt, Human
ucgcuuuaauggucuucacagc

SEQ ID NO: 194095 - RNA, 22 nt, Human
ucggcgaccugucauggaccaa

SEQ ID NO: 194096 - RNA, 22 nt, Human
uaggggaagcauagguuuagaa

SEQ ID NO: 194097 - RNA, 22 nt, Human
uagggggagugugcugaagcca

SEQ ID NO: 194098 - RNA, 20 nt, Human
ucgcugcaagggaaauggag

SEQ ID NO: 194099 - RNA, 22 nt, Human
uaggcagggauuaggguugauu

SEQ ID NO: 194100 - RNA, 22 nt, Human
uaggcauguaaaagugaguucg

SEQ ID NO: 194101 - RNA, 22 nt, Human
uccuuuuuagguuauuguacau

SEQ ID NO: 194102 - RNA, 22 nt, Human
ucgagcgcucccugugcucucg

SEQ ID NO: 194103 - RNA, 22 nt, Human
ucgccuccucccagaucaacaa

SEQ ID NO: 194104 - RNA, 22 nt, Human
ucgcccagguuggagugcagug

SEQ ID NO: 194105 - RNA, 22 nt, Human
ucgccauguacaugaagggcgg

SEQ ID NO: 194106 - RNA, 22 nt, Human
ucgcuauuauuuuagguucuca

SEQ ID NO: 194107 - RNA, 22 nt, Human
ucgcucgcuggcuccugcccgc

SEQ ID NO: 194108 - RNA, 22 nt, Human
ucgccccccgccucacccucgg

SEQ ID NO: 194109 - RNA, 22 nt, Human
ucgcggccgcuccacaugcaca

SEQ ID NO: 194110 - RNA, 22 nt, Human
uaccucauguucaggaggauca

SEQ ID NO: 194111 - RNA, 22 nt, Human
uccagguucaguucaucaucua

SEQ ID NO: 194112 - RNA, 22 nt, Human
uacuagacugagaaucagcuga

SEQ ID NO: 194113 - RNA, 19 nt, Human
uacccggauagccagguag

SEQ ID NO: 194114 - RNA, 22 nt, Human
uacuauuuugacaugaaauuga

SEQ ID NO: 194115 - RNA, 22 nt, Human
uacucauuggagaauuacgagg

SEQ ID NO: 194116 - RNA, 22 nt, Human
uccauucccugacagccucuuu

SEQ ID NO: 194117 - RNA, 20 nt, Human
uccaguuuuggagacauucu

SEQ ID NO: 194118 - RNA, 22 nt, Human
uccagugccagcuguuaaaguu

SEQ ID NO: 194119 - RNA, 22 nt, Human
uccagugaacaucauggcucca

SEQ ID NO: 194120 - RNA, 21 nt, Human
uacugugccagggcagcucug

SEQ ID NO: 194121 - RNA, 22 nt, Human
ucccacagcuuccuagccacag

SEQ ID NO: 194122 - RNA, 23 nt, Human
ucccacauuucacagcacuuucc

SEQ ID NO: 194123 - RNA, 23 nt, Human
ucccaacuuugaaauauuccaca

SEQ ID NO: 194124 - RNA, 22 nt, Human
uacugggugagcugggcuggga

SEQ ID NO: 194125 - RNA, 22 nt, Human
uacuggaugcaacaaagcccag

SEQ ID NO: 194126 - RNA, 17 nt, Human
uccauugagacaagaag

SEQ ID NO: 194127 - RNA, 22 nt, Human
uacugccauuauccugcugaaa

SEQ ID NO: 194128 - RNA, 22 nt, Human
uacucuggaguugagaugcgag

SEQ ID NO: 194129 - RNA, 22 nt, Human
uccagcacacagguggcucuca

SEQ ID NO: 194130 - RNA, 22 nt, Human
uaccauaaagcaggcaaaugag

SEQ ID NO: 194131 - RNA, 22 nt, Human
uccagaaaucucuguugauugu

SEQ ID NO: 194132 - RNA, 22 nt, Human
uacauccuuuugaaaucccaga

SEQ ID NO: 194133 - RNA, 23 nt, Human
uaccagacccugaaagaaagugu

SEQ ID NO: 194134 - RNA, 22 nt, Human
uaccaauuaaauagccaaucua

SEQ ID NO: 194135 - RNA, 22 nt, Human
uacauuguguuaaaacagaaga

SEQ ID NO: 194136 - RNA, 22 nt, Human
uacauggauguuauccuuacug

SEQ ID NO: 194137 - RNA, 19 nt, Human
uccaccgcgugcaccucua

SEQ ID NO: 194138 - RNA, 22 nt, Human
uccaccacgaaacugcagcugc

SEQ ID NO: 194139 - RNA, 22 nt, Human
uccacgggagcgucggucucgg

SEQ ID NO: 194140 - RNA, 22 nt, Human
uacagugaggcgagauucacca

SEQ ID NO: 194141 - RNA, 22 nt, Human
uacaguauuuuuuaagaaaaaa

SEQ ID NO: 194142 - RNA, 22 nt, Human
uccacagcagagcacgguaccu

SEQ ID NO: 194143 - RNA, 22 nt, Human
uacagauggacacuguuucaag

SEQ ID NO: 194144 - RNA, 22 nt, Human
uacagauaaaaaugcuguucuu

SEQ ID NO: 194145 - RNA, 22 nt, Human
uaaggcuuuggucaccauggag

SEQ ID NO: 194146 - RNA, 22 nt, Human
uaaggcuguuaggaggauuaaa

SEQ ID NO: 194147 - RNA, 22 nt, Human
ucauccugucucuguucggaau

SEQ ID NO: 194148 - RNA, 22 nt, Human
ucaucccuuccugcacuauuag

SEQ ID NO: 194149 - RNA, 21 nt, Human
ucauccagguccugcuucuuc

SEQ ID NO: 194150 - RNA, 22 nt, Human
ucauccgcaaccacuuuagccu

SEQ ID NO: 194151 - RNA, 22 nt, Human
ucauccugaagaaccugcuucc

SEQ ID NO: 194152 - RNA, 22 nt, Human
uaagcguuugggaguuaugaac

SEQ ID NO: 194153 - RNA, 23 nt, Human
uaagccacgugacccuuuauuug

SEQ ID NO: 194154 - RNA, 21 nt, Human
uaagaacauuaucuucuuccu

SEQ ID NO: 194155 - RNA, 22 nt, Human
uaaagacaauuucgagcuguag

SEQ ID NO: 194156 - RNA, 22 nt, Human
uaaagaggagaauuaagucagc

SEQ ID NO: 194157 - RNA, 19 nt, Human
uaagaaucaccaggggugu

SEQ ID NO: 194158 - RNA, 22 nt, Human
uaagaccuuuuugaaaucacug

SEQ ID NO: 194159 - RNA, 22 nt, Human
uaagauuuuuacaaauagagug

SEQ ID NO: 194160 - RNA, 22 nt, Human
uaauggagggucugagucuggg

SEQ ID NO: 194161 - RNA, 22 nt, Human
uaauuauuaauuuuagguugcu

SEQ ID NO: 194162 - RNA, 20 nt, Human
uacaaggauguucaucagag

SEQ ID NO: 194163 - RNA, 22 nt, Human
uaagugugcauguguauuauau

SEQ ID NO: 194164 - RNA, 22 nt, Human
uaauaagugcuggcuguacauc

SEQ ID NO: 194165 - RNA, 22 nt, Human
uaauaauuaacagugauggguc

SEQ ID NO: 194166 - RNA, 22 nt, Human
uaauagauagggagaguugcug

SEQ ID NO: 194167 - RNA, 20 nt, Human
ucauucagaaucaguaugca

SEQ ID NO: 194168 - RNA, 22 nt, Human
ucauugguugcauaauuugauc

SEQ ID NO: 194169 - RNA, 22 nt, Human
uaaugcucauuuggcucugcaa

SEQ ID NO: 194170 - RNA, 22 nt, Human
uacugaaagagugguggacucu

SEQ ID NO: 194171 - RNA, 22 nt, Human
gugaagaugccucaggugaccc

SEQ ID NO: 194172 - RNA, 22 nt, Human
gugaagcacaugggcguugggu

SEQ ID NO: 194173 - RNA, 23 nt, Human
uacagccaugucgcugauuuaac

SEQ ID NO: 194174 - RNA, 22 nt, Human
uacagcuuccucuaugguggcc

SEQ ID NO: 194175 - RNA, 21 nt, Human
uaccacugaaauugaucguuc

SEQ ID NO: 194176 - RNA, 22 nt, Human
uacaggaggaugugcagccagg

SEQ ID NO: 194177 - RNA, 22 nt, Human
uacccauuuugguucuugaugc

SEQ ID NO: 194178 - RNA, 20 nt, Human
uacccgcagcugggucuggc

SEQ ID NO: 194179 - RNA, 22 nt, Human
uacuaaacugcauuucuaucua

SEQ ID NO: 194180 - RNA, 22 nt, Human
uacaaauugccugacggcaggu

SEQ ID NO: 194181 - RNA, 22 nt, Human
uaauaguugaaggucaucacua

SEQ ID NO: 194182 - RNA, 22 nt, Human
gucuauuuauagacagauccua

SEQ ID NO: 194183 - RNA, 21 nt, Human
uaauaauugggggcagggugg

SEQ ID NO: 194184 - RNA, 22 nt, Human
uaauaaaaauuuaauucacauu

SEQ ID NO: 194185 - RNA, 23 nt, Human
gucagcuugaccaguggagaguc

SEQ ID NO: 194186 - RNA, 22 nt, Human
gucugaaauaucuuuugucuug

SEQ ID NO: 194187 - RNA, 22 nt, Human
gucuccugcccacccugguccc

SEQ ID NO: 194188 - RNA, 20 nt, Human
uacaauauucccacuuugcu

SEQ ID NO: 194189 - RNA, 22 nt, Human
gucugcagcacugugcacgguc

SEQ ID NO: 194190 - RNA, 18 nt, Human
uacagauguaugucuaca

SEQ ID NO: 194191 - RNA, 22 nt, Human
gucugcccuuggccugggacuu

SEQ ID NO: 194192 - RNA, 22 nt, Human
gucugccagauucugcuggauc

SEQ ID NO: 194193 - RNA, 22 nt, Human
uacaaucaggcucuagcuucuc

SEQ ID NO: 194194 - RNA, 22 nt, Human
uacaccaugcuccagcaggaca

SEQ ID NO: 194195 - RNA, 22 nt, Human
uacaagcucuuguagggggaaa

SEQ ID NO: 194196 - RNA, 22 nt, Human
gugccuuuuucccaguucauug

SEQ ID NO: 194197 - RNA, 22 nt, Human
gugccuggugcaggauaaucac

SEQ ID NO: 194198 - RNA, 22 nt, Human
gugccuggaaucuuuucuucac

SEQ ID NO: 194199 - RNA, 22 nt, Human
uagcaggaggcaguuccucgcu

SEQ ID NO: 194200 - RNA, 22 nt, Human
uagcagaacaauagucaaugau

SEQ ID NO: 194201 - RNA, 22 nt, Human
uagcaggagagaaguuuuaagu

SEQ ID NO: 194202 - RNA, 22 nt, Human
gugccaaauagcuugauuaaga

SEQ ID NO: 194203 - RNA, 22 nt, Human
gugccgaugaggccuggcauuc

SEQ ID NO: 194204 - RNA, 22 nt, Human
uagaugaacagaaagccacugu

SEQ ID NO: 194205 - RNA, 22 nt, Human
gugcacuugaucuagacagauu

SEQ ID NO: 194206 - RNA, 22 nt, Human
uagaggcuagugguuaugaccu

SEQ ID NO: 194207 - RNA, 22 nt, Human
uagaguaagugugugcugagcu

SEQ ID NO: 194208 - RNA, 22 nt, Human
gugcacagaaacauacaaugug

SEQ ID NO: 194209 - RNA, 19 nt, Human
gugcacugucacuuugcuc

SEQ ID NO: 194210 - RNA, 22 nt, Human
gugcagcugggcgcugaccuuc

SEQ ID NO: 194211 - RNA, 22 nt, Human
uagaaugggaggggaaucaucc

SEQ ID NO: 194212 - RNA, 22 nt, Human
gugaggcccaggugaaauuaac

SEQ ID NO: 194213 - RNA, 22 nt, Human
gugaguguguccgacuccaagg

SEQ ID NO: 194214 - RNA, 22 nt, Human
uagaaauaaacacugcuaccuu

SEQ ID NO: 194215 - RNA, 19 nt, Human
uaccagguuggagaggccc

SEQ ID NO: 194216 - RNA, 22 nt, Human
gugaggugauugcugguguuug

SEQ ID NO: 194217 - RNA, 22 nt, Human
gugauggucgagcgcuuguugu

SEQ ID NO: 194218 - RNA, 22 nt, Human
gugaugaagguggagaaucaga

SEQ ID NO: 194219 - RNA, 19 nt, Human
gugaugaugccacuccaac

SEQ ID NO: 194220 - RNA, 22 nt, Human
gugaugugugaaggucugcagg

SEQ ID NO: 194221 - RNA, 22 nt, Human
uagagauagccaaguccuucaa

SEQ ID NO: 194222 - RNA, 19 nt, Human
uagaggagaauggcaaaga

SEQ ID NO: 194223 - RNA, 22 nt, Human
gugauuucaaauauagagugag

SEQ ID NO: 194224 - RNA, 22 nt, Human
guuuugugugugugcccacacg

SEQ ID NO: 194225 - RNA, 22 nt, Human
guuuuucuagaaaucuccuccu

SEQ ID NO: 194226 - RNA, 22 nt, Human
guuuuucuuugauuuagaacca

SEQ ID NO: 194227 - RNA, 19 nt, Human
gguuaccagugugucuggc

SEQ ID NO: 194228 - RNA, 22 nt, Human
gguuaacaccacagcugggaca

SEQ ID NO: 194229 - RNA, 22 nt, Human
gguguuccgguucugcucuggg

SEQ ID NO: 194230 - RNA, 22 nt, Human
uaaagaagaaaaggcuucaggc

SEQ ID NO: 194231 - RNA, 22 nt, Human
gguugauuuuuaugaagccaug

SEQ ID NO: 194232 - RNA, 22 nt, Human
uaaacugacagugagggagagu

SEQ ID NO: 194233 - RNA, 22 nt, Human
uaaagcacucaaaauuguagcu

SEQ ID NO: 194234 - RNA, 23 nt, Human
uaaagauaguuuaaaggugaguu

SEQ ID NO: 194235 - RNA, 21 nt, Human
gguuucugcaaaccuuguaca

SEQ ID NO: 194236 - RNA, 22 nt, Human
gguuuaucuuuacaaaugaaau

SEQ ID NO: 194237 - RNA, 22 nt, Human
guaaauaucucacgaaugauuc

SEQ ID NO: 194238 - RNA, 22 nt, Human
guaaauacuaugagauaaugaa

SEQ ID NO: 194239 - RNA, 22 nt, Human
uaaauguacugaggcaacagga

SEQ ID NO: 194240 - RNA, 22 nt, Human
uaaaugcucuuuaaaagugcuu

SEQ ID NO: 194241 - RNA, 22 nt, Human
uaaaugaaaugaagugaaagcu

SEQ ID NO: 194242 - RNA, 22 nt, Human
ggugcuuuucacaagcauggga

SEQ ID NO: 194243 - RNA, 22 nt, Human
gguggcagaggaggcgggagag

SEQ ID NO: 194244 - RNA, 22 nt, Human
guuuuauguuuuauagacacaa

SEQ ID NO: 194245 - RNA, 22 nt, Human
guuuugauggaguguguuaaau

SEQ ID NO: 194246 - RNA, 22 nt, Human
guuuugaagagaagcaagucug

SEQ ID NO: 194247 - RNA, 22 nt, Human
guuuucuuguuaauuuugaacg

SEQ ID NO: 194248 - RNA, 22 nt, Human
guuuuguagucuggagacuguc

SEQ ID NO: 194249 - RNA, 22 nt, Human
guuuugaugugauuucucaugu

SEQ ID NO: 194250 - RNA, 22 nt, Human
ggucaauuuggucaaucguuua

SEQ ID NO: 194251 - RNA, 22 nt, Human
ggucauagagcuggaaauuggc

SEQ ID NO: 194252 - RNA, 22 nt, Human
guuuuauaacuauagugagaau

SEQ ID NO: 194253 - RNA, 22 nt, Human
ggugcuggggaaauuaggguag

SEQ ID NO: 194254 - RNA, 22 nt, Human
guaguggaauuuagaguauaau

SEQ ID NO: 194255 - RNA, 22 nt, Human
guagguggaggcaacacagcca

SEQ ID NO: 194256 - RNA, 22 nt, Human
guagggguggggagguggucug

SEQ ID NO: 194257 - RNA, 22 nt, Human
guaguuuuucuugcaagaguag

SEQ ID NO: 194258 - RNA, 22 nt, Human
guaguuagaguugugcuggaga

SEQ ID NO: 194259 - RNA, 22 nt, Human
guauaaauaucuauauuguuac

SEQ ID NO: 194260 - RNA, 22 nt, Human
uaacgcaucuggaaacaggaca

SEQ ID NO: 194261 - RNA, 18 nt, Human
uaacugguuucuucccau

SEQ ID NO: 194262 - RNA, 22 nt, Human
uaacucugcuguggaaauggga

SEQ ID NO: 194263 - RNA, 22 nt, Human
uaacuuuucuguucaauuuucc

SEQ ID NO: 194264 - RNA, 22 nt, Human
uaacuguuuugaauauuguggu

SEQ ID NO: 194265 - RNA, 22 nt, Human
uaaauuggaauaaugagaagug

SEQ ID NO: 194266 - RNA, 22 nt, Human
guaaugcuuuuauuucggggaa

SEQ ID NO: 194267 - RNA, 22 nt, Human
guaauucugugugaaucuauua

SEQ ID NO: 194268 - RNA, 22 nt, Human
uaaccuugaagacugagcugac

SEQ ID NO: 194269 - RNA, 22 nt, Human
uaacauuagcuuugcucaugca

SEQ ID NO: 194270 - RNA, 22 nt, Human
gucagacugaguuccuggguac

SEQ ID NO: 194271 - RNA, 22 nt, Human
gucagauucuuucauuugcuga

SEQ ID NO: 194272 - RNA, 22 nt, Human
guauuugcaaucacaaacaaaa

SEQ ID NO: 194273 - RNA, 22 nt, Human
gucaccgguuuuuagguaaaca

SEQ ID NO: 194274 - RNA, 22 nt, Human
uaagcgagccaguggaaaaagc

SEQ ID NO: 194275 - RNA, 22 nt, Human
guaucaggacuaaauuauggau

SEQ ID NO: 194276 - RNA, 22 nt, Human
uaagaaacauuuuuaugacagu

SEQ ID NO: 194277 - RNA, 22 nt, Human
uaacuuuuuauccuguuaaaug

SEQ ID NO: 194278 - RNA, 22 nt, Human
guaucugaaaaagaauucugac

SEQ ID NO: 194279 - RNA, 21 nt, Human
guaucuuucuuuuaaaauauc

SEQ ID NO: 194280 - RNA, 21 nt, Human
uaagccaccaugugaaaccag

SEQ ID NO: 194281 - RNA, 23 nt, Human
uaagccugugccugcuaccugcu

SEQ ID NO: 194282 - RNA, 22 nt, Human
guauuauauaaccauugguucu

SEQ ID NO: 194283 - RNA, 22 nt, Human
guaugugugcauacauguacga

SEQ ID NO: 194284 - RNA, 22 nt, Human
uaagaggucugaaacgguggga

SEQ ID NO: 194285 - RNA, 22 nt, Human
uaagagcagacacaaccugaga

SEQ ID NO: 194286 - RNA, 22 nt, Human
guggagaaagcuggaaucugag

SEQ ID NO: 194287 - RNA, 22 nt, Human
guggacuagaguaggaguugca

SEQ ID NO: 194288 - RNA, 22 nt, Human
gggcaugcagcaauucuguggu

SEQ ID NO: 194289 - RNA, 22 nt, Human
gggcaugugauggacgugugcc

SEQ ID NO: 194290 - RNA, 22 nt, Human
guggagauauuugugauagggg

SEQ ID NO: 194291 - RNA, 22 nt, Human
gggcccggguaggggaagagag

SEQ ID NO: 194292 - RNA, 19 nt, Human
gggccucacccacaccucc

SEQ ID NO: 194293 - RNA, 22 nt, Human
gggccucccggagcugcuccca

SEQ ID NO: 194294 - RNA, 22 nt, Human
ggccuugauuccggucauugaa

SEQ ID NO: 194295 - RNA, 22 nt, Human
guggaaauuuuaggaucaucuu

SEQ ID NO: 194296 - RNA, 22 nt, Human
gggcaguuucaugugguucaac

SEQ ID NO: 194297 - RNA, 22 nt, Human
gggcaggcuggguggugguccc

SEQ ID NO: 194298 - RNA, 22 nt, Human
guggaagggaaaccgcacuggc

SEQ ID NO: 194299 - RNA, 22 nt, Human
gugcuuuaccuuauuggucucg

SEQ ID NO: 194300 - RNA, 22 nt, Human
gggcagagagcuggaacuccuu

SEQ ID NO: 194301 - RNA, 22 nt, Human
guggccaaggcagagaaagagc

SEQ ID NO: 194302 - RNA, 18 nt, Human
guggccauugaccagcuu

SEQ ID NO: 194303 - RNA, 22 nt, Human
guggccuuccuguuccuuugaa

SEQ ID NO: 194304 - RNA, 22 nt, Human
guggccugacagaucggaacag

SEQ ID NO: 194305 - RNA, 22 nt, Human
guggcuuucuaccauuaaauug

SEQ ID NO: 194306 - RNA, 22 nt, Human
guggcuuauguccagcagauau

SEQ ID NO: 194307 - RNA, 22 nt, Human
guggcaaguuuucugacaagga

SEQ ID NO: 194308 - RNA, 22 nt, Human
guggcagagagcaagugucuga

SEQ ID NO: 194309 - RNA, 22 nt, Human
guggcagagccuugcggcuuug

SEQ ID NO: 194310 - RNA, 22 nt, Human
guggcagguguacagcucagcu

SEQ ID NO: 194311 - RNA, 20 nt, Human
guggcagugguggcagcagu

SEQ ID NO: 194312 - RNA, 22 nt, Human
gugggcuuuuuugaaaccugaa

SEQ ID NO: 194313 - RNA, 22 nt, Human
gugggcacguccuacugucacu

SEQ ID NO: 194314 - RNA, 22 nt, Human
gugggcagauuaauuucucaau

SEQ ID NO: 194315 - RNA, 22 nt, Human
gugggugaguggggccgccuga

SEQ ID NO: 194316 - RNA, 22 nt, Human
gggccugcgcuggggggagccg

SEQ ID NO: 194317 - RNA, 22 nt, Human
guguauuucuagaagaaaugaa

SEQ ID NO: 194318 - RNA, 22 nt, Human
guguagugugcuguucaguguu

SEQ ID NO: 194319 - RNA, 22 nt, Human
gugguggugaggcaaggggugu

SEQ ID NO: 194320 - RNA, 22 nt, Human
guggugggcgugguguaugccu

SEQ ID NO: 194321 - RNA, 22 nt, Human
gugguggggaguuggauggaag

SEQ ID NO: 194322 - RNA, 22 nt, Human
gggcggugccugucuccgaagc

SEQ ID NO: 194323 - RNA, 22 nt, Human
gggcggggggagcuggaaugaa

SEQ ID NO: 194324 - RNA, 22 nt, Human
gggcggggcuuccguccuccac

SEQ ID NO: 194325 - RNA, 22 nt, Human
guggugaacauuugcaucugcu

SEQ ID NO: 194326 - RNA, 22 nt, Human
guggucaagaccgggaauagga

SEQ ID NO: 194327 - RNA, 22 nt, Human
guggugauuugggucuagcuuu

SEQ ID NO: 194328 - RNA, 22 nt, Human
gggcgcgccaggagcugcgcgg

SEQ ID NO: 194329 - RNA, 22 nt, Human
gggcgccgggagugagagugag

SEQ ID NO: 194330 - RNA, 22 nt, Human
gugguaagugcuccuauuggcg

SEQ ID NO: 194331 - RNA, 22 nt, Human
guguugaaaaguagcacugcuu

SEQ ID NO: 194332 - RNA, 22 nt, Human
guguucuuuguagaggaucuug

SEQ ID NO: 194333 - RNA, 22 nt, Human
guguucccauccacaccaagcc

SEQ ID NO: 194334 - RNA, 19 nt, Human
guguucuguuauacaguug

SEQ ID NO: 194335 - RNA, 20 nt, Human
gggcuuugagcucagggcuu

SEQ ID NO: 194336 - RNA, 22 nt, Human
gggcuuuuccaacacucuggag

SEQ ID NO: 194337 - RNA, 22 nt, Human
gugugucucaguugcuccgaag

SEQ ID NO: 194338 - RNA, 22 nt, Human
guguuaggugcauuaaacgugg

SEQ ID NO: 194339 - RNA, 22 nt, Human
gugugguguuaagcaaauuaau

SEQ ID NO: 194340 - RNA, 22 nt, Human
gggcuguaggagcuggaauggg

SEQ ID NO: 194341 - RNA, 22 nt, Human
gggcuggggcucuggggcuagg

SEQ ID NO: 194342 - RNA, 22 nt, Human
gggcugagagcuggaaucugag

SEQ ID NO: 194343 - RNA, 22 nt, Human
gggcugcuccgcccgcugcgcc

SEQ ID NO: 194344 - RNA, 20 nt, Human
gggcucugcauccaucagcc

SEQ ID NO: 194345 - RNA, 22 nt, Human
guucuuuacuucgcaucugcua

SEQ ID NO: 194346 - RNA, 22 nt, Human
ggguuuguuccuacuucuacuc

SEQ ID NO: 194347 - RNA, 22 nt, Human
ggguuuugugauugccucugaa

SEQ ID NO: 194348 - RNA, 22 nt, Human
guugaacagucacccugggagu

SEQ ID NO: 194349 - RNA, 22 nt, Human
guugagaaucucuagcuuagga

SEQ ID NO: 194350 - RNA, 22 nt, Human
ggguuguagagcuggaagggga

SEQ ID NO: 194351 - RNA, 22 nt, Human
ggguucauuugccggguaguuu

SEQ ID NO: 194352 - RNA, 22 nt, Human
ggguuacgaugauuucaugugu

SEQ ID NO: 194353 - RNA, 20 nt, Human
ggguugagcguggccccucu

SEQ ID NO: 194354 - RNA, 22 nt, Human
ggguucugggaggacuagggga

SEQ ID NO: 194355 - RNA, 22 nt, Human
gguaaucuccucauugacguua

SEQ ID NO: 194356 - RNA, 22 nt, Human
gguagagagugaggaggggcuc

SEQ ID NO: 194357 - RNA, 22 nt, Human
gguaauguucugaugaauuugu

SEQ ID NO: 194358 - RNA, 22 nt, Human
gguaagguugggugucagaggg

SEQ ID NO: 194359 - RNA, 22 nt, Human
gguaacagaagagcacuuggca

SEQ ID NO: 194360 - RNA, 22 nt, Human
gguaagcauuaagugagggaau

SEQ ID NO: 194361 - RNA, 22 nt, Human
guugauuuaggguuuugguuuu

SEQ ID NO: 194362 - RNA, 22 nt, Human
guugcaaaugggaagaugguua

SEQ ID NO: 194363 - RNA, 23 nt, Human
guugccuuugcaucuucauccau

SEQ ID NO: 194364 - RNA, 22 nt, Human
guugcggaguguagcgaugcuu

SEQ ID NO: 194365 - RNA, 22 nt, Human
guucuacaacuucgcuugcaga

SEQ ID NO: 194366 - RNA, 22 nt, Human
guucgucuguggugugaggugc

SEQ ID NO: 194367 - RNA, 22 nt, Human
gggucuggagauccgggugaag

SEQ ID NO: 194368 - RNA, 22 nt, Human
guucauuucaagucuaauccau

SEQ ID NO: 194369 - RNA, 22 nt, Human
guucaccaguagcugggcuguu

SEQ ID NO: 194370 - RNA, 22 nt, Human
guuccgcugcaaggccaggaaa

SEQ ID NO: 194371 - RNA, 22 nt, Human
guuccucugaaggauuuucaga

SEQ ID NO: 194372 - RNA, 22 nt, Human
guuccugugcccuguucuuucc

SEQ ID NO: 194373 - RNA, 22 nt, Human
guuccugagcaguuccuggcca

SEQ ID NO: 194374 - RNA, 22 nt, Human
guucucauugugaugcuuaguu

SEQ ID NO: 194375 - RNA, 22 nt, Human
ggguggcaagucuuucugcaac

SEQ ID NO: 194376 - RNA, 22 nt, Human
gggugguuccuggaucugacug

SEQ ID NO: 194377 - RNA, 22 nt, Human
gggugucugcugaauuucccuu

SEQ ID NO: 194378 - RNA, 22 nt, Human
guucuuagguacucauauuuaa

SEQ ID NO: 194379 - RNA, 22 nt, Human
ggguggugagagaacuuugcag

SEQ ID NO: 194380 - RNA, 22 nt, Human
gggggagaauaugugaaggggg

SEQ ID NO: 194381 - RNA, 22 nt, Human
gggggacagugugccuggugug

SEQ ID NO: 194382 - RNA, 22 nt, Human
ggggcuuccagcgcccgccggu

SEQ ID NO: 194383 - RNA, 22 nt, Human
ggggcuggguuugcgcaggcuc

SEQ ID NO: 194384 - RNA, 22 nt, Human
guuacuacccacccuucucccc

SEQ ID NO: 194385 - RNA, 22 nt, Human
ggggcugggaggccggcgcgca

SEQ ID NO: 194386 - RNA, 22 nt, Human
gggggcgcguggagggccgugg

SEQ ID NO: 194387 - RNA, 22 nt, Human
gggggcagguuccaggccagcu

SEQ ID NO: 194388 - RNA, 22 nt, Human
gggggcugugugcccgcucccc

SEQ ID NO: 194389 - RNA, 22 nt, Human
ggggcucauuugcaggggggag

SEQ ID NO: 194390 - RNA, 22 nt, Human
gggguauuugguagacauuuug

SEQ ID NO: 194391 - RNA, 22 nt, Human
gggucauugcgugacgcgagca

SEQ ID NO: 194392 - RNA, 22 nt, Human
ggguacaccaauggaugccagg

SEQ ID NO: 194393 - RNA, 22 nt, Human
gggguuggaugccuuggaaauu

SEQ ID NO: 194394 - RNA, 22 nt, Human
guucacauccuugugaggauuu

SEQ ID NO: 194395 - RNA, 22 nt, Human
gggucagggaggccccaccaug

SEQ ID NO: 194396 - RNA, 22 nt, Human
guuauuuugucuuguucaugaa

SEQ ID NO: 194397 - RNA, 22 nt, Human
ggggucugaucccuucuggcuu

SEQ ID NO: 194398 - RNA, 22 nt, Human
guuauuguuauugcguugucga

SEQ ID NO: 194399 - RNA, 22 nt, Human
ggggugaggcagggcagggguc

SEQ ID NO: 194400 - RNA, 22 nt, Human
guuaucauccucagaggcaguu

SEQ ID NO: 194401 - RNA, 22 nt, Human
guuauuaaauauuuuggugauu

SEQ ID NO: 194402 - RNA, 22 nt, Human
guuauugggagagggaauggga

SEQ ID NO: 194403 - RNA, 22 nt, Human
ggggcggggagcaugagcuggg

SEQ ID NO: 194404 - RNA, 17 nt, Human
ggggcguguauuugaug

SEQ ID NO: 194405 - RNA, 23 nt, Human
guuaccgaccugauucggcagcc

SEQ ID NO: 194406 - RNA, 21 nt, Human
guuaccacugaugcaacagga

SEQ ID NO: 194407 - RNA, 22 nt, Human
guuacagagcugcuaugugugc

SEQ ID NO: 194408 - RNA, 22 nt, Human
guuaaaaugauuugugauuuau

SEQ ID NO: 194409 - RNA, 22 nt, Human
guguuuugagaggaugguuuua

SEQ ID NO: 194410 - RNA, 22 nt, Human
ggggauuucccaaugcgaagca

SEQ ID NO: 194411 - RNA, 22 nt, Human
ggggaggaagcuggaacacggg

SEQ ID NO: 194412 - RNA, 22 nt, Human
ggggaagagagaagaaugaucu

SEQ ID NO: 194413 - RNA, 22 nt, Human
ggggaauaaacacuuugucacu

SEQ ID NO: 194414 - RNA, 22 nt, Human
ggggaagugguggggcuccgag

SEQ ID NO: 194415 - RNA, 22 nt, Human
guguugugauuggucagucacu

SEQ ID NO: 194416 - RNA, 22 nt, Human
guguuuguauccuccauauaac

SEQ ID NO: 194417 - RNA, 22 nt, Human
guguuuauguuuuugcuaggga

SEQ ID NO: 194418 - RNA, 23 nt, Human
guguuguugauuuucgaaucuuu

SEQ ID NO: 194419 - RNA, 22 nt, Human
gcccagcucucuggccugucuu

SEQ ID NO: 194420 - RNA, 22 nt, Human
ggaagcuguugugagugcagca

SEQ ID NO: 194421 - RNA, 22 nt, Human
ggaagcugucugcccggcgcuc

SEQ ID NO: 194422 - RNA, 22 nt, Human
ggaagcucaauacuuuccucuu

SEQ ID NO: 194423 - RNA, 22 nt, Human
ggaagccugggcgcaggcaggg

SEQ ID NO: 194424 - RNA, 22 nt, Human
gcugggagaggcagcuuucgga

SEQ ID NO: 194425 - RNA, 22 nt, Human
gcugggagucgcgucuguggcc

SEQ ID NO: 194426 - RNA, 22 nt, Human
gcuggggaucgaaggcagagcc

SEQ ID NO: 194427 - RNA, 22 nt, Human
gcuggguaguucuuguuuggga

SEQ ID NO: 194428 - RNA, 22 nt, Human
gccuggcagggagauuguaaga

SEQ ID NO: 194429 - RNA, 22 nt, Human
ggaauacggguuuauuuagucu

SEQ ID NO: 194430 - RNA, 22 nt, Human
gccugcuugaaagcacuuucug

SEQ ID NO: 194431 - RNA, 22 nt, Human
gccuggaaugcaaugugacgaa

SEQ ID NO: 194432 - RNA, 20 nt, Human
ggaaguauccacaaauuccu

SEQ ID NO: 194433 - RNA, 22 nt, Human
ggaaggggagcuggaaagggua

SEQ ID NO: 194434 - RNA, 22 nt, Human
ggaaggugagugcugugugauu

SEQ ID NO: 194435 - RNA, 22 nt, Human
ggaaguuaguucuuggcaaagg

SEQ ID NO: 194436 - RNA, 22 nt, Human
ggaaguggauucagggcugcua

SEQ ID NO: 194437 - RNA, 22 nt, Human
ggaagugagcucauuacuuuag

SEQ ID NO: 194438 - RNA, 22 nt, Human
gcccagccucagggcaucagcu

SEQ ID NO: 194439 - RNA, 23 nt, Human
ggacuaggcaacagaugggacag

SEQ ID NO: 194440 - RNA, 22 nt, Human
ggacuccuguguuuuggcugag

SEQ ID NO: 194441 - RNA, 22 nt, Human
ggacggggagcuggaaagggga

SEQ ID NO: 194442 - RNA, 22 nt, Human
gcgcacaaccccguggcgguga

SEQ ID NO: 194443 - RNA, 22 nt, Human
ggacugggagaauggaggcaag

SEQ ID NO: 194444 - RNA, 22 nt, Human
ggacagacagcauggaaccaua

SEQ ID NO: 194445 - RNA, 22 nt, Human
ggaccagagcuaaugcgcgccc

SEQ ID NO: 194446 - RNA, 22 nt, Human
gccuuuauauuacauuuggaag

SEQ ID NO: 194447 - RNA, 19 nt, Human
ggagcagauaaacauacuu

SEQ ID NO: 194448 - RNA, 22 nt, Human
ggagcaagagugagcaagcaga

SEQ ID NO: 194449 - RNA, 22 nt, Human
ggagaugucugugccacgucuc

SEQ ID NO: 194450 - RNA, 20 nt, Human
ggagagggaaaggcuguacu

SEQ ID NO: 194451 - RNA, 22 nt, Human
ggagaaacuaguuagauccaau

SEQ ID NO: 194452 - RNA, 20 nt, Human
gcgcaguuccgggcgcgucu

SEQ ID NO: 194453 - RNA, 22 nt, Human
gcgcgccugccucccgcggugc

SEQ ID NO: 194454 - RNA, 22 nt, Human
gcgccgacccucccugccggac

SEQ ID NO: 194455 - RNA, 22 nt, Human
ggaugggcuuggggaggucuag

SEQ ID NO: 194456 - RNA, 22 nt, Human
ggauuucuucucauaacugaga

SEQ ID NO: 194457 - RNA, 22 nt, Human
ggauugaagggaaccucagaau

SEQ ID NO: 194458 - RNA, 22 nt, Human
ggcaaagaguacaucguccugg

SEQ ID NO: 194459 - RNA, 22 nt, Human
ggauuugaugagacuaucuacu

SEQ ID NO: 194460 - RNA, 22 nt, Human
gcggcaguccuuccaguacagg

SEQ ID NO: 194461 - RNA, 22 nt, Human
gcggcccggguccccagcagca

SEQ ID NO: 194462 - RNA, 22 nt, Human
gcggcggcggaggcgggggcag

SEQ ID NO: 194463 - RNA, 23 nt, Human
gcgggcggagccgggaggcgggg

SEQ ID NO: 194464 - RNA, 19 nt, Human
gcgggcucuccaccccauc

SEQ ID NO: 194465 - RNA, 22 nt, Human
ggcagaaaacaauaaccauuuc

SEQ ID NO: 194466 - RNA, 22 nt, Human
gcggcuggcuguccaaacuggg

SEQ ID NO: 194467 - RNA, 19 nt, Human
gcggcggugccggcuggga

SEQ ID NO: 194468 - RNA, 23 nt, Human
ggauccugacauauaccaucacc

SEQ ID NO: 194469 - RNA, 22 nt, Human
ggaucagcgagaagggcugaaa

SEQ ID NO: 194470 - RNA, 22 nt, Human
ggagccuuccgagucccagguu

SEQ ID NO: 194471 - RNA, 20 nt, Human
ggagcgggcauuuguguucc

SEQ ID NO: 194472 - RNA, 22 nt, Human
ggaugauacuuggagaaauauu

SEQ ID NO: 194473 - RNA, 22 nt, Human
ggaugauuuucaguuguguggg

SEQ ID NO: 194474 - RNA, 22 nt, Human
ggaucguauuucaguuuuuugg

SEQ ID NO: 194475 - RNA, 22 nt, Human
ggaugcugcuccacaucccaca

SEQ ID NO: 194476 - RNA, 23 nt, Human
ggauggacauacguaugcacagg

SEQ ID NO: 194477 - RNA, 22 nt, Human
ggaugcguuugaauguguuugu

SEQ ID NO: 194478 - RNA, 22 nt, Human
ggauggaugugaucugccuccu

SEQ ID NO: 194479 - RNA, 22 nt, Human
gcucagcuggagagggacgggu

SEQ ID NO: 194480 - RNA, 22 nt, Human
ggcagggagagcaugcugauaa

SEQ ID NO: 194481 - RNA, 18 nt, Human
ggcagggcucagcugcuc

SEQ ID NO: 194482 - RNA, 22 nt, Human
gcucaugggcccagagcagccc

SEQ ID NO: 194483 - RNA, 23 nt, Human
gcucauguugcuucuguucuguc

SEQ ID NO: 194484 - RNA, 22 nt, Human
gcuccagcuccauaaacauaag

SEQ ID NO: 194485 - RNA, 22 nt, Human
ggcaggauggagcagggcuaaa

SEQ ID NO: 194486 - RNA, 22 nt, Human
ggcagggacugggauauggaga

SEQ ID NO: 194487 - RNA, 22 nt, Human
gcuacaggggucaguccuuugc

SEQ ID NO: 194488 - RNA, 22 nt, Human
gcuauuggcuaauuguugcaac

SEQ ID NO: 194489 - RNA, 22 nt, Human
gcuacaacugugucuguggggc

SEQ ID NO: 194490 - RNA, 22 nt, Human
gcuacaaauaaaaugggugacu

SEQ ID NO: 194491 - RNA, 22 nt, Human
ggcagagcugugcgcccaccca

SEQ ID NO: 194492 - RNA, 22 nt, Human
ggcagaggagcuggaaacaugg

SEQ ID NO: 194493 - RNA, 22 nt, Human
ggcagaggaagcuggaaguggg

SEQ ID NO: 194494 - RNA, 22 nt, Human
gcggggcucuacuuggccugga

SEQ ID NO: 194495 - RNA, 22 nt, Human
ggcaggaaguaaggaugcuaca

SEQ ID NO: 194496 - RNA, 22 nt, Human
gcggucuaggaccucagugugu

SEQ ID NO: 194497 - RNA, 22 nt, Human
gcguguauuccagaccuuaacg

SEQ ID NO: 194498 - RNA, 22 nt, Human
gcgugugugauaugccucugca

SEQ ID NO: 194499 - RNA, 22 nt, Human
gcuaagcuuugagucuggacag

SEQ ID NO: 194500 - RNA, 22 nt, Human
gcggguggaggagggacgggca

SEQ ID NO: 194501 - RNA, 22 nt, Human
gcgguuauggcagagauuacag

SEQ ID NO: 194502 - RNA, 22 nt, Human
gcgggugagauucgagagaugg

SEQ ID NO: 194503 - RNA, 22 nt, Human
gcgguggcuacuaaaguucgaa

SEQ ID NO: 194504 - RNA, 21 nt, Human
gcucccgaagugcucggcguu

SEQ ID NO: 194505 - RNA, 22 nt, Human
gcucuggcuacuguggcuaccg

SEQ ID NO: 194506 - RNA, 20 nt, Human
gcucuucuccgggucugccu

SEQ ID NO: 194507 - RNA, 22 nt, Human
gcucuucuaaguuuacccuucc

SEQ ID NO: 194508 - RNA, 18 nt, Human
gcugaaauucuaaacaaa

SEQ ID NO: 194509 - RNA, 22 nt, Human
gcugauucuucugcuuuuucuc

SEQ ID NO: 194510 - RNA, 22 nt, Human
gcugcccucccagggcaagcuu

SEQ ID NO: 194511 - RNA, 22 nt, Human
ggccagcgugggggaguagcgg

SEQ ID NO: 194512 - RNA, 22 nt, Human
gcugcaggaggugguagggucu

SEQ ID NO: 194513 - RNA, 22 nt, Human
gcugcagggagcuggaaggcuc

SEQ ID NO: 194514 - RNA, 22 nt, Human
ggccgccacuuuccagugcugc

SEQ ID NO: 194515 - RNA, 22 nt, Human
ggccagucaaggggauccugaa

SEQ ID NO: 194516 - RNA, 22 nt, Human
ggccccggaggccguuagcuua

SEQ ID NO: 194517 - RNA, 22 nt, Human
ggccgggugggaggcagcggag

SEQ ID NO: 194518 - RNA, 22 nt, Human
ggccgggcaugcgagcugagcg

SEQ ID NO: 194519 - RNA, 22 nt, Human
ggccugcucuggcuguggucag

SEQ ID NO: 194520 - RNA, 22 nt, Human
ggccuggccuccugcuuuucca

SEQ ID NO: 194521 - RNA, 22 nt, Human
ggcggcccaggugcuccaggcg

SEQ ID NO: 194522 - RNA, 22 nt, Human
ggcggcugcuccuugcccucgg

SEQ ID NO: 194523 - RNA, 22 nt, Human
ggcggugcgaggaugcagggcu

SEQ ID NO: 194524 - RNA, 23 nt, Human
ggcgugcugggcugacccuuggc

SEQ ID NO: 194525 - RNA, 22 nt, Human
ggcuaagcaguaaaugggguua

SEQ ID NO: 194526 - RNA, 22 nt, Human
ggcggaggucacgcacccgcca

SEQ ID NO: 194527 - RNA, 22 nt, Human
ggcgcuccccgccugcgucgcg

SEQ ID NO: 194528 - RNA, 22 nt, Human
ggcggagggcuguguccccggc

SEQ ID NO: 194529 - RNA, 22 nt, Human
ggcgccuuguggaaugagagcu

SEQ ID NO: 194530 - RNA, 22 nt, Human
ggcgaguacagacggggccugg

SEQ ID NO: 194531 - RNA, 22 nt, Human
ggcgccauuuuugccuucggag

SEQ ID NO: 194532 - RNA, 22 nt, Human
ggccuugguggcuuugcugaug

SEQ ID NO: 194533 - RNA, 23 nt, Human
ggccuuuuuaaccgcgagcgaca

SEQ ID NO: 194534 - RNA, 22 nt, Human
ggccuugggauguggcugcagc

SEQ ID NO: 194535 - RNA, 22 nt, Human
gcugccucacuagauagguaug

SEQ ID NO: 194536 - RNA, 23 nt, Human
gcugccguuucccaucgugguga

SEQ ID NO: 194537 - RNA, 22 nt, Human
ggcgauuggccgggaggaggca

SEQ ID NO: 194538 - RNA, 22 nt, Human
ggcgaugaggucuuagaaucua

SEQ ID NO: 194539 - RNA, 22 nt, Human
gcugcuggcggagcuggcgcug

SEQ ID NO: 194540 - RNA, 22 nt, Human
ggcgaggcgggccgcggggucu

SEQ ID NO: 194541 - RNA, 22 nt, Human
gcugcgcugggacgccaccaac

SEQ ID NO: 194542 - RNA, 18 nt, Human
ggcugggcugugccccuu

SEQ ID NO: 194543 - RNA, 22 nt, Human
ggcugguggcgggcagcacaga

SEQ ID NO: 194544 - RNA, 22 nt, Human
ggcugggagguggcgaggaggc

SEQ ID NO: 194545 - RNA, 22 nt, Human
ggcuggacuuucugcugggcuc

SEQ ID NO: 194546 - RNA, 22 nt, Human
gcuggucuggcaauccucaugg

SEQ ID NO: 194547 - RNA, 22 nt, Human
gcuggguuguucuccuggucca

SEQ ID NO: 194548 - RNA, 22 nt, Human
gcugggucucucccugguccug

SEQ ID NO: 194549 - RNA, 22 nt, Human
gcuggugugagauucucgaggg

SEQ ID NO: 194550 - RNA, 22 nt, Human
gcugguggcagagcuccgcggc

SEQ ID NO: 194551 - RNA, 22 nt, Human
gcugggccucuuacuucuuacg

SEQ ID NO: 194552 - RNA, 19 nt, Human
gcugggauaggauguauuu

SEQ ID NO: 194553 - RNA, 20 nt, Human
gcugugccaugacccucgag

SEQ ID NO: 194554 - RNA, 22 nt, Human
ggcuucucuuggccaugguccc

SEQ ID NO: 194555 - RNA, 22 nt, Human
ggcugugggguccuguggugug

SEQ ID NO: 194556 - RNA, 22 nt, Human
ggcugugguggacgcgggaaac

SEQ ID NO: 194557 - RNA, 22 nt, Human
ggcuuaguagggacagaugcac

SEQ ID NO: 194558 - RNA, 22 nt, Human
gcugucaggaacaugccuuggu

SEQ ID NO: 194559 - RNA, 22 nt, Human
ggcuguggcagcuggaaguggu

SEQ ID NO: 194560 - RNA, 22 nt, Human
gcuguccugggaacaggcacua

SEQ ID NO: 194561 - RNA, 22 nt, Human
gcugugacaagaggcugcuucu

SEQ ID NO: 194562 - RNA, 22 nt, Human
ggcuccaggguaccccuggaug

SEQ ID NO: 194563 - RNA, 22 nt, Human
ggcucacuguaccugccgccgc

SEQ ID NO: 194564 - RNA, 22 nt, Human
ggcucagaggagcuggaacggu

SEQ ID NO: 194565 - RNA, 22 nt, Human
gcugcuuacuauaggguuaacu

SEQ ID NO: 194566 - RNA, 22 nt, Human
gcugcuggcuuccugcuguuuu

SEQ ID NO: 194567 - RNA, 22 nt, Human
gcuggaagggccagcuuucagg

SEQ ID NO: 194568 - RNA, 22 nt, Human
gcuggaugucugugccaggcac

SEQ ID NO: 194569 - RNA, 22 nt, Human
ggcucuccacuauggaugagaa

SEQ ID NO: 194570 - RNA, 22 nt, Human
ggcugcaagacguuauuagcgu

SEQ ID NO: 194571 - RNA, 22 nt, Human
ggcugagguguggggaacuaua

SEQ ID NO: 194572 - RNA, 22 nt, Human
ggcugcugcccaccccugcaug

SEQ ID NO: 194573 - RNA, 22 nt, Human
ggcugcuggaguugggucucuc

SEQ ID NO: 194574 - RNA, 22 nt, Human
ggcugcuugauagauaugagua

SEQ ID NO: 194575 - RNA, 22 nt, Human
ggcugcagugcaacucuuucua

SEQ ID NO: 194576 - RNA, 21 nt, Human
ggcugcucgugaugaacuuca

SEQ ID NO: 194577 - RNA, 22 nt, Human
gcuggccugcgagggcaggcug

SEQ ID NO: 194578 - RNA, 22 nt, Human
gcugggacacacagucuucuuu

SEQ ID NO: 194579 - RNA, 22 nt, Human
ggugggaauccaggccuucauc

SEQ ID NO: 194580 - RNA, 22 nt, Human
gguggcuucuguuugcaagagg

SEQ ID NO: 194581 - RNA, 22 nt, Human
ggcagugguaggagcccaggag

SEQ ID NO: 194582 - RNA, 22 nt, Human
ggugcguggcccauccuccacc

SEQ ID NO: 194583 - RNA, 22 nt, Human
gguggcuugcugguaggugugc

SEQ ID NO: 194584 - RNA, 22 nt, Human
gguggggacuuggggucagcgg

SEQ ID NO: 194585 - RNA, 22 nt, Human
gguggucaggagcgcccguugg

SEQ ID NO: 194586 - RNA, 22 nt, Human
gguguaaucacaagcuggaauu

SEQ ID NO: 194587 - RNA, 22 nt, Human
ggcagggagagcgccgccaugc

SEQ ID NO: 194588 - RNA, 22 nt, Human
ggcagggaauucagagggaagg

SEQ ID NO: 194589 - RNA, 21 nt, Human
ggcagccuggcaggggcacug

SEQ ID NO: 194590 - RNA, 22 nt, Human
ggcagcagaacuggcccuguau

SEQ ID NO: 194591 - RNA, 22 nt, Human
ggcagcagaaccaacuguggcu

SEQ ID NO: 194592 - RNA, 22 nt, Human
ggugccugggcacggaaagcau

SEQ ID NO: 194593 - RNA, 22 nt, Human
ggugcaauaaaguuguagaacc

SEQ ID NO: 194594 - RNA, 22 nt, Human
ggugacauuggagagacaggug

SEQ ID NO: 194595 - RNA, 20 nt, Human
ggauugaacuauuucucagc

SEQ ID NO: 194596 - RNA, 21 nt, Human
gguagggaagguguuccucau

SEQ ID NO: 194597 - RNA, 22 nt, Human
gguagacugagcuccuugagga

SEQ ID NO: 194598 - RNA, 22 nt, Human
gguagaggaugaggagguugga

SEQ ID NO: 194599 - RNA, 18 nt, Human
gguacguuuugaucaaug

SEQ ID NO: 194600 - RNA, 22 nt, Human
gguaauugaaaguuuguugaug

SEQ ID NO: 194601 - RNA, 22 nt, Human
gguaccuggcccuggggcugcu

SEQ ID NO: 194602 - RNA, 22 nt, Human
ggguguuaugccucugagucag

SEQ ID NO: 194603 - RNA, 22 nt, Human
ggguguuuuuggugacagggag

SEQ ID NO: 194604 - RNA, 22 nt, Human
ggauaauguauuuuaaaauggg

SEQ ID NO: 194605 - RNA, 22 nt, Human
ggauaauugaugauuuauaaga

SEQ ID NO: 194606 - RNA, 22 nt, Human
ggcaagauccagcacaaacaca

SEQ ID NO: 194607 - RNA, 22 nt, Human
ggucggggcuggccggcguggu

SEQ ID NO: 194608 - RNA, 22 nt, Human
ggucgucuguccugucgccgcu

SEQ ID NO: 194609 - RNA, 22 nt, Human
ggucgguuggagagaucaugaa

SEQ ID NO: 194610 - RNA, 22 nt, Human
ggcaagcacugggugucuuagc

SEQ ID NO: 194611 - RNA, 22 nt, Human
ggucuuauaauuaauuuaggcu

SEQ ID NO: 194612 - RNA, 22 nt, Human
ggucuucauaugccacagaguc

SEQ ID NO: 194613 - RNA, 22 nt, Human
ggugaaggaucccucuuggccu

SEQ ID NO: 194614 - RNA, 22 nt, Human
ggucugcaaugauuugaaaaac

SEQ ID NO: 194615 - RNA, 20 nt, Human
ggucuguuucuucuuuucau

SEQ ID NO: 194616 - RNA, 22 nt, Human
ggucugcgauggcaagggucuu

SEQ ID NO: 194617 - RNA, 22 nt, Human
ggugucagccacuuugucggag

SEQ ID NO: 194618 - RNA, 22 nt, Human
gguuccagacaguuauaugggc

SEQ ID NO: 194619 - RNA, 22 nt, Human
gguucuggaaaagaaagcaaag

SEQ ID NO: 194620 - RNA, 22 nt, Human
gguugaagcuacuuucuggaug

SEQ ID NO: 194621 - RNA, 22 nt, Human
ggcccuggggcaggagcagagg

SEQ ID NO: 194622 - RNA, 22 nt, Human
ggccgccacacagauucccccg

SEQ ID NO: 194623 - RNA, 22 nt, Human
gguugccuguggcucccuguua

SEQ ID NO: 194624 - RNA, 22 nt, Human
ggcccgcgcugcuggcgcgcca

SEQ ID NO: 194625 - RNA, 22 nt, Human
gguugccuuugcaguuggauca

SEQ ID NO: 194626 - RNA, 22 nt, Human
ggcccugcuuccccaguguaca

SEQ ID NO: 194627 - RNA, 22 nt, Human
guaauaggagggagucugcuuu

SEQ ID NO: 194628 - RNA, 22 nt, Human
guacaaagucaaggugaaaaua

SEQ ID NO: 194629 - RNA, 22 nt, Human
guacuaguuaaaaauagaauua

SEQ ID NO: 194630 - RNA, 22 nt, Human
guaacuuuuuccucauuggcua

SEQ ID NO: 194631 - RNA, 22 nt, Human
guaagaauauacccaggaguca

SEQ ID NO: 194632 - RNA, 22 nt, Human
gguuuucuuguucauuuuuuaa

SEQ ID NO: 194633 - RNA, 22 nt, Human
guaaacugaauuggauacugug

SEQ ID NO: 194634 - RNA, 22 nt, Human
guagccauuuucuagagaguua

SEQ ID NO: 194635 - RNA, 22 nt, Human
guagucauugggucugugguca

SEQ ID NO: 194636 - RNA, 22 nt, Human
guagucuuaggaaugauuuugu

SEQ ID NO: 194637 - RNA, 22 nt, Human
guagaaaauagauugucucuug

SEQ ID NO: 194638 - RNA, 22 nt, Human
guacugggaauggagccugggc

SEQ ID NO: 194639 - RNA, 22 nt, Human
guacugguuuucuuacucuggc

SEQ ID NO: 194640 - RNA, 22 nt, Human
guagaacucuuuccugcguggg

SEQ ID NO: 194641 - RNA, 22 nt, Human
guacuuccauccacauauaugu

SEQ ID NO: 194642 - RNA, 22 nt, Human
ggccgccgcuuagcugagcccc

SEQ ID NO: 194643 - RNA, 22 nt, Human
ggccgcuuucuggggagugagg

SEQ ID NO: 194644 - RNA, 22 nt, Human
guaguuuuugagcuguaaucuu

SEQ ID NO: 194645 - RNA, 18 nt, Human
ggccucagccuggccgga

SEQ ID NO: 194646 - RNA, 20 nt, Human
ggccugagcauggcuggcag

SEQ ID NO: 194647 - RNA, 22 nt, Human
ggccugagaagcaaggacacaa

SEQ ID NO: 194648 - RNA, 22 nt, Human
ggccuggcacauaguaggcagu

SEQ ID NO: 194649 - RNA, 22 nt, Human
ggccugcuaccagcugugaccu

SEQ ID NO: 194650 - RNA, 22 nt, Human
gggcaagaggguuugacaugag

SEQ ID NO: 194651 - RNA, 22 nt, Human
gggcacggaaggcgccaggggu

SEQ ID NO: 194652 - RNA, 22 nt, Human
gggcaagaagcuggaagcauuc

SEQ ID NO: 194653 - RNA, 22 nt, Human
ggaaagaggacaucuuacuucu

SEQ ID NO: 194654 - RNA, 22 nt, Human
ggaaaaugcugaagcaucugaa

SEQ ID NO: 194655 - RNA, 22 nt, Human
ggaaaagaauuguuaguuagug

SEQ ID NO: 194656 - RNA, 21 nt, Human
gggagugaguaaugauggggg

SEQ ID NO: 194657 - RNA, 22 nt, Human
gggagguaaugggggugcaggg

SEQ ID NO: 194658 - RNA, 22 nt, Human
gggaggucgaggcugggccgca

SEQ ID NO: 194659 - RNA, 22 nt, Human
gggagggggauucuggcgagaa

SEQ ID NO: 194660 - RNA, 22 nt, Human
gggauuaaaaaucaccaaagua

SEQ ID NO: 194661 - RNA, 22 nt, Human
gcuguggacacagcucucuuca

SEQ ID NO: 194662 - RNA, 22 nt, Human
gcuguggaaaaugggucuccaa

SEQ ID NO: 194663 - RNA, 22 nt, Human
gggaggcagacgcuggagccca

SEQ ID NO: 194664 - RNA, 22 nt, Human
gggagcuggagcuggaagacuc

SEQ ID NO: 194665 - RNA, 22 nt, Human
gcuuuucucccugcuuucuucc

SEQ ID NO: 194666 - RNA, 22 nt, Human
gcuuuguugauggugagucugu

SEQ ID NO: 194667 - RNA, 22 nt, Human
gcuuuucaaguuacaauuagcu

SEQ ID NO: 194668 - RNA, 22 nt, Human
ggacagacuuuacagccccggg

SEQ ID NO: 194669 - RNA, 22 nt, Human
ggacaauuguacucgauuucaa

SEQ ID NO: 194670 - RNA, 22 nt, Human
ggacauagaucuagacuuuaaa

SEQ ID NO: 194671 - RNA, 22 nt, Human
ggacagagcaacccuacgcagc

SEQ ID NO: 194672 - RNA, 22 nt, Human
gggcuacagaugggagggauga

SEQ ID NO: 194673 - RNA, 22 nt, Human
ggaauugagcaagggguggggc

SEQ ID NO: 194674 - RNA, 23 nt, Human
ggaauuucagaugugaaauaaaa

SEQ ID NO: 194675 - RNA, 22 nt, Human
gggcgcuguguuaggugcugua

SEQ ID NO: 194676 - RNA, 22 nt, Human
gggcgcgcggagccucgccggg

SEQ ID NO: 194677 - RNA, 22 nt, Human
gggcgcuuucugggucagggcu

SEQ ID NO: 194678 - RNA, 22 nt, Human
gggcggggcucacggugcggca

SEQ ID NO: 194679 - RNA, 22 nt, Human
gggcggcguccucagucgggug

SEQ ID NO: 194680 - RNA, 22 nt, Human
gggcggccugcucuguggggag

SEQ ID NO: 194681 - RNA, 17 nt, Human
ggaagaaaaggaucauc

SEQ ID NO: 194682 - RNA, 22 nt, Human
gggccaggaugugguucauuuu

SEQ ID NO: 194683 - RNA, 22 nt, Human
gggcaggggcagugguggcauu

SEQ ID NO: 194684 - RNA, 22 nt, Human
gggcagucagauucgggggccu

SEQ ID NO: 194685 - RNA, 22 nt, Human
ggaaagagaaacaugaacuaga

SEQ ID NO: 194686 - RNA, 18 nt, Human
ggaaggugcuggagugca

SEQ ID NO: 194687 - RNA, 22 nt, Human
gggcgagcgucucagccgggcg

SEQ ID NO: 194688 - RNA, 22 nt, Human
gggcgcaagcaugugucugggu

SEQ ID NO: 194689 - RNA, 22 nt, Human
ggagauaugugaaaaagacagc

SEQ ID NO: 194690 - RNA, 22 nt, Human
ggagaggaaguuuaaagaauug

SEQ ID NO: 194691 - RNA, 22 nt, Human
ggagagcuagugagcuggaggu

SEQ ID NO: 194692 - RNA, 22 nt, Human
ggggauuuuucuuacucuuagg

SEQ ID NO: 194693 - RNA, 22 nt, Human
ggggcaucguugauugcauggu

SEQ ID NO: 194694 - RNA, 22 nt, Human
ggagagcguggaugggcuucca

SEQ ID NO: 194695 - RNA, 23 nt, Human
ggagaaggaugucaucaaaagac

SEQ ID NO: 194696 - RNA, 22 nt, Human
ggggagaugauaagugcauuug

SEQ ID NO: 194697 - RNA, 22 nt, Human
ggggacugccgacagucucaaa

SEQ ID NO: 194698 - RNA, 22 nt, Human
ggggaauuaaaugagaagccuu

SEQ ID NO: 194699 - RNA, 23 nt, Human
ggacaugucucuggguauuuuga

SEQ ID NO: 194700 - RNA, 22 nt, Human
gggcugaugcuuauacauacug

SEQ ID NO: 194701 - RNA, 22 nt, Human
ggacauugaagcuggaaaggga

SEQ ID NO: 194702 - RNA, 22 nt, Human
gggcuguggggccugcagaagg

SEQ ID NO: 194703 - RNA, 22 nt, Human
gggcuggcaguuuucugaguuc

SEQ ID NO: 194704 - RNA, 22 nt, Human
ggggaaauauuucugaccugug

SEQ ID NO: 194705 - RNA, 22 nt, Human
ggggaaggaaggggagggcacg

SEQ ID NO: 194706 - RNA, 22 nt, Human
ggacuuuggauuuuauucuaaa

SEQ ID NO: 194707 - RNA, 18 nt, Human
ggagaagaacagaugugg

SEQ ID NO: 194708 - RNA, 22 nt, Human
ggagaugaaugugguaaaacug

SEQ ID NO: 194709 - RNA, 22 nt, Human
gggguaggaagagaaaauagug

SEQ ID NO: 194710 - RNA, 22 nt, Human
gggguguuagucuuacccagag

SEQ ID NO: 194711 - RNA, 22 nt, Human
ggggugggcuggguguccaagg

SEQ ID NO: 194712 - RNA, 22 nt, Human
ggggugagaguguuuuaaagca

SEQ ID NO: 194713 - RNA, 22 nt, Human
ggggccgggccggcagacuggg

SEQ ID NO: 194714 - RNA, 22 nt, Human
ggagaucucauugauacugaua

SEQ ID NO: 194715 - RNA, 22 nt, Human
ggggccaugauggacgagguga

SEQ ID NO: 194716 - RNA, 22 nt, Human
ggggcggcgugggcgcggugau

SEQ ID NO: 194717 - RNA, 22 nt, Human
ggggcgaguguggaccgcagcc

SEQ ID NO: 194718 - RNA, 22 nt, Human
ggggcguugccacggggacggg

SEQ ID NO: 194719 - RNA, 22 nt, Human
gggugguggagguuugacagac

SEQ ID NO: 194720 - RNA, 22 nt, Human
ggaguucaaaucuuuuggaucu

SEQ ID NO: 194721 - RNA, 22 nt, Human
ggauaaaugaaggcauacagau

SEQ ID NO: 194722 - RNA, 22 nt, Human
ggaguucacagcaauggaacag

SEQ ID NO: 194723 - RNA, 22 nt, Human
ggguauuugacaaacugacacu

SEQ ID NO: 194724 - RNA, 22 nt, Human
ggaggcggaaguccaagcaggu

SEQ ID NO: 194725 - RNA, 20 nt, Human
gggucuggcaucucucucug

SEQ ID NO: 194726 - RNA, 22 nt, Human
ggguggugauacugcuucugcc

SEQ ID NO: 194727 - RNA, 22 nt, Human
gggucggcacucuggcagcacc

SEQ ID NO: 194728 - RNA, 22 nt, Human
gcugccuugaacuuggccuggg

SEQ ID NO: 194729 - RNA, 22 nt, Human
gccacucaguuuaggggcaagc

SEQ ID NO: 194730 - RNA, 22 nt, Human
gcugcgcgcagccggcgccgag

SEQ ID NO: 194731 - RNA, 22 nt, Human
gcugcgccgggagccggggccg

SEQ ID NO: 194732 - RNA, 22 nt, Human
gccagccggugaguggaagcgg

SEQ ID NO: 194733 - RNA, 22 nt, Human
gccaaucaggaggcuguacauc

SEQ ID NO: 194734 - RNA, 22 nt, Human
gcugccgcugcggggcgcgggc

SEQ ID NO: 194735 - RNA, 23 nt, Human
gcugcagugaauguuguuguugu

SEQ ID NO: 194736 - RNA, 22 nt, Human
gcugagcagaacaauuagaaau

SEQ ID NO: 194737 - RNA, 23 nt, Human
gcugagcaccagccauaucuuuu

SEQ ID NO: 194738 - RNA, 22 nt, Human
gcugagcagcgaaggcacaugc

SEQ ID NO: 194739 - RNA, 22 nt, Human
gcugcacgguccuggcaccacg

SEQ ID NO: 194740 - RNA, 23 nt, Human
gcucugauaccagcuacaucuag

SEQ ID NO: 194741 - RNA, 22 nt, Human
gcucucuggccugggaggagga

SEQ ID NO: 194742 - RNA, 22 nt, Human
gcucuccuugaugcccucuguu

SEQ ID NO: 194743 - RNA, 22 nt, Human
gcucugaacugucaugaauugg

SEQ ID NO: 194744 - RNA, 22 nt, Human
gcugagaguguaggauguuuac

SEQ ID NO: 194745 - RNA, 22 nt, Human
gcugagcaaugcacugccgcau

SEQ ID NO: 194746 - RNA, 22 nt, Human
gcucuggcugccuuaguuuugu

SEQ ID NO: 194747 - RNA, 21 nt, Human
gcuggcugucucuuacacggu

SEQ ID NO: 194748 - RNA, 22 nt, Human
gcuggcggguuggggaggcgga

SEQ ID NO: 194749 - RNA, 22 nt, Human
gccauguuuugguaaauaccau

SEQ ID NO: 194750 - RNA, 22 nt, Human
gcccagaagguagcgaguaguc

SEQ ID NO: 194751 - RNA, 22 nt, Human
gcuggcgauggccgagucuccg

SEQ ID NO: 194752 - RNA, 22 nt, Human
gcuggauuuaggguucccuccu

SEQ ID NO: 194753 - RNA, 22 nt, Human
gcuggauaaggaucaguuucuu

SEQ ID NO: 194754 - RNA, 22 nt, Human
gccaguggucagugggagggug

SEQ ID NO: 194755 - RNA, 22 nt, Human
gcuggaaauaacuuguguagaa

SEQ ID NO: 194756 - RNA, 22 nt, Human
gcugcucaaaaaaacacuagcu

SEQ ID NO: 194757 - RNA, 22 nt, Human
gcugcuacagagcuggaggggg

SEQ ID NO: 194758 - RNA, 22 nt, Human
gccaggccuggguggagcgcuc

SEQ ID NO: 194759 - RNA, 22 nt, Human
gccaggcagcagcgaggauggu

SEQ ID NO: 194760 - RNA, 22 nt, Human
gccagggcucgagcaggccagc

SEQ ID NO: 194761 - RNA, 22 nt, Human
gcugcuucgcugcacacccgag

SEQ ID NO: 194762 - RNA, 22 nt, Human
gcugcuuagaaccauauuuaaa

SEQ ID NO: 194763 - RNA, 22 nt, Human
gccauauucaugcaggugcuaa

SEQ ID NO: 194764 - RNA, 22 nt, Human
gccaguuuguuuacugaugguu

SEQ ID NO: 194765 - RNA, 22 nt, Human
gccaggugauuucaaaguccuu

SEQ ID NO: 194766 - RNA, 22 nt, Human
gcucaacuucuaggacuucagg

SEQ ID NO: 194767 - RNA, 22 nt, Human
gcaugaauggaacccccugagu

SEQ ID NO: 194768 - RNA, 22 nt, Human
gcaucuccugagucagauuuug

SEQ ID NO: 194769 - RNA, 22 nt, Human
gcaucuguuagagugugcaugc

SEQ ID NO: 194770 - RNA, 22 nt, Human
gcucgauugucaguguuaggga

SEQ ID NO: 194771 - RNA, 22 nt, Human
gcauaacaacagacucuguguu

SEQ ID NO: 194772 - RNA, 22 nt, Human
gcauaaaggacuauaaggauca

SEQ ID NO: 194773 - RNA, 22 nt, Human
gcaguuugugauguggcaguca

SEQ ID NO: 194774 - RNA, 22 nt, Human
gcaguugugguuucguuuccuu

SEQ ID NO: 194775 - RNA, 22 nt, Human
gcuauuuagaaaggcuuggaga

SEQ ID NO: 194776 - RNA, 22 nt, Human
gcucaacucaacgucauuugaa

SEQ ID NO: 194777 - RNA, 19 nt, Human
gcaguuauggcccacuucc

SEQ ID NO: 194778 - RNA, 22 nt, Human
gcaguugguccagccucggcug

SEQ ID NO: 194779 - RNA, 22 nt, Human
gcuauacuugccuccucuccac

SEQ ID NO: 194780 - RNA, 22 nt, Human
gcaguuaccuauuuuguagaaa

SEQ ID NO: 194781 - RNA, 22 nt, Human
gcuacaaaaccagggcaaagga

SEQ ID NO: 194782 - RNA, 22 nt, Human
gcguggccugcugaaggacuuc

SEQ ID NO: 194783 - RNA, 22 nt, Human
gcgugcauggccguguguaugc

SEQ ID NO: 194784 - RNA, 22 nt, Human
gcguggaugauuuugagucggu

SEQ ID NO: 194785 - RNA, 22 nt, Human
gcgugcauguguguaugcgugu

SEQ ID NO: 194786 - RNA, 22 nt, Human
gcggcgucccagcuccgacggc

SEQ ID NO: 194787 - RNA, 22 nt, Human
gcgggccggcaggggaggaguu

SEQ ID NO: 194788 - RNA, 22 nt, Human
gcagcguguggcuaauggcucu

SEQ ID NO: 194789 - RNA, 22 nt, Human
gcagcgcugagaugauuuguug

SEQ ID NO: 194790 - RNA, 22 nt, Human
gcgguguuuuaacacucccucg

SEQ ID NO: 194791 - RNA, 22 nt, Human
gcggggggcucgggcagcucgg

SEQ ID NO: 194792 - RNA, 22 nt, Human
gcgguuguucugugugcaugga

SEQ ID NO: 194793 - RNA, 22 nt, Human
gcaggacuucuguuuaaccagu

SEQ ID NO: 194794 - RNA, 22 nt, Human
gcaggaaugguacauaccuguu

SEQ ID NO: 194795 - RNA, 22 nt, Human
gccuuggacuaccacucccaca

SEQ ID NO: 194796 - RNA, 22 nt, Human
gccuuucuugguuugucaggca

SEQ ID NO: 194797 - RNA, 22 nt, Human
gcggagcuaaagauuggcuccu

SEQ ID NO: 194798 - RNA, 22 nt, Human
gcagccaugcacgucauuauga

SEQ ID NO: 194799 - RNA, 22 nt, Human
gcagccugaguuuagcucgucg

SEQ ID NO: 194800 - RNA, 22 nt, Human
gaucauuuucauuaauguugca

SEQ ID NO: 194801 - RNA, 22 nt, Human
gaucauauccagucaccacuau

SEQ ID NO: 194802 - RNA, 22 nt, Human
gaugaaguaguccacuggaagg

SEQ ID NO: 194803 - RNA, 22 nt, Human
gaugauaacagcauuucaacug

SEQ ID NO: 194804 - RNA, 22 nt, Human
gccaguaaaguaucuccuuuug

SEQ ID NO: 194805 - RNA, 23 nt, Human
gaugauggcaacuacauccggug

SEQ ID NO: 194806 - RNA, 22 nt, Human
gaugauuccuuuguucauugug

SEQ ID NO: 194807 - RNA, 23 nt, Human
gcauuugcaggaaacuggaaaag

SEQ ID NO: 194808 - RNA, 22 nt, Human
gcauuucauaaccagccaugcu

SEQ ID NO: 194809 - RNA, 22 nt, Human
gcauuuuaauuggggcaguuag

SEQ ID NO: 194810 - RNA, 22 nt, Human
gauauucauaggcagguauuua

SEQ ID NO: 194811 - RNA, 19 nt, Human
gauauugagcugagaauuc

SEQ ID NO: 194812 - RNA, 22 nt, Human
gaugcuaauuaaugaagaggag

SEQ ID NO: 194813 - RNA, 22 nt, Human
gauggacgguuuuaccagacag

SEQ ID NO: 194814 - RNA, 22 nt, Human
gccaucuucggcagccgccugg

SEQ ID NO: 194815 - RNA, 22 nt, Human
gccauguucuugaaucuggguc

SEQ ID NO: 194816 - RNA, 22 nt, Human
gccaugguggggccucccugac

SEQ ID NO: 194817 - RNA, 22 nt, Human
gaugccuccaggaaagaggacg

SEQ ID NO: 194818 - RNA, 22 nt, Human
gaugauugaauaaauaugguca

SEQ ID NO: 194819 - RNA, 22 nt, Human
gccauggugagccaccuggugg

SEQ ID NO: 194820 - RNA, 22 nt, Human
gcccguuuagcaaacgccuccu

SEQ ID NO: 194821 - RNA, 22 nt, Human
gcccagacaucuguugggaccu

SEQ ID NO: 194822 - RNA, 23 nt, Human
gcccagaggccccuggccugagc

SEQ ID NO: 194823 - RNA, 22 nt, Human
gauggcauucacaaacuuaacu

SEQ ID NO: 194824 - RNA, 22 nt, Human
gauggcaaugcuagaaauuuag

SEQ ID NO: 194825 - RNA, 22 nt, Human
gaugccggggucguagccgugg

SEQ ID NO: 194826 - RNA, 22 nt, Human
gcauguucaaguuaguauauuu

SEQ ID NO: 194827 - RNA, 23 nt, Human
gcaugcccauauguguauauaua

SEQ ID NO: 194828 - RNA, 22 nt, Human
gcaugguuagacaucaauguga

SEQ ID NO: 194829 - RNA, 22 nt, Human
gcaugguuuccugcaacguucu

SEQ ID NO: 194830 - RNA, 22 nt, Human
gcauuccagaguugcuggaaaa

SEQ ID NO: 194831 - RNA, 22 nt, Human
gauauauuucaaauucuuuugc

SEQ ID NO: 194832 - RNA, 22 nt, Human
gcauuuaaauuugaacuucaga

SEQ ID NO: 194833 - RNA, 22 nt, Human
gaguuggggcugcguguuucca

SEQ ID NO: 194834 - RNA, 22 nt, Human
gaguugucggaggaagggggcg

SEQ ID NO: 194835 - RNA, 20 nt, Human
gcauggcuggcugcugucug

SEQ ID NO: 194836 - RNA, 22 nt, Human
gcaugcuguuuggaaacgauaa

SEQ ID NO: 194837 - RNA, 22 nt, Human
gcagcuuuggagguggaacucu

SEQ ID NO: 194838 - RNA, 22 nt, Human
gaggugggaggcgggccugcau

SEQ ID NO: 194839 - RNA, 22 nt, Human
gagguuggagggcugcccugca

SEQ ID NO: 194840 - RNA, 22 nt, Human
gagguuuaguccauaguauuua

SEQ ID NO: 194841 - RNA, 22 nt, Human
gcaacguauauggguaaggaua

SEQ ID NO: 194842 - RNA, 22 nt, Human
gcaaagaauugauucauuuugc

SEQ ID NO: 194843 - RNA, 22 nt, Human
gcaacccugggucaugguugac

SEQ ID NO: 194844 - RNA, 21 nt, Human
gcaaccagaccacagggcagu

SEQ ID NO: 194845 - RNA, 21 nt, Human
gauuuuagggcagccaaacac

SEQ ID NO: 194846 - RNA, 22 nt, Human
gauuuuaaaagauguauaaggu

SEQ ID NO: 194847 - RNA, 22 nt, Human
gccuccuccaucauugcuucau

SEQ ID NO: 194848 - RNA, 22 nt, Human
gccuccgccuuccugucucccc

SEQ ID NO: 194849 - RNA, 22 nt, Human
gccuccggagucgcagugucuu

SEQ ID NO: 194850 - RNA, 22 nt, Human
gccugcaaagacuuccuucucu

SEQ ID NO: 194851 - RNA, 22 nt, Human
gccugagauuggacauuauuua

SEQ ID NO: 194852 - RNA, 22 nt, Human
gccugagucaagauguggcacc

SEQ ID NO: 194853 - RNA, 22 nt, Human
gcacagauaaucugccuuacca

SEQ ID NO: 194854 - RNA, 22 nt, Human
gcacagaguguaaaaguuucau

SEQ ID NO: 194855 - RNA, 22 nt, Human
gccugggcuuccgggacccggg

SEQ ID NO: 194856 - RNA, 23 nt, Human
gcacuguuugaggagcacugugc

SEQ ID NO: 194857 - RNA, 22 nt, Human
gccugggugcugugggguggag

SEQ ID NO: 194858 - RNA, 22 nt, Human
gcccugaagagguagagaauuu

SEQ ID NO: 194859 - RNA, 22 nt, Human
gaugguggaggaaucgcugaag

SEQ ID NO: 194860 - RNA, 22 nt, Human
gauguaucugagcugcuuaggu

SEQ ID NO: 194861 - RNA, 22 nt, Human
gcccuuuuaucaacuccuagaa

SEQ ID NO: 194862 - RNA, 18 nt, Human
gccgccuugcucgugaac

SEQ ID NO: 194863 - RNA, 22 nt, Human
gccgcgggucugggucuggcuc

SEQ ID NO: 194864 - RNA, 22 nt, Human
gccgccgccgccuuuguugcgg

SEQ ID NO: 194865 - RNA, 22 nt, Human
gauugauguaggugauaaaucu

SEQ ID NO: 194866 - RNA, 22 nt, Human
gauucuaucauucuguauauua

SEQ ID NO: 194867 - RNA, 22 nt, Human
gccgcguggcagucuuggugac

SEQ ID NO: 194868 - RNA, 20 nt, Human
gccggggcauaggggccguc

SEQ ID NO: 194869 - RNA, 22 nt, Human
gccgggagaggcggcgcagggg

SEQ ID NO: 194870 - RNA, 22 nt, Human
gauugcugccagcguguccgug

SEQ ID NO: 194871 - RNA, 21 nt, Human
gccgugcgccuccaggcgcgc

SEQ ID NO: 194872 - RNA, 22 nt, Human
gauuucauaaaacgagaaacuc

SEQ ID NO: 194873 - RNA, 22 nt, Human
gauuucuucauuuaaaaauauu

SEQ ID NO: 194874 - RNA, 22 nt, Human
gauggauuuuuuauuaaaucag

SEQ ID NO: 194875 - RNA, 22 nt, Human
gaugcucuugauuggaccaggg

SEQ ID NO: 194876 - RNA, 22 nt, Human
gagagauacauucccaaccuga

SEQ ID NO: 194877 - RNA, 22 nt, Human
gagaggaagugccugcucccag

SEQ ID NO: 194878 - RNA, 22 nt, Human
gagaggcagcucaggaggucag

SEQ ID NO: 194879 - RNA, 22 nt, Human
gagagcugucagcguagcaccg

SEQ ID NO: 194880 - RNA, 22 nt, Human
gagacugcguggcucugacaca

SEQ ID NO: 194881 - RNA, 22 nt, Human
gagacagugucagccauugaaa

SEQ ID NO: 194882 - RNA, 22 nt, Human
gagaccuuaagagaugucagcu

SEQ ID NO: 194883 - RNA, 22 nt, Human
gaugguuuuacauuuuaauguu

SEQ ID NO: 194884 - RNA, 22 nt, Human
gagcagcaggccagguugcagg

SEQ ID NO: 194885 - RNA, 22 nt, Human
gaugucuauguccagggccauc

SEQ ID NO: 194886 - RNA, 22 nt, Human
gagcagccugaggauucugcuc

SEQ ID NO: 194887 - RNA, 22 nt, Human
gagcagcacagaccaaacagaa

SEQ ID NO: 194888 - RNA, 22 nt, Human
gaugguggggggcagcugggag

SEQ ID NO: 194889 - RNA, 22 nt, Human
gaugggaggaugaauuggaccu

SEQ ID NO: 194890 - RNA, 22 nt, Human
gauggguugaguucauggagcc

SEQ ID NO: 194891 - RNA, 22 nt, Human
gauggguuugagauguuugggu

SEQ ID NO: 194892 - RNA, 22 nt, Human
gauggggaaaaaauggaucuuu

SEQ ID NO: 194893 - RNA, 22 nt, Human
gaugguagauauagaaagggga

SEQ ID NO: 194894 - RNA, 22 nt, Human
gauggugcaauuaucgugcaug

SEQ ID NO: 194895 - RNA, 22 nt, Human
gagagucuuaaguuacagaacu

SEQ ID NO: 194896 - RNA, 22 nt, Human
gagauuguggcagcagcuguuu

SEQ ID NO: 194897 - RNA, 22 nt, Human
gagauuaauuaaaaccuuuaug

SEQ ID NO: 194898 - RNA, 22 nt, Human
gagcggcggugagaaguguggg

SEQ ID NO: 194899 - RNA, 22 nt, Human
gagcuaauagacagcaacauca

SEQ ID NO: 194900 - RNA, 22 nt, Human
gagcuaagcccuggagaggucg

SEQ ID NO: 194901 - RNA, 22 nt, Human
gagcuggagaaacacauaagaa

SEQ ID NO: 194902 - RNA, 22 nt, Human
gcaaaugacuuagucacuccag

SEQ ID NO: 194903 - RNA, 22 nt, Human
gauuuuuaaaaguaguuuugaa

SEQ ID NO: 194904 - RNA, 22 nt, Human
gcaaaaacaguguagucuucug

SEQ ID NO: 194905 - RNA, 22 nt, Human
gagcuuuguuccgugguggcac

SEQ ID NO: 194906 - RNA, 22 nt, Human
gaggaaaauggaguguaauuaa

SEQ ID NO: 194907 - RNA, 22 nt, Human
gagcgcgcaaucucuccagcug

SEQ ID NO: 194908 - RNA, 22 nt, Human
gauuuucauuauagcuaguuuc

SEQ ID NO: 194909 - RNA, 22 nt, Human
gagccggggcucccugaggucc

SEQ ID NO: 194910 - RNA, 22 nt, Human
gagcgacucuuuuaguccagag

SEQ ID NO: 194911 - RNA, 22 nt, Human
gagccuguuaggcaccuguguu

SEQ ID NO: 194912 - RNA, 22 nt, Human
gauuccuuucgccugccgagcu

SEQ ID NO: 194913 - RNA, 22 nt, Human
gauugcaucaauauuuagagua

SEQ ID NO: 194914 - RNA, 22 nt, Human
gauugcauaugcauucugauac

SEQ ID NO: 194915 - RNA, 22 nt, Human
gauugauuuaauaugagaggau

SEQ ID NO: 194916 - RNA, 22 nt, Human
gauuggucacacaauaguauau

SEQ ID NO: 194917 - RNA, 22 nt, Human
gauugggagugugacauuguau

SEQ ID NO: 194918 - RNA, 20 nt, Human
gauuuaacgcugcgucuguc

SEQ ID NO: 194919 - RNA, 22 nt, Human
gauucugaaauuaacagacugg

SEQ ID NO: 194920 - RNA, 22 nt, Human
gagcccuguagcaagucauguc

SEQ ID NO: 194921 - RNA, 22 nt, Human
gagccgcagcugcguagggucc

SEQ ID NO: 194922 - RNA, 22 nt, Human
gagcaugacgcaacaccaagug

SEQ ID NO: 194923 - RNA, 22 nt, Human
gagccaugagauaagagcaccu

SEQ ID NO: 194924 - RNA, 19 nt, Human
gagcaugacuggccuugca

SEQ ID NO: 194925 - RNA, 22 nt, Human
gagcaggucucaguucugccuc

SEQ ID NO: 194926 - RNA, 22 nt, Human
gauuaagugaauuggagaaaag

SEQ ID NO: 194927 - RNA, 22 nt, Human
gauuaagauuacauauuuaagu

SEQ ID NO: 194928 - RNA, 22 nt, Human
gauguuuugaaagaagaauaca

SEQ ID NO: 194929 - RNA, 22 nt, Human
gauuaaaggucuugauuauaag

SEQ ID NO: 194930 - RNA, 22 nt, Human
gagcagcugagcuggaaugaga

SEQ ID NO: 194931 - RNA, 22 nt, Human
gagcaggucuuugguaaugcuu

SEQ ID NO: 194932 - RNA, 22 nt, Human
gagcagguuauuagaaauggaa

SEQ ID NO: 194933 - RNA, 22 nt, Human
gaggaagucuuaucuggaugca

SEQ ID NO: 194934 - RNA, 22 nt, Human
gagcuuuagcugagaccugcuu

SEQ ID NO: 194935 - RNA, 22 nt, Human
gcaagagaagaaagaauaguuu

SEQ ID NO: 194936 - RNA, 22 nt, Human
gaggagaaacagccgugauagu

SEQ ID NO: 194937 - RNA, 22 nt, Human
gcaaggaagcagaguugcuauc

SEQ ID NO: 194938 - RNA, 22 nt, Human
gaggagagcuggccagguuucu

SEQ ID NO: 194939 - RNA, 22 nt, Human
gaggagcaggcaggaucugguc

SEQ ID NO: 194940 - RNA, 22 nt, Human
gaggagagaaauguuuucugug

SEQ ID NO: 194941 - RNA, 22 nt, Human
gcaacuccuaggcgaggccuuc

SEQ ID NO: 194942 - RNA, 22 nt, Human
gcaauuguauugucaagacaug

SEQ ID NO: 194943 - RNA, 22 nt, Human
gcaauaaguuuucucuucuguc

SEQ ID NO: 194944 - RNA, 22 nt, Human
gcacaaguccuccgacagcacg

SEQ ID NO: 194945 - RNA, 22 nt, Human
gaggaggagacggaggccuggg

SEQ ID NO: 194946 - RNA, 22 nt, Human
gcacagcuaugagcugaauugu

SEQ ID NO: 194947 - RNA, 22 nt, Human
gaggagacaguggagccgcuac

SEQ ID NO: 194948 - RNA, 22 nt, Human
gagggaaaggggccaugauugg

SEQ ID NO: 194949 - RNA, 22 nt, Human
gaggcuugccacuguccauggc

SEQ ID NO: 194950 - RNA, 22 nt, Human
gaggcgcgcugcgagggcgcgg

SEQ ID NO: 194951 - RNA, 22 nt, Human
gaggcggugguggcgagaguca

SEQ ID NO: 194952 - RNA, 22 nt, Human
gaggcucagagggacuuucaag

SEQ ID NO: 194953 - RNA, 22 nt, Human
gcacucugggucaucugcugcc

SEQ ID NO: 194954 - RNA, 23 nt, Human
gcacuccgagggcacgugucucu

SEQ ID NO: 194955 - RNA, 22 nt, Human
gcacucuguggagacaagauag

SEQ ID NO: 194956 - RNA, 21 nt, Human
gcacucagucacuacucaaga

SEQ ID NO: 194957 - RNA, 22 nt, Human
gaggaugacaaagaaggcagac

SEQ ID NO: 194958 - RNA, 22 nt, Human
gaggcagaggaugggacuguau

SEQ ID NO: 194959 - RNA, 22 nt, Human
gaggaucuuuagcgggacugcu

SEQ ID NO: 194960 - RNA, 22 nt, Human
gcacaggcugcacgaccccagc

SEQ ID NO: 194961 - RNA, 22 nt, Human
gaggcaggcggggcccaggugg

SEQ ID NO: 194962 - RNA, 22 nt, Human
gcagcucagcacgcacagguaa

SEQ ID NO: 194963 - RNA, 22 nt, Human
gcagcguuaacauuuuuccugu

SEQ ID NO: 194964 - RNA, 22 nt, Human
gcaggaagauugcagaaggcug

SEQ ID NO: 194965 - RNA, 22 nt, Human
gcaggacugauggagcauaugu

SEQ ID NO: 194966 - RNA, 22 nt, Human
gcaggagggggccuggagccca

SEQ ID NO: 194967 - RNA, 22 nt, Human
gcaggcagauccagaagcacua

SEQ ID NO: 194968 - RNA, 22 nt, Human
gaggugauuccucccauguaau

SEQ ID NO: 194969 - RNA, 22 nt, Human
gcaggcaggauucagagauaca

SEQ ID NO: 194970 - RNA, 22 nt, Human
gaggucagugugggggcaaggg

SEQ ID NO: 194971 - RNA, 22 nt, Human
gcagccauuugcaucuaauuaa

SEQ ID NO: 194972 - RNA, 22 nt, Human
gaggguuagauuuuaagaaaga

SEQ ID NO: 194973 - RNA, 22 nt, Human
gcagccauggcuggccgggcau

SEQ ID NO: 194974 - RNA, 22 nt, Human
gcagcauuaccaagacauggca

SEQ ID NO: 194975 - RNA, 23 nt, Human
gcagccaacccacgugagagaag

SEQ ID NO: 194976 - RNA, 22 nt, Human
gcagccagggaccuuugacuau

SEQ ID NO: 194977 - RNA, 22 nt, Human
gaggggaagaacaauuuaauuu

SEQ ID NO: 194978 - RNA, 22 nt, Human
gaggggaacaggcauucuuaag

SEQ ID NO: 194979 - RNA, 22 nt, Human
gcagauaaaauuuuugauggga

SEQ ID NO: 194980 - RNA, 22 nt, Human
gaggggaaggagcgaaggcggg

SEQ ID NO: 194981 - RNA, 22 nt, Human
gaggggaaggauuucuucagaa

SEQ ID NO: 194982 - RNA, 22 nt, Human
gaggggaauguuccugagcugg

SEQ ID NO: 194983 - RNA, 22 nt, Human
gcagagaaugucagauuuuguu

SEQ ID NO: 194984 - RNA, 22 nt, Human
gcagagcacccugcagugguau

SEQ ID NO: 194985 - RNA, 22 nt, Human
gcagaggcaaagucuggaugac

SEQ ID NO: 194986 - RNA, 22 nt, Human
gagggaggugacaaggacauag

SEQ ID NO: 194987 - RNA, 22 nt, Human
gagggcugccacguugggcgag

SEQ ID NO: 194988 - RNA, 22 nt, Human
gaggggcucuugggcaugaagg

SEQ ID NO: 194989 - RNA, 22 nt, Human
gaggggcugggguugacuccaa

SEQ ID NO: 194990 - RNA, 22 nt, Human
gaggggggcacuuguuuugacu

SEQ ID NO: 194991 - RNA, 22 nt, Human
gagggguuguuaacaaagaaua

SEQ ID NO: 194992 - RNA, 22 nt, Human
gaggguaaauucagaguaggag

SEQ ID NO: 194993 - RNA, 20 nt, Human
gcagcagacagacaggggac

SEQ ID NO: 194994 - RNA, 22 nt, Human
gcagcaauaaaacugaaggugu

SEQ ID NO: 194995 - RNA, 22 nt, Human
gaggggcgaggacgcugaagua

SEQ ID NO: 194996 - RNA, 22 nt, Human
gaggggcggggcgggaggagag

SEQ ID NO: 194997 - RNA, 22 nt, Human
aaauguauuagccuaugugaga

SEQ ID NO: 194998 - RNA, 22 nt, Human
aaaugcucgccagguuuuauua

SEQ ID NO: 194999 - RNA, 22 nt, Human
aaauggauaaucaagauaauca

SEQ ID NO: 195000 - RNA, 22 nt, Human
aaauccaucaaaucuucuagaa

SEQ ID NO: 195001 - RNA, 22 nt, Human
aaaucccacucacgaguuuugc

SEQ ID NO: 195002 - RNA, 22 nt, Human
aaaucgcuugaacccaggaagu

SEQ ID NO: 195003 - RNA, 22 nt, Human
aaauauagugacacuuauaguc

SEQ ID NO: 195004 - RNA, 22 nt, Human
aaauauauccuucuguccugcc

SEQ ID NO: 195005 - RNA, 22 nt, Human
aaaucugaauuaaaaucugguu

SEQ ID NO: 195006 - RNA, 22 nt, Human
aaauauuaaugaugaagguagu

SEQ ID NO: 195007 - RNA, 22 nt, Human
aaauaugguaucugccaaacua

SEQ ID NO: 195008 - RNA, 22 nt, Human
aaaucaagucagcugaauucca

SEQ ID NO: 195009 - RNA, 22 nt, Human
aaaucauagccaugaacauuug

SEQ ID NO: 195010 - RNA, 22 nt, Human
aaauuagucacaccagugucuu

SEQ ID NO: 195011 - RNA, 22 nt, Human
aaauuuauaacuuaaagugaau

SEQ ID NO: 195012 - RNA, 21 nt, Human
aacaaaagggaagaacagcug

SEQ ID NO: 195013 - RNA, 22 nt, Human
aacaaaacauuuuacgaauaua

SEQ ID NO: 195014 - RNA, 19 nt, Human
aacaaaauaguucuaguua

SEQ ID NO: 195015 - RNA, 22 nt, Human
aacaaagaaaagcuugagguuu

SEQ ID NO: 195016 - RNA, 22 nt, Human
aacauuuauguuuugaccaagu

SEQ ID NO: 195017 - RNA, 22 nt, Human
aacauuuccggccuuuuguucu

SEQ ID NO: 195018 - RNA, 22 nt, Human
aacaaccuaguaguaucuuuca

SEQ ID NO: 195019 - RNA, 22 nt, Human
aacaggaagaauccagauggug

SEQ ID NO: 195020 - RNA, 22 nt, Human
aacagggcaguuccuuauagug

SEQ ID NO: 195021 - RNA, 22 nt, Human
aacagggcgugaauaaugaaga

SEQ ID NO: 195022 - RNA, 22 nt, Human
aacagguucaagccuugcagca

SEQ ID NO: 195023 - RNA, 22 nt, Human
aacaggcuaaauuguccauuuc

SEQ ID NO: 195024 - RNA, 22 nt, Human
aaauauauauaauauauauauu

SEQ ID NO: 195025 - RNA, 22 nt, Human
aaaguuacacgacuauuuaugu

SEQ ID NO: 195026 - RNA, 22 nt, Human
aaaguguuuaacaaauugcuuu

SEQ ID NO: 195027 - RNA, 22 nt, Human
aaaguagaugagaauuuuguug

SEQ ID NO: 195028 - RNA, 22 nt, Human
aaagucugaaaaaguuuguggg

SEQ ID NO: 195029 - RNA, 22 nt, Human
aaauauuugaaugguguaagau

SEQ ID NO: 195030 - RNA, 22 nt, Human
aaauauugaauuugaggaugua

SEQ ID NO: 195031 - RNA, 22 nt, Human
aaaguugcauccuaugaccuca

SEQ ID NO: 195032 - RNA, 22 nt, Human
aaaguuaauucuuguuuuuuau

SEQ ID NO: 195033 - RNA, 22 nt, Human
aaauauuagacauaccuggaga

SEQ ID NO: 195034 - RNA, 22 nt, Human
aaaucaaaagugguuauuuuau

SEQ ID NO: 195035 - RNA, 22 nt, Human
aaauagucagaaaucaacgugc

SEQ ID NO: 195036 - RNA, 22 nt, Human
aaaguuuguacugggaguuacu

SEQ ID NO: 195037 - RNA, 23 nt, Human
aaauaauaauuucucuguuggga

SEQ ID NO: 195038 - RNA, 22 nt, Human
aaauagauuugacuacuuggug

SEQ ID NO: 195039 - RNA, 22 nt, Human
aaaucugaaggaaacagcuuca

SEQ ID NO: 195040 - RNA, 22 nt, Human
aaaucauguuaaagagggaguu

SEQ ID NO: 195041 - RNA, 22 nt, Human
aaaggagugaaaugagaggaaa

SEQ ID NO: 195042 - RNA, 22 nt, Human
aaagcgagccggcuuggaggga

SEQ ID NO: 195043 - RNA, 22 nt, Human
aaagucgugucagaaguuggga

SEQ ID NO: 195044 - RNA, 21 nt, Human
aaagugguaaggauuauuuug

SEQ ID NO: 195045 - RNA, 22 nt, Human
aaaguguaagucccugguuguc

SEQ ID NO: 195046 - RNA, 22 nt, Human
aaaguagaauaauaaacccuug

SEQ ID NO: 195047 - RNA, 22 nt, Human
aaauaggaguagugauguauua

SEQ ID NO: 195048 - RNA, 22 nt, Human
aaaguuguccuuugugccuuua

SEQ ID NO: 195049 - RNA, 22 nt, Human
aaagguguagacucaguuaugc

SEQ ID NO: 195050 - RNA, 22 nt, Human
aaagguggugguuagggaauau

SEQ ID NO: 195051 - RNA, 22 nt, Human
aaagggcugaaguagucucugu

SEQ ID NO: 195052 - RNA, 22 nt, Human
aaaggucagaugugucgaggag

SEQ ID NO: 195053 - RNA, 22 nt, Human
aaagggaugauuucugaagaua

SEQ ID NO: 195054 - RNA, 22 nt, Human
aaaguaaagccuauuuaauaau

SEQ ID NO: 195055 - RNA, 22 nt, Human
aaagccaagucugauuuuguug

SEQ ID NO: 195056 - RNA, 22 nt, Human
aaagccagggacagugugcaug

SEQ ID NO: 195057 - RNA, 22 nt, Human
aaagcaaauaguugcuuaauau

SEQ ID NO: 195058 - RNA, 17 nt, Human
aaagccgaucagauguu

SEQ ID NO: 195059 - RNA, 22 nt, Human
aaagcuccaaauggguggaagu

SEQ ID NO: 195060 - RNA, 22 nt, Human
aaagcugaaacgaaaugacaac

SEQ ID NO: 195061 - RNA, 22 nt, Human
aaagccauaucuauucuauucu

SEQ ID NO: 195062 - RNA, 22 nt, Human
aaagccaagguccauguacuuu

SEQ ID NO: 195063 - RNA, 22 nt, Human
aaagcauucuaaccgaucgacg

SEQ ID NO: 195064 - RNA, 22 nt, Human
aaagcagucuguuuuaaccuga

SEQ ID NO: 195065 - RNA, 22 nt, Human
aaagcauuuguuucuccuggaa

SEQ ID NO: 195066 - RNA, 22 nt, Human
aaaggugccucuuacaaggcuu

SEQ ID NO: 195067 - RNA, 22 nt, Human
aaagcccuccaggguauacauu

SEQ ID NO: 195068 - RNA, 22 nt, Human
aaagaacguuucugggaaucag

SEQ ID NO: 195069 - RNA, 21 nt, Human
aaagaagagcucagagguaga

SEQ ID NO: 195070 - RNA, 21 nt, Human
aaagaaguuaguucagugguu

SEQ ID NO: 195071 - RNA, 22 nt, Human
aaagaguuaagagucuuaagcu

SEQ ID NO: 195072 - RNA, 22 nt, Human
aaagacaauaauucucucuagc

SEQ ID NO: 195073 - RNA, 22 nt, Human
aaacuuuaucaaguacucuuca

SEQ ID NO: 195074 - RNA, 18 nt, Human
aaacgguuucaugcugua

SEQ ID NO: 195075 - RNA, 22 nt, Human
aaacccuagcguuguuuauuga

SEQ ID NO: 195076 - RNA, 22 nt, Human
aaagaugucauacacauuaaga

SEQ ID NO: 195077 - RNA, 22 nt, Human
aaagaugaaguucagcgaagaa

SEQ ID NO: 195078 - RNA, 22 nt, Human
aaagcaaagaucuguagcccaa

SEQ ID NO: 195079 - RNA, 22 nt, Human
aaagagccaacuaccgcaaauu

SEQ ID NO: 195080 - RNA, 23 nt, Human
aaagaggugaauccaggacaagc

SEQ ID NO: 195081 - RNA, 22 nt, Human
aaagagugugcauguaccugug

SEQ ID NO: 195082 - RNA, 22 nt, Human
aaagagggaaggaaggagugaa

SEQ ID NO: 195083 - RNA, 22 nt, Human
aaagcagguugcaauuacagug

SEQ ID NO: 195084 - RNA, 22 nt, Human
aaaaugggaaaauuuuagauua

SEQ ID NO: 195085 - RNA, 23 nt, Human
aaacuacauuuauaguuuuucuc

SEQ ID NO: 195086 - RNA, 22 nt, Human
aaaccgguacccuccugccugc

SEQ ID NO: 195087 - RNA, 22 nt, Human
aaacgcauucuuacaugcuucc

SEQ ID NO: 195088 - RNA, 22 nt, Human
aaacgcaauuucuugcauguca

SEQ ID NO: 195089 - RNA, 22 nt, Human
aaaauuuccuuggaccauuuuu

SEQ ID NO: 195090 - RNA, 22 nt, Human
aaacaauaauaauuaggaagga

SEQ ID NO: 195091 - RNA, 22 nt, Human
aaacaagagcuuacauggcugc

SEQ ID NO: 195092 - RNA, 22 nt, Human
aaacaccaagagcuagcuauua

SEQ ID NO: 195093 - RNA, 22 nt, Human
aaaagguauuuagcgauugcau

SEQ ID NO: 195094 - RNA, 22 nt, Human
aaaaguauaagugucuccugau

SEQ ID NO: 195095 - RNA, 22 nt, Human
aaaagguuauagcuuugccuug

SEQ ID NO: 195096 - RNA, 22 nt, Human
aaaauauucuauaucaaagaua

SEQ ID NO: 195097 - RNA, 22 nt, Human
aaaauauuuaucuagcucuuaa

SEQ ID NO: 195098 - RNA, 17 nt, Human
aaaaucaaaggaggugc

SEQ ID NO: 195099 - RNA, 22 nt, Human
aaacagcugcaguacacggccu

SEQ ID NO: 195100 - RNA, 22 nt, Human
aaaaggauauuuggugcaaagc

SEQ ID NO: 195101 - RNA, 22 nt, Human
aaaaguuguaauauuuccuuua

SEQ ID NO: 195102 - RNA, 22 nt, Human
aaaagggucugacacugcuuga

SEQ ID NO: 195103 - RNA, 22 nt, Human
aaaagcucucuucuucggcuuu

SEQ ID NO: 195104 - RNA, 22 nt, Human
aaaagcgaagagaacugaaguu

SEQ ID NO: 195105 - RNA, 22 nt, Human
aaaagcauuauuagucugggug

SEQ ID NO: 195106 - RNA, 22 nt, Human
aaaagauguaaacauauauuaa

SEQ ID NO: 195107 - RNA, 22 nt, Human
aaaaggacaguagccuugaggu

SEQ ID NO: 195108 - RNA, 22 nt, Human
aaaaggaacaauaugguauuuu

SEQ ID NO: 195109 - RNA, 22 nt, Human
aaaagacaaggaucuggaguga

SEQ ID NO: 195110 - RNA, 22 nt, Human
aaaacuuucagggauacagaaa

SEQ ID NO: 195111 - RNA, 22 nt, Human
aaaacauuuaggguuuuuuuua

SEQ ID NO: 195112 - RNA, 22 nt, Human
aaaacauuuuacugccaucuca

SEQ ID NO: 195113 - RNA, 22 nt, Human
aauucugcagucguacuauaau

SEQ ID NO: 195114 - RNA, 22 nt, Human
aauugccaagaauuagugauac

SEQ ID NO: 195115 - RNA, 21 nt, Human
aauugccuaauauaugggaag

SEQ ID NO: 195116 - RNA, 22 nt, Human
aauuauucaugucugggcagcc

SEQ ID NO: 195117 - RNA, 22 nt, Human
aauuauugucuuuuuuaaaagc

SEQ ID NO: 195118 - RNA, 22 nt, Human
aauugugagaguuagagagcau

SEQ ID NO: 195119 - RNA, 22 nt, Human
aauuuaaguuauugcuaaugug

SEQ ID NO: 195120 - RNA, 22 nt, Human
aauuggagaguugugaaaggau

SEQ ID NO: 195121 - RNA, 22 nt, Human
aauuuaauugguuuuuacuugu

SEQ ID NO: 195122 - RNA, 22 nt, Human
aauuuauccuuuugcuaaagca

SEQ ID NO: 195123 - RNA, 22 nt, Human
aauuucaucugagacugggagc

SEQ ID NO: 195124 - RNA, 22 nt, Human
aauuucagaccaacgagucagg

SEQ ID NO: 195125 - RNA, 22 nt, Human
aauuuuagcuaaagauccaugg

SEQ ID NO: 195126 - RNA, 22 nt, Human
aauuuuauuagacaggcauaau

SEQ ID NO: 195127 - RNA, 22 nt, Human
aauuuuauuuuuuccccuagau

SEQ ID NO: 195128 - RNA, 21 nt, Human
acaaaaccuaacuuggcugcu

SEQ ID NO: 195129 - RNA, 22 nt, Human
aauuucuuuagagguacugauc

SEQ ID NO: 195130 - RNA, 22 nt, Human
aauuucuuucagcugcuuuaag

SEQ ID NO: 195131 - RNA, 22 nt, Human
acaaaaauauuguagaagugcu

SEQ ID NO: 195132 - RNA, 18 nt, Human
acaaaaauagugcuuugg

SEQ ID NO: 195133 - RNA, 22 nt, Human
acaaagugaaaagcaucgaauu

SEQ ID NO: 195134 - RNA, 22 nt, Human
aauuugcuccaaugucaguucu

SEQ ID NO: 195135 - RNA, 22 nt, Human
acaaacugggauaggauccugu

SEQ ID NO: 195136 - RNA, 22 nt, Human
acaaauuuaaauguugucuguu

SEQ ID NO: 195137 - RNA, 22 nt, Human
acaaaucccuguaaacacagcu

SEQ ID NO: 195138 - RNA, 20 nt, Human
acaaccacugcucacaguuu

SEQ ID NO: 195139 - RNA, 22 nt, Human
aauuauguuugcuuuagaugga

SEQ ID NO: 195140 - RNA, 22 nt, Human
aauuaacuggguucucagaugc

SEQ ID NO: 195141 - RNA, 22 nt, Human
aauuauuaucauuaucuuccug

SEQ ID NO: 195142 - RNA, 22 nt, Human
aauuauuaagcuuucuccagug

SEQ ID NO: 195143 - RNA, 22 nt, Human
aauuauuauguggaagacgacg

SEQ ID NO: 195144 - RNA, 22 nt, Human
aauguuuuucaaguguggagca

SEQ ID NO: 195145 - RNA, 22 nt, Human
aauuaaauguuugguuugagcu

SEQ ID NO: 195146 - RNA, 22 nt, Human
aauguguauguguauauauaug

SEQ ID NO: 195147 - RNA, 22 nt, Human
aaugugcauaacuuuauaaauu

SEQ ID NO: 195148 - RNA, 23 nt, Human
aaugugaaauugaguuuuuguua

SEQ ID NO: 195149 - RNA, 22 nt, Human
aaugugguauuuuggcauucuu

SEQ ID NO: 195150 - RNA, 22 nt, Human
aaugugcugguaacugcuuugc

SEQ ID NO: 195151 - RNA, 22 nt, Human
aauguucauauggguagcagau

SEQ ID NO: 195152 - RNA, 22 nt, Human
aaugugugggagaacagucuuu

SEQ ID NO: 195153 - RNA, 22 nt, Human
aauguauuuuuaggcagaauau

SEQ ID NO: 195154 - RNA, 22 nt, Human
aauggugaggagugcauugaga

SEQ ID NO: 195155 - RNA, 22 nt, Human
aaugggauuaagaaagaucuug

SEQ ID NO: 195156 - RNA, 22 nt, Human
aaucaugguacaaguaagcacg

SEQ ID NO: 195157 - RNA, 22 nt, Human
aaucccaguugacagaacuguu

SEQ ID NO: 195158 - RNA, 22 nt, Human
aaucacuuagaacccaggaagu

SEQ ID NO: 195159 - RNA, 22 nt, Human
aaucacuucuuugucuucuuca

SEQ ID NO: 195160 - RNA, 22 nt, Human
aaucauaacaaaagcaauuaua

SEQ ID NO: 195161 - RNA, 22 nt, Human
aaugcgcagaguggugugugca

SEQ ID NO: 195162 - RNA, 22 nt, Human
aaucuacaaugaaaaaauguuu

SEQ ID NO: 195163 - RNA, 22 nt, Human
aauccucguagugguuagaaag

SEQ ID NO: 195164 - RNA, 22 nt, Human
aaucgguugaacccaggaagug

SEQ ID NO: 195165 - RNA, 22 nt, Human
aauggagaaaagacaauguuga

SEQ ID NO: 195166 - RNA, 22 nt, Human
aauggauaacaccgguucuguc

SEQ ID NO: 195167 - RNA, 22 nt, Human
aauggcaaaaguuucggaaauu

SEQ ID NO: 195168 - RNA, 22 nt, Human
aauggaugauuaaauggaugaa

SEQ ID NO: 195169 - RNA, 22 nt, Human
aauggcaauagugcauuaugua

SEQ ID NO: 195170 - RNA, 22 nt, Human
aaugcugugggauagggcuccu

SEQ ID NO: 195171 - RNA, 22 nt, Human
aaucaugagguguuucuuugca

SEQ ID NO: 195172 - RNA, 22 nt, Human
aauggaaaaauccacagggaac

SEQ ID NO: 195173 - RNA, 22 nt, Human
aauggaaaaagaacuguuuaaa

SEQ ID NO: 195174 - RNA, 22 nt, Human
aauggaaaggagccugacuaua

SEQ ID NO: 195175 - RNA, 22 nt, Human
acauaaacaugcagccugccaa

SEQ ID NO: 195176 - RNA, 22 nt, Human
acaguuagguccuaaaauucug

SEQ ID NO: 195177 - RNA, 22 nt, Human
acagugugcaagaaauggggga

SEQ ID NO: 195178 - RNA, 22 nt, Human
acauccagcagauuguccagag

SEQ ID NO: 195179 - RNA, 22 nt, Human
acauauggcagguugaucaaug

SEQ ID NO: 195180 - RNA, 22 nt, Human
acaggguaagggagggugagug

SEQ ID NO: 195181 - RNA, 22 nt, Human
acagguauuaugaagccuauuu

SEQ ID NO: 195182 - RNA, 22 nt, Human
acagguaucccuuucuaccuga

SEQ ID NO: 195183 - RNA, 22 nt, Human
acagguuggagguguggaguca

SEQ ID NO: 195184 - RNA, 22 nt, Human
acaggaaaugaaaugguaucua

SEQ ID NO: 195185 - RNA, 22 nt, Human
acagguuucuccccugguuauu

SEQ ID NO: 195186 - RNA, 22 nt, Human
acaggcgucgccugcucuugcc

SEQ ID NO: 195187 - RNA, 21 nt, Human
acaguacuugagaucuuuuga

SEQ ID NO: 195188 - RNA, 21 nt, Human
acaguaugaucaaaugugcca

SEQ ID NO: 195189 - RNA, 22 nt, Human
acaggauuuucagggaagguga

SEQ ID NO: 195190 - RNA, 22 nt, Human
acaggccuggguucaaauuugg

SEQ ID NO: 195191 - RNA, 22 nt, Human
acaggacgugugugcgcaugug

SEQ ID NO: 195192 - RNA, 22 nt, Human
acaggacaaaaaucuggauggc

SEQ ID NO: 195193 - RNA, 22 nt, Human
acagcuggaggucugugagcac

SEQ ID NO: 195194 - RNA, 22 nt, Human
acagcuauuuaaaggcuuuagg

SEQ ID NO: 195195 - RNA, 22 nt, Human
acagagguuaggauggguugua

SEQ ID NO: 195196 - RNA, 20 nt, Human
acagccguaaugguccuugg

SEQ ID NO: 195197 - RNA, 19 nt, Human
acagccuguugguggggcu

SEQ ID NO: 195198 - RNA, 22 nt, Human
acagcucaggcccaucaacccc

SEQ ID NO: 195199 - RNA, 22 nt, Human
acagcugagaugcuacuugugg

SEQ ID NO: 195200 - RNA, 22 nt, Human
acagcugguugaaggggaccaa

SEQ ID NO: 195201 - RNA, 22 nt, Human
acaggaaugaagaugagagagu

SEQ ID NO: 195202 - RNA, 19 nt, Human
acaggaaggaaaauuucaa

SEQ ID NO: 195203 - RNA, 22 nt, Human
acagcauagaggaaauguggaa

SEQ ID NO: 195204 - RNA, 22 nt, Human
acagcagguuauuguuauggca

SEQ ID NO: 195205 - RNA, 22 nt, Human
acagaucugcacagugaacaau

SEQ ID NO: 195206 - RNA, 22 nt, Human
acagagggagugacggccaacc

SEQ ID NO: 195207 - RNA, 22 nt, Human
acagccacuaugacagauuuag

SEQ ID NO: 195208 - RNA, 22 nt, Human
acagccacccuggaacgguugu

SEQ ID NO: 195209 - RNA, 22 nt, Human
acagcaauccuggcagaggguu

SEQ ID NO: 195210 - RNA, 21 nt, Human
acagaaguggcuuggucucag

SEQ ID NO: 195211 - RNA, 22 nt, Human
acagacaucaucaacaucuucc

SEQ ID NO: 195212 - RNA, 22 nt, Human
acagacuuaguauccugcugcu

SEQ ID NO: 195213 - RNA, 22 nt, Human
acagacuugaccuuggagaggc

SEQ ID NO: 195214 - RNA, 22 nt, Human
acagaugccagcuacaccaccg

SEQ ID NO: 195215 - RNA, 22 nt, Human
acacugguucucuuaacccuau

SEQ ID NO: 195216 - RNA, 22 nt, Human
acagaucuauauuauauauaca

SEQ ID NO: 195217 - RNA, 23 nt, Human
acagaggcaucagagcagcaggc

SEQ ID NO: 195218 - RNA, 23 nt, Human
acagcaagaggaccagaugugag

SEQ ID NO: 195219 - RNA, 22 nt, Human
acagacuuuuagacuuaugagu

SEQ ID NO: 195220 - RNA, 22 nt, Human
acacucagaaaggcagagguuc

SEQ ID NO: 195221 - RNA, 22 nt, Human
acacgguggccagcaguaggug

SEQ ID NO: 195222 - RNA, 22 nt, Human
acacgugcaggagaauguagug

SEQ ID NO: 195223 - RNA, 22 nt, Human
acacgcacaccugugcacucgu

SEQ ID NO: 195224 - RNA, 21 nt, Human
acacagcuggagcaucccggu

SEQ ID NO: 195225 - RNA, 20 nt, Human
acacaccugcucagacugag

SEQ ID NO: 195226 - RNA, 22 nt, Human
acacgauguuuuaagccccuaa

SEQ ID NO: 195227 - RNA, 20 nt, Human
acacagccuagaguuuggcu

SEQ ID NO: 195228 - RNA, 19 nt, Human
acacaccagugccugugac

SEQ ID NO: 195229 - RNA, 22 nt, Human
acacacaugccuuuccuaagua

SEQ ID NO: 195230 - RNA, 22 nt, Human
acacaagaaugugcacucagcc

SEQ ID NO: 195231 - RNA, 22 nt, Human
acaaugugcuuaugaaggcagu

SEQ ID NO: 195232 - RNA, 21 nt, Human
acaaugaguuugaggcaucag

SEQ ID NO: 195233 - RNA, 22 nt, Human
acaaggccugagggugacagca

SEQ ID NO: 195234 - RNA, 22 nt, Human
acaaucagcacugaguuuaucu

SEQ ID NO: 195235 - RNA, 22 nt, Human
acaauaauguuuuuagguuauu

SEQ ID NO: 195236 - RNA, 22 nt, Human
acaaggaagaaaacauuacuuu

SEQ ID NO: 195237 - RNA, 22 nt, Human
acaagaccagcagggagggugc

SEQ ID NO: 195238 - RNA, 22 nt, Human
acaagaaaggucugggaacaau

SEQ ID NO: 195239 - RNA, 22 nt, Human
aaguucuugguuaauuagggaa

SEQ ID NO: 195240 - RNA, 22 nt, Human
aaguucuuauguucugaugugc

SEQ ID NO: 195241 - RNA, 20 nt, Human
aagugcuguuagcugccuga

SEQ ID NO: 195242 - RNA, 23 nt, Human
aagugcucaguggacagcauugc

SEQ ID NO: 195243 - RNA, 22 nt, Human
aagugcuggccuacucaaucga

SEQ ID NO: 195244 - RNA, 22 nt, Human
aagugauuuuccuacuugcuaa

SEQ ID NO: 195245 - RNA, 22 nt, Human
aauaagagaauaaaaucuguua

SEQ ID NO: 195246 - RNA, 22 nt, Human
aauaacuuaaugacuguguaca

SEQ ID NO: 195247 - RNA, 22 nt, Human
aauaacaguuuauuugagggcu

SEQ ID NO: 195248 - RNA, 21 nt, Human
aaguuuuggcuguacaguugu

SEQ ID NO: 195249 - RNA, 22 nt, Human
aauaaagcuugaaagcagggaa

SEQ ID NO: 195250 - RNA, 20 nt, Human
aauaaauauaacccauaauu

SEQ ID NO: 195251 - RNA, 21 nt, Human
aaguuucucccuaauuguugc

SEQ ID NO: 195252 - RNA, 23 nt, Human
aaucacuggauuugagcaugagg

SEQ ID NO: 195253 - RNA, 22 nt, Human
aaucacuggcuccucacggcaa

SEQ ID NO: 195254 - RNA, 22 nt, Human
aaucaaauuucuugugguuguu

SEQ ID NO: 195255 - RNA, 22 nt, Human
aaucaaagccugcaaguugacu

SEQ ID NO: 195256 - RNA, 22 nt, Human
aauauuuugggacugaggaauu

SEQ ID NO: 195257 - RNA, 22 nt, Human
aauauuuaccuaccugucaucu

SEQ ID NO: 195258 - RNA, 22 nt, Human
aauauuuaaauagaauuacauc

SEQ ID NO: 195259 - RNA, 22 nt, Human
aauagcaauuacccuucaacuc

SEQ ID NO: 195260 - RNA, 22 nt, Human
aauaaugguuugauucucacau

SEQ ID NO: 195261 - RNA, 22 nt, Human
aauaauuuuuuugugauuaugu

SEQ ID NO: 195262 - RNA, 20 nt, Human
aauagcacagcucaaacauu

SEQ ID NO: 195263 - RNA, 22 nt, Human
aauaugucacacuccuuaauag

SEQ ID NO: 195264 - RNA, 22 nt, Human
aauaugcaaagcguguuaucug

SEQ ID NO: 195265 - RNA, 22 nt, Human
aauaugccaaauccugucacau

SEQ ID NO: 195266 - RNA, 22 nt, Human
aauaucuugaguuauaaauuca

SEQ ID NO: 195267 - RNA, 22 nt, Human
aagugaggagaccucuucuuca

SEQ ID NO: 195268 - RNA, 22 nt, Human
aagugagaugggagucagagga

SEQ ID NO: 195269 - RNA, 22 nt, Human
aagugauuuucccaccaucuac

SEQ ID NO: 195270 - RNA, 22 nt, Human
aagugauuuagagagcucuuag

SEQ ID NO: 195271 - RNA, 22 nt, Human
aagugauauaaaucgagaggga

SEQ ID NO: 195272 - RNA, 22 nt, Human
aagucuguucuacagcaccaga

SEQ ID NO: 195273 - RNA, 22 nt, Human
aagugaagccaauuuuuuuagg

SEQ ID NO: 195274 - RNA, 22 nt, Human
aagugaaaaaagucaguacuga

SEQ ID NO: 195275 - RNA, 22 nt, Human
aagucuuugagaucggacauag

SEQ ID NO: 195276 - RNA, 22 nt, Human
aagguggugaucaucuugaagg

SEQ ID NO: 195277 - RNA, 22 nt, Human
aaggugcugaggguccuggcuu

SEQ ID NO: 195278 - RNA, 22 nt, Human
aaguacugauucuguuccucaa

SEQ ID NO: 195279 - RNA, 20 nt, Human
aagucuauuuagaguugcuu

SEQ ID NO: 195280 - RNA, 22 nt, Human
aaguauuccccaaguauucugg

SEQ ID NO: 195281 - RNA, 22 nt, Human
aagucgccuaaacaaaguaucu

SEQ ID NO: 195282 - RNA, 20 nt, Human
aaguagguuucaguugcugu

SEQ ID NO: 195283 - RNA, 22 nt, Human
aagggagaguauccagaaacag

SEQ ID NO: 195284 - RNA, 22 nt, Human
aagggaggguaggaagagggag

SEQ ID NO: 195285 - RNA, 22 nt, Human
aagggccuccuggggagccugg

SEQ ID NO: 195286 - RNA, 22 nt, Human
aaggggaauaguaggaccuggg

SEQ ID NO: 195287 - RNA, 22 nt, Human
aaggggaggccugcgcuuucgg

SEQ ID NO: 195288 - RNA, 22 nt, Human
aaggggauuuaagguaagaaga

SEQ ID NO: 195289 - RNA, 22 nt, Human
aagguauaaauaacucgggagg

SEQ ID NO: 195290 - RNA, 22 nt, Human
aagggccacaugccauuuaaaa

SEQ ID NO: 195291 - RNA, 22 nt, Human
aaggugcauuaguuuggagggg

SEQ ID NO: 195292 - RNA, 23 nt, Human
aaggugaagccaccaggugagga

SEQ ID NO: 195293 - RNA, 22 nt, Human
aagggcuucucgccugugugca

SEQ ID NO: 195294 - RNA, 19 nt, Human
aaggcuuucugagugaaaa

SEQ ID NO: 195295 - RNA, 22 nt, Human
aagggaaaagcugaaugagaug

SEQ ID NO: 195296 - RNA, 22 nt, Human
aaggcugugaacuuuucgggaa

SEQ ID NO: 195297 - RNA, 22 nt, Human
aaggcuuguugucacgcucuug

SEQ ID NO: 195298 - RNA, 22 nt, Human
aaggcugaccaguuuacacuuu

SEQ ID NO: 195299 - RNA, 22 nt, Human
aaggagaggagucauugggaua

SEQ ID NO: 195300 - RNA, 22 nt, Human
aaggaaaaaauggcuugugaua

SEQ ID NO: 195301 - RNA, 22 nt, Human
aagaugaguuacaaaggaguaa

SEQ ID NO: 195302 - RNA, 22 nt, Human
aagaggcagcuugguaggcauc

SEQ ID NO: 195303 - RNA, 22 nt, Human
aagaggcuacagcccugugucu

SEQ ID NO: 195304 - RNA, 22 nt, Human
aagaguggagcuggaaaguggg

SEQ ID NO: 195305 - RNA, 22 nt, Human
aagauuugaaaguggugcauuu

SEQ ID NO: 195306 - RNA, 22 nt, Human
aagcaaaagguuacacuucugg

SEQ ID NO: 195307 - RNA, 22 nt, Human
aagauauauaacccuuucacuu

SEQ ID NO: 195308 - RNA, 22 nt, Human
aagauagaaugauguuggcuca

SEQ ID NO: 195309 - RNA, 22 nt, Human
aagaugaucagagggcaagagg

SEQ ID NO: 195310 - RNA, 22 nt, Human
aagauauauaaggaaguucagu

SEQ ID NO: 195311 - RNA, 22 nt, Human
aagaucugaccgugauggcggc

SEQ ID NO: 195312 - RNA, 21 nt, Human
aagcagcugcagaauuucagu

SEQ ID NO: 195313 - RNA, 22 nt, Human
aagcagcauaugacagcaucca

SEQ ID NO: 195314 - RNA, 22 nt, Human
aagaaugaaaugaaagaacuaa

SEQ ID NO: 195315 - RNA, 22 nt, Human
aagagaaaaaucuuaaucuagu

SEQ ID NO: 195316 - RNA, 22 nt, Human
aagaagagaauauauuuacguc

SEQ ID NO: 195317 - RNA, 22 nt, Human
aagaaagaucugaaagaagcga

SEQ ID NO: 195318 - RNA, 22 nt, Human
aaccaagcucaauggucugagu

SEQ ID NO: 195319 - RNA, 22 nt, Human
aaccaauaagaggaugccauuu

SEQ ID NO: 195320 - RNA, 22 nt, Human
aagaacaacugcuuuaaaagca

SEQ ID NO: 195321 - RNA, 22 nt, Human
aagaacaugggugugggcauuc

SEQ ID NO: 195322 - RNA, 22 nt, Human
aagaaaggagauauucuuuuag

SEQ ID NO: 195323 - RNA, 22 nt, Human
aaggccuaggaguugacauggg

SEQ ID NO: 195324 - RNA, 22 nt, Human
aaggccacacuugcuggccagc

SEQ ID NO: 195325 - RNA, 22 nt, Human
aaggcacauauuuuagagucac

SEQ ID NO: 195326 - RNA, 22 nt, Human
aaggcaguuaauuuggcuagaa

SEQ ID NO: 195327 - RNA, 22 nt, Human
aaggauuuccaggccugcgccu

SEQ ID NO: 195328 - RNA, 22 nt, Human
aaggaguacagggagggucccu

SEQ ID NO: 195329 - RNA, 22 nt, Human
aaggagcuuucauuacagccuu

SEQ ID NO: 195330 - RNA, 20 nt, Human
aaggaggcuuaaaguuagaa

SEQ ID NO: 195331 - RNA, 22 nt, Human
aaggaucuuucuuuuuaccauu

SEQ ID NO: 195332 - RNA, 22 nt, Human
aaggaggugauucaccuuuugg

SEQ ID NO: 195333 - RNA, 18 nt, Human
aaggaggaaugaauagca

SEQ ID NO: 195334 - RNA, 22 nt, Human
aagcuuugggcagaagaggauu

SEQ ID NO: 195335 - RNA, 22 nt, Human
aaggacaaaacagcuguucuaa

SEQ ID NO: 195336 - RNA, 20 nt, Human
aagcuguguucaagauggga

SEQ ID NO: 195337 - RNA, 22 nt, Human
aagcuguuauuucacagguuca

SEQ ID NO: 195338 - RNA, 22 nt, Human
aagcgcaaggugucagcagguu

SEQ ID NO: 195339 - RNA, 22 nt, Human
aagcgcggccgccgcggucgcu

SEQ ID NO: 195340 - RNA, 22 nt, Human
aagcucuauaggagauacagua

SEQ ID NO: 195341 - RNA, 22 nt, Human
aagcucagcugguggugauugc

SEQ ID NO: 195342 - RNA, 22 nt, Human
aagcgggcagcggccugcgcca

SEQ ID NO: 195343 - RNA, 22 nt, Human
aaggaaaguuaagguaaacucu

SEQ ID NO: 195344 - RNA, 22 nt, Human
aaggaacuucagggcgaaugga

SEQ ID NO: 195345 - RNA, 22 nt, Human
aaggaaaaccugacugaagaac

SEQ ID NO: 195346 - RNA, 18 nt, Human
aagcugcauuauuuuggc

SEQ ID NO: 195347 - RNA, 22 nt, Human
aagcugaguaggaaugguaggu

SEQ ID NO: 195348 - RNA, 22 nt, Human
aagcucuuuccacuaaaccacu

SEQ ID NO: 195349 - RNA, 22 nt, Human
aagcugccugggaggaagggcu

SEQ ID NO: 195350 - RNA, 22 nt, Human
aagcugcagacccccugucuca

SEQ ID NO: 195351 - RNA, 22 nt, Human
aagcaacccagugcuuguauag

SEQ ID NO: 195352 - RNA, 22 nt, Human
aagcaugaaauaauguccuugu

SEQ ID NO: 195353 - RNA, 22 nt, Human
aagccgagggaggugauggaga

SEQ ID NO: 195354 - RNA, 22 nt, Human
aagccagccaguuccagcagcu

SEQ ID NO: 195355 - RNA, 22 nt, Human
aagcaggaaaugaaaugcuugc

SEQ ID NO: 195356 - RNA, 22 nt, Human
aagcagugacucucagaggcag

SEQ ID NO: 195357 - RNA, 22 nt, Human
aagcaaaugguauugguauuau

SEQ ID NO: 195358 - RNA, 22 nt, Human
aagcaaagucaucuagaguagu

SEQ ID NO: 195359 - RNA, 22 nt, Human
aagcaaaaucgcaucuggggcc

SEQ ID NO: 195360 - RNA, 23 nt, Human
aagcaacagacuucaucagauau

SEQ ID NO: 195361 - RNA, 22 nt, Human
aagcacagggacucaggaccgg

SEQ ID NO: 195362 - RNA, 22 nt, Human
aguuuuugagaauucuucugaa

SEQ ID NO: 195363 - RNA, 20 nt, Human
auaaauaggauuuucugaca

SEQ ID NO: 195364 - RNA, 22 nt, Human
auaaaaauguuuuuguguggua

SEQ ID NO: 195365 - RNA, 22 nt, Human
auaaauucuaugauggauuggg

SEQ ID NO: 195366 - RNA, 22 nt, Human
auaaaucaagggcaguauuucc

SEQ ID NO: 195367 - RNA, 22 nt, Human
auaaauuugacagcucuucaug

SEQ ID NO: 195368 - RNA, 22 nt, Human
auaagguuuucuuuuguucccu

SEQ ID NO: 195369 - RNA, 22 nt, Human
auaaguuauuuuaguaaaucag

SEQ ID NO: 195370 - RNA, 22 nt, Human
auaaccaaaaauaguuuaguac

SEQ ID NO: 195371 - RNA, 22 nt, Human
auaaaguaaugcauauaaugug

SEQ ID NO: 195372 - RNA, 22 nt, Human
auaaagggccuuauuuuagcaa

SEQ ID NO: 195373 - RNA, 22 nt, Human
auaaugccucauaggguguucc

SEQ ID NO: 195374 - RNA, 22 nt, Human
auaaaacagaucaggagaauga

SEQ ID NO: 195375 - RNA, 22 nt, Human
auaaaaucugaagcaagaauaa

SEQ ID NO: 195376 - RNA, 22 nt, Human
auaaaagcacaauagaguuaug

SEQ ID NO: 195377 - RNA, 22 nt, Human
auacaucuuaacgcgcucuugg

SEQ ID NO: 195378 - RNA, 22 nt, Human
auaaucuuugaguagaguugag

SEQ ID NO: 195379 - RNA, 23 nt, Human
auaaugauaaugcuauuuuuugu

SEQ ID NO: 195380 - RNA, 22 nt, Human
auaagccugccuuaucuccaga

SEQ ID NO: 195381 - RNA, 22 nt, Human
auaaggcauagugagucaucau

SEQ ID NO: 195382 - RNA, 22 nt, Human
auacaugugugugcauacaugu

SEQ ID NO: 195383 - RNA, 21 nt, Human
auaccaaaagaacaccuuguu

SEQ ID NO: 195384 - RNA, 22 nt, Human
auaaggacuugaauuagacauu

SEQ ID NO: 195385 - RNA, 22 nt, Human
auaaggaaagugagugcuuaaa

SEQ ID NO: 195386 - RNA, 22 nt, Human
auaagcuucucugcaguucagu

SEQ ID NO: 195387 - RNA, 22 nt, Human
auaacgaaagcaauuauuuuca

SEQ ID NO: 195388 - RNA, 22 nt, Human
auaaauuugccagcauauguuc

SEQ ID NO: 195389 - RNA, 22 nt, Human
auacaaaaaguggugaguguau

SEQ ID NO: 195390 - RNA, 22 nt, Human
auaauugaauaagagcugcagg

SEQ ID NO: 195391 - RNA, 22 nt, Human
auacagccuaguuugaguccca

SEQ ID NO: 195392 - RNA, 22 nt, Human
auacaggcaguaagauucucag

SEQ ID NO: 195393 - RNA, 22 nt, Human
auaaaaaguggcugcuauugga

SEQ ID NO: 195394 - RNA, 18 nt, Human
aguuuuuuuggcaaaagg

SEQ ID NO: 195395 - RNA, 22 nt, Human
aguuuucugccucuggaugcgu

SEQ ID NO: 195396 - RNA, 22 nt, Human
aguuucuugaagacugauguuu

SEQ ID NO: 195397 - RNA, 22 nt, Human
aguuuguagguuaggaucagca

SEQ ID NO: 195398 - RNA, 23 nt, Human
aguuuacguauucauucuuacuc

SEQ ID NO: 195399 - RNA, 22 nt, Human
aguuuuugccucgaauucugcg

SEQ ID NO: 195400 - RNA, 22 nt, Human
aguuuccacuggagacacugug

SEQ ID NO: 195401 - RNA, 22 nt, Human
aguuuuguuuguuuguuuguua

SEQ ID NO: 195402 - RNA, 22 nt, Human
aguuuuuaacgccauguuugaa

SEQ ID NO: 195403 - RNA, 22 nt, Human
aguugguguuagaguuuuucag

SEQ ID NO: 195404 - RNA, 22 nt, Human
aguuuaaauuguucuaucagaa

SEQ ID NO: 195405 - RNA, 22 nt, Human
aguuuacccacuguugaaauua

SEQ ID NO: 195406 - RNA, 22 nt, Human
aguuucaguuaguugggugaca

SEQ ID NO: 195407 - RNA, 22 nt, Human
aguuugauuugucuaucuucau

SEQ ID NO: 195408 - RNA, 22 nt, Human
aguuucccucacaggucugcau

SEQ ID NO: 195409 - RNA, 22 nt, Human
aguugguggaagcuaagcuucu

SEQ ID NO: 195410 - RNA, 22 nt, Human
aguugguucgucucgccuugag

SEQ ID NO: 195411 - RNA, 22 nt, Human
aguugugagaaugaacacugaa

SEQ ID NO: 195412 - RNA, 22 nt, Human
aguugguauuuacugcaguugg

SEQ ID NO: 195413 - RNA, 22 nt, Human
aguugcuucccuauucuuagca

SEQ ID NO: 195414 - RNA, 22 nt, Human
aguuguuuuucuuagauuuuag

SEQ ID NO: 195415 - RNA, 22 nt, Human
aguucauucuagcugggagcag

SEQ ID NO: 195416 - RNA, 22 nt, Human
aguugcuaauacaaaaaguccc

SEQ ID NO: 195417 - RNA, 22 nt, Human
aguugcugccagguccugggag

SEQ ID NO: 195418 - RNA, 22 nt, Human
aguucugggaggugcacgucca

SEQ ID NO: 195419 - RNA, 22 nt, Human
aguucccgcgggagggcgcagg

SEQ ID NO: 195420 - RNA, 22 nt, Human
aguucccuguuuuuuuccacug

SEQ ID NO: 195421 - RNA, 22 nt, Human
aguucuggcccugaaacaggga

SEQ ID NO: 195422 - RNA, 22 nt, Human
agugcucagggaaugccacuga

SEQ ID NO: 195423 - RNA, 22 nt, Human
agugcuuuauguuguugugcaa

SEQ ID NO: 195424 - RNA, 22 nt, Human
agugccuuaaaggucuugcagc

SEQ ID NO: 195425 - RNA, 22 nt, Human
agugccuggcugauggguccug

SEQ ID NO: 195426 - RNA, 22 nt, Human
agugccaucuuuaacuguccca

SEQ ID NO: 195427 - RNA, 21 nt, Human
aguggcacuguuucuucccua

SEQ ID NO: 195428 - RNA, 23 nt, Human
aguggaggucgggguggggagac

SEQ ID NO: 195429 - RNA, 22 nt, Human
aguggugaucuguuacagucac

SEQ ID NO: 195430 - RNA, 22 nt, Human
aguggguaaggacaggugucug

SEQ ID NO: 195431 - RNA, 23 nt, Human
aguggccgaucaucucgggcuug

SEQ ID NO: 195432 - RNA, 22 nt, Human
agugggaaagcugccuuguaga

SEQ ID NO: 195433 - RNA, 22 nt, Human
aguggcuguuccaggugaggac

SEQ ID NO: 195434 - RNA, 19 nt, Human
agugggauggcuuuuuccc

SEQ ID NO: 195435 - RNA, 22 nt, Human
agugcgagaugaggacagaagc

SEQ ID NO: 195436 - RNA, 22 nt, Human
aguggagguuacagcuguacau

SEQ ID NO: 195437 - RNA, 20 nt, Human
agugauuuguuaguacauug

SEQ ID NO: 195438 - RNA, 22 nt, Human
agugauguaauggugaauguga

SEQ ID NO: 195439 - RNA, 22 nt, Human
agugaaagaaaacuguuagaac

SEQ ID NO: 195440 - RNA, 22 nt, Human
agugaaaacugaaucaccuucc

SEQ ID NO: 195441 - RNA, 20 nt, Human
agucuuaucugcauuuagaa

SEQ ID NO: 195442 - RNA, 22 nt, Human
agucugaaccagauggcaaggu

SEQ ID NO: 195443 - RNA, 22 nt, Human
aguagucacuucacccauccca

SEQ ID NO: 195444 - RNA, 22 nt, Human
agugaauuagccuauuuguaaa

SEQ ID NO: 195445 - RNA, 22 nt, Human
agugaagauagagccaggucug

SEQ ID NO: 195446 - RNA, 22 nt, Human
agugaaauaugcccauugcugu

SEQ ID NO: 195447 - RNA, 22 nt, Human
agugagaguauuaaugugaacu

SEQ ID NO: 195448 - RNA, 21 nt, Human
agugagauuuaugccugguuc

SEQ ID NO: 195449 - RNA, 22 nt, Human
agugagcauuagugcuuauauu

SEQ ID NO: 195450 - RNA, 23 nt, Human
agugaugcaguaucugggucugu

SEQ ID NO: 195451 - RNA, 22 nt, Human
agugaugcuuuggagaagaucc

SEQ ID NO: 195452 - RNA, 21 nt, Human
agugagugacagaagaagguu

SEQ ID NO: 195453 - RNA, 22 nt, Human
agugaugauccaaaugaauuga

SEQ ID NO: 195454 - RNA, 20 nt, Human
agugaguuaucagcuacagu

SEQ ID NO: 195455 - RNA, 22 nt, Human
aguuauuaagaaaauuuugcca

SEQ ID NO: 195456 - RNA, 22 nt, Human
aguuauuuuucacuauuaggcu

SEQ ID NO: 195457 - RNA, 20 nt, Human
aguucagguuauuuuccucc

SEQ ID NO: 195458 - RNA, 22 nt, Human
aguucaauuguuuuguaaaagu

SEQ ID NO: 195459 - RNA, 22 nt, Human
aguucaugugguuuaacuuaau

SEQ ID NO: 195460 - RNA, 22 nt, Human
aguucauccucauuuacaagga

SEQ ID NO: 195461 - RNA, 22 nt, Human
aguuaauuauagugcuuaauau

SEQ ID NO: 195462 - RNA, 22 nt, Human
aguguuugggagagggugugag

SEQ ID NO: 195463 - RNA, 22 nt, Human
aguuaaucuuguauuaaugguu

SEQ ID NO: 195464 - RNA, 22 nt, Human
aguuauggguauguauuauaau

SEQ ID NO: 195465 - RNA, 22 nt, Human
aguuaugcaagcaaguaccacu

SEQ ID NO: 195466 - RNA, 17 nt, Human
aguuacugcacuugcca

SEQ ID NO: 195467 - RNA, 22 nt, Human
aguguuuuaugugccaguuuaa

SEQ ID NO: 195468 - RNA, 22 nt, Human
aguguuuuaagaaaguaauuuu

SEQ ID NO: 195469 - RNA, 22 nt, Human
aguuaaagggggcuacagugug

SEQ ID NO: 195470 - RNA, 22 nt, Human
aguguggcccaugaauuauugg

SEQ ID NO: 195471 - RNA, 22 nt, Human
aguguggccaaugaggaugggc

SEQ ID NO: 195472 - RNA, 23 nt, Human
aguguucagcauguaguaaauac

SEQ ID NO: 195473 - RNA, 22 nt, Human
aguguauuugccuauaaaaaug

SEQ ID NO: 195474 - RNA, 22 nt, Human
agugucagcagcuucauugucu

SEQ ID NO: 195475 - RNA, 22 nt, Human
agugucuuuagucgcugagcaa

SEQ ID NO: 195476 - RNA, 19 nt, Human
agugggcaaggaagaugac

SEQ ID NO: 195477 - RNA, 22 nt, Human
aguggugccuaagcgcggaggc

SEQ ID NO: 195478 - RNA, 22 nt, Human
aguggcuucucuggggucaaga

SEQ ID NO: 195479 - RNA, 22 nt, Human
aguggcuggcaggggagggucc

SEQ ID NO: 195480 - RNA, 22 nt, Human
aguggcugugaaauacauggga

SEQ ID NO: 195481 - RNA, 22 nt, Human
aguggggcccaagaaucugcau

SEQ ID NO: 195482 - RNA, 22 nt, Human
aguguucaauuugagcucaaag

SEQ ID NO: 195483 - RNA, 22 nt, Human
agugucugcgggcagaggagcg

SEQ ID NO: 195484 - RNA, 22 nt, Human
aguguccaacucagcuugucaa

SEQ ID NO: 195485 - RNA, 22 nt, Human
agggggaaaauguggauuaugg

SEQ ID NO: 195486 - RNA, 22 nt, Human
agggggaauccugcuuauggau

SEQ ID NO: 195487 - RNA, 18 nt, Human
agggggaagccaggagga

SEQ ID NO: 195488 - RNA, 22 nt, Human
aggggguugcgcaggggcuccc

SEQ ID NO: 195489 - RNA, 22 nt, Human
aggguaauaacaguauggugau

SEQ ID NO: 195490 - RNA, 20 nt, Human
agggguucuguuaugaaaua

SEQ ID NO: 195491 - RNA, 22 nt, Human
aggucagacagggugucuuucu

SEQ ID NO: 195492 - RNA, 22 nt, Human
aggucugcccaggaugcugcuu

SEQ ID NO: 195493 - RNA, 22 nt, Human
agguccugucuuaucucuguaa

SEQ ID NO: 195494 - RNA, 22 nt, Human
aggucggcuuuuuuccuuucac

SEQ ID NO: 195495 - RNA, 22 nt, Human
aggucgugggugagagagagac

SEQ ID NO: 195496 - RNA, 22 nt, Human
agggcuuacaucccacaguuag

SEQ ID NO: 195497 - RNA, 22 nt, Human
agggcugcugcuccgggcccag

SEQ ID NO: 195498 - RNA, 22 nt, Human
aggggcaagucuggccauuucu

SEQ ID NO: 195499 - RNA, 22 nt, Human
agggcugggcuuggcaggcugg

SEQ ID NO: 195500 - RNA, 22 nt, Human
aggguguuugggagcagaggau

SEQ ID NO: 195501 - RNA, 22 nt, Human
aggguggcacucugggggcucc

SEQ ID NO: 195502 - RNA, 22 nt, Human
aggggcuuguggaguugcuggu

SEQ ID NO: 195503 - RNA, 22 nt, Human
aggggcugugucauuuguccua

SEQ ID NO: 195504 - RNA, 22 nt, Human
aggcugucucaccucaggaggg

SEQ ID NO: 195505 - RNA, 22 nt, Human
aggcuuaacuacaauuuuugcc

SEQ ID NO: 195506 - RNA, 22 nt, Human
aggcaguguggagggcuguugc

SEQ ID NO: 195507 - RNA, 21 nt, Human
aggcuuggaucuagacaggcc

SEQ ID NO: 195508 - RNA, 22 nt, Human
agggcaugugaaguaaccuagg

SEQ ID NO: 195509 - RNA, 22 nt, Human
agggaugcaguaaaaacuguag

SEQ ID NO: 195510 - RNA, 22 nt, Human
agggcaggguuggugcuggugc

SEQ ID NO: 195511 - RNA, 22 nt, Human
agggcuguuggugcccucgagg

SEQ ID NO: 195512 - RNA, 22 nt, Human
agggcccaccuuggugcugagg

SEQ ID NO: 195513 - RNA, 22 nt, Human
aggggcagaggaugauggaaga

SEQ ID NO: 195514 - RNA, 22 nt, Human
agggcaguuaugaaugucucca

SEQ ID NO: 195515 - RNA, 22 nt, Human
agggcaguuuuacugaaaggug

SEQ ID NO: 195516 - RNA, 22 nt, Human
agggccaagaaagaguggcuuu

SEQ ID NO: 195517 - RNA, 21 nt, Human
agggccagaucaccaaggagc

SEQ ID NO: 195518 - RNA, 22 nt, Human
agguuuggccuuggggggaguu

SEQ ID NO: 195519 - RNA, 21 nt, Human
aguaccugugugccugugugu

SEQ ID NO: 195520 - RNA, 20 nt, Human
aguacugacaauauucugug

SEQ ID NO: 195521 - RNA, 22 nt, Human
aguaauggucucaauaaauucu

SEQ ID NO: 195522 - RNA, 22 nt, Human
agguuuuagaagcugaagccaa

SEQ ID NO: 195523 - RNA, 22 nt, Human
aguaaaggaaggaagggacagc

SEQ ID NO: 195524 - RNA, 22 nt, Human
agguuuuugucauuuucuggua

SEQ ID NO: 195525 - RNA, 22 nt, Human
agguuuggaaguggcgauccau

SEQ ID NO: 195526 - RNA, 18 nt, Human
aguaaauguuaaauauug

SEQ ID NO: 195527 - RNA, 22 nt, Human
agguuuggguucauugcuggcu

SEQ ID NO: 195528 - RNA, 20 nt, Human
agguugguuuacuagucugu

SEQ ID NO: 195529 - RNA, 22 nt, Human
agguuuaggaaaacugagaguc

SEQ ID NO: 195530 - RNA, 22 nt, Human
agguuuauggagcaccacaucu

SEQ ID NO: 195531 - RNA, 22 nt, Human
agguggcuaugaggaugcaguc

SEQ ID NO: 195532 - RNA, 18 nt, Human
agguugcaucugugcaga

SEQ ID NO: 195533 - RNA, 22 nt, Human
aggugagaacguggaggggcgg

SEQ ID NO: 195534 - RNA, 22 nt, Human
aggugagaaggacuguugcauu

SEQ ID NO: 195535 - RNA, 22 nt, Human
agguggcguauguguucguguu

SEQ ID NO: 195536 - RNA, 22 nt, Human
aggugauaugggcuucucugag

SEQ ID NO: 195537 - RNA, 22 nt, Human
aggugggaauaauaaucaaagc

SEQ ID NO: 195538 - RNA, 19 nt, Human
aggugaugugacucuagaa

SEQ ID NO: 195539 - RNA, 22 nt, Human
aggugcccaaaucuucuguuuu

SEQ ID NO: 195540 - RNA, 22 nt, Human
aggugcacugguacaggcuuca

SEQ ID NO: 195541 - RNA, 22 nt, Human
agguuaggaggggagugccaca

SEQ ID NO: 195542 - RNA, 22 nt, Human
agguuaaaagagugaguggaua

SEQ ID NO: 195543 - RNA, 22 nt, Human
aggucccauguccucccugacc

SEQ ID NO: 195544 - RNA, 22 nt, Human
agguuaauaugaacagcagaag

SEQ ID NO: 195545 - RNA, 22 nt, Human
agguggucccaauggcugggca

SEQ ID NO: 195546 - RNA, 21 nt, Human
aggugcccaggauuauuuuuu

SEQ ID NO: 195547 - RNA, 22 nt, Human
aggugucauuauagaccagaua

SEQ ID NO: 195548 - RNA, 22 nt, Human
agguggugacgaugcuccguac

SEQ ID NO: 195549 - RNA, 21 nt, Human
aggugguuccaauaaguaggu

SEQ ID NO: 195550 - RNA, 22 nt, Human
aggauuuagcaugaaaugugaa

SEQ ID NO: 195551 - RNA, 22 nt, Human
aggaugagugaagagguaaauu

SEQ ID NO: 195552 - RNA, 22 nt, Human
aggauugauggcauguuuacug

SEQ ID NO: 195553 - RNA, 22 nt, Human
aggagguagggugugaaacagc

SEQ ID NO: 195554 - RNA, 22 nt, Human
aggauuuaauugcauuuuucuc

SEQ ID NO: 195555 - RNA, 22 nt, Human
aggauuuauuccagaaaugcaa

SEQ ID NO: 195556 - RNA, 20 nt, Human
aggcagacaaggagucuguu

SEQ ID NO: 195557 - RNA, 22 nt, Human
aggauucuccuguuucccaccc

SEQ ID NO: 195558 - RNA, 20 nt, Human
aggauuauguacauggaugc

SEQ ID NO: 195559 - RNA, 22 nt, Human
aggcaacagacaggcuugguuc

SEQ ID NO: 195560 - RNA, 22 nt, Human
aggauggauagcaaggaagccg

SEQ ID NO: 195561 - RNA, 22 nt, Human
aggauggaaguaacuggauaau

SEQ ID NO: 195562 - RNA, 23 nt, Human
aggcaagaacggguuguucaccc

SEQ ID NO: 195563 - RNA, 22 nt, Human
aggcaagauuaggaccagaaga

SEQ ID NO: 195564 - RNA, 22 nt, Human
aggcaauuauacuagguuuugg

SEQ ID NO: 195565 - RNA, 22 nt, Human
aggcaauuuuuaggguuguugu

SEQ ID NO: 195566 - RNA, 22 nt, Human
aggagcugccggauggggcaug

SEQ ID NO: 195567 - RNA, 22 nt, Human
aggaauuugggguuacaugaug

SEQ ID NO: 195568 - RNA, 16 nt, Human
aggagcagaaagcagu

SEQ ID NO: 195569 - RNA, 20 nt, Human
aggaacuggaagggaggaaa

SEQ ID NO: 195570 - RNA, 22 nt, Human
aggaauugucgucauguauaau

SEQ ID NO: 195571 - RNA, 22 nt, Human
aggaauuucacugcguuuuuua

SEQ ID NO: 195572 - RNA, 22 nt, Human
aggaauguugagacauggcuaa

SEQ ID NO: 195573 - RNA, 22 nt, Human
aggaaauaggaccagacaaagc

SEQ ID NO: 195574 - RNA, 22 nt, Human
aggaaguucuggaauuacuagg

SEQ ID NO: 195575 - RNA, 22 nt, Human
aggacaaaggaccagaucugga

SEQ ID NO: 195576 - RNA, 22 nt, Human
aggaauuuuaauaugcuugucu

SEQ ID NO: 195577 - RNA, 22 nt, Human
agcgcugugaaggcugggccac

SEQ ID NO: 195578 - RNA, 22 nt, Human
agcgcuguguucccgugggcau

SEQ ID NO: 195579 - RNA, 22 nt, Human
agcggcaggaagcgcgcaagcg

SEQ ID NO: 195580 - RNA, 22 nt, Human
agcggaggaggcggagcaggga

SEQ ID NO: 195581 - RNA, 19 nt, Human
agcggccgccgcgggcgcc

SEQ ID NO: 195582 - RNA, 22 nt, Human
aggcauuuaucaggaaauguuc

SEQ ID NO: 195583 - RNA, 22 nt, Human
aggcaguguguagcuggaagag

SEQ ID NO: 195584 - RNA, 22 nt, Human
aggcagugguguuugcuggugg

SEQ ID NO: 195585 - RNA, 22 nt, Human
aggcaucguguuuuucugcuuu

SEQ ID NO: 195586 - RNA, 22 nt, Human
aggcauuuaaagauguaagacu

SEQ ID NO: 195587 - RNA, 22 nt, Human
aggcauuuucuuguuauuuuua

SEQ ID NO: 195588 - RNA, 21 nt, Human
aggcauuuucuuggagauucu

SEQ ID NO: 195589 - RNA, 22 nt, Human
aggccaggcgccggcgcgagac

SEQ ID NO: 195590 - RNA, 22 nt, Human
aggccacucagggggccaagau

SEQ ID NO: 195591 - RNA, 22 nt, Human
aggccagggacaaugaggcaga

SEQ ID NO: 195592 - RNA, 22 nt, Human
aggcugcucucgccggcggugu

SEQ ID NO: 195593 - RNA, 22 nt, Human
aggcucagcaucugauucauau

SEQ ID NO: 195594 - RNA, 22 nt, Human
aggcugcuggcaggcguggacg

SEQ ID NO: 195595 - RNA, 22 nt, Human
aggccgagaugacagagccacu

SEQ ID NO: 195596 - RNA, 22 nt, Human
aggcagagauggcugcagggcc

SEQ ID NO: 195597 - RNA, 22 nt, Human
aggcagcagggagggagaaaug

SEQ ID NO: 195598 - RNA, 22 nt, Human
aggcaggagcugugguggugag

SEQ ID NO: 195599 - RNA, 22 nt, Human
aggcaggauuugcgaugugguu

SEQ ID NO: 195600 - RNA, 22 nt, Human
aggcaauagagggugaggagga

SEQ ID NO: 195601 - RNA, 22 nt, Human
aggcacagaauccagucugcug

SEQ ID NO: 195602 - RNA, 19 nt, Human
aggcagccccaacuugcau

SEQ ID NO: 195603 - RNA, 21 nt, Human
aggcagcgauuuucauauugc

SEQ ID NO: 195604 - RNA, 22 nt, Human
aggcagaugggagcuggaaguu

SEQ ID NO: 195605 - RNA, 22 nt, Human
aggcaggggagcuggaagggua

SEQ ID NO: 195606 - RNA, 22 nt, Human
aggcauguugcuucgggcuuug

SEQ ID NO: 195607 - RNA, 22 nt, Human
aggcauauaguguuuaaaaaaa

SEQ ID NO: 195608 - RNA, 22 nt, Human
aggcaguggcuuuuguuguguu

SEQ ID NO: 195609 - RNA, 22 nt, Human
aggcaguggagcuggaauaggc

SEQ ID NO: 195610 - RNA, 23 nt, Human
aggcagaguccuggggcacagcc

SEQ ID NO: 195611 - RNA, 22 nt, Human
aggcaggcucaaugcccagucu

SEQ ID NO: 195612 - RNA, 22 nt, Human
acgggggagucuuuuacaucau

SEQ ID NO: 195613 - RNA, 22 nt, Human
acgcgcuccagcaggugcuuca

SEQ ID NO: 195614 - RNA, 22 nt, Human
acgccuugagccuugccugaau

SEQ ID NO: 195615 - RNA, 22 nt, Human
acgccggguaaggucauucugc

SEQ ID NO: 195616 - RNA, 22 nt, Human
acgccugccuguacuugugggg

SEQ ID NO: 195617 - RNA, 20 nt, Human
acgcauguauaugcaucacc

SEQ ID NO: 195618 - RNA, 20 nt, Human
acgccgcgaggugagcuggu

SEQ ID NO: 195619 - RNA, 22 nt, Human
acgcauguacuuguaugcaaug

SEQ ID NO: 195620 - RNA, 22 nt, Human
acgcuucacaggugcgcauugu

SEQ ID NO: 195621 - RNA, 23 nt, Human
acgcagacacauguaugggccuc

SEQ ID NO: 195622 - RNA, 22 nt, Human
acgcugagcucauggagaugca

SEQ ID NO: 195623 - RNA, 22 nt, Human
acggagggagagagggaggaga

SEQ ID NO: 195624 - RNA, 22 nt, Human
acgucaucguugucaucgucau

SEQ ID NO: 195625 - RNA, 22 nt, Human
acguccaccccguaccagauca

SEQ ID NO: 195626 - RNA, 22 nt, Human
acggggagcgucggccucuccc

SEQ ID NO: 195627 - RNA, 22 nt, Human
acaggguauauaggcaaagcua

SEQ ID NO: 195628 - RNA, 22 nt, Human
acaucuaugucugaggccuugg

SEQ ID NO: 195629 - RNA, 22 nt, Human
acagucuuggauuccaggaguc

SEQ ID NO: 195630 - RNA, 22 nt, Human
acagugguggagggcuguccug

SEQ ID NO: 195631 - RNA, 22 nt, Human
acaugacagugacuuuauaaga

SEQ ID NO: 195632 - RNA, 22 nt, Human
acgccaggagcuucuccguuca

SEQ ID NO: 195633 - RNA, 22 nt, Human
acuauacaguauguacgugcac

SEQ ID NO: 195634 - RNA, 22 nt, Human
acguugaaaugggcauuuuccg

SEQ ID NO: 195635 - RNA, 22 nt, Human
acgucuacaugcaauucuuaua

SEQ ID NO: 195636 - RNA, 22 nt, Human
acggugagacuggcgaaggaaa

SEQ ID NO: 195637 - RNA, 22 nt, Human
acgguuuggggaggaggauccc

SEQ ID NO: 195638 - RNA, 22 nt, Human
acgguuuugugagguaguacuu

SEQ ID NO: 195639 - RNA, 22 nt, Human
acggguuccuugagggcaggau

SEQ ID NO: 195640 - RNA, 22 nt, Human
acgguguuucucguucaggguu

SEQ ID NO: 195641 - RNA, 22 nt, Human
acuagccucauaaaguuugucu

SEQ ID NO: 195642 - RNA, 22 nt, Human
acuacccugaccaaguauuuua

SEQ ID NO: 195643 - RNA, 22 nt, Human
acuaugugucuguaucuggugc

SEQ ID NO: 195644 - RNA, 22 nt, Human
acuauugcuuuagggggaaacc

SEQ ID NO: 195645 - RNA, 22 nt, Human
acuauggaguucagaucuugag

SEQ ID NO: 195646 - RNA, 22 nt, Human
acucagcaccuagaaagugugc

SEQ ID NO: 195647 - RNA, 22 nt, Human
acucaaacuuuuuguggacauu

SEQ ID NO: 195648 - RNA, 22 nt, Human
acuaucuauugucuucuucaug

SEQ ID NO: 195649 - RNA, 22 nt, Human
acugaugacaaugugaguguuc

SEQ ID NO: 195650 - RNA, 22 nt, Human
acugcagauccucugagaaacc

SEQ ID NO: 195651 - RNA, 22 nt, Human
acugaucuguguaauauguuac

SEQ ID NO: 195652 - RNA, 22 nt, Human
acugauuccaagcuuguggagg

SEQ ID NO: 195653 - RNA, 22 nt, Human
acugcauuaucaccaagaugua

SEQ ID NO: 195654 - RNA, 22 nt, Human
acugccauauuaggagcuucag

SEQ ID NO: 195655 - RNA, 22 nt, Human
acugcucugugguuggaagccu

SEQ ID NO: 195656 - RNA, 22 nt, Human
acugaacuaaagaaaugggcaa

SEQ ID NO: 195657 - RNA, 22 nt, Human
acugaaauuuauauuuugggca

SEQ ID NO: 195658 - RNA, 22 nt, Human
acugaaauggggacaguccuua

SEQ ID NO: 195659 - RNA, 22 nt, Human
acugaaaguugaugagucacug

SEQ ID NO: 195660 - RNA, 18 nt, Human
acugagcccaggacacac

SEQ ID NO: 195661 - RNA, 22 nt, Human
acugacuucugguauuuuuagu

SEQ ID NO: 195662 - RNA, 22 nt, Human
acugacuacauguccugucauu

SEQ ID NO: 195663 - RNA, 22 nt, Human
acucuuauuuugaaguaauaau

SEQ ID NO: 195664 - RNA, 22 nt, Human
acugaauguucucaaaggggag

SEQ ID NO: 195665 - RNA, 22 nt, Human
acucuugacuaaugcuaauguc

SEQ ID NO: 195666 - RNA, 22 nt, Human
acugaaggcuggaccaugcauc

SEQ ID NO: 195667 - RNA, 22 nt, Human
acucacuguuuugaaauugaac

SEQ ID NO: 195668 - RNA, 22 nt, Human
acucaucauuuuacggagcagc

SEQ ID NO: 195669 - RNA, 22 nt, Human
acucagucauuuggggaacagu

SEQ ID NO: 195670 - RNA, 22 nt, Human
acucggaggccaaggccaacgg

SEQ ID NO: 195671 - RNA, 22 nt, Human
acuccuauuugguagauggaag

SEQ ID NO: 195672 - RNA, 21 nt, Human
acuccagccacugacugucuc

SEQ ID NO: 195673 - RNA, 23 nt, Human
acucucuguuuggaggcacuggu

SEQ ID NO: 195674 - RNA, 22 nt, Human
acucugaaaggcuacaaaugcu

SEQ ID NO: 195675 - RNA, 22 nt, Human
acucggcggccucgagugcugg

SEQ ID NO: 195676 - RNA, 22 nt, Human
acucugagaugugucuugauuc

SEQ ID NO: 195677 - RNA, 18 nt, Human
acucugaagcuaagucac

SEQ ID NO: 195678 - RNA, 22 nt, Human
acucucaauuaucuggacugaa

SEQ ID NO: 195679 - RNA, 22 nt, Human
acugccuugcaccauggcuuuu

SEQ ID NO: 195680 - RNA, 22 nt, Human
acuucuuuugcaugauucuuua

SEQ ID NO: 195681 - RNA, 22 nt, Human
acuggauucucuuacacagaug

SEQ ID NO: 195682 - RNA, 22 nt, Human
acuggcauuccuaggggagggg

SEQ ID NO: 195683 - RNA, 22 nt, Human
acugcguuucuaaaguagcaua

SEQ ID NO: 195684 - RNA, 22 nt, Human
acuucaggagcagucucuggaa

SEQ ID NO: 195685 - RNA, 22 nt, Human
acuucaggacggcaguggaggg

SEQ ID NO: 195686 - RNA, 22 nt, Human
acugcugauuauugaaguagag

SEQ ID NO: 195687 - RNA, 22 nt, Human
acuugcaucuuagagacucacc

SEQ ID NO: 195688 - RNA, 22 nt, Human
acuugauggaguuucacuguau

SEQ ID NO: 195689 - RNA, 22 nt, Human
acuuggucguggugcagcaugg

SEQ ID NO: 195690 - RNA, 22 nt, Human
acuguugcuuguuuggaauguu

SEQ ID NO: 195691 - RNA, 22 nt, Human
acuugagcuugaaagguaugcu

SEQ ID NO: 195692 - RNA, 22 nt, Human
acuguugugaauaaugaaaugc

SEQ ID NO: 195693 - RNA, 22 nt, Human
acuuauaaauuuaguacacugu

SEQ ID NO: 195694 - RNA, 23 nt, Human
acuuugaggagaagaaugucagu

SEQ ID NO: 195695 - RNA, 22 nt, Human
acuuuccuggcuuugcaaggua

SEQ ID NO: 195696 - RNA, 22 nt, Human
acuuguuuacaagcaguucuga

SEQ ID NO: 195697 - RNA, 22 nt, Human
acuuccuuccagcaaauggcau

SEQ ID NO: 195698 - RNA, 22 nt, Human
acuuuauacuagugauaguuug

SEQ ID NO: 195699 - RNA, 22 nt, Human
acuuguaaaauagagauaggga

SEQ ID NO: 195700 - RNA, 22 nt, Human
acuuugccuucuuacuguguug

SEQ ID NO: 195701 - RNA, 22 nt, Human
agaaacaagcccuagaaguccu

SEQ ID NO: 195702 - RNA, 20 nt, Human
agaaaggaguaaagaagaga

SEQ ID NO: 195703 - RNA, 22 nt, Human
agaaagcacccugcacuuucug

SEQ ID NO: 195704 - RNA, 22 nt, Human
agaaauggccagacuugccccu

SEQ ID NO: 195705 - RNA, 22 nt, Human
agaaaaggaagcuuagacugua

SEQ ID NO: 195706 - RNA, 22 nt, Human
agaaaagaggcuuucuaagcau

SEQ ID NO: 195707 - RNA, 22 nt, Human
agaccauuuuguagccagcaua

SEQ ID NO: 195708 - RNA, 22 nt, Human
agacaaucaacuguugaugccu

SEQ ID NO: 195709 - RNA, 19 nt, Human
agaauuggaaccaugaacc

SEQ ID NO: 195710 - RNA, 22 nt, Human
agacaagagcugaggacauauu

SEQ ID NO: 195711 - RNA, 22 nt, Human
agaccauagugauguuuacguc

SEQ ID NO: 195712 - RNA, 21 nt, Human
agaaguuauuccauggguguu

SEQ ID NO: 195713 - RNA, 22 nt, Human
agaagguagaugcaucaggagg

SEQ ID NO: 195714 - RNA, 22 nt, Human
agaagguggaguagaacaagcu

SEQ ID NO: 195715 - RNA, 22 nt, Human
agaaucugcauuuuaacaagau

SEQ ID NO: 195716 - RNA, 21 nt, Human
agaaugaagaagaggucuuug

SEQ ID NO: 195717 - RNA, 22 nt, Human
agaagggcugcuuagaauauac

SEQ ID NO: 195718 - RNA, 22 nt, Human
agaagcagaaggaagcagggcc

SEQ ID NO: 195719 - RNA, 22 nt, Human
agaauauaguaaauauuuucua

SEQ ID NO: 195720 - RNA, 22 nt, Human
agaaggcaucugcucgcuucca

SEQ ID NO: 195721 - RNA, 22 nt, Human
agaaggcagaaaagcuuuacaa

SEQ ID NO: 195722 - RNA, 22 nt, Human
agaaguguacuuagagaacaua

SEQ ID NO: 195723 - RNA, 22 nt, Human
agaaguuuguuauguaaacaaa

SEQ ID NO: 195724 - RNA, 22 nt, Human
agaauaagucuaauauauuggu

SEQ ID NO: 195725 - RNA, 22 nt, Human
agaaccauccugguuccagcuu

SEQ ID NO: 195726 - RNA, 22 nt, Human
agaaaauagguaguagacgggc

SEQ ID NO: 195727 - RNA, 16 nt, Human
agaaggcuaguaacag

SEQ ID NO: 195728 - RNA, 19 nt, Human
agaacccccuuccucugcu

SEQ ID NO: 195729 - RNA, 22 nt, Human
agaagaagacccuaaggaaagg

SEQ ID NO: 195730 - RNA, 22 nt, Human
agaagauucagcaguagggugg

SEQ ID NO: 195731 - RNA, 22 nt, Human
agaagaucccugugguuacgac

SEQ ID NO: 195732 - RNA, 21 nt, Human
agaguuuucuccauuucaggc

SEQ ID NO: 195733 - RNA, 22 nt, Human
agauaagaacauuaguaagccg

SEQ ID NO: 195734 - RNA, 22 nt, Human
agauaacauguugcagauucug

SEQ ID NO: 195735 - RNA, 22 nt, Human
agauaaucacaaucuagacuuu

SEQ ID NO: 195736 - RNA, 22 nt, Human
agaugaacuuuuuuaaacugga

SEQ ID NO: 195737 - RNA, 22 nt, Human
agauagaaggauugugacacau

SEQ ID NO: 195738 - RNA, 22 nt, Human
agaugacuaacauaguauugcu

SEQ ID NO: 195739 - RNA, 22 nt, Human
agaguacagaagcauuucagau

SEQ ID NO: 195740 - RNA, 22 nt, Human
agagugagauaugugguuggua

SEQ ID NO: 195741 - RNA, 22 nt, Human
agaguguguggggcugagguca

SEQ ID NO: 195742 - RNA, 22 nt, Human
agaguuaaugcaggccaagccu

SEQ ID NO: 195743 - RNA, 21 nt, Human
agaguugaaggcaguaaagag

SEQ ID NO: 195744 - RNA, 22 nt, Human
agaguguggaaauguucagagu

SEQ ID NO: 195745 - RNA, 22 nt, Human
agauaaaucauuuauuaagcgg

SEQ ID NO: 195746 - RNA, 22 nt, Human
agauaaacaacucuuagcuguu

SEQ ID NO: 195747 - RNA, 22 nt, Human
agauauguuaggcuuguucccu

SEQ ID NO: 195748 - RNA, 22 nt, Human
agagcaucgguggaguccccac

SEQ ID NO: 195749 - RNA, 22 nt, Human
agagcucguggcucauugagga

SEQ ID NO: 195750 - RNA, 22 nt, Human
agagcugggacuuggacucaau

SEQ ID NO: 195751 - RNA, 22 nt, Human
agaggcaggcagcagagaagau

SEQ ID NO: 195752 - RNA, 22 nt, Human
agaggcagagcugggguuugac

SEQ ID NO: 195753 - RNA, 22 nt, Human
agagggagagauuggcaaucag

SEQ ID NO: 195754 - RNA, 22 nt, Human
agacuacggggaggggagggaa

SEQ ID NO: 195755 - RNA, 22 nt, Human
agacgcgcagaaggaagcggcc

SEQ ID NO: 195756 - RNA, 22 nt, Human
agacacagcaauaacuacuguu

SEQ ID NO: 195757 - RNA, 22 nt, Human
agaccguguguggguugcggug

SEQ ID NO: 195758 - RNA, 22 nt, Human
agacagaaaaguugucaaucau

SEQ ID NO: 195759 - RNA, 22 nt, Human
agauguugucucuuacguuuga

SEQ ID NO: 195760 - RNA, 22 nt, Human
agauugaacgagcuggcaugga

SEQ ID NO: 195761 - RNA, 22 nt, Human
agcaaaacuaaagacacagaca

SEQ ID NO: 195762 - RNA, 22 nt, Human
agaugucauguguugcuccaag

SEQ ID NO: 195763 - RNA, 22 nt, Human
agcaaagguagcagcucccagg

SEQ ID NO: 195764 - RNA, 22 nt, Human
agcaacauggaguuugugcgca

SEQ ID NO: 195765 - RNA, 22 nt, Human
agauggaguccugaagccagaa

SEQ ID NO: 195766 - RNA, 19 nt, Human
agauggcaaaaugcaaaga

SEQ ID NO: 195767 - RNA, 22 nt, Human
agauggggccugaggacacugu

SEQ ID NO: 195768 - RNA, 22 nt, Human
agaugguucagaauuauaaaga

SEQ ID NO: 195769 - RNA, 22 nt, Human
agauggaggaaagcaguuagaa

SEQ ID NO: 195770 - RNA, 20 nt, Human
agaugcccaacucuguuuug

SEQ ID NO: 195771 - RNA, 22 nt, Human
agauuucaauggauauugcaag

SEQ ID NO: 195772 - RNA, 22 nt, Human
agauggcuccaguguccagagg

SEQ ID NO: 195773 - RNA, 22 nt, Human
agaugaccaguaagugguugaa

SEQ ID NO: 195774 - RNA, 22 nt, Human
agaucugucaccauccuggagc

SEQ ID NO: 195775 - RNA, 17 nt, Human
agaucugaaggagaaca

SEQ ID NO: 195776 - RNA, 22 nt, Human
agaugaguaaauggagucuucc

SEQ ID NO: 195777 - RNA, 21 nt, Human
agaugaggauacugaggccua

SEQ ID NO: 195778 - RNA, 22 nt, Human
agauuaagcauuauaauuauaa

SEQ ID NO: 195779 - RNA, 22 nt, Human
agauuauuuaagacaggaacca

SEQ ID NO: 195780 - RNA, 22 nt, Human
agauauuauuuucuauuuauca

SEQ ID NO: 195781 - RNA, 23 nt, Human
agaugaugaauaaagagugagga

SEQ ID NO: 195782 - RNA, 22 nt, Human
agauaucuuguuggcauaaaug

SEQ ID NO: 195783 - RNA, 22 nt, Human
agauaggccauuaagaaggaua

SEQ ID NO: 195784 - RNA, 21 nt, Human
agaugcaguuugcaggugggu

SEQ ID NO: 195785 - RNA, 22 nt, Human
agaugaugugugucuucagcua

SEQ ID NO: 195786 - RNA, 19 nt, Human
agaucaggauguauuuuug

SEQ ID NO: 195787 - RNA, 22 nt, Human
agauauucugccuaacagguuu

SEQ ID NO: 195788 - RNA, 22 nt, Human
agccauggagaacagacuugaa

SEQ ID NO: 195789 - RNA, 22 nt, Human
agccauggagauguggguuggg

SEQ ID NO: 195790 - RNA, 23 nt, Human
agcccagcagagaaccuaggucc

SEQ ID NO: 195791 - RNA, 22 nt, Human
agccauggaggaugugcagcau

SEQ ID NO: 195792 - RNA, 22 nt, Human
agcccuucccuuucacuggugc

SEQ ID NO: 195793 - RNA, 22 nt, Human
agccgauaaauuguuuucuugg

SEQ ID NO: 195794 - RNA, 22 nt, Human
agccagcauauauauaguugaa

SEQ ID NO: 195795 - RNA, 22 nt, Human
agccagugcagcuggaaauuca

SEQ ID NO: 195796 - RNA, 22 nt, Human
agccagugucgugugacaugag

SEQ ID NO: 195797 - RNA, 22 nt, Human
agccaugcuguuuugccuggga

SEQ ID NO: 195798 - RNA, 22 nt, Human
agccaucuggugucaaugauuc

SEQ ID NO: 195799 - RNA, 22 nt, Human
agccccggugagggaguccugu

SEQ ID NO: 195800 - RNA, 22 nt, Human
agcccugaccuguccuguucug

SEQ ID NO: 195801 - RNA, 22 nt, Human
agcccuauacuuagauuuauuc

SEQ ID NO: 195802 - RNA, 22 nt, Human
agccuacauuugacuauagucu

SEQ ID NO: 195803 - RNA, 22 nt, Human
agcgaaaagaauggaguggagu

SEQ ID NO: 195804 - RNA, 22 nt, Human
agccggccucggacagagggag

SEQ ID NO: 195805 - RNA, 22 nt, Human
agccgcugaauuugaaacaagc

SEQ ID NO: 195806 - RNA, 22 nt, Human
agccuaauuuguaggucugugu

SEQ ID NO: 195807 - RNA, 21 nt, Human
agccgggacaacguggacccc

SEQ ID NO: 195808 - RNA, 22 nt, Human
agccugaaccaauauagcagcc

SEQ ID NO: 195809 - RNA, 22 nt, Human
agccuggagcaggcucugcucu

SEQ ID NO: 195810 - RNA, 22 nt, Human
agccugagucugcacauagaac

SEQ ID NO: 195811 - RNA, 22 nt, Human
agccuauucaucugaucuugaa

SEQ ID NO: 195812 - RNA, 22 nt, Human
agccugggucgagagacgagaa

SEQ ID NO: 195813 - RNA, 22 nt, Human
agccuguacuuagagggauuaa

SEQ ID NO: 195814 - RNA, 22 nt, Human
agccugugcuguguuugcucca

SEQ ID NO: 195815 - RNA, 22 nt, Human
agcgcucauuuuccuccugcuc

SEQ ID NO: 195816 - RNA, 21 nt, Human
agcgcugcauccaccauggcu

SEQ ID NO: 195817 - RNA, 19 nt, Human
agcgccucuacugcaugga

SEQ ID NO: 195818 - RNA, 22 nt, Human
agcagagaacauucauucaugu

SEQ ID NO: 195819 - RNA, 22 nt, Human
agcaaagccucuuugaaaaaaa

SEQ ID NO: 195820 - RNA, 22 nt, Human
agcagagggucaguuuuuuagu

SEQ ID NO: 195821 - RNA, 22 nt, Human
agcacuaccggucacggccaug

SEQ ID NO: 195822 - RNA, 22 nt, Human
agcaauguuggccuauauaccu

SEQ ID NO: 195823 - RNA, 22 nt, Human
agcaagggucucucauggcuug

SEQ ID NO: 195824 - RNA, 22 nt, Human
agcaaauaauugucuuugaggg

SEQ ID NO: 195825 - RNA, 22 nt, Human
agcaaaguacugagcucaaagg

SEQ ID NO: 195826 - RNA, 22 nt, Human
agcaaggguugguuuucugaca

SEQ ID NO: 195827 - RNA, 22 nt, Human
agauucucccuccuggcgcugu

SEQ ID NO: 195828 - RNA, 22 nt, Human
agcaaaauuccaaaaugcuaau

SEQ ID NO: 195829 - RNA, 22 nt, Human
agcacgcccaccuccugcggcg

SEQ ID NO: 195830 - RNA, 22 nt, Human
agauuuucuuuuccaucuuugu

SEQ ID NO: 195831 - RNA, 22 nt, Human
agauuuuacggaguauuagggu

SEQ ID NO: 195832 - RNA, 22 nt, Human
agcagauuguacagugcauuag

SEQ ID NO: 195833 - RNA, 22 nt, Human
agcagcaccuguccucgcugcu

SEQ ID NO: 195834 - RNA, 22 nt, Human
agcagcaaugacaauucaacca

SEQ ID NO: 195835 - RNA, 20 nt, Human
agcacaggcagucauucagu

SEQ ID NO: 195836 - RNA, 22 nt, Human
agcacagugccugacauauaug

SEQ ID NO: 195837 - RNA, 22 nt, Human
agcaauucugaaauuacuugac

SEQ ID NO: 195838 - RNA, 22 nt, Human
agcaauucagagcauggacuuu

SEQ ID NO: 195839 - RNA, 22 nt, Human
agcacguucuucauuacuucac

SEQ ID NO: 195840 - RNA, 22 nt, Human
agcacucacuagaguuagaacc

SEQ ID NO: 195841 - RNA, 22 nt, Human
agcagauaaagguugcauuucu

SEQ ID NO: 195842 - RNA, 22 nt, Human
agcauaacaaagggcauaauug

SEQ ID NO: 195843 - RNA, 22 nt, Human
agcaggagagacuggcccaaaa

SEQ ID NO: 195844 - RNA, 22 nt, Human
agcaugaauugccauuuauuaa

SEQ ID NO: 195845 - RNA, 22 nt, Human
agcaggagaaagaguaugggcu

SEQ ID NO: 195846 - RNA, 22 nt, Human
agcaggauggaguaacgugaaa

SEQ ID NO: 195847 - RNA, 16 nt, Human
agcagcgugggggugg

SEQ ID NO: 195848 - RNA, 22 nt, Human
agcagcugagccccagcuguga

SEQ ID NO: 195849 - RNA, 17 nt, Human
agcagcuggguugaucu

SEQ ID NO: 195850 - RNA, 19 nt, Human
agcagccaucgaccaugga

SEQ ID NO: 195851 - RNA, 22 nt, Human
agcagcaggcugggaugagucu

SEQ ID NO: 195852 - RNA, 22 nt, Human
gaauguuaaugcacuucuagcu

SEQ ID NO: 195853 - RNA, 22 nt, Human
gaauuacuccaguguguggguu

SEQ ID NO: 195854 - RNA, 22 nt, Human
gaaugguuauaugauguuuaaa

SEQ ID NO: 195855 - RNA, 22 nt, Human
gaauguuugagugccaugugac

SEQ ID NO: 195856 - RNA, 22 nt, Human
gagggauuuuagugcagcaacu

SEQ ID NO: 195857 - RNA, 22 nt, Human
gaaugguuagugaacaaauuug

SEQ ID NO: 195858 - RNA, 19 nt, Human
gaauggguucuguagggag

SEQ ID NO: 195859 - RNA, 22 nt, Human
gaauggcagaaugaagcagugu

SEQ ID NO: 195860 - RNA, 22 nt, Human
gaggggcuccagguguugagga

SEQ ID NO: 195861 - RNA, 22 nt, Human
gacaagaagaacggagguuuca

SEQ ID NO: 195862 - RNA, 18 nt, Human
gacaaaaguacagacaga

SEQ ID NO: 195863 - RNA, 19 nt, Human
gaauugcacgagcagaggc

SEQ ID NO: 195864 - RNA, 22 nt, Human
gaggggaaggguguucaauggg

SEQ ID NO: 195865 - RNA, 22 nt, Human
gaggggcaagaaguuggccucu

SEQ ID NO: 195866 - RNA, 22 nt, Human
gaauuagguaauagaacuagua

SEQ ID NO: 195867 - RNA, 22 nt, Human
gaagucaggaaggagauugaag

SEQ ID NO: 195868 - RNA, 22 nt, Human
gaaguauuucugaguugcccag

SEQ ID NO: 195869 - RNA, 22 nt, Human
gaauaagaauccacuucuggca

SEQ ID NO: 195870 - RNA, 22 nt, Human
gaaguucuuagucucauuugca

SEQ ID NO: 195871 - RNA, 22 nt, Human
gaauacaaauaauaccaaggug

SEQ ID NO: 195872 - RNA, 22 nt, Human
gaggcagaggaaacagcucauu

SEQ ID NO: 195873 - RNA, 22 nt, Human
gaggauuugagggucacuccac

SEQ ID NO: 195874 - RNA, 22 nt, Human
gaauauuuaucucagcugcaga

SEQ ID NO: 195875 - RNA, 22 nt, Human
gaggcugguucccuugaucuuu

SEQ ID NO: 195876 - RNA, 22 nt, Human
gaauggaugcuggucaguuugg

SEQ ID NO: 195877 - RNA, 22 nt, Human
gaggcuaugucuacgcucagcg

SEQ ID NO: 195878 - RNA, 22 nt, Human
gaauggaacauagcaacaucuu

SEQ ID NO: 195879 - RNA, 22 nt, Human
gaaugccugggguucuucgauc

SEQ ID NO: 195880 - RNA, 22 nt, Human
gaggcggcgacgcgggcccggg

SEQ ID NO: 195881 - RNA, 22 nt, Human
gaaugcacacgugugugcaugc

SEQ ID NO: 195882 - RNA, 22 nt, Human
gaggcaggaagggaggguugug

SEQ ID NO: 195883 - RNA, 22 nt, Human
gaggccauguggcccgggcugc

SEQ ID NO: 195884 - RNA, 22 nt, Human
gaggccagcacccagaugcaug

SEQ ID NO: 195885 - RNA, 22 nt, Human
gaggauaaugaaucugaaucau

SEQ ID NO: 195886 - RNA, 22 nt, Human
gaggaggucaccuggugagcaa

SEQ ID NO: 195887 - RNA, 22 nt, Human
gaggagggagcuggaagcucuu

SEQ ID NO: 195888 - RNA, 22 nt, Human
gaaguaaugugauugcucaggg

SEQ ID NO: 195889 - RNA, 22 nt, Human
gaaguaaaacaguaacuuuguu

SEQ ID NO: 195890 - RNA, 22 nt, Human
gaggaggacauuggaaagaacu

SEQ ID NO: 195891 - RNA, 22 nt, Human
gaggaggagaagcggcggcgga

SEQ ID NO: 195892 - RNA, 22 nt, Human
gaggagcggugcaugugggggc

SEQ ID NO: 195893 - RNA, 22 nt, Human
gaggagcugggucagggagaca

SEQ ID NO: 195894 - RNA, 22 nt, Human
gaaggugcugaaacagaaauuu

SEQ ID NO: 195895 - RNA, 22 nt, Human
gaaggcugaauuauuuguuccu

SEQ ID NO: 195896 - RNA, 22 nt, Human
gaaggcagucuggggagcagcc

SEQ ID NO: 195897 - RNA, 22 nt, Human
gaggacugguugggaaugugaa

SEQ ID NO: 195898 - RNA, 22 nt, Human
gaggaaagcugguuuaaaguau

SEQ ID NO: 195899 - RNA, 22 nt, Human
gaggacuucaggccuggccagg

SEQ ID NO: 195900 - RNA, 22 nt, Human
gagcuggacauacaggaaacca

SEQ ID NO: 195901 - RNA, 22 nt, Human
gaaggaaaagacgugcuaagua

SEQ ID NO: 195902 - RNA, 22 nt, Human
gaaggcaguaaauggcuguuuu

SEQ ID NO: 195903 - RNA, 22 nt, Human
gaagcuucgaaagagugauuuc

SEQ ID NO: 195904 - RNA, 22 nt, Human
gagcguuucccugggggucugc

SEQ ID NO: 195905 - RNA, 22 nt, Human
gagcgugaggcagcuuucuaag

SEQ ID NO: 195906 - RNA, 22 nt, Human
gagcgcacagaaggaagcagcc

SEQ ID NO: 195907 - RNA, 22 nt, Human
gaagcgucaugaaagaaaggcu

SEQ ID NO: 195908 - RNA, 22 nt, Human
gaagccaugauaaccagugugg

SEQ ID NO: 195909 - RNA, 22 nt, Human
gagcggcucaguggccauguga

SEQ ID NO: 195910 - RNA, 22 nt, Human
gaagcagguucuucaggaugaa

SEQ ID NO: 195911 - RNA, 22 nt, Human
gaagcaccuggacggugccugg

SEQ ID NO: 195912 - RNA, 22 nt, Human
gaagcaagagggaucaggaucu

SEQ ID NO: 195913 - RNA, 19 nt, Human
gagccgcucccgcagccgg

SEQ ID NO: 195914 - RNA, 22 nt, Human
gagccuggagcuggaacgaagc

SEQ ID NO: 195915 - RNA, 22 nt, Human
gaaaaguuuaaccuuguacauu

SEQ ID NO: 195916 - RNA, 22 nt, Human
gagagaggggaagagaagcucu

SEQ ID NO: 195917 - RNA, 22 nt, Human
gaagauucugacccugacucag

SEQ ID NO: 195918 - RNA, 21 nt, Human
gaaaaucuaaugugacaaugc

SEQ ID NO: 195919 - RNA, 22 nt, Human
gaaaaugcacacauacacaccc

SEQ ID NO: 195920 - RNA, 22 nt, Human
gaucacuuugauuagauguccu

SEQ ID NO: 195921 - RNA, 22 nt, Human
gauccagauauuugggcuggua

SEQ ID NO: 195922 - RNA, 22 nt, Human
gagaacagauaugaugacuuca

SEQ ID NO: 195923 - RNA, 22 nt, Human
gauauuuugugaaaaaacaacu

SEQ ID NO: 195924 - RNA, 22 nt, Human
gagaaugagucagagcuggcug

SEQ ID NO: 195925 - RNA, 22 nt, Human
gagaagugggggucugggauga

SEQ ID NO: 195926 - RNA, 22 nt, Human
gauauuaguuuuggaaggaggg

SEQ ID NO: 195927 - RNA, 22 nt, Human
gagaaagauuguccuucagggg

SEQ ID NO: 195928 - RNA, 22 nt, Human
gagaaauagauucaugguagau

SEQ ID NO: 195929 - RNA, 22 nt, Human
gagaacaaggaagagucggcag

SEQ ID NO: 195930 - RNA, 22 nt, Human
gagaaagggagaaaaagaucuu

SEQ ID NO: 195931 - RNA, 22 nt, Human
gauacuuuguggaauccuggau

SEQ ID NO: 195932 - RNA, 22 nt, Human
gauagaaagagaaucagaacuu

SEQ ID NO: 195933 - RNA, 22 nt, Human
gauauggaaacuugauguugug

SEQ ID NO: 195934 - RNA, 22 nt, Human
gauagguacuguaagguccucu

SEQ ID NO: 195935 - RNA, 22 nt, Human
gauagcacacuuguugcuucug

SEQ ID NO: 195936 - RNA, 22 nt, Human
gauacuugaggagaucaccaca

SEQ ID NO: 195937 - RNA, 20 nt, Human
gauagcacaaagagaauggg

SEQ ID NO: 195938 - RNA, 22 nt, Human
gacuucuuaaagaggugaggaa

SEQ ID NO: 195939 - RNA, 22 nt, Human
gacuucaucagagcguacuguu

SEQ ID NO: 195940 - RNA, 22 nt, Human
gacuugaagcucucugguuuug

SEQ ID NO: 195941 - RNA, 22 nt, Human
gacuucaagaugaaucuuuggg

SEQ ID NO: 195942 - RNA, 22 nt, Human
gauaccugccaagcugcacuca

SEQ ID NO: 195943 - RNA, 22 nt, Human
gauaagugauucugauucacau

SEQ ID NO: 195944 - RNA, 22 nt, Human
gauaaugcuuuggucagacaug

SEQ ID NO: 195945 - RNA, 22 nt, Human
gauacaugucacaaguugugca

SEQ ID NO: 195946 - RNA, 22 nt, Human
gauaauuauaggcuaagccacu

SEQ ID NO: 195947 - RNA, 22 nt, Human
gauaaauaguguuuggggacau

SEQ ID NO: 195948 - RNA, 22 nt, Human
gacuuaaccacggucacauggu

SEQ ID NO: 195949 - RNA, 22 nt, Human
gaguuucacguagaucaggguc

SEQ ID NO: 195950 - RNA, 22 nt, Human
gaguguuugcuguauaauugga

SEQ ID NO: 195951 - RNA, 22 nt, Human
gaguggugagaauacaacggaa

SEQ ID NO: 195952 - RNA, 22 nt, Human
gacuaaauaaaagccaaacuuc

SEQ ID NO: 195953 - RNA, 22 nt, Human
gagucaguuguugcaccacuag

SEQ ID NO: 195954 - RNA, 22 nt, Human
gacuccugccucucuacuucug

SEQ ID NO: 195955 - RNA, 22 nt, Human
gacuggggcauuagaguagcuu

SEQ ID NO: 195956 - RNA, 22 nt, Human
gacugggacucaacccaccauu

SEQ ID NO: 195957 - RNA, 22 nt, Human
gacucuucucucccaaaugccc

SEQ ID NO: 195958 - RNA, 22 nt, Human
gaguaaacagccuucucccagc

SEQ ID NO: 195959 - RNA, 20 nt, Human
gacaugagggagcaaagagc

SEQ ID NO: 195960 - RNA, 22 nt, Human
gacaucuguccauggcacugga

SEQ ID NO: 195961 - RNA, 22 nt, Human
gacagugucccucuggggugga

SEQ ID NO: 195962 - RNA, 22 nt, Human
gacauugaauugaauccagauu

SEQ ID NO: 195963 - RNA, 22 nt, Human
gacccggauguuguacucgagg

SEQ ID NO: 195964 - RNA, 22 nt, Human
gaccgggcucugcugacggucu

SEQ ID NO: 195965 - RNA, 22 nt, Human
gacccuuugacuugugacauua

SEQ ID NO: 195966 - RNA, 22 nt, Human
gacccucucagacuuccaggca

SEQ ID NO: 195967 - RNA, 22 nt, Human
gacccugaggauucccugcuga

SEQ ID NO: 195968 - RNA, 22 nt, Human
gaguauuacuaaaauucgccua

SEQ ID NO: 195969 - RNA, 22 nt, Human
gaguaucagauuggaguccuca

SEQ ID NO: 195970 - RNA, 22 nt, Human
gagucuacaugcaggcaauugu

SEQ ID NO: 195971 - RNA, 22 nt, Human
gagugaucuguaggcagcaugg

SEQ ID NO: 195972 - RNA, 22 nt, Human
gacggagugcgcuugcuguuca

SEQ ID NO: 195973 - RNA, 22 nt, Human
gacggggcagccagcugguggc

SEQ ID NO: 195974 - RNA, 22 nt, Human
gacgacgggccccguggccacc

SEQ ID NO: 195975 - RNA, 22 nt, Human
gagucaggucaggcuuguagau

SEQ ID NO: 195976 - RNA, 22 nt, Human
gagucaucucuagaaugaugau

SEQ ID NO: 195977 - RNA, 22 nt, Human
gaccugcucagcccuguguguu

SEQ ID NO: 195978 - RNA, 22 nt, Human
gaccugaccucauuagcaaguu

SEQ ID NO: 195979 - RNA, 22 nt, Human
gaccuccauucugucaugacug

SEQ ID NO: 195980 - RNA, 22 nt, Human
gaggugaacccaggugcuucac

SEQ ID NO: 195981 - RNA, 22 nt, Human
gacagaccucugcugacuggag

SEQ ID NO: 195982 - RNA, 22 nt, Human
gacacugccaagugccccgaga

SEQ ID NO: 195983 - RNA, 22 nt, Human
gacagcguguuuugcaugaaca

SEQ ID NO: 195984 - RNA, 22 nt, Human
gacaggcagagaggaagagaga

SEQ ID NO: 195985 - RNA, 22 nt, Human
gacagguagacaugaauauuaa

SEQ ID NO: 195986 - RNA, 22 nt, Human
gacagggacacagccagugagg

SEQ ID NO: 195987 - RNA, 22 nt, Human
gacaggaauuaucuaaaguaga

SEQ ID NO: 195988 - RNA, 22 nt, Human
gaggugcaggggcccgggcugg

SEQ ID NO: 195989 - RNA, 22 nt, Human
gagguuauucuucuaucaguau

SEQ ID NO: 195990 - RNA, 22 nt, Human
gagguucgauacagcguauuua

SEQ ID NO: 195991 - RNA, 19 nt, Human
gaguaaaacuagagagaaa

SEQ ID NO: 195992 - RNA, 22 nt, Human
gagguuggagggcuggccugca

SEQ ID NO: 195993 - RNA, 22 nt, Human
gaggguggagccuccuggaagu

SEQ ID NO: 195994 - RNA, 22 nt, Human
gacacccgccggcgccugccuc

SEQ ID NO: 195995 - RNA, 22 nt, Human
gacacaacuucccucccacauu

SEQ ID NO: 195996 - RNA, 22 nt, Human
gacacaacuauccaguauggga

SEQ ID NO: 195997 - RNA, 22 nt, Human
gaggguuucagugggacggguu

SEQ ID NO: 195998 - RNA, 22 nt, Human
gagguagaggaaaagauuauca

SEQ ID NO: 195999 - RNA, 22 nt, Human
gacaccuucuacugacuaugga

SEQ ID NO: 196000 - RNA, 22 nt, Human
gaggucaugcagcucugaguuc

SEQ ID NO: 196001 - RNA, 22 nt, Human
gaggucggaagugaggguaacu

SEQ ID NO: 196002 - RNA, 22 nt, Human
gaggucagcaagccaugcuugu

SEQ ID NO: 196003 - RNA, 22 nt, Human
gagguagcgugcagggcccgaa

SEQ ID NO: 196004 - RNA, 22 nt, Human
gaaguggggaggagaagacuga

SEQ ID NO: 196005 - RNA, 22 nt, Human
cuugcagagcccauggauguca

SEQ ID NO: 196006 - RNA, 22 nt, Human
gaaggggccuggggcaaggcua

SEQ ID NO: 196007 - RNA, 22 nt, Human
gaagggucagggcccaggggcc

SEQ ID NO: 196008 - RNA, 22 nt, Human
cuucucuuccuucucauccuca

SEQ ID NO: 196009 - RNA, 22 nt, Human
gaagucugacucuuuguaagcu

SEQ ID NO: 196010 - RNA, 22 nt, Human
cuucuaauucuuauguaagcuu

SEQ ID NO: 196011 - RNA, 21 nt, Human
cuucgcuguuccagcucuugg

SEQ ID NO: 196012 - RNA, 22 nt, Human
cuuccugcaacaccuguguugc

SEQ ID NO: 196013 - RNA, 22 nt, Human
gaaggcuguggcuggucucagu

SEQ ID NO: 196014 - RNA, 22 nt, Human
gaaggggacuccauggaaugau

SEQ ID NO: 196015 - RNA, 22 nt, Human
gaagauuauuacucauugcagg

SEQ ID NO: 196016 - RNA, 22 nt, Human
gaagaugacaucggaucugucu

SEQ ID NO: 196017 - RNA, 18 nt, Human
gaagcaacaguucugagu

SEQ ID NO: 196018 - RNA, 22 nt, Human
gacaagaugacaucauggcuuc

SEQ ID NO: 196019 - RNA, 22 nt, Human
cuuucauuuuugggcaucugag

SEQ ID NO: 196020 - RNA, 22 nt, Human
cuuuaguaaaacguauuuagga

SEQ ID NO: 196021 - RNA, 20 nt, Human
gacaagccacagcucccaga

SEQ ID NO: 196022 - RNA, 22 nt, Human
gaaugggaauuauggugggacu

SEQ ID NO: 196023 - RNA, 22 nt, Human
gaauuacagaguuguuaaguca

SEQ ID NO: 196024 - RNA, 22 nt, Human
gaauuagacggcaucacauggg

SEQ ID NO: 196025 - RNA, 22 nt, Human
cuuggggcuugcuguuguagcc

SEQ ID NO: 196026 - RNA, 22 nt, Human
cuugccaguguugcagaagcuc

SEQ ID NO: 196027 - RNA, 22 nt, Human
gagagaaggaagugaauuuccc

SEQ ID NO: 196028 - RNA, 22 nt, Human
gagagagacugggaaaucauca

SEQ ID NO: 196029 - RNA, 20 nt, Human
gagaauuccagguuucugug

SEQ ID NO: 196030 - RNA, 16 nt, Human
gacuuucuacgacucu

SEQ ID NO: 196031 - RNA, 22 nt, Human
gagaaaacauacuuaguguccu

SEQ ID NO: 196032 - RNA, 22 nt, Human
gagaaggagcagaaaaucuccu

SEQ ID NO: 196033 - RNA, 22 nt, Human
gagaaaaauuucuuugcugcac

SEQ ID NO: 196034 - RNA, 22 nt, Human
cuuuuugccuugaagugaccuc

SEQ ID NO: 196035 - RNA, 22 nt, Human
cuuuuuuucuccauauuucugg

SEQ ID NO: 196036 - RNA, 22 nt, Human
cuuuuugcccuugggcuuccug

SEQ ID NO: 196037 - RNA, 22 nt, Human
gacugacagugguacuguaauu

SEQ ID NO: 196038 - RNA, 22 nt, Human
gacuggaaucucugcuuguuaa

SEQ ID NO: 196039 - RNA, 18 nt, Human
gacugccuugaacuauug

SEQ ID NO: 196040 - RNA, 22 nt, Human
cuuuuucaugggugaugagugg

SEQ ID NO: 196041 - RNA, 22 nt, Human
gacuguuggcagauguuugagu

SEQ ID NO: 196042 - RNA, 22 nt, Human
gacaguggagccacguugggag

SEQ ID NO: 196043 - RNA, 21 nt, Human
cuuugccuccagcagccgcag

SEQ ID NO: 196044 - RNA, 22 nt, Human
cuuuggacaacugagugacguu

SEQ ID NO: 196045 - RNA, 21 nt, Human
cuuuggcaagggagaagucac

SEQ ID NO: 196046 - RNA, 22 nt, Human
cuuuguaaucaauaagucuuuu

SEQ ID NO: 196047 - RNA, 22 nt, Human
cuuuucuuuucuucucuuccca

SEQ ID NO: 196048 - RNA, 22 nt, Human
gaccucauggaguaagugagug

SEQ ID NO: 196049 - RNA, 22 nt, Human
gacagcaggaugugaggggaug

SEQ ID NO: 196050 - RNA, 22 nt, Human
cuuuccaugucuucuuucucca

SEQ ID NO: 196051 - RNA, 22 nt, Human
cuuucucucaaacacacauaca

SEQ ID NO: 196052 - RNA, 22 nt, Human
cuuucuccagagugaagauccu

SEQ ID NO: 196053 - RNA, 22 nt, Human
cuuucuuucaaguucugcuuua

SEQ ID NO: 196054 - RNA, 22 nt, Human
gacagcuauggaguucacuucu

SEQ ID NO: 196055 - RNA, 22 nt, Human
gacagcguaucaauugaacaua

SEQ ID NO: 196056 - RNA, 22 nt, Human
cugaugcucuggauguagucaa

SEQ ID NO: 196057 - RNA, 22 nt, Human
cuucagagugacucagcaucuu

SEQ ID NO: 196058 - RNA, 22 nt, Human
cuggaucgccccgaugugcccc

SEQ ID NO: 196059 - RNA, 22 nt, Human
cuggauagaggaugguaggcac

SEQ ID NO: 196060 - RNA, 22 nt, Human
cuggauagaccccuuauugcau

SEQ ID NO: 196061 - RNA, 22 nt, Human
cuggagcucugggcaucucagg

SEQ ID NO: 196062 - RNA, 22 nt, Human
cuucagcgucgucaguguugcu

SEQ ID NO: 196063 - RNA, 22 nt, Human
cuggagcuucaggguucucggg

SEQ ID NO: 196064 - RNA, 22 nt, Human
cuggcggugaucccgauggugu

SEQ ID NO: 196065 - RNA, 22 nt, Human
cugggaaggaagggaaaaacag

SEQ ID NO: 196066 - RNA, 22 nt, Human
cuggcuuucauggcgcaguuga

SEQ ID NO: 196067 - RNA, 22 nt, Human
cuggcgagcugggccuggggga

SEQ ID NO: 196068 - RNA, 21 nt, Human
cuuuucuagucccagccccgc

SEQ ID NO: 196069 - RNA, 22 nt, Human
cuuuuccuccaggaagccaagc

SEQ ID NO: 196070 - RNA, 22 nt, Human
cuuuucauuucauggaauacaa

SEQ ID NO: 196071 - RNA, 22 nt, Human
cuuuucaaacaggacagguccu

SEQ ID NO: 196072 - RNA, 22 nt, Human
gaaaaacucagugggggucuuu

SEQ ID NO: 196073 - RNA, 22 nt, Human
gaaaaauggguuguuugaagau

SEQ ID NO: 196074 - RNA, 22 nt, Human
cugggugggcacccagccuggg

SEQ ID NO: 196075 - RNA, 22 nt, Human
cuggguguggugggugcugccg

SEQ ID NO: 196076 - RNA, 22 nt, Human
cugggugugugugaacagagau

SEQ ID NO: 196077 - RNA, 22 nt, Human
cuggguaaggaaacuccuuugu

SEQ ID NO: 196078 - RNA, 22 nt, Human
cugggguggugcaggccucaug

SEQ ID NO: 196079 - RNA, 22 nt, Human
cugggguuggccagggcccuag

SEQ ID NO: 196080 - RNA, 22 nt, Human
cugggcuuucaggcccuaaggc

SEQ ID NO: 196081 - RNA, 22 nt, Human
cugggguaucugccacaacucu

SEQ ID NO: 196082 - RNA, 22 nt, Human
cuuuuucuugugguuaauaucu

SEQ ID NO: 196083 - RNA, 22 nt, Human
cugggcaugggaacuucaaggc

SEQ ID NO: 196084 - RNA, 22 nt, Human
cuuuuggcaucagccucaggaa

SEQ ID NO: 196085 - RNA, 22 nt, Human
cuuuuuaaaguaaauggcuaga

SEQ ID NO: 196086 - RNA, 19 nt, Human
cugggacaaugaaagcauc

SEQ ID NO: 196087 - RNA, 22 nt, Human
cugggacacguugugcuuuaac

SEQ ID NO: 196088 - RNA, 22 nt, Human
cugggacccagcccaagucuuu

SEQ ID NO: 196089 - RNA, 22 nt, Human
cuuuugcaauagugacacugau

SEQ ID NO: 196090 - RNA, 22 nt, Human
cugggaggagacaggggauggg

SEQ ID NO: 196091 - RNA, 22 nt, Human
cugggagggguagccaauccua

SEQ ID NO: 196092 - RNA, 22 nt, Human
cuguguugggauggugcgcgca

SEQ ID NO: 196093 - RNA, 22 nt, Human
cuguguuguuugaguagcuuga

SEQ ID NO: 196094 - RNA, 22 nt, Human
gaacugaauguguaauguuggc

SEQ ID NO: 196095 - RNA, 22 nt, Human
gaagaagagauaauggggagca

SEQ ID NO: 196096 - RNA, 22 nt, Human
gaacuugagugugcuauuucuu

SEQ ID NO: 196097 - RNA, 22 nt, Human
gaacaguuucccuguagaaaau

SEQ ID NO: 196098 - RNA, 21 nt, Human
cugugggaaggccugaggucu

SEQ ID NO: 196099 - RNA, 22 nt, Human
cuguggcugcgcccugggggag

SEQ ID NO: 196100 - RNA, 22 nt, Human
cugugggcucucaugggaccug

SEQ ID NO: 196101 - RNA, 22 nt, Human
gaaagaggcugucagggaaugg

SEQ ID NO: 196102 - RNA, 22 nt, Human
gaaaccauggcaaccagguccu

SEQ ID NO: 196103 - RNA, 22 nt, Human
gaaacauuuguugaguacuugc

SEQ ID NO: 196104 - RNA, 22 nt, Human
cuguauggaggaggugcuagcc

SEQ ID NO: 196105 - RNA, 22 nt, Human
cuguccuguggccugcuccggu

SEQ ID NO: 196106 - RNA, 22 nt, Human
cugucagcaaaucagugucugg

SEQ ID NO: 196107 - RNA, 22 nt, Human
cugucacuguuuuaaccaacaa

SEQ ID NO: 196108 - RNA, 22 nt, Human
gaaaauaguucaucacaaugau

SEQ ID NO: 196109 - RNA, 22 nt, Human
cugguuuuccaauguuuugacu

SEQ ID NO: 196110 - RNA, 22 nt, Human
gaaaaucaggauggaugugagg

SEQ ID NO: 196111 - RNA, 22 nt, Human
gaaaaucaugaaaguguguugu

SEQ ID NO: 196112 - RNA, 22 nt, Human
cuggguuuggcugugcuugaau

SEQ ID NO: 196113 - RNA, 22 nt, Human
cugguacuggaggaguucagag

SEQ ID NO: 196114 - RNA, 22 nt, Human
gaaaacccuguauguagcguuu

SEQ ID NO: 196115 - RNA, 20 nt, Human
cuggugccuucugcgauuua

SEQ ID NO: 196116 - RNA, 22 nt, Human
gaaaaggaggggaggcagaugg

SEQ ID NO: 196117 - RNA, 22 nt, Human
gaaaagcucuuuagaagagguu

SEQ ID NO: 196118 - RNA, 22 nt, Human
cuggugggucacgugugggugg

SEQ ID NO: 196119 - RNA, 22 nt, Human
cuggugcuguagccugauugag

SEQ ID NO: 196120 - RNA, 22 nt, Human
cugcgcgagcacugccggcggg

SEQ ID NO: 196121 - RNA, 22 nt, Human
cugccuuggcccuaguucaugg

SEQ ID NO: 196122 - RNA, 22 nt, Human
cugcgcagaucugcuguucucu

SEQ ID NO: 196123 - RNA, 22 nt, Human
cugccuucaaaguaauauuuua

SEQ ID NO: 196124 - RNA, 22 nt, Human
cuacuucucccuagaucagaaa

SEQ ID NO: 196125 - RNA, 22 nt, Human
cuacuucuguggcucuaagaga

SEQ ID NO: 196126 - RNA, 22 nt, Human
cugccugugcgccaagugcacg

SEQ ID NO: 196127 - RNA, 22 nt, Human
cugccuggggaaugugaggauu

SEQ ID NO: 196128 - RNA, 22 nt, Human
cugccgaugcgcaguggcgccu

SEQ ID NO: 196129 - RNA, 22 nt, Human
cugccggcugcugcagagaggu

SEQ ID NO: 196130 - RNA, 22 nt, Human
cugccucucaugccugcuugcu

SEQ ID NO: 196131 - RNA, 22 nt, Human
cuaauuguaagcuccuugaggg

SEQ ID NO: 196132 - RNA, 22 nt, Human
cuaaugaaaugauggcuccuac

SEQ ID NO: 196133 - RNA, 22 nt, Human
cuaauaauuuacugagugcuac

SEQ ID NO: 196134 - RNA, 23 nt, Human
cuaagcuugaguauagcuuagga

SEQ ID NO: 196135 - RNA, 18 nt, Human
cuacauucauaggaaagg

SEQ ID NO: 196136 - RNA, 22 nt, Human
cuacauaaauuuaucacagacu

SEQ ID NO: 196137 - RNA, 22 nt, Human
cuaccagcacgccuuccucuac

SEQ ID NO: 196138 - RNA, 22 nt, Human
cugcccugcagcuccacggacu

SEQ ID NO: 196139 - RNA, 22 nt, Human
cugccaggagaggccagggccc

SEQ ID NO: 196140 - RNA, 22 nt, Human
cuacugacugaccauaguuuca

SEQ ID NO: 196141 - RNA, 22 nt, Human
cugcuguugagguuccaggcca

SEQ ID NO: 196142 - RNA, 22 nt, Human
cugcuguuuucugggcuucuua

SEQ ID NO: 196143 - RNA, 22 nt, Human
cugcugugcagacagacucucu

SEQ ID NO: 196144 - RNA, 22 nt, Human
cuauauucuggaauguccauuu

SEQ ID NO: 196145 - RNA, 22 nt, Human
cuauaucuguggauaguguaug

SEQ ID NO: 196146 - RNA, 22 nt, Human
cugcuggugcugcccacacggu

SEQ ID NO: 196147 - RNA, 22 nt, Human
cugcuacgguguccgguggggc

SEQ ID NO: 196148 - RNA, 22 nt, Human
cugcgguucuguuuaguggcga

SEQ ID NO: 196149 - RNA, 22 nt, Human
cugcguugaccagacuccuggg

SEQ ID NO: 196150 - RNA, 22 nt, Human
cuaggaugcuguaauggugucu

SEQ ID NO: 196151 - RNA, 22 nt, Human
cuagcaggacucagcagauauu

SEQ ID NO: 196152 - RNA, 22 nt, Human
cuaguucugccauucaguguca

SEQ ID NO: 196153 - RNA, 22 nt, Human
cugcuauaacacuaacaucuaa

SEQ ID NO: 196154 - RNA, 20 nt, Human
cugcuccauggcaucuuuag

SEQ ID NO: 196155 - RNA, 21 nt, Human
cugcugaaggaaccccaugga

SEQ ID NO: 196156 - RNA, 22 nt, Human
cugcugccagcuuaauacucac

SEQ ID NO: 196157 - RNA, 22 nt, Human
cugaguuuuucaaaucugaauu

SEQ ID NO: 196158 - RNA, 22 nt, Human
cugagggagacagugcggacua

SEQ ID NO: 196159 - RNA, 21 nt, Human
cgucccggcgugagagagcug

SEQ ID NO: 196160 - RNA, 22 nt, Human
cgguuuuuaaaagucucuucua

SEQ ID NO: 196161 - RNA, 19 nt, Human
cggugcugauuggugcagu

SEQ ID NO: 196162 - RNA, 22 nt, Human
cucugcuuagacaggcuuuaag

SEQ ID NO: 196163 - RNA, 22 nt, Human
cugagcaucaaaugggcaauua

SEQ ID NO: 196164 - RNA, 22 nt, Human
cguggccacaguggagcugagc

SEQ ID NO: 196165 - RNA, 22 nt, Human
cguggcaguagagcuggaacuu

SEQ ID NO: 196166 - RNA, 22 nt, Human
cguggaggucgcauauuccucu

SEQ ID NO: 196167 - RNA, 22 nt, Human
cgugaagaaguaauagguggug

SEQ ID NO: 196168 - RNA, 22 nt, Human
cgugaaaugcagaaaguugugg

SEQ ID NO: 196169 - RNA, 21 nt, Human
cugauguaccucaagccuagu

SEQ ID NO: 196170 - RNA, 22 nt, Human
cugauggagagugugauuuggg

SEQ ID NO: 196171 - RNA, 22 nt, Human
cugaucuuaaguaacauuauuu

SEQ ID NO: 196172 - RNA, 22 nt, Human
cugauaauaaccauuuuaaaau

SEQ ID NO: 196173 - RNA, 22 nt, Human
cugauagagcauuagugugaga

SEQ ID NO: 196174 - RNA, 22 nt, Human
cugauccuauauugguaugagg

SEQ ID NO: 196175 - RNA, 22 nt, Human
cugaucccuuuucauuugcagg

SEQ ID NO: 196176 - RNA, 22 nt, Human
cugagguccucagagggaaagg

SEQ ID NO: 196177 - RNA, 22 nt, Human
cugagguagaggaaauguagcu

SEQ ID NO: 196178 - RNA, 22 nt, Human
cuaaagacagcaagacaucauc

SEQ ID NO: 196179 - RNA, 22 nt, Human
cuaaauucuauauccuugcuuc

SEQ ID NO: 196180 - RNA, 22 nt, Human
cuaaaaauguucuaguaguuca

SEQ ID NO: 196181 - RNA, 22 nt, Human
cugcaucacagcaggaggcaca

SEQ ID NO: 196182 - RNA, 22 nt, Human
cugcaguguccgcuugcucagc

SEQ ID NO: 196183 - RNA, 22 nt, Human
cugaugugcauguggggggaug

SEQ ID NO: 196184 - RNA, 22 nt, Human
cguugguggguguguggucgga

SEQ ID NO: 196185 - RNA, 17 nt, Human
cguuccagaacaaauga

SEQ ID NO: 196186 - RNA, 22 nt, Human
cguuauagagcacucgaacuuu

SEQ ID NO: 196187 - RNA, 19 nt, Human
cugagcagggaaaaacccu

SEQ ID NO: 196188 - RNA, 20 nt, Human
cuguuugcuaucaugagcug

SEQ ID NO: 196189 - RNA, 22 nt, Human
cuguuuuugccugugacaaaaa

SEQ ID NO: 196190 - RNA, 22 nt, Human
cuguuuggcuuccacugcuucu

SEQ ID NO: 196191 - RNA, 22 nt, Human
cuuacaauuuucuuggacuuuu

SEQ ID NO: 196192 - RNA, 22 nt, Human
cuuauucuucuggacuuggagu

SEQ ID NO: 196193 - RNA, 22 nt, Human
cuuaagacaggcucaaagauua

SEQ ID NO: 196194 - RNA, 22 nt, Human
cuguuguguuauuugcagugca

SEQ ID NO: 196195 - RNA, 20 nt, Human
cuguucucuugccacaugag

SEQ ID NO: 196196 - RNA, 22 nt, Human
cuguuucucugccugcacacau

SEQ ID NO: 196197 - RNA, 22 nt, Human
cuguuguucacuuugcugguga

SEQ ID NO: 196198 - RNA, 22 nt, Human
cugaagaaagaaaauggccauc

SEQ ID NO: 196199 - RNA, 22 nt, Human
cuguucuccacuccugacuucu

SEQ ID NO: 196200 - RNA, 22 nt, Human
cuguucagugcauauguauuga

SEQ ID NO: 196201 - RNA, 22 nt, Human
cugugcuguuaagaaauuuagu

SEQ ID NO: 196202 - RNA, 22 nt, Human
cucuuuuuuugucuuaagaacc

SEQ ID NO: 196203 - RNA, 22 nt, Human
cugugcauguucucuagcugau

SEQ ID NO: 196204 - RNA, 22 nt, Human
cucuuucauucuuagguugccg

SEQ ID NO: 196205 - RNA, 22 nt, Human
cucuuucauucuguccuuguuu

SEQ ID NO: 196206 - RNA, 22 nt, Human
cugaaacucaagauaggaggaa

SEQ ID NO: 196207 - RNA, 19 nt, Human
cugaaacacagagagggcu

SEQ ID NO: 196208 - RNA, 22 nt, Human
cuguuaucaggaguuuucacgg

SEQ ID NO: 196209 - RNA, 22 nt, Human
cuguuaauugugaauuuuacau

SEQ ID NO: 196210 - RNA, 22 nt, Human
cugguuacuucagaucaguagu

SEQ ID NO: 196211 - RNA, 22 nt, Human
cugguuuauuucauaguuuguu

SEQ ID NO: 196212 - RNA, 22 nt, Human
cucuggacaucugcggugcuuc

SEQ ID NO: 196213 - RNA, 22 nt, Human
cucuggagggaggcugagcugg

SEQ ID NO: 196214 - RNA, 22 nt, Human
cuggugaagccuucggagaccc

SEQ ID NO: 196215 - RNA, 22 nt, Human
cuguaaguggugaaauuaguuu

SEQ ID NO: 196216 - RNA, 22 nt, Human
cucuuauaaagaugucucuguu

SEQ ID NO: 196217 - RNA, 22 nt, Human
cuguccugauggugccacuggu

SEQ ID NO: 196218 - RNA, 22 nt, Human
cuggcuaaugugcugauagcca

SEQ ID NO: 196219 - RNA, 22 nt, Human
cuccgccuguccugggcccacg

SEQ ID NO: 196220 - RNA, 22 nt, Human
cucccugagaugcaggagagag

SEQ ID NO: 196221 - RNA, 22 nt, Human
cuggcuguguguuugugcaucu

SEQ ID NO: 196222 - RNA, 21 nt, Human
cuggcucgccaugguucuuuu

SEQ ID NO: 196223 - RNA, 22 nt, Human
cugggagaugacucagagcagg

SEQ ID NO: 196224 - RNA, 22 nt, Human
cuggcggcccgaggcagaggag

SEQ ID NO: 196225 - RNA, 22 nt, Human
cuggcgauugcgagagucgccu

SEQ ID NO: 196226 - RNA, 22 nt, Human
cuccagcagaaagggcgagugg

SEQ ID NO: 196227 - RNA, 22 nt, Human
cuccaccucagugucaucuucu

SEQ ID NO: 196228 - RNA, 22 nt, Human
cugggugagcuggccagagggu

SEQ ID NO: 196229 - RNA, 22 nt, Human
cuggguaaauauguauuccuga

SEQ ID NO: 196230 - RNA, 22 nt, Human
cuggucuugguauucgcagaag

SEQ ID NO: 196231 - RNA, 22 nt, Human
cuggucaauaaucauguaguac

SEQ ID NO: 196232 - RNA, 22 nt, Human
cuggguguuccuuucauuuuaa

SEQ ID NO: 196233 - RNA, 22 nt, Human
cugggaugagcuguuuccuggu

SEQ ID NO: 196234 - RNA, 22 nt, Human
cugggaguugacgaggcuugua

SEQ ID NO: 196235 - RNA, 22 nt, Human
cugggggacagagagaggcggu

SEQ ID NO: 196236 - RNA, 22 nt, Human
cugggguaucuggugucuuggu

SEQ ID NO: 196237 - RNA, 22 nt, Human
cucaaagcagacuuuucccuuu

SEQ ID NO: 196238 - RNA, 22 nt, Human
cuauaagguguuucuauugguc

SEQ ID NO: 196239 - RNA, 22 nt, Human
cucacugucagcugcagggcuu

SEQ ID NO: 196240 - RNA, 22 nt, Human
cuauuaauggccaggagucaug

SEQ ID NO: 196241 - RNA, 22 nt, Human
cugcuucacccugccugagaac

SEQ ID NO: 196242 - RNA, 22 nt, Human
cugcuugaugaggaaaggauug

SEQ ID NO: 196243 - RNA, 22 nt, Human
cuauuuucccauaugguugaca

SEQ ID NO: 196244 - RNA, 22 nt, Human
cucaugaauggcucuuugugcu

SEQ ID NO: 196245 - RNA, 22 nt, Human
cucaugagucugucagagucau

SEQ ID NO: 196246 - RNA, 22 nt, Human
cucaguauugacgaaagagauu

SEQ ID NO: 196247 - RNA, 22 nt, Human
cucaggaaaauauugaagaagu

SEQ ID NO: 196248 - RNA, 22 nt, Human
cucagcgggagucuggccgaac

SEQ ID NO: 196249 - RNA, 22 nt, Human
cucagcgagggaaagaggccgc

SEQ ID NO: 196250 - RNA, 22 nt, Human
cucagcaauuaccugugucucu

SEQ ID NO: 196251 - RNA, 22 nt, Human
cucagcaacccacacacggucu

SEQ ID NO: 196252 - RNA, 22 nt, Human
cgcgggcuugggcaccugcgga

SEQ ID NO: 196253 - RNA, 22 nt, Human
cgcuagggagcacuuggcagug

SEQ ID NO: 196254 - RNA, 22 nt, Human
cgcgcgguguuccgcauucugc

SEQ ID NO: 196255 - RNA, 22 nt, Human
cgcgcuuugggcaguguggcug

SEQ ID NO: 196256 - RNA, 22 nt, Human
cgccgugucuggucuguacguc

SEQ ID NO: 196257 - RNA, 22 nt, Human
cucaagugacucagccugguug

SEQ ID NO: 196258 - RNA, 22 nt, Human
cucaauuguuuggucucugguu

SEQ ID NO: 196259 - RNA, 22 nt, Human
cucaaugagcuauuuguuucau

SEQ ID NO: 196260 - RNA, 22 nt, Human
cuaggcuuucugugugacuaga

SEQ ID NO: 196261 - RNA, 22 nt, Human
cuagcagaagcuccuugagggu

SEQ ID NO: 196262 - RNA, 22 nt, Human
cgcagcuucagggccaggaggg

SEQ ID NO: 196263 - RNA, 22 nt, Human
cgcaucggguagaggagcugga

SEQ ID NO: 196264 - RNA, 22 nt, Human
cgcauugcaauucaggggauaa

SEQ ID NO: 196265 - RNA, 22 nt, Human
cgccaguggcagcuggaacagg

SEQ ID NO: 196266 - RNA, 22 nt, Human
cuauguuucagauauauauaua

SEQ ID NO: 196267 - RNA, 22 nt, Human
cuaguuuuaagcuccuugaggu

SEQ ID NO: 196268 - RNA, 21 nt, Human
cgcccggccggaaaccccuuc

SEQ ID NO: 196269 - RNA, 22 nt, Human
cgcccguacuuugccggcauga

SEQ ID NO: 196270 - RNA, 22 nt, Human
cucucuccuuuuugauauuuag

SEQ ID NO: 196271 - RNA, 22 nt, Human
cucugauuuuucuaauacuuca

SEQ ID NO: 196272 - RNA, 22 nt, Human
cucugagcucgugcaguacuuc

SEQ ID NO: 196273 - RNA, 22 nt, Human
cucugcuagaaggucaaucucu

SEQ ID NO: 196274 - RNA, 22 nt, Human
cggagcauacugccuggagaug

SEQ ID NO: 196275 - RNA, 22 nt, Human
cggaggcugcuuucuguugcua

SEQ ID NO: 196276 - RNA, 22 nt, Human
cggagcgagaaggggaaagccc

SEQ ID NO: 196277 - RNA, 20 nt, Human
cuccuccccucggccccacc

SEQ ID NO: 196278 - RNA, 22 nt, Human
cucccuucaggggaggacuagg

SEQ ID NO: 196279 - RNA, 22 nt, Human
cuccgcagcugggguuggcgcu

SEQ ID NO: 196280 - RNA, 22 nt, Human
cuccggccuucugacuccccug

SEQ ID NO: 196281 - RNA, 22 nt, Human
cuccagcucgcgagcucugcuc

SEQ ID NO: 196282 - RNA, 20 nt, Human
cucauugcuuucauuuucuu

SEQ ID NO: 196283 - RNA, 22 nt, Human
cgcugcugucaucgucuacggu

SEQ ID NO: 196284 - RNA, 22 nt, Human
cucauugacagagcagcucuac

SEQ ID NO: 196285 - RNA, 22 nt, Human
cucaucagagcccuccucuggc

SEQ ID NO: 196286 - RNA, 22 nt, Human
cgugaucuguuauauagugagc

SEQ ID NO: 196287 - RNA, 17 nt, Human
cgugaggaccaggcagc

SEQ ID NO: 196288 - RNA, 22 nt, Human
cgugcuaccugagcugacagcu

SEQ ID NO: 196289 - RNA, 22 nt, Human
cgaaaaagaagugcaccauguu

SEQ ID NO: 196290 - RNA, 22 nt, Human
cgucauuuguaaaugaucaaga

SEQ ID NO: 196291 - RNA, 22 nt, Human
cgucauguuauggcucauucua

SEQ ID NO: 196292 - RNA, 19 nt, Human
ccuggccaacgucaacauu

SEQ ID NO: 196293 - RNA, 22 nt, Human
ccuggcauuagaaauuccguca

SEQ ID NO: 196294 - RNA, 21 nt, Human
ccuggagacaaagacagggug

SEQ ID NO: 196295 - RNA, 22 nt, Human
ccuucgcuggcaucuccaggua

SEQ ID NO: 196296 - RNA, 22 nt, Human
cgggcacucagggucgaggugg

SEQ ID NO: 196297 - RNA, 22 nt, Human
cgggagcagcucuggggcuggg

SEQ ID NO: 196298 - RNA, 22 nt, Human
cgggagaugaggagagcuucgg

SEQ ID NO: 196299 - RNA, 22 nt, Human
ccuucuguaccaaggccucaug

SEQ ID NO: 196300 - RNA, 22 nt, Human
ccuucugcuggucaucccagug

SEQ ID NO: 196301 - RNA, 22 nt, Human
cuacuuucuucuucagaauugu

SEQ ID NO: 196302 - RNA, 22 nt, Human
cgauuccugauaagugaauaag

SEQ ID NO: 196303 - RNA, 22 nt, Human
cgagguuuaugaguuuguguuc

SEQ ID NO: 196304 - RNA, 18 nt, Human
cgauguguaugugauuug

SEQ ID NO: 196305 - RNA, 22 nt, Human
cuacugaugccccgcugugccu

SEQ ID NO: 196306 - RNA, 22 nt, Human
cgugucauggcggcgcaggugg

SEQ ID NO: 196307 - RNA, 22 nt, Human
cgugugcguauguguuuguaug

SEQ ID NO: 196308 - RNA, 22 nt, Human
cuaaaacuuuuccaaauuaugu

SEQ ID NO: 196309 - RNA, 22 nt, Human
cuaaauuuuuuagugaaauagg

SEQ ID NO: 196310 - RNA, 22 nt, Human
cuaaauguuuuaucuuccuggc

SEQ ID NO: 196311 - RNA, 22 nt, Human
cuaaacuucauauguugcuuua

SEQ ID NO: 196312 - RNA, 22 nt, Human
cgaggccgcuucauggcuggca

SEQ ID NO: 196313 - RNA, 22 nt, Human
cuacauuuacacaguuaggcuu

SEQ ID NO: 196314 - RNA, 22 nt, Human
cuacacgauaaauuuuaguggu

SEQ ID NO: 196315 - RNA, 22 nt, Human
cuacaaggucuuuaucugcuuu

SEQ ID NO: 196316 - RNA, 22 nt, Human
cgagugauuauucuggcugaga

SEQ ID NO: 196317 - RNA, 22 nt, Human
cgcacacaaaugcauacgccag

SEQ ID NO: 196318 - RNA, 22 nt, Human
cgcccggcugagacgcucgccc

SEQ ID NO: 196319 - RNA, 22 nt, Human
cgaggagguccaggagcaguag

SEQ ID NO: 196320 - RNA, 22 nt, Human
cgaggcuugcaaggacgaggag

SEQ ID NO: 196321 - RNA, 22 nt, Human
cgaguaauuggaaauuugcuau

SEQ ID NO: 196322 - RNA, 21 nt, Human
ccuccagccagagggucugga

SEQ ID NO: 196323 - RNA, 22 nt, Human
ccuccccugccugugcuguugg

SEQ ID NO: 196324 - RNA, 22 nt, Human
ccuccugggccuugcucuguga

SEQ ID NO: 196325 - RNA, 22 nt, Human
ccucgcucauggauucugccug

SEQ ID NO: 196326 - RNA, 18 nt, Human
ccuccccuguggaggucc

SEQ ID NO: 196327 - RNA, 22 nt, Human
ccuuuuuagaugugcgaauguu

SEQ ID NO: 196328 - RNA, 22 nt, Human
cgaacggcagagagcccguccc

SEQ ID NO: 196329 - RNA, 21 nt, Human
ccguuauucuucccaccccca

SEQ ID NO: 196330 - RNA, 22 nt, Human
ccguuugugcugcaggagaucg

SEQ ID NO: 196331 - RNA, 22 nt, Human
ccguccgcuccuccagccgcug

SEQ ID NO: 196332 - RNA, 22 nt, Human
ccuaacaugguuauuguuaauu

SEQ ID NO: 196333 - RNA, 22 nt, Human
ccuacccucaagggccuggggg

SEQ ID NO: 196334 - RNA, 22 nt, Human
ccuaauuuuagacccacuccua

SEQ ID NO: 196335 - RNA, 22 nt, Human
ccgguguggguuucucgguagu

SEQ ID NO: 196336 - RNA, 22 nt, Human
ccggguccagugggcacugggc

SEQ ID NO: 196337 - RNA, 19 nt, Human
ccggucaugcauuccuuug

SEQ ID NO: 196338 - RNA, 22 nt, Human
ccugccugggcucacuugccag

SEQ ID NO: 196339 - RNA, 22 nt, Human
cggaggagcugcgcggaggggg

SEQ ID NO: 196340 - RNA, 22 nt, Human
cgcuuuccaggcacauccucuu

SEQ ID NO: 196341 - RNA, 22 nt, Human
cgcuggagagcaagugcgugca

SEQ ID NO: 196342 - RNA, 22 nt, Human
cgcuuugacuuuagaaggccaa

SEQ ID NO: 196343 - RNA, 22 nt, Human
cgcuuugguaauagggcagccu

SEQ ID NO: 196344 - RNA, 22 nt, Human
cgggagagacagaggaggcgcc

SEQ ID NO: 196345 - RNA, 22 nt, Human
cgggacaauagcagugcugaug

SEQ ID NO: 196346 - RNA, 22 nt, Human
cggcugcagcggagcaggcugg

SEQ ID NO: 196347 - RNA, 22 nt, Human
cggagggcccucaggacugggu

SEQ ID NO: 196348 - RNA, 21 nt, Human
ccugagccuguuuauccagaa

SEQ ID NO: 196349 - RNA, 22 nt, Human
ccugagacucuccugugcagcc

SEQ ID NO: 196350 - RNA, 22 nt, Human
cgcugggugguugauguacagc

SEQ ID NO: 196351 - RNA, 22 nt, Human
cgcugcagcggcugagucccgc

SEQ ID NO: 196352 - RNA, 22 nt, Human
cgccgugcagucagcccagaag

SEQ ID NO: 196353 - RNA, 22 nt, Human
cgccgccgccugcccgcgcccc

SEQ ID NO: 196354 - RNA, 22 nt, Human
ccucucugcgaaugcugauagu

SEQ ID NO: 196355 - RNA, 22 nt, Human
ccugacgcugauauauaguuaa

SEQ ID NO: 196356 - RNA, 22 nt, Human
ccugaccauuugccacaugggu

SEQ ID NO: 196357 - RNA, 22 nt, Human
ccugacucugauuucgcugcau

SEQ ID NO: 196358 - RNA, 22 nt, Human
ccuguuuguucauguacuguga

SEQ ID NO: 196359 - RNA, 22 nt, Human
ccuugauaugcuucagagaauu

SEQ ID NO: 196360 - RNA, 22 nt, Human
ccgcgggcagggcuucaccuuu

SEQ ID NO: 196361 - RNA, 22 nt, Human
ccgcggcuguaguggaggugga

SEQ ID NO: 196362 - RNA, 17 nt, Human
ccuuucugaucaucuga

SEQ ID NO: 196363 - RNA, 22 nt, Human
ccuuggcuuaccuucugugugg

SEQ ID NO: 196364 - RNA, 22 nt, Human
ccggauuugggagccaccaggg

SEQ ID NO: 196365 - RNA, 22 nt, Human
ccgcuggccgacuuccgagagc

SEQ ID NO: 196366 - RNA, 22 nt, Human
ccuuucucuuggauaccgauug

SEQ ID NO: 196367 - RNA, 22 nt, Human
ccgcucuuugagacucucccga

SEQ ID NO: 196368 - RNA, 22 nt, Human
ccuuugcccugagaaauguucc

SEQ ID NO: 196369 - RNA, 22 nt, Human
ccuuucuggucucugagagacu

SEQ ID NO: 196370 - RNA, 22 nt, Human
ccgggcggcauccagccguucc

SEQ ID NO: 196371 - RNA, 22 nt, Human
ccuuuuaucgcgaagaacucca

SEQ ID NO: 196372 - RNA, 22 nt, Human
ccgaaaaacagaaucuuggaac

SEQ ID NO: 196373 - RNA, 22 nt, Human
ccagaauuugaacccacaaaug

SEQ ID NO: 196374 - RNA, 22 nt, Human
ccagacuggggauuuugccagg

SEQ ID NO: 196375 - RNA, 22 nt, Human
ccgcgcccccggcugugccccc

SEQ ID NO: 196376 - RNA, 22 nt, Human
ccgagcagggcgcccugcccca

SEQ ID NO: 196377 - RNA, 19 nt, Human
ccgagcagauugauguuuc

SEQ ID NO: 196378 - RNA, 22 nt, Human
ccgcggcagaggcgggggcgcc

SEQ ID NO: 196379 - RNA, 22 nt, Human
ccuggccacagggcucugcauu

SEQ ID NO: 196380 - RNA, 22 nt, Human
ccgcggcugcgcggugccccuc

SEQ ID NO: 196381 - RNA, 23 nt, Human
ccuggcugaccugaagguguagu

SEQ ID NO: 196382 - RNA, 22 nt, Human
ccgaggaguagggugucuacgg

SEQ ID NO: 196383 - RNA, 22 nt, Human
ccuggcccagcuggaagcggga

SEQ ID NO: 196384 - RNA, 21 nt, Human
ccugucagcccaacuuuugga

SEQ ID NO: 196385 - RNA, 22 nt, Human
ccuuaauaguguucuaauguuu

SEQ ID NO: 196386 - RNA, 22 nt, Human
ccugugacucugucugaugguc

SEQ ID NO: 196387 - RNA, 22 nt, Human
ccugugcuucacucaacaagcc

SEQ ID NO: 196388 - RNA, 22 nt, Human
ccaccacauuugccuagacuuu

SEQ ID NO: 196389 - RNA, 22 nt, Human
ccacccacuucucugcccucca

SEQ ID NO: 196390 - RNA, 22 nt, Human
cauuagugaggggcugccugcu

SEQ ID NO: 196391 - RNA, 22 nt, Human
cauucauagaaucaguuuggga

SEQ ID NO: 196392 - RNA, 22 nt, Human
cauuccaaguauauacaugaua

SEQ ID NO: 196393 - RNA, 20 nt, Human
cauuccaugcaucuuggucc

SEQ ID NO: 196394 - RNA, 22 nt, Human
ccaccuggcagcaggcucggca

SEQ ID NO: 196395 - RNA, 22 nt, Human
ccacucagaagaaacaagagag

SEQ ID NO: 196396 - RNA, 22 nt, Human
caugugcaucagccaauuggag

SEQ ID NO: 196397 - RNA, 22 nt, Human
ccaauguuaggcucugguuuua

SEQ ID NO: 196398 - RNA, 22 nt, Human
caugucaagacugaagauccag

SEQ ID NO: 196399 - RNA, 22 nt, Human
caugccucuguuuuaguuguug

SEQ ID NO: 196400 - RNA, 22 nt, Human
ccaaggcuggagggcuuaugua

SEQ ID NO: 196401 - RNA, 22 nt, Human
caugugacuuagguuuuaucac

SEQ ID NO: 196402 - RNA, 22 nt, Human
caugguaaucggggccaucugu

SEQ ID NO: 196403 - RNA, 21 nt, Human
caugguaaguacaaagaugac

SEQ ID NO: 196404 - RNA, 22 nt, Human
caugcuggcacugaccagccua

SEQ ID NO: 196405 - RNA, 22 nt, Human
caugcgucugcauuggguggug

SEQ ID NO: 196406 - RNA, 22 nt, Human
ccaaggcugcagccgugacgcg

SEQ ID NO: 196407 - RNA, 22 nt, Human
ccaaccaguuucuuggcuuuag

SEQ ID NO: 196408 - RNA, 19 nt, Human
cauggcgguaaagaggcug

SEQ ID NO: 196409 - RNA, 22 nt, Human
cauggcggcgcucucccugccu

SEQ ID NO: 196410 - RNA, 22 nt, Human
cauggcacagaagaugucguuu

SEQ ID NO: 196411 - RNA, 22 nt, Human
cauggcacuuuugugucuaaau

SEQ ID NO: 196412 - RNA, 22 nt, Human
caugcagauugccaggcucccu

SEQ ID NO: 196413 - RNA, 22 nt, Human
caugccugaucagcggccagca

SEQ ID NO: 196414 - RNA, 22 nt, Human
caugccaguagccggcuugacu

SEQ ID NO: 196415 - RNA, 22 nt, Human
caugauaacacuucuguuuaau

SEQ ID NO: 196416 - RNA, 22 nt, Human
caucuuuguuuuggauauaauc

SEQ ID NO: 196417 - RNA, 22 nt, Human
cauuucuugugagccgcauccu

SEQ ID NO: 196418 - RNA, 23 nt, Human
cauuugauccucacaauaaaugg

SEQ ID NO: 196419 - RNA, 22 nt, Human
cauuuucugcaagucugcucaa

SEQ ID NO: 196420 - RNA, 22 nt, Human
cauuuaucacuugcuaaacaua

SEQ ID NO: 196421 - RNA, 22 nt, Human
cauuuaaccccuugguacugaa

SEQ ID NO: 196422 - RNA, 22 nt, Human
caucuccaagucuguaagcagu

SEQ ID NO: 196423 - RNA, 22 nt, Human
cauugggcggggaccucggcug

SEQ ID NO: 196424 - RNA, 22 nt, Human
cauuggcacauguauucugggc

SEQ ID NO: 196425 - RNA, 22 nt, Human
caucucagguuuguucugagac

SEQ ID NO: 196426 - RNA, 22 nt, Human
cauugcaucuuuuauggguaag

SEQ ID NO: 196427 - RNA, 22 nt, Human
cauccagcuccugggggccacc

SEQ ID NO: 196428 - RNA, 22 nt, Human
cauugcugugggcauuugcugc

SEQ ID NO: 196429 - RNA, 22 nt, Human
cauuccuucucagguacuggca

SEQ ID NO: 196430 - RNA, 22 nt, Human
cauugcaaccauuccaaauggc

SEQ ID NO: 196431 - RNA, 20 nt, Human
cauuccugaggaauucaugu

SEQ ID NO: 196432 - RNA, 22 nt, Human
caucaguaaaguacuuuuaugu

SEQ ID NO: 196433 - RNA, 22 nt, Human
caucauuuggcuuuagggccug

SEQ ID NO: 196434 - RNA, 22 nt, Human
caucaggcugggaacacagauc

SEQ ID NO: 196435 - RNA, 22 nt, Human
cauucauaagacuuugcucuug

SEQ ID NO: 196436 - RNA, 22 nt, Human
cauuauacaugaagacucaccc

SEQ ID NO: 196437 - RNA, 22 nt, Human
caucaauagguauuugagagac

SEQ ID NO: 196438 - RNA, 21 nt, Human
caucaagaucaauggagggcu

SEQ ID NO: 196439 - RNA, 22 nt, Human
caucaacagucuacuuuuugcc

SEQ ID NO: 196440 - RNA, 22 nt, Human
cauaguuuguucuuuuuuauug

SEQ ID NO: 196441 - RNA, 22 nt, Human
cauguguuucuuaagccaggcc

SEQ ID NO: 196442 - RNA, 22 nt, Human
cauaucuccagguucugcugga

SEQ ID NO: 196443 - RNA, 22 nt, Human
cauauacauauacaugcauaca

SEQ ID NO: 196444 - RNA, 22 nt, Human
cauuauucaggcuuuggaauuu

SEQ ID NO: 196445 - RNA, 22 nt, Human
cagguuuuuauuacaacuuuga

SEQ ID NO: 196446 - RNA, 22 nt, Human
cauguggaaaugcaugcuuuuu

SEQ ID NO: 196447 - RNA, 22 nt, Human
cauguguauuauucuuguggaa

SEQ ID NO: 196448 - RNA, 22 nt, Human
caugugguauugugagauccac

SEQ ID NO: 196449 - RNA, 22 nt, Human
caucagucugaaagccagggag

SEQ ID NO: 196450 - RNA, 22 nt, Human
cagguuuuccuuuuaaaaggaa

SEQ ID NO: 196451 - RNA, 22 nt, Human
caucacggagcaugagaagaca

SEQ ID NO: 196452 - RNA, 22 nt, Human
ccacccugguuacugugccagg

SEQ ID NO: 196453 - RNA, 22 nt, Human
ccaccucuaccuggccggccuu

SEQ ID NO: 196454 - RNA, 22 nt, Human
ccaccacugaggcacaggagcc

SEQ ID NO: 196455 - RNA, 22 nt, Human
ccauggaaaagacgggcaggcc

SEQ ID NO: 196456 - RNA, 22 nt, Human
ccaucuuugcucuuuuauugca

SEQ ID NO: 196457 - RNA, 22 nt, Human
ccaguuuuuccagugcuuucug

SEQ ID NO: 196458 - RNA, 21 nt, Human
ccacaucaugucaccuccuag

SEQ ID NO: 196459 - RNA, 22 nt, Human
ccagaacgacgggcagaggcgc

SEQ ID NO: 196460 - RNA, 22 nt, Human
ccagaacguuugugcgaggcag

SEQ ID NO: 196461 - RNA, 16 nt, Human
cccaccuggacuaccu

SEQ ID NO: 196462 - RNA, 22 nt, Human
cccagaagaguauguguuugcu

SEQ ID NO: 196463 - RNA, 18 nt, Human
cccaccugcccagguuca

SEQ ID NO: 196464 - RNA, 22 nt, Human
cccaaccagaaauugacagaga

SEQ ID NO: 196465 - RNA, 22 nt, Human
ccauggauacuaagguauguga

SEQ ID NO: 196466 - RNA, 22 nt, Human
ccauuucacaucccugacaugu

SEQ ID NO: 196467 - RNA, 22 nt, Human
ccacuuugagaagcugaugaaa

SEQ ID NO: 196468 - RNA, 22 nt, Human
ccagggagggccacagggccau

SEQ ID NO: 196469 - RNA, 22 nt, Human
ccagggaggucauagugcuggu

SEQ ID NO: 196470 - RNA, 22 nt, Human
ccagggcuggguuugucggugu

SEQ ID NO: 196471 - RNA, 22 nt, Human
ccagggcuggaccagugcuugg

SEQ ID NO: 196472 - RNA, 22 nt, Human
ccagggcuggaggaggucagga

SEQ ID NO: 196473 - RNA, 22 nt, Human
ccaaccaguuaucuccuaaggu

SEQ ID NO: 196474 - RNA, 22 nt, Human
ccagguggacggcgaguacagg

SEQ ID NO: 196475 - RNA, 22 nt, Human
ccaaauuaccuucuuggauuca

SEQ ID NO: 196476 - RNA, 22 nt, Human
ccaaagaauuuggaaaaucuga

SEQ ID NO: 196477 - RNA, 19 nt, Human
ccaacaguacugaagcacu

SEQ ID NO: 196478 - RNA, 22 nt, Human
ccaaucaacuguguggcuuucu

SEQ ID NO: 196479 - RNA, 22 nt, Human
ccaguguguuuuucucugacuc

SEQ ID NO: 196480 - RNA, 22 nt, Human
ccacagcauugaaaucuauaau

SEQ ID NO: 196481 - RNA, 22 nt, Human
ccagugcuuccaggaauacggu

SEQ ID NO: 196482 - RNA, 19 nt, Human
ccacacacuggucucuggg

SEQ ID NO: 196483 - RNA, 22 nt, Human
ccaauuuuggaauuauuaggca

SEQ ID NO: 196484 - RNA, 22 nt, Human
ccagucagccuaguucuucuuu

SEQ ID NO: 196485 - RNA, 22 nt, Human
ccagucugccggcccggccccu

SEQ ID NO: 196486 - RNA, 22 nt, Human
ccagugcagacgcggaacuggc

SEQ ID NO: 196487 - RNA, 22 nt, Human
ccagucuuggugucuguagcac

SEQ ID NO: 196488 - RNA, 22 nt, Human
ccagugcaguacaaaccuuagu

SEQ ID NO: 196489 - RNA, 23 nt, Human
ccagcugugccuggcccaggagc

SEQ ID NO: 196490 - RNA, 22 nt, Human
ccaggcagaggggucuggagca

SEQ ID NO: 196491 - RNA, 22 nt, Human
ccaaagaagcaaugagaauagu

SEQ ID NO: 196492 - RNA, 22 nt, Human
ccaaacauuucaaauuuagaga

SEQ ID NO: 196493 - RNA, 22 nt, Human
cauuuugguaauguucguuugc

SEQ ID NO: 196494 - RNA, 22 nt, Human
cauuuuuccucaggcaauuuga

SEQ ID NO: 196495 - RNA, 22 nt, Human
cauuuuuuuuccccuccuggua

SEQ ID NO: 196496 - RNA, 22 nt, Human
ccagcagaagcucccgcugggu

SEQ ID NO: 196497 - RNA, 22 nt, Human
ccagcaaguaagucagugucag

SEQ ID NO: 196498 - RNA, 22 nt, Human
cauuuacguaacaguaacgcug

SEQ ID NO: 196499 - RNA, 22 nt, Human
ccagccacugacugauuuaaaa

SEQ ID NO: 196500 - RNA, 22 nt, Human
ccagccugagcuugcugcccuc

SEQ ID NO: 196501 - RNA, 22 nt, Human
cauuuuccucugcugguguuca

SEQ ID NO: 196502 - RNA, 22 nt, Human
cauuuuaucagcacacgucacu

SEQ ID NO: 196503 - RNA, 22 nt, Human
cauuucuggccuggggagcggg

SEQ ID NO: 196504 - RNA, 22 nt, Human
cauuugcuuaucacucuucuuu

SEQ ID NO: 196505 - RNA, 22 nt, Human
cauuugacaauugggauagauc

SEQ ID NO: 196506 - RNA, 22 nt, Human
cauuuagagaagauuacaagga

SEQ ID NO: 196507 - RNA, 22 nt, Human
cauuuacauaacaguaacgcug

SEQ ID NO: 196508 - RNA, 22 nt, Human
cauugguacaaaauguacuuug

SEQ ID NO: 196509 - RNA, 22 nt, Human
ccagcaagacucgcagugggau

SEQ ID NO: 196510 - RNA, 22 nt, Human
ccagagcaccgaaacgagcuuu

SEQ ID NO: 196511 - RNA, 22 nt, Human
ccagauaaacauuccuuggccu

SEQ ID NO: 196512 - RNA, 22 nt, Human
cauuccuaccauaucugcucuu

SEQ ID NO: 196513 - RNA, 22 nt, Human
ccacuuucuaaauuggcgauuu

SEQ ID NO: 196514 - RNA, 22 nt, Human
cauugcaaccccaaaaagaaca

SEQ ID NO: 196515 - RNA, 19 nt, Human
ccagaagggcaagcaaagg

SEQ ID NO: 196516 - RNA, 20 nt, Human
ccagaagagaagaaaaggaa

SEQ ID NO: 196517 - RNA, 22 nt, Human
cauugcuguuaauugucucuag

SEQ ID NO: 196518 - RNA, 22 nt, Human
cauugcugccaaggugagcugg

SEQ ID NO: 196519 - RNA, 22 nt, Human
cagaacugaauaaagccaggau

SEQ ID NO: 196520 - RNA, 22 nt, Human
cagcacuuccuccgugagcccc

SEQ ID NO: 196521 - RNA, 22 nt, Human
cagcagaggagguggcagcacc

SEQ ID NO: 196522 - RNA, 21 nt, Human
cagcagaaaugagaggagaaa

SEQ ID NO: 196523 - RNA, 22 nt, Human
cagcagaugacuauuggagcug

SEQ ID NO: 196524 - RNA, 21 nt, Human
cagcagaugccagggucucug

SEQ ID NO: 196525 - RNA, 22 nt, Human
cagaaagugauuugcuauucca

SEQ ID NO: 196526 - RNA, 22 nt, Human
cagcacaggugugaggccugau

SEQ ID NO: 196527 - RNA, 22 nt, Human
cacuuagugcuuuuguguuucu

SEQ ID NO: 196528 - RNA, 22 nt, Human
cagaccuggaaaacaggcuugc

SEQ ID NO: 196529 - RNA, 22 nt, Human
cagagaggagcacaaagugaag

SEQ ID NO: 196530 - RNA, 22 nt, Human
cagcccuggccucuucgcuuuc

SEQ ID NO: 196531 - RNA, 22 nt, Human
cagcauugagcacagaaggaaa

SEQ ID NO: 196532 - RNA, 22 nt, Human
cagccagaucgccuuccgccuc

SEQ ID NO: 196533 - RNA, 22 nt, Human
cagccauucuaacacugccagu

SEQ ID NO: 196534 - RNA, 22 nt, Human
caccaccaguaccaucacacgc

SEQ ID NO: 196535 - RNA, 22 nt, Human
caccaucagacuucugggcagg

SEQ ID NO: 196536 - RNA, 20 nt, Human
cacccgguccucagcgacuc

SEQ ID NO: 196537 - RNA, 22 nt, Human
caccccauccccucccaauucc

SEQ ID NO: 196538 - RNA, 23 nt, Human
caccaugacaugccuauagggga

SEQ ID NO: 196539 - RNA, 22 nt, Human
cacgggcgacgugaucuaggac

SEQ ID NO: 196540 - RNA, 22 nt, Human
cagaccagaaggaagccgacaa

SEQ ID NO: 196541 - RNA, 22 nt, Human
caccgaacuuugcaaaugcaau

SEQ ID NO: 196542 - RNA, 22 nt, Human
cagacgguuaaacgauuuugcu

SEQ ID NO: 196543 - RNA, 22 nt, Human
cagagagcguccauccggugcc

SEQ ID NO: 196544 - RNA, 22 nt, Human
cacugcacuccagccugggcaa

SEQ ID NO: 196545 - RNA, 22 nt, Human
cacugcguaguggcccgaagcu

SEQ ID NO: 196546 - RNA, 22 nt, Human
caaacauuuguuggaaccccug

SEQ ID NO: 196547 - RNA, 22 nt, Human
caaagaaccuucgagacagggc

SEQ ID NO: 196548 - RNA, 22 nt, Human
caaugccaggaaccugggggaa

SEQ ID NO: 196549 - RNA, 22 nt, Human
caagccacugggagcugcacac

SEQ ID NO: 196550 - RNA, 22 nt, Human
caaaagcaaagaucuuugauug

SEQ ID NO: 196551 - RNA, 22 nt, Human
cacucuucucucauuuuccuuu

SEQ ID NO: 196552 - RNA, 22 nt, Human
caauuaccaguaauugagguuu

SEQ ID NO: 196553 - RNA, 22 nt, Human
caaugggagaugcagaacagcu

SEQ ID NO: 196554 - RNA, 22 nt, Human
caauggguuuucuauagagugc

SEQ ID NO: 196555 - RNA, 22 nt, Human
cacagcagcaucauuuaucugg

SEQ ID NO: 196556 - RNA, 22 nt, Human
cacugugagugcaagcaggggu

SEQ ID NO: 196557 - RNA, 22 nt, Human
cacuguugagcaauguacagug

SEQ ID NO: 196558 - RNA, 22 nt, Human
cacuuaaaauucagggcuuaua

SEQ ID NO: 196559 - RNA, 22 nt, Human
cacuguugaagauacuuccucu

SEQ ID NO: 196560 - RNA, 22 nt, Human
cacagauaaggcuuugucccca

SEQ ID NO: 196561 - RNA, 22 nt, Human
cacagaauuaagggagaaauau

SEQ ID NO: 196562 - RNA, 22 nt, Human
cacagaggaugcccaagcgauc

SEQ ID NO: 196563 - RNA, 22 nt, Human
cacacguuuagcuucuggcggc

SEQ ID NO: 196564 - RNA, 22 nt, Human
cacugcugaggcccguguuacu

SEQ ID NO: 196565 - RNA, 23 nt, Human
cacuggugggguuuaaaagaagc

SEQ ID NO: 196566 - RNA, 22 nt, Human
cacacagcuagugacaggagaa

SEQ ID NO: 196567 - RNA, 22 nt, Human
cacaugugugugccuacaugca

SEQ ID NO: 196568 - RNA, 22 nt, Human
cacauugguagaauuuagaaga

SEQ ID NO: 196569 - RNA, 22 nt, Human
caccaaaauaucccuuuguaca

SEQ ID NO: 196570 - RNA, 22 nt, Human
cacaucugaaggcggcucuagg

SEQ ID NO: 196571 - RNA, 22 nt, Human
cacauuaagcccaagcauagaa

SEQ ID NO: 196572 - RNA, 22 nt, Human
cacaugugggcacagggcugca

SEQ ID NO: 196573 - RNA, 22 nt, Human
cacauguguaccugccucucug

SEQ ID NO: 196574 - RNA, 22 nt, Human
cagaaguugcuugagagagagc

SEQ ID NO: 196575 - RNA, 22 nt, Human
cagaaauuggcagagaagaccu

SEQ ID NO: 196576 - RNA, 22 nt, Human
cagacagaaggcuccuugaggu

SEQ ID NO: 196577 - RNA, 22 nt, Human
cacagcuggggaagcugaggcc

SEQ ID NO: 196578 - RNA, 22 nt, Human
cacaggacuuggcuucucacag

SEQ ID NO: 196579 - RNA, 23 nt, Human
cacaggcagaaaucaagacggua

SEQ ID NO: 196580 - RNA, 22 nt, Human
cacaguuuuaucuuauacugau

SEQ ID NO: 196581 - RNA, 22 nt, Human
cacuuauuuuuccuuugugauu

SEQ ID NO: 196582 - RNA, 22 nt, Human
cacuucaguacuagaggaugaa

SEQ ID NO: 196583 - RNA, 22 nt, Human
cacuugauugucagaaaaaugg

SEQ ID NO: 196584 - RNA, 22 nt, Human
cagaaaacauuguguguauaag

SEQ ID NO: 196585 - RNA, 22 nt, Human
cagaaacacuguauuuagggaa

SEQ ID NO: 196586 - RNA, 22 nt, Human
cagaaagaaguggggauagagg

SEQ ID NO: 196587 - RNA, 22 nt, Human
caggaguggugagguuagcaga

SEQ ID NO: 196588 - RNA, 19 nt, Human
caggauuguuuaaagcuuu

SEQ ID NO: 196589 - RNA, 22 nt, Human
caggauauguucaagguuuucu

SEQ ID NO: 196590 - RNA, 22 nt, Human
caggcacaagaucggcuagaua

SEQ ID NO: 196591 - RNA, 22 nt, Human
caggauuuaauaagauaguguu

SEQ ID NO: 196592 - RNA, 22 nt, Human
cagggacgugagccaugucagu

SEQ ID NO: 196593 - RNA, 22 nt, Human
cagggagcggggagaucucggg

SEQ ID NO: 196594 - RNA, 22 nt, Human
cagggaaguauuacauguuucc

SEQ ID NO: 196595 - RNA, 22 nt, Human
caggcgcugacgggaccgggcu

SEQ ID NO: 196596 - RNA, 22 nt, Human
caggccccagggacugggcgcu

SEQ ID NO: 196597 - RNA, 22 nt, Human
caggccgccacugcagcagcug

SEQ ID NO: 196598 - RNA, 22 nt, Human
caggcgcauggugagcagauga

SEQ ID NO: 196599 - RNA, 22 nt, Human
cagcuugcccugauguggaaga

SEQ ID NO: 196600 - RNA, 22 nt, Human
caggugcucugauauggggcug

SEQ ID NO: 196601 - RNA, 22 nt, Human
cagcuucacuuaaaacaugcaa

SEQ ID NO: 196602 - RNA, 22 nt, Human
cagcuucaaaggcccugauggu

SEQ ID NO: 196603 - RNA, 22 nt, Human
caggguuuuaguugcagguuau

SEQ ID NO: 196604 - RNA, 22 nt, Human
cagcuuaccucccacagcucuc

SEQ ID NO: 196605 - RNA, 22 nt, Human
cagcuguacgugaucuacaugg

SEQ ID NO: 196606 - RNA, 22 nt, Human
cagcuguggagauggggugcau

SEQ ID NO: 196607 - RNA, 22 nt, Human
cagcugcugguguaucgggucc

SEQ ID NO: 196608 - RNA, 22 nt, Human
cagcucuggcuauugaggacca

SEQ ID NO: 196609 - RNA, 22 nt, Human
cagcuggggagagacauggcag

SEQ ID NO: 196610 - RNA, 22 nt, Human
cagcuggaggagcagcuuccag

SEQ ID NO: 196611 - RNA, 22 nt, Human
cagcgguggcaaggugacugug

SEQ ID NO: 196612 - RNA, 22 nt, Human
cagccuacaucagaauaccaau

SEQ ID NO: 196613 - RNA, 22 nt, Human
cagcuauggaauuggcccagau

SEQ ID NO: 196614 - RNA, 20 nt, Human
cagcagucagcucuccaaug

SEQ ID NO: 196615 - RNA, 22 nt, Human
cagaggauggaaaugagaacaa

SEQ ID NO: 196616 - RNA, 22 nt, Human
cagcuacuaccuguagacaaag

SEQ ID NO: 196617 - RNA, 22 nt, Human
cagagcugagucuucaagguug

SEQ ID NO: 196618 - RNA, 22 nt, Human
cagagcugucauuugccaguga

SEQ ID NO: 196619 - RNA, 22 nt, Human
cagagaugaggcuggcgugguu

SEQ ID NO: 196620 - RNA, 22 nt, Human
cagagcagaaaccugggugauu

SEQ ID NO: 196621 - RNA, 22 nt, Human
cagagccagcuguccuuggcau

SEQ ID NO: 196622 - RNA, 22 nt, Human
cagccuggccucuggauauuug

SEQ ID NO: 196623 - RNA, 22 nt, Human
cagagcucacaaacugaaaacc

SEQ ID NO: 196624 - RNA, 21 nt, Human
cagcccccauacccugcccag

SEQ ID NO: 196625 - RNA, 22 nt, Human
cagccccucuucucuccucgga

SEQ ID NO: 196626 - RNA, 19 nt, Human
caggacaguuugccaagaa

SEQ ID NO: 196627 - RNA, 22 nt, Human
caggagaaauucacauuaguga

SEQ ID NO: 196628 - RNA, 22 nt, Human
cagcaugguggagcugcucuuu

SEQ ID NO: 196629 - RNA, 22 nt, Human
cagcauucuacuuugugaacug

SEQ ID NO: 196630 - RNA, 22 nt, Human
caggugauuuuguuuucaaaug

SEQ ID NO: 196631 - RNA, 22 nt, Human
cauaacuugguguuggaaacug

SEQ ID NO: 196632 - RNA, 22 nt, Human
cagguggccggguaggaggugg

SEQ ID NO: 196633 - RNA, 22 nt, Human
cagguggauggcgagcccugca

SEQ ID NO: 196634 - RNA, 22 nt, Human
cauaagaauauuuaguggcagc

SEQ ID NO: 196635 - RNA, 22 nt, Human
cauaaauuuuaccuuguaagug

SEQ ID NO: 196636 - RNA, 22 nt, Human
cauaucuuaaacaucaucucug

SEQ ID NO: 196637 - RNA, 22 nt, Human
caggugggauuuugcugcuuga

SEQ ID NO: 196638 - RNA, 22 nt, Human
cauagcuagcaccuucuuuucu

SEQ ID NO: 196639 - RNA, 22 nt, Human
caguuaaugauaggaauucggu

SEQ ID NO: 196640 - RNA, 22 nt, Human
caguggaugucucauaguguga

SEQ ID NO: 196641 - RNA, 22 nt, Human
caggguugaugaauugucugua

SEQ ID NO: 196642 - RNA, 22 nt, Human
caguuuccagacauuauugaua

SEQ ID NO: 196643 - RNA, 22 nt, Human
caggaggaggccgggaggaagc

SEQ ID NO: 196644 - RNA, 22 nt, Human
cagguuuggaagucacgaagcu

SEQ ID NO: 196645 - RNA, 20 nt, Human
cagugcccguggaaaagaug

SEQ ID NO: 196646 - RNA, 22 nt, Human
cagugcaacguugugcauucaa

SEQ ID NO: 196647 - RNA, 22 nt, Human
cagucugcuggcuuuuucagca

SEQ ID NO: 196648 - RNA, 22 nt, Human
cagugcuccugccccugcccuu

SEQ ID NO: 196649 - RNA, 22 nt, Human
caggaacucuucugggugcuug

SEQ ID NO: 196650 - RNA, 22 nt, Human
caggaacagcaccaggagcuag

SEQ ID NO: 196651 - RNA, 22 nt, Human
caggacagaaauaaggaauaua

SEQ ID NO: 196652 - RNA, 22 nt, Human
caggacacaaaagguggagaag

SEQ ID NO: 196653 - RNA, 22 nt, Human
caggaacucggagcccaucucu

SEQ ID NO: 196654 - RNA, 22 nt, Human
cagguuguucugggcauggagg

SEQ ID NO: 196655 - RNA, 22 nt, Human
cagguugaaaguggaggagcua

SEQ ID NO: 196656 - RNA, 22 nt, Human
cagguugaagagguuaacgaua

SEQ ID NO: 196657 - RNA, 20 nt, Human
auggaaacacgcagccccaa

SEQ ID NO: 196658 - RNA, 22 nt, Human
augggaggguagagugaacaga

SEQ ID NO: 196659 - RNA, 22 nt, Human
augggaauggauugagugggug

SEQ ID NO: 196660 - RNA, 22 nt, Human
auggccguggccagggucaggg

SEQ ID NO: 196661 - RNA, 22 nt, Human
auggaagagacaaugcuaucug

SEQ ID NO: 196662 - RNA, 22 nt, Human
auggaacccgggcgucugcucu

SEQ ID NO: 196663 - RNA, 22 nt, Human
auggaacauuaaucuucaaaug

SEQ ID NO: 196664 - RNA, 22 nt, Human
augggcauggauggccgagucu

SEQ ID NO: 196665 - RNA, 22 nt, Human
auggaaggggagguagggagga

SEQ ID NO: 196666 - RNA, 22 nt, Human
auggauggaagcagccugaacu

SEQ ID NO: 196667 - RNA, 22 nt, Human
auggauuggguugauggcauac

SEQ ID NO: 196668 - RNA, 19 nt, Human
augguauugcuggguuuuu

SEQ ID NO: 196669 - RNA, 22 nt, Human
augggugggagugaaggggcuc

SEQ ID NO: 196670 - RNA, 22 nt, Human
auggaggaugugcagcaugggc

SEQ ID NO: 196671 - RNA, 22 nt, Human
auggaguguggccaggcaguaa

SEQ ID NO: 196672 - RNA, 22 nt, Human
auggagggguuguugcuugagu

SEQ ID NO: 196673 - RNA, 22 nt, Human
auggacguuuguguauuaugua

SEQ ID NO: 196674 - RNA, 22 nt, Human
auggagcgggaggauggaggag

SEQ ID NO: 196675 - RNA, 22 nt, Human
auggagcagagcugaugggccu

SEQ ID NO: 196676 - RNA, 18 nt, Human
augggggaggaggaaagg

SEQ ID NO: 196677 - RNA, 22 nt, Human
augggcggugcauuugcacagu

SEQ ID NO: 196678 - RNA, 22 nt, Human
auggggaauugaccguggaucu

SEQ ID NO: 196679 - RNA, 22 nt, Human
auggggaucugcaguguugauc

SEQ ID NO: 196680 - RNA, 22 nt, Human
augcuuucucuucuauuucuca

SEQ ID NO: 196681 - RNA, 22 nt, Human
augcugccuaaagcuacuuaca

SEQ ID NO: 196682 - RNA, 22 nt, Human
auggaggagcagaggguuucca

SEQ ID NO: 196683 - RNA, 22 nt, Human
augcccagaacccccuggaugg

SEQ ID NO: 196684 - RNA, 22 nt, Human
augccacuguuuaugucacuua

SEQ ID NO: 196685 - RNA, 22 nt, Human
augccccucucucucccaauca

SEQ ID NO: 196686 - RNA, 22 nt, Human
augccccuuuauauguuaaguc

SEQ ID NO: 196687 - RNA, 22 nt, Human
augcuuuauuggagacagucau

SEQ ID NO: 196688 - RNA, 22 nt, Human
augcugccuccucuucagccgc

SEQ ID NO: 196689 - RNA, 22 nt, Human
augcaugaucccgguaugugaa

SEQ ID NO: 196690 - RNA, 22 nt, Human
auguuuuauacacauguaucac

SEQ ID NO: 196691 - RNA, 22 nt, Human
auguuuucuugucuggagaagu

SEQ ID NO: 196692 - RNA, 22 nt, Human
auuaaaaaaagauaaugaguua

SEQ ID NO: 196693 - RNA, 22 nt, Human
auuaaacuaaauuaugaauugg

SEQ ID NO: 196694 - RNA, 22 nt, Human
auguuguuuauggguuaucaag

SEQ ID NO: 196695 - RNA, 22 nt, Human
auguauguauguauauacacac

SEQ ID NO: 196696 - RNA, 22 nt, Human
augugagcuggaugaauuuaua

SEQ ID NO: 196697 - RNA, 22 nt, Human
augugacaagugugggcagggc

SEQ ID NO: 196698 - RNA, 23 nt, Human
auguagcugcucccgaugcccuc

SEQ ID NO: 196699 - RNA, 22 nt, Human
auguguuuugaccccugcuaaa

SEQ ID NO: 196700 - RNA, 22 nt, Human
auguauauauacauguauugua

SEQ ID NO: 196701 - RNA, 22 nt, Human
augugucauuauccagaauaac

SEQ ID NO: 196702 - RNA, 22 nt, Human
auguguguaugacugaaucuau

SEQ ID NO: 196703 - RNA, 22 nt, Human
augugggugaggaggccauugu

SEQ ID NO: 196704 - RNA, 20 nt, Human
augugcuaauauuaauaugu

SEQ ID NO: 196705 - RNA, 22 nt, Human
augggagggugaggaggcagcu

SEQ ID NO: 196706 - RNA, 22 nt, Human
augggcauacaaaugcuacccu

SEQ ID NO: 196707 - RNA, 22 nt, Human
auggggaggcggauggagugcu

SEQ ID NO: 196708 - RNA, 22 nt, Human
augggcuuuacccucagagcuu

SEQ ID NO: 196709 - RNA, 22 nt, Human
augguguaggugaagagaacau

SEQ ID NO: 196710 - RNA, 22 nt, Human
auggucugcucagucucuugac

SEQ ID NO: 196711 - RNA, 19 nt, Human
augggaagcggccagcgga

SEQ ID NO: 196712 - RNA, 22 nt, Human
augggagggagcagugaguguu

SEQ ID NO: 196713 - RNA, 22 nt, Human
auggugugugugugugugugug

SEQ ID NO: 196714 - RNA, 22 nt, Human
auggcagcggagcuggaaauga

SEQ ID NO: 196715 - RNA, 22 nt, Human
auggugaaaugauuugauguca

SEQ ID NO: 196716 - RNA, 22 nt, Human
auggugaugaugaugaugauaa

SEQ ID NO: 196717 - RNA, 22 nt, Human
auggggucagagaauggugggu

SEQ ID NO: 196718 - RNA, 22 nt, Human
augguaaguuuuuaaaaagcgu

SEQ ID NO: 196719 - RNA, 22 nt, Human
augggggccagggacccuggca

SEQ ID NO: 196720 - RNA, 22 nt, Human
auguccugacaguccaagggcg

SEQ ID NO: 196721 - RNA, 22 nt, Human
augguuacgcccucacccuacc

SEQ ID NO: 196722 - RNA, 22 nt, Human
augguuagauggaugagaugug

SEQ ID NO: 196723 - RNA, 22 nt, Human
augugcucaggucuauaucuca

SEQ ID NO: 196724 - RNA, 22 nt, Human
auguggaaagcuugucuuagag

SEQ ID NO: 196725 - RNA, 22 nt, Human
auguaccgccuuggagaaaugc

SEQ ID NO: 196726 - RNA, 22 nt, Human
augauguuggaauuuuaacuua

SEQ ID NO: 196727 - RNA, 22 nt, Human
augaguuaaguagcccuucaug

SEQ ID NO: 196728 - RNA, 22 nt, Human
augcaggcuaagaguaaagacg

SEQ ID NO: 196729 - RNA, 21 nt, Human
augagguggcuacuaaagagu

SEQ ID NO: 196730 - RNA, 22 nt, Human
augaggagucaaggagucggag

SEQ ID NO: 196731 - RNA, 22 nt, Human
augaggauuagcaucugcaaau

SEQ ID NO: 196732 - RNA, 19 nt, Human
augcacgugaaaugcauuu

SEQ ID NO: 196733 - RNA, 22 nt, Human
augaaacucuagcuuucagcac

SEQ ID NO: 196734 - RNA, 22 nt, Human
augaaacuggagcgccuggagg

SEQ ID NO: 196735 - RNA, 23 nt, Human
augaaaugauacuuuauucacug

SEQ ID NO: 196736 - RNA, 22 nt, Human
aucuuuuuucacaauuuauuuu

SEQ ID NO: 196737 - RNA, 22 nt, Human
augaaaacgugugugugugugu

SEQ ID NO: 196738 - RNA, 22 nt, Human
augaaaacggaccagagcuauu

SEQ ID NO: 196739 - RNA, 22 nt, Human
augcaaaaucuuauuuuuucua

SEQ ID NO: 196740 - RNA, 22 nt, Human
augauaccacucaauagggcau

SEQ ID NO: 196741 - RNA, 22 nt, Human
augaacugcaguauaaacuugg

SEQ ID NO: 196742 - RNA, 22 nt, Human
augaaggauagggcaaaauuuu

SEQ ID NO: 196743 - RNA, 18 nt, Human
augauaauguuugcauca

SEQ ID NO: 196744 - RNA, 20 nt, Human
augaaugcuccccacguuuc

SEQ ID NO: 196745 - RNA, 22 nt, Human
augaauuaucugguguuggaaa

SEQ ID NO: 196746 - RNA, 22 nt, Human
augaaugccggucucgggggaa

SEQ ID NO: 196747 - RNA, 22 nt, Human
aucugugauuuuggcaagauuu

SEQ ID NO: 196748 - RNA, 20 nt, Human
aucugugaugagaacgguuu

SEQ ID NO: 196749 - RNA, 22 nt, Human
augacuauaaauaggagauugu

SEQ ID NO: 196750 - RNA, 22 nt, Human
augaggccacaguuauagauuu

SEQ ID NO: 196751 - RNA, 22 nt, Human
augaggguggggaaugggccau

SEQ ID NO: 196752 - RNA, 22 nt, Human
aucuuguuagaaggcaguaggu

SEQ ID NO: 196753 - RNA, 22 nt, Human
aucuuugccuuuaugccucuag

SEQ ID NO: 196754 - RNA, 22 nt, Human
aucuugaaacauauaugcauuu

SEQ ID NO: 196755 - RNA, 22 nt, Human
aucuuggauccuuugccagcuu

SEQ ID NO: 196756 - RNA, 22 nt, Human
augacugaugcugacucauggg

SEQ ID NO: 196757 - RNA, 22 nt, Human
aucggggaaugaccuuuucauu

SEQ ID NO: 196758 - RNA, 22 nt, Human
aucguggcacgucgccgcagcg

SEQ ID NO: 196759 - RNA, 22 nt, Human
aucuguuccccuaugcucucua

SEQ ID NO: 196760 - RNA, 21 nt, Human
aucugugucauuagguggcag

SEQ ID NO: 196761 - RNA, 23 nt, Human
aucgcccggguccagucccggcu

SEQ ID NO: 196762 - RNA, 22 nt, Human
aucuguggguaaggauaagcau

SEQ ID NO: 196763 - RNA, 22 nt, Human
aucuuagcucaacucucaccaa

SEQ ID NO: 196764 - RNA, 22 nt, Human
aucuacuuugggaguuucucuu

SEQ ID NO: 196765 - RNA, 22 nt, Human
aucuucaggggcaauggagaua

SEQ ID NO: 196766 - RNA, 22 nt, Human
aucuccaguuagcaguacugau

SEQ ID NO: 196767 - RNA, 21 nt, Human
aucucaguccugggaaugauu

SEQ ID NO: 196768 - RNA, 22 nt, Human
aucucacuucugucauguggca

SEQ ID NO: 196769 - RNA, 22 nt, Human
aucuuuguaaguaaucaaagcu

SEQ ID NO: 196770 - RNA, 23 nt, Human
aucugagccuggucccacccgcu

SEQ ID NO: 196771 - RNA, 19 nt, Human
aucuuucagcagcuccccu

SEQ ID NO: 196772 - RNA, 22 nt, Human
aucuuggccuucuccuggagug

SEQ ID NO: 196773 - RNA, 22 nt, Human
aucugugguacaugacggcugc

SEQ ID NO: 196774 - RNA, 22 nt, Human
aucuggaacuucucugcauuga

SEQ ID NO: 196775 - RNA, 22 nt, Human
aucugcuguaguuggugccagu

SEQ ID NO: 196776 - RNA, 22 nt, Human
aucugacaaccuauugacuuga

SEQ ID NO: 196777 - RNA, 22 nt, Human
aucugcauguggcagguggauu

SEQ ID NO: 196778 - RNA, 22 nt, Human
auacacauguuauuguggaagc

SEQ ID NO: 196779 - RNA, 22 nt, Human
auacagacacuguagguuauuu

SEQ ID NO: 196780 - RNA, 22 nt, Human
auacuaagcucauuacauuuug

SEQ ID NO: 196781 - RNA, 22 nt, Human
aucuccagcagugcuuuugagc

SEQ ID NO: 196782 - RNA, 22 nt, Human
auacuuccugcuucccugaucu

SEQ ID NO: 196783 - RNA, 22 nt, Human
auuuuuagagugaaagaauuaa

SEQ ID NO: 196784 - RNA, 22 nt, Human
caaaauuguugaugcugcuuug

SEQ ID NO: 196785 - RNA, 22 nt, Human
caaaggaaagagaaaaagucuu

SEQ ID NO: 196786 - RNA, 22 nt, Human
caaaggaauuacauguuucgga

SEQ ID NO: 196787 - RNA, 22 nt, Human
caaaggagcccuuugccggguu

SEQ ID NO: 196788 - RNA, 22 nt, Human
caaaugaugcauggcuagugag

SEQ ID NO: 196789 - RNA, 22 nt, Human
caaauacguuuggcuggagcac

SEQ ID NO: 196790 - RNA, 22 nt, Human
caaaggauguguagugcaacca

SEQ ID NO: 196791 - RNA, 22 nt, Human
auuuuuuuggucauaugagaua

SEQ ID NO: 196792 - RNA, 22 nt, Human
auuuuuucaugugugguugaga

SEQ ID NO: 196793 - RNA, 22 nt, Human
auuuuucuuucacauuuucuua

SEQ ID NO: 196794 - RNA, 22 nt, Human
caagcacaauuucuacauguua

SEQ ID NO: 196795 - RNA, 22 nt, Human
caaaaaauccauagaaagaggu

SEQ ID NO: 196796 - RNA, 22 nt, Human
caaauguuugguggcauuuugu

SEQ ID NO: 196797 - RNA, 22 nt, Human
caaauggggaauagaugauggg

SEQ ID NO: 196798 - RNA, 22 nt, Human
auuuuugugcuuuauuggggua

SEQ ID NO: 196799 - RNA, 22 nt, Human
auuuucauauggguuauuugua

SEQ ID NO: 196800 - RNA, 22 nt, Human
auuuuauuuugggaucuuuuua

SEQ ID NO: 196801 - RNA, 22 nt, Human
auuuuagagaaacaaacguagg

SEQ ID NO: 196802 - RNA, 23 nt, Human
auuuuuccacacacagacucagu

SEQ ID NO: 196803 - RNA, 22 nt, Human
auuuuaccauuaguuuguaaua

SEQ ID NO: 196804 - RNA, 22 nt, Human
auuuuuagucuugcugcaauca

SEQ ID NO: 196805 - RNA, 21 nt, Human
auuuguggugcaauuguggua

SEQ ID NO: 196806 - RNA, 21 nt, Human
auuuuucagaaggaugugaua

SEQ ID NO: 196807 - RNA, 22 nt, Human
auuuccugugaacuuuucugau

SEQ ID NO: 196808 - RNA, 19 nt, Human
auuuccuggcauauaucac

SEQ ID NO: 196809 - RNA, 22 nt, Human
auuuucuugucucuguuguagg

SEQ ID NO: 196810 - RNA, 22 nt, Human
auuuucuucauuuugauuguau

SEQ ID NO: 196811 - RNA, 17 nt, Human
auuuccgaguuucuuuc

SEQ ID NO: 196812 - RNA, 22 nt, Human
auuuuguugaaacccuuguugu

SEQ ID NO: 196813 - RNA, 22 nt, Human
auuuuggguguuaacaaugaaa

SEQ ID NO: 196814 - RNA, 19 nt, Human
auuuugguucuuuccauuc

SEQ ID NO: 196815 - RNA, 22 nt, Human
auuguuuccccggaauuauuca

SEQ ID NO: 196816 - RNA, 22 nt, Human
auugacagaaaauuggauggca

SEQ ID NO: 196817 - RNA, 19 nt, Human
auugguuugcucgggaaug

SEQ ID NO: 196818 - RNA, 22 nt, Human
auugaauuagauguuguagucc

SEQ ID NO: 196819 - RNA, 22 nt, Human
auugaaguguacguuugaucua

SEQ ID NO: 196820 - RNA, 20 nt, Human
auucuuguuccauuucccag

SEQ ID NO: 196821 - RNA, 19 nt, Human
auucuucucuuccugcugu

SEQ ID NO: 196822 - RNA, 22 nt, Human
auucuuuagaguccuucaaaua

SEQ ID NO: 196823 - RNA, 22 nt, Human
auucuuuauuuucuguacuugc

SEQ ID NO: 196824 - RNA, 22 nt, Human
auugguuucuuguggguuaucc

SEQ ID NO: 196825 - RNA, 22 nt, Human
auuggcugucagcccggauggg

SEQ ID NO: 196826 - RNA, 22 nt, Human
auugcauucaugcuccccuuag

SEQ ID NO: 196827 - RNA, 22 nt, Human
auugcaggucguguggaaguga

SEQ ID NO: 196828 - RNA, 22 nt, Human
auugauuuugugcuuuccuacg

SEQ ID NO: 196829 - RNA, 22 nt, Human
auugaugccugaaaaauaugua

SEQ ID NO: 196830 - RNA, 22 nt, Human
auugaugaaaauaguuauuuua

SEQ ID NO: 196831 - RNA, 22 nt, Human
auugagcuguugaagucccaca

SEQ ID NO: 196832 - RNA, 22 nt, Human
auuuaagugagucuuuaaaaua

SEQ ID NO: 196833 - RNA, 22 nt, Human
auugaguucaccucuuucagaa

SEQ ID NO: 196834 - RNA, 22 nt, Human
auugagaaaauucgagcaaguu

SEQ ID NO: 196835 - RNA, 18 nt, Human
auugagcaugacagaccu

SEQ ID NO: 196836 - RNA, 22 nt, Human
auuugcaucagugagcgaugug

SEQ ID NO: 196837 - RNA, 23 nt, Human
auuugcugaucguagaugacuag

SEQ ID NO: 196838 - RNA, 22 nt, Human
auuguuacuggguuaauuugga

SEQ ID NO: 196839 - RNA, 22 nt, Human
auuugaaguauaaguaauugcu

SEQ ID NO: 196840 - RNA, 22 nt, Human
auuguauugcguuugcgaaugu

SEQ ID NO: 196841 - RNA, 22 nt, Human
auuggagacauuaagucuaaga

SEQ ID NO: 196842 - RNA, 22 nt, Human
auuggccaguggacagcgccgu

SEQ ID NO: 196843 - RNA, 22 nt, Human
auuugcauguuuauuucuuaga

SEQ ID NO: 196844 - RNA, 22 nt, Human
auuucccugcagugcuuaggaa

SEQ ID NO: 196845 - RNA, 22 nt, Human
auuuccagcagcauauuugucu

SEQ ID NO: 196846 - RNA, 22 nt, Human
auuucauaaaaacuuuaccuga

SEQ ID NO: 196847 - RNA, 22 nt, Human
auuuggucuguaauuacaugga

SEQ ID NO: 196848 - RNA, 22 nt, Human
auuucagcagcccauguuugga

SEQ ID NO: 196849 - RNA, 22 nt, Human
auuucauccauuaagaguacuc

SEQ ID NO: 196850 - RNA, 22 nt, Human
auuucauuuuagaaauaagugu

SEQ ID NO: 196851 - RNA, 21 nt, Human
auuuggucaaugucugcguga

SEQ ID NO: 196852 - RNA, 22 nt, Human
auucuacucuuuaaauaugaaa

SEQ ID NO: 196853 - RNA, 22 nt, Human
auucucauguuaccaaauucua

SEQ ID NO: 196854 - RNA, 22 nt, Human
auuaugugagggacuuaaucau

SEQ ID NO: 196855 - RNA, 22 nt, Human
auuauggacuuucuuguuuggg

SEQ ID NO: 196856 - RNA, 22 nt, Human
auuaucuauccgccaacaguaa

SEQ ID NO: 196857 - RNA, 23 nt, Human
auuaugaagaagacucgccuguu

SEQ ID NO: 196858 - RNA, 22 nt, Human
auucuacgcuccgucucuauca

SEQ ID NO: 196859 - RNA, 22 nt, Human
auucgcggcuugaucugcuugc

SEQ ID NO: 196860 - RNA, 22 nt, Human
auucgaucacugccgaggaccu

SEQ ID NO: 196861 - RNA, 22 nt, Human
auuccguuuuaaaaccuuaagc

SEQ ID NO: 196862 - RNA, 22 nt, Human
auuccuguggcuggguaaagua

SEQ ID NO: 196863 - RNA, 21 nt, Human
auuaagacaauggcaaugggu

SEQ ID NO: 196864 - RNA, 22 nt, Human
auuaacaggcucuguucuaguu

SEQ ID NO: 196865 - RNA, 22 nt, Human
auuaaauagcagaagaaagaug

SEQ ID NO: 196866 - RNA, 22 nt, Human
auuaaagcuaguugagauuuaa

SEQ ID NO: 196867 - RNA, 22 nt, Human
auguuguugaacucuuugcaug

SEQ ID NO: 196868 - RNA, 22 nt, Human
auguugcugauccuguggcugu

SEQ ID NO: 196869 - RNA, 20 nt, Human
auuauuucuucugcccaaag

SEQ ID NO: 196870 - RNA, 23 nt, Human
auuauuucaggguuuugacuugc

SEQ ID NO: 196871 - RNA, 22 nt, Human
auuauugcaagcagugaaggga

SEQ ID NO: 196872 - RNA, 22 nt, Human
auucucuguacagaagguaccg

SEQ ID NO: 196873 - RNA, 22 nt, Human
auucuguaggcuuuuguuaaaa

SEQ ID NO: 196874 - RNA, 22 nt, Human
auucugcaauaaucaguccuua

SEQ ID NO: 196875 - RNA, 22 nt, Human
auucuguugguuuaauagucaa

SEQ ID NO: 196876 - RNA, 22 nt, Human
auucuguuuuaccauuuucuuu

SEQ ID NO: 196877 - RNA, 22 nt, Human
auucauuuuuacaucaccaaua

SEQ ID NO: 196878 - RNA, 22 nt, Human
auucuuacaaagcagagucugu

SEQ ID NO: 196879 - RNA, 19 nt, Human
auucaagugcuuagagauc

SEQ ID NO: 196880 - RNA, 22 nt, Human
auucaggacucuuccuugaaga

SEQ ID NO: 196881 - RNA, 22 nt, Human
auucaucuguacuucaauaucu

SEQ ID NO: 196882 - RNA, 22 nt, Human
auucauucugaccucaagagaa

SEQ ID NO: 196883 - RNA, 17 nt, Human
auucaugaacauguccu

SEQ ID NO: 196884 - RNA, 18 nt, Human
auucauuugcguuuggcu

SEQ ID NO: 196885 - RNA, 20 nt, Human
auucuguguaaauguccugu

SEQ ID NO: 196886 - RNA, 22 nt, Human
auucuccucaaaacaucugcug

SEQ ID NO: 196887 - RNA, 22 nt, Human
auugacagagguguaguugaga

SEQ ID NO: 196888 - RNA, 22 nt, Human
auugaagcauggagaugaggca

SEQ ID NO: 196889 - RNA, 22 nt, Human
auucuaugaaugacuguuagau

SEQ ID NO: 196890 - RNA, 22 nt, Human
auucuagaguuucaauccaagg

SEQ ID NO: 196891 - RNA, 22 nt, Human
auucuucauguugaagcuguca

SEQ ID NO: 196892 - RNA, 22 nt, Human
auucccucaagagacccacagc

SEQ ID NO: 196893 - RNA, 22 nt, Human
auucuuuucucuaaaugaugaa

SEQ ID NO: 196894 - RNA, 22 nt, Human
auucuugauauagauaguuaau

SEQ ID NO: 196895 - RNA, 23 nt, Human
auugccuguagaucuucacuuuc

SEQ ID NO: 196896 - RNA, 22 nt, Human
auugccauaauagagccaugua

SEQ ID NO: 196897 - RNA, 21 nt, Human
auuggcagaucucuggauugu

SEQ ID NO: 196898 - RNA, 17 nt, Human
auucuuauacucuguga

SEQ ID NO: 196899 - RNA, 22 nt, Human
auucuuauaaaaaguguugacu

SEQ ID NO: 196900 - RNA, 22 nt, Human
auugaguauuguaaauaaaaca

SEQ ID NO: 196901 - RNA, 19 nt, Human
auugcaguguaaaacuauu

SEQ ID NO: 196902 - RNA, 21 nt, Human
auucugaguugucagucuuca

SEQ ID NO: 196903 - RNA, 22 nt, Human
auucugaagcagaaaaggcaga

SEQ ID NO: 196904 - RNA, 22 nt, Human
auucucugaugcagguggaaga

SEQ ID NO: 196905 - RNA, 21 nt, Human
auucugauguuucuauuguuu

SEQ ID NO: 196906 - RNA, 22 nt, Human
auucugcauuucuaaccagguc

SEQ ID NO: 196907 - RNA, 22 nt, Human
auucugcugccuaguuuaugaa

SEQ ID NO: 196908 - RNA, 22 nt, Human
auucuguuuaauacacgaaagg

SEQ ID NO: 196909 - RNA, 22 nt, Human
auugagacugaaauuacugaag

SEQ ID NO: 196910 - RNA, 22 nt, Human
auugagaugcuuaaaucuucac

SEQ ID NO: 196911 - RNA, 22 nt, Human
uuugugauaaguggauucaagg

SEQ ID NO: 196912 - RNA, 22 nt, Human
uuuguguuacaguccuagaacu

SEQ ID NO: 196913 - RNA, 22 nt, Human
uuucuuccaucuggcuuuauuu

SEQ ID NO: 196914 - RNA, 22 nt, Human
uuucuuccuucuugaucauuug

SEQ ID NO: 196915 - RNA, 22 nt, Human
uuucuguuuguaacuccagcaa

SEQ ID NO: 196916 - RNA, 22 nt, Human
uuucugguuuuauucugggguu

SEQ ID NO: 196917 - RNA, 22 nt, Human
uuucucuuuuugggguggggug

SEQ ID NO: 196918 - RNA, 22 nt, Human
uuucugggggucgugcuggcug

SEQ ID NO: 196919 - RNA, 19 nt, Human
uuucuggguucaccucuug

SEQ ID NO: 196920 - RNA, 22 nt, Human
uuucuguucuguuggauucuuu

SEQ ID NO: 196921 - RNA, 22 nt, Human
uuucuguugugaccugacucuu

SEQ ID NO: 196922 - RNA, 22 nt, Human
uuucuuugggcccuggcagucu

SEQ ID NO: 196923 - RNA, 22 nt, Human
uuucuuugcugguuggcucucc

SEQ ID NO: 196924 - RNA, 22 nt, Human
uuucuugggaaaugucagaagu

SEQ ID NO: 196925 - RNA, 22 nt, Human
uuucuugugauuuugaugaacu

SEQ ID NO: 196926 - RNA, 22 nt, Human
uuucuuuuucuacaccuuagcu

SEQ ID NO: 196927 - RNA, 22 nt, Human
uuugaagaaacagucuuaagag

SEQ ID NO: 196928 - RNA, 22 nt, Human
uuugaaaggagcuuuauccaga

SEQ ID NO: 196929 - RNA, 22 nt, Human
uuucuggaaacuguaaagagga

SEQ ID NO: 196930 - RNA, 22 nt, Human
uuucugcuuucuaguugguguu

SEQ ID NO: 196931 - RNA, 22 nt, Human
uuucuggacuaaagggagagau

SEQ ID NO: 196932 - RNA, 22 nt, Human
uuucuggauaagcagggucucu

SEQ ID NO: 196933 - RNA, 23 nt, Human
uuucugaguuuuuuaaaagucca

SEQ ID NO: 196934 - RNA, 22 nt, Human
uuucugaugaaguagaaagacc

SEQ ID NO: 196935 - RNA, 17 nt, Human
uuucugcaugauuggac

SEQ ID NO: 196936 - RNA, 22 nt, Human
uuucuauuuacagugcuaggua

SEQ ID NO: 196937 - RNA, 22 nt, Human
uuucucuuucaaucugcaguac

SEQ ID NO: 196938 - RNA, 22 nt, Human
uuucugagccacauauaauuug

SEQ ID NO: 196939 - RNA, 22 nt, Human
uuuccuuuguuuugguauaugu

SEQ ID NO: 196940 - RNA, 22 nt, Human
uuuccuucccuccugggccuuc

SEQ ID NO: 196941 - RNA, 22 nt, Human
uuucgggauuucaaagagcaaa

SEQ ID NO: 196942 - RNA, 22 nt, Human
uuuccuguuuugguuuggagag

SEQ ID NO: 196943 - RNA, 22 nt, Human
uuuccugcagacaguuuaagca

SEQ ID NO: 196944 - RNA, 22 nt, Human
uuucuaacacccuccuuccaga

SEQ ID NO: 196945 - RNA, 22 nt, Human
uuucuaaaaccagaguuuauaa

SEQ ID NO: 196946 - RNA, 22 nt, Human
uuucuaaaauuacugcagucgg

SEQ ID NO: 196947 - RNA, 22 nt, Human
uuucuaaguuugaggcgaagca

SEQ ID NO: 196948 - RNA, 21 nt, Human
uuucauaggguuaaaggguua

SEQ ID NO: 196949 - RNA, 21 nt, Human
uuuccagaggcagccggacuc

SEQ ID NO: 196950 - RNA, 22 nt, Human
uuucagcaugacuguuaucuuu

SEQ ID NO: 196951 - RNA, 22 nt, Human
uuucagugaaugaauggcuaac

SEQ ID NO: 196952 - RNA, 22 nt, Human
uuucauagaggcagcggcggau

SEQ ID NO: 196953 - RNA, 22 nt, Human
uuucaugauuaacuuagugaau

SEQ ID NO: 196954 - RNA, 22 nt, Human
uuugcuguccaauauucagggu

SEQ ID NO: 196955 - RNA, 22 nt, Human
uuugcuuugacuuugggaguau

SEQ ID NO: 196956 - RNA, 22 nt, Human
uuuggcaagcagaugaagguag

SEQ ID NO: 196957 - RNA, 22 nt, Human
uuuggaugcugucauaugcugc

SEQ ID NO: 196958 - RNA, 22 nt, Human
uuuggcuacucuucauugguga

SEQ ID NO: 196959 - RNA, 22 nt, Human
uuuggccauuuguaugcaugau

SEQ ID NO: 196960 - RNA, 22 nt, Human
uuugggcuuuguuuuaagguau

SEQ ID NO: 196961 - RNA, 22 nt, Human
uuugggccugucugccugcuuu

SEQ ID NO: 196962 - RNA, 22 nt, Human
uuugggcauuuuuaaggaucuu

SEQ ID NO: 196963 - RNA, 22 nt, Human
uuuguauuucaaggcacucuca

SEQ ID NO: 196964 - RNA, 22 nt, Human
uuugucaucuuccauauuugca

SEQ ID NO: 196965 - RNA, 20 nt, Human
uuugugaggccagagaacag

SEQ ID NO: 196966 - RNA, 22 nt, Human
uuuguacuuucuaauguauuua

SEQ ID NO: 196967 - RNA, 22 nt, Human
uuugauuuuuugagcaguguau

SEQ ID NO: 196968 - RNA, 22 nt, Human
uuugauuuuguuuauagugccg

SEQ ID NO: 196969 - RNA, 20 nt, Human
uuugauugccccucugacuu

SEQ ID NO: 196970 - RNA, 22 nt, Human
uuugcaaaguccauugaaguua

SEQ ID NO: 196971 - RNA, 23 nt, Human
uuugccuaaugaagacuauguca

SEQ ID NO: 196972 - RNA, 22 nt, Human
uuugcuccucuucauuuguauc

SEQ ID NO: 196973 - RNA, 22 nt, Human
uuugcuguaaugcaugucagag

SEQ ID NO: 196974 - RNA, 22 nt, Human
uuucuuaguuaaguagguaggc

SEQ ID NO: 196975 - RNA, 21 nt, Human
uuugacagaccagguauaguu

SEQ ID NO: 196976 - RNA, 22 nt, Human
uuugaagauaaauauggagaaa

SEQ ID NO: 196977 - RNA, 22 nt, Human
uuugaauauacuucaaacaaag

SEQ ID NO: 196978 - RNA, 22 nt, Human
uuugagugccucgaguguggga

SEQ ID NO: 196979 - RNA, 22 nt, Human
uuugaugagaaaugacuuaagu

SEQ ID NO: 196980 - RNA, 22 nt, Human
uuuaccugucuguagaacauaa

SEQ ID NO: 196981 - RNA, 22 nt, Human
uuuaccucguuguguccuuguu

SEQ ID NO: 196982 - RNA, 22 nt, Human
uuguuuaaagaacuucugacuu

SEQ ID NO: 196983 - RNA, 22 nt, Human
uuguucacuaugaagagguugg

SEQ ID NO: 196984 - RNA, 22 nt, Human
uuguuauuauuauuuucguucu

SEQ ID NO: 196985 - RNA, 22 nt, Human
uuguguuuaaucuguuccacua

SEQ ID NO: 196986 - RNA, 22 nt, Human
uuguggcaggauggacagcaga

SEQ ID NO: 196987 - RNA, 22 nt, Human
uuguguugaagugguuagggcg

SEQ ID NO: 196988 - RNA, 22 nt, Human
uuuaccuuauguaaauaagagu

SEQ ID NO: 196989 - RNA, 22 nt, Human
uuuagcaaggagaaauaauccu

SEQ ID NO: 196990 - RNA, 22 nt, Human
uuuaguauaguaugugcucaaa

SEQ ID NO: 196991 - RNA, 22 nt, Human
uuuagcugugugugucgcucca

SEQ ID NO: 196992 - RNA, 22 nt, Human
uuuauauauauguaggagcaca

SEQ ID NO: 196993 - RNA, 22 nt, Human
uuuauaauuguuauguuaccca

SEQ ID NO: 196994 - RNA, 22 nt, Human
uuuauaaacacaagaugggcuc

SEQ ID NO: 196995 - RNA, 22 nt, Human
uuuaugguacaggaaugcuguu

SEQ ID NO: 196996 - RNA, 22 nt, Human
uuuauguugagcaaaauaccac

SEQ ID NO: 196997 - RNA, 22 nt, Human
uuuaugauguagccuagagcug

SEQ ID NO: 196998 - RNA, 22 nt, Human
uuuaucaucuucugaauuugga

SEQ ID NO: 196999 - RNA, 22 nt, Human
uuuauccacucauccaugccuc

SEQ ID NO: 197000 - RNA, 22 nt, Human
uuuauuuggugguguuacuguu

SEQ ID NO: 197001 - RNA, 22 nt, Human
uuuaugucaaaaguaaaaugaa

SEQ ID NO: 197002 - RNA, 22 nt, Human
uuuauuuacuuucgguucugcu

SEQ ID NO: 197003 - RNA, 22 nt, Human
uuuauugcuaugucuugauugu

SEQ ID NO: 197004 - RNA, 22 nt, Human
uuuauuugugguaguguaaucu

SEQ ID NO: 197005 - RNA, 22 nt, Human
uuucagaaauggcacugaaauc

SEQ ID NO: 197006 - RNA, 22 nt, Human
uuucacugaguaggagagcacu

SEQ ID NO: 197007 - RNA, 22 nt, Human
uugucaguggccugaggacaga

SEQ ID NO: 197008 - RNA, 22 nt, Human
uugucagcuagugaugcuguuc

SEQ ID NO: 197009 - RNA, 22 nt, Human
uugucaugauccuucuguuagg

SEQ ID NO: 197010 - RNA, 22 nt, Human
uugucauuuucuuaauguuccu

SEQ ID NO: 197011 - RNA, 22 nt, Human
uuguauguuucugugcacauga

SEQ ID NO: 197012 - RNA, 22 nt, Human
uuguauuaauacacuccuuuuc

SEQ ID NO: 197013 - RNA, 22 nt, Human
uugugcauuugcuaugggccau

SEQ ID NO: 197014 - RNA, 22 nt, Human
uugugccuuaauauaggcgcug

SEQ ID NO: 197015 - RNA, 23 nt, Human
uugugcggugcuuuggguuuaca

SEQ ID NO: 197016 - RNA, 22 nt, Human
uugugcucaguuguggucuauu

SEQ ID NO: 197017 - RNA, 22 nt, Human
uugugcauuuuguuuuacuuau

SEQ ID NO: 197018 - RNA, 22 nt, Human
uugugauuaauaacuuuucucu

SEQ ID NO: 197019 - RNA, 22 nt, Human
uugguguuucacuuccuugucg

SEQ ID NO: 197020 - RNA, 22 nt, Human
uuggggaaaaagaccuaaugac

SEQ ID NO: 197021 - RNA, 22 nt, Human
uuggugauguagcagcaauugu

SEQ ID NO: 197022 - RNA, 22 nt, Human
uuggggaugccccuacgggcua

SEQ ID NO: 197023 - RNA, 22 nt, Human
uuguaaguuuuagguguuucaa

SEQ ID NO: 197024 - RNA, 22 nt, Human
uugguuuuuugguguaucuuau

SEQ ID NO: 197025 - RNA, 22 nt, Human
uugguuuuauucguauuuguau

SEQ ID NO: 197026 - RNA, 19 nt, Human
uugguuuguugcuuaggug

SEQ ID NO: 197027 - RNA, 22 nt, Human
uugguuuacucuggggauaucu

SEQ ID NO: 197028 - RNA, 22 nt, Human
uuggggaauuuggggccguccg

SEQ ID NO: 197029 - RNA, 22 nt, Human
uugggcuagaaacaacgugggu

SEQ ID NO: 197030 - RNA, 22 nt, Human
uugggaaauuugaaaauaaaag

SEQ ID NO: 197031 - RNA, 22 nt, Human
uuggcuucuugcuaggaagcug

SEQ ID NO: 197032 - RNA, 22 nt, Human
uugggagaaaguuaacuuucua

SEQ ID NO: 197033 - RNA, 22 nt, Human
uuggccuuacgcauggucggca

SEQ ID NO: 197034 - RNA, 22 nt, Human
uuggccugcuccagaacaaggg

SEQ ID NO: 197035 - RNA, 22 nt, Human
uuggcguuuccuguucugggug

SEQ ID NO: 197036 - RNA, 21 nt, Human
uuggcuacugcuucagaggga

SEQ ID NO: 197037 - RNA, 22 nt, Human
uuggcuuuucaguuuuaaguua

SEQ ID NO: 197038 - RNA, 22 nt, Human
uuggauguccucuguggaguau

SEQ ID NO: 197039 - RNA, 22 nt, Human
uuggauguggggauggaguggg

SEQ ID NO: 197040 - RNA, 22 nt, Human
uuggccauuacugagccuggag

SEQ ID NO: 197041 - RNA, 22 nt, Human
uuggauugugaaaguauucucu

SEQ ID NO: 197042 - RNA, 22 nt, Human
uuggaggcagagucuugcugag

SEQ ID NO: 197043 - RNA, 23 nt, Human
uugaucuggaaaauacuuguuug

SEQ ID NO: 197044 - RNA, 22 nt, Human
uugauggaggaaaaguuggaau

SEQ ID NO: 197045 - RNA, 20 nt, Human
uugauucacaaaaagcuuag

SEQ ID NO: 197046 - RNA, 22 nt, Human
uugauuugcagaagguguagag

SEQ ID NO: 197047 - RNA, 22 nt, Human
uugagaugacuuaaaucacugu

SEQ ID NO: 197048 - RNA, 22 nt, Human
uugaccauguggcccaggccaa

SEQ ID NO: 197049 - RNA, 22 nt, Human
uugaccagaaaaguuaguaauu

SEQ ID NO: 197050 - RNA, 22 nt, Human
uugacguccucgauggggaacu

SEQ ID NO: 197051 - RNA, 22 nt, Human
uuuuuuuccaguuauucauuuu

SEQ ID NO: 197052 - RNA, 20 nt, Human
uugagccucauggauugucu

SEQ ID NO: 197053 - RNA, 22 nt, Human
uugauagauuuuagaggcaggc

SEQ ID NO: 197054 - RNA, 22 nt, Human
uugaugacauuuagcauaauug

SEQ ID NO: 197055 - RNA, 22 nt, Human
uugaugagucacuuucuguaaa

SEQ ID NO: 197056 - RNA, 22 nt, Human
uugaauaguuuuggauagcaua

SEQ ID NO: 197057 - RNA, 22 nt, Human
uugaauaaggcauaaagauacu

SEQ ID NO: 197058 - RNA, 22 nt, Human
uuuuuuaaucaaguaggaaaca

SEQ ID NO: 197059 - RNA, 20 nt, Human
uuuuuuaaauagagcuguug

SEQ ID NO: 197060 - RNA, 22 nt, Human
uuuuuuccagcuucuagaggcc

SEQ ID NO: 197061 - RNA, 22 nt, Human
uuuuuuccugguuacagauugu

SEQ ID NO: 197062 - RNA, 22 nt, Human
uugaacaguuuugucagguuca

SEQ ID NO: 197063 - RNA, 22 nt, Human
uugaaaaaauguguuuaaggag

SEQ ID NO: 197064 - RNA, 22 nt, Human
uugaacauuagaauaaguaauu

SEQ ID NO: 197065 - RNA, 22 nt, Human
uuuuuggacccaucuucuuuuu

SEQ ID NO: 197066 - RNA, 22 nt, Human
uuuuugggaagaauucugauau

SEQ ID NO: 197067 - RNA, 22 nt, Human
uuuuugggccaaauauauuuac

SEQ ID NO: 197068 - RNA, 21 nt, Human
uugaaguggguagcuggcggg

SEQ ID NO: 197069 - RNA, 22 nt, Human
uuuuucuuugcuuuccacuggc

SEQ ID NO: 197070 - RNA, 22 nt, Human
uucuuugcucaccugccgcucc

SEQ ID NO: 197071 - RNA, 22 nt, Human
uucuuugcccauguuuccuaag

SEQ ID NO: 197072 - RNA, 21 nt, Human
uucuuugcugcuguuuuugua

SEQ ID NO: 197073 - RNA, 22 nt, Human
uuuuucugccucucucccacau

SEQ ID NO: 197074 - RNA, 22 nt, Human
uucuuuuaauagagauccugug

SEQ ID NO: 197075 - RNA, 22 nt, Human
uuuuugcccuaaagaagucauu

SEQ ID NO: 197076 - RNA, 22 nt, Human
uuuuugcuuuuuugucaucuaa

SEQ ID NO: 197077 - RNA, 22 nt, Human
uucuuuuaauuucugucugcag

SEQ ID NO: 197078 - RNA, 22 nt, Human
uucuucuguuggcagagcauac

SEQ ID NO: 197079 - RNA, 22 nt, Human
uucuucauucccuuacuuccga

SEQ ID NO: 197080 - RNA, 22 nt, Human
uucuugcgaaagaaugagcuga

SEQ ID NO: 197081 - RNA, 22 nt, Human
uucuucuucuuccucauccuca

SEQ ID NO: 197082 - RNA, 22 nt, Human
uuuuuaaaauuaggacggcacg

SEQ ID NO: 197083 - RNA, 22 nt, Human
uucuugucuuuguuauguagga

SEQ ID NO: 197084 - RNA, 23 nt, Human
uucuuuccuuaucccauuuacuu

SEQ ID NO: 197085 - RNA, 22 nt, Human
uuuucucaguuuuuuucaaaag

SEQ ID NO: 197086 - RNA, 22 nt, Human
uucuggaguuugaagaucaggu

SEQ ID NO: 197087 - RNA, 22 nt, Human
uuuucuucucauucugaccuca

SEQ ID NO: 197088 - RNA, 22 nt, Human
uuuucuugagucacuccaguga

SEQ ID NO: 197089 - RNA, 22 nt, Human
uuuucuguuuaugaaauugugu

SEQ ID NO: 197090 - RNA, 22 nt, Human
uuuucuucggugcuggguugau

SEQ ID NO: 197091 - RNA, 22 nt, Human
uuuuccuugagucggggcacag

SEQ ID NO: 197092 - RNA, 22 nt, Human
uuuucuacaaaucuggacuuuu

SEQ ID NO: 197093 - RNA, 22 nt, Human
uucugagccacaguaaggaucu

SEQ ID NO: 197094 - RNA, 22 nt, Human
uuuucuacaaucacucuggaag

SEQ ID NO: 197095 - RNA, 22 nt, Human
uucuuauuuuucguaaauccug

SEQ ID NO: 197096 - RNA, 22 nt, Human
uuuugcuucuaguauauuuuuu

SEQ ID NO: 197097 - RNA, 22 nt, Human
uucuguuuuuauucuaucucug

SEQ ID NO: 197098 - RNA, 22 nt, Human
uuuugccuauuguaucaucgua

SEQ ID NO: 197099 - RNA, 22 nt, Human
uucugugacgcaaagcugggaa

SEQ ID NO: 197100 - RNA, 22 nt, Human
uuuuagaagcauuuaugagauu

SEQ ID NO: 197101 - RNA, 22 nt, Human
uuuuacuuuucccacuuacagc

SEQ ID NO: 197102 - RNA, 23 nt, Human
uuuuacaagagugcauuugucuc

SEQ ID NO: 197103 - RNA, 22 nt, Human
uucggugagcugcgggcgagga

SEQ ID NO: 197104 - RNA, 22 nt, Human
uucggcagaaagucauuugucu

SEQ ID NO: 197105 - RNA, 22 nt, Human
uuuuaauucaacauuugcuuuu

SEQ ID NO: 197106 - RNA, 22 nt, Human
uucgucauuaugcagccuguga

SEQ ID NO: 197107 - RNA, 22 nt, Human
uucucucaguuaaacuuuguga

SEQ ID NO: 197108 - RNA, 22 nt, Human
uuuuccuuagaaauacauugau

SEQ ID NO: 197109 - RNA, 22 nt, Human
uuuuccgaccuuaggaaggaac

SEQ ID NO: 197110 - RNA, 22 nt, Human
uuuuauguuccugaagcuaucu

SEQ ID NO: 197111 - RNA, 22 nt, Human
uuuucaguuccaucucugcucu

SEQ ID NO: 197112 - RNA, 22 nt, Human
uucuauaagagaugaauacagu

SEQ ID NO: 197113 - RNA, 22 nt, Human
uucgcggccaggcggggaggcc

SEQ ID NO: 197114 - RNA, 21 nt, Human
uucgaaugggucguugcugcc

SEQ ID NO: 197115 - RNA, 22 nt, Human
uuuuaaauggcuuuuacuuuuc

SEQ ID NO: 197116 - RNA, 22 nt, Human
uuccuuuucuucuaccacaugu

SEQ ID NO: 197117 - RNA, 20 nt, Human
uuccuuucuuucuuuuuuuu

SEQ ID NO: 197118 - RNA, 19 nt, Human
uuccuuucuauccugggua

SEQ ID NO: 197119 - RNA, 20 nt, Human
uuccuuaucuguaaagugga

SEQ ID NO: 197120 - RNA, 22 nt, Human
uuccuggaguggagggagguga

SEQ ID NO: 197121 - RNA, 17 nt, Human
uuuguuucauacuucau

SEQ ID NO: 197122 - RNA, 22 nt, Human
uuuguuugcugagugaauucaa

SEQ ID NO: 197123 - RNA, 22 nt, Human
uuuuaaaacaugucaaaaugug

SEQ ID NO: 197124 - RNA, 22 nt, Human
uuccucauuuggcacaucugag

SEQ ID NO: 197125 - RNA, 22 nt, Human
uuccucauucuggggcauguug

SEQ ID NO: 197126 - RNA, 22 nt, Human
uuccugacacuggcaggcuucu

SEQ ID NO: 197127 - RNA, 21 nt, Human
uuccuccucuggagaagaaga

SEQ ID NO: 197128 - RNA, 22 nt, Human
uuccucauuuauaggaaagaga

SEQ ID NO: 197129 - RNA, 22 nt, Human
uuccagcaaagguaguguguua

SEQ ID NO: 197130 - RNA, 22 nt, Human
uuccagaacaauguggacguau

SEQ ID NO: 197131 - RNA, 22 nt, Human
uuugugguuuugagagaguugc

SEQ ID NO: 197132 - RNA, 22 nt, Human
uuccaggacuggguguuugaag

SEQ ID NO: 197133 - RNA, 22 nt, Human
uuccagauguuuaaguucugcu

SEQ ID NO: 197134 - RNA, 22 nt, Human
uucauuagcacauuuccuuggu

SEQ ID NO: 197135 - RNA, 22 nt, Human
uuccacaugaucauuguaauaa

SEQ ID NO: 197136 - RNA, 22 nt, Human
uucaugucuuugauucugauaa

SEQ ID NO: 197137 - RNA, 21 nt, Human
uucauucauggcauaauauag

SEQ ID NO: 197138 - RNA, 22 nt, Human
uucaucuucaaaccccagugcc

SEQ ID NO: 197139 - RNA, 20 nt, Human
uucaugcagugguugcugug

SEQ ID NO: 197140 - RNA, 22 nt, Human
uucaugcaagagugugaggucc

SEQ ID NO: 197141 - RNA, 22 nt, Human
uuccauggggcuguugcgcaga

SEQ ID NO: 197142 - RNA, 22 nt, Human
uuccaugccuaagagccugaag

SEQ ID NO: 197143 - RNA, 22 nt, Human
uucccagggaucucuaguauuu

SEQ ID NO: 197144 - RNA, 18 nt, Human
uuccauuuuucagucuuc

SEQ ID NO: 197145 - RNA, 22 nt, Human
uucccauuccagcucgaucaau

SEQ ID NO: 197146 - RNA, 21 nt, Human
uuuguucaggggcaaaguuaa

SEQ ID NO: 197147 - RNA, 22 nt, Human
uuuguucaccuagcaaacuuuu

SEQ ID NO: 197148 - RNA, 22 nt, Human
uuccccgagccuggggaagcug

SEQ ID NO: 197149 - RNA, 22 nt, Human
uuuguucaguuuguugugggug

SEQ ID NO: 197150 - RNA, 22 nt, Human
uucccggccgccccccgcucgg

SEQ ID NO: 197151 - RNA, 19 nt, Human
uuuguuguaucagagcuuu

SEQ ID NO: 197152 - RNA, 22 nt, Human
uucauauuuaauuggucaucaa

SEQ ID NO: 197153 - RNA, 22 nt, Human
uucaucauuuuccauuccucuu

SEQ ID NO: 197154 - RNA, 22 nt, Human
uucagguuauugaagagcuuuc

SEQ ID NO: 197155 - RNA, 22 nt, Human
uucagguuuuaugguaaugcuu

SEQ ID NO: 197156 - RNA, 22 nt, Human
uuuggcgucucucaggagcuca

SEQ ID NO: 197157 - RNA, 22 nt, Human
uucaggacuauccaguggucuc

SEQ ID NO: 197158 - RNA, 20 nt, Human
uucaggaccuuccaguccau

SEQ ID NO: 197159 - RNA, 22 nt, Human
uucaggaaacaaauuugcaguu

SEQ ID NO: 197160 - RNA, 22 nt, Human
uuuggcugucauuugaaaaugu

SEQ ID NO: 197161 - RNA, 22 nt, Human
uuuggcuuugauccuaggauuc

SEQ ID NO: 197162 - RNA, 22 nt, Human
uuuggcuaccugggagggaaag

SEQ ID NO: 197163 - RNA, 22 nt, Human
uuugcugggaagccuucacucu

SEQ ID NO: 197164 - RNA, 19 nt, Human
uuugccugugguucagaag

SEQ ID NO: 197165 - RNA, 22 nt, Human
uuugccggaucugucuccagcu

SEQ ID NO: 197166 - RNA, 22 nt, Human
uucagcugcuugccugaaguca

SEQ ID NO: 197167 - RNA, 22 nt, Human
uuugcugaaaaaccacuugagu

SEQ ID NO: 197168 - RNA, 22 nt, Human
uuuggaggaaugaguuuaauau

SEQ ID NO: 197169 - RNA, 22 nt, Human
uucagcacuggacagcgagucu

SEQ ID NO: 197170 - RNA, 22 nt, Human
uucagaugcuugauuauggcaa

SEQ ID NO: 197171 - RNA, 22 nt, Human
uuugccccacaggcagcuuugg

SEQ ID NO: 197172 - RNA, 22 nt, Human
uucagcaagugucucuacuguc

SEQ ID NO: 197173 - RNA, 22 nt, Human
uucagauuuguuuuuguuucug

SEQ ID NO: 197174 - RNA, 22 nt, Human
uuuauuugggauuucucaucug

SEQ ID NO: 197175 - RNA, 22 nt, Human
uuuauucacuuaucaggaacga

SEQ ID NO: 197176 - RNA, 22 nt, Human
uuaguuacuugacucaagaccc

SEQ ID NO: 197177 - RNA, 20 nt, Human
uucacagaucucuaacugag

SEQ ID NO: 197178 - RNA, 22 nt, Human
uucagaaagugaaucuuguuau

SEQ ID NO: 197179 - RNA, 22 nt, Human
uuugccaucagaugugguaggu

SEQ ID NO: 197180 - RNA, 22 nt, Human
uucacucagagcaggacagccc

SEQ ID NO: 197181 - RNA, 22 nt, Human
uucaccucuuuuuggggacauc

SEQ ID NO: 197182 - RNA, 22 nt, Human
uucacguuguugaagaaaauac

SEQ ID NO: 197183 - RNA, 22 nt, Human
uucacccuucucuggcuuucag

SEQ ID NO: 197184 - RNA, 22 nt, Human
uugggucaugggaucccagcau

SEQ ID NO: 197185 - RNA, 22 nt, Human
uuggggcugcguguuuccaugu

SEQ ID NO: 197186 - RNA, 22 nt, Human
uuggguaacuucccagaggguc

SEQ ID NO: 197187 - RNA, 22 nt, Human
uugguauucaguuggauuugga

SEQ ID NO: 197188 - RNA, 22 nt, Human
uuggucaagacugauaucaaga

SEQ ID NO: 197189 - RNA, 22 nt, Human
uugucaggaacuaugauuaugc

SEQ ID NO: 197190 - RNA, 22 nt, Human
uuguauuguuugcgucuguguu

SEQ ID NO: 197191 - RNA, 22 nt, Human
uguuguucuuuuucuucuuguu

SEQ ID NO: 197192 - RNA, 22 nt, Human
uuaaaagaauccuguuauccuc

SEQ ID NO: 197193 - RNA, 22 nt, Human
uuguggacgcaauucaaggaua

SEQ ID NO: 197194 - RNA, 23 nt, Human
uugugguuauauuugcccauuuu

SEQ ID NO: 197195 - RNA, 22 nt, Human
uguuuuuucccccccuucuaaa

SEQ ID NO: 197196 - RNA, 22 nt, Human
uguuuuucaagcauuuauuaau

SEQ ID NO: 197197 - RNA, 22 nt, Human
uguuuucaucucucacccagaa

SEQ ID NO: 197198 - RNA, 22 nt, Human
uguuuguuuuguauuuuuaauu

SEQ ID NO: 197199 - RNA, 22 nt, Human
uguuuucuuuccccuucuuuuc

SEQ ID NO: 197200 - RNA, 22 nt, Human
uguuuucccacugguuuguaca

SEQ ID NO: 197201 - RNA, 22 nt, Human
uugugacaauacagcauggaga

SEQ ID NO: 197202 - RNA, 21 nt, Human
uugugaaaguccaggaacaac

SEQ ID NO: 197203 - RNA, 22 nt, Human
uguguuuaaacuauaugccugc

SEQ ID NO: 197204 - RNA, 22 nt, Human
uguguucagaagaggcugccgg

SEQ ID NO: 197205 - RNA, 22 nt, Human
uuggcaaaaauacuguaggccu

SEQ ID NO: 197206 - RNA, 22 nt, Human
uuggcaaaagauuggguacuua

SEQ ID NO: 197207 - RNA, 22 nt, Human
uuggcacagagcugcagccugg

SEQ ID NO: 197208 - RNA, 22 nt, Human
uuggcaaagagaugcauaagga

SEQ ID NO: 197209 - RNA, 20 nt, Human
uuggggacaggagugugaug

SEQ ID NO: 197210 - RNA, 22 nt, Human
uuggggaggaagauagggugaa

SEQ ID NO: 197211 - RNA, 22 nt, Human
uuggggagaagagcuggucagg

SEQ ID NO: 197212 - RNA, 19 nt, Human
uguucuacuugcuaguauu

SEQ ID NO: 197213 - RNA, 22 nt, Human
uuggcgcuauuauuaccacauu

SEQ ID NO: 197214 - RNA, 22 nt, Human
uguuccacgcguaguuccugcu

SEQ ID NO: 197215 - RNA, 22 nt, Human
uguuccucuuagucuuaugugu

SEQ ID NO: 197216 - RNA, 22 nt, Human
uguucaguuugcuaucauaauc

SEQ ID NO: 197217 - RNA, 22 nt, Human
uguuccaacuacugaauuggca

SEQ ID NO: 197218 - RNA, 22 nt, Human
uuggccaaggaccuuuuuggag

SEQ ID NO: 197219 - RNA, 23 nt, Human
uguuaucacauguuccuuuaaau

SEQ ID NO: 197220 - RNA, 22 nt, Human
uuggacugguuuacauuucaag

SEQ ID NO: 197221 - RNA, 19 nt, Human
uguguaccuaauguuugug

SEQ ID NO: 197222 - RNA, 22 nt, Human
uguguauguauguauguaugua

SEQ ID NO: 197223 - RNA, 21 nt, Human
uguguaccuucuuccgagcuc

SEQ ID NO: 197224 - RNA, 22 nt, Human
uuggagaaagcugcaggcucug

SEQ ID NO: 197225 - RNA, 22 nt, Human
uugccuguuugagagcuguguu

SEQ ID NO: 197226 - RNA, 22 nt, Human
uugcggaucuucauggccucag

SEQ ID NO: 197227 - RNA, 22 nt, Human
uuggaagagagauggggagaga

SEQ ID NO: 197228 - RNA, 22 nt, Human
uuggaaauguagaaaagcagau

SEQ ID NO: 197229 - RNA, 22 nt, Human
uguguguuguuuugccagaaua

SEQ ID NO: 197230 - RNA, 22 nt, Human
uguguguucauccccucaacau

SEQ ID NO: 197231 - RNA, 22 nt, Human
uguguuacaauaauggcaagua

SEQ ID NO: 197232 - RNA, 19 nt, Human
uguguguguuuuguuugaa

SEQ ID NO: 197233 - RNA, 22 nt, Human
uguguguguguguguaauauau

SEQ ID NO: 197234 - RNA, 17 nt, Human
uguguauucuccaggug

SEQ ID NO: 197235 - RNA, 22 nt, Human
ugugucgccaacaauugugucu

SEQ ID NO: 197236 - RNA, 22 nt, Human
ugugugcacguacauacuguau

SEQ ID NO: 197237 - RNA, 22 nt, Human
uguguguaugagcauuuguaug

SEQ ID NO: 197238 - RNA, 22 nt, Human
uguguguguauacauguauaua

SEQ ID NO: 197239 - RNA, 22 nt, Human
uguguguguccucauuugcaga

SEQ ID NO: 197240 - RNA, 22 nt, Human
uuguuuuaguagaaguuacaug

SEQ ID NO: 197241 - RNA, 22 nt, Human
uuuaaaacagcauuuaaaaggu

SEQ ID NO: 197242 - RNA, 22 nt, Human
uuguuuuucucuagggaaggcu

SEQ ID NO: 197243 - RNA, 22 nt, Human
uuaauauuaagauauugagugg

SEQ ID NO: 197244 - RNA, 22 nt, Human
uuaaucagacauucucaaguuu

SEQ ID NO: 197245 - RNA, 22 nt, Human
uuguuuuaaaaagaauaacuac

SEQ ID NO: 197246 - RNA, 22 nt, Human
uuguuuguaaggcucuuagaau

SEQ ID NO: 197247 - RNA, 22 nt, Human
uuaaugcauguaaaugugcaaa

SEQ ID NO: 197248 - RNA, 21 nt, Human
uuaaugcuaugcagaaaaucu

SEQ ID NO: 197249 - RNA, 22 nt, Human
uuaauguuuuagaaugagagug

SEQ ID NO: 197250 - RNA, 22 nt, Human
uuaauguugacacacuagcaca

SEQ ID NO: 197251 - RNA, 22 nt, Human
uuuaaaauguuuuauuuauuua

SEQ ID NO: 197252 - RNA, 22 nt, Human
uuuaaaccuaucuaagaaauag

SEQ ID NO: 197253 - RNA, 22 nt, Human
uuuaaauaguugguuuuuuugc

SEQ ID NO: 197254 - RNA, 22 nt, Human
uuuaaauuucugaaucuugagg

SEQ ID NO: 197255 - RNA, 22 nt, Human
uuguuuggcaaaugugugugug

SEQ ID NO: 197256 - RNA, 22 nt, Human
uuguugcaagccuggaaucugg

SEQ ID NO: 197257 - RNA, 22 nt, Human
uuaaguauggaggccuaacuga

SEQ ID NO: 197258 - RNA, 22 nt, Human
uuaaguccuugguaauuuucuu

SEQ ID NO: 197259 - RNA, 22 nt, Human
uuaauaaauugugguaccagag

SEQ ID NO: 197260 - RNA, 22 nt, Human
uuguuccuuucuucuguagucg

SEQ ID NO: 197261 - RNA, 22 nt, Human
uuguuccuaguuguccaucaca

SEQ ID NO: 197262 - RNA, 22 nt, Human
uuaaagaguuuauuacuuguaa

SEQ ID NO: 197263 - RNA, 22 nt, Human
uuaaaucaggcaucauuucagu

SEQ ID NO: 197264 - RNA, 22 nt, Human
uuaaggcuguggggauuacugc

SEQ ID NO: 197265 - RNA, 23 nt, Human
uuaagacuggcugaacuuaguag

SEQ ID NO: 197266 - RNA, 22 nt, Human
uuaagagaagaguaucuagaac

SEQ ID NO: 197267 - RNA, 22 nt, Human
uuaaacauuuccacuugccagu

SEQ ID NO: 197268 - RNA, 22 nt, Human
uuacuguguguaaaauaucuuu

SEQ ID NO: 197269 - RNA, 18 nt, Human
uuuacgaacucacuugag

SEQ ID NO: 197270 - RNA, 22 nt, Human
uuuacuauuaguauuucauuuu

SEQ ID NO: 197271 - RNA, 22 nt, Human
uuuacuuguuuugcucuuuucc

SEQ ID NO: 197272 - RNA, 19 nt, Human
uuuacuuaggccacagaau

SEQ ID NO: 197273 - RNA, 22 nt, Human
uuuacuuuugguaaggucauuu

SEQ ID NO: 197274 - RNA, 22 nt, Human
uuuagaaugaaugcaagagaau

SEQ ID NO: 197275 - RNA, 22 nt, Human
uuuaauuauaucugggcaguua

SEQ ID NO: 197276 - RNA, 22 nt, Human
uuuaauauucucuuugaaggaa

SEQ ID NO: 197277 - RNA, 22 nt, Human
uuuaauauuacacuuaccuugu

SEQ ID NO: 197278 - RNA, 21 nt, Human
uuaauugagggauggggguga

SEQ ID NO: 197279 - RNA, 22 nt, Human
uuuaacauaugaaagaauauuu

SEQ ID NO: 197280 - RNA, 22 nt, Human
uuuaaguuaguauggguuaggu

SEQ ID NO: 197281 - RNA, 22 nt, Human
uuuaagguacagcuagcagcau

SEQ ID NO: 197282 - RNA, 22 nt, Human
uuuaaucaauaaccuccugggu

SEQ ID NO: 197283 - RNA, 19 nt, Human
uuacaugacauaugaagga

SEQ ID NO: 197284 - RNA, 22 nt, Human
uuacaucacuuuacuuaauaau

SEQ ID NO: 197285 - RNA, 22 nt, Human
uuuaaugaugucuaugccuguu

SEQ ID NO: 197286 - RNA, 22 nt, Human
uuuagguuguguucuggcaugu

SEQ ID NO: 197287 - RNA, 22 nt, Human
uuuagcaaaaaagcucugcgua

SEQ ID NO: 197288 - RNA, 22 nt, Human
uuuagauguucccucuacccug

SEQ ID NO: 197289 - RNA, 22 nt, Human
uuacuuacagggggucaggcug

SEQ ID NO: 197290 - RNA, 22 nt, Human
uuacuguaggugggugaauuug

SEQ ID NO: 197291 - RNA, 22 nt, Human
uuacuuucugggauaucaaaug

SEQ ID NO: 197292 - RNA, 22 nt, Human
uuaguauuuuuugaaugaugaa

SEQ ID NO: 197293 - RNA, 22 nt, Human
uuuauguuuguuuuugaaauaa

SEQ ID NO: 197294 - RNA, 22 nt, Human
uuaggcugcuuuggaaaacugu

SEQ ID NO: 197295 - RNA, 22 nt, Human
uuuagugaagcuuugcauuuca

SEQ ID NO: 197296 - RNA, 22 nt, Human
uuuaguugcuuuaguugagcug

SEQ ID NO: 197297 - RNA, 22 nt, Human
uugaaagucuaagaauagguau

SEQ ID NO: 197298 - RNA, 22 nt, Human
uguagcaauauaucagugcaca

SEQ ID NO: 197299 - RNA, 22 nt, Human
uugaagccaccacuguaaguca

SEQ ID NO: 197300 - RNA, 22 nt, Human
uugaagaagucaaaagcugcag

SEQ ID NO: 197301 - RNA, 22 nt, Human
uguacauacauagauauacaca

SEQ ID NO: 197302 - RNA, 22 nt, Human
uguacauuuacaaaagcuuuau

SEQ ID NO: 197303 - RNA, 22 nt, Human
uugaaaaaaucugaggaggacc

SEQ ID NO: 197304 - RNA, 22 nt, Human
uugaaaaaugcccagcagacaa

SEQ ID NO: 197305 - RNA, 22 nt, Human
uguagaaguuaauugaugagua

SEQ ID NO: 197306 - RNA, 22 nt, Human
ugguucugucugugcugggggg

SEQ ID NO: 197307 - RNA, 17 nt, Human
ugguucuuuuccugacc

SEQ ID NO: 197308 - RNA, 22 nt, Human
ugguugagguugacucuauaua

SEQ ID NO: 197309 - RNA, 22 nt, Human
ugguugcaguggugcuuauaca

SEQ ID NO: 197310 - RNA, 22 nt, Human
ugguugggguaacaaaaaggaa

SEQ ID NO: 197311 - RNA, 22 nt, Human
uguaaucaugguagaggcaaag

SEQ ID NO: 197312 - RNA, 22 nt, Human
uucuuuguccuagcauucuaca

SEQ ID NO: 197313 - RNA, 22 nt, Human
uucuugcuucucugucugccuc

SEQ ID NO: 197314 - RNA, 22 nt, Human
uucuugcuuccggugcuccagg

SEQ ID NO: 197315 - RNA, 22 nt, Human
ugguuauauaaggauuaaauac

SEQ ID NO: 197316 - RNA, 23 nt, Human
uggugugaggaaggaagacuuua

SEQ ID NO: 197317 - RNA, 22 nt, Human
uggugugggauccugggaagga

SEQ ID NO: 197318 - RNA, 22 nt, Human
ugguuauggaacuggcuauggc

SEQ ID NO: 197319 - RNA, 22 nt, Human
ugguucggcuguaaguauaucu

SEQ ID NO: 197320 - RNA, 22 nt, Human
ugguucuagaugagaugaugag

SEQ ID NO: 197321 - RNA, 22 nt, Human
uggugcucuugauauauaaggc

SEQ ID NO: 197322 - RNA, 22 nt, Human
uggugcuuuuguggaugcuaac

SEQ ID NO: 197323 - RNA, 20 nt, Human
uucuguggcccguuuaagug

SEQ ID NO: 197324 - RNA, 22 nt, Human
uggucuccucuuaauugccuac

SEQ ID NO: 197325 - RNA, 22 nt, Human
uggucuuuccuucauuguccag

SEQ ID NO: 197326 - RNA, 22 nt, Human
uucugugcugagaaauagagag

SEQ ID NO: 197327 - RNA, 22 nt, Human
uucugugacuccucagagauuu

SEQ ID NO: 197328 - RNA, 22 nt, Human
uggugcacgugggcagucggcc

SEQ ID NO: 197329 - RNA, 22 nt, Human
uugcagugucaucuagacgugg

SEQ ID NO: 197330 - RNA, 22 nt, Human
uugcauauguccagccaugcau

SEQ ID NO: 197331 - RNA, 22 nt, Human
ugucuucauuccccaugaaguc

SEQ ID NO: 197332 - RNA, 22 nt, Human
uugcagcuguugcaaagucucu

SEQ ID NO: 197333 - RNA, 22 nt, Human
uugcaucaaauauguaccacag

SEQ ID NO: 197334 - RNA, 22 nt, Human
uugcaucagcaggcauaauugg

SEQ ID NO: 197335 - RNA, 23 nt, Human
uugcauuaauguggaggcacagg

SEQ ID NO: 197336 - RNA, 22 nt, Human
uugccaggagacaucuggagcc

SEQ ID NO: 197337 - RNA, 22 nt, Human
uugccaggggacaucuggagcc

SEQ ID NO: 197338 - RNA, 22 nt, Human
ugucuuaugcugcauagacuau

SEQ ID NO: 197339 - RNA, 22 nt, Human
ugucuuaggcuccgccggccca

SEQ ID NO: 197340 - RNA, 20 nt, Human
ugucugugugugauaauagu

SEQ ID NO: 197341 - RNA, 22 nt, Human
uugauuuggcguuuuccuccug

SEQ ID NO: 197342 - RNA, 20 nt, Human
ugucugguaagacgcccauc

SEQ ID NO: 197343 - RNA, 22 nt, Human
uugauuggguauaaugacagga

SEQ ID NO: 197344 - RNA, 22 nt, Human
uugauucauuuguucccauuuu

SEQ ID NO: 197345 - RNA, 22 nt, Human
ugucugaauuguaauguugcgu

SEQ ID NO: 197346 - RNA, 21 nt, Human
ugucugcaauuccagggaacc

SEQ ID NO: 197347 - RNA, 22 nt, Human
ugucugauccuucaggagcccc

SEQ ID NO: 197348 - RNA, 20 nt, Human
uugaggagauauugaauacu

SEQ ID NO: 197349 - RNA, 22 nt, Human
ugucagccacggugugaccggc

SEQ ID NO: 197350 - RNA, 22 nt, Human
uugauaacuuagcugggcugcu

SEQ ID NO: 197351 - RNA, 22 nt, Human
uugaugacuaaagaaagcugcu

SEQ ID NO: 197352 - RNA, 22 nt, Human
ugucauuggugaucugaugccu

SEQ ID NO: 197353 - RNA, 22 nt, Human
ugucauuuauucucuuauucua

SEQ ID NO: 197354 - RNA, 22 nt, Human
ugucccuggacuccaggagcca

SEQ ID NO: 197355 - RNA, 22 nt, Human
uugacacauggcuucaauugca

SEQ ID NO: 197356 - RNA, 22 nt, Human
ugucacaccuggcgauaauggg

SEQ ID NO: 197357 - RNA, 22 nt, Human
uugagcagccauuagcuggggu

SEQ ID NO: 197358 - RNA, 22 nt, Human
uugaaggugggaggauuuauau

SEQ ID NO: 197359 - RNA, 22 nt, Human
uugaauuuagguuuaugugaaa

SEQ ID NO: 197360 - RNA, 23 nt, Human
uguauacacccugugcaucuggg

SEQ ID NO: 197361 - RNA, 22 nt, Human
uugaaucauauguaauugacuu

SEQ ID NO: 197362 - RNA, 22 nt, Human
uuccucuugaaucugucugacu

SEQ ID NO: 197363 - RNA, 22 nt, Human
uuccugcuggucaaaguugccu

SEQ ID NO: 197364 - RNA, 22 nt, Human
uuccugaucuuuucccagaguu

SEQ ID NO: 197365 - RNA, 19 nt, Human
uuccucaggugugaguuag

SEQ ID NO: 197366 - RNA, 22 nt, Human
uucccuagagagauuuuuauuc

SEQ ID NO: 197367 - RNA, 22 nt, Human
uucccugggggggccgcuuucc

SEQ ID NO: 197368 - RNA, 18 nt, Human
ugggacucugacuugguu

SEQ ID NO: 197369 - RNA, 22 nt, Human
ugggacaugaugcauuugaaag

SEQ ID NO: 197370 - RNA, 22 nt, Human
uuccuuuaaccaagagcaguac

SEQ ID NO: 197371 - RNA, 21 nt, Human
uuccuggaggcagaaacguga

SEQ ID NO: 197372 - RNA, 22 nt, Human
ugggauucugaaaauggauuac

SEQ ID NO: 197373 - RNA, 18 nt, Human
uucgucauggggaucgua

SEQ ID NO: 197374 - RNA, 22 nt, Human
uucgucaauaugcagccuguga

SEQ ID NO: 197375 - RNA, 22 nt, Human
uucgcucuucacacagugcuga

SEQ ID NO: 197376 - RNA, 22 nt, Human
uggcugggagcuggaacugggc

SEQ ID NO: 197377 - RNA, 22 nt, Human
uggcugaugucuguucuguuau

SEQ ID NO: 197378 - RNA, 22 nt, Human
uggcuguuggagcuggaagaug

SEQ ID NO: 197379 - RNA, 22 nt, Human
uggcuuuuuauuccuaugugau

SEQ ID NO: 197380 - RNA, 22 nt, Human
ugggaacuggaaaaaaugaagu

SEQ ID NO: 197381 - RNA, 22 nt, Human
ugggaaacucuaaacuugagua

SEQ ID NO: 197382 - RNA, 22 nt, Human
ugggaaggggagcuggaaagga

SEQ ID NO: 197383 - RNA, 22 nt, Human
ugggaagaguuagagacagcug

SEQ ID NO: 197384 - RNA, 22 nt, Human
uggcugagcugcagcguggcuu

SEQ ID NO: 197385 - RNA, 22 nt, Human
uuaugugcuacacauaauuugu

SEQ ID NO: 197386 - RNA, 22 nt, Human
uucauuuccauuuuauagauaa

SEQ ID NO: 197387 - RNA, 22 nt, Human
uucuggggccgugacgaggggc

SEQ ID NO: 197388 - RNA, 22 nt, Human
ugguauauuugaccauaugugu

SEQ ID NO: 197389 - RNA, 22 nt, Human
uucuguacuagaucuuaucagu

SEQ ID NO: 197390 - RNA, 22 nt, Human
ugguaugaaggaggccggcagc

SEQ ID NO: 197391 - RNA, 22 nt, Human
uggucacgucgggguauugcca

SEQ ID NO: 197392 - RNA, 22 nt, Human
ugguccgagaacuguccugguu

SEQ ID NO: 197393 - RNA, 22 nt, Human
ugguauaaaaauuugugaaugu

SEQ ID NO: 197394 - RNA, 22 nt, Human
ugguagcaggugcuaaaggccu

SEQ ID NO: 197395 - RNA, 22 nt, Human
ugguacaaaaaagauuuuggac

SEQ ID NO: 197396 - RNA, 22 nt, Human
ugguaauuuaacaaaauuguca

SEQ ID NO: 197397 - RNA, 17 nt, Human
uucugcucaggaacaga

SEQ ID NO: 197398 - RNA, 23 nt, Human
uucugcuucccauagcacuuugu

SEQ ID NO: 197399 - RNA, 22 nt, Human
uggguucugaucccaggacugc

SEQ ID NO: 197400 - RNA, 22 nt, Human
uggguucaaauccugguuccac

SEQ ID NO: 197401 - RNA, 22 nt, Human
uggguuaaaguuugucacugac

SEQ ID NO: 197402 - RNA, 22 nt, Human
uucuccccacuccucccucuga

SEQ ID NO: 197403 - RNA, 22 nt, Human
uggguuaaaaguugaaugaauu

SEQ ID NO: 197404 - RNA, 22 nt, Human
uggguguguccauauuuugacu

SEQ ID NO: 197405 - RNA, 22 nt, Human
uggguggauucgggaacuuguu

SEQ ID NO: 197406 - RNA, 22 nt, Human
uggguggugaaauggaugggaa

SEQ ID NO: 197407 - RNA, 22 nt, Human
ugggugugcaccuacgaucucu

SEQ ID NO: 197408 - RNA, 22 nt, Human
uggguguggaagcagcgugggg

SEQ ID NO: 197409 - RNA, 22 nt, Human
ugggugugggguaggguaagag

SEQ ID NO: 197410 - RNA, 22 nt, Human
uucuccugacuggccauucagu

SEQ ID NO: 197411 - RNA, 22 nt, Human
uggguagggagcuggaauccua

SEQ ID NO: 197412 - RNA, 22 nt, Human
uucucaagccuuccuuucccaa

SEQ ID NO: 197413 - RNA, 22 nt, Human
uggggcgccuggcugaggcugc

SEQ ID NO: 197414 - RNA, 21 nt, Human
uucuauauugagaauuggcua

SEQ ID NO: 197415 - RNA, 22 nt, Human
uuauaguuuucaaggauuggag

SEQ ID NO: 197416 - RNA, 22 nt, Human
uuauauuaaaaaucgcuaacag

SEQ ID NO: 197417 - RNA, 22 nt, Human
uuauaucagaaggugagauuga

SEQ ID NO: 197418 - RNA, 22 nt, Human
uggacagguacuucacauuauu

SEQ ID NO: 197419 - RNA, 22 nt, Human
uggacagugguggggaggagga

SEQ ID NO: 197420 - RNA, 22 nt, Human
uggaaugaaagaaaaauuguag

SEQ ID NO: 197421 - RNA, 22 nt, Human
uggaauuaucugaagugauuug

SEQ ID NO: 197422 - RNA, 22 nt, Human
uuauaagugccucuuuauuuuc

SEQ ID NO: 197423 - RNA, 22 nt, Human
uggagagauagucauucuagag

SEQ ID NO: 197424 - RNA, 22 nt, Human
uuaucagggaguuguguguucu

SEQ ID NO: 197425 - RNA, 22 nt, Human
uuaucaaaaaauaguacuuuga

SEQ ID NO: 197426 - RNA, 19 nt, Human
uuauccggacuuaauuuau

SEQ ID NO: 197427 - RNA, 22 nt, Human
uggaaggggagcuggaaagggg

SEQ ID NO: 197428 - RNA, 22 nt, Human
uggaagggagcuggaauuugga

SEQ ID NO: 197429 - RNA, 21 nt, Human
uggaagggaagucuugguugu

SEQ ID NO: 197430 - RNA, 22 nt, Human
uggaaggggccaggcgcggagu

SEQ ID NO: 197431 - RNA, 22 nt, Human
uggaagggguuacgcagcagga

SEQ ID NO: 197432 - RNA, 22 nt, Human
uuaguuagucuaugccugacca

SEQ ID NO: 197433 - RNA, 22 nt, Human
uuaguuaauaaauauugagugu

SEQ ID NO: 197434 - RNA, 22 nt, Human
uuaguuaccacugcagaucuuu

SEQ ID NO: 197435 - RNA, 22 nt, Human
uuagugucugacgcaggcgcca

SEQ ID NO: 197436 - RNA, 22 nt, Human
uuagucauucccucuugauauu

SEQ ID NO: 197437 - RNA, 22 nt, Human
uuaguccuaaauuuagauuuuc

SEQ ID NO: 197438 - RNA, 22 nt, Human
uggaagaagcuacaagcgguga

SEQ ID NO: 197439 - RNA, 23 nt, Human
uuagcccaggcuggagguagccc

SEQ ID NO: 197440 - RNA, 21 nt, Human
uuagcaguuguugauuuccag

SEQ ID NO: 197441 - RNA, 22 nt, Human
uuaggaauugcuucauguuugg

SEQ ID NO: 197442 - RNA, 22 nt, Human
uuaggcuaauagagauggaaug

SEQ ID NO: 197443 - RNA, 22 nt, Human
uuagauaaaucagcccugagua

SEQ ID NO: 197444 - RNA, 22 nt, Human
uuagaguucaagcuuuaggaaa

SEQ ID NO: 197445 - RNA, 22 nt, Human
uggaagaaaacuuggaaggcau

SEQ ID NO: 197446 - RNA, 22 nt, Human
uggaacuagugucugagauggg

SEQ ID NO: 197447 - RNA, 22 nt, Human
uuagaugaaaaucggaacaugu

SEQ ID NO: 197448 - RNA, 22 nt, Human
uuagaugcugugauuuuucaaa

SEQ ID NO: 197449 - RNA, 22 nt, Human
uuagaugugaucagcuggcuua

SEQ ID NO: 197450 - RNA, 22 nt, Human
uuagcagacagauggagagaga

SEQ ID NO: 197451 - RNA, 22 nt, Human
uggaacugguuugcuucagacu

SEQ ID NO: 197452 - RNA, 22 nt, Human
uggaaaugcuuagaggugaucu

SEQ ID NO: 197453 - RNA, 22 nt, Human
uuagagaagcacuguaggugaa

SEQ ID NO: 197454 - RNA, 22 nt, Human
uuagaauggaaucauuugcauu

SEQ ID NO: 197455 - RNA, 22 nt, Human
uggaaaggcccauaaaaggaua

SEQ ID NO: 197456 - RNA, 22 nt, Human
uuagaaauguccuacuaauaug

SEQ ID NO: 197457 - RNA, 22 nt, Human
uggaaauacaagaaguauguca

SEQ ID NO: 197458 - RNA, 22 nt, Human
uuacuuuuuucccccuuagaug

SEQ ID NO: 197459 - RNA, 22 nt, Human
uggaaagcagcccugcucccca

SEQ ID NO: 197460 - RNA, 22 nt, Human
uggaaagauuuaaaauaacgag

SEQ ID NO: 197461 - RNA, 22 nt, Human
uggaaagaagacugugguugag

SEQ ID NO: 197462 - RNA, 22 nt, Human
uuacaugcuugugcagguuuug

SEQ ID NO: 197463 - RNA, 22 nt, Human
uuaccgagaacaugacuggaau

SEQ ID NO: 197464 - RNA, 22 nt, Human
ugcuuguuuuguggcuucagcu

SEQ ID NO: 197465 - RNA, 22 nt, Human
ugcuuuauucgacaucugguag

SEQ ID NO: 197466 - RNA, 21 nt, Human
ugcuuucugugcuuuuucugc

SEQ ID NO: 197467 - RNA, 22 nt, Human
ugcuuuccuucccuauguugag

SEQ ID NO: 197468 - RNA, 22 nt, Human
uuacccuugaauuugugacaaa

SEQ ID NO: 197469 - RNA, 22 nt, Human
ugcuuuuguaucagaguauuca

SEQ ID NO: 197470 - RNA, 22 nt, Human
uggaaaagaugucuuccugaau

SEQ ID NO: 197471 - RNA, 21 nt, Human
uuacuggcagcagaaaccuga

SEQ ID NO: 197472 - RNA, 22 nt, Human
ugcuuuggcccaacauugaugc

SEQ ID NO: 197473 - RNA, 23 nt, Human
uuacuaugaaaauuccagucacu

SEQ ID NO: 197474 - RNA, 22 nt, Human
uuaccuuuucuuguuuacaagu

SEQ ID NO: 197475 - RNA, 21 nt, Human
uuacuaagagagcagagggac

SEQ ID NO: 197476 - RNA, 22 nt, Human
uuaccuuggaccggguaucaga

SEQ ID NO: 197477 - RNA, 22 nt, Human
uuaccugcagagacguggaggc

SEQ ID NO: 197478 - RNA, 22 nt, Human
ugcuuacgcaaccuguguuugg

SEQ ID NO: 197479 - RNA, 22 nt, Human
ugcuuacauuuugcuggucucc

SEQ ID NO: 197480 - RNA, 22 nt, Human
uuaaugauuaauguggacccaa

SEQ ID NO: 197481 - RNA, 22 nt, Human
uuaaugcagguacuguuacaau

SEQ ID NO: 197482 - RNA, 22 nt, Human
uuaauaaggaccugugacaugc

SEQ ID NO: 197483 - RNA, 22 nt, Human
uuaauacugugucuuuuuuaau

SEQ ID NO: 197484 - RNA, 22 nt, Human
uuaauauuuauugguaaucacu

SEQ ID NO: 197485 - RNA, 22 nt, Human
uuaaguauauccauuugacugg

SEQ ID NO: 197486 - RNA, 20 nt, Human
ugcugugugucuacuguggg

SEQ ID NO: 197487 - RNA, 20 nt, Human
ugcuguggguaagcuuuaua

SEQ ID NO: 197488 - RNA, 22 nt, Human
uuaauguggaagaguuuggcua

SEQ ID NO: 197489 - RNA, 22 nt, Human
uuaauucuugagcugucuuucc

SEQ ID NO: 197490 - RNA, 22 nt, Human
uuaauuguuagauagauuauag

SEQ ID NO: 197491 - RNA, 22 nt, Human
ugcuugugcacacacauguuau

SEQ ID NO: 197492 - RNA, 22 nt, Human
ugcuugcuaucuaaguguuuca

SEQ ID NO: 197493 - RNA, 22 nt, Human
ugcuugaggcuugucaucuaac

SEQ ID NO: 197494 - RNA, 22 nt, Human
ugcugguuucugaguaaccaca

SEQ ID NO: 197495 - RNA, 23 nt, Human
uuaaggugccguguaauucaugc

SEQ ID NO: 197496 - RNA, 22 nt, Human
uuaagggauugagauggaauga

SEQ ID NO: 197497 - RNA, 22 nt, Human
uuaacgaauugugcauaauucc

SEQ ID NO: 197498 - RNA, 22 nt, Human
uuaacggugagacgccccaaau

SEQ ID NO: 197499 - RNA, 22 nt, Human
ugcuggagucucuugacccugg

SEQ ID NO: 197500 - RNA, 23 nt, Human
ugcugcuggaguaucuacaaugc

SEQ ID NO: 197501 - RNA, 23 nt, Human
ugcugcgggacccgagcgcgcgc

SEQ ID NO: 197502 - RNA, 22 nt, Human
ugcugcucaagcugcagcaaaa

SEQ ID NO: 197503 - RNA, 22 nt, Human
ugcugcuguuaucauuuuacca

SEQ ID NO: 197504 - RNA, 22 nt, Human
ugcugcuguuuccuacaucuca

SEQ ID NO: 197505 - RNA, 22 nt, Human
uuaaaauuguuaacuuugguga

SEQ ID NO: 197506 - RNA, 21 nt, Human
uguuuuguaauagauacuaug

SEQ ID NO: 197507 - RNA, 22 nt, Human
uguuuuuagcuguuuuuuggau

SEQ ID NO: 197508 - RNA, 22 nt, Human
uguuuuuauucuuaauguuuca

SEQ ID NO: 197509 - RNA, 22 nt, Human
uguuuuuuagagugauacuuuu

SEQ ID NO: 197510 - RNA, 22 nt, Human
uguuuucuauuaccugagauug

SEQ ID NO: 197511 - RNA, 22 nt, Human
uguuugaggugacucuggaaug

SEQ ID NO: 197512 - RNA, 22 nt, Human
uguuugaugugcacgugugugu

SEQ ID NO: 197513 - RNA, 21 nt, Human
uguuugcuuuuggagcaacug

SEQ ID NO: 197514 - RNA, 22 nt, Human
uguuuguaugauggcacaucca

SEQ ID NO: 197515 - RNA, 20 nt, Human
uguuucccaacaccccaaag

SEQ ID NO: 197516 - RNA, 22 nt, Human
ugcucuuucaggcauagaccuu

SEQ ID NO: 197517 - RNA, 22 nt, Human
uguuucaguaugauuuucccuc

SEQ ID NO: 197518 - RNA, 22 nt, Human
uguuuagcucugacuaugugau

SEQ ID NO: 197519 - RNA, 22 nt, Human
uguuuaagugguuaaaggauuc

SEQ ID NO: 197520 - RNA, 22 nt, Human
uguuuaucaguagacucaaguu

SEQ ID NO: 197521 - RNA, 22 nt, Human
ugcugccgccgccaccgccgcc

SEQ ID NO: 197522 - RNA, 22 nt, Human
ugcugcacucacaggaagaguu

SEQ ID NO: 197523 - RNA, 22 nt, Human
ugccuggugcggagugaguggc

SEQ ID NO: 197524 - RNA, 22 nt, Human
ugccugucuaucuuugucaucu

SEQ ID NO: 197525 - RNA, 20 nt, Human
ugcuccaggaacacuggccg

SEQ ID NO: 197526 - RNA, 22 nt, Human
uguguguguguguaugugcgug

SEQ ID NO: 197527 - RNA, 22 nt, Human
ugcuccucugcaugucugcggc

SEQ ID NO: 197528 - RNA, 21 nt, Human
uguuggccuucauucucuguc

SEQ ID NO: 197529 - RNA, 18 nt, Human
uguugguguucacucacu

SEQ ID NO: 197530 - RNA, 23 nt, Human
uguuggcucccagucucccccuc

SEQ ID NO: 197531 - RNA, 22 nt, Human
uguuuaaauagaacauacugca

SEQ ID NO: 197532 - RNA, 22 nt, Human
ugcucgauuauuucauuuugca

SEQ ID NO: 197533 - RNA, 22 nt, Human
ugcuccugaacacagcccuaug

SEQ ID NO: 197534 - RNA, 23 nt, Human
ugcucgccuucaggacuugggcu

SEQ ID NO: 197535 - RNA, 22 nt, Human
ugagaacuguuuugguuugggu

SEQ ID NO: 197536 - RNA, 22 nt, Human
ugagaagaggucuuuugggaug

SEQ ID NO: 197537 - RNA, 20 nt, Human
ugagaaacaagggcuggucu

SEQ ID NO: 197538 - RNA, 23 nt, Human
uggguuucagugccaaugcugcc

SEQ ID NO: 197539 - RNA, 20 nt, Human
uggguucaguuguuucuggc

SEQ ID NO: 197540 - RNA, 22 nt, Human
ugguauaaaaaaaugaguauaa

SEQ ID NO: 197541 - RNA, 22 nt, Human
ugguaaaugucuaacaaucacu

SEQ ID NO: 197542 - RNA, 22 nt, Human
ugguaacgguuuccuugccauu

SEQ ID NO: 197543 - RNA, 21 nt, Human
ugguaaggggauccuguuacu

SEQ ID NO: 197544 - RNA, 22 nt, Human
ugguaaguuacaugucugccuc

SEQ ID NO: 197545 - RNA, 22 nt, Human
ugagaagucagucuauugugaa

SEQ ID NO: 197546 - RNA, 22 nt, Human
ugagaauuuaacuugauuagga

SEQ ID NO: 197547 - RNA, 22 nt, Human
uggguuugcuuguucagguucu

SEQ ID NO: 197548 - RNA, 22 nt, Human
ugguaaaguguacugaauauga

SEQ ID NO: 197549 - RNA, 22 nt, Human
ugguccaaaccagugcuguggu

SEQ ID NO: 197550 - RNA, 22 nt, Human
uggucacagauuuacaggaaug

SEQ ID NO: 197551 - RNA, 22 nt, Human
ugagagcuccacaccuugcccu

SEQ ID NO: 197552 - RNA, 22 nt, Human
ugagaggaagggaaagaugauu

SEQ ID NO: 197553 - RNA, 22 nt, Human
ugagacagaccuuggaccaugu

SEQ ID NO: 197554 - RNA, 22 nt, Human
ugguagacaacagcagugggac

SEQ ID NO: 197555 - RNA, 22 nt, Human
ugacugaggaaggugggguggg

SEQ ID NO: 197556 - RNA, 19 nt, Human
ugacuggguucuaggcagg

SEQ ID NO: 197557 - RNA, 22 nt, Human
ugacuaauacagaaacuacaag

SEQ ID NO: 197558 - RNA, 22 nt, Human
ugacucugaugcaguguguuua

SEQ ID NO: 197559 - RNA, 22 nt, Human
ugggugaugagguccccagccc

SEQ ID NO: 197560 - RNA, 22 nt, Human
uggguguuccuggggugcaagg

SEQ ID NO: 197561 - RNA, 22 nt, Human
ugacuuuucuccucugaaguuu

SEQ ID NO: 197562 - RNA, 22 nt, Human
ugagaaaacaguuuguaauaau

SEQ ID NO: 197563 - RNA, 22 nt, Human
ugaccuuaguuuuuucaaugag

SEQ ID NO: 197564 - RNA, 22 nt, Human
ugacgggacacaggugccaaca

SEQ ID NO: 197565 - RNA, 22 nt, Human
uggguagcucaauagagccaca

SEQ ID NO: 197566 - RNA, 22 nt, Human
ucuuuugaacauccaggauguc

SEQ ID NO: 197567 - RNA, 22 nt, Human
uggcucaguaaucgagucuccu

SEQ ID NO: 197568 - RNA, 22 nt, Human
ugaaagccuacagcucacuguu

SEQ ID NO: 197569 - RNA, 22 nt, Human
ugaaaaaugcuuuaaugcaugu

SEQ ID NO: 197570 - RNA, 22 nt, Human
ucuuuuucccugguuccuuuuu

SEQ ID NO: 197571 - RNA, 22 nt, Human
ugaaaaauauuuuuagaaauaa

SEQ ID NO: 197572 - RNA, 22 nt, Human
uguaagaagaaaaccguaugga

SEQ ID NO: 197573 - RNA, 22 nt, Human
ugauaugguaauaagauauucu

SEQ ID NO: 197574 - RNA, 22 nt, Human
ugauagcaugcucucaguaaaa

SEQ ID NO: 197575 - RNA, 22 nt, Human
ugauaguaucugauuauuucac

SEQ ID NO: 197576 - RNA, 22 nt, Human
ugaugaaguuggaaggaaaguu

SEQ ID NO: 197577 - RNA, 22 nt, Human
ugaucuuugcuuuuggcuuagu

SEQ ID NO: 197578 - RNA, 22 nt, Human
uguacuguuuucuaggcaaaaa

SEQ ID NO: 197579 - RNA, 20 nt, Human
uguacuauaaaagguugagu

SEQ ID NO: 197580 - RNA, 22 nt, Human
ugagguugggaggacugccuaa

SEQ ID NO: 197581 - RNA, 20 nt, Human
ugagucagcugcaugggugg

SEQ ID NO: 197582 - RNA, 22 nt, Human
ugagucugaagagagaauaagg

SEQ ID NO: 197583 - RNA, 22 nt, Human
ugguuuccugauggacacuugg

SEQ ID NO: 197584 - RNA, 23 nt, Human
ugguuuucagaagaccuuguuag

SEQ ID NO: 197585 - RNA, 21 nt, Human
ugguuuuaucuugguggcugc

SEQ ID NO: 197586 - RNA, 22 nt, Human
ugguuuuuuguaggauaaacau

SEQ ID NO: 197587 - RNA, 22 nt, Human
ugguuuucuuaauuagcaguca

SEQ ID NO: 197588 - RNA, 22 nt, Human
uggucggugguguggggaggca

SEQ ID NO: 197589 - RNA, 22 nt, Human
ugguccuuuccauuggagacac

SEQ ID NO: 197590 - RNA, 22 nt, Human
uggucugauggucccaccaccg

SEQ ID NO: 197591 - RNA, 22 nt, Human
uggugccuuccgagagcuguga

SEQ ID NO: 197592 - RNA, 22 nt, Human
uggugcucucgauauauaaggc

SEQ ID NO: 197593 - RNA, 19 nt, Human
uggugcgcuguuccugagc

SEQ ID NO: 197594 - RNA, 22 nt, Human
ugagccauguucaugagguuca

SEQ ID NO: 197595 - RNA, 22 nt, Human
ugagcaaacacagauaggcuua

SEQ ID NO: 197596 - RNA, 22 nt, Human
ugagauuuagaacuggauuuca

SEQ ID NO: 197597 - RNA, 22 nt, Human
ugguucugccacuuuccccuug

SEQ ID NO: 197598 - RNA, 22 nt, Human
ugguuacagaugaagaucggcc

SEQ ID NO: 197599 - RNA, 20 nt, Human
ugguuaaagugggugagcgg

SEQ ID NO: 197600 - RNA, 22 nt, Human
ugagggaagguugauaauguuc

SEQ ID NO: 197601 - RNA, 22 nt, Human
ugagggaggggaaugugugcag

SEQ ID NO: 197602 - RNA, 22 nt, Human
ugguggccucaguggcuucugu

SEQ ID NO: 197603 - RNA, 22 nt, Human
ugaggaugagaaggaagagaag

SEQ ID NO: 197604 - RNA, 22 nt, Human
ugcacacaguucucaggaaaga

SEQ ID NO: 197605 - RNA, 23 nt, Human
ugcaaugcagcuagauguaaaau

SEQ ID NO: 197606 - RNA, 22 nt, Human
ugucuuugaccuuaagaaguuu

SEQ ID NO: 197607 - RNA, 22 nt, Human
ugcagagagccagcucucucgg

SEQ ID NO: 197608 - RNA, 22 nt, Human
ugcagaauauucuggugacaau

SEQ ID NO: 197609 - RNA, 22 nt, Human
ugcagaacacaguagacagaac

SEQ ID NO: 197610 - RNA, 22 nt, Human
ugcagacuguuucuugacugaa

SEQ ID NO: 197611 - RNA, 22 nt, Human
ugcagaggagcuggaaggcugg

SEQ ID NO: 197612 - RNA, 22 nt, Human
ugcagcaucuccuugugccaug

SEQ ID NO: 197613 - RNA, 19 nt, Human
ugcagcacuaaaaacuuuc

SEQ ID NO: 197614 - RNA, 22 nt, Human
ugugagucuugcaggucgcuca

SEQ ID NO: 197615 - RNA, 22 nt, Human
ugugacugaaaaugauugagug

SEQ ID NO: 197616 - RNA, 22 nt, Human
ugugaaggaaaguaggagggac

SEQ ID NO: 197617 - RNA, 22 nt, Human
ugugaagaauuaaugugaauca

SEQ ID NO: 197618 - RNA, 22 nt, Human
ugucuuuuaaaaauguguaaaa

SEQ ID NO: 197619 - RNA, 22 nt, Human
ugugaagugaugggugaccgag

SEQ ID NO: 197620 - RNA, 22 nt, Human
ugugaaugacuuuguucuuugc

SEQ ID NO: 197621 - RNA, 22 nt, Human
ugauuugauuuguuuaugccug

SEQ ID NO: 197622 - RNA, 22 nt, Human
ugaugccauaguaaaauuugcu

SEQ ID NO: 197623 - RNA, 22 nt, Human
ugauggaguauaauaaaaugac

SEQ ID NO: 197624 - RNA, 22 nt, Human
ugauugguauguauguuuguca

SEQ ID NO: 197625 - RNA, 22 nt, Human
ugcaaugagcuucuuugauaaa

SEQ ID NO: 197626 - RNA, 22 nt, Human
ugucauggacuggauuucugcu

SEQ ID NO: 197627 - RNA, 22 nt, Human
uguccuuuauauguuuuuuagu

SEQ ID NO: 197628 - RNA, 22 nt, Human
ugucguaaaagggccgcagugg

SEQ ID NO: 197629 - RNA, 20 nt, Human
ugucccuggagagcugcaga

SEQ ID NO: 197630 - RNA, 22 nt, Human
ugucacguaaaaacuagauuuc

SEQ ID NO: 197631 - RNA, 23 nt, Human
ugucacugcggaguggccugcag

SEQ ID NO: 197632 - RNA, 22 nt, Human
ugucacuuaagguuggugucuc

SEQ ID NO: 197633 - RNA, 21 nt, Human
ugucagaaagccugugacuuu

SEQ ID NO: 197634 - RNA, 22 nt, Human
ugcaaauuuuuuuauuuuuccu

SEQ ID NO: 197635 - RNA, 22 nt, Human
ugucauauagaauguucuauga

SEQ ID NO: 197636 - RNA, 22 nt, Human
ugucaucuuucuaaagcugguc

SEQ ID NO: 197637 - RNA, 22 nt, Human
ugugcugcagcgagagcuacga

SEQ ID NO: 197638 - RNA, 22 nt, Human
ugcagugcagcuggaauaucuu

SEQ ID NO: 197639 - RNA, 22 nt, Human
ugcagugaugcuucuggcucag

SEQ ID NO: 197640 - RNA, 22 nt, Human
ugugcuugucguggagccaggc

SEQ ID NO: 197641 - RNA, 22 nt, Human
ugcaucauuaagguacaguugg

SEQ ID NO: 197642 - RNA, 22 nt, Human
uguggauauauuuuaaaaggaa

SEQ ID NO: 197643 - RNA, 23 nt, Human
ugcaugagcaucuccaccucagu

SEQ ID NO: 197644 - RNA, 22 nt, Human
ugcaugaucucacuuacaggug

SEQ ID NO: 197645 - RNA, 17 nt, Human
ugcaugcgucugugaua

SEQ ID NO: 197646 - RNA, 22 nt, Human
ugugauaauauuauuagagcuc

SEQ ID NO: 197647 - RNA, 22 nt, Human
ugugauugucuucugaaaguca

SEQ ID NO: 197648 - RNA, 22 nt, Human
ugcagcuucucugcaacaggag

SEQ ID NO: 197649 - RNA, 22 nt, Human
ugugauuucaaagggugucuuu

SEQ ID NO: 197650 - RNA, 22 nt, Human
ugugcuauuuuugcauaugugu

SEQ ID NO: 197651 - RNA, 22 nt, Human
ugcaggaacucgaaaacuauag

SEQ ID NO: 197652 - RNA, 22 nt, Human
ugcagcuuuugguuucuagaug

SEQ ID NO: 197653 - RNA, 18 nt, Human
ugcagcuuugugauuggc

SEQ ID NO: 197654 - RNA, 23 nt, Human
ugccggaucuacuuuggguucuc

SEQ ID NO: 197655 - RNA, 22 nt, Human
uguguggaaaugcuguauaugu

SEQ ID NO: 197656 - RNA, 22 nt, Human
ugugucuuuggcgaugucugga

SEQ ID NO: 197657 - RNA, 22 nt, Human
ugugugcuaguuuugucaguau

SEQ ID NO: 197658 - RNA, 22 nt, Human
ugccgcaggaggggcgauuucu

SEQ ID NO: 197659 - RNA, 22 nt, Human
ugcccugucccuagguuugugg

SEQ ID NO: 197660 - RNA, 22 nt, Human
ugcccuuucuccagugaccauu

SEQ ID NO: 197661 - RNA, 22 nt, Human
ugccgcuuucuggcccucaguc

SEQ ID NO: 197662 - RNA, 21 nt, Human
ugccccucuuuucuuuccuuc

SEQ ID NO: 197663 - RNA, 22 nt, Human
uguggugcagcgggaacagcuu

SEQ ID NO: 197664 - RNA, 22 nt, Human
ugcccugaagcugucaauuuug

SEQ ID NO: 197665 - RNA, 22 nt, Human
ugcccugcagacccugcagugu

SEQ ID NO: 197666 - RNA, 22 nt, Human
ugccaaugauuccacaauggaa

SEQ ID NO: 197667 - RNA, 22 nt, Human
ugcauuacuuugauaagcgucu

SEQ ID NO: 197668 - RNA, 22 nt, Human
ugccagcuccgaggagcugcag

SEQ ID NO: 197669 - RNA, 22 nt, Human
ugcaugguuauauacuacuagu

SEQ ID NO: 197670 - RNA, 22 nt, Human
ugcauguuauuguggcaagaau

SEQ ID NO: 197671 - RNA, 22 nt, Human
ugcauguuucuguauguuaaug

SEQ ID NO: 197672 - RNA, 22 nt, Human
ugccaauuaccuauuucugaga

SEQ ID NO: 197673 - RNA, 23 nt, Human
ugccaggaagaaugaccucugcu

SEQ ID NO: 197674 - RNA, 22 nt, Human
ugccagugugccuuccgcucac

SEQ ID NO: 197675 - RNA, 22 nt, Human
ugccagucggcacuuuaucugg

SEQ ID NO: 197676 - RNA, 22 nt, Human
ugccaguaauuguccuguagcu

SEQ ID NO: 197677 - RNA, 19 nt, Human
ugccccacccucuauccag

SEQ ID NO: 197678 - RNA, 22 nt, Human
ugauugauaaugaagacaguca

SEQ ID NO: 197679 - RNA, 22 nt, Human
ugauugaauaauguuaugugaa

SEQ ID NO: 197680 - RNA, 22 nt, Human
ugauugcucgacacucugcuug

SEQ ID NO: 197681 - RNA, 22 nt, Human
ugauugcucagcuagccucuuu

SEQ ID NO: 197682 - RNA, 22 nt, Human
ugauucacagacuucacaaggc

SEQ ID NO: 197683 - RNA, 22 nt, Human
ugauuagccguccuuuuauuaa

SEQ ID NO: 197684 - RNA, 22 nt, Human
ugaugugugaauucuuaaaugu

SEQ ID NO: 197685 - RNA, 22 nt, Human
ugauguuucugaagggguuacu

SEQ ID NO: 197686 - RNA, 22 nt, Human
ugaugaugccaaaauuuggcau

SEQ ID NO: 197687 - RNA, 22 nt, Human
ucauuugggauuuuuuauaauu

SEQ ID NO: 197688 - RNA, 22 nt, Human
ucauuuuaucaggaauggaauc

SEQ ID NO: 197689 - RNA, 22 nt, Human
ugauggaucuguuggcggguuu

SEQ ID NO: 197690 - RNA, 22 nt, Human
ugauggugagaugucccguguu

SEQ ID NO: 197691 - RNA, 22 nt, Human
ugauguaaaauaggaaguucua

SEQ ID NO: 197692 - RNA, 22 nt, Human
ugaucauguucuccaaaagcgu

SEQ ID NO: 197693 - RNA, 22 nt, Human
ugaugaugaagaaauauuauca

SEQ ID NO: 197694 - RNA, 22 nt, Human
ugaucaacagggcuggaaagag

SEQ ID NO: 197695 - RNA, 20 nt, Human
ugauaugcgguacagagagg

SEQ ID NO: 197696 - RNA, 22 nt, Human
ucaucauccuuuuuugaagagu

SEQ ID NO: 197697 - RNA, 22 nt, Human
ucaucagccaaagaguccuuca

SEQ ID NO: 197698 - RNA, 22 nt, Human
ucauauugguagagauguguaa

SEQ ID NO: 197699 - RNA, 17 nt, Human
ugaggcugucucccugg

SEQ ID NO: 197700 - RNA, 21 nt, Human
ugaggccugccagucucagaa

SEQ ID NO: 197701 - RNA, 16 nt, Human
ucauaaacugcagcuu

SEQ ID NO: 197702 - RNA, 22 nt, Human
ugaggcaguucuuacuuguauu

SEQ ID NO: 197703 - RNA, 22 nt, Human
ucauaaguuguugacuagcaaa

SEQ ID NO: 197704 - RNA, 20 nt, Human
ucaguuucccuauuagguug

SEQ ID NO: 197705 - RNA, 22 nt, Human
ucaguuuaucuagcugggggaa

SEQ ID NO: 197706 - RNA, 22 nt, Human
ugagugccagugcuugcucuac

SEQ ID NO: 197707 - RNA, 22 nt, Human
ucaucgauggggagcucuacaa

SEQ ID NO: 197708 - RNA, 22 nt, Human
ucaucuuucuuuauggaaauac

SEQ ID NO: 197709 - RNA, 22 nt, Human
ucaucggcugucaucuucacgu

SEQ ID NO: 197710 - RNA, 22 nt, Human
ugauauaaaagauucuuauuga

SEQ ID NO: 197711 - RNA, 22 nt, Human
ucaugauaauacaggccuucua

SEQ ID NO: 197712 - RNA, 22 nt, Human
ucauguauucugggcaggagau

SEQ ID NO: 197713 - RNA, 22 nt, Human
ucaugggcaaacuuggggauca

SEQ ID NO: 197714 - RNA, 22 nt, Human
ucaugcagauaagaauaaguaa

SEQ ID NO: 197715 - RNA, 22 nt, Human
ucauggcucuaaagacauagau

SEQ ID NO: 197716 - RNA, 22 nt, Human
ucaguguccuucguucuuguug

SEQ ID NO: 197717 - RNA, 22 nt, Human
ucaguuuaauuggaucuuuuuc

SEQ ID NO: 197718 - RNA, 17 nt, Human
ucaguugugcgagcagc

SEQ ID NO: 197719 - RNA, 22 nt, Human
ucaguugagguggucuauugcg

SEQ ID NO: 197720 - RNA, 22 nt, Human
ucaguugauggcaguuaauguc

SEQ ID NO: 197721 - RNA, 22 nt, Human
ugaggaugaggaagaagaagaa

SEQ ID NO: 197722 - RNA, 22 nt, Human
ugaggaggugggcacacagagu

SEQ ID NO: 197723 - RNA, 22 nt, Human
ugaggaggugcuaccagcgucu

SEQ ID NO: 197724 - RNA, 22 nt, Human
ugaggaaugugacaaaaccaag

SEQ ID NO: 197725 - RNA, 22 nt, Human
ugagcagccagucauucaaaaa

SEQ ID NO: 197726 - RNA, 22 nt, Human
ugagccauguucaugaguucau

SEQ ID NO: 197727 - RNA, 22 nt, Human
ugagcagagcacuugggaacga

SEQ ID NO: 197728 - RNA, 19 nt, Human
ugagauuguaugaggagau

SEQ ID NO: 197729 - RNA, 22 nt, Human
ucaguggaacacacagaguggg

SEQ ID NO: 197730 - RNA, 22 nt, Human
ucagucuucaggacuaugaaaa

SEQ ID NO: 197731 - RNA, 22 nt, Human
ucagugauccagauauuugagc

SEQ ID NO: 197732 - RNA, 23 nt, Human
ucagugccaaggagaacuuggug

SEQ ID NO: 197733 - RNA, 22 nt, Human
ucagucucuggggcuucuguuu

SEQ ID NO: 197734 - RNA, 18 nt, Human
ucaguccuccauagagcu

SEQ ID NO: 197735 - RNA, 22 nt, Human
ugagauguaauguaguacuuug

SEQ ID NO: 197736 - RNA, 22 nt, Human
ucagguuuaagugacuggaauc

SEQ ID NO: 197737 - RNA, 22 nt, Human
ugagaaauauacaccagacaca

SEQ ID NO: 197738 - RNA, 22 nt, Human
ugagaacacuuuucucuuugcu

SEQ ID NO: 197739 - RNA, 22 nt, Human
ucuucaucucuaaaaugggaac

SEQ ID NO: 197740 - RNA, 22 nt, Human
ucuucauuucuggggaauuggc

SEQ ID NO: 197741 - RNA, 22 nt, Human
ucuucaugaaauugauugcuua

SEQ ID NO: 197742 - RNA, 22 nt, Human
ucagucauacuuuaugauugaa

SEQ ID NO: 197743 - RNA, 22 nt, Human
ucagucacugucucagacagga

SEQ ID NO: 197744 - RNA, 22 nt, Human
ucaguauaugaauuugggggua

SEQ ID NO: 197745 - RNA, 22 nt, Human
ugagagguagaacuuguagugu

SEQ ID NO: 197746 - RNA, 22 nt, Human
ugagagaauuacuaaagggcuu

SEQ ID NO: 197747 - RNA, 22 nt, Human
ugagacugaguuugguuuuguu

SEQ ID NO: 197748 - RNA, 22 nt, Human
ucagguuuuuaaggagcuagga

SEQ ID NO: 197749 - RNA, 22 nt, Human
ugagacaaaguuguuggauguu

SEQ ID NO: 197750 - RNA, 22 nt, Human
uccagcuucugccugcugcugc

SEQ ID NO: 197751 - RNA, 21 nt, Human
uccaggagcacgggacuagga

SEQ ID NO: 197752 - RNA, 22 nt, Human
uccagccugaacuuuguccaga

SEQ ID NO: 197753 - RNA, 22 nt, Human
uccagccauaucuuguagcccu

SEQ ID NO: 197754 - RNA, 22 nt, Human
ugauuuagguauuuucuuuugu

SEQ ID NO: 197755 - RNA, 22 nt, Human
ugauuugaaaccuuuggcaaga

SEQ ID NO: 197756 - RNA, 22 nt, Human
ugauuucauaugacagcuuuuu

SEQ ID NO: 197757 - RNA, 22 nt, Human
ucccgcccugcguucucccaug

SEQ ID NO: 197758 - RNA, 21 nt, Human
uccccugugccuggcauacag

SEQ ID NO: 197759 - RNA, 22 nt, Human
ucccguuucacuccuugccagc

SEQ ID NO: 197760 - RNA, 22 nt, Human
uccccugccccccauccucugg

SEQ ID NO: 197761 - RNA, 20 nt, Human
ugcacggcugugugugugca

SEQ ID NO: 197762 - RNA, 22 nt, Human
uccccgcuccguagagaaagag

SEQ ID NO: 197763 - RNA, 22 nt, Human
ucccauauuauggggaaaaacu

SEQ ID NO: 197764 - RNA, 22 nt, Human
ucccagguugaggccuugccug

SEQ ID NO: 197765 - RNA, 23 nt, Human
uccccagcugcccgugucccggg

SEQ ID NO: 197766 - RNA, 22 nt, Human
uccccaccuaagauacccaucu

SEQ ID NO: 197767 - RNA, 22 nt, Human
uccccaugaacuuguggcugcu

SEQ ID NO: 197768 - RNA, 22 nt, Human
ucccacgugccaucugcucugu

SEQ ID NO: 197769 - RNA, 22 nt, Human
ugcaauggauaucugaacgugg

SEQ ID NO: 197770 - RNA, 22 nt, Human
ugcauaaauauuguugggagua

SEQ ID NO: 197771 - RNA, 22 nt, Human
ugcagugcagcuggaaguuggc

SEQ ID NO: 197772 - RNA, 22 nt, Human
uccgugguguuggcucuccggc

SEQ ID NO: 197773 - RNA, 18 nt, Human
uccggaggucagaguaaa

SEQ ID NO: 197774 - RNA, 22 nt, Human
uccgaccuuuacuucuugucuc

SEQ ID NO: 197775 - RNA, 22 nt, Human
ugcaggagcaccagcucacccu

SEQ ID NO: 197776 - RNA, 22 nt, Human
ugcaggguuucaauacacagga

SEQ ID NO: 197777 - RNA, 22 nt, Human
uccgcguugguuagagagggcu

SEQ ID NO: 197778 - RNA, 22 nt, Human
uccggcgaccuccagauguucc

SEQ ID NO: 197779 - RNA, 22 nt, Human
ugcaggaagcucagcggggccg

SEQ ID NO: 197780 - RNA, 18 nt, Human
ugcaggggaggggugaua

SEQ ID NO: 197781 - RNA, 22 nt, Human
ugcaggagaaaguacggagcgu

SEQ ID NO: 197782 - RNA, 22 nt, Human
ugcaggagcccaggaauacuau

SEQ ID NO: 197783 - RNA, 22 nt, Human
ucccugagagacuucuuuggcu

SEQ ID NO: 197784 - RNA, 22 nt, Human
ucccugcaggcauguacucuga

SEQ ID NO: 197785 - RNA, 22 nt, Human
ucccugcgugagaaagcacuua

SEQ ID NO: 197786 - RNA, 22 nt, Human
ucccuguuuccugcgcuccuuc

SEQ ID NO: 197787 - RNA, 22 nt, Human
ugcgcgcaccugcauauauaug

SEQ ID NO: 197788 - RNA, 22 nt, Human
ugccuuuggcuguucugugacc

SEQ ID NO: 197789 - RNA, 22 nt, Human
ucgacguuguuuuuucucuguc

SEQ ID NO: 197790 - RNA, 22 nt, Human
uccuuguuggaauauccuuacc

SEQ ID NO: 197791 - RNA, 22 nt, Human
uccuuuauuuaugggcagugua

SEQ ID NO: 197792 - RNA, 22 nt, Human
ugccuguguuugggguggggaa

SEQ ID NO: 197793 - RNA, 17 nt, Human
ugccuucgucuucaguu

SEQ ID NO: 197794 - RNA, 22 nt, Human
ugccucucuggaucugcuguga

SEQ ID NO: 197795 - RNA, 22 nt, Human
ugccuaguuuaaaucauuuucu

SEQ ID NO: 197796 - RNA, 22 nt, Human
uccuuguaccauuugcucacag

SEQ ID NO: 197797 - RNA, 22 nt, Human
uccuugaccuccugacaguaac

SEQ ID NO: 197798 - RNA, 22 nt, Human
uccuggccucugagucaagaac

SEQ ID NO: 197799 - RNA, 22 nt, Human
ugcccuagaucacauuacaggu

SEQ ID NO: 197800 - RNA, 22 nt, Human
ugcauugccucuauucauuaua

SEQ ID NO: 197801 - RNA, 22 nt, Human
uccuacccccuucuccagcucc

SEQ ID NO: 197802 - RNA, 22 nt, Human
ugcaucugagcacuacggugga

SEQ ID NO: 197803 - RNA, 19 nt, Human
ugccccuucuucauccauc

SEQ ID NO: 197804 - RNA, 22 nt, Human
ugcccagcagggagcuaccugg

SEQ ID NO: 197805 - RNA, 22 nt, Human
ugccccagcacauuuacuaucc

SEQ ID NO: 197806 - RNA, 22 nt, Human
uccuccuuuccccgcuggagcc

SEQ ID NO: 197807 - RNA, 22 nt, Human
ugcccacaggaagacaccagcg

SEQ ID NO: 197808 - RNA, 22 nt, Human
uccucgccgucacgcagccucu

SEQ ID NO: 197809 - RNA, 22 nt, Human
uccucccgaaugaguagaaggg

SEQ ID NO: 197810 - RNA, 16 nt, Human
uccucacuguagccug

SEQ ID NO: 197811 - RNA, 22 nt, Human
uccucccugcacucagugaagu

SEQ ID NO: 197812 - RNA, 22 nt, Human
ugccaacaggcuugccugaugu

SEQ ID NO: 197813 - RNA, 22 nt, Human
ucuauuauauuuacacgagagu

SEQ ID NO: 197814 - RNA, 23 nt, Human
ucucaccaggauaugacugucac

SEQ ID NO: 197815 - RNA, 22 nt, Human
ucucaaagguuuuccucuuuuu

SEQ ID NO: 197816 - RNA, 22 nt, Human
ugcugcggcgcaggcacuccag

SEQ ID NO: 197817 - RNA, 22 nt, Human
ugcugcggauauacaggaucug

SEQ ID NO: 197818 - RNA, 22 nt, Human
ucucagaaaugacaggagguac

SEQ ID NO: 197819 - RNA, 22 nt, Human
ucgcgcgugccacgcgccgcgg

SEQ ID NO: 197820 - RNA, 22 nt, Human
ugcggaaggcagcgcagggugg

SEQ ID NO: 197821 - RNA, 20 nt, Human
ucuaggguuugguuaucauc

SEQ ID NO: 197822 - RNA, 19 nt, Human
ucggaaugugggaagcaug

SEQ ID NO: 197823 - RNA, 22 nt, Human
ucgcuucugaguuggugacccc

SEQ ID NO: 197824 - RNA, 22 nt, Human
ucgcuguguccuuuucacuuau

SEQ ID NO: 197825 - RNA, 22 nt, Human
ucgcuugaacccaggaagugga

SEQ ID NO: 197826 - RNA, 22 nt, Human
ucucccaaaucuuucuagcaca

SEQ ID NO: 197827 - RNA, 22 nt, Human
ucuccagcugaggccuucuucc

SEQ ID NO: 197828 - RNA, 22 nt, Human
ugcuguacaagacccucuguuu

SEQ ID NO: 197829 - RNA, 22 nt, Human
ucuccucucugaucuugcuccg

SEQ ID NO: 197830 - RNA, 22 nt, Human
ugcuguugacuuuguuguucuu

SEQ ID NO: 197831 - RNA, 22 nt, Human
ugcugugagaccauuuguugag

SEQ ID NO: 197832 - RNA, 22 nt, Human
ugcugugcuggcggcagaggcc

SEQ ID NO: 197833 - RNA, 22 nt, Human
ugcuggaguggcacuguguggc

SEQ ID NO: 197834 - RNA, 22 nt, Human
ucucauugugcuuuuuguacug

SEQ ID NO: 197835 - RNA, 22 nt, Human
ugcuggagccauguuuucucua

SEQ ID NO: 197836 - RNA, 22 nt, Human
ugcuggaaggguaguauuaacu

SEQ ID NO: 197837 - RNA, 20 nt, Human
ugcugggccaucuugcaugc

SEQ ID NO: 197838 - RNA, 22 nt, Human
ugcugggagcugggccucgaca

SEQ ID NO: 197839 - RNA, 22 nt, Human
ugcuggugauuaaauccugaag

SEQ ID NO: 197840 - RNA, 22 nt, Human
ucucauaauuguuucccagcua

SEQ ID NO: 197841 - RNA, 22 nt, Human
ucucaggcuuccuggugcugug

SEQ ID NO: 197842 - RNA, 22 nt, Human
ucucagcuggcugggagcccug

SEQ ID NO: 197843 - RNA, 22 nt, Human
ugcugcucuucaccauggccuc

SEQ ID NO: 197844 - RNA, 22 nt, Human
ucucauaucuguacacccuugu

SEQ ID NO: 197845 - RNA, 21 nt, Human
ucucauuuuaacacagaguug

SEQ ID NO: 197846 - RNA, 20 nt, Human
ucucauuuugauuucgcauu

SEQ ID NO: 197847 - RNA, 20 nt, Human
ucucuuuuucuucuuuucuc

SEQ ID NO: 197848 - RNA, 22 nt, Human
ugcuuuaccuuccauuuaagga

SEQ ID NO: 197849 - RNA, 22 nt, Human
ucucuucggagagaccuuugga

SEQ ID NO: 197850 - RNA, 22 nt, Human
ucucugugaauggcgucaccug

SEQ ID NO: 197851 - RNA, 22 nt, Human
ugcuuucagauaucuguuucaa

SEQ ID NO: 197852 - RNA, 18 nt, Human
ucugaaggaaugauucca

SEQ ID NO: 197853 - RNA, 23 nt, Human
ugcuuugauuauuauucccaccu

SEQ ID NO: 197854 - RNA, 22 nt, Human
ucugaaaggagaguagggcaga

SEQ ID NO: 197855 - RNA, 22 nt, Human
ucucuuuuuuuaaaacucuaug

SEQ ID NO: 197856 - RNA, 22 nt, Human
ucugaccccccuugccuccacu

SEQ ID NO: 197857 - RNA, 22 nt, Human
ucugacguugguucugcccuuu

SEQ ID NO: 197858 - RNA, 22 nt, Human
ucugacugucccguagaggaac

SEQ ID NO: 197859 - RNA, 22 nt, Human
ucugagagcuguagaagccuau

SEQ ID NO: 197860 - RNA, 22 nt, Human
ucugaguagaaucauucauaaa

SEQ ID NO: 197861 - RNA, 22 nt, Human
ucugagucgcucccuggaucca

SEQ ID NO: 197862 - RNA, 22 nt, Human
uggaaaacgcaguuuaauuuuu

SEQ ID NO: 197863 - RNA, 22 nt, Human
uggaaaauuuagaaagauuuau

SEQ ID NO: 197864 - RNA, 21 nt, Human
ugcuuuuguugucagcugcug

SEQ ID NO: 197865 - RNA, 22 nt, Human
ugcuuuuggcagcaguguuuau

SEQ ID NO: 197866 - RNA, 22 nt, Human
ucucuacuuggcuuguguucac

SEQ ID NO: 197867 - RNA, 22 nt, Human
ugcuuaucuccuuaguuuuugc

SEQ ID NO: 197868 - RNA, 17 nt, Human
ucuccuggcucuaucag

SEQ ID NO: 197869 - RNA, 22 nt, Human
ucuccuuugaaaguuaggacug

SEQ ID NO: 197870 - RNA, 22 nt, Human
ugcuucuuugggggugaagaga

SEQ ID NO: 197871 - RNA, 21 nt, Human
ucucuaucguauaccagccgg

SEQ ID NO: 197872 - RNA, 22 nt, Human
ugcuucucucuaggaagacgcu

SEQ ID NO: 197873 - RNA, 22 nt, Human
ugcuuaaccagccccuucccuu

SEQ ID NO: 197874 - RNA, 22 nt, Human
ucucucugcuguccagcguuau

SEQ ID NO: 197875 - RNA, 22 nt, Human
ucucugaggacagaaaguuugu

SEQ ID NO: 197876 - RNA, 22 nt, Human
ucucugcguucaucccaucaca

SEQ ID NO: 197877 - RNA, 22 nt, Human
ugcuugacucagcaucggcaau

SEQ ID NO: 197878 - RNA, 22 nt, Human
ugcuugaacccaggaaguggag

SEQ ID NO: 197879 - RNA, 22 nt, Human
ucucuguacauagugaagcccg

SEQ ID NO: 197880 - RNA, 22 nt, Human
ucucugucucccguguguccgg

SEQ ID NO: 197881 - RNA, 22 nt, Human
ucucuguaguugggcagcugcu

SEQ ID NO: 197882 - RNA, 22 nt, Human
ugcuugggucuguuuugcaaag

SEQ ID NO: 197883 - RNA, 22 nt, Human
ucuucaggaaaaccaaaguugu

SEQ ID NO: 197884 - RNA, 22 nt, Human
ucuucacagaugcauauacuuc

SEQ ID NO: 197885 - RNA, 22 nt, Human
uggcaagcuguuggcagauagc

SEQ ID NO: 197886 - RNA, 22 nt, Human
uggcaaacacaauauggguaca

SEQ ID NO: 197887 - RNA, 22 nt, Human
uggaugacaaccauuggaagag

SEQ ID NO: 197888 - RNA, 22 nt, Human
uggaucaugcgaggccuccccu

SEQ ID NO: 197889 - RNA, 20 nt, Human
uggaucgaccucacuuccau

SEQ ID NO: 197890 - RNA, 22 nt, Human
uggauuuuggaauguuucagua

SEQ ID NO: 197891 - RNA, 22 nt, Human
ucuuccauuccccuccuacgcc

SEQ ID NO: 197892 - RNA, 22 nt, Human
ucuucuuacauuaaguugaaac

SEQ ID NO: 197893 - RNA, 22 nt, Human
ucuucuauaucuacauaugcaa

SEQ ID NO: 197894 - RNA, 22 nt, Human
ucuucuguguguagugguugug

SEQ ID NO: 197895 - RNA, 22 nt, Human
uggcagugggaagcuggaaguc

SEQ ID NO: 197896 - RNA, 19 nt, Human
ucuuccaucuauccuccuc

SEQ ID NO: 197897 - RNA, 21 nt, Human
ucuuccaacacugacaccaug

SEQ ID NO: 197898 - RNA, 22 nt, Human
uggcucacaggaggcagaggug

SEQ ID NO: 197899 - RNA, 22 nt, Human
uggcucaggccuacgacgccuu

SEQ ID NO: 197900 - RNA, 22 nt, Human
uggcucacuuccguggagaggu

SEQ ID NO: 197901 - RNA, 22 nt, Human
uggccuucagcucuggggugca

SEQ ID NO: 197902 - RNA, 22 nt, Human
uggcgacuggaauuaaucuuuu

SEQ ID NO: 197903 - RNA, 22 nt, Human
ucuugcuguagcuguuucuucu

SEQ ID NO: 197904 - RNA, 22 nt, Human
ucuucuuauuuuaugaucgcuu

SEQ ID NO: 197905 - RNA, 20 nt, Human
uggcccgcgcuccuccugcu

SEQ ID NO: 197906 - RNA, 22 nt, Human
uggccgaugagcaugcgcugau

SEQ ID NO: 197907 - RNA, 22 nt, Human
uggcauuuuguagcuguguauc

SEQ ID NO: 197908 - RNA, 22 nt, Human
uggccaaauuggccugauguau

SEQ ID NO: 197909 - RNA, 22 nt, Human
ucuguggcaaacacagugacca

SEQ ID NO: 197910 - RNA, 21 nt, Human
ucugugcuuuuuuggcuccua

SEQ ID NO: 197911 - RNA, 17 nt, Human
ucuguguccgcucaguc

SEQ ID NO: 197912 - RNA, 19 nt, Human
ucuguggccuucccugaug

SEQ ID NO: 197913 - RNA, 20 nt, Human
ucuguggcagguggcgcuug

SEQ ID NO: 197914 - RNA, 22 nt, Human
uggaagugggcaucaccaucca

SEQ ID NO: 197915 - RNA, 22 nt, Human
ucuguuguauggcugucuaauu

SEQ ID NO: 197916 - RNA, 19 nt, Human
ucuguugcuuuguguccuc

SEQ ID NO: 197917 - RNA, 22 nt, Human
ucuguuucaggggucuggaaug

SEQ ID NO: 197918 - RNA, 22 nt, Human
ucuguuuacaugucagcagcaa

SEQ ID NO: 197919 - RNA, 22 nt, Human
ucuguuuugugcuuuguuuucu

SEQ ID NO: 197920 - RNA, 20 nt, Human
uggaucaccauccuguugcu

SEQ ID NO: 197921 - RNA, 22 nt, Human
ucuguuuuuaucuauucuguua

SEQ ID NO: 197922 - RNA, 22 nt, Human
uggauauuuuguaugugcguuu

SEQ ID NO: 197923 - RNA, 22 nt, Human
uggauaugaaacaaaacaagag

SEQ ID NO: 197924 - RNA, 22 nt, Human
ucuguucagaagaggugaaagu

SEQ ID NO: 197925 - RNA, 22 nt, Human
ucuguguguguggcuaaacaag

SEQ ID NO: 197926 - RNA, 22 nt, Human
ucuguucacaauuacacacacu

SEQ ID NO: 197927 - RNA, 22 nt, Human
ucuguuauaaaucacacugcau

SEQ ID NO: 197928 - RNA, 22 nt, Human
uggaaguggcaggggagacgua

SEQ ID NO: 197929 - RNA, 22 nt, Human
uggaagucuucucucccaugga

SEQ ID NO: 197930 - RNA, 22 nt, Human
ucuggguuuccuucacaagcac

SEQ ID NO: 197931 - RNA, 22 nt, Human
ucugggucuaucccaugccuuu

SEQ ID NO: 197932 - RNA, 22 nt, Human
ucuggucugccgagauccauuu

SEQ ID NO: 197933 - RNA, 17 nt, Human
ucuggguuucugauuua

SEQ ID NO: 197934 - RNA, 22 nt, Human
ucugguuaggcuugugaggucc

SEQ ID NO: 197935 - RNA, 22 nt, Human
uggaagugucagcaggcugguu

SEQ ID NO: 197936 - RNA, 22 nt, Human
ucugguuccugcauucauucaa

SEQ ID NO: 197937 - RNA, 22 nt, Human
ucugcuggugucauuuuugcua

SEQ ID NO: 197938 - RNA, 22 nt, Human
ucugcguggcgugguucugugc

SEQ ID NO: 197939 - RNA, 22 nt, Human
ucugcuuaguuuucuugaacag

SEQ ID NO: 197940 - RNA, 22 nt, Human
uggaagcuggcugaucugacuu

SEQ ID NO: 197941 - RNA, 22 nt, Human
uggaagcuagggguuucuguug

SEQ ID NO: 197942 - RNA, 22 nt, Human
ucuggcaguugccgcuucaguc

SEQ ID NO: 197943 - RNA, 21 nt, Human
ucuggccuauaaaguagucgc

SEQ ID NO: 197944 - RNA, 20 nt, Human
uggaaggaaagguguaucuu

SEQ ID NO: 197945 - RNA, 20 nt, Human
ucugcuugucuucagguucc

SEQ ID NO: 197946 - RNA, 22 nt, Human
ucugaugaccacaugugggacu

SEQ ID NO: 197947 - RNA, 22 nt, Human
ucugauucauucugguaaaugg

SEQ ID NO: 197948 - RNA, 22 nt, Human
ucugaucagaagacaaaugagg

SEQ ID NO: 197949 - RNA, 22 nt, Human
ucugauaaggaaggauuaaaag

SEQ ID NO: 197950 - RNA, 23 nt, Human
uggaagaaaaugguuuggcugug

SEQ ID NO: 197951 - RNA, 18 nt, Human
uauaaacacacuuagguu

SEQ ID NO: 197952 - RNA, 22 nt, Human
ucucauacguuuccagguguca

SEQ ID NO: 197953 - RNA, 22 nt, Human
uaguuucuaauguugaaauuau

SEQ ID NO: 197954 - RNA, 23 nt, Human
ucuccccuccagcccucccuccu

SEQ ID NO: 197955 - RNA, 22 nt, Human
ucuccaggaaagacacuggacu

SEQ ID NO: 197956 - RNA, 22 nt, Human
ucuccaccccugggaggcagaa

SEQ ID NO: 197957 - RNA, 22 nt, Human
uauacauauacaaaugcacaua

SEQ ID NO: 197958 - RNA, 22 nt, Human
uauagcccaaucuggaugcagu

SEQ ID NO: 197959 - RNA, 22 nt, Human
uauaagaaacaaggcaaauuuu

SEQ ID NO: 197960 - RNA, 22 nt, Human
ucuccucuuaaugcacguuucc

SEQ ID NO: 197961 - RNA, 22 nt, Human
ucuccucuauuucuguauguau

SEQ ID NO: 197962 - RNA, 18 nt, Human
ucuccgaccccgcggucc

SEQ ID NO: 197963 - RNA, 22 nt, Human
ucucccuuuggauuuguuuugg

SEQ ID NO: 197964 - RNA, 22 nt, Human
ucucccgcuuccugcuggcugc

SEQ ID NO: 197965 - RNA, 22 nt, Human
ucucgcuguuccugcuucaggu

SEQ ID NO: 197966 - RNA, 22 nt, Human
uaguuauuucugcacuuaauga

SEQ ID NO: 197967 - RNA, 22 nt, Human
uaguuacuuuugcucuucauua

SEQ ID NO: 197968 - RNA, 22 nt, Human
ucuaggcugugugugggcaggg

SEQ ID NO: 197969 - RNA, 22 nt, Human
uaggaagagauuuucacauggc

SEQ ID NO: 197970 - RNA, 21 nt, Human
uaggaacuguucugagugguc

SEQ ID NO: 197971 - RNA, 22 nt, Human
uaggagcagauggcagcaggug

SEQ ID NO: 197972 - RNA, 22 nt, Human
ucucaaagagcuacuggucuau

SEQ ID NO: 197973 - RNA, 22 nt, Human
uaguugaauuuaucaguagcau

SEQ ID NO: 197974 - RNA, 22 nt, Human
ucuaugaagucuuccuuuccuc

SEQ ID NO: 197975 - RNA, 22 nt, Human
ucuauuguuauccuuuccauuu

SEQ ID NO: 197976 - RNA, 22 nt, Human
uaucugcuggagguaauuacuc

SEQ ID NO: 197977 - RNA, 17 nt, Human
ucugaccuuuacuccug

SEQ ID NO: 197978 - RNA, 22 nt, Human
uaucuguagucucaugguuccu

SEQ ID NO: 197979 - RNA, 22 nt, Human
uaucuucaauagcccagaugug

SEQ ID NO: 197980 - RNA, 21 nt, Human
ucugaggagaaacucuuggug

SEQ ID NO: 197981 - RNA, 22 nt, Human
ucugaggacagugcugugccug

SEQ ID NO: 197982 - RNA, 22 nt, Human
uaugaaggauacaccucugauu

SEQ ID NO: 197983 - RNA, 22 nt, Human
ucugagcaggaaagagcagaga

SEQ ID NO: 197984 - RNA, 22 nt, Human
uauccaucuucuuugagaaugg

SEQ ID NO: 197985 - RNA, 21 nt, Human
uaucauuuuuuccccugagau

SEQ ID NO: 197986 - RNA, 22 nt, Human
ucucuugcuauugcgaacaggu

SEQ ID NO: 197987 - RNA, 22 nt, Human
ucugaauauguuuaucaucucu

SEQ ID NO: 197988 - RNA, 22 nt, Human
ucugaccaggcucuuguagccu

SEQ ID NO: 197989 - RNA, 22 nt, Human
ucugaagagaacucuuaguguu

SEQ ID NO: 197990 - RNA, 22 nt, Human
ucugaaauuuuaguuauagaaa

SEQ ID NO: 197991 - RNA, 22 nt, Human
uauauguagcucaaaaauuccc

SEQ ID NO: 197992 - RNA, 22 nt, Human
uauauuuguccuagcuccuagc

SEQ ID NO: 197993 - RNA, 22 nt, Human
uaucauuaggagugcugcucgg

SEQ ID NO: 197994 - RNA, 19 nt, Human
ucucugguggcuccaucag

SEQ ID NO: 197995 - RNA, 22 nt, Human
uauaugcagauuuucaucaucg

SEQ ID NO: 197996 - RNA, 22 nt, Human
ucucugguggcuccaucaguag

SEQ ID NO: 197997 - RNA, 22 nt, Human
ucucuggcuuuuuuuccauuuu

SEQ ID NO: 197998 - RNA, 22 nt, Human
ucucugguagcucugugcucug

SEQ ID NO: 197999 - RNA, 22 nt, Human
ucucuggacggacauuuaaggu

SEQ ID NO: 198000 - RNA, 22 nt, Human
ucucucgguacagcuggcugga

SEQ ID NO: 198001 - RNA, 22 nt, Human
ucucucucucuuccagcauguu

SEQ ID NO: 198002 - RNA, 22 nt, Human
ucucucggagcuaccggaaguu

SEQ ID NO: 198003 - RNA, 20 nt, Human
ucucucacccuugcugugca

SEQ ID NO: 198004 - RNA, 22 nt, Human
uauauacacgcacauauacaua

SEQ ID NO: 198005 - RNA, 22 nt, Human
uauaggugagugaagcucagga

SEQ ID NO: 198006 - RNA, 22 nt, Human
uauauaauacacaaauauguac

SEQ ID NO: 198007 - RNA, 22 nt, Human
uauauauacauauagaauaugu

SEQ ID NO: 198008 - RNA, 22 nt, Human
uauauauaauguguacagguga

SEQ ID NO: 198009 - RNA, 22 nt, Human
uaugcagauaguuugccauuca

SEQ ID NO: 198010 - RNA, 22 nt, Human
uaugcacacguguccaugugca

SEQ ID NO: 198011 - RNA, 22 nt, Human
ucugcagggcccuuggcuccug

SEQ ID NO: 198012 - RNA, 21 nt, Human
ucugccaguuucucuuacuuu

SEQ ID NO: 198013 - RNA, 22 nt, Human
uaugccaaaaauaaguuuuaug

SEQ ID NO: 198014 - RNA, 22 nt, Human
ucugcgggccuggcucccagcg

SEQ ID NO: 198015 - RNA, 20 nt, Human
uaugcgaagccuuucuggac

SEQ ID NO: 198016 - RNA, 22 nt, Human
ucugcccguucaaauccuuguu

SEQ ID NO: 198017 - RNA, 23 nt, Human
ucugccuccuaauuguugguguc

SEQ ID NO: 198018 - RNA, 22 nt, Human
ucugcccaggaggucccauggg

SEQ ID NO: 198019 - RNA, 22 nt, Human
ucugccuucaggagcagacucu

SEQ ID NO: 198020 - RNA, 22 nt, Human
uaugaauauaccacaauuuagg

SEQ ID NO: 198021 - RNA, 22 nt, Human
ucugagugacguccugacagga

SEQ ID NO: 198022 - RNA, 19 nt, Human
uaugaaguugauaaaaguu

SEQ ID NO: 198023 - RNA, 22 nt, Human
ucugagugggaacucucaugac

SEQ ID NO: 198024 - RNA, 22 nt, Human
uaugagugccaaguuaccuggg

SEQ ID NO: 198025 - RNA, 22 nt, Human
ucugaguuaaaauuccagaggu

SEQ ID NO: 198026 - RNA, 22 nt, Human
ucugaucuuucauccuaaaugg

SEQ ID NO: 198027 - RNA, 17 nt, Human
ucugcagaggcaaaccu

SEQ ID NO: 198028 - RNA, 22 nt, Human
ucugcacagcucaccucccugg

SEQ ID NO: 198029 - RNA, 22 nt, Human
ucugauucucuuguugaccuag

SEQ ID NO: 198030 - RNA, 22 nt, Human
uaugugugugcguguguuuugc

SEQ ID NO: 198031 - RNA, 22 nt, Human
uaugugguuugucauuuaauau

SEQ ID NO: 198032 - RNA, 22 nt, Human
ucuggcucuccagugcucuuag

SEQ ID NO: 198033 - RNA, 22 nt, Human
ucugggaccuagacccauuguu

SEQ ID NO: 198034 - RNA, 22 nt, Human
ucuggcuucaguaggguucacu

SEQ ID NO: 198035 - RNA, 20 nt, Human
uaugugcaguuugguuuauc

SEQ ID NO: 198036 - RNA, 22 nt, Human
uauguauguauguauguauaug

SEQ ID NO: 198037 - RNA, 22 nt, Human
uaugugaaauggaauauagaaa

SEQ ID NO: 198038 - RNA, 22 nt, Human
uauguauaacuugauaggauga

SEQ ID NO: 198039 - RNA, 22 nt, Human
ucuggcucaggagcuguguuca

SEQ ID NO: 198040 - RNA, 22 nt, Human
uaugggaaggauuugucuuuca

SEQ ID NO: 198041 - RNA, 22 nt, Human
uauggcuaguguguuuguaaca

SEQ ID NO: 198042 - RNA, 22 nt, Human
uaugcuguauucuguauguuag

SEQ ID NO: 198043 - RNA, 22 nt, Human
ucuggaaauggaaguaacuaug

SEQ ID NO: 198044 - RNA, 22 nt, Human
ucugcuguugaucaugacuagc

SEQ ID NO: 198045 - RNA, 22 nt, Human
uauguaacaccauuuacaaagu

SEQ ID NO: 198046 - RNA, 22 nt, Human
ucuggaggucucagggcgggaa

SEQ ID NO: 198047 - RNA, 22 nt, Human
ucuuauucuuuuaaacaacgca

SEQ ID NO: 198048 - RNA, 22 nt, Human
ucuuauugguaaugauggcauu

SEQ ID NO: 198049 - RNA, 22 nt, Human
ucuuauugugaugaugaagaac

SEQ ID NO: 198050 - RNA, 22 nt, Human
ucuuauuucuuucuuuuccugu

SEQ ID NO: 198051 - RNA, 22 nt, Human
ucuucacugaagcuuugcaucu

SEQ ID NO: 198052 - RNA, 20 nt, Human
ucuucagcuccaagucuggc

SEQ ID NO: 198053 - RNA, 22 nt, Human
ucuuaaauaugaaaaggauuau

SEQ ID NO: 198054 - RNA, 22 nt, Human
ucuuaaucauucuucacuuccu

SEQ ID NO: 198055 - RNA, 21 nt, Human
ucuuauacagcaauagaucug

SEQ ID NO: 198056 - RNA, 22 nt, Human
uauucccacuccucagcaauuu

SEQ ID NO: 198057 - RNA, 21 nt, Human
uauucgcauuucugucuuuac

SEQ ID NO: 198058 - RNA, 22 nt, Human
uauuaugguuguagguuaacaa

SEQ ID NO: 198059 - RNA, 22 nt, Human
ucuguuuuccaggaaucucaua

SEQ ID NO: 198060 - RNA, 21 nt, Human
ucuguuguguguugaggacuu

SEQ ID NO: 198061 - RNA, 22 nt, Human
uauuagggaacugcaagacuaa

SEQ ID NO: 198062 - RNA, 22 nt, Human
ucugugcuccuuccuugucauc

SEQ ID NO: 198063 - RNA, 22 nt, Human
ucugugugugcauguguguaua

SEQ ID NO: 198064 - RNA, 22 nt, Human
uauguucaauaccagguucuuu

SEQ ID NO: 198065 - RNA, 22 nt, Human
ucugucucugucaggcugcugc

SEQ ID NO: 198066 - RNA, 22 nt, Human
ucugucaguguccucguguggu

SEQ ID NO: 198067 - RNA, 22 nt, Human
ucuguagucuuggagccgcaca

SEQ ID NO: 198068 - RNA, 22 nt, Human
uauuacugccacaucauuaggu

SEQ ID NO: 198069 - RNA, 22 nt, Human
uauuaaaagagaaaaagccacc

SEQ ID NO: 198070 - RNA, 22 nt, Human
ucuguauuuuuuacacacaugc

SEQ ID NO: 198071 - RNA, 22 nt, Human
ucuguagcuuuagaggacagga

SEQ ID NO: 198072 - RNA, 22 nt, Human
ucuguaacaucaguguaauuuu

SEQ ID NO: 198073 - RNA, 22 nt, Human
ucugguagauuauuuagaguac

SEQ ID NO: 198074 - RNA, 22 nt, Human
ucuggugcacucugauauuuga

SEQ ID NO: 198075 - RNA, 22 nt, Human
ucugguuucccaguuccuccgu

SEQ ID NO: 198076 - RNA, 22 nt, Human
ucuggggaugagugaugucgua

SEQ ID NO: 198077 - RNA, 22 nt, Human
ucaucuauaaguagcaucuggg

SEQ ID NO: 198078 - RNA, 21 nt, Human
ucauaauaauuacaugggggg

SEQ ID NO: 198079 - RNA, 22 nt, Human
ucauaagucucauauaugucca

SEQ ID NO: 198080 - RNA, 22 nt, Human
ucauacuuuuuugacccuugug

SEQ ID NO: 198081 - RNA, 22 nt, Human
ucaguuacucugauguccugug

SEQ ID NO: 198082 - RNA, 22 nt, Human
ucaguuguuggaaguagaugua

SEQ ID NO: 198083 - RNA, 22 nt, Human
uaagagauuuauugaggacuuc

SEQ ID NO: 198084 - RNA, 22 nt, Human
ucauaaaaucaguguccauugu

SEQ ID NO: 198085 - RNA, 22 nt, Human
ucauggguauaauuuuagaugu

SEQ ID NO: 198086 - RNA, 22 nt, Human
ucauuagucuuuaauacauaau

SEQ ID NO: 198087 - RNA, 22 nt, Human
uaaggaaaugcaaauuuaagaa

SEQ ID NO: 198088 - RNA, 22 nt, Human
uaaggagagaauuuagagguuu

SEQ ID NO: 198089 - RNA, 22 nt, Human
ucaugagcacaggugcagggac

SEQ ID NO: 198090 - RNA, 22 nt, Human
ucaugcagaguagaaagggcaa

SEQ ID NO: 198091 - RNA, 22 nt, Human
ucaugccugcgauugucccugg

SEQ ID NO: 198092 - RNA, 18 nt, Human
uccaaaccuuuuacuucc

SEQ ID NO: 198093 - RNA, 22 nt, Human
uccaaauagcuggaugauggug

SEQ ID NO: 198094 - RNA, 22 nt, Human
ucauuuaucgcugccuuuuaaa

SEQ ID NO: 198095 - RNA, 22 nt, Human
ucauuuaauuuggaacucagag

SEQ ID NO: 198096 - RNA, 22 nt, Human
ucauuuguauucuacaaagcac

SEQ ID NO: 198097 - RNA, 22 nt, Human
uaauaucuuuacacauuuucaa

SEQ ID NO: 198098 - RNA, 22 nt, Human
uaauauaacugccaguuaaggu

SEQ ID NO: 198099 - RNA, 22 nt, Human
uacaaaauucaaauaauguuug

SEQ ID NO: 198100 - RNA, 22 nt, Human
uaauuuagugcauuuccuagua

SEQ ID NO: 198101 - RNA, 22 nt, Human
uaauugaacguucauuuuuaau

SEQ ID NO: 198102 - RNA, 22 nt, Human
uaauuucauuuugcaaugaucu

SEQ ID NO: 198103 - RNA, 22 nt, Human
uaaccuuuuuuaaaguuuccug

SEQ ID NO: 198104 - RNA, 19 nt, Human
ucagugggacauuugcuuu

SEQ ID NO: 198105 - RNA, 20 nt, Human
ucaguggcauaguugcuaag

SEQ ID NO: 198106 - RNA, 22 nt, Human
uaaccaggaaaaagauaugcau

SEQ ID NO: 198107 - RNA, 22 nt, Human
uaacacauagauauuuuaacuu

SEQ ID NO: 198108 - RNA, 22 nt, Human
ucagucugcuauagguauuugu

SEQ ID NO: 198109 - RNA, 22 nt, Human
ucagucugguggaugcucauug

SEQ ID NO: 198110 - RNA, 22 nt, Human
ucagugagauuuuuagcaguag

SEQ ID NO: 198111 - RNA, 23 nt, Human
ucagugaaggaacaacuaaauag

SEQ ID NO: 198112 - RNA, 23 nt, Human
uaaauuuuauucugauaacacag

SEQ ID NO: 198113 - RNA, 22 nt, Human
uaaauuugugaauuagcuauca

SEQ ID NO: 198114 - RNA, 22 nt, Human
ucagucauguuuaccagacgua

SEQ ID NO: 198115 - RNA, 22 nt, Human
uaaauguugcuugugcugcuca

SEQ ID NO: 198116 - RNA, 22 nt, Human
ucaggagaguguucaguggagg

SEQ ID NO: 198117 - RNA, 19 nt, Human
ucaggaggucgaccuggca

SEQ ID NO: 198118 - RNA, 22 nt, Human
uaaaggaccuguacuagguuua

SEQ ID NO: 198119 - RNA, 22 nt, Human
ucaggguacuuguggccaaagu

SEQ ID NO: 198120 - RNA, 22 nt, Human
ucaggucacugauaaaguggaa

SEQ ID NO: 198121 - RNA, 18 nt, Human
ucagggaaacuuugccug

SEQ ID NO: 198122 - RNA, 22 nt, Human
guugguggaggcgagagaagaa

SEQ ID NO: 198123 - RNA, 22 nt, Human
ucaagcacugugcaaugagcuu

SEQ ID NO: 198124 - RNA, 21 nt, Human
ucaagcggcagagcaguuauu

SEQ ID NO: 198125 - RNA, 22 nt, Human
uaaaugaaaggguuuaauuuau

SEQ ID NO: 198126 - RNA, 22 nt, Human
uaaaugagcaccucuaguuuug

SEQ ID NO: 198127 - RNA, 22 nt, Human
uaaagugaaguucagaauggcu

SEQ ID NO: 198128 - RNA, 22 nt, Human
uaaaggcaaacucuccaaggau

SEQ ID NO: 198129 - RNA, 22 nt, Human
uaaauaugcaugugguauucau

SEQ ID NO: 198130 - RNA, 22 nt, Human
ucagucacugugaaaugaauuu

SEQ ID NO: 198131 - RNA, 22 nt, Human
ucaguauuagugcauuaucagg

SEQ ID NO: 198132 - RNA, 22 nt, Human
ucaguaagauugauauuucccc

SEQ ID NO: 198133 - RNA, 22 nt, Human
ucagguuuaagcuacuggaauc

SEQ ID NO: 198134 - RNA, 22 nt, Human
uccuggaagggaugguugagga

SEQ ID NO: 198135 - RNA, 22 nt, Human
uccugcuucaaucugcugcugg

SEQ ID NO: 198136 - RNA, 22 nt, Human
uccugcucucuccauuccuucc

SEQ ID NO: 198137 - RNA, 22 nt, Human
uccugggcuugcucuuuccauu

SEQ ID NO: 198138 - RNA, 22 nt, Human
uccuggccuuggggagagaagu

SEQ ID NO: 198139 - RNA, 22 nt, Human
uccugguaaagaguaucagauu

SEQ ID NO: 198140 - RNA, 22 nt, Human
uccuggcgugggcuggcugcag

SEQ ID NO: 198141 - RNA, 22 nt, Human
uagcguucuugcaugcuaaccu

SEQ ID NO: 198142 - RNA, 22 nt, Human
uagcguaugcugugugaugaau

SEQ ID NO: 198143 - RNA, 22 nt, Human
uagcuggaggggcaggaugcug

SEQ ID NO: 198144 - RNA, 22 nt, Human
uagcucuuaccagugaaguuug

SEQ ID NO: 198145 - RNA, 20 nt, Human
uccugaaauuacgugauuca

SEQ ID NO: 198146 - RNA, 22 nt, Human
uccugaaggccugaguuccacc

SEQ ID NO: 198147 - RNA, 21 nt, Human
uccugccuuaguccagagcag

SEQ ID NO: 198148 - RNA, 21 nt, Human
uccugccuggccuucugacua

SEQ ID NO: 198149 - RNA, 22 nt, Human
uagcagcacuauuuguuguagu

SEQ ID NO: 198150 - RNA, 20 nt, Human
uagcacuguauccucuucau

SEQ ID NO: 198151 - RNA, 22 nt, Human
uagcacauaguaggcacaggcu

SEQ ID NO: 198152 - RNA, 22 nt, Human
uagaugguguccagaaagagaa

SEQ ID NO: 198153 - RNA, 23 nt, Human
uccuccccaccuuuguccccucc

SEQ ID NO: 198154 - RNA, 22 nt, Human
uagaacaaacagcauguuugau

SEQ ID NO: 198155 - RNA, 22 nt, Human
uagaacugcucucauacuugcu

SEQ ID NO: 198156 - RNA, 22 nt, Human
uagaagagcaugucaaacuaua

SEQ ID NO: 198157 - RNA, 22 nt, Human
uagaacuguaaauuaucucucc

SEQ ID NO: 198158 - RNA, 22 nt, Human
ucccuuuucauccuaucccagc

SEQ ID NO: 198159 - RNA, 22 nt, Human
ucccuuuuagccccgcccuccu

SEQ ID NO: 198160 - RNA, 22 nt, Human
ucccuuuuuaauugugucccug

SEQ ID NO: 198161 - RNA, 22 nt, Human
ucccuuuuuccugaucugugaa

SEQ ID NO: 198162 - RNA, 22 nt, Human
uagaggauucuaaaggaagcug

SEQ ID NO: 198163 - RNA, 22 nt, Human
uccucagcaaacacuucacucu

SEQ ID NO: 198164 - RNA, 22 nt, Human
uccgggcagcuccuggagcugu

SEQ ID NO: 198165 - RNA, 21 nt, Human
uccguucgguuaaaaaggccc

SEQ ID NO: 198166 - RNA, 22 nt, Human
uccgugggucuugaagugucac

SEQ ID NO: 198167 - RNA, 22 nt, Human
uccgggagcccccggaggagga

SEQ ID NO: 198168 - RNA, 22 nt, Human
uccguccacacuuagagaguuu

SEQ ID NO: 198169 - RNA, 22 nt, Human
ucccugcugggcgaucuucucu

SEQ ID NO: 198170 - RNA, 22 nt, Human
ucccugccuuauuuucauaugc

SEQ ID NO: 198171 - RNA, 22 nt, Human
ucccugccuccuggcagugcca

SEQ ID NO: 198172 - RNA, 22 nt, Human
ucccugcagggccauugugcag

SEQ ID NO: 198173 - RNA, 22 nt, Human
ucccugagcuguguuuguuggu

SEQ ID NO: 198174 - RNA, 22 nt, Human
uacugacguaguagaguugcuu

SEQ ID NO: 198175 - RNA, 22 nt, Human
uacugagcauaaaacccauacu

SEQ ID NO: 198176 - RNA, 22 nt, Human
uacugaauuacugcugguaaau

SEQ ID NO: 198177 - RNA, 22 nt, Human
uacugaagaugccaucacaagc

SEQ ID NO: 198178 - RNA, 22 nt, Human
uacugcaguuccugcugucucc

SEQ ID NO: 198179 - RNA, 22 nt, Human
uacugauggagauaggcuauca

SEQ ID NO: 198180 - RNA, 22 nt, Human
uccccggagucccuggccaggg

SEQ ID NO: 198181 - RNA, 22 nt, Human
uccccgcugcgcccgcugcugc

SEQ ID NO: 198182 - RNA, 20 nt, Human
uccccuccacuuuccuccua

SEQ ID NO: 198183 - RNA, 22 nt, Human
uacuucuuuuguaaaguauuga

SEQ ID NO: 198184 - RNA, 22 nt, Human
uacuugaaaugggcaucaagag

SEQ ID NO: 198185 - RNA, 22 nt, Human
uacuugcaaggcucuuggaaua

SEQ ID NO: 198186 - RNA, 22 nt, Human
uacuugaacaucacuaagagaa

SEQ ID NO: 198187 - RNA, 22 nt, Human
uccacaaagucuaugagaguug

SEQ ID NO: 198188 - RNA, 22 nt, Human
uacagcgaaaauuuagcuugau

SEQ ID NO: 198189 - RNA, 21 nt, Human
uacagcucaucaauuacugcu

SEQ ID NO: 198190 - RNA, 22 nt, Human
uccagcuccugaguucacugcu

SEQ ID NO: 198191 - RNA, 22 nt, Human
uccagguaggagaccaggcugu

SEQ ID NO: 198192 - RNA, 22 nt, Human
uccaggacgccgacgugucggc

SEQ ID NO: 198193 - RNA, 22 nt, Human
uccaggaggacugagggggcug

SEQ ID NO: 198194 - RNA, 22 nt, Human
uccaggagucagacagauggug

SEQ ID NO: 198195 - RNA, 22 nt, Human
uccaugcgcgauggccuggcuu

SEQ ID NO: 198196 - RNA, 22 nt, Human
uacguaauagcuuuauuuuggg

SEQ ID NO: 198197 - RNA, 22 nt, Human
uaccugguuucuuaaacccaaa

SEQ ID NO: 198198 - RNA, 22 nt, Human
uccaggucauucucuccgaccg

SEQ ID NO: 198199 - RNA, 22 nt, Human
uaccuuuuuauucuuaaggccg

SEQ ID NO: 198200 - RNA, 22 nt, Human
uacuaaagaaugaguuaaguuu

SEQ ID NO: 198201 - RNA, 22 nt, Human
uacgugucacugaugaaguuua

SEQ ID NO: 198202 - RNA, 22 nt, Human
guggaaggaauuaacagacuag

SEQ ID NO: 198203 - RNA, 22 nt, Human
guggaagauauuucugguccag

SEQ ID NO: 198204 - RNA, 22 nt, Human
guggaaauaugggcaacaaaga

SEQ ID NO: 198205 - RNA, 22 nt, Human
gugcugggaggcccaggaugga

SEQ ID NO: 198206 - RNA, 22 nt, Human
gugcuugaguaaaaauagucuu

SEQ ID NO: 198207 - RNA, 22 nt, Human
gugcugcaugagcaucacguag

SEQ ID NO: 198208 - RNA, 22 nt, Human
gugcuguuagcgguuuauaaca

SEQ ID NO: 198209 - RNA, 22 nt, Human
guggaggaagaucuuugaugau

SEQ ID NO: 198210 - RNA, 22 nt, Human
guggagaucuggugcccccugg

SEQ ID NO: 198211 - RNA, 22 nt, Human
guggagaaauauguucagcuuc

SEQ ID NO: 198212 - RNA, 22 nt, Human
guggagaagggaccgggaagga

SEQ ID NO: 198213 - RNA, 22 nt, Human
guggauggagcuggaagccauu

SEQ ID NO: 198214 - RNA, 22 nt, Human
guggauaaguuguuugaccuac

SEQ ID NO: 198215 - RNA, 22 nt, Human
guggaguggguuguacucaggg

SEQ ID NO: 198216 - RNA, 22 nt, Human
guggauuguaccacgaaaagug

SEQ ID NO: 198217 - RNA, 22 nt, Human
guggauuucaggcuccccucag

SEQ ID NO: 198218 - RNA, 22 nt, Human
uaggauaacaauuuguaguuuc

SEQ ID NO: 198219 - RNA, 22 nt, Human
uaggcaaguggaccagagguuu

SEQ ID NO: 198220 - RNA, 22 nt, Human
uagcauuucacugaucuucacu

SEQ ID NO: 198221 - RNA, 22 nt, Human
uagaagagcuuccaccuggggc

SEQ ID NO: 198222 - RNA, 17 nt, Human
uagccagcuugugauuu

SEQ ID NO: 198223 - RNA, 22 nt, Human
uagccacuccgcagcaccgggu

SEQ ID NO: 198224 - RNA, 22 nt, Human
uagaagaugccuuaaaguugaa

SEQ ID NO: 198225 - RNA, 22 nt, Human
uagaagaacaugucaaacuaua

SEQ ID NO: 198226 - RNA, 22 nt, Human
gugagaggaggcagcuuuuaca

SEQ ID NO: 198227 - RNA, 19 nt, Human
uagcuguucuugaguguga

SEQ ID NO: 198228 - RNA, 22 nt, Human
uagcuagacacucagggccuca

SEQ ID NO: 198229 - RNA, 23 nt, Human
uagcggccaugacgggggucaca

SEQ ID NO: 198230 - RNA, 22 nt, Human
gugcucaucuucuguaacuguu

SEQ ID NO: 198231 - RNA, 20 nt, Human
uagcuucaccuagagauagc

SEQ ID NO: 198232 - RNA, 22 nt, Human
uagcuucacuuuuguugaugcg

SEQ ID NO: 198233 - RNA, 20 nt, Human
uaguaugggagaagaucucc

SEQ ID NO: 198234 - RNA, 22 nt, Human
uaguaugaaaauuagcgggagg

SEQ ID NO: 198235 - RNA, 22 nt, Human
gugggggcuaaauugaggggug

SEQ ID NO: 198236 - RNA, 22 nt, Human
guggggguaggggguuuccugg

SEQ ID NO: 198237 - RNA, 22 nt, Human
gugggggugaggaauguucuau

SEQ ID NO: 198238 - RNA, 22 nt, Human
guggggcgggucccccgccugg

SEQ ID NO: 198239 - RNA, 18 nt, Human
gugggcacacacucuguu

SEQ ID NO: 198240 - RNA, 22 nt, Human
gugggaguggagcucagcaugu

SEQ ID NO: 198241 - RNA, 22 nt, Human
gugggauaaccugagauaacau

SEQ ID NO: 198242 - RNA, 22 nt, Human
gugggaaacagccuugcuucua

SEQ ID NO: 198243 - RNA, 22 nt, Human
gugggagaaugggaggaguaau

SEQ ID NO: 198244 - RNA, 22 nt, Human
uaguggaaacagacugagcccg

SEQ ID NO: 198245 - RNA, 22 nt, Human
guggguccaaccugugugugug

SEQ ID NO: 198246 - RNA, 22 nt, Human
guggguauauauaugugugcug

SEQ ID NO: 198247 - RNA, 22 nt, Human
uagucaauuagaaagaggccuu

SEQ ID NO: 198248 - RNA, 22 nt, Human
uagucucagaauauuugcugau

SEQ ID NO: 198249 - RNA, 22 nt, Human
uagugauuuaagaaaggugacu

SEQ ID NO: 198250 - RNA, 22 nt, Human
guggcauggggagcagcuagaa

SEQ ID NO: 198251 - RNA, 22 nt, Human
guggcaguaaagcuggaaaagu

SEQ ID NO: 198252 - RNA, 22 nt, Human
uagguaauacuuagaccugauu

SEQ ID NO: 198253 - RNA, 22 nt, Human
uaggccugcugaagagcaagcu

SEQ ID NO: 198254 - RNA, 22 nt, Human
uaggcaauauuagacuuugucu

SEQ ID NO: 198255 - RNA, 22 nt, Human
uaggcaguagcuuuggauguca

SEQ ID NO: 198256 - RNA, 22 nt, Human
guggcuuuguuuccaaaugaaa

SEQ ID NO: 198257 - RNA, 22 nt, Human
guggcuuaauauuuauagcaga

SEQ ID NO: 198258 - RNA, 22 nt, Human
guggcuugguauuaaggugcca

SEQ ID NO: 198259 - RNA, 22 nt, Human
guggcgucgaugauggugucau

SEQ ID NO: 198260 - RNA, 22 nt, Human
guggcuggguggaacugagucu

SEQ ID NO: 198261 - RNA, 22 nt, Human
ucaacagaagugauagcuauua

SEQ ID NO: 198262 - RNA, 22 nt, Human
ucaaaggcuugugguucuggga

SEQ ID NO: 198263 - RNA, 22 nt, Human
guugggauugaaggugccucua

SEQ ID NO: 198264 - RNA, 22 nt, Human
guugggcugaagugugugcuua

SEQ ID NO: 198265 - RNA, 22 nt, Human
ucaaccagcuuaucugcaggau

SEQ ID NO: 198266 - RNA, 22 nt, Human
uauuuuuuuaacauuuauugua

SEQ ID NO: 198267 - RNA, 22 nt, Human
guugccugguuucaaaaggaau

SEQ ID NO: 198268 - RNA, 22 nt, Human
guugcuggggcugaguccccag

SEQ ID NO: 198269 - RNA, 22 nt, Human
guucuggaggagagccuggugu

SEQ ID NO: 198270 - RNA, 22 nt, Human
uauuuccugcguuucugugagc

SEQ ID NO: 198271 - RNA, 22 nt, Human
guucuguuguugaucuuuggag

SEQ ID NO: 198272 - RNA, 22 nt, Human
guucugcccaggccuccccaac

SEQ ID NO: 198273 - RNA, 22 nt, Human
guucuguucuucacagguuugu

SEQ ID NO: 198274 - RNA, 22 nt, Human
guucucuccugcuggugaugga

SEQ ID NO: 198275 - RNA, 22 nt, Human
guucucuuaauccuaguuggua

SEQ ID NO: 198276 - RNA, 22 nt, Human
guucuccaggggcuguucaucu

SEQ ID NO: 198277 - RNA, 22 nt, Human
guucuucucuuguaauggaauc

SEQ ID NO: 198278 - RNA, 22 nt, Human
uauuuuaaaagcauuaauucuu

SEQ ID NO: 198279 - RNA, 22 nt, Human
guucuacaugacacucaacauu

SEQ ID NO: 198280 - RNA, 16 nt, Human
guuccuguguguacaa

SEQ ID NO: 198281 - RNA, 22 nt, Human
guucggcuuccuaugucaugag

SEQ ID NO: 198282 - RNA, 22 nt, Human
guuccucugugguggaggaagg

SEQ ID NO: 198283 - RNA, 19 nt, Human
uauuagccucaucccagcc

SEQ ID NO: 198284 - RNA, 22 nt, Human
uauuauggguuuuuguguaaau

SEQ ID NO: 198285 - RNA, 22 nt, Human
guucaaggagcagcuugcuaca

SEQ ID NO: 198286 - RNA, 22 nt, Human
uauucauuuuuauuugugacug

SEQ ID NO: 198287 - RNA, 22 nt, Human
uauucagugcugguucuuuuuc

SEQ ID NO: 198288 - RNA, 22 nt, Human
guguuggugagcucauuuccac

SEQ ID NO: 198289 - RNA, 22 nt, Human
guguugaugugucuguauucua

SEQ ID NO: 198290 - RNA, 22 nt, Human
guguuugagagguacaagggaa

SEQ ID NO: 198291 - RNA, 22 nt, Human
guguuucccuggcacaagaacc

SEQ ID NO: 198292 - RNA, 22 nt, Human
uauguuugcaguucuaggucuu

SEQ ID NO: 198293 - RNA, 22 nt, Human
uauguuuugcaaauaucaaaca

SEQ ID NO: 198294 - RNA, 22 nt, Human
guuaggcagugugguauagcag

SEQ ID NO: 198295 - RNA, 22 nt, Human
guuaguucccaccccuguaaga

SEQ ID NO: 198296 - RNA, 22 nt, Human
guuaaaugcagauucugacuca

SEQ ID NO: 198297 - RNA, 22 nt, Human
uauguugucuuguucagccaua

SEQ ID NO: 198298 - RNA, 22 nt, Human
uaugugaguaccugucaugugc

SEQ ID NO: 198299 - RNA, 22 nt, Human
guuaaaggaagccauauguucg

SEQ ID NO: 198300 - RNA, 22 nt, Human
uauguggcaggugggagaucag

SEQ ID NO: 198301 - RNA, 22 nt, Human
uaugaaagguuuuuucuugaaa

SEQ ID NO: 198302 - RNA, 22 nt, Human
uaucuuugccuuggguuuuguu

SEQ ID NO: 198303 - RNA, 22 nt, Human
uauggacagcuuucuuuguguu

SEQ ID NO: 198304 - RNA, 22 nt, Human
uaugcuagauggaaaaauauug

SEQ ID NO: 198305 - RNA, 22 nt, Human
guguaucagaggcuguguuaua

SEQ ID NO: 198306 - RNA, 22 nt, Human
uaugcgguccaucaggggcacu

SEQ ID NO: 198307 - RNA, 22 nt, Human
uaucauuuuacugugacauuuu

SEQ ID NO: 198308 - RNA, 22 nt, Human
uauccaaaggaacaaucacagc

SEQ ID NO: 198309 - RNA, 22 nt, Human
guggugguguuggugacaaguu

SEQ ID NO: 198310 - RNA, 22 nt, Human
gugguuugacccuucagguaaa

SEQ ID NO: 198311 - RNA, 22 nt, Human
gugguuuagccuucauuaaccu

SEQ ID NO: 198312 - RNA, 22 nt, Human
gugguuugcugguguacguuua

SEQ ID NO: 198313 - RNA, 22 nt, Human
uaucaguccaggguuuugugac

SEQ ID NO: 198314 - RNA, 22 nt, Human
guggguuggguuuuugaaggga

SEQ ID NO: 198315 - RNA, 22 nt, Human
gugggugauacugccgugggag

SEQ ID NO: 198316 - RNA, 22 nt, Human
gugguaaagugugccugugguc

SEQ ID NO: 198317 - RNA, 22 nt, Human
guagaauggggcucucaaagca

SEQ ID NO: 198318 - RNA, 22 nt, Human
guagauaauuuuggaaagcugg

SEQ ID NO: 198319 - RNA, 22 nt, Human
guagaucaugaaaauucacugc

SEQ ID NO: 198320 - RNA, 22 nt, Human
guauugauuguuuuaaaagauu

SEQ ID NO: 198321 - RNA, 22 nt, Human
guauucugugugaucaagugau

SEQ ID NO: 198322 - RNA, 22 nt, Human
uaagacuuuaccaggcucaaau

SEQ ID NO: 198323 - RNA, 22 nt, Human
uaagaaaggggaaguuccucuu

SEQ ID NO: 198324 - RNA, 22 nt, Human
uaagauauugagugguaauuug

SEQ ID NO: 198325 - RNA, 22 nt, Human
uaacaguauacuacaucauauu

SEQ ID NO: 198326 - RNA, 22 nt, Human
uaagauggaagaaaaggcggau

SEQ ID NO: 198327 - RNA, 22 nt, Human
uaagcacuuuauaugcuuuauc

SEQ ID NO: 198328 - RNA, 22 nt, Human
uaaguaauugugguuuuugcca

SEQ ID NO: 198329 - RNA, 22 nt, Human
gucaguccugugccuuuccgga

SEQ ID NO: 198330 - RNA, 22 nt, Human
gucagugaaccuucaccaaacc

SEQ ID NO: 198331 - RNA, 22 nt, Human
gucacucuuuuucagcuagcuc

SEQ ID NO: 198332 - RNA, 22 nt, Human
gucaggaugagggaugaggagu

SEQ ID NO: 198333 - RNA, 22 nt, Human
uaaguauguuagaaaaucaagu

SEQ ID NO: 198334 - RNA, 22 nt, Human
uaauauauuuuuuaagggaugu

SEQ ID NO: 198335 - RNA, 22 nt, Human
guccucgggcucacucccaggg

SEQ ID NO: 198336 - RNA, 22 nt, Human
gucccuggucuaccguggcuuc

SEQ ID NO: 198337 - RNA, 22 nt, Human
uaauccaaaccaggaauucccu

SEQ ID NO: 198338 - RNA, 22 nt, Human
uaaugaugaacacuuggaagaa

SEQ ID NO: 198339 - RNA, 22 nt, Human
guccucgugucuuuuucucuaa

SEQ ID NO: 198340 - RNA, 22 nt, Human
uaauauccaguuauuucccuca

SEQ ID NO: 198341 - RNA, 22 nt, Human
guccaguaguguuugcaugugg

SEQ ID NO: 198342 - RNA, 22 nt, Human
guccagaguagucgaguauucu

SEQ ID NO: 198343 - RNA, 22 nt, Human
uaagugguagaaagagaaaggu

SEQ ID NO: 198344 - RNA, 23 nt, Human
gucauuacuguuaccuuauucuu

SEQ ID NO: 198345 - RNA, 22 nt, Human
guccugaaaaaaaucccugagu

SEQ ID NO: 198346 - RNA, 22 nt, Human
guccuggagcagcuggaagaug

SEQ ID NO: 198347 - RNA, 22 nt, Human
guccuguccugcugagcuccug

SEQ ID NO: 198348 - RNA, 22 nt, Human
guccuguguaaguacuugcuca

SEQ ID NO: 198349 - RNA, 22 nt, Human
uaauucuacagggaacucugga

SEQ ID NO: 198350 - RNA, 22 nt, Human
uaauucuucaauccaguguuca

SEQ ID NO: 198351 - RNA, 22 nt, Human
uaauuccacacucccgcaagcg

SEQ ID NO: 198352 - RNA, 22 nt, Human
gugaccagacagagucuagccc

SEQ ID NO: 198353 - RNA, 21 nt, Human
gugaccuguuaugcaaaggca

SEQ ID NO: 198354 - RNA, 22 nt, Human
gugaaggggaagcagggagagg

SEQ ID NO: 198355 - RNA, 22 nt, Human
gugaaggcaugugugcugugcu

SEQ ID NO: 198356 - RNA, 22 nt, Human
gugaagguccugauuugugacc

SEQ ID NO: 198357 - RNA, 23 nt, Human
uacuuuggcuagaguugucucuu

SEQ ID NO: 198358 - RNA, 22 nt, Human
uacuuuggugaaauuggaaaua

SEQ ID NO: 198359 - RNA, 23 nt, Human
gugagaccagagccuauucucag

SEQ ID NO: 198360 - RNA, 22 nt, Human
uacuuuuuucacuucuagcccc

SEQ ID NO: 198361 - RNA, 22 nt, Human
uacuugucuuuauuuuaaugcu

SEQ ID NO: 198362 - RNA, 22 nt, Human
uacuuuaauugcaaaaauaaau

SEQ ID NO: 198363 - RNA, 22 nt, Human
uacguuuuauaucuuuuggaau

SEQ ID NO: 198364 - RNA, 19 nt, Human
gucuuauggauagcuccuc

SEQ ID NO: 198365 - RNA, 22 nt, Human
uaccgcagagucauugugagga

SEQ ID NO: 198366 - RNA, 22 nt, Human
uaccuggauaaauguacaaccg

SEQ ID NO: 198367 - RNA, 22 nt, Human
gugaaaugaagugacuggauau

SEQ ID NO: 198368 - RNA, 22 nt, Human
gugaaaauaguaaccuggcuag

SEQ ID NO: 198369 - RNA, 22 nt, Human
uacuggguguucugagaaaaua

SEQ ID NO: 198370 - RNA, 22 nt, Human
uacugguguauuucuucuuauu

SEQ ID NO: 198371 - RNA, 22 nt, Human
gugaaacuggaugugaaaacaa

SEQ ID NO: 198372 - RNA, 20 nt, Human
gugaacuggagaacugaugu

SEQ ID NO: 198373 - RNA, 22 nt, Human
uacuucccacuggggucuacca

SEQ ID NO: 198374 - RNA, 22 nt, Human
uacauaauagcaaggugcuguc

SEQ ID NO: 198375 - RNA, 22 nt, Human
uacaccuuaagccgcggcuccc

SEQ ID NO: 198376 - RNA, 22 nt, Human
uacagaccaguaguucucagcg

SEQ ID NO: 198377 - RNA, 21 nt, Human
uacaucaguuuucuuggcuca

SEQ ID NO: 198378 - RNA, 22 nt, Human
gucuucugacacuguuaggagg

SEQ ID NO: 198379 - RNA, 22 nt, Human
gucuugugaagacggcagaaag

SEQ ID NO: 198380 - RNA, 22 nt, Human
uacauuccagaaaguuucugua

SEQ ID NO: 198381 - RNA, 22 nt, Human
uacauuugauuuuugcuucuuu

SEQ ID NO: 198382 - RNA, 18 nt, Human
gucuguuccuuuaauguc

SEQ ID NO: 198383 - RNA, 22 nt, Human
uaccgaagcugcuuuugcaugu

SEQ ID NO: 198384 - RNA, 22 nt, Human
gugaaaaauggccaucaggaca

SEQ ID NO: 198385 - RNA, 22 nt, Human
uaauuuugucacagugacaugc

SEQ ID NO: 198386 - RNA, 22 nt, Human
uaauuugauuucucccuggaaa

SEQ ID NO: 198387 - RNA, 22 nt, Human
gucuggugguggguguagggca

SEQ ID NO: 198388 - RNA, 22 nt, Human
gucgagaacauucauuaugcaa

SEQ ID NO: 198389 - RNA, 22 nt, Human
gucgcuuuccugaggggucuca

SEQ ID NO: 198390 - RNA, 20 nt, Human
gucguguauauagcuggggc

SEQ ID NO: 198391 - RNA, 22 nt, Human
gucguucugcuauucuaugagg

SEQ ID NO: 198392 - RNA, 22 nt, Human
gucgucgcucccaccuuccgcu

SEQ ID NO: 198393 - RNA, 22 nt, Human
guaaccacuaugguuauugauu

SEQ ID NO: 198394 - RNA, 22 nt, Human
guaagcagcaugacgguuggau

SEQ ID NO: 198395 - RNA, 22 nt, Human
guaccuuucuaucuagaaggua

SEQ ID NO: 198396 - RNA, 22 nt, Human
guacauauggcacaugcuauuu

SEQ ID NO: 198397 - RNA, 22 nt, Human
guaccuguacauaacuacauau

SEQ ID NO: 198398 - RNA, 22 nt, Human
uaaauuagauucccagcgcuau

SEQ ID NO: 198399 - RNA, 22 nt, Human
gguuuguggagcuggaaacacu

SEQ ID NO: 198400 - RNA, 22 nt, Human
gguuuuccaguagaucagaaga

SEQ ID NO: 198401 - RNA, 22 nt, Human
gguuugccagugcuggaaugca

SEQ ID NO: 198402 - RNA, 22 nt, Human
gguuugggaagaacuauucccu

SEQ ID NO: 198403 - RNA, 22 nt, Human
uaaaaucaugacagauugacau

SEQ ID NO: 198404 - RNA, 22 nt, Human
uaaaguauucaaguagcuuucu

SEQ ID NO: 198405 - RNA, 22 nt, Human
uaaaggaguguauaauuguagu

SEQ ID NO: 198406 - RNA, 22 nt, Human
uaaacgaagcuucaugcuugaa

SEQ ID NO: 198407 - RNA, 22 nt, Human
gguguagggaaacuugacuaau

SEQ ID NO: 198408 - RNA, 22 nt, Human
uaaaacuaugcaaccuacuacc

SEQ ID NO: 198409 - RNA, 22 nt, Human
ggugugugugugugugugugug

SEQ ID NO: 198410 - RNA, 22 nt, Human
uaaaaauuagauauguauuuag

SEQ ID NO: 198411 - RNA, 22 nt, Human
gguguacgaagaggcgggaguc

SEQ ID NO: 198412 - RNA, 22 nt, Human
ggugguucagugguuagggcca

SEQ ID NO: 198413 - RNA, 22 nt, Human
ggugcagucuggggcacauuau

SEQ ID NO: 198414 - RNA, 22 nt, Human
ggugcaaagauggcaguugcaa

SEQ ID NO: 198415 - RNA, 19 nt, Human
ggugaucugucccuugcuc

SEQ ID NO: 198416 - RNA, 22 nt, Human
ggugcugcugcugaacccagcu

SEQ ID NO: 198417 - RNA, 22 nt, Human
guuggugagaguuagggauuua

SEQ ID NO: 198418 - RNA, 22 nt, Human
ggucaucacugagagcagaucc

SEQ ID NO: 198419 - RNA, 22 nt, Human
gugcuuccuguauugauuccau

SEQ ID NO: 198420 - RNA, 22 nt, Human
guugugcaaaacaggaaggucu

SEQ ID NO: 198421 - RNA, 22 nt, Human
ggucgaguuccuuguuuuuuau

SEQ ID NO: 198422 - RNA, 22 nt, Human
guuguuaagugcugguuguuag

SEQ ID NO: 198423 - RNA, 22 nt, Human
guuguuuucagcccagcauuag

SEQ ID NO: 198424 - RNA, 22 nt, Human
gugcuggcaaagagaacaucuu

SEQ ID NO: 198425 - RNA, 22 nt, Human
gugcugucguggaacugggcug

SEQ ID NO: 198426 - RNA, 22 nt, Human
guuggaaauaucagucacguga

SEQ ID NO: 198427 - RNA, 22 nt, Human
guugggguuucaguggcaguca

SEQ ID NO: 198428 - RNA, 22 nt, Human
guugggugccagaggcuucacg

SEQ ID NO: 198429 - RNA, 20 nt, Human
guugggagaagugucagcug

SEQ ID NO: 198430 - RNA, 22 nt, Human
guuggcgaaggaccuggaggag

SEQ ID NO: 198431 - RNA, 22 nt, Human
guuuauuucuuaucaucacuau

SEQ ID NO: 198432 - RNA, 22 nt, Human
guuuauucuuuuauuugugaga

SEQ ID NO: 198433 - RNA, 22 nt, Human
ggucugagcaaguuaccauggg

SEQ ID NO: 198434 - RNA, 22 nt, Human
ggucugauaccugcagguuguc

SEQ ID NO: 198435 - RNA, 19 nt, Human
ggucugcggggugaccgug

SEQ ID NO: 198436 - RNA, 22 nt, Human
guuuggguggcuagagaaagaa

SEQ ID NO: 198437 - RNA, 22 nt, Human
ggugaucucagucuagaugguu

SEQ ID NO: 198438 - RNA, 22 nt, Human
guuugagcaaucccucuauccc

SEQ ID NO: 198439 - RNA, 22 nt, Human
guuugaacagaaggguugauca

SEQ ID NO: 198440 - RNA, 22 nt, Human
guuugcagacuauguaaacuuc

SEQ ID NO: 198441 - RNA, 22 nt, Human
guuucuguggacucugcuuagg

SEQ ID NO: 198442 - RNA, 22 nt, Human
guuuccaggcuuugguaugguu

SEQ ID NO: 198443 - RNA, 22 nt, Human
guuucucuuugguggguugaga

SEQ ID NO: 198444 - RNA, 22 nt, Human
ggugaguagaaguaguuggcuu

SEQ ID NO: 198445 - RNA, 18 nt, Human
ggugagggagcuggaagc

SEQ ID NO: 198446 - RNA, 22 nt, Human
guuuccaagucucucaacaccc

SEQ ID NO: 198447 - RNA, 22 nt, Human
gucucuuuugauuuuucacuca

SEQ ID NO: 198448 - RNA, 22 nt, Human
gucugcacgugccagggagggg

SEQ ID NO: 198449 - RNA, 22 nt, Human
gucucacuucauuuucuuagcc

SEQ ID NO: 198450 - RNA, 22 nt, Human
ggcuggagcaggcugcacagug

SEQ ID NO: 198451 - RNA, 22 nt, Human
ggcugggaggcggaggcugaga

SEQ ID NO: 198452 - RNA, 22 nt, Human
gucugcuuuuaucacaugucau

SEQ ID NO: 198453 - RNA, 22 nt, Human
gucuggagccacugcugcugcu

SEQ ID NO: 198454 - RNA, 22 nt, Human
gucugguggaguuguauauacu

SEQ ID NO: 198455 - RNA, 22 nt, Human
gucugcucauguuugguuugug

SEQ ID NO: 198456 - RNA, 22 nt, Human
guccuuaaauacgaugaacaug

SEQ ID NO: 198457 - RNA, 22 nt, Human
guccuucgcggcugaggccauu

SEQ ID NO: 198458 - RNA, 22 nt, Human
guccuuuuuuuauacccaggcc

SEQ ID NO: 198459 - RNA, 22 nt, Human
gucgagcuggaggagcgaaugg

SEQ ID NO: 198460 - RNA, 17 nt, Human
ggcugccaggcaacaua

SEQ ID NO: 198461 - RNA, 22 nt, Human
ggcugcuauuggucuggcuugg

SEQ ID NO: 198462 - RNA, 22 nt, Human
gucuauucaucauucaucaaac

SEQ ID NO: 198463 - RNA, 22 nt, Human
gucguuugucaauuuugaugug

SEQ ID NO: 198464 - RNA, 22 nt, Human
ggcuggaacuucuucuggcauu

SEQ ID NO: 198465 - RNA, 22 nt, Human
guccaggucauuuaaaaagucc

SEQ ID NO: 198466 - RNA, 22 nt, Human
guccaauguggcaccacagggg

SEQ ID NO: 198467 - RNA, 22 nt, Human
guccaugugcuaacagugcuua

SEQ ID NO: 198468 - RNA, 22 nt, Human
gucaugaugauacagguggagg

SEQ ID NO: 198469 - RNA, 22 nt, Human
ggcuaaucaagaaggcccagug

SEQ ID NO: 198470 - RNA, 22 nt, Human
ggcuagggagacagagggcaug

SEQ ID NO: 198471 - RNA, 22 nt, Human
ggcuauuguuuuaaaaaaugag

SEQ ID NO: 198472 - RNA, 22 nt, Human
ggcuccagauguccccuggcaa

SEQ ID NO: 198473 - RNA, 22 nt, Human
ggcgucuugcgggcgguagcgc

SEQ ID NO: 198474 - RNA, 22 nt, Human
ggcgggucuagggcccuggagu

SEQ ID NO: 198475 - RNA, 22 nt, Human
ggcguccuccucgucugaggcg

SEQ ID NO: 198476 - RNA, 22 nt, Human
ggcugaugacgccugagucuga

SEQ ID NO: 198477 - RNA, 22 nt, Human
ggcuccuuguaugauauuuugu

SEQ ID NO: 198478 - RNA, 22 nt, Human
ggcucuggcgagcuuuaguaca

SEQ ID NO: 198479 - RNA, 22 nt, Human
guccuguccuguccuggagaca

SEQ ID NO: 198480 - RNA, 22 nt, Human
guccuggugccaccugcgggau

SEQ ID NO: 198481 - RNA, 22 nt, Human
guccugauggccauuuuucacu

SEQ ID NO: 198482 - RNA, 22 nt, Human
guccguaauuuuugcuugcaga

SEQ ID NO: 198483 - RNA, 22 nt, Human
ggcugcagggaacaggaugggu

SEQ ID NO: 198484 - RNA, 22 nt, Human
guaugugguaccaugcaacggg

SEQ ID NO: 198485 - RNA, 22 nt, Human
guauuaagaaaugccugugaaa

SEQ ID NO: 198486 - RNA, 22 nt, Human
guauuaugaaugccgaggcggc

SEQ ID NO: 198487 - RNA, 22 nt, Human
guauuugacaccagugaauggu

SEQ ID NO: 198488 - RNA, 22 nt, Human
guauuggcaguauacauagcac

SEQ ID NO: 198489 - RNA, 22 nt, Human
gucacaaaugauuuagcaauca

SEQ ID NO: 198490 - RNA, 22 nt, Human
gucaaaguuaacuagcaggugc

SEQ ID NO: 198491 - RNA, 22 nt, Human
gucaaugcuuaguuugccugaa

SEQ ID NO: 198492 - RNA, 22 nt, Human
guauuuggacugccuguucauu

SEQ ID NO: 198493 - RNA, 22 nt, Human
gucaggugcaccuccaccaaca

SEQ ID NO: 198494 - RNA, 22 nt, Human
gucagaagauagaggaaguuug

SEQ ID NO: 198495 - RNA, 22 nt, Human
gucacuguuucacuguucauua

SEQ ID NO: 198496 - RNA, 22 nt, Human
gucagacucuggggccccaggc

SEQ ID NO: 198497 - RNA, 20 nt, Human
gucagaggacccuagagcga

SEQ ID NO: 198498 - RNA, 22 nt, Human
ggcggcaagggaauggagaaga

SEQ ID NO: 198499 - RNA, 20 nt, Human
gucaucucagggacugucug

SEQ ID NO: 198500 - RNA, 22 nt, Human
gucaguggugcuuaaaguuuca

SEQ ID NO: 198501 - RNA, 22 nt, Human
gucagugcuuuaguucaggaug

SEQ ID NO: 198502 - RNA, 22 nt, Human
gucaucugagggacgagauuuc

SEQ ID NO: 198503 - RNA, 22 nt, Human
ggcgggggagccaggaacccag

SEQ ID NO: 198504 - RNA, 22 nt, Human
guauaaagaugccauacuuacu

SEQ ID NO: 198505 - RNA, 22 nt, Human
ggcgacuacugaaugcuugaaa

SEQ ID NO: 198506 - RNA, 22 nt, Human
ggccaguauacaaacuuccggu

SEQ ID NO: 198507 - RNA, 22 nt, Human
ggccagcuuugagcugcaggaa

SEQ ID NO: 198508 - RNA, 22 nt, Human
gguuuucagaaugcaguccugu

SEQ ID NO: 198509 - RNA, 22 nt, Human
gguuuauucccacaaaggaagu

SEQ ID NO: 198510 - RNA, 22 nt, Human
gguuucuuuccucucugugccu

SEQ ID NO: 198511 - RNA, 22 nt, Human
gguuuucacgauccucccuuuu

SEQ ID NO: 198512 - RNA, 22 nt, Human
gguuugauauguuugugauucu

SEQ ID NO: 198513 - RNA, 22 nt, Human
guaucuuuauuuuaauuaagau

SEQ ID NO: 198514 - RNA, 22 nt, Human
ggcgcaguguucgcccucucgc

SEQ ID NO: 198515 - RNA, 22 nt, Human
guauauuuaugagcauuagccu

SEQ ID NO: 198516 - RNA, 22 nt, Human
guauauccaauaggugaugaaa

SEQ ID NO: 198517 - RNA, 22 nt, Human
guaucaggugugagcauuuuaa

SEQ ID NO: 198518 - RNA, 22 nt, Human
ggcgcccucccuguccgucuuc

SEQ ID NO: 198519 - RNA, 22 nt, Human
ggcgccugguauucuuccucuc

SEQ ID NO: 198520 - RNA, 22 nt, Human
guaugaguggauagauguaucu

SEQ ID NO: 198521 - RNA, 22 nt, Human
guaugugucuuagaacuuggga

SEQ ID NO: 198522 - RNA, 22 nt, Human
guaugucuuaggguucaguaac

SEQ ID NO: 198523 - RNA, 22 nt, Human
gugaucagaagaaccugccgaa

SEQ ID NO: 198524 - RNA, 22 nt, Human
gugauggggagagcgcagcuuu

SEQ ID NO: 198525 - RNA, 22 nt, Human
gugaugaaggccugcaccuggu

SEQ ID NO: 198526 - RNA, 20 nt, Human
gggaauggauggauugcucc

SEQ ID NO: 198527 - RNA, 22 nt, Human
gggaauuuuaggaugacuccua

SEQ ID NO: 198528 - RNA, 22 nt, Human
gggagaaccagccagugcaagg

SEQ ID NO: 198529 - RNA, 22 nt, Human
gugauucaucuggggccuuauu

SEQ ID NO: 198530 - RNA, 22 nt, Human
gggacugguuguguguggugug

SEQ ID NO: 198531 - RNA, 20 nt, Human
gggacugagccuuguuugug

SEQ ID NO: 198532 - RNA, 22 nt, Human
gugcaaugaguguggcaaagcc

SEQ ID NO: 198533 - RNA, 22 nt, Human
gugauuucagguuuuucauacu

SEQ ID NO: 198534 - RNA, 22 nt, Human
gugcagcugguggagucugggg

SEQ ID NO: 198535 - RNA, 22 nt, Human
gggagauuuguguaggaaaacu

SEQ ID NO: 198536 - RNA, 22 nt, Human
gugcauauguguguauacaaac

SEQ ID NO: 198537 - RNA, 22 nt, Human
gugcaucuguaauuacaauggu

SEQ ID NO: 198538 - RNA, 22 nt, Human
gggaggaagaguaggaauuuga

SEQ ID NO: 198539 - RNA, 21 nt, Human
gggaggagcuucccuuugccc

SEQ ID NO: 198540 - RNA, 22 nt, Human
gggagccagcagggcauggagc

SEQ ID NO: 198541 - RNA, 22 nt, Human
gggagcccuggacgggcgguau

SEQ ID NO: 198542 - RNA, 22 nt, Human
gggagcugagcuggaagagaau

SEQ ID NO: 198543 - RNA, 20 nt, Human
gggaucgaguaccuccgggu

SEQ ID NO: 198544 - RNA, 22 nt, Human
gugccugcucauucucaauauu

SEQ ID NO: 198545 - RNA, 22 nt, Human
gggaguggagagugaagcuaau

SEQ ID NO: 198546 - RNA, 22 nt, Human
gggaguauguccgggcucuaga

SEQ ID NO: 198547 - RNA, 22 nt, Human
gggagggucugagagcugcacc

SEQ ID NO: 198548 - RNA, 22 nt, Human
gugcccaguugaggccaggacu

SEQ ID NO: 198549 - RNA, 22 nt, Human
gugccaccagaugcuguugcua

SEQ ID NO: 198550 - RNA, 22 nt, Human
gugccgcuggagcuggaauuga

SEQ ID NO: 198551 - RNA, 22 nt, Human
gugccgggcugcggcaaggugu

SEQ ID NO: 198552 - RNA, 22 nt, Human
gugcgaaagaagcgacuccagu

SEQ ID NO: 198553 - RNA, 20 nt, Human
gugcggcucuaccacucggu

SEQ ID NO: 198554 - RNA, 22 nt, Human
gugcuacacaaauguuaguugu

SEQ ID NO: 198555 - RNA, 22 nt, Human
gggauggggagcuggaaagggg

SEQ ID NO: 198556 - RNA, 22 nt, Human
gggauguauguuuguguggaga

SEQ ID NO: 198557 - RNA, 22 nt, Human
gugcucgagcugugcgcgcugc

SEQ ID NO: 198558 - RNA, 22 nt, Human
gggaugaaugccuggcuccccc

SEQ ID NO: 198559 - RNA, 22 nt, Human
gggcaagagaggaagagauggc

SEQ ID NO: 198560 - RNA, 22 nt, Human
gugcugcaaggauggagaggca

SEQ ID NO: 198561 - RNA, 22 nt, Human
gggaaaauguuucugagacaaa

SEQ ID NO: 198562 - RNA, 22 nt, Human
gugacuaugguggagaucagua

SEQ ID NO: 198563 - RNA, 22 nt, Human
gugacugagcuggcaaaguaug

SEQ ID NO: 198564 - RNA, 22 nt, Human
gggaacuguaguuuacgcugcc

SEQ ID NO: 198565 - RNA, 22 nt, Human
gggaaaugugucuuggcauucu

SEQ ID NO: 198566 - RNA, 23 nt, Human
gggaaaucaaaagauauuucuuc

SEQ ID NO: 198567 - RNA, 20 nt, Human
gugaaguuuucugaagacag

SEQ ID NO: 198568 - RNA, 22 nt, Human
ggcuuuuucccuaggguaagag

SEQ ID NO: 198569 - RNA, 22 nt, Human
gggaaaaaggaaccuuauuacu

SEQ ID NO: 198570 - RNA, 22 nt, Human
gugauauaacaauuuagggaau

SEQ ID NO: 198571 - RNA, 22 nt, Human
gugaguuuucgugacacuauuu

SEQ ID NO: 198572 - RNA, 17 nt, Human
gugagcugagucaggac

SEQ ID NO: 198573 - RNA, 22 nt, Human
gggaagaaccucugcuaccaau

SEQ ID NO: 198574 - RNA, 22 nt, Human
gggaacccaaauaggaaaauug

SEQ ID NO: 198575 - RNA, 22 nt, Human
gugacugagugaagguugggua

SEQ ID NO: 198576 - RNA, 22 nt, Human
gggaagaacugauuucacacca

SEQ ID NO: 198577 - RNA, 19 nt, Human
gugauauuuauuauuuauu

SEQ ID NO: 198578 - RNA, 22 nt, Human
ggcuuaugaucugacccaucga

SEQ ID NO: 198579 - RNA, 22 nt, Human
ggcuuauauguauucccagaga

SEQ ID NO: 198580 - RNA, 22 nt, Human
gugaaauuguacacucaguacc

SEQ ID NO: 198581 - RNA, 23 nt, Human
gugaacaaugcuccaggagauac

SEQ ID NO: 198582 - RNA, 22 nt, Human
ggcuuuuguuauaaucaggccu

SEQ ID NO: 198583 - RNA, 22 nt, Human
gugaagcaagggucaccugugg

SEQ ID NO: 198584 - RNA, 21 nt, Human
ggcuguuaauagugauuagaa

SEQ ID NO: 198585 - RNA, 22 nt, Human
gucuuugagccucaguuuccuc

SEQ ID NO: 198586 - RNA, 22 nt, Human
ggcuggggccuguugaagaugc

SEQ ID NO: 198587 - RNA, 22 nt, Human
ggcugugaaguacguugaaggu

SEQ ID NO: 198588 - RNA, 22 nt, Human
gucuuucuuuuacauauuugug

SEQ ID NO: 198589 - RNA, 22 nt, Human
gucuguuggcacagggggaggu

SEQ ID NO: 198590 - RNA, 22 nt, Human
gggaaaucugcuuccuagggcu

SEQ ID NO: 198591 - RNA, 22 nt, Human
gcuguuguugcacggaaggugg

SEQ ID NO: 198592 - RNA, 22 nt, Human
gggaaaaaggaguuagagauaa

SEQ ID NO: 198593 - RNA, 22 nt, Human
gcuguuuaaguggaauuuguuu

SEQ ID NO: 198594 - RNA, 22 nt, Human
gcuguuucuuuggcaaacugau

SEQ ID NO: 198595 - RNA, 22 nt, Human
ggcuuguccuucugguugucuu

SEQ ID NO: 198596 - RNA, 22 nt, Human
gcuguuggaggaguucagugcu

SEQ ID NO: 198597 - RNA, 22 nt, Human
ggcuuguaggugauggagaacu

SEQ ID NO: 198598 - RNA, 19 nt, Human
ggcuuugcccuucgcuccg

SEQ ID NO: 198599 - RNA, 22 nt, Human
ggcuucuuaacauuuggacacc

SEQ ID NO: 198600 - RNA, 22 nt, Human
ggcuuugggaggaugaggcggu

SEQ ID NO: 198601 - RNA, 21 nt, Human
ggccagauucucccauagcug

SEQ ID NO: 198602 - RNA, 22 nt, Human
ggccacgggguuugcugaaacu

SEQ ID NO: 198603 - RNA, 22 nt, Human
ggccacauuccagagggcugaa

SEQ ID NO: 198604 - RNA, 22 nt, Human
gggaagugcaguuuucuuuugg

SEQ ID NO: 198605 - RNA, 22 nt, Human
gcuugcugaacaggaaccuggc

SEQ ID NO: 198606 - RNA, 22 nt, Human
gggaagugagcuggaaucaagg

SEQ ID NO: 198607 - RNA, 22 nt, Human
gcuucuguuaggauguggcuua

SEQ ID NO: 198608 - RNA, 20 nt, Human
gcuugcggacagguggcuca

SEQ ID NO: 198609 - RNA, 22 nt, Human
gggacaggacuccuggggccug

SEQ ID NO: 198610 - RNA, 22 nt, Human
gggacagcuggggguaaagcau

SEQ ID NO: 198611 - RNA, 22 nt, Human
gggaauguuaaccuuucuauuu

SEQ ID NO: 198612 - RNA, 22 nt, Human
gggacgggcuagcugccguggc

SEQ ID NO: 198613 - RNA, 18 nt, Human
gcuuggguggcuauguuu

SEQ ID NO: 198614 - RNA, 22 nt, Human
gcuuguuuagcauaggucacug

SEQ ID NO: 198615 - RNA, 22 nt, Human
gggacugcgagauucucaaggg

SEQ ID NO: 198616 - RNA, 22 nt, Human
gcuuaggcgcuccuuuucacuc

SEQ ID NO: 198617 - RNA, 22 nt, Human
gcuuauugcuuauagauaggaa

SEQ ID NO: 198618 - RNA, 22 nt, Human
gggaacuuggcaggaaaauuau

SEQ ID NO: 198619 - RNA, 22 nt, Human
gggaacuuugugagacuggaga

SEQ ID NO: 198620 - RNA, 22 nt, Human
gggaagagggagcuggaaugau

SEQ ID NO: 198621 - RNA, 21 nt, Human
gggaagagaagagaaaggagg

SEQ ID NO: 198622 - RNA, 22 nt, Human
gggaagaagaaaagagguggga

SEQ ID NO: 198623 - RNA, 18 nt, Human
gggaagaugccacaguga

SEQ ID NO: 198624 - RNA, 22 nt, Human
gggcuuguuaacuuggcuucca

SEQ ID NO: 198625 - RNA, 22 nt, Human
ggaauguuuuccagaccuagau

SEQ ID NO: 198626 - RNA, 22 nt, Human
ggacggcuagcagcagaauuca

SEQ ID NO: 198627 - RNA, 22 nt, Human
ggacccagggcuuauucauguu

SEQ ID NO: 198628 - RNA, 22 nt, Human
gggccggcuggggcggggcggg

SEQ ID NO: 198629 - RNA, 22 nt, Human
gggccggagaagguagcugaag

SEQ ID NO: 198630 - RNA, 21 nt, Human
gggccugggccagggccgggu

SEQ ID NO: 198631 - RNA, 21 nt, Human
ggaauagcuuaaagugagggg

SEQ ID NO: 198632 - RNA, 22 nt, Human
ggaauaauauuacagauacagu

SEQ ID NO: 198633 - RNA, 22 nt, Human
ggaauaaaaggagguggcgaga

SEQ ID NO: 198634 - RNA, 22 nt, Human
ggaaguuugagcaucuguuucc

SEQ ID NO: 198635 - RNA, 20 nt, Human
gggccagguggaccaggggc

SEQ ID NO: 198636 - RNA, 22 nt, Human
ggaagaggaagaugaggcagca

SEQ ID NO: 198637 - RNA, 22 nt, Human
gggccgcagccucuccggccug

SEQ ID NO: 198638 - RNA, 22 nt, Human
ggaagaagagggagcuguggga

SEQ ID NO: 198639 - RNA, 22 nt, Human
ggaagauagaaguucaaaaguu

SEQ ID NO: 198640 - RNA, 22 nt, Human
ggaaaggacuggagcccagcgc

SEQ ID NO: 198641 - RNA, 22 nt, Human
gggcagaaaggaaggcuggggg

SEQ ID NO: 198642 - RNA, 22 nt, Human
gggcagagggcgagcugggaga

SEQ ID NO: 198643 - RNA, 22 nt, Human
gggcaggacccguuagaguggc

SEQ ID NO: 198644 - RNA, 22 nt, Human
gcuuuccuggcccugucccugc

SEQ ID NO: 198645 - RNA, 22 nt, Human
gcuuucagggucacugucaaca

SEQ ID NO: 198646 - RNA, 22 nt, Human
gcuuguuagcaaugcagaaucu

SEQ ID NO: 198647 - RNA, 19 nt, Human
gggagaaaaucuuuauccu

SEQ ID NO: 198648 - RNA, 22 nt, Human
gcuuuuuaauuugcuucccugg

SEQ ID NO: 198649 - RNA, 22 nt, Human
gcuuuugagaaaguguuuuccc

SEQ ID NO: 198650 - RNA, 22 nt, Human
gggauacuuuguuucccugcca

SEQ ID NO: 198651 - RNA, 22 nt, Human
gggagcucaccaugcucugcau

SEQ ID NO: 198652 - RNA, 22 nt, Human
ggguuuuaccagauguguggug

SEQ ID NO: 198653 - RNA, 22 nt, Human
ggguuuuggggaggaagugagc

SEQ ID NO: 198654 - RNA, 22 nt, Human
gguaagcugcuguagggucaga

SEQ ID NO: 198655 - RNA, 22 nt, Human
gguaagcacuucauguacauga

SEQ ID NO: 198656 - RNA, 22 nt, Human
ggguuuccugcucgcggguagc

SEQ ID NO: 198657 - RNA, 22 nt, Human
ggaucaccagguuuguuguugg

SEQ ID NO: 198658 - RNA, 22 nt, Human
ggguuguuuguauuucucugaa

SEQ ID NO: 198659 - RNA, 22 nt, Human
ggaucgauuccaaauguagauc

SEQ ID NO: 198660 - RNA, 22 nt, Human
ggaucuaaagccagaauauaug

SEQ ID NO: 198661 - RNA, 22 nt, Human
ggaugaguuguauauaggauuc

SEQ ID NO: 198662 - RNA, 22 nt, Human
ggguuccuuggaacacuguuug

SEQ ID NO: 198663 - RNA, 22 nt, Human
ggguuaaauggauggcauuugc

SEQ ID NO: 198664 - RNA, 22 nt, Human
gggugcuucauaggugaugcug

SEQ ID NO: 198665 - RNA, 22 nt, Human
ggagucugugucuugaagcagu

SEQ ID NO: 198666 - RNA, 22 nt, Human
ggagugaagacagagugaacuu

SEQ ID NO: 198667 - RNA, 22 nt, Human
ggagugaaugguggccguguuu

SEQ ID NO: 198668 - RNA, 22 nt, Human
ggagguggagcuggaaguucca

SEQ ID NO: 198669 - RNA, 19 nt, Human
ggaggguguccucaguguc

SEQ ID NO: 198670 - RNA, 22 nt, Human
ggagguaagaggcccugggccg

SEQ ID NO: 198671 - RNA, 22 nt, Human
gggcuuuuccauuccaggguuc

SEQ ID NO: 198672 - RNA, 18 nt, Human
gggcuuuacagaguggag

SEQ ID NO: 198673 - RNA, 18 nt, Human
gggcuuugggguucuauc

SEQ ID NO: 198674 - RNA, 22 nt, Human
ggagauggucacagguaaacau

SEQ ID NO: 198675 - RNA, 22 nt, Human
ggagaugacaucccagcccggc

SEQ ID NO: 198676 - RNA, 22 nt, Human
ggagcagaggaaagaguagcau

SEQ ID NO: 198677 - RNA, 22 nt, Human
gggggcgccgccgcucaucuca

SEQ ID NO: 198678 - RNA, 22 nt, Human
gggggaggcucggcgccgcggu

SEQ ID NO: 198679 - RNA, 22 nt, Human
gggggagcuacaggucccuugg

SEQ ID NO: 198680 - RNA, 22 nt, Human
ggagcaguggaggggccagggu

SEQ ID NO: 198681 - RNA, 22 nt, Human
ggaggccgugcugugcugccag

SEQ ID NO: 198682 - RNA, 22 nt, Human
ggaggccccccaugcagcucca

SEQ ID NO: 198683 - RNA, 22 nt, Human
ggagcuaaggauuuuuauaugu

SEQ ID NO: 198684 - RNA, 22 nt, Human
ggaggccagagaagagccaggc

SEQ ID NO: 198685 - RNA, 22 nt, Human
ggagcaucuaccauuucuagau

SEQ ID NO: 198686 - RNA, 22 nt, Human
ggagccuggaguuucugauggg

SEQ ID NO: 198687 - RNA, 22 nt, Human
ggagccaguuuagaccucaguu

SEQ ID NO: 198688 - RNA, 22 nt, Human
ggaggaaauccuuaguaaggca

SEQ ID NO: 198689 - RNA, 22 nt, Human
ggagcugaacccuuaacuggcu

SEQ ID NO: 198690 - RNA, 22 nt, Human
ggaugcagcagagaccuggagu

SEQ ID NO: 198691 - RNA, 22 nt, Human
ggauggugauguacccagucau

SEQ ID NO: 198692 - RNA, 22 nt, Human
gguaugaggaugaggguggcau

SEQ ID NO: 198693 - RNA, 22 nt, Human
gguauccaaauaaagcagguaa

SEQ ID NO: 198694 - RNA, 20 nt, Human
ggucagccaagaaguuaccu

SEQ ID NO: 198695 - RNA, 22 nt, Human
ggucgagcagcacccguucggc

SEQ ID NO: 198696 - RNA, 22 nt, Human
ggucccacgauguaccugucug

SEQ ID NO: 198697 - RNA, 22 nt, Human
gguccgcgcgcagaggcccugg

SEQ ID NO: 198698 - RNA, 22 nt, Human
ggucauacaaggcacuggugau

SEQ ID NO: 198699 - RNA, 22 nt, Human
ggucaaauaugaguaauuuccu

SEQ ID NO: 198700 - RNA, 22 nt, Human
ggcagauaaacaauguuguaua

SEQ ID NO: 198701 - RNA, 20 nt, Human
ggcagcaaccauaugcuaca

SEQ ID NO: 198702 - RNA, 22 nt, Human
ggcagagguagcuggaaccagg

SEQ ID NO: 198703 - RNA, 22 nt, Human
ggugaggagaaacucugccccu

SEQ ID NO: 198704 - RNA, 20 nt, Human
ggcagagcuaugucuguugc

SEQ ID NO: 198705 - RNA, 22 nt, Human
ggcacccugcauuggcuugagu

SEQ ID NO: 198706 - RNA, 22 nt, Human
ggugacuucugaaccuggagug

SEQ ID NO: 198707 - RNA, 22 nt, Human
ggcaauuacguauuagucaugu

SEQ ID NO: 198708 - RNA, 19 nt, Human
gguccguuacaggcuuucc

SEQ ID NO: 198709 - RNA, 22 nt, Human
ggcaaggaagaaagcagaaguu

SEQ ID NO: 198710 - RNA, 22 nt, Human
gguguuaaccagcuaaaguuug

SEQ ID NO: 198711 - RNA, 22 nt, Human
ggugugaauagagccuggagca

SEQ ID NO: 198712 - RNA, 22 nt, Human
gguguggcaguggaccugugaa

SEQ ID NO: 198713 - RNA, 22 nt, Human
ggugucucagauuguaaaaugu

SEQ ID NO: 198714 - RNA, 22 nt, Human
ggugucguuucacaugacccag

SEQ ID NO: 198715 - RNA, 22 nt, Human
ggcauugauggggucuugggga

SEQ ID NO: 198716 - RNA, 22 nt, Human
gguuauuucugauuauaugaua

SEQ ID NO: 198717 - RNA, 20 nt, Human
ggcauuuuuuaguugagcuu

SEQ ID NO: 198718 - RNA, 22 nt, Human
ggccaaagagcacaaugaauag

SEQ ID NO: 198719 - RNA, 22 nt, Human
ggccaccuaagguugugcauca

SEQ ID NO: 198720 - RNA, 22 nt, Human
ggccaauuuccuagacauuagu

SEQ ID NO: 198721 - RNA, 22 nt, Human
gguugcggaccagcugggcugc

SEQ ID NO: 198722 - RNA, 22 nt, Human
ggugaggggauccuguuaccau

SEQ ID NO: 198723 - RNA, 22 nt, Human
ggugauaaaaagcauuuaaauu

SEQ ID NO: 198724 - RNA, 22 nt, Human
gguggcauguaccucacagacu

SEQ ID NO: 198725 - RNA, 22 nt, Human
gguggagacucagauuuguugc

SEQ ID NO: 198726 - RNA, 20 nt, Human
ggcaucugacaacuaguugc

SEQ ID NO: 198727 - RNA, 22 nt, Human
gguggcauucaguaaguauaua

SEQ ID NO: 198728 - RNA, 22 nt, Human
ggcaguguggauccuggagaag

SEQ ID NO: 198729 - RNA, 22 nt, Human
gguggccuaacaaugguggcaa

SEQ ID NO: 198730 - RNA, 22 nt, Human
gguggccggcaccccacccucg

SEQ ID NO: 198731 - RNA, 22 nt, Human
ggcauuccucucuguucaugga

SEQ ID NO: 198732 - RNA, 22 nt, Human
ggcaugcaaaugugggugaccu

SEQ ID NO: 198733 - RNA, 22 nt, Human
gaugucccuggaggggacagga

SEQ ID NO: 198734 - RNA, 22 nt, Human
gaugugugugcccugggccugc

SEQ ID NO: 198735 - RNA, 22 nt, Human
gauguuggugcauucacuucug

SEQ ID NO: 198736 - RNA, 22 nt, Human
gauguuaauauguuucaccaaa

SEQ ID NO: 198737 - RNA, 22 nt, Human
gcccccgccuugcugggccagg

SEQ ID NO: 198738 - RNA, 22 nt, Human
gccccgcgcgcguagcgccgcu

SEQ ID NO: 198739 - RNA, 22 nt, Human
gcccugaaggccuccaggacuc

SEQ ID NO: 198740 - RNA, 22 nt, Human
gcccugccauugaucggcccag

SEQ ID NO: 198741 - RNA, 22 nt, Human
gcccuguguguuugcacugauu

SEQ ID NO: 198742 - RNA, 22 nt, Human
gaugguaucugcuggcuuucag

SEQ ID NO: 198743 - RNA, 22 nt, Human
gauggugauggcccuaagcuga

SEQ ID NO: 198744 - RNA, 23 nt, Human
gccaucugcugggugccccggcc

SEQ ID NO: 198745 - RNA, 22 nt, Human
gccaucugcuuagauugcuggg

SEQ ID NO: 198746 - RNA, 22 nt, Human
gcccagcuuuuugaggcaggca

SEQ ID NO: 198747 - RNA, 21 nt, Human
gaucgcaaugugggaaucaug

SEQ ID NO: 198748 - RNA, 22 nt, Human
gaucccagaggcggggauagga

SEQ ID NO: 198749 - RNA, 22 nt, Human
gaucuuacucacuucagcuggc

SEQ ID NO: 198750 - RNA, 22 nt, Human
gaucuguccuggcaguuaacac

SEQ ID NO: 198751 - RNA, 18 nt, Human
gccagcccuccaaccucc

SEQ ID NO: 198752 - RNA, 22 nt, Human
gccagucgucuuuauuacagcu

SEQ ID NO: 198753 - RNA, 22 nt, Human
gaugcauccuuucugucuucuc

SEQ ID NO: 198754 - RNA, 22 nt, Human
gccaggcggcccaggagauggc

SEQ ID NO: 198755 - RNA, 22 nt, Human
gaugauuuuguaacuggggaca

SEQ ID NO: 198756 - RNA, 22 nt, Human
gccaggagaaaaggcgaaugau

SEQ ID NO: 198757 - RNA, 22 nt, Human
gccagcuuagaucccccagccc

SEQ ID NO: 198758 - RNA, 22 nt, Human
gccaaccagucgguccaggaag

SEQ ID NO: 198759 - RNA, 23 nt, Human
gccaaacugcccguucucucugc

SEQ ID NO: 198760 - RNA, 20 nt, Human
gccaccucugcucuuucccg

SEQ ID NO: 198761 - RNA, 21 nt, Human
gccacugcugcucauucucug

SEQ ID NO: 198762 - RNA, 16 nt, Human
gccagauugaacuuug

SEQ ID NO: 198763 - RNA, 22 nt, Human
gaguuauuuuuccuguuuuuua

SEQ ID NO: 198764 - RNA, 22 nt, Human
gagucaauucaccuuggugcuu

SEQ ID NO: 198765 - RNA, 22 nt, Human
gagucaaugugcagugcagccc

SEQ ID NO: 198766 - RNA, 22 nt, Human
gaguauuuaccacuaaaugguu

SEQ ID NO: 198767 - RNA, 22 nt, Human
gaguauuagaagaguaguuauu

SEQ ID NO: 198768 - RNA, 19 nt, Human
gcaguuccucuuaagagaa

SEQ ID NO: 198769 - RNA, 23 nt, Human
gcaguggagcgagaacuuccugu

SEQ ID NO: 198770 - RNA, 22 nt, Human
gcagugcugcgacagucgggug

SEQ ID NO: 198771 - RNA, 22 nt, Human
gcauccaaggagcagaagugau

SEQ ID NO: 198772 - RNA, 22 nt, Human
gaguuaaauagcuuaggauuca

SEQ ID NO: 198773 - RNA, 22 nt, Human
gagugguaaaguguacugaaua

SEQ ID NO: 198774 - RNA, 22 nt, Human
gagugggugaaugugcucauaa

SEQ ID NO: 198775 - RNA, 22 nt, Human
gaguggcaaagagaacaaagau

SEQ ID NO: 198776 - RNA, 22 nt, Human
gaguggccugccccagccaggc

SEQ ID NO: 198777 - RNA, 22 nt, Human
gcauagacaccuuagagcaaua

SEQ ID NO: 198778 - RNA, 22 nt, Human
gcauauuuuaaaguguaaccug

SEQ ID NO: 198779 - RNA, 22 nt, Human
gcauagauauguaaugcaucau

SEQ ID NO: 198780 - RNA, 22 nt, Human
gcauaauauugagaaauuauua

SEQ ID NO: 198781 - RNA, 22 nt, Human
gcagucuacuuaagaaucucag

SEQ ID NO: 198782 - RNA, 22 nt, Human
gcaguccuugcuguguaauaaa

SEQ ID NO: 198783 - RNA, 23 nt, Human
gcagugacugggauggaaguaga

SEQ ID NO: 198784 - RNA, 22 nt, Human
gcaguagauccagcagccugca

SEQ ID NO: 198785 - RNA, 22 nt, Human
gcaguaaggaggggaaggguuu

SEQ ID NO: 198786 - RNA, 22 nt, Human
gcaguauuguguguggucaugg

SEQ ID NO: 198787 - RNA, 22 nt, Human
gcaguaaauugagagucauguu

SEQ ID NO: 198788 - RNA, 22 nt, Human
gcagguggaagcagcagacuca

SEQ ID NO: 198789 - RNA, 22 nt, Human
gaguaaggaaguguuggccaca

SEQ ID NO: 198790 - RNA, 22 nt, Human
gaguaauuuucuuaaaacauca

SEQ ID NO: 198791 - RNA, 22 nt, Human
gaguaaaagaugaggcaguaga

SEQ ID NO: 198792 - RNA, 22 nt, Human
gaguacagaagauaaaggcaca

SEQ ID NO: 198793 - RNA, 22 nt, Human
gaguagccucagucugcaagug

SEQ ID NO: 198794 - RNA, 22 nt, Human
gaguagcaguucauccacaagc

SEQ ID NO: 198795 - RNA, 18 nt, Human
gaugaagaggaagaggag

SEQ ID NO: 198796 - RNA, 22 nt, Human
gaugaagaaacucaaccaagaa

SEQ ID NO: 198797 - RNA, 22 nt, Human
gaucugguuccaggacauugca

SEQ ID NO: 198798 - RNA, 22 nt, Human
gcaggucacagcugauuggcca

SEQ ID NO: 198799 - RNA, 22 nt, Human
gcaggggguaaggggcagggcu

SEQ ID NO: 198800 - RNA, 22 nt, Human
gcaggguaggugacagguaguc

SEQ ID NO: 198801 - RNA, 21 nt, Human
gcaggggugugugagcugggg

SEQ ID NO: 198802 - RNA, 22 nt, Human
gauccucagacccuccucuggu

SEQ ID NO: 198803 - RNA, 22 nt, Human
gagaauuauacaugagcuauuu

SEQ ID NO: 198804 - RNA, 22 nt, Human
gcaggccuccccugcuggagcu

SEQ ID NO: 198805 - RNA, 22 nt, Human
gauuaagaaagauagaugugga

SEQ ID NO: 198806 - RNA, 22 nt, Human
gauuccugcuauucacagggcu

SEQ ID NO: 198807 - RNA, 22 nt, Human
gauucagagcugcaacaaagaa

SEQ ID NO: 198808 - RNA, 22 nt, Human
gauuaucaccaaauggccuccu

SEQ ID NO: 198809 - RNA, 22 nt, Human
gccucuuugcucuuugguuguu

SEQ ID NO: 198810 - RNA, 22 nt, Human
gccucucuggcaaagcggugau

SEQ ID NO: 198811 - RNA, 22 nt, Human
gauuuugaaccuuauuuggaaa

SEQ ID NO: 198812 - RNA, 22 nt, Human
gauuuugcuuuagugaaggaag

SEQ ID NO: 198813 - RNA, 22 nt, Human
gcaccacccaaaggcggggcuc

SEQ ID NO: 198814 - RNA, 22 nt, Human
gcacauauuuagaucuugaugu

SEQ ID NO: 198815 - RNA, 22 nt, Human
gcacggucagggugggggagug

SEQ ID NO: 198816 - RNA, 22 nt, Human
gcaccgagaaggaagcaugccu

SEQ ID NO: 198817 - RNA, 18 nt, Human
gccugccagccgagggac

SEQ ID NO: 198818 - RNA, 22 nt, Human
gcacauaugcuguaagcacaug

SEQ ID NO: 198819 - RNA, 22 nt, Human
gcaauuggaaugaauucuauuu

SEQ ID NO: 198820 - RNA, 22 nt, Human
gcaauagccuacaugcgucaga

SEQ ID NO: 198821 - RNA, 22 nt, Human
gccugcacucaaacacucucuu

SEQ ID NO: 198822 - RNA, 22 nt, Human
gccugcagccagggaguucucu

SEQ ID NO: 198823 - RNA, 22 nt, Human
gcagauuggguacauaaacagu

SEQ ID NO: 198824 - RNA, 22 nt, Human
gcagcaaucuucacagugucau

SEQ ID NO: 198825 - RNA, 22 nt, Human
gcagcagugugggcugaaccua

SEQ ID NO: 198826 - RNA, 22 nt, Human
gcagauccaaauauaguucuug

SEQ ID NO: 198827 - RNA, 22 nt, Human
gcgcagugagguuaagaaugca

SEQ ID NO: 198828 - RNA, 22 nt, Human
gcgccuugccuguccucuaacc

SEQ ID NO: 198829 - RNA, 21 nt, Human
gcgcgcucgugcucgacgcgc

SEQ ID NO: 198830 - RNA, 22 nt, Human
gccugggguuugcggggcugca

SEQ ID NO: 198831 - RNA, 22 nt, Human
gcagaggcugccgugggcagga

SEQ ID NO: 198832 - RNA, 22 nt, Human
gcagauaguaggagcuaaucuu

SEQ ID NO: 198833 - RNA, 22 nt, Human
gcagaugagagugugaucuggg

SEQ ID NO: 198834 - RNA, 22 nt, Human
gcgauugguuuggggccagagu

SEQ ID NO: 198835 - RNA, 22 nt, Human
gccugcugggcucuuccugcug

SEQ ID NO: 198836 - RNA, 21 nt, Human
gcagaaagugauuugcuauuc

SEQ ID NO: 198837 - RNA, 21 nt, Human
gccugcuguucacccugccac

SEQ ID NO: 198838 - RNA, 21 nt, Human
gcagaacuaggacuugaacau

SEQ ID NO: 198839 - RNA, 22 nt, Human
gcagaaguauuguacgguggga

SEQ ID NO: 198840 - RNA, 22 nt, Human
gcagacuaacuuuugucagccu

SEQ ID NO: 198841 - RNA, 22 nt, Human
gcggacaauggaagaugucauu

SEQ ID NO: 198842 - RNA, 21 nt, Human
gcagcucaggauauagacuug

SEQ ID NO: 198843 - RNA, 20 nt, Human
gcagcugacccuagugcuug

SEQ ID NO: 198844 - RNA, 22 nt, Human
gcgcucuccugcagacagccuc

SEQ ID NO: 198845 - RNA, 22 nt, Human
gcgcggcgcggguccucggccu

SEQ ID NO: 198846 - RNA, 21 nt, Human
gcagcaugagaaagccccaaa

SEQ ID NO: 198847 - RNA, 22 nt, Human
gcagggcucagccgcucccacc

SEQ ID NO: 198848 - RNA, 22 nt, Human
gcgggcgcuguggccccggccu

SEQ ID NO: 198849 - RNA, 22 nt, Human
gcgggcuuggcuccagggccca

SEQ ID NO: 198850 - RNA, 22 nt, Human
gcagggcucuggagucaggcug

SEQ ID NO: 198851 - RNA, 22 nt, Human
gcgguuggacguucgccucggg

SEQ ID NO: 198852 - RNA, 22 nt, Human
gcaggccgauuuguuagaaguc

SEQ ID NO: 198853 - RNA, 22 nt, Human
gcagguuguuuaaauuaggauu

SEQ ID NO: 198854 - RNA, 22 nt, Human
gcagugccauguggaggaucuc

SEQ ID NO: 198855 - RNA, 22 nt, Human
gcagugacagacaacuguuuga

SEQ ID NO: 198856 - RNA, 22 nt, Human
gcagucauggguagaacucaag

SEQ ID NO: 198857 - RNA, 23 nt, Human
gcugaagcccacucccugggucu

SEQ ID NO: 198858 - RNA, 22 nt, Human
gcucuagcuggcgcugaccugg

SEQ ID NO: 198859 - RNA, 22 nt, Human
gcucggcuggcucaucucaugu

SEQ ID NO: 198860 - RNA, 22 nt, Human
gcaugcgugcgugcgugcaugu

SEQ ID NO: 198861 - RNA, 23 nt, Human
gcaucgcaggucuaagauuagcu

SEQ ID NO: 198862 - RNA, 22 nt, Human
gcauccugacuauggugguggu

SEQ ID NO: 198863 - RNA, 20 nt, Human
gcucaguggagaaaugcacc

SEQ ID NO: 198864 - RNA, 22 nt, Human
gcucagccuuuuguucuauuca

SEQ ID NO: 198865 - RNA, 22 nt, Human
gcauaguuuucauagguguuuu

SEQ ID NO: 198866 - RNA, 22 nt, Human
gcaucccagaagauucugauuu

SEQ ID NO: 198867 - RNA, 22 nt, Human
gcaucacacgcacauacacaca

SEQ ID NO: 198868 - RNA, 22 nt, Human
gcuagaaggaagccccugcuga

SEQ ID NO: 198869 - RNA, 22 nt, Human
gcagugucacuaguaauagucu

SEQ ID NO: 198870 - RNA, 22 nt, Human
gcuacauuagcuucaauggcua

SEQ ID NO: 198871 - RNA, 22 nt, Human
gcuugggcugaaggccuggguc

SEQ ID NO: 198872 - RNA, 22 nt, Human
gcuuucauuauguuguguuuuu

SEQ ID NO: 198873 - RNA, 22 nt, Human
gcuuucacugcaauagaugaau

SEQ ID NO: 198874 - RNA, 22 nt, Human
gcuugaggaacucagacuugag

SEQ ID NO: 198875 - RNA, 15 nt, Human
gccgcgcuggggagc

SEQ ID NO: 198876 - RNA, 22 nt, Human
gcuugcaucaggggcuggggcc

SEQ ID NO: 198877 - RNA, 20 nt, Human
gcuugaauuugauggccaga

SEQ ID NO: 198878 - RNA, 20 nt, Human
gcuugcgugggaggaggggg

SEQ ID NO: 198879 - RNA, 22 nt, Human
gcuuuuaaauuaucugacaaug

SEQ ID NO: 198880 - RNA, 22 nt, Human
gcuuuggcuucuccuggcagga

SEQ ID NO: 198881 - RNA, 22 nt, Human
gcuuuguucauuuaguuuuuuu

SEQ ID NO: 198882 - RNA, 22 nt, Human
gcuuuugaauacuacaggaguu

SEQ ID NO: 198883 - RNA, 23 nt, Human
gcuuugaaaaugcuuucuuccag

SEQ ID NO: 198884 - RNA, 22 nt, Human
ggaaaagccauauuauaggcaa

SEQ ID NO: 198885 - RNA, 22 nt, Human
ggaaaaucaaaccauuuacagu

SEQ ID NO: 198886 - RNA, 22 nt, Human
gccggagagccaacaccacgga

SEQ ID NO: 198887 - RNA, 22 nt, Human
gcuuuugcaaagcuggagaauu

SEQ ID NO: 198888 - RNA, 22 nt, Human
ggaaaaauggguggugauauga

SEQ ID NO: 198889 - RNA, 18 nt, Human
gccucuguugacagaguu

SEQ ID NO: 198890 - RNA, 22 nt, Human
gccuagggacuuugguuuagau

SEQ ID NO: 198891 - RNA, 22 nt, Human
gccucaaaaguguuguagaggg

SEQ ID NO: 198892 - RNA, 22 nt, Human
gccuagaagaaugagcgcaggg

SEQ ID NO: 198893 - RNA, 22 nt, Human
gccggguguuccugggaagaug

SEQ ID NO: 198894 - RNA, 22 nt, Human
gccgggagugcagcgggcgcgc

SEQ ID NO: 198895 - RNA, 22 nt, Human
gccggcugggggcggagggcag

SEQ ID NO: 198896 - RNA, 22 nt, Human
gccggcccugcgcggggcggaa

SEQ ID NO: 198897 - RNA, 22 nt, Human
ggaacaguacucggaggccaga

SEQ ID NO: 198898 - RNA, 22 nt, Human
gccugccucugacuggggcuga

SEQ ID NO: 198899 - RNA, 22 nt, Human
gccugcaggaaggugugccugu

SEQ ID NO: 198900 - RNA, 22 nt, Human
ggaaaggaagggaaggagaugc

SEQ ID NO: 198901 - RNA, 22 nt, Human
ggaaaggggaaaauacagagag

SEQ ID NO: 198902 - RNA, 22 nt, Human
ggaaauauaagcaguuugugug

SEQ ID NO: 198903 - RNA, 22 nt, Human
ggaaauguguguaagaaaguau

SEQ ID NO: 198904 - RNA, 22 nt, Human
gccugaaaugaaccagaggacu

SEQ ID NO: 198905 - RNA, 22 nt, Human
gcuuauuagguuauuucaagga

SEQ ID NO: 198906 - RNA, 22 nt, Human
gcuuaugauguuuacauaaaag

SEQ ID NO: 198907 - RNA, 22 nt, Human
gcuucucacccuuacuaucucu

SEQ ID NO: 198908 - RNA, 22 nt, Human
gcuuccuccaucuggggcuugc

SEQ ID NO: 198909 - RNA, 22 nt, Human
gcuucugugagugcagaugcug

SEQ ID NO: 198910 - RNA, 21 nt, Human
gccgaugugacucuacguagu

SEQ ID NO: 198911 - RNA, 22 nt, Human
gccgcagauucugagacgugua

SEQ ID NO: 198912 - RNA, 22 nt, Human
gccgcaacggacccugggaguc

SEQ ID NO: 198913 - RNA, 22 nt, Human
gccgccgcucaccugggcgccg

SEQ ID NO: 198914 - RNA, 22 nt, Human
gcuguggagaagcugccuaugg

SEQ ID NO: 198915 - RNA, 18 nt, Human
gcuguccgguagcuggug

SEQ ID NO: 198916 - RNA, 22 nt, Human
gcuguguaugaugcaggcaccu

SEQ ID NO: 198917 - RNA, 22 nt, Human
gcuguguucauccugcccaggu

SEQ ID NO: 198918 - RNA, 22 nt, Human
gcuguggguuccuccccugucc

SEQ ID NO: 198919 - RNA, 22 nt, Human
gcuguggcuccaauggugagcc

SEQ ID NO: 198920 - RNA, 22 nt, Human
gcuguugagucagacaaguuuu

SEQ ID NO: 198921 - RNA, 22 nt, Human
gcuguugcaaucaaggccaugg

SEQ ID NO: 198922 - RNA, 22 nt, Human
gcuguugugaggaucagcauau

SEQ ID NO: 198923 - RNA, 22 nt, Human
gcuuacuguuccuguuggugcu

SEQ ID NO: 198924 - RNA, 22 nt, Human
gcuuacagauaaugaggagacu

SEQ ID NO: 198925 - RNA, 22 nt, Human
gcuguacugucugccaagccag

SEQ ID NO: 198926 - RNA, 22 nt, Human
gcugguuacuucauuagguccu

SEQ ID NO: 198927 - RNA, 22 nt, Human
gcugguuucucucauugucagu

SEQ ID NO: 198928 - RNA, 22 nt, Human
gcugucauggacaugucuguuu

SEQ ID NO: 198929 - RNA, 22 nt, Human
gcccuggcauuucuauucaugu

SEQ ID NO: 198930 - RNA, 22 nt, Human
gcccuggucguggagggcaaca

SEQ ID NO: 198931 - RNA, 22 nt, Human
gcccuguuuucuggguuccuug

SEQ ID NO: 198932 - RNA, 22 nt, Human
gcugucccccaaagaugcuccu

SEQ ID NO: 198933 - RNA, 22 nt, Human
gcccuguuauagucugaggccu

SEQ ID NO: 198934 - RNA, 22 nt, Human
gcauugcuauuucuguuagugu

SEQ ID NO: 198935 - RNA, 22 nt, Human
gcauuggaaacugcuuuaugcu

SEQ ID NO: 198936 - RNA, 22 nt, Human
gcugacuuauuagaaaaggaca

SEQ ID NO: 198937 - RNA, 22 nt, Human
gcccgaccgcgccggcccgcac

SEQ ID NO: 198938 - RNA, 22 nt, Human
gcccgccaacuugccagcggug

SEQ ID NO: 198939 - RNA, 22 nt, Human
gcauuagacuaguacacggcag

SEQ ID NO: 198940 - RNA, 22 nt, Human
gcauggaaaagggaugcuaacu

SEQ ID NO: 198941 - RNA, 22 nt, Human
gcugacuauaaggcugcucugu

SEQ ID NO: 198942 - RNA, 22 nt, Human
gcugacucugcuuuuagccucc

SEQ ID NO: 198943 - RNA, 22 nt, Human
gcugacuguagcugggggaaga

SEQ ID NO: 198944 - RNA, 22 nt, Human
ggcagucuuucccuugagcucu

SEQ ID NO: 198945 - RNA, 22 nt, Human
ggcauuccgggguccccuucuc

SEQ ID NO: 198946 - RNA, 22 nt, Human
ggcauggugggggaggacuugg

SEQ ID NO: 198947 - RNA, 21 nt, Human
ggcauguagccagcaaaggua

SEQ ID NO: 198948 - RNA, 22 nt, Human
gcuccggggguuccagaucauc

SEQ ID NO: 198949 - RNA, 19 nt, Human
gcuccugcagcuagagugc

SEQ ID NO: 198950 - RNA, 22 nt, Human
gcuagauugucacuugaguguc

SEQ ID NO: 198951 - RNA, 20 nt, Human
gcuaggggacuggagggagg

SEQ ID NO: 198952 - RNA, 22 nt, Human
ggcagguggcacugcugcuccc

SEQ ID NO: 198953 - RNA, 17 nt, Human
gcuaguuguuuccagua

SEQ ID NO: 198954 - RNA, 22 nt, Human
ggcaguagucagaggguuuuac

SEQ ID NO: 198955 - RNA, 22 nt, Human
ggcagguccugaguccugaggc

SEQ ID NO: 198956 - RNA, 22 nt, Human
ggcagucaucacuuauucauca

SEQ ID NO: 198957 - RNA, 22 nt, Human
gcgucucugggcugacccaggu

SEQ ID NO: 198958 - RNA, 22 nt, Human
gcguagaagaaagcugcugcua

SEQ ID NO: 198959 - RNA, 22 nt, Human
ggcagcgcuuggcugcucgaca

SEQ ID NO: 198960 - RNA, 22 nt, Human
ggcagcuuucaauaggguuaug

SEQ ID NO: 198961 - RNA, 22 nt, Human
gcuagaaacuguuuaaucucuu

SEQ ID NO: 198962 - RNA, 19 nt, Human
ggauaagguuggagugauc

SEQ ID NO: 198963 - RNA, 22 nt, Human
ggcaauauuauaagggcauuua

SEQ ID NO: 198964 - RNA, 22 nt, Human
ggcacuggguugcagagagaga

SEQ ID NO: 198965 - RNA, 22 nt, Human
ggcacagcgacuaccaucgaaa

SEQ ID NO: 198966 - RNA, 22 nt, Human
ggcacaggcugguaccaguuca

SEQ ID NO: 198967 - RNA, 22 nt, Human
ggaguguuaggaaguuguguuu

SEQ ID NO: 198968 - RNA, 22 nt, Human
ggagugauuugucuugucuggu

SEQ ID NO: 198969 - RNA, 19 nt, Human
ggaguugccaggagaagga

SEQ ID NO: 198970 - RNA, 22 nt, Human
ggaguuucugucaucccguccc

SEQ ID NO: 198971 - RNA, 20 nt, Human
gcgcuucccuacgcucugcu

SEQ ID NO: 198972 - RNA, 22 nt, Human
gcgcgggugagucacgggcgga

SEQ ID NO: 198973 - RNA, 22 nt, Human
gcggagaggcagagacuccgcg

SEQ ID NO: 198974 - RNA, 22 nt, Human
gcggaucuccuugagugggcaa

SEQ ID NO: 198975 - RNA, 22 nt, Human
gcgcugagcuuuucuuauugaa

SEQ ID NO: 198976 - RNA, 22 nt, Human
ggagacagugacuuagagacug

SEQ ID NO: 198977 - RNA, 22 nt, Human
gcgcgcucugcgaggacacgcu

SEQ ID NO: 198978 - RNA, 22 nt, Human
ggaggucagcuggaggggaggc

SEQ ID NO: 198979 - RNA, 22 nt, Human
ggaggguggaggagggaauuga

SEQ ID NO: 198980 - RNA, 23 nt, Human
ggaggcccagaggucggccccac

SEQ ID NO: 198981 - RNA, 22 nt, Human
ggaggggaguuugccucugggg

SEQ ID NO: 198982 - RNA, 22 nt, Human
ggaggaagagaccagggggcuu

SEQ ID NO: 198983 - RNA, 22 nt, Human
ggaggagggaguucaggaguau

SEQ ID NO: 198984 - RNA, 22 nt, Human
ggaggaugaggguggugguguu

SEQ ID NO: 198985 - RNA, 22 nt, Human
gccuucauuggaaucuagcuuc

SEQ ID NO: 198986 - RNA, 22 nt, Human
ggacauggaaagugugugauuu

SEQ ID NO: 198987 - RNA, 22 nt, Human
ggagaagaggagcuggaagccu

SEQ ID NO: 198988 - RNA, 22 nt, Human
gccuuuuaaggcagagggagau

SEQ ID NO: 198989 - RNA, 17 nt, Human
ggacuuucugccugucc

SEQ ID NO: 198990 - RNA, 22 nt, Human
ggacuggugaagccuucggaga

SEQ ID NO: 198991 - RNA, 22 nt, Human
gccuggggaacuugauccuguc

SEQ ID NO: 198992 - RNA, 22 nt, Human
gccugggccgggcgcggccccc

SEQ ID NO: 198993 - RNA, 22 nt, Human
ggaauuauuuuaaauagacauu

SEQ ID NO: 198994 - RNA, 22 nt, Human
ggaauuaagaggcuggacaggg

SEQ ID NO: 198995 - RNA, 22 nt, Human
ggaauccugguguuuucugccu

SEQ ID NO: 198996 - RNA, 22 nt, Human
ggaaugcagugagcauuagaua

SEQ ID NO: 198997 - RNA, 22 nt, Human
gccugggauuggggauuuuuug

SEQ ID NO: 198998 - RNA, 22 nt, Human
gccuggccaaucgccgucuagg

SEQ ID NO: 198999 - RNA, 22 nt, Human
ggaauauaaaucagaugcuccg

SEQ ID NO: 199000 - RNA, 22 nt, Human
ggaaucuucagccaugccaaga

SEQ ID NO: 199001 - RNA, 20 nt, Human
gccugggagaagaucaggga

SEQ ID NO: 199002 - RNA, 19 nt, Human
ggaacgcugggcuccccuc

SEQ ID NO: 199003 - RNA, 22 nt, Human
aucuucaaagcacaucguuugu

SEQ ID NO: 199004 - RNA, 20 nt, Human
uggagggaggaggggcccaa

SEQ ID NO: 199005 - RNA, 22 nt, Human
ggcuccagauguccccuggcaa

SEQ ID NO: 199006 - RNA, 22 nt, Human
auuucauuuuagaaauaagugu

SEQ ID NO: 199007 - RNA, 22 nt, Human
uuuuucuccucucucuuucauu

SEQ ID NO: 199008 - RNA, 22 nt, Human
uacaagcucuuguagggggaaa

SEQ ID NO: 199009 - RNA, 22 nt, Human
uccaggagucagacagauggug

SEQ ID NO: 199010 - RNA, 22 nt, Human
aagagaaaaaucuuaaucuagu

SEQ ID NO: 199011 - RNA, 22 nt, Human
uguugaagcaccucugucuuuc

SEQ ID NO: 199012 - RNA, 22 nt, Human
gcugcuacagagcuggaggggg

SEQ ID NO: 199013 - RNA, 22 nt, Human
cuuucuuucaaguucugcuuua

SEQ ID NO: 199014 - RNA, 22 nt, Human
auuuuauuuugggaucuuuuua

SEQ ID NO: 199015 - RNA, 22 nt, Human
cguuuugaguagauagccauau

SEQ ID NO: 199016 - RNA, 22 nt, Human
caggccccagggacugggcgcu

SEQ ID NO: 199017 - RNA, 22 nt, Human
aacugcauaagcuucgggaccu

SEQ ID NO: 199018 - RNA, 22 nt, Human
auagggaggcggagggagcugg

SEQ ID NO: 199019 - RNA, 22 nt, Human
uuuauuuuccaugucucuaggu

SEQ ID NO: 199020 - RNA, 22 nt, Human
guuuucuccugcuauacagugc

SEQ ID NO: 199021 - RNA, 22 nt, Human
uugcaagcccugaagggcugga

SEQ ID NO: 199022 - RNA, 20 nt, Human
agucuucaggugugaggauu

SEQ ID NO: 199023 - RNA, 22 nt, Human
guucuguauauauccuagcaaa

SEQ ID NO: 199024 - RNA, 22 nt, Human
aaauguaaacuguauuuauaaa

SEQ ID NO: 199025 - RNA, 22 nt, Human
aggggcugugucauuuguccua

SEQ ID NO: 199026 - RNA, 22 nt, Human
ugggcagggagcuggaaccaca

SEQ ID NO: 199027 - RNA, 17 nt, Human
ucuuuuacuuucucucc

SEQ ID NO: 199028 - RNA, 22 nt, Human
ucccuugacauuacuugggagg

SEQ ID NO: 199029 - RNA, 22 nt, Human
acauuucuccuacuuguuauuu

SEQ ID NO: 199030 - RNA, 22 nt, Human
guccuguguaaguacuugcuca

SEQ ID NO: 199031 - RNA, 22 nt, Human
cacuguugagcaauguacagug

SEQ ID NO: 199032 - RNA, 22 nt, Human
cauggcggcgcucucccugccu

SEQ ID NO: 199033 - RNA, 22 nt, Human
gugaucagaagaaccugccgaa

SEQ ID NO: 199034 - RNA, 22 nt, Human
aaaacauuuaggguuuuuuuua

SEQ ID NO: 199035 - RNA, 22 nt, Human
uacaggaggaugugcagccagg

SEQ ID NO: 199036 - RNA, 22 nt, Human
uuuccuucccuccugggccuuc

SEQ ID NO: 199037 - RNA, 23 nt, Human
caggggacaggugaccugggcuc

SEQ ID NO: 199038 - RNA, 22 nt, Human
auuaaacuaaauuaugaauugg

SEQ ID NO: 199039 - RNA, 22 nt, Human
uuugcaggaaauguacugaaug

SEQ ID NO: 199040 - RNA, 22 nt, Human
ccuuuccuggaaaugguaaguu

SEQ ID NO: 199041 - RNA, 22 nt, Human
cccagaggcugaguugggagca

SEQ ID NO: 199042 - RNA, 22 nt, Human
aagcccucagagccucuuugac

SEQ ID NO: 199043 - RNA, 20 nt, Human
uuguacuuaugugagaagga

SEQ ID NO: 199044 - RNA, 22 nt, Human
uccaaggacucuugucagcugu

SEQ ID NO: 199045 - RNA, 18 nt, Human
ggagaagaacagaugugg

SEQ ID NO: 199046 - RNA, 23 nt, Human
gaugauggcaacuacauccggug

SEQ ID NO: 199047 - RNA, 22 nt, Human
ucauuauuuugauguauuuccu

SEQ ID NO: 199048 - RNA, 21 nt, Human
caguuugcuauuuuaguauga

SEQ ID NO: 199049 - RNA, 22 nt, Human
agggggaauccugcuuauggau

SEQ ID NO: 199050 - RNA, 22 nt, Human
gcuuccuuagcuuaccaaguau

SEQ ID NO: 199051 - RNA, 22 nt, Human
ggcuagggaucuagaccaggac

SEQ ID NO: 199052 - RNA, 22 nt, Human
uagcuucccagcuaaccauguc

SEQ ID NO: 199053 - RNA, 23 nt, Human
uuuuccaaaucgacucucuaguu

SEQ ID NO: 199054 - RNA, 22 nt, Human
ggcagagguagcuggaaccagg

SEQ ID NO: 199055 - RNA, 22 nt, Human
ggaagauagaaguucaaaaguu

SEQ ID NO: 199056 - RNA, 22 nt, Human
aacagaauaucaaaagauuaug

SEQ ID NO: 199057 - RNA, 19 nt, Human
cuuguggcuaugcagauac

SEQ ID NO: 199058 - RNA, 22 nt, Human
ggcucacuguaccugccgccgc

SEQ ID NO: 199059 - RNA, 22 nt, Human
cuggaagcgucggaggaagggc

SEQ ID NO: 199060 - RNA, 19 nt, Human
agcucaggcccaucguccc

SEQ ID NO: 199061 - RNA, 22 nt, Human
gggcaggggcagugguggcauu

SEQ ID NO: 199062 - RNA, 22 nt, Human
aguuauuuuucacuauuaggcu

SEQ ID NO: 199063 - RNA, 22 nt, Human
ggcagaggagcuggaaacaugg

SEQ ID NO: 199064 - RNA, 22 nt, Human
auauuuuacagcucucguugaa

SEQ ID NO: 199065 - RNA, 22 nt, Human
uccuuguuggaauauccuuacc

SEQ ID NO: 199066 - RNA, 22 nt, Human
aggauggaaguaacuggauaau

SEQ ID NO: 199067 - RNA, 22 nt, Human
agcugaggccccgcagcagggu

SEQ ID NO: 199068 - RNA, 22 nt, Human
cagauaagcuauaaguaguacc

SEQ ID NO: 199069 - RNA, 21 nt, Human
ugagcccaaagcuguauuggu

SEQ ID NO: 199070 - RNA, 22 nt, Human
uauaagaaaagucauuaucaaa

SEQ ID NO: 199071 - RNA, 22 nt, Human
gggagggucugagagcugcacc

SEQ ID NO: 199072 - RNA, 22 nt, Human
gggcaagaagcuggaagcauuc

SEQ ID NO: 199073 - RNA, 22 nt, Human
uggcucacuuccguggagaggu

SEQ ID NO: 199074 - RNA, 22 nt, Human
ggcugugaaguacguugaaggu

SEQ ID NO: 199075 - RNA, 22 nt, Human
ccagaugggggcugugggaggg

SEQ ID NO: 199076 - RNA, 22 nt, Human
cucugugucugauucugggaag

SEQ ID NO: 199077 - RNA, 22 nt, Human
ccugccagaaaagagggaguuc

SEQ ID NO: 199078 - RNA, 22 nt, Human
caguagcuuuuugcagacaaga

SEQ ID NO: 199079 - RNA, 22 nt, Human
aucacuagaguuacauugccag

SEQ ID NO: 199080 - RNA, 22 nt, Human
uuacuuaucugaugugauuuuu

SEQ ID NO: 199081 - RNA, 22 nt, Human
gcucagagaugucugcugccuu

SEQ ID NO: 199082 - RNA, 22 nt, Human
cauaaauuuuaccuuguaagug

SEQ ID NO: 199083 - RNA, 22 nt, Human
aguaggaauucaaagagacaaa

SEQ ID NO: 199084 - RNA, 20 nt, Human
gggaauggauggauugcucc

SEQ ID NO: 199085 - RNA, 22 nt, Human
cagguugaaaguggaggagcua

SEQ ID NO: 199086 - RNA, 22 nt, Human
auggagguuugucugguuuugu

SEQ ID NO: 199087 - RNA, 22 nt, Human
ccuucugcuggucaucccagug

SEQ ID NO: 199088 - RNA, 22 nt, Human
agccccaauuacagcugugcug

SEQ ID NO: 199089 - RNA, 20 nt, Human
aauagcacagcucaaacauu

SEQ ID NO: 199090 - RNA, 22 nt, Human
agcaauucugaaauuacuugac

SEQ ID NO: 199091 - RNA, 23 nt, Human
agauaaggaagcauuugagccag

SEQ ID NO: 199092 - RNA, 21 nt, Human
acaaaaccuaacuuggcugcu

SEQ ID NO: 199093 - RNA, 22 nt, Human
uuuuaaaguaauugaagcuugu

SEQ ID NO: 199094 - RNA, 22 nt, Human
caucuaaaauaagccuuauaau

SEQ ID NO: 199095 - RNA, 22 nt, Human
gucugcccuuggccugggacuu

SEQ ID NO: 199096 - RNA, 22 nt, Human
augugugugcgagcgugugugu

SEQ ID NO: 199097 - RNA, 22 nt, Human
uauauauacauauagaauaugu

SEQ ID NO: 199098 - RNA, 20 nt, Human
ccugggcuccaggagccccg

SEQ ID NO: 199099 - RNA, 22 nt, Human
guuguuuucagcccagcauuag

SEQ ID NO: 199100 - RNA, 22 nt, Human
ucucucucucuuccagcauguu

SEQ ID NO: 199101 - RNA, 22 nt, Human
uuauuuuuguaacacuguauag

SEQ ID NO: 199102 - RNA, 22 nt, Human
ugugucuccacugugcuauuuu

SEQ ID NO: 199103 - RNA, 22 nt, Human
ggaggcccagaaggaagcccag

SEQ ID NO: 199104 - RNA, 22 nt, Human
cugaccucuaaguaacagagaa

SEQ ID NO: 199105 - RNA, 22 nt, Human
gcagguggaagcagcagacuca

SEQ ID NO: 199106 - RNA, 18 nt, Human
aguuuuuuuggcaaaagg

SEQ ID NO: 199107 - RNA, 22 nt, Human
uucacauucauuucuuauguuu

SEQ ID NO: 199108 - RNA, 22 nt, Human
ugggggaggaggagacagacug

SEQ ID NO: 199109 - RNA, 22 nt, Human
aggauggauagcaaggaagccg

SEQ ID NO: 199110 - RNA, 23 nt, Human
gugugccuuuaucuucuguacuc

SEQ ID NO: 199111 - RNA, 22 nt, Human
gcuucuguuaggauguggcuua

SEQ ID NO: 199112 - RNA, 22 nt, Human
auuucacucuuaauugcuuccu

SEQ ID NO: 199113 - RNA, 22 nt, Human
auccuccuuugcccugagauca

SEQ ID NO: 199114 - RNA, 21 nt, Human
gggagaguagcgguagggagg

SEQ ID NO: 199115 - RNA, 22 nt, Human
cuccugcuuuuucuucuuccga

SEQ ID NO: 199116 - RNA, 20 nt, Human
cccuggaaugagaugcauau

SEQ ID NO: 199117 - RNA, 22 nt, Human
ugcugcacucacaggaagaguu

SEQ ID NO: 199118 - RNA, 22 nt, Human
aucuaaaacuacgaauacuacc

SEQ ID NO: 199119 - RNA, 22 nt, Human
aggggcugagaguuugaugugg

SEQ ID NO: 199120 - RNA, 22 nt, Human
uuauuuucgugugugugugugu

SEQ ID NO: 199121 - RNA, 22 nt, Human
cacaugugggcacagggcugca

SEQ ID NO: 199122 - RNA, 22 nt, Human
ugcuuggagaaucagucccagc

SEQ ID NO: 199123 - RNA, 22 nt, Human
uuuuaaauaaacuacacugauu

SEQ ID NO: 199124 - RNA, 22 nt, Human
gugauggucgagcgcuuguugu

SEQ ID NO: 199125 - RNA, 22 nt, Human
cuccagcucgcgagcucugcuc

SEQ ID NO: 199126 - RNA, 22 nt, Human
uuccuucccccuucuuugccuu

SEQ ID NO: 199127 - RNA, 22 nt, Human
uggagccugauggauaggaacg

SEQ ID NO: 199128 - RNA, 22 nt, Human
cuccuuugagcaaaucuuugau

SEQ ID NO: 199129 - RNA, 22 nt, Human
gaggggaacaggcauucuuaag

SEQ ID NO: 199130 - RNA, 22 nt, Human
acuuccuuccagcaaauggcau

SEQ ID NO: 199131 - RNA, 22 nt, Human
auguguuuugaccccugcuaaa

SEQ ID NO: 199132 - RNA, 22 nt, Human
augugagcuggaugaauuuaua

SEQ ID NO: 199133 - RNA, 22 nt, Human
aucuguuccccuaugcucucua

SEQ ID NO: 199134 - RNA, 19 nt, Human
agugaacuccauaucaggu

SEQ ID NO: 199135 - RNA, 22 nt, Human
gcuguugugaggaucagcauau

SEQ ID NO: 199136 - RNA, 22 nt, Human
auuuucuucauuuugauuguau

SEQ ID NO: 199137 - RNA, 22 nt, Human
ucccugcugggcgaucuucucu

SEQ ID NO: 199138 - RNA, 22 nt, Human
acagccaacgucuuucuuacuu

SEQ ID NO: 199139 - RNA, 22 nt, Human
gcccugucagcucucauggaca

SEQ ID NO: 199140 - RNA, 22 nt, Human
aaggcuguuugagcacuggagc

SEQ ID NO: 199141 - RNA, 22 nt, Human
aauguuuuucaaguguggagca

SEQ ID NO: 199142 - RNA, 22 nt, Human
uuguuuucuaguguuuugaaua

SEQ ID NO: 199143 - RNA, 18 nt, Human
auucauuugcguuuggcu

SEQ ID NO: 199144 - RNA, 22 nt, Human
acuguugagggaagcagaugaa

SEQ ID NO: 199145 - RNA, 22 nt, Human
uucuucuguuggcagagcauac

SEQ ID NO: 199146 - RNA, 22 nt, Human
uuccagauguuuaaguucugcu

SEQ ID NO: 199147 - RNA, 22 nt, Human
gagcagcugagcuggaaugaga

SEQ ID NO: 199148 - RNA, 22 nt, Human
cacugguugccucuuucuguuc

SEQ ID NO: 199149 - RNA, 22 nt, Human
ggcagggaauucagagggaagg

SEQ ID NO: 199150 - RNA, 22 nt, Human
aggaaauaagggcacuucagau

SEQ ID NO: 199151 - RNA, 22 nt, Human
ucaaauaugggccagaggaaau

SEQ ID NO: 199152 - RNA, 22 nt, Human
auauuuuugcagaauuuuucgu

SEQ ID NO: 199153 - RNA, 22 nt, Human
caaaucuguuaauuucaaguug

SEQ ID NO: 199154 - RNA, 22 nt, Human
aggcauauaguguuuaaaaaaa

SEQ ID NO: 199155 - RNA, 22 nt, Human
cagcuccagcccaggcagcucc

SEQ ID NO: 199156 - RNA, 22 nt, Human
uuuguuuuggugucaugcguga

SEQ ID NO: 199157 - RNA, 22 nt, Human
uaguggaaccuucuaaaugacg

SEQ ID NO: 199158 - RNA, 21 nt, Human
uuccauggacccugucagugu

SEQ ID NO: 199159 - RNA, 22 nt, Human
gcuguggacacagcucucuuca

SEQ ID NO: 199160 - RNA, 22 nt, Human
caaagaugccaaaaggaagaca

SEQ ID NO: 199161 - RNA, 22 nt, Human
cuggccagccucccagguaccc

SEQ ID NO: 199162 - RNA, 22 nt, Human
aggccaggcgccggcgcgagac

SEQ ID NO: 199163 - RNA, 22 nt, Human
cuccuagagcacaaaaggccau

SEQ ID NO: 199164 - RNA, 22 nt, Human
uucacuguucuuagagaagacc

SEQ ID NO: 199165 - RNA, 22 nt, Human
caaggaguuuggggaccaagga

SEQ ID NO: 199166 - RNA, 22 nt, Human
uccaugaguuuuuuaguuucac

SEQ ID NO: 199167 - RNA, 22 nt, Human
uguuuuuucccccccuucuaaa

SEQ ID NO: 199168 - RNA, 22 nt, Human
agggcaggguuggugcuggugc

SEQ ID NO: 199169 - RNA, 22 nt, Human
uaaguuguagaacguuuucuua

SEQ ID NO: 199170 - RNA, 22 nt, Human
aaggggaauaguaggaccuggg

SEQ ID NO: 199171 - RNA, 22 nt, Human
cuucuuuucuacuggccuagaa

SEQ ID NO: 199172 - RNA, 22 nt, Human
aggggaggcugcgggcugccgu

SEQ ID NO: 199173 - RNA, 22 nt, Human
ucuccuuuacuggcuccuuuug

SEQ ID NO: 199174 - RNA, 22 nt, Human
uucuucgacuguauaaaaguau

SEQ ID NO: 199175 - RNA, 22 nt, Human
ucucaaagguuuuccucuuuuu

SEQ ID NO: 199176 - RNA, 22 nt, Human
aaaauaauauuauaccacugcu

SEQ ID NO: 199177 - RNA, 22 nt, Human
guaauucugugugaaucuauua

SEQ ID NO: 199178 - RNA, 22 nt, Human
uucuuuucuucccuguuuauua

SEQ ID NO: 199179 - RNA, 22 nt, Human
gugaaauuguacacucaguacc

SEQ ID NO: 199180 - RNA, 22 nt, Human
ucaucuuucuuuauggaaauac

SEQ ID NO: 199181 - RNA, 22 nt, Human
agugccuggcugauggguccug

SEQ ID NO: 199182 - RNA, 22 nt, Human
uccucaaauccuagccucaucg

SEQ ID NO: 199183 - RNA, 22 nt, Human
cugucucugauaagcucgaggg

SEQ ID NO: 199184 - RNA, 22 nt, Human
ucagcucucucuuggugaucuc

SEQ ID NO: 199185 - RNA, 22 nt, Human
aucucacuucugucauguggca

SEQ ID NO: 199186 - RNA, 22 nt, Human
agcugugaccuucaagagcuac

SEQ ID NO: 199187 - RNA, 22 nt, Human
uggggcuggccaggaggagucu

SEQ ID NO: 199188 - RNA, 22 nt, Human
aaacucaucaguuuagaaaccu

SEQ ID NO: 199189 - RNA, 22 nt, Human
agcaaggguugguuuucugaca

SEQ ID NO: 199190 - RNA, 22 nt, Human
gcucagccuuuuguucuauuca

SEQ ID NO: 199191 - RNA, 22 nt, Human
ccuccuuuccuguuuuccugag

SEQ ID NO: 199192 - RNA, 22 nt, Human
uugccaggggacaucuggagcc

SEQ ID NO: 199193 - RNA, 22 nt, Human
uauuuaaagucagcaacuuuuc

SEQ ID NO: 199194 - RNA, 22 nt, Human
guggggguaggggguuuucugg

SEQ ID NO: 199195 - RNA, 22 nt, Human
auaaaaauguuuuuguguggua

SEQ ID NO: 199196 - RNA, 22 nt, Human
gcuguguaugaugcaggcaccu

SEQ ID NO: 199197 - RNA, 20 nt, Human
uccaguuuuggagacauucu

SEQ ID NO: 199198 - RNA, 22 nt, Human
augcggcugugggggaauggga

SEQ ID NO: 199199 - RNA, 22 nt, Human
agggcugggcuuggcaggcugg

SEQ ID NO: 199200 - RNA, 22 nt, Human
uagcugucauuggaucagaagg

SEQ ID NO: 199201 - RNA, 22 nt, Human
cuagcacagugcuuggcacaca

SEQ ID NO: 199202 - RNA, 22 nt, Human
uuuuagaagcauuuaugagauu

SEQ ID NO: 199203 - RNA, 22 nt, Human
gggcugcuccgcccgcugcgcc

SEQ ID NO: 199204 - RNA, 22 nt, Human
uucccugugcaguauguuccaa

SEQ ID NO: 199205 - RNA, 20 nt, Human
ucacuguaauugccuacauu

SEQ ID NO: 199206 - RNA, 22 nt, Human
augaggaacagcaagaauauuu

SEQ ID NO: 199207 - RNA, 22 nt, Human
ugccagcuccgaggagcugcag

SEQ ID NO: 199208 - RNA, 22 nt, Human
agauuuucuuuuccaucuuugu

SEQ ID NO: 199209 - RNA, 22 nt, Human
ugcuuucagauaucuguuucaa

SEQ ID NO: 199210 - RNA, 22 nt, Human
cuguuaauugugaauuuuacau

SEQ ID NO: 199211 - RNA, 22 nt, Human
aggccagggacaaugaggcaga

SEQ ID NO: 199212 - RNA, 22 nt, Human
uucacugugauguuuaagagaa

SEQ ID NO: 199213 - RNA, 22 nt, Human
guacauauccuuuacguuuugu

SEQ ID NO: 199214 - RNA, 22 nt, Human
cucucugcugucuuucgggaaa

SEQ ID NO: 199215 - RNA, 22 nt, Human
auuuucauauggguuauuugua

SEQ ID NO: 199216 - RNA, 22 nt, Human
ugucuuuuaaaaauguguaaaa

SEQ ID NO: 199217 - RNA, 22 nt, Human
auguuuucuugucuggagaagu

SEQ ID NO: 199218 - RNA, 22 nt, Human
augaaaacggaccagagcuauu

SEQ ID NO: 199219 - RNA, 22 nt, Human
caucucagguuuguucugagac

SEQ ID NO: 199220 - RNA, 22 nt, Human
agaucugucaccauccuggagc

SEQ ID NO: 199221 - RNA, 22 nt, Human
ucaccaugcccuucucugcucu

SEQ ID NO: 199222 - RNA, 22 nt, Human
uggaugccuugggggaggagga

SEQ ID NO: 199223 - RNA, 22 nt, Human
uuauuucaggcauuuguaaaug

SEQ ID NO: 199224 - RNA, 22 nt, Human
auguguguaugacugaaucuau

SEQ ID NO: 199225 - RNA, 22 nt, Human
guucuucagcccucagguccua

SEQ ID NO: 199226 - RNA, 22 nt, Human
ugugccuguugguguagacaua

SEQ ID NO: 199227 - RNA, 22 nt, Human
cagggcagaguuaagaugcugg

SEQ ID NO: 199228 - RNA, 22 nt, Human
aaaucauagccaugaacauuug

SEQ ID NO: 199229 - RNA, 22 nt, Human
cagaccuggaaaacaggcuugc

SEQ ID NO: 199230 - RNA, 22 nt, Human
gaaggagaggauugugaggcug

SEQ ID NO: 199231 - RNA, 22 nt, Human
cacacacacacacacucucaca

SEQ ID NO: 199232 - RNA, 19 nt, Human
gauauugagcugagaauuc

SEQ ID NO: 199233 - RNA, 22 nt, Human
ugguggcuuuucguagguucac

SEQ ID NO: 199234 - RNA, 22 nt, Human
cauuucaaacaguuacagcugc

SEQ ID NO: 199235 - RNA, 22 nt, Human
uggggagacauggaguaaaaga

SEQ ID NO: 199236 - RNA, 22 nt, Human
cuccuuccuccgcccuuccucg

SEQ ID NO: 199237 - RNA, 22 nt, Human
guuuauucuuuuauuugugaga

SEQ ID NO: 199238 - RNA, 22 nt, Human
uaauuccacacucccgcaagcg

SEQ ID NO: 199239 - RNA, 22 nt, Human
cccuguccugcuaggcccuggu

SEQ ID NO: 199240 - RNA, 22 nt, Human
uucacuuuuucucugcuugaga

SEQ ID NO: 199241 - RNA, 22 nt, Human
auuuaaaaacugguacaacagg

SEQ ID NO: 199242 - RNA, 22 nt, Human
gucugcagcacugugcacgguc

SEQ ID NO: 199243 - RNA, 19 nt, Human
ggaggguguccucaguguc

SEQ ID NO: 199244 - RNA, 22 nt, Human
uauuuuauuuagguuuaguugu

SEQ ID NO: 199245 - RNA, 22 nt, Human
agggaugugcagggcuugccau

SEQ ID NO: 199246 - RNA, 22 nt, Human
auauguuaugccauuuucaagg

SEQ ID NO: 199247 - RNA, 22 nt, Human
guuauuguuauugcguugucga

SEQ ID NO: 199248 - RNA, 22 nt, Human
auuguuuugugaaacauaguga

SEQ ID NO: 199249 - RNA, 22 nt, Human
uuuaaaauguuuuauuuauuua

SEQ ID NO: 199250 - RNA, 22 nt, Human
aaauauuugaaugguguaagau

SEQ ID NO: 199251 - RNA, 19 nt, Human
uggugcgcuguuccugagc

SEQ ID NO: 199252 - RNA, 22 nt, Human
cuguggcuaggaagcuguggga

SEQ ID NO: 199253 - RNA, 22 nt, Human
ucacaucugugugauugucauu

SEQ ID NO: 199254 - RNA, 22 nt, Human
ccucuagaauuaucacuuuuaa

SEQ ID NO: 199255 - RNA, 22 nt, Human
ucagaaggagagacagcgugga

SEQ ID NO: 199256 - RNA, 19 nt, Human
ccaguuuuuuaauauucaa

SEQ ID NO: 199257 - RNA, 22 nt, Human
acugcagauccucugagaaacc

SEQ ID NO: 199258 - RNA, 20 nt, Human
aauaaauauaacccauaauu

SEQ ID NO: 199259 - RNA, 22 nt, Human
acuuccuuuuuuggggauagca

SEQ ID NO: 199260 - RNA, 22 nt, Human
uuccccaccagagacagagcug

SEQ ID NO: 199261 - RNA, 19 nt, Human
agcaucuccacagaaaaag

SEQ ID NO: 199262 - RNA, 22 nt, Human
agggaguuccgaucugugcacc

SEQ ID NO: 199263 - RNA, 22 nt, Human
gacuggggcauuagaguagcuu

SEQ ID NO: 199264 - RNA, 22 nt, Human
uguguuguuuggggauguccau

SEQ ID NO: 199265 - RNA, 22 nt, Human
ucuuuuucccugguuccuuuuu

SEQ ID NO: 199266 - RNA, 22 nt, Human
cagaccagaaggaagccgacaa

SEQ ID NO: 199267 - RNA, 22 nt, Human
uuuauuugggauuucucaucug

SEQ ID NO: 199268 - RNA, 22 nt, Human
uuuguuuccagccuuuugucuu

SEQ ID NO: 199269 - RNA, 22 nt, Human
acagagcucccagccaucuccu

SEQ ID NO: 199270 - RNA, 22 nt, Human
uucuugucuuuguuauguagga

SEQ ID NO: 199271 - RNA, 21 nt, Human
uaaaagaugacaagacagcuc

SEQ ID NO: 199272 - RNA, 22 nt, Human
cacugcaaccuccaccucccgg

SEQ ID NO: 199273 - RNA, 22 nt, Human
uucuuuuaauagagauccugug

SEQ ID NO: 199274 - RNA, 22 nt, Human
aggcuccucugggggccccgga

SEQ ID NO: 199275 - RNA, 22 nt, Human
acucacuguuuugaaauugaac

SEQ ID NO: 199276 - RNA, 22 nt, Human
ucuugcuguggcagaucuggag

SEQ ID NO: 199277 - RNA, 22 nt, Human
acauaaaccccccuuccccagg

SEQ ID NO: 199278 - RNA, 18 nt, Human
aguaaauguuaaauauug

SEQ ID NO: 199279 - RNA, 22 nt, Human
aaugaaaaucugucaguucaag

SEQ ID NO: 199280 - RNA, 22 nt, Human
uuuucauagccagaaacugaaa

SEQ ID NO: 199281 - RNA, 20 nt, Human
gggcucugcauccaucagcc

SEQ ID NO: 199282 - RNA, 22 nt, Human
guuuauuucuuaucaucacuau

SEQ ID NO: 199283 - RNA, 22 nt, Human
augggagggugaggaggcagcu

SEQ ID NO: 199284 - RNA, 22 nt, Human
cuuuuuuucuccauauuucugg

SEQ ID NO: 199285 - RNA, 22 nt, Human
uucucaauggcaacuuguugcu

SEQ ID NO: 199286 - RNA, 22 nt, Human
cugcaucacagcaggaggcaca

SEQ ID NO: 199287 - RNA, 22 nt, Human
ggaggaugaggguggugguguu

SEQ ID NO: 199288 - RNA, 22 nt, Human
uguuuagcucugacuaugugau

SEQ ID NO: 199289 - RNA, 22 nt, Human
uuggggagaagagcuggucagg

SEQ ID NO: 199290 - RNA, 22 nt, Human
gcccagccucagggcaucagcu

SEQ ID NO: 199291 - RNA, 22 nt, Human
ggaaguggauucagggcugcua

SEQ ID NO: 199292 - RNA, 22 nt, Human
cuagcagaagcuccuugagggu

SEQ ID NO: 199293 - RNA, 22 nt, Human
uguggacaccuauuaccaguga

SEQ ID NO: 199294 - RNA, 22 nt, Human
ucuccucucugaucuugcuccg

SEQ ID NO: 199295 - RNA, 22 nt, Human
agauaaaucauuuauuaagcgg

SEQ ID NO: 199296 - RNA, 22 nt, Human
uucaaacaguguagaauauaug

SEQ ID NO: 199297 - RNA, 22 nt, Human
uuuauuuagguaaacaugaguu

SEQ ID NO: 199298 - RNA, 22 nt, Human
guuuucuuguuaauuuugaacg

SEQ ID NO: 199299 - RNA, 22 nt, Human
aauaucuugaguuauaaauuca

SEQ ID NO: 199300 - RNA, 22 nt, Human
uuugauuuuguuuauagugccg

SEQ ID NO: 199301 - RNA, 22 nt, Human
cacacgagcccuggagccagca

SEQ ID NO: 199302 - RNA, 20 nt, Human
cuggaguguagcaguggcug

SEQ ID NO: 199303 - RNA, 22 nt, Human
accuggcccugggucuccugac

SEQ ID NO: 199304 - RNA, 22 nt, Human
cuucuucaucuuuuggaggaac

SEQ ID NO: 199305 - RNA, 22 nt, Human
gggcaugcagcaauucuguggu

SEQ ID NO: 199306 - RNA, 22 nt, Human
uuuacaaggcaguuauuuuccu

SEQ ID NO: 199307 - RNA, 22 nt, Human
gggacugguuguguguggugug

SEQ ID NO: 199308 - RNA, 22 nt, Human
uguuuccuaagugucucugaag

SEQ ID NO: 199309 - RNA, 22 nt, Human
aacauuuccggccuuuuguucu

SEQ ID NO: 199310 - RNA, 22 nt, Human
uucagaauuaucauaauuuuga

SEQ ID NO: 199311 - RNA, 22 nt, Human
agcaggagagacuggcccaaaa

SEQ ID NO: 199312 - RNA, 22 nt, Human
aggcaggggagcuggaagggua

SEQ ID NO: 199313 - RNA, 22 nt, Human
ucauuguuucugcuuuucauga

SEQ ID NO: 199314 - RNA, 22 nt, Human
auuuuucuuucacauuuucuua

SEQ ID NO: 199315 - RNA, 22 nt, Human
augcuuucucuucuauuucuca

SEQ ID NO: 199316 - RNA, 22 nt, Human
ucucugaggaagcgaucuuuag

SEQ ID NO: 199317 - RNA, 22 nt, Human
uauuuccugcguuucugugagc

SEQ ID NO: 199318 - RNA, 22 nt, Human
ggcugugguggacgcgggaaac
